United States Patent 12,031,154 (UNIVERSAL DONOR STEM CELLS AND RELATED METHODS) - sequence listing, part 4

SEQ ID NO: 61918 - DNA, 20 bp, synthetic construct
  misc_feature 1..20: note = CRISPR gRNA sequence
  source 1..20: mol_type = other DNA
ctgagcagcgggagctccat

SEQ ID NO: 61919 - DNA, 20 bp, synthetic construct
  misc_feature 1..20: note = CRISPR gRNA sequence
  source 1..20: mol_type = other DNA
ctactctggtagctgaggca

SEQ ID NO: 61920 - DNA, 20 bp, synthetic construct
  misc_feature 1..20: note = CRISPR gRNA sequence
  source 1..20: mol_type = other DNA
attgtacttcttttgcatgt

SEQ ID NO: 61921 - DNA, 20 bp, synthetic construct
  misc_feature 1..20: note = CRISPR gRNA sequence
  source 1..20: mol_type = other DNA
acacctacccagacaatgag

SEQ ID NO: 61922 - DNA, 20 bp, synthetic construct
  misc_feature 1..20: note = CRISPR gRNA sequence
  source 1..20: mol_type = other DNA
ggttgtggctcaagcttggg

SEQ ID NO: 61923 - DNA, 20 bp, synthetic construct
  misc_feature 1..20: note = CRISPR gRNA sequence
  source 1..20: mol_type = other DNA
atcttgtccacaccccactc

SEQ ID NO: 61924 - DNA, 20 bp, synthetic construct
  misc_feature 1..20: note = CRISPR gRNA sequence
  source 1..20: mol_type = other DNA
aaattgtcctgggtctgggg

SEQ ID NO: 61925 - DNA, 20 bp, synthetic construct
  misc_feature 1..20: note = CRISPR gRNA sequence
  source 1..20: mol_type = other DNA
tggtggcagccctgagagcc

SEQ ID NO: 61926 - DNA, 20 bp, synthetic construct
  misc_feature 1..20: note = CRISPR gRNA sequence
  source 1..20: mol_type = other DNA
tattgtccccagtgtccagg

SEQ ID NO: 61927 - DNA, 20 bp, synthetic construct
  misc_feature 1..20: note = CRISPR gRNA sequence
  source 1..20: mol_type = other DNA
ctacttgggcggctgaggca

SEQ ID NO: 61928 - DNA, 20 bp, synthetic construct
  misc_feature 1..20: note = CRISPR gRNA sequence
  source 1..20: mol_type = other DNA
tctcaaaaaataaaaataaa

SEQ ID NO: 61929 - DNA, 20 bp, synthetic construct
  misc_feature 1..20: note = CRISPR gRNA sequence
  source 1..20: mol_type = other DNA
caaagtgctgaccgtggccc

SEQ ID NO: 61930 - DNA, 20 bp, synthetic construct
  misc_feature 1..20: note = CRISPR gRNA sequence
  source 1..20: mol_type = other DNA
tgataccacccggaagcttg

SEQ ID NO: 61931 - DNA, 20 bp, synthetic construct
  misc_feature 1..20: note = CRISPR gRNA sequence
  source 1..20: mol_type = other DNA
aagaccagcctgaccaacat

SEQ ID NO: 61932 - DNA, 20 bp, synthetic construct
  misc_feature 1..20: note = CRISPR gRNA sequence
  source 1..20: mol_type = other DNA
ctactcgggaggctgaggca

SEQ ID NO: 61933 - DNA, 20 bp, synthetic construct
  misc_feature 1..20: note = CRISPR gRNA sequence
  source 1..20: mol_type = other DNA
tcaaaaacaaacaaacaaaa

SEQ ID NO: 61934 - DNA, 20 bp, synthetic construct
  misc_feature 1..20: note = CRISPR gRNA sequence
  source 1..20: mol_type = other DNA
aaaaaaaaagcacagtctag

SEQ ID NO: 61935 - DNA, 20 bp, synthetic construct
  misc_feature 1..20: note = CRISPR gRNA sequence
  source 1..20: mol_type = other DNA
agaattccagacctggggaa

SEQ ID NO: 61936 - DNA, 20 bp, synthetic construct
  misc_feature 1..20: note = CRISPR gRNA sequence
  source 1..20: mol_type = other DNA
cccccagcctaggcaggaga

SEQ ID NO: 61937 - DNA, 20 bp, synthetic construct
  misc_feature 1..20: note = CRISPR gRNA sequence
  source 1..20: mol_type = other DNA
actggcacgagttcacacat

SEQ ID NO: 61938 - DNA, 20 bp, synthetic construct
  misc_feature 1..20: note = CRISPR gRNA sequence
  source 1..20: mol_type = other DNA
aaaccccatctccactaaaa

SEQ ID NO: 61939 - DNA, 20 bp, synthetic construct
  misc_feature 1..20: note = CRISPR gRNA sequence
  source 1..20: mol_type = other DNA
ggtgcctgggaaatcaggag

SEQ ID NO: 61940 - DNA, 20 bp, synthetic construct
  misc_feature 1..20: note = CRISPR gRNA sequence
  source 1..20: mol_type = other DNA
caggtacatggacagtgggc

SEQ ID NO: 61941 - DNA, 20 bp, synthetic construct
  misc_feature 1..20: note = CRISPR gRNA sequence
  source 1..20: mol_type = other DNA
caagcaaagagggacaagcg

SEQ ID NO: 61942 - DNA, 20 bp, synthetic construct
  misc_feature 1..20: note = CRISPR gRNA sequence
  source 1..20: mol_type = other DNA
aagctgaattcaaaacatat

SEQ ID NO: 61943 - DNA, 20 bp, synthetic construct
  misc_feature 1..20: note = CRISPR gRNA sequence
  source 1..20: mol_type = other DNA
atatgtagaaaaaaaaatct

SEQ ID NO: 61944 - DNA, 20 bp, synthetic construct
  misc_feature 1..20: note = CRISPR gRNA sequence
  source 1..20: mol_type = other DNA
atgttatttgttacatattt

SEQ ID NO: 61945 - DNA, 20 bp, synthetic construct
  misc_feature 1..20: note = CRISPR gRNA sequence
  source 1..20: mol_type = other DNA
agatggaacttttttggtca

SEQ ID NO: 61946 - DNA, 20 bp, synthetic construct
  misc_feature 1..20: note = CRISPR gRNA sequence
  source 1..20: mol_type = other DNA
gaggctgtttctggcatttc

SEQ ID NO: 61947 - DNA, 20 bp, synthetic construct
  misc_feature 1..20: note = CRISPR gRNA sequence
  source 1..20: mol_type = other DNA
cgcccaggtctggccagtga

SEQ ID NO: 61948 - DNA, 20 bp, synthetic construct
  misc_feature 1..20: note = CRISPR gRNA sequence
  source 1..20: mol_type = other DNA
accttttgttgtaaccacag

SEQ ID NO: 61949 - DNA, 20 bp, synthetic construct
  misc_feature 1..20: note = CRISPR gRNA sequence
  source 1..20: mol_type = other DNA
actccctttccactaagctg

SEQ ID NO: 61950 - DNA, 20 bp, synthetic construct
  misc_feature 1..20: note = CRISPR gRNA sequence
  source 1..20: mol_type = other DNA
agaaggaagccaaggtggac

SEQ ID NO: 61951 - DNA, 20 bp, synthetic construct
  misc_feature 1..20: note = CRISPR gRNA sequence
  source 1..20: mol_type = other DNA
gttcttgctggcactgagat

SEQ ID NO: 61952 - DNA, 20 bp, synthetic construct
  misc_feature 1..20: note = CRISPR gRNA sequence
  source 1..20: mol_type = other DNA
tgctggcactgagatccaga

SEQ ID NO: 61953 - DNA, 20 bp, synthetic construct
  misc_feature 1..20: note = CRISPR gRNA sequence
  source 1..20: mol_type = other DNA
ttcagctcacctgggtccat

SEQ ID NO: 61954 - DNA, 20 bp, synthetic construct
  misc_feature 1..20: note = CRISPR gRNA sequence
  source 1..20: mol_type = other DNA
atagtcacagctggcccagc

SEQ ID NO: 61955 - DNA, 20 bp, synthetic construct
  misc_feature 1..20: note = CRISPR gRNA sequence
  source 1..20: mol_type = other DNA
taattttactggattatgga

SEQ ID NO: 61956 - DNA, 20 bp, synthetic construct
  misc_feature 1..20: note = CRISPR gRNA sequence
  source 1..20: mol_type = other DNA
acaacttacttctaaatggt

SEQ ID NO: 61957 - DNA, 20 bp, synthetic construct
  misc_feature 1..20: note = CRISPR gRNA sequence
  source 1..20: mol_type = other DNA
aaggagagagggagagagtg

SEQ ID NO: 61958 - DNA, 20 bp, synthetic construct
  misc_feature 1..20: note = CRISPR gRNA sequence
  source 1..20: mol_type = other DNA
gtgggaaagaaggagggagg

SEQ ID NO: 61959 - DNA, 20 bp, synthetic construct
  misc_feature 1..20: note = CRISPR gRNA sequence
  source 1..20: mol_type = other DNA
gttagttcgcagttatttta

SEQ ID NO: 61960 - DNA, 20 bp, synthetic construct
  misc_feature 1..20: note = CRISPR gRNA sequence
  source 1..20: mol_type = other DNA
ttttctcctgcacaaggaag

SEQ ID NO: 61961 - DNA, 20 bp, synthetic construct
  misc_feature 1..20: note = CRISPR gRNA sequence
  source 1..20: mol_type = other DNA
atcctaccatgctctatttc

SEQ ID NO: 61962 - DNA, 20 bp, synthetic construct
  misc_feature 1..20: note = CRISPR gRNA sequence
  source 1..20: mol_type = other DNA
ataagccttttcagaccatg

SEQ ID NO: 61963 - DNA, 20 bp, synthetic construct
  misc_feature 1..20: note = CRISPR gRNA sequence
  source 1..20: mol_type = other DNA
agagggatccaagggcagtt

SEQ ID NO: 61964 - DNA, 20 bp, synthetic construct
  misc_feature 1..20: note = CRISPR gRNA sequence
  source 1..20: mol_type = other DNA
tcccaatgcttatgaaagat

SEQ ID NO: 61965 - DNA, 20 bp, synthetic construct
  misc_feature 1..20: note = CRISPR gRNA sequence
  source 1..20: mol_type = other DNA
ctattgttgtgacaatccaa

SEQ ID NO: 61966 - DNA, 20 bp, synthetic construct
  misc_feature 1..20: note = CRISPR gRNA sequence
  source 1..20: mol_type = other DNA
gccactgatatttttagatt

SEQ ID NO: 61967 - DNA, 20 bp, synthetic construct
  misc_feature 1..20: note = CRISPR gRNA sequence
  source 1..20: mol_type = other DNA
tcaaaaaaaggaaagtattt

SEQ ID NO: 61968 - DNA, 20 bp, synthetic construct
  misc_feature 1..20: note = CRISPR gRNA sequence
  source 1..20: mol_type = other DNA
tttggagaaaaaaagtgtgg

SEQ ID NO: 61969 - DNA, 20 bp, synthetic construct
  misc_feature 1..20: note = CRISPR gRNA sequence
  source 1..20: mol_type = other DNA
catggtggttgtttaagatg

SEQ ID NO: 61970 - DNA, 20 bp, synthetic construct
  misc_feature 1..20: note = CRISPR gRNA sequence
  source 1..20: mol_type = other DNA
taatttgaaagtaggaaaaa

SEQ ID NO: 61971 - DNA, 20 bp, synthetic construct
  misc_feature 1..20: note = CRISPR gRNA sequence
  source 1..20: mol_type = other DNA
aaccaatattatttttagac

SEQ ID NO: 61972 - DNA, 20 bp, synthetic construct
  misc_feature 1..20: note = CRISPR gRNA sequence
  source 1..20: mol_type = other DNA
ctactctggaggctgaggca

SEQ ID NO: 61973 - DNA, 20 bp, synthetic construct
  misc_feature 1..20: note = CRISPR gRNA sequence
  source 1..20: mol_type = other DNA
aaataaaataatatttaaaa

SEQ ID NO: 61974 - DNA, 20 bp, synthetic construct
  misc_feature 1..20: note = CRISPR gRNA sequence
  source 1..20: mol_type = other DNA
ctactccggaggctgaggca

SEQ ID NO: 61975 - DNA, 20 bp, synthetic construct
  misc_feature 1..20: note = CRISPR gRNA sequence
  source 1..20: mol_type = other DNA
gagcagtccaattcatagag

SEQ ID NO: 61976 - DNA, 20 bp, synthetic construct
  misc_feature 1..20: note = CRISPR gRNA sequence
  source 1..20: mol_type = other DNA
ccaattcatagagacagaaa

SEQ ID NO: 61977 - DNA, 20 bp, synthetic construct
  misc_feature 1..20: note = CRISPR gRNA sequence
  source 1..20: mol_type = other DNA
aacactcctgaatggtacac

SEQ ID NO: 61978 - DNA, 20 bp, synthetic construct
  misc_feature 1..20: note = CRISPR gRNA sequence
  source 1..20: mol_type = other DNA
gaacacgtgccatgacatca

SEQ ID NO: 61979 - DNA, 20 bp, synthetic construct
  misc_feature 1..20: note = CRISPR gRNA sequence
  source 1..20: mol_type = other DNA
tcaacagacactgacatgaa

SEQ ID NO: 61980 - DNA, 20 bp, synthetic construct
  misc_feature 1..20: note = CRISPR gRNA sequence
  source 1..20: mol_type = other DNA
tgcactcacttagcctgagg

SEQ ID NO: 61981 - DNA, 20 bp, synthetic construct
  misc_feature 1..20: note = CRISPR gRNA sequence
  source 1..20: mol_type = other DNA
ggaacctcccacaccccctg

SEQ ID NO: 61982 - DNA, 20 bp, synthetic construct
  misc_feature 1..20: note = CRISPR gRNA sequence
  source 1..20: mol_type = other DNA
acccaaggacacacagcaga

SEQ ID NO: 61983 - DNA, 20 bp, synthetic construct
  misc_feature 1..20: note = CRISPR gRNA sequence
  source 1..20: mol_type = other DNA
acagcagataagaaagaagg

SEQ ID NO: 61984 - DNA, 20 bp, synthetic construct
  misc_feature 1..20: note = CRISPR gRNA sequence
  source 1..20: mol_type = other DNA
agctgggtgttaaaggattg

SEQ ID NO: 61985 - DNA, 20 bp, synthetic construct
  misc_feature 1..20: note = CRISPR gRNA sequence
  source 1..20: mol_type = other DNA
aggattgggagaattttatc

SEQ ID NO: 61986 - DNA, 20 bp, synthetic construct
  misc_feature 1..20: note = CRISPR gRNA sequence
  source 1..20: mol_type = other DNA
tatctcagaaaaggcaagga

SEQ ID NO: 61987 - DNA, 20 bp, synthetic construct
  misc_feature 1..20: note = CRISPR gRNA sequence
  source 1..20: mol_type = other DNA
agtgcggtgtgagcagaggc

SEQ ID NO: 61988 - DNA, 20 bp, synthetic construct
  misc_feature 1..20: note = CRISPR gRNA sequence
  source 1..20: mol_type = other DNA
tagtcaggacatggcaagga

SEQ ID NO: 61989 - DNA, 20 bp, synthetic construct
  misc_feature 1..20: note = CRISPR gRNA sequence
  source 1..20: mol_type = other DNA
tggcacccgggcatcagggg

SEQ ID NO: 61990 - DNA, 20 bp, synthetic construct
  misc_feature 1..20: note = CRISPR gRNA sequence
  source 1..20: mol_type = other DNA
cccaggaaaccctgagattc

SEQ ID NO: 61991 - DNA, 20 bp, synthetic construct
  misc_feature 1..20: note = CRISPR gRNA sequence
  source 1..20: mol_type = other DNA
ccaggggcacctgttggcca

SEQ ID NO: 61992 - DNA, 20 bp, synthetic construct
  misc_feature 1..20: note = CRISPR gRNA sequence
  source 1..20: mol_type = other DNA
gcaggtacagggcactttcc

SEQ ID NO: 61993 - DNA, 20 bp, synthetic construct
  misc_feature 1..20: note = CRISPR gRNA sequence
  source 1..20: mol_type = other DNA
gactagaagggaaatggaga

SEQ ID NO: 61994 - DNA, 20 bp, synthetic construct
  misc_feature 1..20: note = CRISPR gRNA sequence
  source 1..20: mol_type = other DNA
atgttccacagattgggtca

SEQ ID NO: 61995 - DNA, 20 bp, synthetic construct
  misc_feature 1..20: note = CRISPR gRNA sequence
  source 1..20: mol_type = other DNA
ccaggggagtgaaggcaagg

SEQ ID NO: 61996 - DNA, 20 bp, synthetic construct
  misc_feature 1..20: note = CRISPR gRNA sequence
  source 1..20: mol_type = other DNA
caccatcccttccatcacca

SEQ ID NO: 61997 - DNA, 20 bp, synthetic construct
  misc_feature 1..20: note = CRISPR gRNA sequence
  source 1..20: mol_type = other DNA
ccagcaggctttcaagggtt

SEQ ID NO: 61998 - DNA, 20 bp, synthetic construct
  misc_feature 1..20: note = CRISPR gRNA sequence
  source 1..20: mol_type = other DNA
agctagttttaactacagtt

SEQ ID NO: 61999 - DNA, 20 bp, synthetic construct
  misc_feature 1..20: note = CRISPR gRNA sequence
  source 1..20: mol_type = other DNA
ttgttaatttcatcttttcc

SEQ ID NO: 62000 - DNA, 20 bp, synthetic construct
  misc_feature 1..20: note = CRISPR gRNA sequence
  source 1..20: mol_type = other DNA
taataaaatagtctttaaaa

SEQ ID NO: 62001 - DNA, 20 bp, synthetic construct
  misc_feature 1..20: note = CRISPR gRNA sequence
  source 1..20: mol_type = other DNA
ctccttgggaggctgaggca

SEQ ID NO: 62002 - DNA, 20 bp, synthetic construct
  misc_feature 1..20: note = CRISPR gRNA sequence
  source 1..20: mol_type = other DNA
tgcattccagcctgggcagc

SEQ ID NO: 62003 - DNA, 20 bp, synthetic construct
  misc_feature 1..20: note = CRISPR gRNA sequence
  source 1..20: mol_type = other DNA
gaaagactccatctaaaaaa

SEQ ID NO: 62004 - DNA, 20 bp, synthetic construct
  misc_feature 1..20: note = CRISPR gRNA sequence
  source 1..20: mol_type = other DNA
gactccatctaaaaaaaaag

SEQ ID NO: 62005 - DNA, 20 bp, synthetic construct
  misc_feature 1..20: note = CRISPR gRNA sequence
  source 1..20: mol_type = other DNA
ccatctaaaaaaaaagaaag

SEQ ID NO: 62006 - DNA, 20 bp, synthetic construct
  misc_feature 1..20: note = CRISPR gRNA sequence
  source 1..20: mol_type = other DNA
taaaaaaaaagaaagaaaga

SEQ ID NO: 62007 - DNA, 20 bp, synthetic construct
  misc_feature 1..20: note = CRISPR gRNA sequence
  source 1..20: mol_type = other DNA
gaccccaggtcttaaaaaaa

SEQ ID NO: 62008 - DNA, 20 bp, synthetic construct
  misc_feature 1..20: note = CRISPR gRNA sequence
  source 1..20: mol_type = other DNA
ttcttctctgccacatcaca

SEQ ID NO: 62009 - DNA, 20 bp, synthetic construct
  misc_feature 1..20: note = CRISPR gRNA sequence
  source 1..20: mol_type = other DNA
tgtcaagcacttagaacagt

SEQ ID NO: 62010 - DNA, 20 bp, synthetic construct
  misc_feature 1..20: note = CRISPR gRNA sequence
  source 1..20: mol_type = other DNA
ggcgagagtgggggcgggag

SEQ ID NO: 62011 - DNA, 20 bp, synthetic construct
  misc_feature 1..20: note = CRISPR gRNA sequence
  source 1..20: mol_type = other DNA
cttggaccctctggaagtgt

SEQ ID NO: 62012 - DNA, 20 bp, synthetic construct
  misc_feature 1..20: note = CRISPR gRNA sequence
  source 1..20: mol_type = other DNA
cagttggaaaccactgcctt

SEQ ID NO: 62013 - DNA, 20 bp, synthetic construct
  misc_feature 1..20: note = CRISPR gRNA sequence
  source 1..20: mol_type = other DNA
ctacttgggaggctgaggca

SEQ ID NO: 62014 - DNA, 20 bp, synthetic construct
  misc_feature 1..20: note = CRISPR gRNA sequence
  source 1..20: mol_type = other DNA
gcgagaccctcccccacaaa

SEQ ID NO: 62015 - DNA, 20 bp, synthetic construct
  misc_feature 1..20: note = CRISPR gRNA sequence
  source 1..20: mol_type = other DNA
gaccctcccccacaaaaaag

SEQ ID NO: 62016 - DNA, 20 bp, synthetic construct
  misc_feature 1..20: note = CRISPR gRNA sequence
  source 1..20: mol_type = other DNA
ctcccccacaaaaaagaaag

SEQ ID NO: 62017 - DNA, 20 bp, synthetic construct
  misc_feature 1..20: note = CRISPR gRNA sequence
  source 1..20: mol_type = other DNA
agccactcttcaccacatcc

SEQ ID NO: 62018 - DNA, 20 bp, synthetic construct
  misc_feature 1..20: note = CRISPR gRNA sequence
  source 1..20: mol_type = other DNA
ctaaccagtctgagctgaaa

SEQ ID NO: 62019 - DNA, 20 bp, synthetic construct
  misc_feature 1..20: note = CRISPR gRNA sequence
  source 1..20: mol_type = other DNA
ttccatttcttaaggtgatt

SEQ ID NO: 62020 - DNA, 20 bp, synthetic construct
  misc_feature 1..20: note = CRISPR gRNA sequence
  source 1..20: mol_type = other DNA
aatgataaaacaacctaagg

SEQ ID NO: 62021 - DNA, 20 bp, synthetic construct
  misc_feature 1..20: note = CRISPR gRNA sequence
  source 1..20: mol_type = other DNA
agctttgccatggaggagcc

SEQ ID NO: 62022 - DNA, 20 bp, synthetic construct
  misc_feature 1..20: note = CRISPR gRNA sequence
  source 1..20: mol_type = other DNA
tccccaaactaaatggacta

SEQ ID NO: 62023 - DNA, 20 bp, synthetic construct
  misc_feature 1..20: note = CRISPR gRNA sequence
  source 1..20: mol_type = other DNA
gttccgcaaaacatgtttgt

SEQ ID NO: 62024 - DNA, 20 bp, synthetic construct
  misc_feature 1..20: note = CRISPR gRNA sequence
  source 1..20: mol_type = other DNA
gcaaaacatgtttgttaaga

SEQ ID NO: 62025 - DNA, 20 bp, synthetic construct
  misc_feature 1..20: note = CRISPR gRNA sequence
  source 1..20: mol_type = other DNA
ctctatctcaaaaaaataaa

SEQ ID NO: 62026 - DNA, 20 bp, synthetic construct
  misc_feature 1..20: note = CRISPR gRNA sequence
  source 1..20: mol_type = other DNA
tctcaaaaaaataaaaaaga

SEQ ID NO: 62027 - DNA, 20 bp, synthetic construct
  misc_feature 1..20: note = CRISPR gRNA sequence
  source 1..20: mol_type = other DNA
gtcagaacccagtgcattta

SEQ ID NO: 62028 - DNA, 20 bp, synthetic construct
  misc_feature 1..20: note = CRISPR gRNA sequence
  source 1..20: mol_type = other DNA
ctttattgagggtggtcttt

SEQ ID NO: 62029 - DNA, 20 bp, synthetic construct
  misc_feature 1..20: note = CRISPR gRNA sequence
  source 1..20: mol_type = other DNA
ctactcaggaggctgaggca

SEQ ID NO: 62030 - DNA, 20 bp, synthetic construct
  misc_feature 1..20: note = CRISPR gRNA sequence
  source 1..20: mol_type = other DNA
aacaagagcaaaactctgtc

SEQ ID NO: 62031 - DNA, 20 bp, synthetic construct
  misc_feature 1..20: note = CRISPR gRNA sequence
  source 1..20: mol_type = other DNA
aagggcatttgagatggggg

SEQ ID NO: 62032 - DNA, 20 bp, synthetic construct
  misc_feature 1..20: note = CRISPR gRNA sequence
  source 1..20: mol_type = other DNA
ttgagatgggggctagaaag

SEQ ID NO: 62033 - DNA, 20 bp, synthetic construct
  misc_feature 1..20: note = CRISPR gRNA sequence
  source 1..20: mol_type = other DNA
tagtttatgactgcaaacag

SEQ ID NO: 62034 - DNA, 20 bp, synthetic construct
  misc_feature 1..20: note = CRISPR gRNA sequence
  source 1..20: mol_type = other DNA
attttaaggtaattactata

SEQ ID NO: 62035 - DNA, 20 bp, synthetic construct
  misc_feature 1..20: note = CRISPR gRNA sequence
  source 1..20: mol_type = other DNA
tcatggggcagggctggtgg

SEQ ID NO: 62036 - DNA, 20 bp, synthetic construct
  misc_feature 1..20: note = CRISPR gRNA sequence
  source 1..20: mol_type = other DNA
cagggctggtgggaagaaat

SEQ ID NO: 62037 - DNA, 20 bp, synthetic construct
  misc_feature 1..20: note = CRISPR gRNA sequence
  source 1..20: mol_type = other DNA
aatgggcagggcagggaatc

SEQ ID NO: 62038 - DNA, 20 bp, synthetic construct
  misc_feature 1..20: note = CRISPR gRNA sequence
  source 1..20: mol_type = other DNA
tgagctgctctgtttgcttc

SEQ ID NO: 62039 - DNA, 20 bp, synthetic construct
  misc_feature 1..20: note = CRISPR gRNA sequence
  source 1..20: mol_type = other DNA
atgtggaatcttctctccaa

SEQ ID NO: 62040 - DNA, 20 bp, synthetic construct
  misc_feature 1..20: note = CRISPR gRNA sequence
  source 1..20: mol_type = other DNA
atccctaggagggggatcat

SEQ ID NO: 62041 - DNA, 20 bp, synthetic construct
  misc_feature 1..20: note = CRISPR gRNA sequence
  source 1..20: mol_type = other DNA
acccctaggagggggatcgt

SEQ ID NO: 62042 - DNA, 20 bp, synthetic construct
  misc_feature 1..20: note = CRISPR gRNA sequence
  source 1..20: mol_type = other DNA
tcagggaagggaagcctgag

SEQ ID NO: 62043 - DNA, 20 bp, synthetic construct
  misc_feature 1..20: note = CRISPR gRNA sequence
  source 1..20: mol_type = other DNA
ctcaagaacccgggggttcc

SEQ ID NO: 62044 - DNA, 20 bp, synthetic construct
  misc_feature 1..20: note = CRISPR gRNA sequence
  source 1..20: mol_type = other DNA
tctcacaataaacaatgagg

SEQ ID NO: 62045 - DNA, 20 bp, synthetic construct
  misc_feature 1..20: note = CRISPR gRNA sequence
  source 1..20: mol_type = other DNA
ttcttctttgttgttgtttc

SEQ ID NO: 62046 - DNA, 20 bp, synthetic construct
  misc_feature 1..20: note = CRISPR gRNA sequence
  source 1..20: mol_type = other DNA
aactctctaatggtgaattt

SEQ ID NO: 62047 - DNA, 20 bp, synthetic construct
  misc_feature 1..20: note = CRISPR gRNA sequence
  source 1..20: mol_type = other DNA
atggggaaacagagtcctag

SEQ ID NO: 62048 - DNA, 20 bp, synthetic construct
  misc_feature 1..20: note = CRISPR gRNA sequence
  source 1..20: mol_type = other DNA
gaaaatgcagggtctcttgt

SEQ ID NO: 62049 - DNA, 20 bp, synthetic construct
  misc_feature 1..20: note = CRISPR gRNA sequence
  source 1..20: mol_type = other DNA
ggagaggggatgtaacttgc

SEQ ID NO: 62050 - DNA, 20 bp, synthetic construct
  misc_feature 1..20: note = CRISPR gRNA sequence
  source 1..20: mol_type = other DNA
cccctcccggcaccccaggg

SEQ ID NO: 62051 - DNA, 20 bp, synthetic construct
  misc_feature 1..20: note = CRISPR gRNA sequence
  source 1..20: mol_type = other DNA
tgagtcacagactctctgag

SEQ ID NO: 62052 - DNA, 20 bp, synthetic construct
  misc_feature 1..20: note = CRISPR gRNA sequence
  source 1..20: mol_type = other DNA
aggaaagagggggatgggac

SEQ ID NO: 62053 - DNA, 20 bp, synthetic construct
  misc_feature 1..20: note = CRISPR gRNA sequence
  source 1..20: mol_type = other DNA
caccccccagacacagaggc

SEQ ID NO: 62054 - DNA, 20 bp, synthetic construct
  misc_feature 1..20: note = CRISPR gRNA sequence
  source 1..20: mol_type = other DNA
cagttaaataaactgataaa

SEQ ID NO: 62055 - DNA, 20 bp, synthetic construct
  misc_feature 1..20: note = CRISPR gRNA sequence
  source 1..20: mol_type = other DNA
gaaatacacgatgagagagg

SEQ ID NO: 62056 - DNA, 20 bp, synthetic construct
  misc_feature 1..20: note = CRISPR gRNA sequence
  source 1..20: mol_type = other DNA
gatgagagagggaagaaatg

SEQ ID NO: 62057 - DNA, 20 bp, synthetic construct
  misc_feature 1..20: note = CRISPR gRNA sequence
  source 1..20: mol_type = other DNA
catctggagcatgaggctgt

SEQ ID NO: 62058 - DNA, 20 bp, synthetic construct
  misc_feature 1..20: note = CRISPR gRNA sequence
  source 1..20: mol_type = other DNA
aaaggccatgtccgccatct

SEQ ID NO: 62059 - DNA, 20 bp, synthetic construct
  misc_feature 1..20: note = CRISPR gRNA sequence
  source 1..20: mol_type = other DNA
ccatttcctggcaagtctta

SEQ ID NO: 62060 - DNA, 20 bp, synthetic construct
  misc_feature 1..20: note = CRISPR gRNA sequence
  source 1..20: mol_type = other DNA
cagagcaagatcctgtctct

SEQ ID NO: 62061 - DNA, 20 bp, synthetic construct
  misc_feature 1..20: note = CRISPR gRNA sequence
  source 1..20: mol_type = other DNA
cagggaccaccctactgggt

SEQ ID NO: 62062 - DNA, 20 bp, synthetic construct
  misc_feature 1..20: note = CRISPR gRNA sequence
  source 1..20: mol_type = other DNA
catactcaacggcgagactt

SEQ ID NO: 62063 - DNA, 20 bp, synthetic construct
  misc_feature 1..20: note = CRISPR gRNA sequence
  source 1..20: mol_type = other DNA
gaactgacggtctgctctca

SEQ ID NO: 62064 - DNA, 20 bp, synthetic construct
  misc_feature 1..20: note = CRISPR gRNA sequence
  source 1..20: mol_type = other DNA
gcacacaatgcaccccggcc

SEQ ID NO: 62065 - DNA, 20 bp, synthetic construct
  misc_feature 1..20: note = CRISPR gRNA sequence
  source 1..20: mol_type = other DNA
gttctggaccacctgggagt

SEQ ID NO: 62066 - DNA, 20 bp, synthetic construct
  misc_feature 1..20: note = CRISPR gRNA sequence
  source 1..20: mol_type = other DNA
agagatgagggtgggttgga

SEQ ID NO: 62067 - DNA, 20 bp, synthetic construct
  misc_feature 1..20: note = CRISPR gRNA sequence
  source 1..20: mol_type = other DNA
gctttaagcagttagaggga

SEQ ID NO: 62068 - DNA, 20 bp, synthetic construct
  misc_feature 1..20: note = CRISPR gRNA sequence
  source 1..20: mol_type = other DNA
cctcagtgcagcagtagcag

SEQ ID NO: 62069 - DNA, 20 bp, synthetic construct
  misc_feature 1..20: note = CRISPR gRNA sequence
  source 1..20: mol_type = other DNA
tgcaagagtgttttaaaaag

SEQ ID NO: 62070 - DNA, 20 bp, synthetic construct
  misc_feature 1..20: note = CRISPR gRNA sequence
  source 1..20: mol_type = other DNA
agtcagaaaaacaattttca

SEQ ID NO: 62071 - DNA, 20 bp, synthetic construct
  misc_feature 1..20: note = CRISPR gRNA sequence
  source 1..20: mol_type = other DNA
acaagaaatataataaaaat

SEQ ID NO: 62072 - DNA, 20 bp, synthetic construct
  misc_feature 1..20: note = CRISPR gRNA sequence
  source 1..20: mol_type = other DNA
gcccggctgaatttttttta

SEQ ID NO: 62073 - DNA, 20 bp, synthetic construct
  misc_feature 1..20: note = CRISPR gRNA sequence
  source 1..20: mol_type = other DNA
ttaatagaaatttttatgag

SEQ ID NO: 62074 - DNA, 20 bp, synthetic construct
  misc_feature 1..20: note = CRISPR gRNA sequence
  source 1..20: mol_type = other DNA
gggagacataagacaggggc

SEQ ID NO: 62075 - DNA, 20 bp, synthetic construct
  misc_feature 1..20: note = CRISPR gRNA sequence
  source 1..20: mol_type = other DNA
agtcactttcaatagccagg

SEQ ID NO: 62076 - DNA, 20 bp, synthetic construct
  misc_feature 1..20: note = CRISPR gRNA sequence
  source 1..20: mol_type = other DNA
ctatcccttctcctgggatt

SEQ ID NO: 62077 - DNA, 20 bp, synthetic construct
  misc_feature 1..20: note = CRISPR gRNA sequence
  source 1..20: mol_type = other DNA
acctctgactcttccatgag

SEQ ID NO: 62078 - DNA, 20 bp, synthetic construct
  misc_feature 1..20: note = CRISPR gRNA sequence
  source 1..20: mol_type = other DNA
tacagattcgttttaggaac

SEQ ID NO: 62079 - DNA, 20 bp, synthetic construct
  misc_feature 1..20: note = CRISPR gRNA sequence
  source 1..20: mol_type = other DNA
ttgacagagagactgagagt

SEQ ID NO: 62080 - DNA, 20 bp, synthetic construct
  misc_feature 1..20: note = CRISPR gRNA sequence
  source 1..20: mol_type = other DNA
ggccatcaggtgcagggcag

SEQ ID NO: 62081 - DNA, 20 bp, synthetic construct
  misc_feature 1..20: note = CRISPR gRNA sequence
  source 1..20: mol_type = other DNA
agggtcccattgcagagatg

SEQ ID NO: 62082 - DNA, 20 bp, synthetic construct
  misc_feature 1..20: note = CRISPR gRNA sequence
  source 1..20: mol_type = other DNA
ggaccattctgagaactggt

SEQ ID NO: 62083 - DNA, 20 bp, synthetic construct
  misc_feature 1..20: note = CRISPR gRNA sequence
  source 1..20: mol_type = other DNA
gggccaacagccagcagccc

SEQ ID NO: 62084 - DNA, 20 bp, synthetic construct
  misc_feature 1..20: note = CRISPR gRNA sequence
  source 1..20: mol_type = other DNA
aatgcctttctggaagagtt

SEQ ID NO: 62085 - DNA, 20 bp, synthetic construct
  misc_feature 1..20: note = CRISPR gRNA sequence
  source 1..20: mol_type = other DNA
aaaacaagaaggaaggggac

SEQ ID NO: 62086 - DNA, 20 bp, synthetic construct
  misc_feature 1..20: note = CRISPR gRNA sequence
  source 1..20: mol_type = other DNA
ggacccagaaaggaagggag

SEQ ID NO: 62087 - DNA, 20 bp, synthetic construct
  misc_feature 1..20: note = CRISPR gRNA sequence
  source 1..20: mol_type = other DNA
gaaaggaaagaggactcagg

SEQ ID NO: 62088 - DNA, 20 bp, synthetic construct
  misc_feature 1..20: note = CRISPR gRNA sequence
  source 1..20: mol_type = other DNA
taagtaaagtcaatgcttct

SEQ ID NO: 62089 - DNA, 20 bp, synthetic construct
  misc_feature 1..20: note = CRISPR gRNA sequence
  source 1..20: mol_type = other DNA
actggcccttccgagctcct

SEQ ID NO: 62090 - DNA, 20 bp, synthetic construct
  misc_feature 1..20: note = CRISPR gRNA sequence
  source 1..20: mol_type = other DNA
ggggttccaggttagaccct

SEQ ID NO: 62091 - DNA, 20 bp, synthetic construct
  misc_feature 1..20: note = CRISPR gRNA sequence
  source 1..20: mol_type = other DNA
cagacgaagagcatggccta

SEQ ID NO: 62092 - DNA, 20 bp, synthetic construct
  misc_feature 1..20: note = CRISPR gRNA sequence
  source 1..20: mol_type = other DNA
aacactcagttatctgttgt

SEQ ID NO: 62093 - DNA, 20 bp, synthetic construct
  misc_feature 1..20: note = CRISPR gRNA sequence
  source 1..20: mol_type = other DNA
agctttgaaggcagtgctgg

SEQ ID NO: 62094 - DNA, 20 bp, synthetic construct
  misc_feature 1..20: note = CRISPR gRNA sequence
  source 1..20: mol_type = other DNA
ctgtgcaaacagaaggtgcc

SEQ ID NO: 62095 - DNA, 20 bp, synthetic construct
  misc_feature 1..20: note = CRISPR gRNA sequence
  source 1..20: mol_type = other DNA
agtgatgtcctgtctctaca

SEQ ID NO: 62096 - DNA, 20 bp, synthetic construct
  misc_feature 1..20: note = CRISPR gRNA sequence
  source 1..20: mol_type = other DNA
cccccacccccgccaaaaaa

SEQ ID NO: 62097 - DNA, 20 bp, synthetic construct
  misc_feature 1..20: note = CRISPR gRNA sequence
  source 1..20: mol_type = other DNA
aaatttgttctgggaagtgt

SEQ ID NO: 62098 - DNA, 20 bp, synthetic construct
  misc_feature 1..20: note = CRISPR gRNA sequence
  source 1..20: mol_type = other DNA
actaaatattctctggtcat

SEQ ID NO: 62099 - DNA, 20 bp, synthetic construct
  misc_feature 1..20: note = CRISPR gRNA sequence
  source 1..20: mol_type = other DNA
atttggccagtggaatgtaa

SEQ ID NO: 62100 - DNA, 20 bp, synthetic construct
  misc_feature 1..20: note = CRISPR gRNA sequence
  source 1..20: mol_type = other DNA
cctcactcaggcagagagtc

SEQ ID NO: 62101 - DNA, 20 bp, synthetic construct
  misc_feature 1..20: note = CRISPR gRNA sequence
  source 1..20: mol_type = other DNA
ccagcatccatgctacccat

SEQ ID NO: 62102 - DNA, 20 bp, synthetic construct
  misc_feature 1..20: note = CRISPR gRNA sequence
  source 1..20: mol_type = other DNA
tttaaggctaaccatcctca

SEQ ID NO: 62103 - DNA, 20 bp, synthetic construct
  misc_feature 1..20: note = CRISPR gRNA sequence
  source 1..20: mol_type = other DNA
ctttttttctactccaggga

SEQ ID NO: 62104 - DNA, 20 bp, synthetic construct
  misc_feature 1..20: note = CRISPR gRNA sequence
  source 1..20: mol_type = other DNA
agggaccagtcttggcagta

SEQ ID NO: 62105 - DNA, 20 bp, synthetic construct
  misc_feature 1..20: note = CRISPR gRNA sequence
  source 1..20: mol_type = other DNA
gaaaagaggaggtgaagggg

SEQ ID NO: 62106 - DNA, 20 bp, synthetic construct
  misc_feature 1..20: note = CRISPR gRNA sequence
  source 1..20: mol_type = other DNA
ttggagtctggaatagtggg

SEQ ID NO: 62107 - DNA, 20 bp, synthetic construct
  misc_feature 1..20: note = CRISPR gRNA sequence
  source 1..20: mol_type = other DNA
gtcaattacaccttggttct

SEQ ID NO: 62108 - DNA, 20 bp, synthetic construct
  misc_feature 1..20: note = CRISPR gRNA sequence
  source 1..20: mol_type = other DNA
gcatggcagtaatgccaaca

SEQ ID NO: 62109 - DNA, 20 bp, synthetic construct
  misc_feature 1..20: note = CRISPR gRNA sequence
  source 1..20: mol_type = other DNA
acctcagctccccagtgaat

SEQ ID NO: 62110 - DNA, 20 bp, synthetic construct
  misc_feature 1..20: note = CRISPR gRNA sequence
  source 1..20: mol_type = other DNA
gtgataagaaatcgggatga

SEQ ID NO: 62111 - DNA, 20 bp, synthetic construct
  misc_feature 1..20: note = CRISPR gRNA sequence
  source 1..20: mol_type = other DNA
tactagcctggccaacgtga

SEQ ID NO: 62112 - DNA, 20 bp, synthetic construct
  misc_feature 1..20: note = CRISPR gRNA sequence
  source 1..20: mol_type = other DNA
ggccagagtttcttcgttcc

SEQ ID NO: 62113 - DNA, 20 bp, synthetic construct
  misc_feature 1..20: note = CRISPR gRNA sequence
  source 1..20: mol_type = other DNA
atgagatgggatggtgcatg

SEQ ID NO: 62114 - DNA, 20 bp, synthetic construct
  misc_feature 1..20: note = CRISPR gRNA sequence
  source 1..20: mol_type = other DNA
gatcccttgagccgccaggc

SEQ ID NO: 62115 - DNA, 20 bp, synthetic construct
  misc_feature 1..20: note = CRISPR gRNA sequence
  source 1..20: mol_type = other DNA
tttaaaaagaaaggaaaaaa

SEQ ID NO: 62116 - DNA, 20 bp, synthetic construct
  misc_feature 1..20: note = CRISPR gRNA sequence
  source 1..20: mol_type = other DNA
aaattgtttttctgactttt

SEQ ID NO: 62117 - DNA, 20 bp, synthetic construct
  misc_feature 1..20: note = CRISPR gRNA sequence
  source 1..20: mol_type = other DNA
agtatttcacatgcctgatt

SEQ ID NO: 62118 - DNA, 20 bp, synthetic construct
  misc_feature 1..20: note = CRISPR gRNA sequence
  source 1..20: mol_type = other DNA
gactggcattactagatggt

SEQ ID NO: 62119 - DNA, 20 bp, synthetic construct
  misc_feature 1..20: note = CRISPR gRNA sequence
  source 1..20: mol_type = other DNA
atggacctactggtagcgct

SEQ ID NO: 62120 - DNA, 20 bp, synthetic construct
  misc_feature 1..20: note = CRISPR gRNA sequence
  source 1..20: mol_type = other DNA
ctccttcccactgctcagga

SEQ ID NO: 62121 - DNA, 20 bp, synthetic construct
  misc_feature 1..20: note = CRISPR gRNA sequence
  source 1..20: mol_type = other DNA
ggtggttattttacagatga

SEQ ID NO: 62122 - DNA, 20 bp, synthetic construct
  misc_feature 1..20: note = CRISPR gRNA sequence
  source 1..20: mol_type = other DNA
aaactgggggtcagagaggt

SEQ ID NO: 62123 - DNA, 20 bp, synthetic construct
  misc_feature 1..20: note = CRISPR gRNA sequence
  source 1..20: mol_type = other DNA
cccgtctctactaaaaatac

SEQ ID NO: 62124 - DNA, 20 bp, synthetic construct
  misc_feature 1..20: note = CRISPR gRNA sequence
  source 1..20: mol_type = other DNA
atccctgcttctagccctta

SEQ ID NO: 62125 - DNA, 20 bp, synthetic construct
  misc_feature 1..20: note = CRISPR gRNA sequence
  source 1..20: mol_type = other DNA
atagtttaatcccatgtttg

SEQ ID NO: 62126 - DNA, 20 bp, synthetic construct
  misc_feature 1..20: note = CRISPR gRNA sequence
  source 1..20: mol_type = other DNA
tgtcttcacagcctgcagca

SEQ ID NO: 62127 - DNA, 20 bp, synthetic construct
  misc_feature 1..20: note = CRISPR gRNA sequence
  source 1..20: mol_type = other DNA
gtagcattaaatagtaaata

SEQ ID NO: 62128 - DNA, 20 bp, synthetic construct
  misc_feature 1..20: note = CRISPR gRNA sequence
  source 1..20: mol_type = other DNA
tatgctgcagagacttttaa

SEQ ID NO: 62129 - DNA, 20 bp, synthetic construct
  misc_feature 1..20: note = CRISPR gRNA sequence
  source 1..20: mol_type = other DNA
aaaaaaaaaagaaaagaaaa

SEQ ID NO: 62130 - DNA, 20 bp, synthetic construct
  misc_feature 1..20: note = CRISPR gRNA sequence
  source 1..20: mol_type = other DNA
gaccagcctgctcaacatgg

SEQ ID NO: 62131 - DNA, 20 bp, synthetic construct
  misc_feature 1..20: note = CRISPR gRNA sequence
  source 1..20: mol_type = other DNA
aggggccgtgggtgctctga

SEQ ID NO: 62132 - DNA, 20 bp, synthetic construct
  misc_feature 1..20: note = CRISPR gRNA sequence
  source 1..20: mol_type = other DNA
taaaataaagaaatccaaga

SEQ ID NO: 62133 - DNA, 20 bp, synthetic construct
  misc_feature 1..20: note = CRISPR gRNA sequence
  source 1..20: mol_type = other DNA
caggttcaaacatataacca

SEQ ID NO: 62134 - DNA, 20 bp, synthetic construct
  misc_feature 1..20: note = CRISPR gRNA sequence
  source 1..20: mol_type = other DNA
tagctgatgtgctaaaaaaa

SEQ ID NO: 62135 - DNA, 20 bp, synthetic construct
  misc_feature 1..20: note = CRISPR gRNA sequence
  source 1..20: mol_type = other DNA
gatgtgctaaaaaaaaaaaa

SEQ ID NO: 62136 - DNA, 20 bp, synthetic construct
  misc_feature 1..20: note = CRISPR gRNA sequence
  source 1..20: mol_type = other DNA
cagagaagccctgcagcaaa

SEQ ID NO: 62137 - DNA, 20 bp, synthetic construct
  misc_feature 1..20: note = CRISPR gRNA sequence
  source 1..20: mol_type = other DNA
gcagaattcccccaaagtat

SEQ ID NO: 62138 - DNA, 20 bp, synthetic construct
  misc_feature 1..20: note = CRISPR gRNA sequence
  source 1..20: mol_type = other DNA
tctcaatagtgctaaggttt

SEQ ID NO: 62139 - DNA, 20 bp, synthetic construct
  misc_feature 1..20: note = CRISPR gRNA sequence
  source 1..20: mol_type = other DNA
tgaaatctgtgcttgcaggt

SEQ ID NO: 62140 - DNA, 20 bp, synthetic construct
  misc_feature 1..20: note = CRISPR gRNA sequence
  source 1..20: mol_type = other DNA
agtatgcagactgcctacca

SEQ ID NO: 62141 - DNA, 20 bp, synthetic construct
  misc_feature 1..20: note = CRISPR gRNA sequence
  source 1..20: mol_type = other DNA
ctctgctggcagatgggggc

SEQ ID NO: 62142 - DNA, 20 bp, synthetic construct
  misc_feature 1..20: note = CRISPR gRNA sequence
  source 1..20: mol_type = other DNA
attatttctgaaactgtagt

SEQ ID NO: 62143 - DNA, 20 bp, synthetic construct
  misc_feature 1..20: note = CRISPR gRNA sequence
  source 1..20: mol_type = other DNA
accagcctgatcaacatggt

SEQ ID NO: 62144 - DNA, 20 bp, synthetic construct
  misc_feature 1..20: note = CRISPR gRNA sequence
  source 1..20: mol_type = other DNA
tctcaaaataaataaataaa

SEQ ID NO: 62145 - DNA, 20 bp, synthetic construct
  misc_feature 1..20: note = CRISPR gRNA sequence
  source 1..20: mol_type = other DNA
tcctgaatttcctctcattc

SEQ ID NO: 62146 - DNA, 20 bp, synthetic construct
  misc_feature 1..20: note = CRISPR gRNA sequence
  source 1..20: mol_type = other DNA
acacaatacacacaccccac

SEQ ID NO: 62147 - DNA, 20 bp, synthetic construct
  misc_feature 1..20: note = CRISPR gRNA sequence
  source 1..20: mol_type = other DNA
tctgttcactatgatcattt

SEQ ID NO: 62148 - DNA, 20 bp, synthetic construct
  misc_feature 1..20: note = CRISPR gRNA sequence
  source 1..20: mol_type = other DNA
aagtagaaagaataattttt

SEQ ID NO: 62149 - DNA, 20 bp, synthetic construct
  misc_feature 1..20: note = CRISPR gRNA sequence
  source 1..20: mol_type = other DNA
cagtttcatgtttgtgccca

SEQ ID NO: 62150 - DNA, 20 bp, synthetic construct
  misc_feature 1..20: note = CRISPR gRNA sequence
  source 1..20: mol_type = other DNA
ccggaactcttttcctcttg

SEQ ID NO: 62151 - DNA, 20 bp, synthetic construct
  misc_feature 1..20: note = CRISPR gRNA sequence
  source 1..20: mol_type = other DNA
tttaaatattattttatttc

SEQ ID NO: 62152 - DNA, 20 bp, synthetic construct
  misc_feature 1..20: note = CRISPR gRNA sequence
  source 1..20: mol_type = other DNA
gccaaaataacattttcaaa

SEQ ID NO: 62153 - DNA, 20 bp, synthetic construct
  misc_feature 1..20: note = CRISPR gRNA sequence
  source 1..20: mol_type = other DNA
gaccagcctggacaacatgg

SEQ ID NO: 62154 - DNA, 20 bp, synthetic construct
  misc_feature 1..20: note = CRISPR gRNA sequence
  source 1..20: mol_type = other DNA
tccagtctgggcaacaagag

SEQ ID NO: 62155 - DNA, 20 bp, synthetic construct
  misc_feature 1..20: note = CRISPR gRNA sequence
  source 1..20: mol_type = other DNA
atagttttaaaatgagcaaa

SEQ ID NO: 62156 - DNA, 20 bp, synthetic construct
  misc_feature 1..20: note = CRISPR gRNA sequence
  source 1..20: mol_type = other DNA
gaggaagacatccccagaat

SEQ ID NO: 62157 - DNA, 20 bp, synthetic construct
  misc_feature 1..20: note = CRISPR gRNA sequence
  source 1..20: mol_type = other DNA
acatactggactagatgttc

SEQ ID NO: 62158 - DNA, 20 bp, synthetic construct
  misc_feature 1..20: note = CRISPR gRNA sequence
  source 1..20: mol_type = other DNA
ccggggatgacaccccctga

SEQ ID NO: 62159 - DNA, 20 bp, synthetic construct
  misc_feature 1..20: note = CRISPR gRNA sequence
  source 1..20: mol_type = other DNA
cccaaagtcccacatccagg

SEQ ID NO: 62160 - DNA, 20 bp, synthetic construct
  misc_feature 1..20: note = CRISPR gRNA sequence
  source 1..20: mol_type = other DNA
ttactttcaatgtgattttt

SEQ ID NO: 62161 - DNA, 20 bp, synthetic construct
  misc_feature 1..20: note = CRISPR gRNA sequence
  source 1..20: mol_type = other DNA
aaacatgaaatcttgtgact

SEQ ID NO: 62162 - DNA, 20 bp, synthetic construct
  misc_feature 1..20: note = CRISPR gRNA sequence
  source 1..20: mol_type = other DNA
tttgcaaaataaaagaaagt

SEQ ID NO: 62163 - DNA, 20 bp, synthetic construct
  misc_feature 1..20: note = CRISPR gRNA sequence
  source 1..20: mol_type = other DNA
acaataccctgggtttaagg

SEQ ID NO: 62164 - DNA, 20 bp, synthetic construct
  misc_feature 1..20: note = CRISPR gRNA sequence
  source 1..20: mol_type = other DNA
ccctaccctgcagcttggcg

SEQ ID NO: 62165 - DNA, 20 bp, synthetic construct
  misc_feature 1..20: note = CRISPR gRNA sequence
  source 1..20: mol_type = other DNA
tcaagaaaggaagtctttcc

SEQ ID NO: 62166 - DNA, 20 bp, synthetic construct
  misc_feature 1..20: note = CRISPR gRNA sequence
  source 1..20: mol_type = other DNA
gagctgcaggtaatgttggg

SEQ ID NO: 62167 - DNA, 20 bp, synthetic construct
  misc_feature 1..20: note = CRISPR gRNA sequence
  source 1..20: mol_type = other DNA
cctttttaaccaaaagggtt

SEQ ID NO: 62168 - DNA, 20 bp, synthetic construct
  misc_feature 1..20: note = CRISPR gRNA sequence
  source 1..20: mol_type = other DNA
cctatcaggtggcctctctt

SEQ ID NO: 62169 - DNA, 20 bp, synthetic construct
  misc_feature 1..20: note = CRISPR gRNA sequence
  source 1..20: mol_type = other DNA
caatttcagacagatggaag

SEQ ID NO: 62170 - DNA, 20 bp, synthetic construct
  misc_feature 1..20: note = CRISPR gRNA sequence
  source 1..20: mol_type = other DNA
ttttattgctactatcaatg

SEQ ID NO: 62171 - DNA, 20 bp, synthetic construct
  misc_feature 1..20: note = CRISPR gRNA sequence
  source 1..20: mol_type = other DNA
cccaaaaggaaggttggacc

SEQ ID NO: 62172 - DNA, 20 bp, synthetic construct
  misc_feature 1..20: note = CRISPR gRNA sequence
  source 1..20: mol_type = other DNA
taaaaaaaaaaaaaaaaaaa

SEQ ID NO: 62173 - DNA, 20 bp, synthetic construct
  misc_feature 1..20: note = CRISPR gRNA sequence
  source 1..20: mol_type = other DNA
tgtggctcaagcttggggga

SEQ ID NO: 62174 - DNA, 20 bp, synthetic construct
  misc_feature 1..20: note = CRISPR gRNA sequence
  source 1..20: mol_type = other DNA
aggaattcatatgctggtag

SEQ ID NO: 62175 - DNA, 20 bp, synthetic construct
  misc_feature 1..20: note = CRISPR gRNA sequence
  source 1..20: mol_type = other DNA
tgtccccagtgtccaggtga

SEQ ID NO: 62176 - DNA, 20 bp, synthetic construct
  misc_feature 1..20: note = CRISPR gRNA sequence
  source 1..20: mol_type = other DNA
cttgctctgcctgggtagga

SEQ ID NO: 62177 - DNA, 20 bp, synthetic construct
  misc_feature 1..20: note = CRISPR gRNA sequence
  source 1..20: mol_type = other DNA
caagagcgaaactctgtctc

SEQ ID NO: 62178 - DNA, 20 bp, synthetic construct
  misc_feature 1..20: note = CRISPR gRNA sequence
  source 1..20: mol_type = other DNA
gctgcttcaggaacagaacc

SEQ ID NO: 62179 - DNA, 20 bp, synthetic construct
  misc_feature 1..20: note = CRISPR gRNA sequence
  source 1..20: mol_type = other DNA
ggctactttcaagctgaatt

SEQ ID NO: 62180 - DNA, 20 bp, synthetic construct
  misc_feature 1..20: note = CRISPR gRNA sequence
  source 1..20: mol_type = other DNA
aacatggcggtttgtgttca

SEQ ID NO: 62181 - DNA, 20 bp, synthetic construct
  misc_feature 1..20: note = CRISPR gRNA sequence
  source 1..20: mol_type = other DNA
gtcagtggcgaaattcagac

SEQ ID NO: 62182 - DNA, 20 bp, synthetic construct
  misc_feature 1..20: note = CRISPR gRNA sequence
  source 1..20: mol_type = other DNA
gttcgcagttattttaaaag

SEQ ID NO: 62183 - DNA, 20 bp, synthetic construct
  misc_feature 1..20: note = CRISPR gRNA sequence
  source 1..20: mol_type = other DNA
aacatagctgagtgggatgc

SEQ ID NO: 62184 - DNA, 20 bp, synthetic construct
  misc_feature 1..20: note = CRISPR gRNA sequence
  source 1..20: mol_type = other DNA
cctgctaccctggggacatg

SEQ ID NO: 62185 - DNA, 20 bp, synthetic construct
  misc_feature 1..20: note = CRISPR gRNA sequence
  source 1..20: mol_type = other DNA
tgagttttttttgctcattt

SEQ ID NO: 62186 - DNA, 20 bp, synthetic construct
  misc_feature 1..20: note = CRISPR gRNA sequence
  source 1..20: mol_type = other DNA
taaggaaaccaaactgtata

SEQ ID NO: 62187 - DNA, 20 bp, synthetic construct
  misc_feature 1..20: note = CRISPR gRNA sequence
  source 1..20: mol_type = other DNA
aacagggagagagatgtgtg

SEQ ID NO: 62188 - DNA, 20 bp, synthetic construct
  misc_feature 1..20: note = CRISPR gRNA sequence
  source 1..20: mol_type = other DNA
ccccgtctctactaaaaata

SEQ ID NO: 62189 - DNA, 20 bp, synthetic construct
  misc_feature 1..20: note = CRISPR gRNA sequence
  source 1..20: mol_type = other DNA
gagatcaagatcatcctggg

SEQ ID NO: 62190 - DNA, 20 bp, synthetic construct
  misc_feature 1..20: note = CRISPR gRNA sequence
  source 1..20: mol_type = other DNA
caggctttcaagggttaaag

SEQ ID NO: 62191 - DNA, 20 bp, synthetic construct
  misc_feature 1..20: note = CRISPR gRNA sequence
  source 1..20: mol_type = other DNA
aaaaatttccctctataatg

SEQ ID NO: 62192 - DNA, 20 bp, synthetic construct
  misc_feature 1..20: note = CRISPR gRNA sequence
  source 1..20: mol_type = other DNA
tccctctataatgaaaaaca

SEQ ID NO: 62193 - DNA, 20 bp, synthetic construct
  misc_feature 1..20: note = CRISPR gRNA sequence
  source 1..20: mol_type = other DNA
tggtgagacttcatctctta

SEQ ID NO: 62194 - DNA, 20 bp, synthetic construct
  misc_feature 1..20: note = CRISPR gRNA sequence
  source 1..20: mol_type = other DNA
agcactcagtctgaactttt

SEQ ID NO: 62195 - DNA, 20 bp, synthetic construct
  misc_feature 1..20: note = CRISPR gRNA sequence
  source 1..20: mol_type = other DNA
ccccacaaaaaagaaagaaa

SEQ ID NO: 62196 - DNA, 20 bp, synthetic construct
  misc_feature 1..20: note = CRISPR gRNA sequence
  source 1..20: mol_type = other DNA
tctcctccctccctcccaga

SEQ ID NO: 62197 - DNA, 20 bp, synthetic construct
  misc_feature 1..20: note = CRISPR gRNA sequence
  source 1..20: mol_type = other DNA
agttgtgccaggtaaaatga

SEQ ID NO: 62198 - DNA, 20 bp, synthetic construct
  misc_feature 1..20: note = CRISPR gRNA sequence
  source 1..20: mol_type = other DNA
acaaggaaccgggaaatagg

SEQ ID NO: 62199 - DNA, 20 bp, synthetic construct
  misc_feature 1..20: note = CRISPR gRNA sequence
  source 1..20: mol_type = other DNA
ccatgaaggttagtgttccg

SEQ ID NO: 62200 - DNA, 20 bp, synthetic construct
  misc_feature 1..20: note = CRISPR gRNA sequence
  source 1..20: mol_type = other DNA
gaaattccacctctactaca

SEQ ID NO: 62201 - DNA, 20 bp, synthetic construct
  misc_feature 1..20: note = CRISPR gRNA sequence
  source 1..20: mol_type = other DNA
caaaaaaataaaaaagaaaa

SEQ ID NO: 62202 - DNA, 20 bp, synthetic construct
  misc_feature 1..20: note = CRISPR gRNA sequence
  source 1..20: mol_type = other DNA
gcactgactgcagtgctaca

SEQ ID NO: 62203 - DNA, 20 bp, synthetic construct
  misc_feature 1..20: note = CRISPR gRNA sequence
  source 1..20: mol_type = other DNA
gactgcagtgctacacaaaa

SEQ ID NO: 62204 - DNA, 20 bp, synthetic construct
  misc_feature 1..20: note = CRISPR gRNA sequence
  source 1..20: mol_type = other DNA
caaaaattcgtaaactttct

SEQ ID NO: 62205 - DNA, 20 bp, synthetic construct
  misc_feature 1..20: note = CRISPR gRNA sequence
  source 1..20: mol_type = other DNA
ggcatcagtatatactctgt

SEQ ID NO: 62206 - DNA, 20 bp, synthetic construct
  misc_feature 1..20: note = CRISPR gRNA sequence
  source 1..20: mol_type = other DNA
tccagcctgggcaacaagag

SEQ ID NO: 62207 - DNA, 20 bp, synthetic construct
  misc_feature 1..20: note = CRISPR gRNA sequence
  source 1..20: mol_type = other DNA
aaaaagactgaagcaaaatg

SEQ ID NO: 62208 - DNA, 20 bp, synthetic construct
  misc_feature 1..20: note = CRISPR gRNA sequence
  source 1..20: mol_type = other DNA
atggaaaacacagatgctat

SEQ ID NO: 62209 - DNA, 20 bp, synthetic construct
  misc_feature 1..20: note = CRISPR gRNA sequence
  source 1..20: mol_type = other DNA
gcattgcctccttccaaggg

SEQ ID NO: 62210 - DNA, 20 bp, synthetic construct
  misc_feature 1..20: note = CRISPR gRNA sequence
  source 1..20: mol_type = other DNA
aaggtcacatgaggacatac

SEQ ID NO: 62211 - DNA, 20 bp, synthetic construct
  misc_feature 1..20: note = CRISPR gRNA sequence
  source 1..20: mol_type = other DNA
cttccttcccagcattgcac

SEQ ID NO: 62212 - DNA, 20 bp, synthetic construct
  misc_feature 1..20: note = CRISPR gRNA sequence
  source 1..20: mol_type = other DNA
gaacagttgatctaaatctt

SEQ ID NO: 62213 - DNA, 20 bp, synthetic construct
  misc_feature 1..20: note = CRISPR gRNA sequence
  source 1..20: mol_type = other DNA
gtgtcagcctgcccagggac

SEQ ID NO: 62214 - DNA, 20 bp, synthetic construct
  misc_feature 1..20: note = CRISPR gRNA sequence
  source 1..20: mol_type = other DNA
ataacagttaaataaactga

SEQ ID NO: 62215 - DNA, 20 bp, synthetic construct
  misc_feature 1..20: note = CRISPR gRNA sequence
  source 1..20: mol_type = other DNA
tttcctggcaagtcttaaaa

SEQ ID NO: 62216 - DNA, 20 bp, synthetic construct
  misc_feature 1..20: note = CRISPR gRNA sequence
  source 1..20: mol_type = other DNA
agaagtgtgtgagcttgtta

SEQ ID NO: 62217 - DNA, 20 bp, synthetic construct
  misc_feature 1..20: note = CRISPR gRNA sequence
  source 1..20: mol_type = other DNA
ttacagtgaggtaatggatg

SEQ ID NO: 62218 - DNA, 20 bp, synthetic construct
  misc_feature 1..20: note = CRISPR gRNA sequence
  source 1..20: mol_type = other DNA
cggctcccttttctcttttc

SEQ ID NO: 62219 - DNA, 20 bp, synthetic construct
  misc_feature 1..20: note = CRISPR gRNA sequence
  source 1..20: mol_type = other DNA
agagtgttttaaaaagtcag

SEQ ID NO: 62220 - DNA, 20 bp, synthetic construct
  misc_feature 1..20: note = CRISPR gRNA sequence
  source 1..20: mol_type = other DNA
cacctaacctaccccatgat

SEQ ID NO: 62221 - DNA, 20 bp, synthetic construct
  misc_feature 1..20: note = CRISPR gRNA sequence
  source 1..20: mol_type = other DNA
tctgaaggtaaagctgtgag

SEQ ID NO: 62222 - DNA, 20 bp, synthetic construct
  misc_feature 1..20: note = CRISPR gRNA sequence
  source 1..20: mol_type = other DNA
gtcactgagctggttgtccc

SEQ ID NO: 62223 - DNA, 20 bp, synthetic construct
  misc_feature 1..20: note = CRISPR gRNA sequence
  source 1..20: mol_type = other DNA
tccctctctgggtctcactg

SEQ ID NO: 62224 - DNA, 20 bp, synthetic construct
  misc_feature 1..20: note = CRISPR gRNA sequence
  source 1..20: mol_type = other DNA
gagtttgagaaaggaagaag

SEQ ID NO: 62225 - DNA, 20 bp, synthetic construct
  misc_feature 1..20: note = CRISPR gRNA sequence
  source 1..20: mol_type = other DNA
tgagttcccattttctctcc

SEQ ID NO: 62226 - DNA, 20 bp, synthetic construct
  misc_feature 1..20: note = CRISPR gRNA sequence
  source 1..20: mol_type = other DNA
cactgtttctgaccatgttg

SEQ ID NO: 62227 - DNA, 20 bp, synthetic construct
  misc_feature 1..20: note = CRISPR gRNA sequence
  source 1..20: mol_type = other DNA
tgcaaaacaaacaaacaaac

SEQ ID NO: 62228 - DNA, 20 bp, synthetic construct
  misc_feature 1..20: note = CRISPR gRNA sequence
  source 1..20: mol_type = other DNA
aagaccttgtctcaaaaata

SEQ ID NO: 62229 - DNA, 20 bp, synthetic construct
  misc_feature 1..20: note = CRISPR gRNA sequence
  source 1..20: mol_type = other DNA
aaaaataaaaaacaaacaaa

SEQ ID NO: 62230 - DNA, 20 bp, synthetic construct
  misc_feature 1..20: note = CRISPR gRNA sequence
  source 1..20: mol_type = other DNA
aacaagagcaacaacaaaca

SEQ ID NO: 62231 - DNA, 20 bp, synthetic construct
  misc_feature 1..20: note = CRISPR gRNA sequence
  source 1..20: mol_type = other DNA
gggtagattagatgctgtct

SEQ ID NO: 62232 - DNA, 20 bp, synthetic construct
  misc_feature 1..20: note = CRISPR gRNA sequence
  source 1..20: mol_type = other DNA
cggcaggcaggggcaagggc

SEQ ID NO: 62233 - DNA, 20 bp, synthetic construct
  misc_feature 1..20: note = CRISPR gRNA sequence
  source 1..20: mol_type = other DNA
gtgcctggtttacagcattc

SEQ ID NO: 62234 - DNA, 20 bp, synthetic construct
  misc_feature 1..20: note = CRISPR gRNA sequence
  source 1..20: mol_type = other DNA
gtttacagcattccttttgg

SEQ ID NO: 62235 - DNA, 20 bp, synthetic construct
  misc_feature 1..20: note = CRISPR gRNA sequence
  source 1..20: mol_type = other DNA
acagcattccttttggagtc

SEQ ID NO: 62236 - DNA, 20 bp, synthetic construct
  misc_feature 1..20: note = CRISPR gRNA sequence
  source 1..20: mol_type = other DNA
cagcattccttttggagtct

SEQ ID NO: 62237 - DNA, 20 bp, synthetic construct
  misc_feature 1..20: note = CRISPR gRNA sequence
  source 1..20: mol_type = other DNA
cttttggagtctggaatagt

SEQ ID NO: 62238 - DNA, 20 bp, synthetic construct
  misc_feature 1..20: note = CRISPR gRNA sequence
  source 1..20: mol_type = other DNA
ttggagtctggaatagtggg

SEQ ID NO: 62239 - DNA, 20 bp, synthetic construct
  misc_feature 1..20: note = CRISPR gRNA sequence
  source 1..20: mol_type = other DNA
tggagtctggaatagtgggg

SEQ ID NO: 62240 - DNA, 20 bp, synthetic construct
  misc_feature 1..20: note = CRISPR gRNA sequence
  source 1..20: mol_type = other DNA
ggagtctggaatagtgggga

SEQ ID NO: 62241 - DNA, 20 bp, synthetic construct
  misc_feature 1..20: note = CRISPR gRNA sequence
  source 1..20: mol_type = other DNA
gagtctggaatagtggggaa

SEQ ID NO: 62242 - DNA, 20 bp, synthetic construct
  misc_feature 1..20: note = CRISPR gRNA sequence
  source 1..20: mol_type = other DNA
gaatagtggggaaaactccc

SEQ ID NO: 62243 - DNA, 20 bp, synthetic construct
  misc_feature 1..20: note = CRISPR gRNA sequence
  source 1..20: mol_type = other DNA
cctgtcttctctccccttag

SEQ ID NO: 62244 - DNA, 20 bp, synthetic construct
  misc_feature 1..20: note = CRISPR gRNA sequence
  source 1..20: mol_type = other DNA
tcttctctccccttaggagt

SEQ ID NO: 62245 - DNA, 20 bp, synthetic construct
  misc_feature 1..20: note = CRISPR gRNA sequence
  source 1..20: mol_type = other DNA
ctctccccttaggagtctgc

SEQ ID NO: 62246 - DNA, 20 bp, synthetic construct
  misc_feature 1..20: note = CRISPR gRNA sequence
  source 1..20: mol_type = other DNA
tctccccttaggagtctgca

SEQ ID NO: 62247 - DNA, 20 bp, synthetic construct
  misc_feature 1..20: note = CRISPR gRNA sequence
  source 1..20: mol_type = other DNA
tccccttaggagtctgcact

SEQ ID NO: 62248 - DNA, 20 bp, synthetic construct
  misc_feature 1..20: note = CRISPR gRNA sequence
  source 1..20: mol_type = other DNA
cccttaggagtctgcactat

SEQ ID NO: 62249 - DNA, 20 bp, synthetic construct
  misc_feature 1..20: note = CRISPR gRNA sequence
  source 1..20: mol_type = other DNA
aggagtctgcactatggaaa

SEQ ID NO: 62250 - DNA, 20 bp, synthetic construct
  misc_feature 1..20: note = CRISPR gRNA sequence
  source 1..20: mol_type = other DNA
ggagtctgcactatggaaac

SEQ ID NO: 62251 - DNA, 20 bp, synthetic construct
  misc_feature 1..20: note = CRISPR gRNA sequence
  source 1..20: mol_type = other DNA
cactatggaaacaacctgtc

SEQ ID NO: 62252 - DNA, 20 bp, synthetic construct
  misc_feature 1..20: note = CRISPR gRNA sequence
  source 1..20: mol_type = other DNA
tggaaacaacctgtcaatcc

SEQ ID NO: 62253 - DNA, 20 bp, synthetic construct
  misc_feature 1..20: note = CRISPR gRNA sequence
  source 1..20: mol_type = other DNA
tcaatccagctcaaggcaca

SEQ ID NO: 62254 - DNA, 20 bp, synthetic construct
  misc_feature 1..20: note = CRISPR gRNA sequence
  source 1..20: mol_type = other DNA
aaggcacacatagcccagac

SEQ ID NO: 62255 - DNA, 20 bp, synthetic construct
  misc_feature 1..20: note = CRISPR gRNA sequence
  source 1..20: mol_type = other DNA
tccgtggggaccctagagca

SEQ ID NO: 62256 - DNA, 20 bp, synthetic construct
  misc_feature 1..20: note = CRISPR gRNA sequence
  source 1..20: mol_type = other DNA
cgtggggaccctagagcacc

SEQ ID NO: 62257 - DNA, 20 bp, synthetic construct
  misc_feature 1..20: note = CRISPR gRNA sequence
  source 1..20: mol_type = other DNA
gagcacctatcatgaacgag

SEQ ID NO: 62258 - DNA, 20 bp, synthetic construct
  misc_feature 1..20: note = CRISPR gRNA sequence
  source 1..20: mol_type = other DNA
tcatgaacgaggagaccaag

SEQ ID NO: 62259 - DNA, 20 bp, synthetic construct
  misc_feature 1..20: note = CRISPR gRNA sequence
  source 1..20: mol_type = other DNA
ttctctccccttcacctcct

SEQ ID NO: 62260 - DNA, 20 bp, synthetic construct
  misc_feature 1..20: note = CRISPR gRNA sequence
  source 1..20: mol_type = other DNA
tctctccccttcacctcctc

SEQ ID NO: 62261 - DNA, 20 bp, synthetic construct
  misc_feature 1..20: note = CRISPR gRNA sequence
  source 1..20: mol_type = other DNA
ctctccccttcacctcctct

SEQ ID NO: 62262 - DNA, 20 bp, synthetic construct
  misc_feature 1..20: note = CRISPR gRNA sequence
  source 1..20: mol_type = other DNA
tctccccttcacctcctctt

SEQ ID NO: 62263 - DNA, 20 bp, synthetic construct
  misc_feature 1..20: note = CRISPR gRNA sequence
  source 1..20: mol_type = other DNA
tccccttcacctcctctttt

SEQ ID NO: 62264 - DNA, 20 bp, synthetic construct
  misc_feature 1..20: note = CRISPR gRNA sequence
  source 1..20: mol_type = other DNA
cccttcacctcctcttttcc

SEQ ID NO: 62265 - DNA, 20 bp, synthetic construct
  misc_feature 1..20: note = CRISPR gRNA sequence
  source 1..20: mol_type = other DNA
cacctcctcttttcccctcc

SEQ ID NO: 62266 - DNA, 20 bp, synthetic construct
  misc_feature 1..20: note = CRISPR gRNA sequence
  source 1..20: mol_type = other DNA
acctcctcttttcccctcct

SEQ ID NO: 62267 - DNA, 20 bp, synthetic construct
  misc_feature 1..20: note = CRISPR gRNA sequence
  source 1..20: mol_type = other DNA
ctcttttcccctcctatcta

SEQ ID NO: 62268 - DNA, 20 bp, synthetic construct
  misc_feature 1..20: note = CRISPR gRNA sequence
  source 1..20: mol_type = other DNA
ttttcccctcctatctactt

SEQ ID NO: 62269 - DNA, 20 bp, synthetic construct
  misc_feature 1..20: note = CRISPR gRNA sequence
  source 1..20: mol_type = other DNA
ttcccctcctatctacttcg

SEQ ID NO: 62270 - DNA, 20 bp, synthetic construct
  misc_feature 1..20: note = CRISPR gRNA sequence
  source 1..20: mol_type = other DNA
tcccctcctatctacttcgt

SEQ ID NO: 62271 - DNA, 20 bp, synthetic construct
  misc_feature 1..20: note = CRISPR gRNA sequence
  source 1..20: mol_type = other DNA
cccctcctatctacttcgtc

SEQ ID NO: 62272 - DNA, 20 bp, synthetic construct
  misc_feature 1..20: note = CRISPR gRNA sequence
  source 1..20: mol_type = other DNA
ccctcctatctacttcgtca

SEQ ID NO: 62273 - DNA, 20 bp, synthetic construct
  misc_feature 1..20: note = CRISPR gRNA sequence
  source 1..20: mol_type = other DNA
ctatctacttcgtcactttt

SEQ ID NO: 62274 - DNA, 20 bp, synthetic construct
  misc_feature 1..20: note = CRISPR gRNA sequence
  source 1..20: mol_type = other DNA
tctacttcgtcacttttctc

SEQ ID NO: 62275 - DNA, 20 bp, synthetic construct
  misc_feature 1..20: note = CRISPR gRNA sequence
  source 1..20: mol_type = other DNA
cttcgtcacttttctcctac

SEQ ID NO: 62276 - DNA, 20 bp, synthetic construct
  misc_feature 1..20: note = CRISPR gRNA sequence
  source 1..20: mol_type = other DNA
cgtcacttttctcctactgc

SEQ ID NO: 62277 - DNA, 20 bp, synthetic construct
  misc_feature 1..20: note = CRISPR gRNA sequence
  source 1..20: mol_type = other DNA
gtcacttttctcctactgcc

SEQ ID NO: 62278 - DNA, 20 bp, synthetic construct
  misc_feature 1..20: note = CRISPR gRNA sequence
  source 1..20: mol_type = other DNA
ttctcctactgccaagactg

SEQ ID NO: 62279 - DNA, 20 bp, synthetic construct
  misc_feature 1..20: note = CRISPR gRNA sequence
  source 1..20: mol_type = other DNA
tctcctactgccaagactgg

SEQ ID NO: 62280 - DNA, 20 bp, synthetic construct
  misc_feature 1..20: note = CRISPR gRNA sequence
  source 1..20: mol_type = other DNA
ctcctactgccaagactggt

SEQ ID NO: 62281 - DNA, 20 bp, synthetic construct
  misc_feature 1..20: note = CRISPR gRNA sequence
  source 1..20: mol_type = other DNA
tcctactgccaagactggtc

SEQ ID NO: 62282 - DNA, 20 bp, synthetic construct
  misc_feature 1..20: note = CRISPR gRNA sequence
  source 1..20: mol_type = other DNA
ctactgccaagactggtccc

SEQ ID NO: 62283 - DNA, 20 bp, synthetic construct
  misc_feature 1..20: note = CRISPR gRNA sequence
  source 1..20: mol_type = other DNA
ctgccaagactggtccctac

SEQ ID NO: 62284 - DNA, 20 bp, synthetic construct
  misc_feature 1..20: note = CRISPR gRNA sequence
  source 1..20: mol_type = other DNA
ccaagactggtccctaccca

SEQ ID NO: 62285 - DNA, 20 bp, synthetic construct
  misc_feature 1..20: note = CRISPR gRNA sequence
  source 1..20: mol_type = other DNA
gtccctacccaaatctgcct

SEQ ID NO: 62286 - DNA, 20 bp, synthetic construct
  misc_feature 1..20: note = CRISPR gRNA sequence
  source 1..20: mol_type = other DNA
cccaaatctgccttactggg

SEQ ID NO: 62287 - DNA, 20 bp, synthetic construct
  misc_feature 1..20: note = CRISPR gRNA sequence
  source 1..20: mol_type = other DNA
ccttactgggctgcccccaa

SEQ ID NO: 62288 - DNA, 20 bp, synthetic construct
  misc_feature 1..20: note = CRISPR gRNA sequence
  source 1..20: mol_type = other DNA
actgggctgcccccaacaca

SEQ ID NO: 62289 - DNA, 20 bp, synthetic construct
  misc_feature 1..20: note = CRISPR gRNA sequence
  source 1..20: mol_type = other DNA
ctgggctgcccccaacacaa

SEQ ID NO: 62290 - DNA, 20 bp, synthetic construct
  misc_feature 1..20: note = CRISPR gRNA sequence
  source 1..20: mol_type = other DNA
ggctgcccccaacacaacaa

SEQ ID NO: 62291 - DNA, 20 bp, synthetic construct
  misc_feature 1..20: note = CRISPR gRNA sequence
  source 1..20: mol_type = other DNA
cccccaacacaacaaacctg

SEQ ID NO: 62292 - DNA, 20 bp, synthetic construct
  misc_feature 1..20: note = CRISPR gRNA sequence
  source 1..20: mol_type = other DNA
cccttgaccatcattcagca

SEQ ID NO: 62293 - DNA, 20 bp, synthetic construct
  misc_feature 1..20: note = CRISPR gRNA sequence
  source 1..20: mol_type = other DNA
gaccatcattcagcatgaga

SEQ ID NO: 62294 - DNA, 20 bp, synthetic construct
  misc_feature 1..20: note = CRISPR gRNA sequence
  source 1..20: mol_type = other DNA
accatcattcagcatgagaa

SEQ ID NO: 62295 - DNA, 20 bp, synthetic construct
  misc_feature 1..20: note = CRISPR gRNA sequence
  source 1..20: mol_type = other DNA
agcatgagaatgtaatgatc

SEQ ID NO: 62296 - DNA, 20 bp, synthetic construct
  misc_feature 1..20: note = CRISPR gRNA sequence
  source 1..20: mol_type = other DNA
tgagacagcatctaatctac

SEQ ID NO: 62297 - DNA, 20 bp, synthetic construct
  misc_feature 1..20: note = CRISPR gRNA sequence
  source 1..20: mol_type = other DNA
gagacagcatctaatctacc

SEQ ID NO: 62298 - DNA, 20 bp, synthetic construct
  misc_feature 1..20: note = CRISPR gRNA sequence
  source 1..20: mol_type = other DNA
agacagcatctaatctaccc

SEQ ID NO: 62299 - DNA, 20 bp, synthetic construct
  misc_feature 1..20: note = CRISPR gRNA sequence
  source 1..20: mol_type = other DNA
atctacccattttagagatg

SEQ ID NO: 62300 - DNA, 20 bp, synthetic construct
  misc_feature 1..20: note = CRISPR gRNA sequence
  source 1..20: mol_type = other DNA
cccattttagagatggtatg

SEQ ID NO: 62301 - DNA, 20 bp, synthetic construct
  misc_feature 1..20: note = CRISPR gRNA sequence
  source 1..20: mol_type = other DNA
tagagatggtatgactgagg

SEQ ID NO: 62302 - DNA, 20 bp, synthetic construct
  misc_feature 1..20: note = CRISPR gRNA sequence
  source 1..20: mol_type = other DNA
agagatggtatgactgaggc

SEQ ID NO: 62303 - DNA, 20 bp, synthetic construct
  misc_feature 1..20: note = CRISPR gRNA sequence
  source 1..20: mol_type = other DNA
gagatggtatgactgaggct

SEQ ID NO: 62304 - DNA, 20 bp, synthetic construct
  misc_feature 1..20: note = CRISPR gRNA sequence
  source 1..20: mol_type = other DNA
aggcttatataggaaaaagg

SEQ ID NO: 62305 - DNA, 20 bp, synthetic construct
  misc_feature 1..20: note = CRISPR gRNA sequence
  source 1..20: mol_type = other DNA
atataggaaaaaggcttgct

SEQ ID NO: 62306 - DNA, 20 bp, synthetic construct
  misc_feature 1..20: note = CRISPR gRNA sequence
  source 1..20: mol_type = other DNA
tataggaaaaaggcttgctc

SEQ ID NO: 62307 - DNA, 20 bp, synthetic construct
  misc_feature 1..20: note = CRISPR gRNA sequence
  source 1..20: mol_type = other DNA
gctcaaggtcacactatgag

SEQ ID NO: 62308 - DNA, 20 bp, synthetic construct
  misc_feature 1..20: note = CRISPR gRNA sequence
  source 1..20: mol_type = other DNA
ctcaaggtcacactatgagt

SEQ ID NO: 62309 - DNA, 20 bp, synthetic construct
  misc_feature 1..20: note = CRISPR gRNA sequence
  source 1..20: mol_type = other DNA
aaggtcacactatgagtgta

SEQ ID NO: 62310 - DNA, 20 bp, synthetic construct
  misc_feature 1..20: note = CRISPR gRNA sequence
  source 1..20: mol_type = other DNA
tgagtgtatcagctaggata

SEQ ID NO: 62311 - DNA, 20 bp, synthetic construct
  misc_feature 1..20: note = CRISPR gRNA sequence
  source 1..20: mol_type = other DNA
ggataggccaggttacactg

SEQ ID NO: 62312 - DNA, 20 bp, synthetic construct
  misc_feature 1..20: note = CRISPR gRNA sequence
  source 1..20: mol_type = other DNA
cactgtagtacatgcaccct

SEQ ID NO: 62313 - DNA, 20 bp, synthetic construct
  misc_feature 1..20: note = CRISPR gRNA sequence
  source 1..20: mol_type = other DNA
tagtacatgcaccctccaaa

SEQ ID NO: 62314 - DNA, 20 bp, synthetic construct
  misc_feature 1..20: note = CRISPR gRNA sequence
  source 1..20: mol_type = other DNA
caaagtcccagtgactcatg

SEQ ID NO: 62315 - DNA, 20 bp, synthetic construct
  misc_feature 1..20: note = CRISPR gRNA sequence
  source 1..20: mol_type = other DNA
atggcaacaaaagtttattt

SEQ ID NO: 62316 - DNA, 20 bp, synthetic construct
  misc_feature 1..20: note = CRISPR gRNA sequence
  source 1..20: mol_type = other DNA
atttcctgctcttgcttcct

SEQ ID NO: 62317 - DNA, 20 bp, synthetic construct
  misc_feature 1..20: note = CRISPR gRNA sequence
  source 1..20: mol_type = other DNA
tttcctgctcttgcttcctg

SEQ ID NO: 62318 - DNA, 20 bp, synthetic construct
  misc_feature 1..20: note = CRISPR gRNA sequence
  source 1..20: mol_type = other DNA
cctgctcttgcttcctgtct

SEQ ID NO: 62319 - DNA, 20 bp, synthetic construct
  misc_feature 1..20: note = CRISPR gRNA sequence
  source 1..20: mol_type = other DNA
ctgctcttgcttcctgtctc

SEQ ID NO: 62320 - DNA, 20 bp, synthetic construct
  misc_feature 1..20: note = CRISPR gRNA sequence
  source 1..20: mol_type = other DNA
ctcttgcttcctgtctcgtg

SEQ ID NO: 62321 - DNA, 20 bp, synthetic construct
  misc_feature 1..20: note = CRISPR gRNA sequence
  source 1..20: mol_type = other DNA
ttgcttcctgtctcgtgtgg

SEQ ID NO: 62322 - DNA, 20 bp, synthetic construct
  misc_feature 1..20: note = CRISPR gRNA sequence
  source 1..20: mol_type = other DNA
gcttcctgtctcgtgtggat

SEQ ID NO: 62323 - DNA, 20 bp, synthetic construct
  misc_feature 1..20: note = CRISPR gRNA sequence
  source 1..20: mol_type = other DNA
cttcctgtctcgtgtggatt

SEQ ID NO: 62324 - DNA, 20 bp, synthetic construct
  misc_feature 1..20: note = CRISPR gRNA sequence
  source 1..20: mol_type = other DNA
cctgtctcgtgtggattgac

SEQ ID NO: 62325 - DNA, 20 bp, synthetic construct
  misc_feature 1..20: note = CRISPR gRNA sequence
  source 1..20: mol_type = other DNA
ctgtctcgtgtggattgact

SEQ ID NO: 62326 - DNA, 20 bp, synthetic construct
  misc_feature 1..20: note = CRISPR gRNA sequence
  source 1..20: mol_type = other DNA
tctcgtgtggattgactggg

SEQ ID NO: 62327 - DNA, 20 bp, synthetic construct
  misc_feature 1..20: note = CRISPR gRNA sequence
  source 1..20: mol_type = other DNA
gtgtggattgactgggattg

SEQ ID NO: 62328 - DNA, 20 bp, synthetic construct
  misc_feature 1..20: note = CRISPR gRNA sequence
  source 1..20: mol_type = other DNA
actgggattgctcctccaca

SEQ ID NO: 62329 - DNA, 20 bp, synthetic construct
  misc_feature 1..20: note = CRISPR gRNA sequence
  source 1..20: mol_type = other DNA
ggattgctcctccacatcat

SEQ ID NO: 62330 - DNA, 20 bp, synthetic construct
  misc_feature 1..20: note = CRISPR gRNA sequence
  source 1..20: mol_type = other DNA
ctcctccacatcatcctgtc

SEQ ID NO: 62331 - DNA, 20 bp, synthetic construct
  misc_feature 1..20: note = CRISPR gRNA sequence
  source 1..20: mol_type = other DNA
ctccacatcatcctgtctcc

SEQ ID NO: 62332 - DNA, 20 bp, synthetic construct
  misc_feature 1..20: note = CRISPR gRNA sequence
  source 1..20: mol_type = other DNA
cacatcatcctgtctcccac

SEQ ID NO: 62333 - DNA, 20 bp, synthetic construct
  misc_feature 1..20: note = CRISPR gRNA sequence
  source 1..20: mol_type = other DNA
tctcccacactcaggctaac

SEQ ID NO: 62334 - DNA, 20 bp, synthetic construct
  misc_feature 1..20: note = CRISPR gRNA sequence
  source 1..20: mol_type = other DNA
ccacactcaggctaacaggg

SEQ ID NO: 62335 - DNA, 20 bp, synthetic construct
  misc_feature 1..20: note = CRISPR gRNA sequence
  source 1..20: mol_type = other DNA
aggctaacagggtagccatg

SEQ ID NO: 62336 - DNA, 20 bp, synthetic construct
  misc_feature 1..20: note = CRISPR gRNA sequence
  source 1..20: mol_type = other DNA
acagggtagccatgatttgc

SEQ ID NO: 62337 - DNA, 20 bp, synthetic construct
  misc_feature 1..20: note = CRISPR gRNA sequence
  source 1..20: mol_type = other DNA
gcaatatttctggtccctgg

SEQ ID NO: 62338 - DNA, 20 bp, synthetic construct
  misc_feature 1..20: note = CRISPR gRNA sequence
  source 1..20: mol_type = other DNA
caatatttctggtccctgga

SEQ ID NO: 62339 - DNA, 20 bp, synthetic construct
  misc_feature 1..20: note = CRISPR gRNA sequence
  source 1..20: mol_type = other DNA
ctggtccctggagtagaaaa

SEQ ID NO: 62340 - DNA, 20 bp, synthetic construct
  misc_feature 1..20: note = CRISPR gRNA sequence
  source 1..20: mol_type = other DNA
tggtccctggagtagaaaaa

SEQ ID NO: 62341 - DNA, 20 bp, synthetic construct
  misc_feature 1..20: note = CRISPR gRNA sequence
  source 1..20: mol_type = other DNA
gtccctggagtagaaaaaaa

SEQ ID NO: 62342 - DNA, 20 bp, synthetic construct
  misc_feature 1..20: note = CRISPR gRNA sequence
  source 1..20: mol_type = other DNA
gagtagaaaaaaagaaaaag

SEQ ID NO: 62343 - DNA, 20 bp, synthetic construct
  misc_feature 1..20: note = CRISPR gRNA sequence
  source 1..20: mol_type = other DNA
tcaattacaccttggttctt

SEQ ID NO: 62344 - DNA, 20 bp, synthetic construct
  misc_feature 1..20: note = CRISPR gRNA sequence
  source 1..20: mol_type = other DNA
caccttggttcttaaaacaa

SEQ ID NO: 62345 - DNA, 20 bp, synthetic construct
  misc_feature 1..20: note = CRISPR gRNA sequence
  source 1..20: mol_type = other DNA
ggttcttaaaacaactacag

SEQ ID NO: 62346 - DNA, 20 bp, synthetic construct
  misc_feature 1..20: note = CRISPR gRNA sequence
  source 1..20: mol_type = other DNA
gttcttaaaacaactacagg

SEQ ID NO: 62347 - DNA, 20 bp, synthetic construct
  misc_feature 1..20: note = CRISPR gRNA sequence
  source 1..20: mol_type = other DNA
ttaaaacaactacaggcatg

SEQ ID NO: 62348 - DNA, 20 bp, synthetic construct
  misc_feature 1..20: note = CRISPR gRNA sequence
  source 1..20: mol_type = other DNA
aaaacaactacaggcatgac

SEQ ID NO: 62349 - DNA, 20 bp, synthetic construct
  misc_feature 1..20: note = CRISPR gRNA sequence
  source 1..20: mol_type = other DNA
aaacaactacaggcatgaca

SEQ ID NO: 62350 - DNA, 20 bp, synthetic construct
  misc_feature 1..20: note = CRISPR gRNA sequence
  source 1..20: mol_type = other DNA
caggcatgacatgagtcttt

SEQ ID NO: 62351 - DNA, 20 bp, synthetic construct
  misc_feature 1..20: note = CRISPR gRNA sequence
  source 1..20: mol_type = other DNA
ttttagcatgtttcattgac

SEQ ID NO: 62352 - DNA, 20 bp, synthetic construct
  misc_feature 1..20: note = CRISPR gRNA sequence
  source 1..20: mol_type = other DNA
tttagcatgtttcattgacc

SEQ ID NO: 62353 - DNA, 20 bp, synthetic construct
  misc_feature 1..20: note = CRISPR gRNA sequence
  source 1..20: mol_type = other DNA
ttagcatgtttcattgacca

SEQ ID NO: 62354 - DNA, 20 bp, synthetic construct
  misc_feature 1..20: note = CRISPR gRNA sequence
  source 1..20: mol_type = other DNA
tagcatgtttcattgaccaa

SEQ ID NO: 62355 - DNA, 20 bp, synthetic construct
  misc_feature 1..20: note = CRISPR gRNA sequence
  source 1..20: mol_type = other DNA
agcatgtttcattgaccaaa

SEQ ID NO: 62356 - DNA, 20 bp, synthetic construct
  misc_feature 1..20: note = CRISPR gRNA sequence
  source 1..20: mol_type = other DNA
gcatgtttcattgaccaaag

SEQ ID NO: 62357 - DNA, 20 bp, synthetic construct
  misc_feature 1..20: note = CRISPR gRNA sequence
  source 1..20: mol_type = other DNA
cattgaccaaagcaagtttc

SEQ ID NO: 62358 - DNA, 20 bp, synthetic construct
  misc_feature 1..20: note = CRISPR gRNA sequence
  source 1..20: mol_type = other DNA
attgaccaaagcaagtttca

SEQ ID NO: 62359 - DNA, 20 bp, synthetic construct
  misc_feature 1..20: note = CRISPR gRNA sequence
  source 1..20: mol_type = other DNA
accaaagcaagtttcatggc

SEQ ID NO: 62360 - DNA, 20 bp, synthetic construct
  misc_feature 1..20: note = CRISPR gRNA sequence
  source 1..20: mol_type = other DNA
catggctgtgcccaatttca

SEQ ID NO: 62361 - DNA, 20 bp, synthetic construct
  misc_feature 1..20: note = CRISPR gRNA sequence
  source 1..20: mol_type = other DNA
atggctgtgcccaatttcaa

SEQ ID NO: 62362 - DNA, 20 bp, synthetic construct
  misc_feature 1..20: note = CRISPR gRNA sequence
  source 1..20: mol_type = other DNA
tgcccaatttcaaggaggca

SEQ ID NO: 62363 - DNA, 20 bp, synthetic construct
  misc_feature 1..20: note = CRISPR gRNA sequence
  source 1..20: mol_type = other DNA
caaggaggcagagaagtgta

SEQ ID NO: 62364 - DNA, 20 bp, synthetic construct
  misc_feature 1..20: note = CRISPR gRNA sequence
  source 1..20: mol_type = other DNA
aaggaggcagagaagtgtaa

SEQ ID NO: 62365 - DNA, 20 bp, synthetic construct
  misc_feature 1..20: note = CRISPR gRNA sequence
  source 1..20: mol_type = other DNA
gaaagaggagaaagagtatc

SEQ ID NO: 62366 - DNA, 20 bp, synthetic construct
  misc_feature 1..20: note = CRISPR gRNA sequence
  source 1..20: mol_type = other DNA
tgaacagccctaatgcctac

SEQ ID NO: 62367 - DNA, 20 bp, synthetic construct
  misc_feature 1..20: note = CRISPR gRNA sequence
  source 1..20: mol_type = other DNA
atgcctaccacagagaatta

SEQ ID NO: 62368 - DNA, 20 bp, synthetic construct
  misc_feature 1..20: note = CRISPR gRNA sequence
  source 1..20: mol_type = other DNA
ccacagagaattagtaacag

SEQ ID NO: 62369 - DNA, 20 bp, synthetic construct
  misc_feature 1..20: note = CRISPR gRNA sequence
  source 1..20: mol_type = other DNA
gtaacagagctgggccatgg

SEQ ID NO: 62370 - DNA, 20 bp, synthetic construct
  misc_feature 1..20: note = CRISPR gRNA sequence
  source 1..20: mol_type = other DNA
ggccatggatctttcaacca

SEQ ID NO: 62371 - DNA, 20 bp, synthetic construct
  misc_feature 1..20: note = CRISPR gRNA sequence
  source 1..20: mol_type = other DNA
tcaaccatcgtcctctgtct

SEQ ID NO: 62372 - DNA, 20 bp, synthetic construct
  misc_feature 1..20: note = CRISPR gRNA sequence
  source 1..20: mol_type = other DNA
caaccatcgtcctctgtctc

SEQ ID NO: 62373 - DNA, 20 bp, synthetic construct
  misc_feature 1..20: note = CRISPR gRNA sequence
  source 1..20: mol_type = other DNA
aaccatcgtcctctgtctcc

SEQ ID NO: 62374 - DNA, 20 bp, synthetic construct
  misc_feature 1..20: note = CRISPR gRNA sequence
  source 1..20: mol_type = other DNA
tgtctccaagattattcccc

SEQ ID NO: 62375 - DNA, 20 bp, synthetic construct
  misc_feature 1..20: note = CRISPR gRNA sequence
  source 1..20: mol_type = other DNA
tctccaagattattccccat

SEQ ID NO: 62376 - DNA, 20 bp, synthetic construct
  misc_feature 1..20: note = CRISPR gRNA sequence
  source 1..20: mol_type = other DNA
caagattattccccatggaa

SEQ ID NO: 62377 - DNA, 20 bp, synthetic construct
  misc_feature 1..20: note = CRISPR gRNA sequence
  source 1..20: mol_type = other DNA
ttccccatggaaatctcaat

SEQ ID NO: 62378 - DNA, 20 bp, synthetic construct
  misc_feature 1..20: note = CRISPR gRNA sequence
  source 1..20: mol_type = other DNA
cccatggaaatctcaatgac

SEQ ID NO: 62379 - DNA, 20 bp, synthetic construct
  misc_feature 1..20: note = CRISPR gRNA sequence
  source 1..20: mol_type = other DNA
aatgactgataatgatgcca

SEQ ID NO: 62380 - DNA, 20 bp, synthetic construct
  misc_feature 1..20: note = CRISPR gRNA sequence
  source 1..20: mol_type = other DNA
ataatgatgccatgtgcttt

SEQ ID NO: 62381 - DNA, 20 bp, synthetic construct
  misc_feature 1..20: note = CRISPR gRNA sequence
  source 1..20: mol_type = other DNA
tttctcctgaggatggttag

SEQ ID NO: 62382 - DNA, 20 bp, synthetic construct
  misc_feature 1..20: note = CRISPR gRNA sequence
  source 1..20: mol_type = other DNA
ttctcctgaggatggttagc

SEQ ID NO: 62383 - DNA, 20 bp, synthetic construct
  misc_feature 1..20: note = CRISPR gRNA sequence
  source 1..20: mol_type = other DNA
tctcctgaggatggttagcc

SEQ ID NO: 62384 - DNA, 20 bp, synthetic construct
  misc_feature 1..20: note = CRISPR gRNA sequence
  source 1..20: mol_type = other DNA
ctcctgaggatggttagcct

SEQ ID NO: 62385 - DNA, 20 bp, synthetic construct
  misc_feature 1..20: note = CRISPR gRNA sequence
  source 1..20: mol_type = other DNA
tcctgaggatggttagcctt

SEQ ID NO: 62386 - DNA, 20 bp, synthetic construct
  misc_feature 1..20: note = CRISPR gRNA sequence
  source 1..20: mol_type = other DNA
ctgaggatggttagccttaa

SEQ ID NO: 62387 - DNA, 20 bp, synthetic construct
  misc_feature 1..20: note = CRISPR gRNA sequence
  source 1..20: mol_type = other DNA
aggatggttagccttaaaga

SEQ ID NO: 62388 - DNA, 20 bp, synthetic construct
  misc_feature 1..20: note = CRISPR gRNA sequence
  source 1..20: mol_type = other DNA
gccttaaagagatttgtgtc

SEQ ID NO: 62389 - DNA, 20 bp, synthetic construct
  misc_feature 1..20: note = CRISPR gRNA sequence
  source 1..20: mol_type = other DNA
aaagagatttgtgtcatatc

SEQ ID NO: 62390 - DNA, 20 bp, synthetic construct
  misc_feature 1..20: note = CRISPR gRNA sequence
  source 1..20: mol_type = other DNA
aagagatttgtgtcatatcc

SEQ ID NO: 62391 - DNA, 20 bp, synthetic construct
  misc_feature 1..20: note = CRISPR gRNA sequence
  source 1..20: mol_type = other DNA
gtgtcatatcctaaggggat

SEQ ID NO: 62392 - DNA, 20 bp, synthetic construct
  misc_feature 1..20: note = CRISPR gRNA sequence
  source 1..20: mol_type = other DNA
tgtcatatcctaaggggata

SEQ ID NO: 62393 - DNA, 20 bp, synthetic construct
  misc_feature 1..20: note = CRISPR gRNA sequence
  source 1..20: mol_type = other DNA
aggggatagaacactaatga

SEQ ID NO: 62394 - DNA, 20 bp, synthetic construct
  misc_feature 1..20: note = CRISPR gRNA sequence
  source 1..20: mol_type = other DNA
atgatggaaacaaaggtatt

SEQ ID NO: 62395 - DNA, 20 bp, synthetic construct
  misc_feature 1..20: note = CRISPR gRNA sequence
  source 1..20: mol_type = other DNA
tgttagactggctggaggag

SEQ ID NO: 62396 - DNA, 20 bp, synthetic construct
  misc_feature 1..20: note = CRISPR gRNA sequence
  source 1..20: mol_type = other DNA
gactggctggaggagaaatt

SEQ ID NO: 62397 - DNA, 20 bp, synthetic construct
  misc_feature 1..20: note = CRISPR gRNA sequence
  source 1..20: mol_type = other DNA
gctggaggagaaatttgagg

SEQ ID NO: 62398 - DNA, 20 bp, synthetic construct
  misc_feature 1..20: note = CRISPR gRNA sequence
  source 1..20: mol_type = other DNA
gaggagaaatttgaggatga

SEQ ID NO: 62399 - DNA, 20 bp, synthetic construct
  misc_feature 1..20: note = CRISPR gRNA sequence
  source 1..20: mol_type = other DNA
gaggatgagaaacatcacca

SEQ ID NO: 62400 - DNA, 20 bp, synthetic construct
  misc_feature 1..20: note = CRISPR gRNA sequence
  source 1..20: mol_type = other DNA
aggatgagaaacatcaccag

SEQ ID NO: 62401 - DNA, 20 bp, synthetic construct
  misc_feature 1..20: note = CRISPR gRNA sequence
  source 1..20: mol_type = other DNA
cttacttccatctggtgcca

SEQ ID NO: 62402 - DNA, 20 bp, synthetic construct
  misc_feature 1..20: note = CRISPR gRNA sequence
  source 1..20: mol_type = other DNA
acttccatctggtgccatgc

SEQ ID NO: 62403 - DNA, 20 bp, synthetic construct
  misc_feature 1..20: note = CRISPR gRNA sequence
  source 1..20: mol_type = other DNA
cttccatctggtgccatgct

SEQ ID NO: 62404 - DNA, 20 bp, synthetic construct
  misc_feature 1..20: note = CRISPR gRNA sequence
  source 1..20: mol_type = other DNA
ccatctggtgccatgctgcc

SEQ ID NO: 62405 - DNA, 20 bp, synthetic construct
  misc_feature 1..20: note = CRISPR gRNA sequence
  source 1..20: mol_type = other DNA
catctggtgccatgctgccc

SEQ ID NO: 62406 - DNA, 20 bp, synthetic construct
  misc_feature 1..20: note = CRISPR gRNA sequence
  source 1..20: mol_type = other DNA
gtgccatgctgccctggacc

SEQ ID NO: 62407 - DNA, 20 bp, synthetic construct
  misc_feature 1..20: note = CRISPR gRNA sequence
  source 1..20: mol_type = other DNA
ccctggaccatttcttcatg

SEQ ID NO: 62408 - DNA, 20 bp, synthetic construct
  misc_feature 1..20: note = CRISPR gRNA sequence
  source 1..20: mol_type = other DNA
gaccatttcttcatgggtag

SEQ ID NO: 62409 - DNA, 20 bp, synthetic construct
  misc_feature 1..20: note = CRISPR gRNA sequence
  source 1..20: mol_type = other DNA
cttcatgggtagcatggatg

SEQ ID NO: 62410 - DNA, 20 bp, synthetic construct
  misc_feature 1..20: note = CRISPR gRNA sequence
  source 1..20: mol_type = other DNA
ttcatgggtagcatggatgc

SEQ ID NO: 62411 - DNA, 20 bp, synthetic construct
  misc_feature 1..20: note = CRISPR gRNA sequence
  source 1..20: mol_type = other DNA
catgggtagcatggatgctg

SEQ ID NO: 62412 - DNA, 20 bp, synthetic construct
  misc_feature 1..20: note = CRISPR gRNA sequence
  source 1..20: mol_type = other DNA
atgggtagcatggatgctgg

SEQ ID NO: 62413 - DNA, 20 bp, synthetic construct
  misc_feature 1..20: note = CRISPR gRNA sequence
  source 1..20: mol_type = other DNA
gacaccatagcctggaaaag

SEQ ID NO: 62414 - DNA, 20 bp, synthetic construct
  misc_feature 1..20: note = CRISPR gRNA sequence
  source 1..20: mol_type = other DNA
gaaaagaagttatgccctag

SEQ ID NO: 62415 - DNA, 20 bp, synthetic construct
  misc_feature 1..20: note = CRISPR gRNA sequence
  source 1..20: mol_type = other DNA
tgccctaggctatggccaca

SEQ ID NO: 62416 - DNA, 20 bp, synthetic construct
  misc_feature 1..20: note = CRISPR gRNA sequence
  source 1..20: mol_type = other DNA
ggctatggccacatcctttt

SEQ ID NO: 62417 - DNA, 20 bp, synthetic construct
  misc_feature 1..20: note = CRISPR gRNA sequence
  source 1..20: mol_type = other DNA
tggccacatccttttgccga

SEQ ID NO: 62418 - DNA, 20 bp, synthetic construct
  misc_feature 1..20: note = CRISPR gRNA sequence
  source 1..20: mol_type = other DNA
ttgccgagatcacacaaaat

SEQ ID NO: 62419 - DNA, 20 bp, synthetic construct
  misc_feature 1..20: note = CRISPR gRNA sequence
  source 1..20: mol_type = other DNA
tgccgagatcacacaaaatc

SEQ ID NO: 62420 - DNA, 20 bp, synthetic construct
  misc_feature 1..20: note = CRISPR gRNA sequence
  source 1..20: mol_type = other DNA
gccgagatcacacaaaatcc

SEQ ID NO: 62421 - DNA, 20 bp, synthetic construct
  misc_feature 1..20: note = CRISPR gRNA sequence
  source 1..20: mol_type = other DNA
ccgagatcacacaaaatcca

SEQ ID NO: 62422 - DNA, 20 bp, synthetic construct
  misc_feature 1..20: note = CRISPR gRNA sequence
  source 1..20: mol_type = other DNA
agccttgtctggtgccatct

SEQ ID NO: 62423 - DNA, 20 bp, synthetic construct
  misc_feature 1..20: note = CRISPR gRNA sequence
  source 1..20: mol_type = other DNA
gccttgtctggtgccatcta

SEQ ID NO: 62424 - DNA, 20 bp, synthetic construct
  misc_feature 1..20: note = CRISPR gRNA sequence
  source 1..20: mol_type = other DNA
gtctggtgccatctaggcct

SEQ ID NO: 62425 - DNA, 20 bp, synthetic construct
  misc_feature 1..20: note = CRISPR gRNA sequence
  source 1..20: mol_type = other DNA
tctggtgccatctaggcctc

SEQ ID NO: 62426 - DNA, 20 bp, synthetic construct
  misc_feature 1..20: note = CRISPR gRNA sequence
  source 1..20: mol_type = other DNA
gtgccatctaggcctccaag

SEQ ID NO: 62427 - DNA, 20 bp, synthetic construct
  misc_feature 1..20: note = CRISPR gRNA sequence
  source 1..20: mol_type = other DNA
ggcctccaaggccttggaaa

SEQ ID NO: 62428 - DNA, 20 bp, synthetic construct
  misc_feature 1..20: note = CRISPR gRNA sequence
  source 1..20: mol_type = other DNA
caaggccttggaaatttact

SEQ ID NO: 62429 - DNA, 20 bp, synthetic construct
  misc_feature 1..20: note = CRISPR gRNA sequence
  source 1..20: mol_type = other DNA
ggaaatttactggcctggga

SEQ ID NO: 62430 - DNA, 20 bp, synthetic construct
  misc_feature 1..20: note = CRISPR gRNA sequence
  source 1..20: mol_type = other DNA
gaaatttactggcctgggag

SEQ ID NO: 62431 - DNA, 20 bp, synthetic construct
  misc_feature 1..20: note = CRISPR gRNA sequence
  source 1..20: mol_type = other DNA
actggcctgggaggcaagaa

SEQ ID NO: 62432 - DNA, 20 bp, synthetic construct
  misc_feature 1..20: note = CRISPR gRNA sequence
  source 1..20: mol_type = other DNA
ctggcctgggaggcaagaaa

SEQ ID NO: 62433 - DNA, 20 bp, synthetic construct
  misc_feature 1..20: note = CRISPR gRNA sequence
  source 1..20: mol_type = other DNA
gcctgggaggcaagaaacct

SEQ ID NO: 62434 - DNA, 20 bp, synthetic construct
  misc_feature 1..20: note = CRISPR gRNA sequence
  source 1..20: mol_type = other DNA
ggaggcaagaaacctcagtt

SEQ ID NO: 62435 - DNA, 20 bp, synthetic construct
  misc_feature 1..20: note = CRISPR gRNA sequence
  source 1..20: mol_type = other DNA
agttctcctcctgcctctgt

SEQ ID NO: 62436 - DNA, 20 bp, synthetic construct
  misc_feature 1..20: note = CRISPR gRNA sequence
  source 1..20: mol_type = other DNA
tcctcctgcctctgtcatgg

SEQ ID NO: 62437 - DNA, 20 bp, synthetic construct
  misc_feature 1..20: note = CRISPR gRNA sequence
  source 1..20: mol_type = other DNA
ctcctgcctctgtcatggac

SEQ ID NO: 62438 - DNA, 20 bp, synthetic construct
  misc_feature 1..20: note = CRISPR gRNA sequence
  source 1..20: mol_type = other DNA
ctgcctctgtcatggacttg

SEQ ID NO: 62439 - DNA, 20 bp, synthetic construct
  misc_feature 1..20: note = CRISPR gRNA sequence
  source 1..20: mol_type = other DNA
cctctgtcatggacttgctg

SEQ ID NO: 62440 - DNA, 20 bp, synthetic construct
  misc_feature 1..20: note = CRISPR gRNA sequence
  source 1..20: mol_type = other DNA
tgtcatggacttgctgtgtg

SEQ ID NO: 62441 - DNA, 20 bp, synthetic construct
  misc_feature 1..20: note = CRISPR gRNA sequence
  source 1..20: mol_type = other DNA
tcatggacttgctgtgtgac

SEQ ID NO: 62442 - DNA, 20 bp, synthetic construct
  misc_feature 1..20: note = CRISPR gRNA sequence
  source 1..20: mol_type = other DNA
gctgtgtgactgtgggcaca

SEQ ID NO: 62443 - DNA, 20 bp, synthetic construct
  misc_feature 1..20: note = CRISPR gRNA sequence
  source 1..20: mol_type = other DNA
ctgtgtgactgtgggcacac

SEQ ID NO: 62444 - DNA, 20 bp, synthetic construct
  misc_feature 1..20: note = CRISPR gRNA sequence
  source 1..20: mol_type = other DNA
tgtgactgtgggcacaccct

SEQ ID NO: 62445 - DNA, 20 bp, synthetic construct
  misc_feature 1..20: note = CRISPR gRNA sequence
  source 1..20: mol_type = other DNA
tgggcacaccctttgccctt

SEQ ID NO: 62446 - DNA, 20 bp, synthetic construct
  misc_feature 1..20: note = CRISPR gRNA sequence
  source 1..20: mol_type = other DNA
tgcccttccttggccatggt

SEQ ID NO: 62447 - DNA, 20 bp, synthetic construct
  misc_feature 1..20: note = CRISPR gRNA sequence
  source 1..20: mol_type = other DNA
gcccttccttggccatggtc

SEQ ID NO: 62448 - DNA, 20 bp, synthetic construct
  misc_feature 1..20: note = CRISPR gRNA sequence
  source 1..20: mol_type = other DNA
cccttccttggccatggtct

SEQ ID NO: 62449 - DNA, 20 bp, synthetic construct
  misc_feature 1..20: note = CRISPR gRNA sequence
  source 1..20: mol_type = other DNA
ccttggccatggtctttccg

SEQ ID NO: 62450 - DNA, 20 bp, synthetic construct
  misc_feature 1..20: note = CRISPR gRNA sequence
  source 1..20: mol_type = other DNA
cttggccatggtctttccgt

SEQ ID NO: 62451 - DNA, 20 bp, synthetic construct
  misc_feature 1..20: note = CRISPR gRNA sequence
  source 1..20: mol_type = other DNA
ggccatggtctttccgtctg

SEQ ID NO: 62452 - DNA, 20 bp, synthetic construct
  misc_feature 1..20: note = CRISPR gRNA sequence
  source 1..20: mol_type = other DNA
gccatggtctttccgtctgc

SEQ ID NO: 62453 - DNA, 20 bp, synthetic construct
  misc_feature 1..20: note = CRISPR gRNA sequence
  source 1..20: mol_type = other DNA
tccgtctgcttagtggaggt

SEQ ID NO: 62454 - DNA, 20 bp, synthetic construct
  misc_feature 1..20: note = CRISPR gRNA sequence
  source 1..20: mol_type = other DNA
ccgtctgcttagtggaggtg

SEQ ID NO: 62455 - DNA, 20 bp, synthetic construct
  misc_feature 1..20: note = CRISPR gRNA sequence
  source 1..20: mol_type = other DNA
cgtctgcttagtggaggtgg

SEQ ID NO: 62456 - DNA, 20 bp, synthetic construct
  misc_feature 1..20: note = CRISPR gRNA sequence
  source 1..20: mol_type = other DNA
cttagtggaggtggtgatcc

SEQ ID NO: 62457 - DNA, 20 bp, synthetic construct
  misc_feature 1..20: note = CRISPR gRNA sequence
  source 1..20: mol_type = other DNA
agtggaggtggtgatccctg

SEQ ID NO: 62458 - DNA, 20 bp, synthetic construct
  misc_feature 1..20: note = CRISPR gRNA sequence
  source 1..20: mol_type = other DNA
gtggaggtggtgatccctgc

SEQ ID NO: 62459 - DNA, 20 bp, synthetic construct
  misc_feature 1..20: note = CRISPR gRNA sequence
  source 1..20: mol_type = other DNA
cctgaggatcatggtgtgag

SEQ ID NO: 62460 - DNA, 20 bp, synthetic construct
  misc_feature 1..20: note = CRISPR gRNA sequence
  source 1..20: mol_type = other DNA
aggatcatggtgtgagcatg

SEQ ID NO: 62461 - DNA, 20 bp, synthetic construct
  misc_feature 1..20: note = CRISPR gRNA sequence
  source 1..20: mol_type = other DNA
cataaattctaagactctct

SEQ ID NO: 62462 - DNA, 20 bp, synthetic construct
  misc_feature 1..20: note = CRISPR gRNA sequence
  source 1..20: mol_type = other DNA
ataaattctaagactctctg

SEQ ID NO: 62463 - DNA, 20 bp, synthetic construct
  misc_feature 1..20: note = CRISPR gRNA sequence
  source 1..20: mol_type = other DNA
taagactctctgcctgagtg

SEQ ID NO: 62464 - DNA, 20 bp, synthetic construct
  misc_feature 1..20: note = CRISPR gRNA sequence
  source 1..20: mol_type = other DNA
agactctctgcctgagtgag

SEQ ID NO: 62465 - DNA, 20 bp, synthetic construct
  misc_feature 1..20: note = CRISPR gRNA sequence
  source 1..20: mol_type = other DNA
tctgcctgagtgaggaccta

SEQ ID NO: 62466 - DNA, 20 bp, synthetic construct
  misc_feature 1..20: note = CRISPR gRNA sequence
  source 1..20: mol_type = other DNA
tgcctgagtgaggacctatt

SEQ ID NO: 62467 - DNA, 20 bp, synthetic construct
  misc_feature 1..20: note = CRISPR gRNA sequence
  source 1..20: mol_type = other DNA
cctgagtgaggacctattgc

SEQ ID NO: 62468 - DNA, 20 bp, synthetic construct
  misc_feature 1..20: note = CRISPR gRNA sequence
  source 1..20: mol_type = other DNA
agtgaggacctattgctatt

SEQ ID NO: 62469 - DNA, 20 bp, synthetic construct
  misc_feature 1..20: note = CRISPR gRNA sequence
  source 1..20: mol_type = other DNA
ttgctattagcccagttgag

SEQ ID NO: 62470 - DNA, 20 bp, synthetic construct
  misc_feature 1..20: note = CRISPR gRNA sequence
  source 1..20: mol_type = other DNA
ctattagcccagttgaggag

SEQ ID NO: 62471 - DNA, 20 bp, synthetic construct
  misc_feature 1..20: note = CRISPR gRNA sequence
  source 1..20: mol_type = other DNA
ttagcccagttgaggagaaa

SEQ ID NO: 62472 - DNA, 20 bp, synthetic construct
  misc_feature 1..20: note = CRISPR gRNA sequence
  source 1..20: mol_type = other DNA
gcccagttgaggagaaatga

SEQ ID NO: 62473 - DNA, 20 bp, synthetic construct
  misc_feature 1..20: note = CRISPR gRNA sequence
  source 1..20: mol_type = other DNA
aggagaaatgaccagtgggg

SEQ ID NO: 62474 - DNA, 20 bp, synthetic construct
  misc_feature 1..20: note = CRISPR gRNA sequence
  source 1..20: mol_type = other DNA
acagtacatccaagtatgtc

SEQ ID NO: 62475 - DNA, 20 bp, synthetic construct
  misc_feature 1..20: note = CRISPR gRNA sequence
  source 1..20: mol_type = other DNA
tactgcatgcccagggagca

SEQ ID NO: 62476 - DNA, 20 bp, synthetic construct
  misc_feature 1..20: note = CRISPR gRNA sequence
  source 1..20: mol_type = other DNA
ctgcatgcccagggagcagc

SEQ ID NO: 62477 - DNA, 20 bp, synthetic construct
  misc_feature 1..20: note = CRISPR gRNA sequence
  source 1..20: mol_type = other DNA
catgcccagggagcagctgg

SEQ ID NO: 62478 - DNA, 20 bp, synthetic construct
  misc_feature 1..20: note = CRISPR gRNA sequence
  source 1..20: mol_type = other DNA
ggctctaaaccccaggacgc

SEQ ID NO: 62479 - DNA, 20 bp, synthetic construct
  misc_feature 1..20: note = CRISPR gRNA sequence
  source 1..20: mol_type = other DNA
taaaccccaggacgcatagt

SEQ ID NO: 62480 - DNA, 20 bp, synthetic construct
  misc_feature 1..20: note = CRISPR gRNA sequence
  source 1..20: mol_type = other DNA
aaccccaggacgcatagtac

SEQ ID NO: 62481 - DNA, 20 bp, synthetic construct
  misc_feature 1..20: note = CRISPR gRNA sequence
  source 1..20: mol_type = other DNA
gcctcagcctctgggaattg

SEQ ID NO: 62482 - DNA, 20 bp, synthetic construct
  misc_feature 1..20: note = CRISPR gRNA sequence
  source 1..20: mol_type = other DNA
agcctctgggaattgggaag

SEQ ID NO: 62483 - DNA, 20 bp, synthetic construct
  misc_feature 1..20: note = CRISPR gRNA sequence
  source 1..20: mol_type = other DNA
tgggaattgggaaggctggc

SEQ ID NO: 62484 - DNA, 20 bp, synthetic construct
  misc_feature 1..20: note = CRISPR gRNA sequence
  source 1..20: mol_type = other DNA
ggaattgggaaggctggctt

SEQ ID NO: 62485 - DNA, 20 bp, synthetic construct
  misc_feature 1..20: note = CRISPR gRNA sequence
  source 1..20: mol_type = other DNA
ggaaggctggcttctgggtg

SEQ ID NO: 62486 - DNA, 20 bp, synthetic construct
  misc_feature 1..20: note = CRISPR gRNA sequence
  source 1..20: mol_type = other DNA
gcttctgggtggacctccta

SEQ ID NO: 62487 - DNA, 20 bp, synthetic construct
  misc_feature 1..20: note = CRISPR gRNA sequence
  source 1..20: mol_type = other DNA
ctgggtggacctcctactct

SEQ ID NO: 62488 - DNA, 20 bp, synthetic construct
  misc_feature 1..20: note = CRISPR gRNA sequence
  source 1..20: mol_type = other DNA
tgggtggacctcctactctt

SEQ ID NO: 62489 - DNA, 20 bp, synthetic construct
  misc_feature 1..20: note = CRISPR gRNA sequence
  source 1..20: mol_type = other DNA
ggtggacctcctactctttt

SEQ ID NO: 62490 - DNA, 20 bp, synthetic construct
  misc_feature 1..20: note = CRISPR gRNA sequence
  source 1..20: mol_type = other DNA
ctactcttttcagagttaga

SEQ ID NO: 62491 - DNA, 20 bp, synthetic construct
  misc_feature 1..20: note = CRISPR gRNA sequence
  source 1..20: mol_type = other DNA
ctcttttcagagttagaggt

SEQ ID NO: 62492 - DNA, 20 bp, synthetic construct
  misc_feature 1..20: note = CRISPR gRNA sequence
  source 1..20: mol_type = other DNA
ttttcagagttagaggtgga

SEQ ID NO: 62493 - DNA, 20 bp, synthetic construct
  misc_feature 1..20: note = CRISPR gRNA sequence
  source 1..20: mol_type = other DNA
ttcagagttagaggtggact

SEQ ID NO: 62494 - DNA, 20 bp, synthetic construct
  misc_feature 1..20: note = CRISPR gRNA sequence
  source 1..20: mol_type = other DNA
tcagagttagaggtggactc

SEQ ID NO: 62495 - DNA, 20 bp, synthetic construct
  misc_feature 1..20: note = CRISPR gRNA sequence
  source 1..20: mol_type = other DNA
cagagttagaggtggactct

SEQ ID NO: 62496 - DNA, 20 bp, synthetic construct
  misc_feature 1..20: note = CRISPR gRNA sequence
  source 1..20: mol_type = other DNA
agagttagaggtggactctc

SEQ ID NO: 62497 - DNA, 20 bp, synthetic construct
  misc_feature 1..20: note = CRISPR gRNA sequence
  source 1..20: mol_type = other DNA
gaggtggactctctggagtt

SEQ ID NO: 62498 - DNA, 20 bp, synthetic construct
  misc_feature 1..20: note = CRISPR gRNA sequence
  source 1..20: mol_type = other DNA
tctggagttgtgaggataaa

SEQ ID NO: 62499 - DNA, 20 bp, synthetic construct
  misc_feature 1..20: note = CRISPR gRNA sequence
  source 1..20: mol_type = other DNA
tggagttgtgaggataaaat

SEQ ID NO: 62500 - DNA, 20 bp, synthetic construct
  misc_feature 1..20: note = CRISPR gRNA sequence
  source 1..20: mol_type = other DNA
gagttgtgaggataaaataa

SEQ ID NO: 62501 - DNA, 20 bp, synthetic construct
  misc_feature 1..20: note = CRISPR gRNA sequence
  source 1..20: mol_type = other DNA
tgaggataaaataaggtata

SEQ ID NO: 62502 - DNA, 20 bp, synthetic construct
  misc_feature 1..20: note = CRISPR gRNA sequence
  source 1..20: mol_type = other DNA
agacagtgcctaatacacag

SEQ ID NO: 62503 - DNA, 20 bp, synthetic construct
  misc_feature 1..20: note = CRISPR gRNA sequence
  source 1..20: mol_type = other DNA
gacagtgcctaatacacagt

SEQ ID NO: 62504 - DNA, 20 bp, synthetic construct
  misc_feature 1..20: note = CRISPR gRNA sequence
  source 1..20: mol_type = other DNA
atacacagtgagtgctttcc

SEQ ID NO: 62505 - DNA, 20 bp, synthetic construct
  misc_feature 1..20: note = CRISPR gRNA sequence
  source 1..20: mol_type = other DNA
tccaagtgtgtactgctatg

SEQ ID NO: 62506 - DNA, 20 bp, synthetic construct
  misc_feature 1..20: note = CRISPR gRNA sequence
  source 1..20: mol_type = other DNA
ccaagtgtgtactgctatga

SEQ ID NO: 62507 - DNA, 20 bp, synthetic construct
  misc_feature 1..20: note = CRISPR gRNA sequence
  source 1..20: mol_type = other DNA
caagtgtgtactgctatgag

SEQ ID NO: 62508 - DNA, 20 bp, synthetic construct
  misc_feature 1..20: note = CRISPR gRNA sequence
  source 1..20: mol_type = other DNA
ctatgaggaaggacatagta

SEQ ID NO: 62509 - DNA, 20 bp, synthetic construct
  misc_feature 1..20: note = CRISPR gRNA sequence
  source 1..20: mol_type = other DNA
tgaggaaggacatagtacca

SEQ ID NO: 62510 - DNA, 20 bp, synthetic construct
  misc_feature 1..20: note = CRISPR gRNA sequence
  source 1..20: mol_type = other DNA
gatgatggaccaccatttag

SEQ ID NO: 62511 - DNA, 20 bp, synthetic construct
  misc_feature 1..20: note = CRISPR gRNA sequence
  source 1..20: mol_type = other DNA
agttggccaatccccaactg

SEQ ID NO: 62512 - DNA, 20 bp, synthetic construct
  misc_feature 1..20: note = CRISPR gRNA sequence
  source 1..20: mol_type = other DNA
gttggccaatccccaactgt

SEQ ID NO: 62513 - DNA, 20 bp, synthetic construct
  misc_feature 1..20: note = CRISPR gRNA sequence
  source 1..20: mol_type = other DNA
gccaatccccaactgttgga

SEQ ID NO: 62514 - DNA, 20 bp, synthetic construct
  misc_feature 1..20: note = CRISPR gRNA sequence
  source 1..20: mol_type = other DNA
ttggacatttaggttgtttc

SEQ ID NO: 62515 - DNA, 20 bp, synthetic construct
  misc_feature 1..20: note = CRISPR gRNA sequence
  source 1..20: mol_type = other DNA
gacatttaggttgtttccaa

SEQ ID NO: 62516 - DNA, 20 bp, synthetic construct
  misc_feature 1..20: note = CRISPR gRNA sequence
  source 1..20: mol_type = other DNA
aggttgtttccaatttttaa

SEQ ID NO: 62517 - DNA, 20 bp, synthetic construct
  misc_feature 1..20: note = CRISPR gRNA sequence
  source 1..20: mol_type = other DNA
ggttgtttccaatttttaat

SEQ ID NO: 62518 - DNA, 20 bp, synthetic construct
  misc_feature 1..20: note = CRISPR gRNA sequence
  source 1..20: mol_type = other DNA
tttccaatttttaataatta

SEQ ID NO: 62519 - DNA, 20 bp, synthetic construct
  misc_feature 1..20: note = CRISPR gRNA sequence
  source 1..20: mol_type = other DNA
ccaatttttaataattataa

SEQ ID NO: 62520 - DNA, 20 bp, synthetic construct
  misc_feature 1..20: note = CRISPR gRNA sequence
  source 1..20: mol_type = other DNA
caatttttaataattataaa

SEQ ID NO: 62521 - DNA, 20 bp, synthetic construct
  misc_feature 1..20: note = CRISPR gRNA sequence
  source 1..20: mol_type = other DNA
ttaataattataaataatct

SEQ ID NO: 62522 - DNA, 20 bp, synthetic construct
  misc_feature 1..20: note = CRISPR gRNA sequence
  source 1..20: mol_type = other DNA
taataattataaataatctt

SEQ ID NO: 62523 - DNA, 20 bp, synthetic construct
  misc_feature 1..20: note = CRISPR gRNA sequence
  source 1..20: mol_type = other DNA
aataattataaataatcttg

SEQ ID NO: 62524 - DNA, 20 bp, synthetic construct
  misc_feature 1..20: note = CRISPR gRNA sequence
  source 1..20: mol_type = other DNA
ataattataaataatcttgc

SEQ ID NO: 62525 - DNA, 20 bp, synthetic construct
  misc_feature 1..20: note = CRISPR gRNA sequence
  source 1..20: mol_type = other DNA
taaataatcttgcagtgagc

SEQ ID NO: 62526 - DNA, 20 bp, synthetic construct
  misc_feature 1..20: note = CRISPR gRNA sequence
  source 1..20: mol_type = other DNA
gcagtgagcatctttgcaat

SEQ ID NO: 62527 - DNA, 20 bp, synthetic construct
  misc_feature 1..20: note = CRISPR gRNA sequence
  source 1..20: mol_type = other DNA
cagtgagcatctttgcaatt

SEQ ID NO: 62528 - DNA, 20 bp, synthetic construct
  misc_feature 1..20: note = CRISPR gRNA sequence
  source 1..20: mol_type = other DNA
tgcaattaaatattgtatat

SEQ ID NO: 62529 - DNA, 20 bp, synthetic construct
  misc_feature 1..20: note = CRISPR gRNA sequence
  source 1..20: mol_type = other DNA
gcaattaaatattgtatata

SEQ ID NO: 62530 - DNA, 20 bp, synthetic construct
  misc_feature 1..20: note = CRISPR gRNA sequence
  source 1..20: mol_type = other DNA
caattaaatattgtatatac

SEQ ID NO: 62531 - DNA, 20 bp, synthetic construct
  misc_feature 1..20: note = CRISPR gRNA sequence
  source 1..20: mol_type = other DNA
aatattgtatatacgttcat

SEQ ID NO: 62532 - DNA, 20 bp, synthetic construct
  misc_feature 1..20: note = CRISPR gRNA sequence
  source 1..20: mol_type = other DNA
tatatacgttcatgatcgtt

SEQ ID NO: 62533 - DNA, 20 bp, synthetic construct
  misc_feature 1..20: note = CRISPR gRNA sequence
  source 1..20: mol_type = other DNA
atgatcgtttgccaaggtta

SEQ ID NO: 62534 - DNA, 20 bp, synthetic construct
  misc_feature 1..20: note = CRISPR gRNA sequence
  source 1..20: mol_type = other DNA
gccaaggttagagtcctaga

SEQ ID NO: 62535 - DNA, 20 bp, synthetic construct
  misc_feature 1..20: note = CRISPR gRNA sequence
  source 1..20: mol_type = other DNA
ccaaggttagagtcctagaa

SEQ ID NO: 62536 - DNA, 20 bp, synthetic construct
  misc_feature 1..20: note = CRISPR gRNA sequence
  source 1..20: mol_type = other DNA
gagtcctagaaatggaatta

SEQ ID NO: 62537 - DNA, 20 bp, synthetic construct
  misc_feature 1..20: note = CRISPR gRNA sequence
  source 1..20: mol_type = other DNA
gaaatggaattactgaatca

SEQ ID NO: 62538 - DNA, 20 bp, synthetic construct
  misc_feature 1..20: note = CRISPR gRNA sequence
  source 1..20: mol_type = other DNA
ctgaatcaaaggaactgcac

SEQ ID NO: 62539 - DNA, 20 bp, synthetic construct
  misc_feature 1..20: note = CRISPR gRNA sequence
  source 1..20: mol_type = other DNA
aatcaaaggaactgcacatt

SEQ ID NO: 62540 - DNA, 20 bp, synthetic construct
  misc_feature 1..20: note = CRISPR gRNA sequence
  source 1..20: mol_type = other DNA
cacattatttaggcttttgc

SEQ ID NO: 62541 - DNA, 20 bp, synthetic construct
  misc_feature 1..20: note = CRISPR gRNA sequence
  source 1..20: mol_type = other DNA
tttaggcttttgctgtgtaa

SEQ ID NO: 62542 - DNA, 20 bp, synthetic construct
  misc_feature 1..20: note = CRISPR gRNA sequence
  source 1..20: mol_type = other DNA
aggcttttgctgtgtaaatg

SEQ ID NO: 62543 - DNA, 20 bp, synthetic construct
  misc_feature 1..20: note = CRISPR gRNA sequence
  source 1..20: mol_type = other DNA
ggcttttgctgtgtaaatgc

SEQ ID NO: 62544 - DNA, 20 bp, synthetic construct
  misc_feature 1..20: note = CRISPR gRNA sequence
  source 1..20: mol_type = other DNA
ttgctgtgtaaatgccccgt

SEQ ID NO: 62545 - DNA, 20 bp, synthetic construct
  misc_feature 1..20: note = CRISPR gRNA sequence
  source 1..20: mol_type = other DNA
tgctgtgtaaatgccccgtg

SEQ ID NO: 62546 - DNA, 20 bp, synthetic construct
  misc_feature 1..20: note = CRISPR gRNA sequence
  source 1..20: mol_type = other DNA
gctgtgtaaatgccccgtgc

SEQ ID NO: 62547 - DNA, 20 bp, synthetic construct
  misc_feature 1..20: note = CRISPR gRNA sequence
  source 1..20: mol_type = other DNA
ctgtgtaaatgccccgtgcc

SEQ ID NO: 62548 - DNA, 20 bp, synthetic construct
  misc_feature 1..20: note = CRISPR gRNA sequence
  source 1..20: mol_type = other DNA
tgtaaatgccccgtgccctc

SEQ ID NO: 62549 - DNA, 20 bp, synthetic construct
  misc_feature 1..20: note = CRISPR gRNA sequence
  source 1..20: mol_type = other DNA
tattggtacttctagaagga

SEQ ID NO: 62550 - DNA, 20 bp, synthetic construct
  misc_feature 1..20: note = CRISPR gRNA sequence
  source 1..20: mol_type = other DNA
ttggtacttctagaaggagg

SEQ ID NO: 62551 - DNA, 20 bp, synthetic construct
  misc_feature 1..20: note = CRISPR gRNA sequence
  source 1..20: mol_type = other DNA
gtacttctagaaggaggtgg

SEQ ID NO: 62552 - DNA, 20 bp, synthetic construct
  misc_feature 1..20: note = CRISPR gRNA sequence
  source 1..20: mol_type = other DNA
ctagaaggaggtggtttaag

SEQ ID NO: 62553 - DNA, 20 bp, synthetic construct
  misc_feature 1..20: note = CRISPR gRNA sequence
  source 1..20: mol_type = other DNA
tagaaggaggtggtttaaga

SEQ ID NO: 62554 - DNA, 20 bp, synthetic construct
  misc_feature 1..20: note = CRISPR gRNA sequence
  source 1..20: mol_type = other DNA
gaaggaggtggtttaagagt

SEQ ID NO: 62555 - DNA, 20 bp, synthetic construct
  misc_feature 1..20: note = CRISPR gRNA sequence
  source 1..20: mol_type = other DNA
aagagttccagttcggccat

SEQ ID NO: 62556 - DNA, 20 bp, synthetic construct
  misc_feature 1..20: note = CRISPR gRNA sequence
  source 1..20: mol_type = other DNA
agagttccagttcggccatc

SEQ ID NO: 62557 - DNA, 20 bp, synthetic construct
  misc_feature 1..20: note = CRISPR gRNA sequence
  source 1..20: mol_type = other DNA
cagttcggccatcatgatgg

SEQ ID NO: 62558 - DNA, 20 bp, synthetic construct
  misc_feature 1..20: note = CRISPR gRNA sequence
  source 1..20: mol_type = other DNA
ggccatcatgatggctcaca

SEQ ID NO: 62559 - DNA, 20 bp, synthetic construct
  misc_feature 1..20: note = CRISPR gRNA sequence
  source 1..20: mol_type = other DNA
acacctgtaatcccagcact

SEQ ID NO: 62560 - DNA, 20 bp, synthetic construct
  misc_feature 1..20: note = CRISPR gRNA sequence
  source 1..20: mol_type = other DNA
taatcccagcactttgggag

SEQ ID NO: 62561 - DNA, 20 bp, synthetic construct
  misc_feature 1..20: note = CRISPR gRNA sequence
  source 1..20: mol_type = other DNA
tgggaggccgaggtgggcag

SEQ ID NO: 62562 - DNA, 20 bp, synthetic construct
  misc_feature 1..20: note = CRISPR gRNA sequence
  source 1..20: mol_type = other DNA
gggaggccgaggtgggcaga

SEQ ID NO: 62563 - DNA, 20 bp, synthetic construct
  misc_feature 1..20: note = CRISPR gRNA sequence
  source 1..20: mol_type = other DNA
ggaggccgaggtgggcagat

SEQ ID NO: 62564 - DNA, 20 bp, synthetic construct
  misc_feature 1..20: note = CRISPR gRNA sequence
  source 1..20: mol_type = other DNA
aggtcaggagtttgagccca

SEQ ID NO: 62565 - DNA, 20 bp, synthetic construct
  misc_feature 1..20: note = CRISPR gRNA sequence
  source 1..20: mol_type = other DNA
gagcccagcctggccaacat

SEQ ID NO: 62566 - DNA, 20 bp, synthetic construct
  misc_feature 1..20: note = CRISPR gRNA sequence
  source 1..20: mol_type = other DNA
agcccagcctggccaacatg

SEQ ID NO: 62567 - DNA, 20 bp, synthetic construct
  misc_feature 1..20: note = CRISPR gRNA sequence
  source 1..20: mol_type = other DNA
gccaacatggtgaaacccca

SEQ ID NO: 62568 - DNA, 20 bp, synthetic construct
  misc_feature 1..20: note = CRISPR gRNA sequence
  source 1..20: mol_type = other DNA
tactaaaaattacaaaaatt

SEQ ID NO: 62569 - DNA, 20 bp, synthetic construct
  misc_feature 1..20: note = CRISPR gRNA sequence
  source 1..20: mol_type = other DNA
aaaattacaaaaattagctg

SEQ ID NO: 62570 - DNA, 20 bp, synthetic construct
  misc_feature 1..20: note = CRISPR gRNA sequence
  source 1..20: mol_type = other DNA
caaaaattagctgggcattg

SEQ ID NO: 62571 - DNA, 20 bp, synthetic construct
  misc_feature 1..20: note = CRISPR gRNA sequence
  source 1..20: mol_type = other DNA
gctgggcattgtggtgtgca

SEQ ID NO: 62572 - DNA, 20 bp, synthetic construct
  misc_feature 1..20: note = CRISPR gRNA sequence
  source 1..20: mol_type = other DNA
ggcattgtggtgtgcacctg

SEQ ID NO: 62573 - DNA, 20 bp, synthetic construct
  misc_feature 1..20: note = CRISPR gRNA sequence
  source 1..20: mol_type = other DNA
tggtgtgcacctgtaatccc

SEQ ID NO: 62574 - DNA, 20 bp, synthetic construct
  misc_feature 1..20: note = CRISPR gRNA sequence
  source 1..20: mol_type = other DNA
taatcccagctactcgggag

SEQ ID NO: 62575 - DNA, 20 bp, synthetic construct
  misc_feature 1..20: note = CRISPR gRNA sequence
  source 1..20: mol_type = other DNA
ctcgggaggctgaggcagaa

SEQ ID NO: 62576 - DNA, 20 bp, synthetic construct
  misc_feature 1..20: note = CRISPR gRNA sequence
  source 1..20: mol_type = other DNA
gggaggctgaggcagaagaa

SEQ ID NO: 62577 - DNA, 20 bp, synthetic construct
  misc_feature 1..20: note = CRISPR gRNA sequence
  source 1..20: mol_type = other DNA
aggcagaagaatcgcttgaa

SEQ ID NO: 62578 - DNA, 20 bp, synthetic construct
  misc_feature 1..20: note = CRISPR gRNA sequence
  source 1..20: mol_type = other DNA
gaacccgggaggcggaggct

SEQ ID NO: 62579 - DNA, 20 bp, synthetic construct
  misc_feature 1..20: note = CRISPR gRNA sequence
  source 1..20: mol_type = other DNA
aacccgggaggcggaggctg

SEQ ID NO: 62580 - DNA, 20 bp, synthetic construct
  misc_feature 1..20: note = CRISPR gRNA sequence
  source 1..20: mol_type = other DNA
cagtgagccgagattgcacc

SEQ ID NO: 62581 - DNA, 20 bp, synthetic construct
  misc_feature 1..20: note = CRISPR gRNA sequence
  source 1..20: mol_type = other DNA
caccattgcactccagcctg

SEQ ID NO: 62582 - DNA, 20 bp, synthetic construct
  misc_feature 1..20: note = CRISPR gRNA sequence
  source 1..20: mol_type = other DNA
cactccagcctgggtgacag

SEQ ID NO: 62583 - DNA, 20 bp, synthetic construct
  misc_feature 1..20: note = CRISPR gRNA sequence
  source 1..20: mol_type = other DNA
cagcctgggtgacagagcga

SEQ ID NO: 62584 - DNA, 20 bp, synthetic construct
  misc_feature 1..20: note = CRISPR gRNA sequence
  source 1..20: mol_type = other DNA
ggtgacagagcgagactctg

SEQ ID NO: 62585 - DNA, 20 bp, synthetic construct
  misc_feature 1..20: note = CRISPR gRNA sequence
  source 1..20: mol_type = other DNA
tgtctcaaaaaaaaaagagt

SEQ ID NO: 62586 - DNA, 20 bp, synthetic construct
  misc_feature 1..20: note = CRISPR gRNA sequence
  source 1..20: mol_type = other DNA
tctcaaaaaaaaaagagttc

SEQ ID NO: 62587 - DNA, 20 bp, synthetic construct
  misc_feature 1..20: note = CRISPR gRNA sequence
  source 1..20: mol_type = other DNA
aaaaaaaaaagagttccagt

SEQ ID NO: 62588 - DNA, 20 bp, synthetic construct
  misc_feature 1..20: note = CRISPR gRNA sequence
  source 1..20: mol_type = other DNA
cagttcagaagggaagaatt

SEQ ID NO: 62589 - DNA, 20 bp, synthetic construct
  misc_feature 1..20: note = CRISPR gRNA sequence
  source 1..20: mol_type = other DNA
agaagggaagaatttgctta

SEQ ID NO: 62590 - DNA, 20 bp, synthetic construct
  misc_feature 1..20: note = CRISPR gRNA sequence
  source 1..20: mol_type = other DNA
gcttagcaaaagaggtgatg

SEQ ID NO: 62591 - DNA, 20 bp, synthetic construct
  misc_feature 1..20: note = CRISPR gRNA sequence
  source 1..20: mol_type = other DNA
cttagcaaaagaggtgatgg

SEQ ID NO: 62592 - DNA, 20 bp, synthetic construct
  misc_feature 1..20: note = CRISPR gRNA sequence
  source 1..20: mol_type = other DNA
agcaaaagaggtgatggtct

SEQ ID NO: 62593 - DNA, 20 bp, synthetic construct
  misc_feature 1..20: note = CRISPR gRNA sequence
  source 1..20: mol_type = other DNA
gcaaaagaggtgatggtctg

SEQ ID NO: 62594 - DNA, 20 bp, synthetic construct
  misc_feature 1..20: note = CRISPR gRNA sequence
  source 1..20: mol_type = other DNA
tgttagctaggattagagtt

SEQ ID NO: 62595 - DNA, 20 bp, synthetic construct
  misc_feature 1..20: note = CRISPR gRNA sequence
  source 1..20: mol_type = other DNA
gctaggattagagttcactg

SEQ ID NO: 62596 - DNA, 20 bp, synthetic construct
  misc_feature 1..20: note = CRISPR gRNA sequence
  source 1..20: mol_type = other DNA
ggattagagttcactgtgag

SEQ ID NO: 62597 - DNA, 20 bp, synthetic construct
  misc_feature 1..20: note = CRISPR gRNA sequence
  source 1..20: mol_type = other DNA
gagttcactgtgagtagcag

SEQ ID NO: 62598 - DNA, 20 bp, synthetic construct
  misc_feature 1..20: note = CRISPR gRNA sequence
  source 1..20: mol_type = other DNA
actgtgagtagcagaaagca

SEQ ID NO: 62599 - DNA, 20 bp, synthetic construct
  misc_feature 1..20: note = CRISPR gRNA sequence
  source 1..20: mol_type = other DNA
tgagtagcagaaagcactaa

SEQ ID NO: 62600 - DNA, 20 bp, synthetic construct
  misc_feature 1..20: note = CRISPR gRNA sequence
  source 1..20: mol_type = other DNA
aacaacagtggcttaaccag

SEQ ID NO: 62601 - DNA, 20 bp, synthetic construct
  misc_feature 1..20: note = CRISPR gRNA sequence
  source 1..20: mol_type = other DNA
aaccagaatggaagtgtatt

SEQ ID NO: 62602 - DNA, 20 bp, synthetic construct
  misc_feature 1..20: note = CRISPR gRNA sequence
  source 1..20: mol_type = other DNA
accagaatggaagtgtattt

SEQ ID NO: 62603 - DNA, 20 bp, synthetic construct
  misc_feature 1..20: note = CRISPR gRNA sequence
  source 1..20: mol_type = other DNA
ccctgccatgtaacagaagt

SEQ ID NO: 62604 - DNA, 20 bp, synthetic construct
  misc_feature 1..20: note = CRISPR gRNA sequence
  source 1..20: mol_type = other DNA
cctgccatgtaacagaagtc

SEQ ID NO: 62605 - DNA, 20 bp, synthetic construct
  misc_feature 1..20: note = CRISPR gRNA sequence
  source 1..20: mol_type = other DNA
ccatgtaacagaagtccaaa

SEQ ID NO: 62606 - DNA, 20 bp, synthetic construct
  misc_feature 1..20: note = CRISPR gRNA sequence
  source 1..20: mol_type = other DNA
taccttccaccttcctcagt

SEQ ID NO: 62607 - DNA, 20 bp, synthetic construct
  misc_feature 1..20: note = CRISPR gRNA sequence
  source 1..20: mol_type = other DNA
accttccaccttcctcagta

SEQ ID NO: 62608 - DNA, 20 bp, synthetic construct
  misc_feature 1..20: note = CRISPR gRNA sequence
  source 1..20: mol_type = other DNA
ccttccaccttcctcagtat

SEQ ID NO: 62609 - DNA, 20 bp, synthetic construct
  misc_feature 1..20: note = CRISPR gRNA sequence
  source 1..20: mol_type = other DNA
ccaccttcctcagtatgggt

SEQ ID NO: 62610 - DNA, 20 bp, synthetic construct
  misc_feature 1..20: note = CRISPR gRNA sequence
  source 1..20: mol_type = other DNA
caccttcctcagtatgggtt

SEQ ID NO: 62611 - DNA, 20 bp, synthetic construct
  misc_feature 1..20: note = CRISPR gRNA sequence
  source 1..20: mol_type = other DNA
cctcagtatgggttccacct

SEQ ID NO: 62612 - DNA, 20 bp, synthetic construct
  misc_feature 1..20: note = CRISPR gRNA sequence
  source 1..20: mol_type = other DNA
ctcagtatgggttccacctc

SEQ ID NO: 62613 - DNA, 20 bp, synthetic construct
  misc_feature 1..20: note = CRISPR gRNA sequence
  source 1..20: mol_type = other DNA
agtatgggttccacctcatg

SEQ ID NO: 62614 - DNA, 20 bp, synthetic construct
  misc_feature 1..20: note = CRISPR gRNA sequence
  source 1..20: mol_type = other DNA
cacctcatgattcaatatgg

SEQ ID NO: 62615 - DNA, 20 bp, synthetic construct
  misc_feature 1..20: note = CRISPR gRNA sequence
  source 1..20: mol_type = other DNA
atgattcaatatggctgccc

SEQ ID NO: 62616 - DNA, 20 bp, synthetic construct
  misc_feature 1..20: note = CRISPR gRNA sequence
  source 1..20: mol_type = other DNA
aatatggctgcccaagatcc

SEQ ID NO: 62617 - DNA, 20 bp, synthetic construct
  misc_feature 1..20: note = CRISPR gRNA sequence
  source 1..20: mol_type = other DNA
cccaagatccagccatccca

SEQ ID NO: 62618 - DNA, 20 bp, synthetic construct
  misc_feature 1..20: note = CRISPR gRNA sequence
  source 1..20: mol_type = other DNA
ctacttacattccactggcc

SEQ ID NO: 62619 - DNA, 20 bp, synthetic construct
  misc_feature 1..20: note = CRISPR gRNA sequence
  source 1..20: mol_type = other DNA
tacttacattccactggcca

SEQ ID NO: 62620 - DNA, 20 bp, synthetic construct
  misc_feature 1..20: note = CRISPR gRNA sequence
  source 1..20: mol_type = other DNA
cttacattccactggccaaa

SEQ ID NO: 62621 - DNA, 20 bp, synthetic construct
  misc_feature 1..20: note = CRISPR gRNA sequence
  source 1..20: mol_type = other DNA
acattccactggccaaatta

SEQ ID NO: 62622 - DNA, 20 bp, synthetic construct
  misc_feature 1..20: note = CRISPR gRNA sequence
  source 1..20: mol_type = other DNA
cattccactggccaaattac

SEQ ID NO: 62623 - DNA, 20 bp, synthetic construct
  misc_feature 1..20: note = CRISPR gRNA sequence
  source 1..20: mol_type = other DNA
cactggccaaattacatggc

SEQ ID NO: 62624 - DNA, 20 bp, synthetic construct
  misc_feature 1..20: note = CRISPR gRNA sequence
  source 1..20: mol_type = other DNA
gccaaattacatggctacat

SEQ ID NO: 62625 - DNA, 20 bp, synthetic construct
  misc_feature 1..20: note = CRISPR gRNA sequence
  source 1..20: mol_type = other DNA
catggctacatataactgca

SEQ ID NO: 62626 - DNA, 20 bp, synthetic construct
  misc_feature 1..20: note = CRISPR gRNA sequence
  source 1..20: mol_type = other DNA
catataactgcaagggagac

SEQ ID NO: 62627 - DNA, 20 bp, synthetic construct
  misc_feature 1..20: note = CRISPR gRNA sequence
  source 1..20: mol_type = other DNA
caagggagactgggatataa

SEQ ID NO: 62628 - DNA, 20 bp, synthetic construct
  misc_feature 1..20: note = CRISPR gRNA sequence
  source 1..20: mol_type = other DNA
ggatataataatctattcta

SEQ ID NO: 62629 - DNA, 20 bp, synthetic construct
  misc_feature 1..20: note = CRISPR gRNA sequence
  source 1..20: mol_type = other DNA
ttctagatgaccagagaata

SEQ ID NO: 62630 - DNA, 20 bp, synthetic construct
  misc_feature 1..20: note = CRISPR gRNA sequence
  source 1..20: mol_type = other DNA
tagatgaccagagaatattt

SEQ ID NO: 62631 - DNA, 20 bp, synthetic construct
  misc_feature 1..20: note = CRISPR gRNA sequence
  source 1..20: mol_type = other DNA
gatgaccagagaatatttag

SEQ ID NO: 62632 - DNA, 20 bp, synthetic construct
  misc_feature 1..20: note = CRISPR gRNA sequence
  source 1..20: mol_type = other DNA
agtagttctaatactgagga

SEQ ID NO: 62633 - DNA, 20 bp, synthetic construct
  misc_feature 1..20: note = CRISPR gRNA sequence
  source 1..20: mol_type = other DNA
gtagttctaatactgaggaa

SEQ ID NO: 62634 - DNA, 20 bp, synthetic construct
  misc_feature 1..20: note = CRISPR gRNA sequence
  source 1..20: mol_type = other DNA
taatactgaggaagaaggga

SEQ ID NO: 62635 - DNA, 20 bp, synthetic construct
  misc_feature 1..20: note = CRISPR gRNA sequence
  source 1..20: mol_type = other DNA
atactgaggaagaagggaag

SEQ ID NO: 62636 - DNA, 20 bp, synthetic construct
  misc_feature 1..20: note = CRISPR gRNA sequence
  source 1..20: mol_type = other DNA
aggaagaagggaagaacaga

SEQ ID NO: 62637 - DNA, 20 bp, synthetic construct
  misc_feature 1..20: note = CRISPR gRNA sequence
  source 1..20: mol_type = other DNA
tgggagacaactagttgtct

SEQ ID NO: 62638 - DNA, 20 bp, synthetic construct
  misc_feature 1..20: note = CRISPR gRNA sequence
  source 1..20: mol_type = other DNA
gggagacaactagttgtctc

SEQ ID NO: 62639 - DNA, 20 bp, synthetic construct
  misc_feature 1..20: note = CRISPR gRNA sequence
  source 1..20: mol_type = other DNA
ggagacaactagttgtctct

SEQ ID NO: 62640 - DNA, 20 bp, synthetic construct
  misc_feature 1..20: note = CRISPR gRNA sequence
  source 1..20: mol_type = other DNA
gttgtctctgccatgaggtt

SEQ ID NO: 62641 - DNA, 20 bp, synthetic construct
  misc_feature 1..20: note = CRISPR gRNA sequence
  source 1..20: mol_type = other DNA
tctctgccatgaggttagct

SEQ ID NO: 62642 - DNA, 20 bp, synthetic construct
  misc_feature 1..20: note = CRISPR gRNA sequence
  source 1..20: mol_type = other DNA
tgccatgaggttagctcaga

SEQ ID NO: 62643 - DNA, 20 bp, synthetic construct
  misc_feature 1..20: note = CRISPR gRNA sequence
  source 1..20: mol_type = other DNA
ccatgaggttagctcagact

SEQ ID NO: 62644 - DNA, 20 bp, synthetic construct
  misc_feature 1..20: note = CRISPR gRNA sequence
  source 1..20: mol_type = other DNA
gctcagactgagagcagcat

SEQ ID NO: 62645 - DNA, 20 bp, synthetic construct
  misc_feature 1..20: note = CRISPR gRNA sequence
  source 1..20: mol_type = other DNA
agactgagagcagcataaat

SEQ ID NO: 62646 - DNA, 20 bp, synthetic construct
  misc_feature 1..20: note = CRISPR gRNA sequence
  source 1..20: mol_type = other DNA
agagcagcataaatggttca

SEQ ID NO: 62647 - DNA, 20 bp, synthetic construct
  misc_feature 1..20: note = CRISPR gRNA sequence
  source 1..20: mol_type = other DNA
atggaaataagaatgagtaa

SEQ ID NO: 62648 - DNA, 20 bp, synthetic construct
  misc_feature 1..20: note = CRISPR gRNA sequence
  source 1..20: mol_type = other DNA
acgggactgtccacagggga

SEQ ID NO: 62649 - DNA, 20 bp, synthetic construct
  misc_feature 1..20: note = CRISPR gRNA sequence
  source 1..20: mol_type = other DNA
tccacaggggatgaacaaga

SEQ ID NO: 62650 - DNA, 20 bp, synthetic construct
  misc_feature 1..20: note = CRISPR gRNA sequence
  source 1..20: mol_type = other DNA
cagagagccagggtgcaggc

SEQ ID NO: 62651 - DNA, 20 bp, synthetic construct
  misc_feature 1..20: note = CRISPR gRNA sequence
  source 1..20: mol_type = other DNA
atctctggagctgatccctg

SEQ ID NO: 62652 - DNA, 20 bp, synthetic construct
  misc_feature 1..20: note = CRISPR gRNA sequence
  source 1..20: mol_type = other DNA
tggagctgatccctgggcag

SEQ ID NO: 62653 - DNA, 20 bp, synthetic construct
  misc_feature 1..20: note = CRISPR gRNA sequence
  source 1..20: mol_type = other DNA
gagctgatccctgggcagag

SEQ ID NO: 62654 - DNA, 20 bp, synthetic construct
  misc_feature 1..20: note = CRISPR gRNA sequence
  source 1..20: mol_type = other DNA
atccctgggcagagacatca

SEQ ID NO: 62655 - DNA, 20 bp, synthetic construct
  misc_feature 1..20: note = CRISPR gRNA sequence
  source 1..20: mol_type = other DNA
ggcagagacatcaagactcc

SEQ ID NO: 62656 - DNA, 20 bp, synthetic construct
  misc_feature 1..20: note = CRISPR gRNA sequence
  source 1..20: mol_type = other DNA
catggagaggccacttccct

SEQ ID NO: 62657 - DNA, 20 bp, synthetic construct
  misc_feature 1..20: note = CRISPR gRNA sequence
  source 1..20: mol_type = other DNA
ccctgcctattttatgtcgc

SEQ ID NO: 62658 - DNA, 20 bp, synthetic construct
  misc_feature 1..20: note = CRISPR gRNA sequence
  source 1..20: mol_type = other DNA
cctgcctattttatgtcgct

SEQ ID NO: 62659 - DNA, 20 bp, synthetic construct
  misc_feature 1..20: note = CRISPR gRNA sequence
  source 1..20: mol_type = other DNA
cctattttatgtcgctcaaa

SEQ ID NO: 62660 - DNA, 20 bp, synthetic construct
  misc_feature 1..20: note = CRISPR gRNA sequence
  source 1..20: mol_type = other DNA
ttttatgtcgctcaaatgta

SEQ ID NO: 62661 - DNA, 20 bp, synthetic construct
  misc_feature 1..20: note = CRISPR gRNA sequence
  source 1..20: mol_type = other DNA
tatgtcgctcaaatgtaggg

SEQ ID NO: 62662 - DNA, 20 bp, synthetic construct
  misc_feature 1..20: note = CRISPR gRNA sequence
  source 1..20: mol_type = other DNA
atgtcgctcaaatgtaggga

SEQ ID NO: 62663 - DNA, 20 bp, synthetic construct
  misc_feature 1..20: note = CRISPR gRNA sequence
  source 1..20: mol_type = other DNA
tgtcgctcaaatgtagggac

SEQ ID NO: 62664 - DNA, 20 bp, synthetic construct
  misc_feature 1..20: note = CRISPR gRNA sequence
  source 1..20: mol_type = other DNA
aaatgtagggactggttctt

SEQ ID NO: 62665 - DNA, 20 bp, synthetic construct
  misc_feature 1..20: note = CRISPR gRNA sequence
  source 1..20: mol_type = other DNA
gttcttgactgcttgacttc

SEQ ID NO: 62666 - DNA, 20 bp, synthetic construct
  misc_feature 1..20: note = CRISPR gRNA sequence
  source 1..20: mol_type = other DNA
ttgactgcttgacttcccta

SEQ ID NO: 62667 - DNA, 20 bp, synthetic construct
  misc_feature 1..20: note = CRISPR gRNA sequence
  source 1..20: mol_type = other DNA
gactgcttgacttccctaga

SEQ ID NO: 62668 - DNA, 20 bp, synthetic construct
  misc_feature 1..20: note = CRISPR gRNA sequence
  source 1..20: mol_type = other DNA
actgcttgacttccctagaa

SEQ ID NO: 62669 - DNA, 20 bp, synthetic construct
  misc_feature 1..20: note = CRISPR gRNA sequence
  source 1..20: mol_type = other DNA
cttgacttccctagaaactc

SEQ ID NO: 62670 - DNA, 20 bp, synthetic construct
  misc_feature 1..20: note = CRISPR gRNA sequence
  source 1..20: mol_type = other DNA
gacttccctagaaactccct

SEQ ID NO: 62671 - DNA, 20 bp, synthetic construct
  misc_feature 1..20: note = CRISPR gRNA sequence
  source 1..20: mol_type = other DNA
acttccctagaaactccctt

SEQ ID NO: 62672 - DNA, 20 bp, synthetic construct
  misc_feature 1..20: note = CRISPR gRNA sequence
  source 1..20: mol_type = other DNA
ccctagaaactcccttatcc

SEQ ID NO: 62673 - DNA, 20 bp, synthetic construct
  misc_feature 1..20: note = CRISPR gRNA sequence
  source 1..20: mol_type = other DNA
cctagaaactcccttatccc

SEQ ID NO: 62674 - DNA, 20 bp, synthetic construct
  misc_feature 1..20: note = CRISPR gRNA sequence
  source 1..20: mol_type = other DNA
gaaactcccttatcccccaa

SEQ ID NO: 62675 - DNA, 20 bp, synthetic construct
  misc_feature 1..20: note = CRISPR gRNA sequence
  source 1..20: mol_type = other DNA
ccttatcccccaactcacct

SEQ ID NO: 62676 - DNA, 20 bp, synthetic construct
  misc_feature 1..20: note = CRISPR gRNA sequence
  source 1..20: mol_type = other DNA
atcccccaactcaccttccc

SEQ ID NO: 62677 - DNA, 20 bp, synthetic construct
  misc_feature 1..20: note = CRISPR gRNA sequence
  source 1..20: mol_type = other DNA
tcccccaactcaccttcccc

SEQ ID NO: 62678 - DNA, 20 bp, synthetic construct
  misc_feature 1..20: note = CRISPR gRNA sequence
  source 1..20: mol_type = other DNA
accttccccagatcaccttc

SEQ ID NO: 62679 - DNA, 20 bp, synthetic construct
  misc_feature 1..20: note = CRISPR gRNA sequence
  source 1..20: mol_type = other DNA
ccccagatcaccttccccct

SEQ ID NO: 62680 - DNA, 20 bp, synthetic construct
  misc_feature 1..20: note = CRISPR gRNA sequence
  source 1..20: mol_type = other DNA
cccagatcaccttcccccta

SEQ ID NO: 62681 - DNA, 20 bp, synthetic construct
  misc_feature 1..20: note = CRISPR gRNA sequence
  source 1..20: mol_type = other DNA
ccccctagttcatctgtacc

SEQ ID NO: 62682 - DNA, 20 bp, synthetic construct
  misc_feature 1..20: note = CRISPR gRNA sequence
  source 1..20: mol_type = other DNA
cccctagttcatctgtaccc

SEQ ID NO: 62683 - DNA, 20 bp, synthetic construct
  misc_feature 1..20: note = CRISPR gRNA sequence
  source 1..20: mol_type = other DNA
gttcatctgtaccccactca

SEQ ID NO: 62684 - DNA, 20 bp, synthetic construct
  misc_feature 1..20: note = CRISPR gRNA sequence
  source 1..20: mol_type = other DNA
atctgtaccccactcacctg

SEQ ID NO: 62685 - DNA, 20 bp, synthetic construct
  misc_feature 1..20: note = CRISPR gRNA sequence
  source 1..20: mol_type = other DNA
taccccactcacctgccctc

SEQ ID NO: 62686 - DNA, 20 bp, synthetic construct
  misc_feature 1..20: note = CRISPR gRNA sequence
  source 1..20: mol_type = other DNA
acctgccctcaggtcacctg

SEQ ID NO: 62687 - DNA, 20 bp, synthetic construct
  misc_feature 1..20: note = CRISPR gRNA sequence
  source 1..20: mol_type = other DNA
ccctcaggtcacctgcccca

SEQ ID NO: 62688 - DNA, 20 bp, synthetic construct
  misc_feature 1..20: note = CRISPR gRNA sequence
  source 1..20: mol_type = other DNA
aggtcacctgccccacaact

SEQ ID NO: 62689 - DNA, 20 bp, synthetic construct
  misc_feature 1..20: note = CRISPR gRNA sequence
  source 1..20: mol_type = other DNA
ccccacaactcacctgttct

SEQ ID NO: 62690 - DNA, 20 bp, synthetic construct
  misc_feature 1..20: note = CRISPR gRNA sequence
  source 1..20: mol_type = other DNA
acctgttctccatctaatct

SEQ ID NO: 62691 - DNA, 20 bp, synthetic construct
  misc_feature 1..20: note = CRISPR gRNA sequence
  source 1..20: mol_type = other DNA
ttctccatctaatcttcctc

SEQ ID NO: 62692 - DNA, 20 bp, synthetic construct
  misc_feature 1..20: note = CRISPR gRNA sequence
  source 1..20: mol_type = other DNA
tccatctaatcttcctccca

SEQ ID NO: 62693 - DNA, 20 bp, synthetic construct
  misc_feature 1..20: note = CRISPR gRNA sequence
  source 1..20: mol_type = other DNA
catctaatcttcctcccagc

SEQ ID NO: 62694 - DNA, 20 bp, synthetic construct
  misc_feature 1..20: note = CRISPR gRNA sequence
  source 1..20: mol_type = other DNA
atcttcctcccagctcccct

SEQ ID NO: 62695 - DNA, 20 bp, synthetic construct
  misc_feature 1..20: note = CRISPR gRNA sequence
  source 1..20: mol_type = other DNA
cctcccagctcccctgtccc

SEQ ID NO: 62696 - DNA, 20 bp, synthetic construct
  misc_feature 1..20: note = CRISPR gRNA sequence
  source 1..20: mol_type = other DNA
ctcccagctcccctgtcccc

SEQ ID NO: 62697 - DNA, 20 bp, synthetic construct
  misc_feature 1..20: note = CRISPR gRNA sequence
  source 1..20: mol_type = other DNA
ccagctcccctgtcccccaa

SEQ ID NO: 62698 - DNA, 20 bp, synthetic construct
  misc_feature 1..20: note = CRISPR gRNA sequence
  source 1..20: mol_type = other DNA
ccctgtcccccaaatcacct

SEQ ID NO: 62699 - DNA, 20 bp, synthetic construct
  misc_feature 1..20: note = CRISPR gRNA sequence
  source 1..20: mol_type = other DNA
tcccccaaatcacctgcccc

SEQ ID NO: 62700 - DNA, 20 bp, synthetic construct
  misc_feature 1..20: note = CRISPR gRNA sequence
  source 1..20: mol_type = other DNA
cccccaatttgcttgtcctc

SEQ ID NO: 62701 - DNA, 20 bp, synthetic construct
  misc_feature 1..20: note = CRISPR gRNA sequence
  source 1..20: mol_type = other DNA
gcttgtcctccagctcaccg

SEQ ID NO: 62702 - DNA, 20 bp, synthetic construct
  misc_feature 1..20: note = CRISPR gRNA sequence
  source 1..20: mol_type = other DNA
cttgtcctccagctcaccgg

SEQ ID NO: 62703 - DNA, 20 bp, synthetic construct
  misc_feature 1..20: note = CRISPR gRNA sequence
  source 1..20: mol_type = other DNA
gtcctccagctcaccggttc

SEQ ID NO: 62704 - DNA, 20 bp, synthetic construct
  misc_feature 1..20: note = CRISPR gRNA sequence
  source 1..20: mol_type = other DNA
tcctccagctcaccggttcc

SEQ ID NO: 62705 - DNA, 20 bp, synthetic construct
  misc_feature 1..20: note = CRISPR gRNA sequence
  source 1..20: mol_type = other DNA
cagctcaccggttccccagc

SEQ ID NO: 62706 - DNA, 20 bp, synthetic construct
  misc_feature 1..20: note = CRISPR gRNA sequence
  source 1..20: mol_type = other DNA
accggttccccagctcatct

SEQ ID NO: 62707 - DNA, 20 bp, synthetic construct
  misc_feature 1..20: note = CRISPR gRNA sequence
  source 1..20: mol_type = other DNA
cccagctcatcttccttcca

SEQ ID NO: 62708 - DNA, 20 bp, synthetic construct
  misc_feature 1..20: note = CRISPR gRNA sequence
  source 1..20: mol_type = other DNA
atcttccttccagttcccct

SEQ ID NO: 62709 - DNA, 20 bp, synthetic construct
  misc_feature 1..20: note = CRISPR gRNA sequence
  source 1..20: mol_type = other DNA
ccttccagttcccctgtccc

SEQ ID NO: 62710 - DNA, 20 bp, synthetic construct
  misc_feature 1..20: note = CRISPR gRNA sequence
  source 1..20: mol_type = other DNA
cttccagttcccctgtcccc

SEQ ID NO: 62711 - DNA, 20 bp, synthetic construct
  misc_feature 1..20: note = CRISPR gRNA sequence
  source 1..20: mol_type = other DNA
ccagttcccctgtcccccag

SEQ ID NO: 62712 - DNA, 20 bp, synthetic construct
  misc_feature 1..20: note = CRISPR gRNA sequence
  source 1..20: mol_type = other DNA
cagttcccctgtcccccagc

SEQ ID NO: 62713 - DNA, 20 bp, synthetic construct
  misc_feature 1..20: note = CRISPR gRNA sequence
  source 1..20: mol_type = other DNA
ccctgtcccccagctcacct

SEQ ID NO: 62714 - DNA, 20 bp, synthetic construct
  misc_feature 1..20: note = CRISPR gRNA sequence
  source 1..20: mol_type = other DNA
tcccccagctcacctgcctg

SEQ ID NO: 62715 - DNA, 20 bp, synthetic construct
  misc_feature 1..20: note = CRISPR gRNA sequence
  source 1..20: mol_type = other DNA
acctgcctgccctcagttca

SEQ ID NO: 62716 - DNA, 20 bp, synthetic construct
  misc_feature 1..20: note = CRISPR gRNA sequence
  source 1..20: mol_type = other DNA
cctgccctcagttcacctgt

SEQ ID NO: 62717 - DNA, 20 bp, synthetic construct
  misc_feature 1..20: note = CRISPR gRNA sequence
  source 1..20: mol_type = other DNA
ccctcagttcacctgtcccc

SEQ ID NO: 62718 - DNA, 20 bp, synthetic construct
  misc_feature 1..20: note = CRISPR gRNA sequence
  source 1..20: mol_type = other DNA
agttcacctgtcccccagtt

SEQ ID NO: 62719 - DNA, 20 bp, synthetic construct
  misc_feature 1..20: note = CRISPR gRNA sequence
  source 1..20: mol_type = other DNA
acctgtcccccagttcatct

SEQ ID NO: 62720 - DNA, 20 bp, synthetic construct
  misc_feature 1..20: note = CRISPR gRNA sequence
  source 1..20: mol_type = other DNA
tcccccagttcatcttcctc

SEQ ID NO: 62721 - DNA, 20 bp, synthetic construct
  misc_feature 1..20: note = CRISPR gRNA sequence
  source 1..20: mol_type = other DNA
atcttcctcctagctcccct

SEQ ID NO: 62722 - DNA, 20 bp, synthetic construct
  misc_feature 1..20: note = CRISPR gRNA sequence
  source 1..20: mol_type = other DNA
cctcctagctcccctgtccc

SEQ ID NO: 62723 - DNA, 20 bp, synthetic construct
  misc_feature 1..20: note = CRISPR gRNA sequence
  source 1..20: mol_type = other DNA
ctcctagctcccctgtcccc

SEQ ID NO: 62724 - DNA, 20 bp, synthetic construct
  misc_feature 1..20: note = CRISPR gRNA sequence
  source 1..20: mol_type = other DNA
ctagctcccctgtcccctag

SEQ ID NO: 62725 - DNA, 20 bp, synthetic construct
  misc_feature 1..20: note = CRISPR gRNA sequence
  source 1..20: mol_type = other DNA
gctcccctgtcccctagctc

SEQ ID NO: 62726 - DNA, 20 bp, synthetic construct
  misc_feature 1..20: note = CRISPR gRNA sequence
  source 1..20: mol_type = other DNA
ccctgtcccctagctcacct

SEQ ID NO: 62727 - DNA, 20 bp, synthetic construct
  misc_feature 1..20: note = CRISPR gRNA sequence
  source 1..20: mol_type = other DNA
tcccctagctcacctgtgcc

SEQ ID NO: 62728 - DNA, 20 bp, synthetic construct
  misc_feature 1..20: note = CRISPR gRNA sequence
  source 1..20: mol_type = other DNA
gctcacctgtgccccagctc

SEQ ID NO: 62729 - DNA, 20 bp, synthetic construct
  misc_feature 1..20: note = CRISPR gRNA sequence
  source 1..20: mol_type = other DNA
acctgtgccccagctcccct

SEQ ID NO: 62730 - DNA, 20 bp, synthetic construct
  misc_feature 1..20: note = CRISPR gRNA sequence
  source 1..20: mol_type = other DNA
tgccccagctcccctgtccc

SEQ ID NO: 62731 - DNA, 20 bp, synthetic construct
  misc_feature 1..20: note = CRISPR gRNA sequence
  source 1..20: mol_type = other DNA
ccctgtcccccagttcccct

SEQ ID NO: 62732 - DNA, 20 bp, synthetic construct
  misc_feature 1..20: note = CRISPR gRNA sequence
  source 1..20: mol_type = other DNA
tcccccagttcccctgtccc

SEQ ID NO: 62733 - DNA, 20 bp, synthetic construct
  misc_feature 1..20: note = CRISPR gRNA sequence
  source 1..20: mol_type = other DNA
ccctgtcccccagctcacct

SEQ ID NO: 62734 - DNA, 20 bp, synthetic construct
  misc_feature 1..20: note = CRISPR gRNA sequence
  source 1..20: mol_type = other DNA
tcccccagctcacctccccc

SEQ ID NO: 62735 - DNA, 20 bp, synthetic construct
  misc_feature 1..20: note = CRISPR gRNA sequence
  source 1..20: mol_type = other DNA
acctccccctcagctctcct

SEQ ID NO: 62736 - DNA, 20 bp, synthetic construct
  misc_feature 1..20: note = CRISPR gRNA sequence
  source 1..20: mol_type = other DNA
cccctcagctctcctgtccc

SEQ ID NO: 62737 - DNA, 20 bp, synthetic construct
  misc_feature 1..20: note = CRISPR gRNA sequence
  source 1..20: mol_type = other DNA
agctctcctgtcccccagct

SEQ ID NO: 62738 - DNA, 20 bp, synthetic construct
  misc_feature 1..20: note = CRISPR gRNA sequence
  source 1..20: mol_type = other DNA
tcctgtcccccagctcatct

SEQ ID NO: 62739 - DNA, 20 bp, synthetic construct
  misc_feature 1..20: note = CRISPR gRNA sequence
  source 1..20: mol_type = other DNA
ctgtcccccagctcatctgc

SEQ ID NO: 62740 - DNA, 20 bp, synthetic construct
  misc_feature 1..20: note = CRISPR gRNA sequence
  source 1..20: mol_type = other DNA
tcccccagctcatctgcccc

SEQ ID NO: 62741 - DNA, 20 bp, synthetic construct
  misc_feature 1..20: note = CRISPR gRNA sequence
  source 1..20: mol_type = other DNA
atctgcccccagtttacctg

SEQ ID NO: 62742 - DNA, 20 bp, synthetic construct
  misc_feature 1..20: note = CRISPR gRNA sequence
  source 1..20: mol_type = other DNA
cccccagtttacctgtcccc

SEQ ID NO: 62743 - DNA, 20 bp, synthetic construct
  misc_feature 1..20: note = CRISPR gRNA sequence
  source 1..20: mol_type = other DNA
acctgtcccctagctcacct

SEQ ID NO: 62744 - DNA, 20 bp, synthetic construct
  misc_feature 1..20: note = CRISPR gRNA sequence
  source 1..20: mol_type = other DNA
cctgtcccctagctcacctc

SEQ ID NO: 62745 - DNA, 20 bp, synthetic construct
  misc_feature 1..20: note = CRISPR gRNA sequence
  source 1..20: mol_type = other DNA
tcccctagctcacctccccc

SEQ ID NO: 62746 - DNA, 20 bp, synthetic construct
  misc_feature 1..20: note = CRISPR gRNA sequence
  source 1..20: mol_type = other DNA
gctcacctcccccccagttt

SEQ ID NO: 62747 - DNA, 20 bp, synthetic construct
  misc_feature 1..20: note = CRISPR gRNA sequence
  source 1..20: mol_type = other DNA
acctcccccccagtttacct

SEQ ID NO: 62748 - DNA, 20 bp, synthetic construct
  misc_feature 1..20: note = CRISPR gRNA sequence
  source 1..20: mol_type = other DNA
ccccccagtttacctgtccc

SEQ ID NO: 62749 - DNA, 20 bp, synthetic construct
  misc_feature 1..20: note = CRISPR gRNA sequence
  source 1..20: mol_type = other DNA
acctgtcccccagctcacct

SEQ ID NO: 62750 - DNA, 20 bp, synthetic construct
  misc_feature 1..20: note = CRISPR gRNA sequence
  source 1..20: mol_type = other DNA
cctgtcccccagctcacctc

SEQ ID NO: 62751 - DNA, 20 bp, synthetic construct
  misc_feature 1..20: note = CRISPR gRNA sequence
  source 1..20: mol_type = other DNA
tcccccagctcacctccccc

SEQ ID NO: 62752 - DNA, 20 bp, synthetic construct
  misc_feature 1..20: note = CRISPR gRNA sequence
  source 1..20: mol_type = other DNA
acctccccccagtttgcctg

SEQ ID NO: 62753 - DNA, 20 bp, synthetic construct
  misc_feature 1..20: note = CRISPR gRNA sequence
  source 1..20: mol_type = other DNA
cccccagtttgcctgtcccc

SEQ ID NO: 62754 - DNA, 20 bp, synthetic construct
  misc_feature 1..20: note = CRISPR gRNA sequence
  source 1..20: mol_type = other DNA
gcctgtcccccagctcaact

SEQ ID NO: 62755 - DNA, 20 bp, synthetic construct
  misc_feature 1..20: note = CRISPR gRNA sequence
  source 1..20: mol_type = other DNA
cctgtcccccagctcaactc

SEQ ID NO: 62756 - DNA, 20 bp, synthetic construct
  misc_feature 1..20: note = CRISPR gRNA sequence
  source 1..20: mol_type = other DNA
tcccccagctcaactccccc

SEQ ID NO: 62757 - DNA, 20 bp, synthetic construct
  misc_feature 1..20: note = CRISPR gRNA sequence
  source 1..20: mol_type = other DNA
aactccccccaagttcccct

SEQ ID NO: 62758 - DNA, 20 bp, synthetic construct
  misc_feature 1..20: note = CRISPR gRNA sequence
  source 1..20: mol_type = other DNA
cccccaagttcccctgtccc

SEQ ID NO: 62759 - DNA, 20 bp, synthetic construct
  misc_feature 1..20: note = CRISPR gRNA sequence
  source 1..20: mol_type = other DNA
ccctgtccctcagctcatct

SEQ ID NO: 62760 - DNA, 20 bp, synthetic construct
  misc_feature 1..20: note = CRISPR gRNA sequence
  source 1..20: mol_type = other DNA
tccctcagctcatctgcccc

SEQ ID NO: 62761 - DNA, 20 bp, synthetic construct
  misc_feature 1..20: note = CRISPR gRNA sequence
  source 1..20: mol_type = other DNA
agctcatctgcccccagttt

SEQ ID NO: 62762 - DNA, 20 bp, synthetic construct
  misc_feature 1..20: note = CRISPR gRNA sequence
  source 1..20: mol_type = other DNA
atctgcccccagtttacctg

SEQ ID NO: 62763 - DNA, 20 bp, synthetic construct
  misc_feature 1..20: note = CRISPR gRNA sequence
  source 1..20: mol_type = other DNA
cccccagtttacctgtcccc

SEQ ID NO: 62764 - DNA, 20 bp, synthetic construct
  misc_feature 1..20: note = CRISPR gRNA sequence
  source 1..20: mol_type = other DNA
acctgtccccctcaactcac

SEQ ID NO: 62765 - DNA, 20 bp, synthetic construct
  misc_feature 1..20: note = CRISPR gRNA sequence
  source 1..20: mol_type = other DNA
cctgtccccctcaactcacc

SEQ ID NO: 62766 - DNA, 20 bp, synthetic construct
  misc_feature 1..20: note = CRISPR gRNA sequence
  source 1..20: mol_type = other DNA
tccccctcaactcacctatc

SEQ ID NO: 62767 - DNA, 20 bp, synthetic construct
  misc_feature 1..20: note = CRISPR gRNA sequence
  source 1..20: mol_type = other DNA
aactcacctatcttccctgt

SEQ ID NO: 62768 - DNA, 20 bp, synthetic construct
  misc_feature 1..20: note = CRISPR gRNA sequence
  source 1..20: mol_type = other DNA
acctatcttccctgtccctc

SEQ ID NO: 62769 - DNA, 20 bp, synthetic construct
  misc_feature 1..20: note = CRISPR gRNA sequence
  source 1..20: mol_type = other DNA
tcttccctgtccctccaggg

SEQ ID NO: 62770 - DNA, 20 bp, synthetic construct
  misc_feature 1..20: note = CRISPR gRNA sequence
  source 1..20: mol_type = other DNA
ccctgtccctccagggctgg

SEQ ID NO: 62771 - DNA, 20 bp, synthetic construct
  misc_feature 1..20: note = CRISPR gRNA sequence
  source 1..20: mol_type = other DNA
cctgtccctccagggctggc

SEQ ID NO: 62772 - DNA, 20 bp, synthetic construct
  misc_feature 1..20: note = CRISPR gRNA sequence
  source 1..20: mol_type = other DNA
tccctccagggctggctcct

SEQ ID NO: 62773 - DNA, 20 bp, synthetic construct
  misc_feature 1..20: note = CRISPR gRNA sequence
  source 1..20: mol_type = other DNA
cagggctggctcctcatgga

SEQ ID NO: 62774 - DNA, 20 bp, synthetic construct
  misc_feature 1..20: note = CRISPR gRNA sequence
  source 1..20: mol_type = other DNA
gctcctcatggaccccgttg

SEQ ID NO: 62775 - DNA, 20 bp, synthetic construct
  misc_feature 1..20: note = CRISPR gRNA sequence
  source 1..20: mol_type = other DNA
ctcatggaccccgttggcct

SEQ ID NO: 62776 - DNA, 20 bp, synthetic construct
  misc_feature 1..20: note = CRISPR gRNA sequence
  source 1..20: mol_type = other DNA
atggaccccgttggcctcca

SEQ ID NO: 62777 - DNA, 20 bp, synthetic construct
  misc_feature 1..20: note = CRISPR gRNA sequence
  source 1..20: mol_type = other DNA
gcctccagctcggcaacaag

SEQ ID NO: 62778 - DNA, 20 bp, synthetic construct
  misc_feature 1..20: note = CRISPR gRNA sequence
  source 1..20: mol_type = other DNA
cagctcggcaacaagaacct

SEQ ID NO: 62779 - DNA, 20 bp, synthetic construct
  misc_feature 1..20: note = CRISPR gRNA sequence
  source 1..20: mol_type = other DNA
ggcaacaagaacctgtggag

SEQ ID NO: 62780 - DNA, 20 bp, synthetic construct
  misc_feature 1..20: note = CRISPR gRNA sequence
  source 1..20: mol_type = other DNA
tggagctgtcttgtgaggct

SEQ ID NO: 62781 - DNA, 20 bp, synthetic construct
  misc_feature 1..20: note = CRISPR gRNA sequence
  source 1..20: mol_type = other DNA
tcttgtgaggctgctcacca

SEQ ID NO: 62782 - DNA, 20 bp, synthetic construct
  misc_feature 1..20: note = CRISPR gRNA sequence
  source 1..20: mol_type = other DNA
gtgaggctgctcaccaaaga

SEQ ID NO: 62783 - DNA, 20 bp, synthetic construct
  misc_feature 1..20: note = CRISPR gRNA sequence
  source 1..20: mol_type = other DNA
tgaggctgctcaccaaagac

SEQ ID NO: 62784 - DNA, 20 bp, synthetic construct
  misc_feature 1..20: note = CRISPR gRNA sequence
  source 1..20: mol_type = other DNA
ctcaccaaagacccagaatg

SEQ ID NO: 62785 - DNA, 20 bp, synthetic construct
  misc_feature 1..20: note = CRISPR gRNA sequence
  source 1..20: mol_type = other DNA
accaaagacccagaatggct

SEQ ID NO: 62786 - DNA, 20 bp, synthetic construct
  misc_feature 1..20: note = CRISPR gRNA sequence
  source 1..20: mol_type = other DNA
aacgccaagatgaagttctt

SEQ ID NO: 62787 - DNA, 20 bp, synthetic construct
  misc_feature 1..20: note = CRISPR gRNA sequence
  source 1..20: mol_type = other DNA
ttcctccccaacacggacct

SEQ ID NO: 62788 - DNA, 20 bp, synthetic construct
  misc_feature 1..20: note = CRISPR gRNA sequence
  source 1..20: mol_type = other DNA
cctccccaacacggacctgg

SEQ ID NO: 62789 - DNA, 20 bp, synthetic construct
  misc_feature 1..20: note = CRISPR gRNA sequence
  source 1..20: mol_type = other DNA
ctccccaacacggacctgga

SEQ ID NO: 62790 - DNA, 20 bp, synthetic construct
  misc_feature 1..20: note = CRISPR gRNA sequence
  source 1..20: mol_type = other DNA
cccaacacggacctggattc

SEQ ID NO: 62791 - DNA, 20 bp, synthetic construct
  misc_feature 1..20: note = CRISPR gRNA sequence
  source 1..20: mol_type = other DNA
gattccaggaacgagacctt

SEQ ID NO: 62792 - DNA, 20 bp, synthetic construct
  misc_feature 1..20: note = CRISPR gRNA sequence
  source 1..20: mol_type = other DNA
caggaacgagaccttggacc

SEQ ID NO: 62793 - DNA, 20 bp, synthetic construct
  misc_feature 1..20: note = CRISPR gRNA sequence
  source 1..20: mol_type = other DNA
ggaccctgaacagagagtca

SEQ ID NO: 62794 - DNA, 20 bp, synthetic construct
  misc_feature 1..20: note = CRISPR gRNA sequence
  source 1..20: mol_type = other DNA
gaccctgaacagagagtcat

SEQ ID NO: 62795 - DNA, 20 bp, synthetic construct
  misc_feature 1..20: note = CRISPR gRNA sequence
  source 1..20: mol_type = other DNA
aacagagagtcatcctgcaa

SEQ ID NO: 62796 - DNA, 20 bp, synthetic construct
  misc_feature 1..20: note = CRISPR gRNA sequence
  source 1..20: mol_type = other DNA
caactcaacaagctgcatgt

SEQ ID NO: 62797 - DNA, 20 bp, synthetic construct
  misc_feature 1..20: note = CRISPR gRNA sequence
  source 1..20: mol_type = other DNA
aacaagctgcatgtccaggg

SEQ ID NO: 62798 - DNA, 20 bp, synthetic construct
  misc_feature 1..20: note = CRISPR gRNA sequence
  source 1..20: mol_type = other DNA
catgtccagggttcggacac

SEQ ID NO: 62799 - DNA, 20 bp, synthetic construct
  misc_feature 1..20: note = CRISPR gRNA sequence
  source 1..20: mol_type = other DNA
ggacacctggcagtctttca

SEQ ID NO: 62800 - DNA, 20 bp, synthetic construct
  misc_feature 1..20: note = CRISPR gRNA sequence
  source 1..20: mol_type = other DNA
gcagtctttcattcattgtg

SEQ ID NO: 62801 - DNA, 20 bp, synthetic construct
  misc_feature 1..20: note = CRISPR gRNA sequence
  source 1..20: mol_type = other DNA
tcattcattgtgtgtgcatg

SEQ ID NO: 62802 - DNA, 20 bp, synthetic construct
  misc_feature 1..20: note = CRISPR gRNA sequence
  source 1..20: mol_type = other DNA
cattcattgtgtgtgcatgc

SEQ ID NO: 62803 - DNA, 20 bp, synthetic construct
  misc_feature 1..20: note = CRISPR gRNA sequence
  source 1..20: mol_type = other DNA
attcattgtgtgtgcatgca

SEQ ID NO: 62804 - DNA, 20 bp, synthetic construct
  misc_feature 1..20: note = CRISPR gRNA sequence
  source 1..20: mol_type = other DNA
attgtgtgtgcatgcagctg

SEQ ID NO: 62805 - DNA, 20 bp, synthetic construct
  misc_feature 1..20: note = CRISPR gRNA sequence
  source 1..20: mol_type = other DNA
tgtgtgcatgcagctggagg

SEQ ID NO: 62806 - DNA, 20 bp, synthetic construct
  misc_feature 1..20: note = CRISPR gRNA sequence
  source 1..20: mol_type = other DNA
gaggtgcctctggacctgga

SEQ ID NO: 62807 - DNA, 20 bp, synthetic construct
  misc_feature 1..20: note = CRISPR gRNA sequence
  source 1..20: mol_type = other DNA
tggacctggaggtgctgctg

SEQ ID NO: 62808 - DNA, 20 bp, synthetic construct
  misc_feature 1..20: note = CRISPR gRNA sequence
  source 1..20: mol_type = other DNA
gacctggaggtgctgctgct

SEQ ID NO: 62809 - DNA, 20 bp, synthetic construct
  misc_feature 1..20: note = CRISPR gRNA sequence
  source 1..20: mol_type = other DNA
gaggtgctgctgctgagtac

SEQ ID NO: 62810 - DNA, 20 bp, synthetic construct
  misc_feature 1..20: note = CRISPR gRNA sequence
  source 1..20: mol_type = other DNA
ctgctgagtacttttggcta

SEQ ID NO: 62811 - DNA, 20 bp, synthetic construct
  misc_feature 1..20: note = CRISPR gRNA sequence
  source 1..20: mol_type = other DNA
ctgagtacttttggctatga

SEQ ID NO: 62812 - DNA, 20 bp, synthetic construct
  misc_feature 1..20: note = CRISPR gRNA sequence
  source 1..20: mol_type = other DNA
agtacttttggctatgatga

SEQ ID NO: 62813 - DNA, 20 bp, synthetic construct
  misc_feature 1..20: note = CRISPR gRNA sequence
  source 1..20: mol_type = other DNA
ttggctatgatgatggtaag

SEQ ID NO: 62814 - DNA, 20 bp, synthetic construct
  misc_feature 1..20: note = CRISPR gRNA sequence
  source 1..20: mol_type = other DNA
tggctatgatgatggtaagg

SEQ ID NO: 62815 - DNA, 20 bp, synthetic construct
  misc_feature 1..20: note = CRISPR gRNA sequence
  source 1..20: mol_type = other DNA
ggctatgatgatggtaaggg

SEQ ID NO: 62816 - DNA, 20 bp, synthetic construct
  misc_feature 1..20: note = CRISPR gRNA sequence
  source 1..20: mol_type = other DNA
gctatgatgatggtaagggc

SEQ ID NO: 62817 - DNA, 20 bp, synthetic construct
  misc_feature 1..20: note = CRISPR gRNA sequence
  source 1..20: mol_type = other DNA
tgatgatggtaagggcaggt

SEQ ID NO: 62818 - DNA, 20 bp, synthetic construct
  misc_feature 1..20: note = CRISPR gRNA sequence
  source 1..20: mol_type = other DNA
cgtcatggggagccgggagg

SEQ ID NO: 62819 - DNA, 20 bp, synthetic construct
  misc_feature 1..20: note = CRISPR gRNA sequence
  source 1..20: mol_type = other DNA
agtcagagagagggtgtagc

SEQ ID NO: 62820 - DNA, 20 bp, synthetic construct
  misc_feature 1..20: note = CRISPR gRNA sequence
  source 1..20: mol_type = other DNA
aactctatatttctggacac

SEQ ID NO: 62821 - DNA, 20 bp, synthetic construct
  misc_feature 1..20: note = CRISPR gRNA sequence
  source 1..20: mol_type = other DNA
tatatttctggacacttccc

SEQ ID NO: 62822 - DNA, 20 bp, synthetic construct
  misc_feature 1..20: note = CRISPR gRNA sequence
  source 1..20: mol_type = other DNA
tatttctggacacttcccag

SEQ ID NO: 62823 - DNA, 20 bp, synthetic construct
  misc_feature 1..20: note = CRISPR gRNA sequence
  source 1..20: mol_type = other DNA
ctggacacttcccagaacaa

SEQ ID NO: 62824 - DNA, 20 bp, synthetic construct
  misc_feature 1..20: note = CRISPR gRNA sequence
  source 1..20: mol_type = other DNA
tggacacttcccagaacaaa

SEQ ID NO: 62825 - DNA, 20 bp, synthetic construct
  misc_feature 1..20: note = CRISPR gRNA sequence
  source 1..20: mol_type = other DNA
gacacttcccagaacaaatt

SEQ ID NO: 62826 - DNA, 20 bp, synthetic construct
  misc_feature 1..20: note = CRISPR gRNA sequence
  source 1..20: mol_type = other DNA
cccagaacaaatttcctaat

SEQ ID NO: 62827 - DNA, 20 bp, synthetic construct
  misc_feature 1..20: note = CRISPR gRNA sequence
  source 1..20: mol_type = other DNA
ccagaacaaatttcctaatg

SEQ ID NO: 62828 - DNA, 20 bp, synthetic construct
  misc_feature 1..20: note = CRISPR gRNA sequence
  source 1..20: mol_type = other DNA
cctaatgcgcccaaatctgc

SEQ ID NO: 62829 - DNA, 20 bp, synthetic construct
  misc_feature 1..20: note = CRISPR gRNA sequence
  source 1..20: mol_type = other DNA
ctaatgcgcccaaatctgct

SEQ ID NO: 62830 - DNA, 20 bp, synthetic construct
  misc_feature 1..20: note = CRISPR gRNA sequence
  source 1..20: mol_type = other DNA
atgcgcccaaatctgctggg

SEQ ID NO: 62831 - DNA, 20 bp, synthetic construct
  misc_feature 1..20: note = CRISPR gRNA sequence
  source 1..20: mol_type = other DNA
ctggggcctggaggacccct

SEQ ID NO: 62832 - DNA, 20 bp, synthetic construct
  misc_feature 1..20: note = CRISPR gRNA sequence
  source 1..20: mol_type = other DNA
gggcctggaggacccctcct

SEQ ID NO: 62833 - DNA, 20 bp, synthetic construct
  misc_feature 1..20: note = CRISPR gRNA sequence
  source 1..20: mol_type = other DNA
gaggacccctccttctacct

SEQ ID NO: 62834 - DNA, 20 bp, synthetic construct
  misc_feature 1..20: note = CRISPR gRNA sequence
  source 1..20: mol_type = other DNA
cttctacctggcttcactcg

SEQ ID NO: 62835 - DNA, 20 bp, synthetic construct
  misc_feature 1..20: note = CRISPR gRNA sequence
  source 1..20: mol_type = other DNA
ctacctggcttcactcgaat

SEQ ID NO: 62836 - DNA, 20 bp, synthetic construct
  misc_feature 1..20: note = CRISPR gRNA sequence
  source 1..20: mol_type = other DNA
tacctggcttcactcgaatt

SEQ ID NO: 62837 - DNA, 20 bp, synthetic construct
  misc_feature 1..20: note = CRISPR gRNA sequence
  source 1..20: mol_type = other DNA
cctggcttcactcgaattgc

SEQ ID NO: 62838 - DNA, 20 bp, synthetic construct
  misc_feature 1..20: note = CRISPR gRNA sequence
  source 1..20: mol_type = other DNA
gcttcactcgaattgctcga

SEQ ID NO: 62839 - DNA, 20 bp, synthetic construct
  misc_feature 1..20: note = CRISPR gRNA sequence
  source 1..20: mol_type = other DNA
cactcgaattgctcgaattg

SEQ ID NO: 62840 - DNA, 20 bp, synthetic construct
  misc_feature 1..20: note = CRISPR gRNA sequence
  source 1..20: mol_type = other DNA
actcgaattgctcgaattgc

SEQ ID NO: 62841 - DNA, 20 bp, synthetic construct
  misc_feature 1..20: note = CRISPR gRNA sequence
  source 1..20: mol_type = other DNA
gaattgctcgaattgctgag

SEQ ID NO: 62842 - DNA, 20 bp, synthetic construct
  misc_feature 1..20: note = CRISPR gRNA sequence
  source 1..20: mol_type = other DNA
ctcgaattgctgagtgactg

SEQ ID NO: 62843 - DNA, 20 bp, synthetic construct
  misc_feature 1..20: note = CRISPR gRNA sequence
  source 1..20: mol_type = other DNA
gaattgctgagtgactgctt

SEQ ID NO: 62844 - DNA, 20 bp, synthetic construct
  misc_feature 1..20: note = CRISPR gRNA sequence
  source 1..20: mol_type = other DNA
ctgagtgactgcttccagcc

SEQ ID NO: 62845 - DNA, 20 bp, synthetic construct
  misc_feature 1..20: note = CRISPR gRNA sequence
  source 1..20: mol_type = other DNA
agtgactgcttccagccaca

SEQ ID NO: 62846 - DNA, 20 bp, synthetic construct
  misc_feature 1..20: note = CRISPR gRNA sequence
  source 1..20: mol_type = other DNA
cttccagccacaaaatccca

SEQ ID NO: 62847 - DNA, 20 bp, synthetic construct
  misc_feature 1..20: note = CRISPR gRNA sequence
  source 1..20: mol_type = other DNA
ccagccacaaaatcccacat

SEQ ID NO: 62848 - DNA, 20 bp, synthetic construct
  misc_feature 1..20: note = CRISPR gRNA sequence
  source 1..20: mol_type = other DNA
cagccacaaaatcccacata

SEQ ID NO: 62849 - DNA, 20 bp, synthetic construct
  misc_feature 1..20: note = CRISPR gRNA sequence
  source 1..20: mol_type = other DNA
atttcttcttttttggcggg

SEQ ID NO: 62850 - DNA, 20 bp, synthetic construct
  misc_feature 1..20: note = CRISPR gRNA sequence
  source 1..20: mol_type = other DNA
tttcttcttttttggcgggg

SEQ ID NO: 62851 - DNA, 20 bp, synthetic construct
  misc_feature 1..20: note = CRISPR gRNA sequence
  source 1..20: mol_type = other DNA
cttcttttttggcgggggtg

SEQ ID NO: 62852 - DNA, 20 bp, synthetic construct
  misc_feature 1..20: note = CRISPR gRNA sequence
  source 1..20: mol_type = other DNA
ttcttttttggcgggggtgg

SEQ ID NO: 62853 - DNA, 20 bp, synthetic construct
  misc_feature 1..20: note = CRISPR gRNA sequence
  source 1..20: mol_type = other DNA
cttttttggcgggggtgggg

SEQ ID NO: 62854 - DNA, 20 bp, synthetic construct
  misc_feature 1..20: note = CRISPR gRNA sequence
  source 1..20: mol_type = other DNA
ttttttggcgggggtggggg

SEQ ID NO: 62855 - DNA, 20 bp, synthetic construct
  misc_feature 1..20: note = CRISPR gRNA sequence
  source 1..20: mol_type = other DNA
ttttggcgggggtggggggg

SEQ ID NO: 62856 - DNA, 20 bp, synthetic construct
  misc_feature 1..20: note = CRISPR gRNA sequence
  source 1..20: mol_type = other DNA
tttggcgggggtgggggggt

SEQ ID NO: 62857 - DNA, 20 bp, synthetic construct
  misc_feature 1..20: note = CRISPR gRNA sequence
  source 1..20: mol_type = other DNA
ttggcgggggtgggggggtg

SEQ ID NO: 62858 - DNA, 20 bp, synthetic construct
  misc_feature 1..20: note = CRISPR gRNA sequence
  source 1..20: mol_type = other DNA
tggcgggggtgggggggtgt

SEQ ID NO: 62859 - DNA, 20 bp, synthetic construct
  misc_feature 1..20: note = CRISPR gRNA sequence
  source 1..20: mol_type = other DNA
ggcgggggtgggggggtgtt

SEQ ID NO: 62860 - DNA, 20 bp, synthetic construct
  misc_feature 1..20: note = CRISPR gRNA sequence
  source 1..20: mol_type = other DNA
gcgggggtgggggggtgttt

SEQ ID NO: 62861 - DNA, 20 bp, synthetic construct
  misc_feature 1..20: note = CRISPR gRNA sequence
  source 1..20: mol_type = other DNA
tttgtttgttgttgctcttg

SEQ ID NO: 62862 - DNA, 20 bp, synthetic construct
  misc_feature 1..20: note = CRISPR gRNA sequence
  source 1..20: mol_type = other DNA
ttgtttgttgttgctcttgt

SEQ ID NO: 62863 - DNA, 20 bp, synthetic construct
  misc_feature 1..20: note = CRISPR gRNA sequence
  source 1..20: mol_type = other DNA
tgtttgttgttgctcttgtt

SEQ ID NO: 62864 - DNA, 20 bp, synthetic construct
  misc_feature 1..20: note = CRISPR gRNA sequence
  source 1..20: mol_type = other DNA
gtttgttgttgctcttgttg

SEQ ID NO: 62865 - DNA, 20 bp, synthetic construct
  misc_feature 1..20: note = CRISPR gRNA sequence
  source 1..20: mol_type = other DNA
tttgttgttgctcttgttgg

SEQ ID NO: 62866 - DNA, 20 bp, synthetic construct
  misc_feature 1..20: note = CRISPR gRNA sequence
  source 1..20: mol_type = other DNA
gttgttgctcttgttgggtt

SEQ ID NO: 62867 - DNA, 20 bp, synthetic construct
  misc_feature 1..20: note = CRISPR gRNA sequence
  source 1..20: mol_type = other DNA
ttgttgctcttgttgggttt

SEQ ID NO: 62868 - DNA, 20 bp, synthetic construct
  misc_feature 1..20: note = CRISPR gRNA sequence
  source 1..20: mol_type = other DNA
ttgctcttgttgggttttgt

SEQ ID NO: 62869 - DNA, 20 bp, synthetic construct
  misc_feature 1..20: note = CRISPR gRNA sequence
  source 1..20: mol_type = other DNA
ctcttgttgggttttgtttg

SEQ ID NO: 62870 - DNA, 20 bp, synthetic construct
  misc_feature 1..20: note = CRISPR gRNA sequence
  source 1..20: mol_type = other DNA
ttgttgggttttgtttgttt

SEQ ID NO: 62871 - DNA, 20 bp, synthetic construct
  misc_feature 1..20: note = CRISPR gRNA sequence
  source 1..20: mol_type = other DNA
gttgggttttgtttgtttgt

SEQ ID NO: 62872 - DNA, 20 bp, synthetic construct
  misc_feature 1..20: note = CRISPR gRNA sequence
  source 1..20: mol_type = other DNA
ttgggttttgtttgtttgtt

SEQ ID NO: 62873 - DNA, 20 bp, synthetic construct
  misc_feature 1..20: note = CRISPR gRNA sequence
  source 1..20: mol_type = other DNA
ggttttgtttgtttgttttt

SEQ ID NO: 62874 - DNA, 20 bp, synthetic construct
  misc_feature 1..20: note = CRISPR gRNA sequence
  source 1..20: mol_type = other DNA
tgtttgtttgttttttattt

SEQ ID NO: 62875 - DNA, 20 bp, synthetic construct
  misc_feature 1..20: note = CRISPR gRNA sequence
  source 1..20: mol_type = other DNA
gtttgtttgttttttatttt

SEQ ID NO: 62876 - DNA, 20 bp, synthetic construct
  misc_feature 1..20: note = CRISPR gRNA sequence
  source 1..20: mol_type = other DNA
tttgtttgttttttattttt

SEQ ID NO: 62877 - DNA, 20 bp, synthetic construct
  misc_feature 1..20: note = CRISPR gRNA sequence
  source 1..20: mol_type = other DNA
gtttgttttttatttttgag

SEQ ID NO: 62878 - DNA, 20 bp, synthetic construct
  misc_feature 1..20: note = CRISPR gRNA sequence
  source 1..20: mol_type = other DNA
tttgttttttatttttgaga

SEQ ID NO: 62879 - DNA, 20 bp, synthetic construct
  misc_feature 1..20: note = CRISPR gRNA sequence
  source 1..20: mol_type = other DNA
gttttttatttttgagacaa

SEQ ID NO: 62880 - DNA, 20 bp, synthetic construct
  misc_feature 1..20: note = CRISPR gRNA sequence
  source 1..20: mol_type = other DNA
ttttttatttttgagacaag

SEQ ID NO: 62881 - DNA, 20 bp, synthetic construct
  misc_feature 1..20: note = CRISPR gRNA sequence
  source 1..20: mol_type = other DNA
tttatttttgagacaaggtc

SEQ ID NO: 62882 - DNA, 20 bp, synthetic construct
  misc_feature 1..20: note = CRISPR gRNA sequence
  source 1..20: mol_type = other DNA
ttatttttgagacaaggtct

SEQ ID NO: 62883 - DNA, 20 bp, synthetic construct
  misc_feature 1..20: note = CRISPR gRNA sequence
  source 1..20: mol_type = other DNA
tatttttgagacaaggtctt

SEQ ID NO: 62884 - DNA, 20 bp, synthetic construct
  misc_feature 1..20: note = CRISPR gRNA sequence
  source 1..20: mol_type = other DNA
atttttgagacaaggtcttg

SEQ ID NO: 62885 - DNA, 20 bp, synthetic construct
  misc_feature 1..20: note = CRISPR gRNA sequence
  source 1..20: mol_type = other DNA
tttttgagacaaggtcttgc

SEQ ID NO: 62886 - DNA, 20 bp, synthetic construct
  misc_feature 1..20: note = CRISPR gRNA sequence
  source 1..20: mol_type = other DNA
ttgagacaaggtcttgctct

SEQ ID NO: 62887 - DNA, 20 bp, synthetic construct
  misc_feature 1..20: note = CRISPR gRNA sequence
  source 1..20: mol_type = other DNA
tgagacaaggtcttgctctg

SEQ ID NO: 62888 - DNA, 20 bp, synthetic construct
  misc_feature 1..20: note = CRISPR gRNA sequence
  source 1..20: mol_type = other DNA
gagacaaggtcttgctctgt

SEQ ID NO: 62889 - DNA, 20 bp, synthetic construct
  misc_feature 1..20: note = CRISPR gRNA sequence
  source 1..20: mol_type = other DNA
agacaaggtcttgctctgtt

SEQ ID NO: 62890 - DNA, 20 bp, synthetic construct
  misc_feature 1..20: note = CRISPR gRNA sequence
  source 1..20: mol_type = other DNA
gctctgttgcctaggctgga

SEQ ID NO: 62891 - DNA, 20 bp, synthetic construct
  misc_feature 1..20: note = CRISPR gRNA sequence
  source 1..20: mol_type = other DNA
ctctgttgcctaggctggag

SEQ ID NO: 62892 - DNA, 20 bp, synthetic construct
  misc_feature 1..20: note = CRISPR gRNA sequence
  source 1..20: mol_type = other DNA
tgttgcctaggctggagtgc

SEQ ID NO: 62893 - DNA, 20 bp, synthetic construct
  misc_feature 1..20: note = CRISPR gRNA sequence
  source 1..20: mol_type = other DNA
ttgcctaggctggagtgcag

SEQ ID NO: 62894 - DNA, 20 bp, synthetic construct
  misc_feature 1..20: note = CRISPR gRNA sequence
  source 1..20: mol_type = other DNA
cctaggctggagtgcagtgg

SEQ ID NO: 62895 - DNA, 20 bp, synthetic construct
  misc_feature 1..20: note = CRISPR gRNA sequence
  source 1..20: mol_type = other DNA
ggctggagtgcagtggcaca

SEQ ID NO: 62896 - DNA, 20 bp, synthetic construct
  misc_feature 1..20: note = CRISPR gRNA sequence
  source 1..20: mol_type = other DNA
gagtgcagtggcacaatcat

SEQ ID NO: 62897 - DNA, 20 bp, synthetic construct
  misc_feature 1..20: note = CRISPR gRNA sequence
  source 1..20: mol_type = other DNA
actacagcatccaactccag

SEQ ID NO: 62898 - DNA, 20 bp, synthetic construct
  misc_feature 1..20: note = CRISPR gRNA sequence
  source 1..20: mol_type = other DNA
cagcatccaactccaggact

SEQ ID NO: 62899 - DNA, 20 bp, synthetic construct
  misc_feature 1..20: note = CRISPR gRNA sequence
  source 1..20: mol_type = other DNA
caggactcaggtgatccttc

SEQ ID NO: 62900 - DNA, 20 bp, synthetic construct
  misc_feature 1..20: note = CRISPR gRNA sequence
  source 1..20: mol_type = other DNA
aggtgatccttcccacttca

SEQ ID NO: 62901 - DNA, 20 bp, synthetic construct
  misc_feature 1..20: note = CRISPR gRNA sequence
  source 1..20: mol_type = other DNA
cccacttcagcctcccaagt

SEQ ID NO: 62902 - DNA, 20 bp, synthetic construct
  misc_feature 1..20: note = CRISPR gRNA sequence
  source 1..20: mol_type = other DNA
ccacttcagcctcccaagta

SEQ ID NO: 62903 - DNA, 20 bp, synthetic construct
  misc_feature 1..20: note = CRISPR gRNA sequence
  source 1..20: mol_type = other DNA
cagcctcccaagtagctgag

SEQ ID NO: 62904 - DNA, 20 bp, synthetic construct
  misc_feature 1..20: note = CRISPR gRNA sequence
  source 1..20: mol_type = other DNA
agcctcccaagtagctgaga

SEQ ID NO: 62905 - DNA, 20 bp, synthetic construct
  misc_feature 1..20: note = CRISPR gRNA sequence
  source 1..20: mol_type = other DNA
ccaagtagctgagactacag

SEQ ID NO: 62906 - DNA, 20 bp, synthetic construct
  misc_feature 1..20: note = CRISPR gRNA sequence
  source 1..20: mol_type = other DNA
agactacagtagaactatag

SEQ ID NO: 62907 - DNA, 20 bp, synthetic construct
  misc_feature 1..20: note = CRISPR gRNA sequence
  source 1..20: mol_type = other DNA
cagtagaactataggtgcat

SEQ ID NO: 62908 - DNA, 20 bp, synthetic construct
  misc_feature 1..20: note = CRISPR gRNA sequence
  source 1..20: mol_type = other DNA
taggtgcatgccaccacatt

SEQ ID NO: 62909 - DNA, 20 bp, synthetic construct
  misc_feature 1..20: note = CRISPR gRNA sequence
  source 1..20: mol_type = other DNA
ggctaatttttcattctttt

SEQ ID NO: 62910 - DNA, 20 bp, synthetic construct
  misc_feature 1..20: note = CRISPR gRNA sequence
  source 1..20: mol_type = other DNA
atttttcattcttttgtaga

SEQ ID NO: 62911 - DNA, 20 bp, synthetic construct
  misc_feature 1..20: note = CRISPR gRNA sequence
  source 1..20: mol_type = other DNA
ttcattcttttgtagagaca

SEQ ID NO: 62912 - DNA, 20 bp, synthetic construct
  misc_feature 1..20: note = CRISPR gRNA sequence
  source 1..20: mol_type = other DNA
tcattcttttgtagagacag

SEQ ID NO: 62913 - DNA, 20 bp, synthetic construct
  misc_feature 1..20: note = CRISPR gRNA sequence
  source 1..20: mol_type = other DNA
cattcttttgtagagacagg

SEQ ID NO: 62914 - DNA, 20 bp, synthetic construct
  misc_feature 1..20: note = CRISPR gRNA sequence
  source 1..20: mol_type = other DNA
attcttttgtagagacagga

SEQ ID NO: 62915 - DNA, 20 bp, synthetic construct
  misc_feature 1..20: note = CRISPR gRNA sequence
  source 1..20: mol_type = other DNA
ttttgtagagacaggacatc

SEQ ID NO: 62916 - DNA, 20 bp, synthetic construct
  misc_feature 1..20: note = CRISPR gRNA sequence
  source 1..20: mol_type = other DNA
ttgtagagacaggacatcac

SEQ ID NO: 62917 - DNA, 20 bp, synthetic construct
  misc_feature 1..20: note = CRISPR gRNA sequence
  source 1..20: mol_type = other DNA
tgtagagacaggacatcact

SEQ ID NO: 62918 - DNA, 20 bp, synthetic construct
  misc_feature 1..20: note = CRISPR gRNA sequence
  source 1..20: mol_type = other DNA
gtagagacaggacatcactg

SEQ ID NO: 62919 - DNA, 20 bp, synthetic construct
  misc_feature 1..20: note = CRISPR gRNA sequence
  source 1..20: mol_type = other DNA
tagagacaggacatcactgt

SEQ ID NO: 62920 - DNA, 20 bp, synthetic construct
  misc_feature 1..20: note = CRISPR gRNA sequence
  source 1..20: mol_type = other DNA
tgttgcccaggctggtcttg

SEQ ID NO: 62921 - DNA, 20 bp, synthetic construct
  misc_feature 1..20: note = CRISPR gRNA sequence
  source 1..20: mol_type = other DNA
cccaggctggtcttgaactc

SEQ ID NO: 62922 - DNA, 20 bp, synthetic construct
  misc_feature 1..20: note = CRISPR gRNA sequence
  source 1..20: mol_type = other DNA
gtcttgaactcctggcctta

SEQ ID NO: 62923 - DNA, 20 bp, synthetic construct
  misc_feature 1..20: note = CRISPR gRNA sequence
  source 1..20: mol_type = other DNA
gaactcctggccttaagtga

SEQ ID NO: 62924 - DNA, 20 bp, synthetic construct
  misc_feature 1..20: note = CRISPR gRNA sequence
  source 1..20: mol_type = other DNA
aactcctggccttaagtgat

SEQ ID NO: 62925 - DNA, 20 bp, synthetic construct
  misc_feature 1..20: note = CRISPR gRNA sequence
  source 1..20: mol_type = other DNA
ctggccttaagtgatcctcc

SEQ ID NO: 62926 - DNA, 20 bp, synthetic construct
  misc_feature 1..20: note = CRISPR gRNA sequence
  source 1..20: mol_type = other DNA
gccttaagtgatcctcctcc

SEQ ID NO: 62927 - DNA, 20 bp, synthetic construct
  misc_feature 1..20: note = CRISPR gRNA sequence
  source 1..20: mol_type = other DNA
aagtgatcctcctcccttgg

SEQ ID NO: 62928 - DNA, 20 bp, synthetic construct
  misc_feature 1..20: note = CRISPR gRNA sequence
  source 1..20: mol_type = other DNA
agtgatcctcctcccttggc

SEQ ID NO: 62929 - DNA, 20 bp, synthetic construct
  misc_feature 1..20: note = CRISPR gRNA sequence
  source 1..20: mol_type = other DNA
ctcccttggcctcccaaagt

SEQ ID NO: 62930 - DNA, 20 bp, synthetic construct
  misc_feature 1..20: note = CRISPR gRNA sequence
  source 1..20: mol_type = other DNA
ccttggcctcccaaagtgct

SEQ ID NO: 62931 - DNA, 20 bp, synthetic construct
  misc_feature 1..20: note = CRISPR gRNA sequence
  source 1..20: mol_type = other DNA
ggcctcccaaagtgctggga

SEQ ID NO: 62932 - DNA, 20 bp, synthetic construct
  misc_feature 1..20: note = CRISPR gRNA sequence
  source 1..20: mol_type = other DNA
gcctcccaaagtgctgggat

SEQ ID NO: 62933 - DNA, 20 bp, synthetic construct
  misc_feature 1..20: note = CRISPR gRNA sequence
  source 1..20: mol_type = other DNA
ccaaagtgctgggattatag

SEQ ID NO: 62934 - DNA, 20 bp, synthetic construct
  misc_feature 1..20: note = CRISPR gRNA sequence
  source 1..20: mol_type = other DNA
ggattatagatgtgagccat

SEQ ID NO: 62935 - DNA, 20 bp, synthetic construct
  misc_feature 1..20: note = CRISPR gRNA sequence
  source 1..20: mol_type = other DNA
tagatgtgagccatcacacc

SEQ ID NO: 62936 - DNA, 20 bp, synthetic construct
  misc_feature 1..20: note = CRISPR gRNA sequence
  source 1..20: mol_type = other DNA
gctagaggtgtttttgtttg

SEQ ID NO: 62937 - DNA, 20 bp, synthetic construct
  misc_feature 1..20: note = CRISPR gRNA sequence
  source 1..20: mol_type = other DNA
gaggtgtttttgtttgtttg

SEQ ID NO: 62938 - DNA, 20 bp, synthetic construct
  misc_feature 1..20: note = CRISPR gRNA sequence
  source 1..20: mol_type = other DNA
ttgtttgtttgtttgttttg

SEQ ID NO: 62939 - DNA, 20 bp, synthetic construct
  misc_feature 1..20: note = CRISPR gRNA sequence
  source 1..20: mol_type = other DNA
tgtttgtttgtttgttttgc

SEQ ID NO: 62940 - DNA, 20 bp, synthetic construct
  misc_feature 1..20: note = CRISPR gRNA sequence
  source 1..20: mol_type = other DNA
gtttgtttgtttgttttgca

SEQ ID NO: 62941 - DNA, 20 bp, synthetic construct
  misc_feature 1..20: note = CRISPR gRNA sequence
  source 1..20: mol_type = other DNA
tttgtttgtttgttttgcaa

SEQ ID NO: 62942 - DNA, 20 bp, synthetic construct
  misc_feature 1..20: note = CRISPR gRNA sequence
  source 1..20: mol_type = other DNA
gtttgtttgttttgcaacat

SEQ ID NO: 62943 - DNA, 20 bp, synthetic construct
  misc_feature 1..20: note = CRISPR gRNA sequence
  source 1..20: mol_type = other DNA
tttgtttgttttgcaacatg

SEQ ID NO: 62944 - DNA, 20 bp, synthetic construct
  misc_feature 1..20: note = CRISPR gRNA sequence
  source 1..20: mol_type = other DNA
gtttgttttgcaacatggtc

SEQ ID NO: 62945 - DNA, 20 bp, synthetic construct
  misc_feature 1..20: note = CRISPR gRNA sequence
  source 1..20: mol_type = other DNA
tttgttttgcaacatggtca

SEQ ID NO: 62946 - DNA, 20 bp, synthetic construct
  misc_feature 1..20: note = CRISPR gRNA sequence
  source 1..20: mol_type = other DNA
gttttgcaacatggtcagaa

SEQ ID NO: 62947 - DNA, 20 bp, synthetic construct
  misc_feature 1..20: note = CRISPR gRNA sequence
  source 1..20: mol_type = other DNA
ttttgcaacatggtcagaaa

SEQ ID NO: 62948 - DNA, 20 bp, synthetic construct
  misc_feature 1..20: note = CRISPR gRNA sequence
  source 1..20: mol_type = other DNA
tgcaacatggtcagaaacag

SEQ ID NO: 62949 - DNA, 20 bp, synthetic construct
  misc_feature 1..20: note = CRISPR gRNA sequence
  source 1..20: mol_type = other DNA
gcaacatggtcagaaacagt

SEQ ID NO: 62950 - DNA, 20 bp, synthetic construct
  misc_feature 1..20: note = CRISPR gRNA sequence
  source 1..20: mol_type = other DNA
caacatggtcagaaacagtg

SEQ ID NO: 62951 - DNA, 20 bp, synthetic construct
  misc_feature 1..20: note = CRISPR gRNA sequence
  source 1..20: mol_type = other DNA
ctgccctctactgatccgtg

SEQ ID NO: 62952 - DNA, 20 bp, synthetic construct
  misc_feature 1..20: note = CRISPR gRNA sequence
  source 1..20: mol_type = other DNA
tgccctctactgatccgtgg

SEQ ID NO: 62953 - DNA, 20 bp, synthetic construct
  misc_feature 1..20: note = CRISPR gRNA sequence
  source 1..20: mol_type = other DNA
ccctctactgatccgtgggg

SEQ ID NO: 62954 - DNA, 20 bp, synthetic construct
  misc_feature 1..20: note = CRISPR gRNA sequence
  source 1..20: mol_type = other DNA
tactgatccgtggggatttc

SEQ ID NO: 62955 - DNA, 20 bp, synthetic construct
  misc_feature 1..20: note = CRISPR gRNA sequence
  source 1..20: mol_type = other DNA
ctgatccgtggggatttctt

SEQ ID NO: 62956 - DNA, 20 bp, synthetic construct
  misc_feature 1..20: note = CRISPR gRNA sequence
  source 1..20: mol_type = other DNA
atccgtggggatttcttggg

SEQ ID NO: 62957 - DNA, 20 bp, synthetic construct
  misc_feature 1..20: note = CRISPR gRNA sequence
  source 1..20: mol_type = other DNA
cttgggcaccttctgtttgc

SEQ ID NO: 62958 - DNA, 20 bp, synthetic construct
  misc_feature 1..20: note = CRISPR gRNA sequence
  source 1..20: mol_type = other DNA
ttgggcaccttctgtttgca

SEQ ID NO: 62959 - DNA, 20 bp, synthetic construct
  misc_feature 1..20: note = CRISPR gRNA sequence
  source 1..20: mol_type = other DNA
gggcaccttctgtttgcaca

SEQ ID NO: 62960 - DNA, 20 bp, synthetic construct
  misc_feature 1..20: note = CRISPR gRNA sequence
  source 1..20: mol_type = other DNA
ggcaccttctgtttgcacag

SEQ ID NO: 62961 - DNA, 20 bp, synthetic construct
  misc_feature 1..20: note = CRISPR gRNA sequence
  source 1..20: mol_type = other DNA
ctgtttgcacagcactgagg

SEQ ID NO: 62962 - DNA, 20 bp, synthetic construct
  misc_feature 1..20: note = CRISPR gRNA sequence
  source 1..20: mol_type = other DNA
tgtttgcacagcactgaggg

SEQ ID NO: 62963 - DNA, 20 bp, synthetic construct
  misc_feature 1..20: note = CRISPR gRNA sequence
  source 1..20: mol_type = other DNA
tttgcacagcactgagggga

SEQ ID NO: 62964 - DNA, 20 bp, synthetic construct
  misc_feature 1..20: note = CRISPR gRNA sequence
  source 1..20: mol_type = other DNA
gcacagcactgaggggaaac

SEQ ID NO: 62965 - DNA, 20 bp, synthetic construct
  misc_feature 1..20: note = CRISPR gRNA sequence
  source 1..20: mol_type = other DNA
cacagcactgaggggaaaca

SEQ ID NO: 62966 - DNA, 20 bp, synthetic construct
  misc_feature 1..20: note = CRISPR gRNA sequence
  source 1..20: mol_type = other DNA
aggggaaacacaggacattg

SEQ ID NO: 62967 - DNA, 20 bp, synthetic construct
  misc_feature 1..20: note = CRISPR gRNA sequence
  source 1..20: mol_type = other DNA
aggggcaacagcgtttttgg

SEQ ID NO: 62968 - DNA, 20 bp, synthetic construct
  misc_feature 1..20: note = CRISPR gRNA sequence
  source 1..20: mol_type = other DNA
ttggagagaaaatgggaact

SEQ ID NO: 62969 - DNA, 20 bp, synthetic construct
  misc_feature 1..20: note = CRISPR gRNA sequence
  source 1..20: mol_type = other DNA
tggagagaaaatgggaactc

SEQ ID NO: 62970 - DNA, 20 bp, synthetic construct
  misc_feature 1..20: note = CRISPR gRNA sequence
  source 1..20: mol_type = other DNA
ggagagaaaatgggaactca

SEQ ID NO: 62971 - DNA, 20 bp, synthetic construct
  misc_feature 1..20: note = CRISPR gRNA sequence
  source 1..20: mol_type = other DNA
gagagaaaatgggaactcac

SEQ ID NO: 62972 - DNA, 20 bp, synthetic construct
  misc_feature 1..20: note = CRISPR gRNA sequence
  source 1..20: mol_type = other DNA
acttaagaaccctacttcaa

SEQ ID NO: 62973 - DNA, 20 bp, synthetic construct
  misc_feature 1..20: note = CRISPR gRNA sequence
  source 1..20: mol_type = other DNA
aagaaccctacttcaaggca

SEQ ID NO: 62974 - DNA, 20 bp, synthetic construct
  misc_feature 1..20: note = CRISPR gRNA sequence
  source 1..20: mol_type = other DNA
agaaccctacttcaaggcag

SEQ ID NO: 62975 - DNA, 20 bp, synthetic construct
  misc_feature 1..20: note = CRISPR gRNA sequence
  source 1..20: mol_type = other DNA
cttcaaggcagagtgtggga

SEQ ID NO: 62976 - DNA, 20 bp, synthetic construct
  misc_feature 1..20: note = CRISPR gRNA sequence
  source 1..20: mol_type = other DNA
caaggcagagtgtgggaatt

SEQ ID NO: 62977 - DNA, 20 bp, synthetic construct
  misc_feature 1..20: note = CRISPR gRNA sequence
  source 1..20: mol_type = other DNA
aaggcagagtgtgggaattg

SEQ ID NO: 62978 - DNA, 20 bp, synthetic construct
  misc_feature 1..20: note = CRISPR gRNA sequence
  source 1..20: mol_type = other DNA
cggggggcggggcggcgcat

SEQ ID NO: 62979 - DNA, 20 bp, synthetic construct
  misc_feature 1..20: note = CRISPR gRNA sequence
  source 1..20: mol_type = other DNA
tgcacacacatacataaact

SEQ ID NO: 62980 - DNA, 20 bp, synthetic construct
  misc_feature 1..20: note = CRISPR gRNA sequence
  source 1..20: mol_type = other DNA
gcatgcacttgcatatacac

SEQ ID NO: 62981 - DNA, 20 bp, synthetic construct
  misc_feature 1..20: note = CRISPR gRNA sequence
  source 1..20: mol_type = other DNA
catgcacttgcatatacaca

SEQ ID NO: 62982 - DNA, 20 bp, synthetic construct
  misc_feature 1..20: note = CRISPR gRNA sequence
  source 1..20: mol_type = other DNA
gcatatacacacatttctgc

SEQ ID NO: 62983 - DNA, 20 bp, synthetic construct
  misc_feature 1..20: note = CRISPR gRNA sequence
  source 1..20: mol_type = other DNA
catatacacacatttctgcc

SEQ ID NO: 62984 - DNA, 20 bp, synthetic construct
  misc_feature 1..20: note = CRISPR gRNA sequence
  source 1..20: mol_type = other DNA
ctgcccagcactgccttcaa

SEQ ID NO: 62985 - DNA, 20 bp, synthetic construct
  misc_feature 1..20: note = CRISPR gRNA sequence
  source 1..20: mol_type = other DNA
tgcccagcactgccttcaaa

SEQ ID NO: 62986 - DNA, 20 bp, synthetic construct
  misc_feature 1..20: note = CRISPR gRNA sequence
  source 1..20: mol_type = other DNA
cccagcactgccttcaaagc

SEQ ID NO: 62987 - DNA, 20 bp, synthetic construct
  misc_feature 1..20: note = CRISPR gRNA sequence
  source 1..20: mol_type = other DNA
ccttcaaagctcaccaccac

SEQ ID NO: 62988 - DNA, 20 bp, synthetic construct
  misc_feature 1..20: note = CRISPR gRNA sequence
  source 1..20: mol_type = other DNA
caaagctcaccaccacattt

SEQ ID NO: 62989 - DNA, 20 bp, synthetic construct
  misc_feature 1..20: note = CRISPR gRNA sequence
  source 1..20: mol_type = other DNA
aaagctcaccaccacatttt

SEQ ID NO: 62990 - DNA, 20 bp, synthetic construct
  misc_feature 1..20: note = CRISPR gRNA sequence
  source 1..20: mol_type = other DNA
accaccacattttctccaca

SEQ ID NO: 62991 - DNA, 20 bp, synthetic construct
  misc_feature 1..20: note = CRISPR gRNA sequence
  source 1..20: mol_type = other DNA
tctccacaacagataactga

SEQ ID NO: 62992 - DNA, 20 bp, synthetic construct
  misc_feature 1..20: note = CRISPR gRNA sequence
  source 1..20: mol_type = other DNA
ctccacaacagataactgag

SEQ ID NO: 62993 - DNA, 20 bp, synthetic construct
  misc_feature 1..20: note = CRISPR gRNA sequence
  source 1..20: mol_type = other DNA
tccacaacagataactgagt

SEQ ID NO: 62994 - DNA, 20 bp, synthetic construct
  misc_feature 1..20: note = CRISPR gRNA sequence
  source 1..20: mol_type = other DNA
cacaacagataactgagtgt

SEQ ID NO: 62995 - DNA, 20 bp, synthetic construct
  misc_feature 1..20: note = CRISPR gRNA sequence
  source 1..20: mol_type = other DNA
agtgttccatttagttctcc

SEQ ID NO: 62996 - DNA, 20 bp, synthetic construct
  misc_feature 1..20: note = CRISPR gRNA sequence
  source 1..20: mol_type = other DNA
catttagttctcccttgctg

SEQ ID NO: 62997 - DNA, 20 bp, synthetic construct
  misc_feature 1..20: note = CRISPR gRNA sequence
  source 1..20: mol_type = other DNA
agttctcccttgctgggtat

SEQ ID NO: 62998 - DNA, 20 bp, synthetic construct
  misc_feature 1..20: note = CRISPR gRNA sequence
  source 1..20: mol_type = other DNA
gttctcccttgctgggtatc

SEQ ID NO: 62999 - DNA, 20 bp, synthetic construct
  misc_feature 1..20: note = CRISPR gRNA sequence
  source 1..20: mol_type = other DNA
tcccttgctgggtatctccc

SEQ ID NO: 63000 - DNA, 20 bp, synthetic construct
  misc_feature 1..20: note = CRISPR gRNA sequence
  source 1..20: mol_type = other DNA
ccttgctgggtatctccctg

SEQ ID NO: 63001 - DNA, 20 bp, synthetic construct
  misc_feature 1..20: note = CRISPR gRNA sequence
  source 1..20: mol_type = other DNA
gctgggtatctccctgtgag

SEQ ID NO: 63002 - DNA, 20 bp, synthetic construct
  misc_feature 1..20: note = CRISPR gRNA sequence
  source 1..20: mol_type = other DNA
ctgggtatctccctgtgaga

SEQ ID NO: 63003 - DNA, 20 bp, synthetic construct
  misc_feature 1..20: note = CRISPR gRNA sequence
  source 1..20: mol_type = other DNA
ggtatctccctgtgagatga

SEQ ID NO: 63004 - DNA, 20 bp, synthetic construct
  misc_feature 1..20: note = CRISPR gRNA sequence
  source 1..20: mol_type = other DNA
cctgtgagatgagccctgag

SEQ ID NO: 63005 - DNA, 20 bp, synthetic construct
  misc_feature 1..20: note = CRISPR gRNA sequence
  source 1..20: mol_type = other DNA
tgagatgagccctgagccag

SEQ ID NO: 63006 - DNA, 20 bp, synthetic construct
  misc_feature 1..20: note = CRISPR gRNA sequence
  source 1..20: mol_type = other DNA
agccaggcgccaggccagag

SEQ ID NO: 63007 - DNA, 20 bp, synthetic construct
  misc_feature 1..20: note = CRISPR gRNA sequence
  source 1..20: mol_type = other DNA
gtccccagcatccctcgaca

SEQ ID NO: 63008 - DNA, 20 bp, synthetic construct
  misc_feature 1..20: note = CRISPR gRNA sequence
  source 1..20: mol_type = other DNA
gacagccccataccacatta

SEQ ID NO: 63009 - DNA, 20 bp, synthetic construct
  misc_feature 1..20: note = CRISPR gRNA sequence
  source 1..20: mol_type = other DNA
tactctcccctctcttgcag

SEQ ID NO: 63010 - DNA, 20 bp, synthetic construct
  misc_feature 1..20: note = CRISPR gRNA sequence
  source 1..20: mol_type = other DNA
tcccctctcttgcagggttc

SEQ ID NO: 63011 - DNA, 20 bp, synthetic construct
  misc_feature 1..20: note = CRISPR gRNA sequence
  source 1..20: mol_type = other DNA
ccctctcttgcagggttcac

SEQ ID NO: 63012 - DNA, 20 bp, synthetic construct
  misc_feature 1..20: note = CRISPR gRNA sequence
  source 1..20: mol_type = other DNA
tcttgcagggttcaccagcc

SEQ ID NO: 63013 - DNA, 20 bp, synthetic construct
  misc_feature 1..20: note = CRISPR gRNA sequence
  source 1..20: mol_type = other DNA
ttgcagggttcaccagccag

SEQ ID NO: 63014 - DNA, 20 bp, synthetic construct
  misc_feature 1..20: note = CRISPR gRNA sequence
  source 1..20: mol_type = other DNA
gcagggttcaccagccagct

SEQ ID NO: 63015 - DNA, 20 bp, synthetic construct
  misc_feature 1..20: note = CRISPR gRNA sequence
  source 1..20: mol_type = other DNA
cagggttcaccagccagctg

SEQ ID NO: 63016 - DNA, 20 bp, synthetic construct
  misc_feature 1..20: note = CRISPR gRNA sequence
  source 1..20: mol_type = other DNA
accagccagctgggagctga

SEQ ID NO: 63017 - DNA, 20 bp, synthetic construct
  misc_feature 1..20: note = CRISPR gRNA sequence
  source 1..20: mol_type = other DNA
ggagctgaggggaaaagcca

SEQ ID NO: 63018 - DNA, 20 bp, synthetic construct
  misc_feature 1..20: note = CRISPR gRNA sequence
  source 1..20: mol_type = other DNA
aggggaaaagccaacctgaa

SEQ ID NO: 63019 - DNA, 20 bp, synthetic construct
  misc_feature 1..20: note = CRISPR gRNA sequence
  source 1..20: mol_type = other DNA
aatctcagctccaccatggt

SEQ ID NO: 63020 - DNA, 20 bp, synthetic construct
  misc_feature 1..20: note = CRISPR gRNA sequence
  source 1..20: mol_type = other DNA
agctccaccatggtgaggac

SEQ ID NO: 63021 - DNA, 20 bp, synthetic construct
  misc_feature 1..20: note = CRISPR gRNA sequence
  source 1..20: mol_type = other DNA
caccatggtgaggactggag

SEQ ID NO: 63022 - DNA, 20 bp, synthetic construct
  misc_feature 1..20: note = CRISPR gRNA sequence
  source 1..20: mol_type = other DNA
gagttggggggtgggaaggg

SEQ ID NO: 63023 - DNA, 20 bp, synthetic construct
  misc_feature 1..20: note = CRISPR gRNA sequence
  source 1..20: mol_type = other DNA
gggggtgggaagggggtggt

SEQ ID NO: 63024 - DNA, 20 bp, synthetic construct
  misc_feature 1..20: note = CRISPR gRNA sequence
  source 1..20: mol_type = other DNA
tgaagtccccacttccaagc

SEQ ID NO: 63025 - DNA, 20 bp, synthetic construct
  misc_feature 1..20: note = CRISPR gRNA sequence
  source 1..20: mol_type = other DNA
ccaagctggaggaggctgtg

SEQ ID NO: 63026 - DNA, 20 bp, synthetic construct
  misc_feature 1..20: note = CRISPR gRNA sequence
  source 1..20: mol_type = other DNA
caagctggaggaggctgtgg

SEQ ID NO: 63027 - DNA, 20 bp, synthetic construct
  misc_feature 1..20: note = CRISPR gRNA sequence
  source 1..20: mol_type = other DNA
gaggaggctgtggaggctgt

SEQ ID NO: 63028 - DNA, 20 bp, synthetic construct
  misc_feature 1..20: note = CRISPR gRNA sequence
  source 1..20: mol_type = other DNA
tggaggctgtggtggctggt

SEQ ID NO: 63029 - DNA, 20 bp, synthetic construct
  misc_feature 1..20: note = CRISPR gRNA sequence
  source 1..20: mol_type = other DNA
tggtggctggtcacagccat

SEQ ID NO: 63030 - DNA, 20 bp, synthetic construct
  misc_feature 1..20: note = CRISPR gRNA sequence
  source 1..20: mol_type = other DNA
gtcacagccatttctcatag

SEQ ID NO: 63031 - DNA, 20 bp, synthetic construct
  misc_feature 1..20: note = CRISPR gRNA sequence
  source 1..20: mol_type = other DNA
ctcataggccatgctcttcg

SEQ ID NO: 63032 - DNA, 20 bp, synthetic construct
  misc_feature 1..20: note = CRISPR gRNA sequence
  source 1..20: mol_type = other DNA
tcataggccatgctcttcgt

SEQ ID NO: 63033 - DNA, 20 bp, synthetic construct
  misc_feature 1..20: note = CRISPR gRNA sequence
  source 1..20: mol_type = other DNA
ataggccatgctcttcgtct

SEQ ID NO: 63034 - DNA, 20 bp, synthetic construct
  misc_feature 1..20: note = CRISPR gRNA sequence
  source 1..20: mol_type = other DNA
ttcgtctgtccctgacccat

SEQ ID NO: 63035 - DNA, 20 bp, synthetic construct
  misc_feature 1..20: note = CRISPR gRNA sequence
  source 1..20: mol_type = other DNA
cgtctgtccctgacccattt

SEQ ID NO: 63036 - DNA, 20 bp, synthetic construct
  misc_feature 1..20: note = CRISPR gRNA sequence
  source 1..20: mol_type = other DNA
gtctgtccctgacccatttg

SEQ ID NO: 63037 - DNA, 20 bp, synthetic construct
  misc_feature 1..20: note = CRISPR gRNA sequence
  source 1..20: mol_type = other DNA
tccctgacccatttgcaagt

SEQ ID NO: 63038 - DNA, 20 bp, synthetic construct
  misc_feature 1..20: note = CRISPR gRNA sequence
  source 1..20: mol_type = other DNA
acccatttgcaagtgtgtca

SEQ ID NO: 63039 - DNA, 20 bp, synthetic construct
  misc_feature 1..20: note = CRISPR gRNA sequence
  source 1..20: mol_type = other DNA
gcaagtgtgtcaagccccta

SEQ ID NO: 63040 - DNA, 20 bp, synthetic construct
  misc_feature 1..20: note = CRISPR gRNA sequence
  source 1..20: mol_type = other DNA
caagtgtgtcaagcccctaa

SEQ ID NO: 63041 - DNA, 20 bp, synthetic construct
  misc_feature 1..20: note = CRISPR gRNA sequence
  source 1..20: mol_type = other DNA
actgtgtctcccagccccac

SEQ ID NO: 63042 - DNA, 20 bp, synthetic construct
  misc_feature 1..20: note = CRISPR gRNA sequence
  source 1..20: mol_type = other DNA
tgtctcccagccccacctcc

SEQ ID NO: 63043 - DNA, 20 bp, synthetic construct
  misc_feature 1..20: note = CRISPR gRNA sequence
  source 1..20: mol_type = other DNA
ccagccccacctcctcctgc

SEQ ID NO: 63044 - DNA, 20 bp, synthetic construct
  misc_feature 1..20: note = CRISPR gRNA sequence
  source 1..20: mol_type = other DNA
ctcctgcagtgactttcaag

SEQ ID NO: 63045 - DNA, 20 bp, synthetic construct
  misc_feature 1..20: note = CRISPR gRNA sequence
  source 1..20: mol_type = other DNA
ctgcagtgactttcaaggct

SEQ ID NO: 63046 - DNA, 20 bp, synthetic construct
  misc_feature 1..20: note = CRISPR gRNA sequence
  source 1..20: mol_type = other DNA
cagtgactttcaaggcttta

SEQ ID NO: 63047 - DNA, 20 bp, synthetic construct
  misc_feature 1..20: note = CRISPR gRNA sequence
  source 1..20: mol_type = other DNA
tcaaggctttagcttgtccc

SEQ ID NO: 63048 - DNA, 20 bp, synthetic construct
  misc_feature 1..20: note = CRISPR gRNA sequence
  source 1..20: mol_type = other DNA
caaggctttagcttgtcccg

SEQ ID NO: 63049 - DNA, 20 bp, synthetic construct
  misc_feature 1..20: note = CRISPR gRNA sequence
  source 1..20: mol_type = other DNA
aaggctttagcttgtcccgt

SEQ ID NO: 63050 - DNA, 20 bp, synthetic construct
  misc_feature 1..20: note = CRISPR gRNA sequence
  source 1..20: mol_type = other DNA
tagcttgtcccgttaccaat

SEQ ID NO: 63051 - DNA, 20 bp, synthetic construct
  misc_feature 1..20: note = CRISPR gRNA sequence
  source 1..20: mol_type = other DNA
agcttgtcccgttaccaatt

SEQ ID NO: 63052 - DNA, 20 bp, synthetic construct
  misc_feature 1..20: note = CRISPR gRNA sequence
  source 1..20: mol_type = other DNA
gcttgtcccgttaccaattc

SEQ ID NO: 63053 - DNA, 20 bp, synthetic construct
  misc_feature 1..20: note = CRISPR gRNA sequence
  source 1..20: mol_type = other DNA
gtcccgttaccaattctaaa

SEQ ID NO: 63054 - DNA, 20 bp, synthetic construct
  misc_feature 1..20: note = CRISPR gRNA sequence
  source 1..20: mol_type = other DNA
tcccgttaccaattctaaag

SEQ ID NO: 63055 - DNA, 20 bp, synthetic construct
  misc_feature 1..20: note = CRISPR gRNA sequence
  source 1..20: mol_type = other DNA
ccaattctaaagggtctaac

SEQ ID NO: 63056 - DNA, 20 bp, synthetic construct
  misc_feature 1..20: note = CRISPR gRNA sequence
  source 1..20: mol_type = other DNA
taaagggtctaacctggaac

SEQ ID NO: 63057 - DNA, 20 bp, synthetic construct
  misc_feature 1..20: note = CRISPR gRNA sequence
  source 1..20: mol_type = other DNA
aagggtctaacctggaaccc

SEQ ID NO: 63058 - DNA, 20 bp, synthetic construct
  misc_feature 1..20: note = CRISPR gRNA sequence
  source 1..20: mol_type = other DNA
acctggaacccctcaggaag

SEQ ID NO: 63059 - DNA, 20 bp, synthetic construct
  misc_feature 1..20: note = CRISPR gRNA sequence
  source 1..20: mol_type = other DNA
gaacccctcaggaagcctgt

SEQ ID NO: 63060 - DNA, 20 bp, synthetic construct
  misc_feature 1..20: note = CRISPR gRNA sequence
  source 1..20: mol_type = other DNA
aggaagcctgttctcacttt

SEQ ID NO: 63061 - DNA, 20 bp, synthetic construct
  misc_feature 1..20: note = CRISPR gRNA sequence
  source 1..20: mol_type = other DNA
ttctcactttcctgcccgca

SEQ ID NO: 63062 - DNA, 20 bp, synthetic construct
  misc_feature 1..20: note = CRISPR gRNA sequence
  source 1..20: mol_type = other DNA
tcactttcctgcccgcaacc

SEQ ID NO: 63063 - DNA, 20 bp, synthetic construct
  misc_feature 1..20: note = CRISPR gRNA sequence
  source 1..20: mol_type = other DNA
actttcctgcccgcaacccg

SEQ ID NO: 63064 - DNA, 20 bp, synthetic construct
  misc_feature 1..20: note = CRISPR gRNA sequence
  source 1..20: mol_type = other DNA
tcctgcccgcaacccgcagg

SEQ ID NO: 63065 - DNA, 20 bp, synthetic construct
  misc_feature 1..20: note = CRISPR gRNA sequence
  source 1..20: mol_type = other DNA
cctgcccgcaacccgcaggg

SEQ ID NO: 63066 - DNA, 20 bp, synthetic construct
  misc_feature 1..20: note = CRISPR gRNA sequence
  source 1..20: mol_type = other DNA
ctgcccgcaacccgcagggc

SEQ ID NO: 63067 - DNA, 20 bp, synthetic construct
  misc_feature 1..20: note = CRISPR gRNA sequence
  source 1..20: mol_type = other DNA
cccgcaacccgcagggcctc

SEQ ID NO: 63068 - DNA, 20 bp, synthetic construct
  misc_feature 1..20: note = CRISPR gRNA sequence
  source 1..20: mol_type = other DNA
atctcccagccccaaagtgt

SEQ ID NO: 63069 - DNA, 20 bp, synthetic construct
  misc_feature 1..20: note = CRISPR gRNA sequence
  source 1..20: mol_type = other DNA
ccagccccaaagtgtcaggc

SEQ ID NO: 63070 - DNA, 20 bp, synthetic construct
  misc_feature 1..20: note = CRISPR gRNA sequence
  source 1..20: mol_type = other DNA
catggggaagccctaaccac

SEQ ID NO: 63071 - DNA, 20 bp, synthetic construct
  misc_feature 1..20: note = CRISPR gRNA sequence
  source 1..20: mol_type = other DNA
atggggaagccctaaccacc

SEQ ID NO: 63072 - DNA, 20 bp, synthetic construct
  misc_feature 1..20: note = CRISPR gRNA sequence
  source 1..20: mol_type = other DNA
accaccccctcccgacttgt

SEQ ID NO: 63073 - DNA, 20 bp, synthetic construct
  misc_feature 1..20: note = CRISPR gRNA sequence
  source 1..20: mol_type = other DNA
ccgacttgtacaccttggac

SEQ ID NO: 63074 - DNA, 20 bp, synthetic construct
  misc_feature 1..20: note = CRISPR gRNA sequence
  source 1..20: mol_type = other DNA
gtacaccttggacttgacac

SEQ ID NO: 63075 - DNA, 20 bp, synthetic construct
  misc_feature 1..20: note = CRISPR gRNA sequence
  source 1..20: mol_type = other DNA
tacaccttggacttgacact

SEQ ID NO: 63076 - DNA, 20 bp, synthetic construct
  misc_feature 1..20: note = CRISPR gRNA sequence
  source 1..20: mol_type = other DNA
ggacttgacactcacccaca

SEQ ID NO: 63077 - DNA, 20 bp, synthetic construct
  misc_feature 1..20: note = CRISPR gRNA sequence
  source 1..20: mol_type = other DNA
gacttgacactcacccacag

SEQ ID NO: 63078 - DNA, 20 bp, synthetic construct
  misc_feature 1..20: note = CRISPR gRNA sequence
  source 1..20: mol_type = other DNA
gacactcacccacagctgct

SEQ ID NO: 63079 - DNA, 20 bp, synthetic construct
  misc_feature 1..20: note = CRISPR gRNA sequence
  source 1..20: mol_type = other DNA
acactcacccacagctgctg

SEQ ID NO: 63080 - DNA, 20 bp, synthetic construct
  misc_feature 1..20: note = CRISPR gRNA sequence
  source 1..20: mol_type = other DNA
acccacagctgctgtcttca

SEQ ID NO: 63081 - DNA, 20 bp, synthetic construct
  misc_feature 1..20: note = CRISPR gRNA sequence
  source 1..20: mol_type = other DNA
ctgtcttcagcgggggagcc

SEQ ID NO: 63082 - DNA, 20 bp, synthetic construct
  misc_feature 1..20: note = CRISPR gRNA sequence
  source 1..20: mol_type = other DNA
tcttcagcgggggagccttt

SEQ ID NO: 63083 - DNA, 20 bp, synthetic construct
  misc_feature 1..20: note = CRISPR gRNA sequence
  source 1..20: mol_type = other DNA
cagcgggggagcctttggct

SEQ ID NO: 63084 - DNA, 20 bp, synthetic construct
  misc_feature 1..20: note = CRISPR gRNA sequence
  source 1..20: mol_type = other DNA
agcgggggagcctttggctg

SEQ ID NO: 63085 - DNA, 20 bp, synthetic construct
  misc_feature 1..20: note = CRISPR gRNA sequence
  source 1..20: mol_type = other DNA
tggctgattttctgaaggag

SEQ ID NO: 63086 - DNA, 20 bp, synthetic construct
  misc_feature 1..20: note = CRISPR gRNA sequence
  source 1..20: mol_type = other DNA
ggctgattttctgaaggagc

SEQ ID NO: 63087 - DNA, 20 bp, synthetic construct
  misc_feature 1..20: note = CRISPR gRNA sequence
  source 1..20: mol_type = other DNA
gctgattttctgaaggagct

SEQ ID NO: 63088 - DNA, 20 bp, synthetic construct
  misc_feature 1..20: note = CRISPR gRNA sequence
  source 1..20: mol_type = other DNA
attttctgaaggagctcgga

SEQ ID NO: 63089 - DNA, 20 bp, synthetic construct
  misc_feature 1..20: note = CRISPR gRNA sequence
  source 1..20: mol_type = other DNA
tctgaaggagctcggaaggg

SEQ ID NO: 63090 - DNA, 20 bp, synthetic construct
  misc_feature 1..20: note = CRISPR gRNA sequence
  source 1..20: mol_type = other DNA
ctgaaggagctcggaagggc

SEQ ID NO: 63091 - DNA, 20 bp, synthetic construct
  misc_feature 1..20: note = CRISPR gRNA sequence
  source 1..20: mol_type = other DNA
tgaaggagctcggaagggcc

SEQ ID NO: 63092 - DNA, 20 bp, synthetic construct
  misc_feature 1..20: note = CRISPR gRNA sequence
  source 1..20: mol_type = other DNA
aaggagctcggaagggccag

SEQ ID NO: 63093 - DNA, 20 bp, synthetic construct
  misc_feature 1..20: note = CRISPR gRNA sequence
  source 1..20: mol_type = other DNA
ggaagggccagtgattaaat

SEQ ID NO: 63094 - DNA, 20 bp, synthetic construct
  misc_feature 1..20: note = CRISPR gRNA sequence
  source 1..20: mol_type = other DNA
aataatgaccacctactgat

SEQ ID NO: 63095 - DNA, 20 bp, synthetic construct
  misc_feature 1..20: note = CRISPR gRNA sequence
  source 1..20: mol_type = other DNA
ctgattcgtgggtcacactt

SEQ ID NO: 63096 - DNA, 20 bp, synthetic construct
  misc_feature 1..20: note = CRISPR gRNA sequence
  source 1..20: mol_type = other DNA
attcgtgggtcacactttca

SEQ ID NO: 63097 - DNA, 20 bp, synthetic construct
  misc_feature 1..20: note = CRISPR gRNA sequence
  source 1..20: mol_type = other DNA
gtgggtcacactttcatctc

SEQ ID NO: 63098 - DNA, 20 bp, synthetic construct
  misc_feature 1..20: note = CRISPR gRNA sequence
  source 1..20: mol_type = other DNA
tcatctcagcaccttgattt

SEQ ID NO: 63099 - DNA, 20 bp, synthetic construct
  misc_feature 1..20: note = CRISPR gRNA sequence
  source 1..20: mol_type = other DNA
catctcagcaccttgatttc

SEQ ID NO: 63100 - DNA, 20 bp, synthetic construct
  misc_feature 1..20: note = CRISPR gRNA sequence
  source 1..20: mol_type = other DNA
atctcagcaccttgatttct

SEQ ID NO: 63101 - DNA, 20 bp, synthetic construct
  misc_feature 1..20: note = CRISPR gRNA sequence
  source 1..20: mol_type = other DNA
agcaccttgatttctacaga

SEQ ID NO: 63102 - DNA, 20 bp, synthetic construct
  misc_feature 1..20: note = CRISPR gRNA sequence
  source 1..20: mol_type = other DNA
gatttctacagaagcattga

SEQ ID NO: 63103 - DNA, 20 bp, synthetic construct
  misc_feature 1..20: note = CRISPR gRNA sequence
  source 1..20: mol_type = other DNA
atttctacagaagcattgac

SEQ ID NO: 63104 - DNA, 20 bp, synthetic construct
  misc_feature 1..20: note = CRISPR gRNA sequence
  source 1..20: mol_type = other DNA
ctacagaagcattgacttta

SEQ ID NO: 63105 - DNA, 20 bp, synthetic construct
  misc_feature 1..20: note = CRISPR gRNA sequence
  source 1..20: mol_type = other DNA
tacagaagcattgactttac

SEQ ID NO: 63106 - DNA, 20 bp, synthetic construct
  misc_feature 1..20: note = CRISPR gRNA sequence
  source 1..20: mol_type = other DNA
cagaagcattgactttactt

SEQ ID NO: 63107 - DNA, 20 bp, synthetic construct
  misc_feature 1..20: note = CRISPR gRNA sequence
  source 1..20: mol_type = other DNA
actttacttatcgctgtgca

SEQ ID NO: 63108 - DNA, 20 bp, synthetic construct
  misc_feature 1..20: note = CRISPR gRNA sequence
  source 1..20: mol_type = other DNA
tacttatcgctgtgcatggc

SEQ ID NO: 63109 - DNA, 20 bp, synthetic construct
  misc_feature 1..20: note = CRISPR gRNA sequence
  source 1..20: mol_type = other DNA
acttatcgctgtgcatggca

SEQ ID NO: 63110 - DNA, 20 bp, synthetic construct
  misc_feature 1..20: note = CRISPR gRNA sequence
  source 1..20: mol_type = other DNA
cttatcgctgtgcatggcag

SEQ ID NO: 63111 - DNA, 20 bp, synthetic construct
  misc_feature 1..20: note = CRISPR gRNA sequence
  source 1..20: mol_type = other DNA
atcgctgtgcatggcagtaa

SEQ ID NO: 63112 - DNA, 20 bp, synthetic construct
  misc_feature 1..20: note = CRISPR gRNA sequence
  source 1..20: mol_type = other DNA
tcgctgtgcatggcagtaat

SEQ ID NO: 63113 - DNA, 20 bp, synthetic construct
  misc_feature 1..20: note = CRISPR gRNA sequence
  source 1..20: mol_type = other DNA
tgcatggcagtaatgccaac

SEQ ID NO: 63114 - DNA, 20 bp, synthetic construct
  misc_feature 1..20: note = CRISPR gRNA sequence
  source 1..20: mol_type = other DNA
taacctcagctccccagtga

SEQ ID NO: 63115 - DNA, 20 bp, synthetic construct
  misc_feature 1..20: note = CRISPR gRNA sequence
  source 1..20: mol_type = other DNA
agctccccagtgaatcaaaa

SEQ ID NO: 63116 - DNA, 20 bp, synthetic construct
  misc_feature 1..20: note = CRISPR gRNA sequence
  source 1..20: mol_type = other DNA
cccagtgaatcaaaactgtc

SEQ ID NO: 63117 - DNA, 20 bp, synthetic construct
  misc_feature 1..20: note = CRISPR gRNA sequence
  source 1..20: mol_type = other DNA
tccaagtccctggtccaata

SEQ ID NO: 63118 - DNA, 20 bp, synthetic construct
  misc_feature 1..20: note = CRISPR gRNA sequence
  source 1..20: mol_type = other DNA
gtccaataggcccgcatcac

SEQ ID NO: 63119 - DNA, 20 bp, synthetic construct
  misc_feature 1..20: note = CRISPR gRNA sequence
  source 1..20: mol_type = other DNA
agctggcatcattatctcat

SEQ ID NO: 63120 - DNA, 20 bp, synthetic construct
  misc_feature 1..20: note = CRISPR gRNA sequence
  source 1..20: mol_type = other DNA
gcatcattatctcatggctg

SEQ ID NO: 63121 - DNA, 20 bp, synthetic construct
  misc_feature 1..20: note = CRISPR gRNA sequence
  source 1..20: mol_type = other DNA
tctcatggctgtaaccagat

SEQ ID NO: 63122 - DNA, 20 bp, synthetic construct
  misc_feature 1..20: note = CRISPR gRNA sequence
  source 1..20: mol_type = other DNA
atggctgtaaccagatctga

SEQ ID NO: 63123 - DNA, 20 bp, synthetic construct
  misc_feature 1..20: note = CRISPR gRNA sequence
  source 1..20: mol_type = other DNA
taaccagatctgattgatat

SEQ ID NO: 63124 - DNA, 20 bp, synthetic construct
  misc_feature 1..20: note = CRISPR gRNA sequence
  source 1..20: mol_type = other DNA
attgatatttggccagtgag

SEQ ID NO: 63125 - DNA, 20 bp, synthetic construct
  misc_feature 1..20: note = CRISPR gRNA sequence
  source 1..20: mol_type = other DNA
atatttggccagtgagtccc

SEQ ID NO: 63126 - DNA, 20 bp, synthetic construct
  misc_feature 1..20: note = CRISPR gRNA sequence
  source 1..20: mol_type = other DNA
ggccagtgagtcccttttta

SEQ ID NO: 63127 - DNA, 20 bp, synthetic construct
  misc_feature 1..20: note = CRISPR gRNA sequence
  source 1..20: mol_type = other DNA
gccagtgagtccctttttaa

SEQ ID NO: 63128 - DNA, 20 bp, synthetic construct
  misc_feature 1..20: note = CRISPR gRNA sequence
  source 1..20: mol_type = other DNA
tttaatataggatttgttaa

SEQ ID NO: 63129 - DNA, 20 bp, synthetic construct
  misc_feature 1..20: note = CRISPR gRNA sequence
  source 1..20: mol_type = other DNA
ttaatataggatttgttaag

SEQ ID NO: 63130 - DNA, 20 bp, synthetic construct
  misc_feature 1..20: note = CRISPR gRNA sequence
  source 1..20: mol_type = other DNA
taatataggatttgttaaga

SEQ ID NO: 63131 - DNA, 20 bp, synthetic construct
  misc_feature 1..20: note = CRISPR gRNA sequence
  source 1..20: mol_type = other DNA
aatataggatttgttaagat

SEQ ID NO: 63132 - DNA, 20 bp, synthetic construct
  misc_feature 1..20: note = CRISPR gRNA sequence
  source 1..20: mol_type = other DNA
atataggatttgttaagata

SEQ ID NO: 63133 - DNA, 20 bp, synthetic construct
  misc_feature 1..20: note = CRISPR gRNA sequence
  source 1..20: mol_type = other DNA
gttaagatattgaagtgctc

SEQ ID NO: 63134 - DNA, 20 bp, synthetic construct
  misc_feature 1..20: note = CRISPR gRNA sequence
  source 1..20: mol_type = other DNA
ttaagatattgaagtgctct

SEQ ID NO: 63135 - DNA, 20 bp, synthetic construct
  misc_feature 1..20: note = CRISPR gRNA sequence
  source 1..20: mol_type = other DNA
agatattgaagtgctctcga

SEQ ID NO: 63136 - DNA, 20 bp, synthetic construct
  misc_feature 1..20: note = CRISPR gRNA sequence
  source 1..20: mol_type = other DNA
aagtgctctcgaactggttc

SEQ ID NO: 63137 - DNA, 20 bp, synthetic construct
  misc_feature 1..20: note = CRISPR gRNA sequence
  source 1..20: mol_type = other DNA
tcgaactggttccagcctcc

SEQ ID NO: 63138 - DNA, 20 bp, synthetic construct
  misc_feature 1..20: note = CRISPR gRNA sequence
  source 1..20: mol_type = other DNA
gaactggttccagcctccta

SEQ ID NO: 63139 - DNA, 20 bp, synthetic construct
  misc_feature 1..20: note = CRISPR gRNA sequence
  source 1..20: mol_type = other DNA
gttccagcctcctagctgga

SEQ ID NO: 63140 - DNA, 20 bp, synthetic construct
  misc_feature 1..20: note = CRISPR gRNA sequence
  source 1..20: mol_type = other DNA
cagcctcctagctggacaag

SEQ ID NO: 63141 - DNA, 20 bp, synthetic construct
  misc_feature 1..20: note = CRISPR gRNA sequence
  source 1..20: mol_type = other DNA
ctagctggacaaggagccca

SEQ ID NO: 63142 - DNA, 20 bp, synthetic construct
  misc_feature 1..20: note = CRISPR gRNA sequence
  source 1..20: mol_type = other DNA
gctggacaaggagcccaggg

SEQ ID NO: 63143 - DNA, 20 bp, synthetic construct
  misc_feature 1..20: note = CRISPR gRNA sequence
  source 1..20: mol_type = other DNA
gacaaggagcccagggccct

SEQ ID NO: 63144 - DNA, 20 bp, synthetic construct
  misc_feature 1..20: note = CRISPR gRNA sequence
  source 1..20: mol_type = other DNA
ctccaggggctgttcctatt

SEQ ID NO: 63145 - DNA, 20 bp, synthetic construct
  misc_feature 1..20: note = CRISPR gRNA sequence
  source 1..20: mol_type = other DNA
caggggctgttcctattggt

SEQ ID NO: 63146 - DNA, 20 bp, synthetic construct
  misc_feature 1..20: note = CRISPR gRNA sequence
  source 1..20: mol_type = other DNA
ttcctattggtcacttagct

SEQ ID NO: 63147 - DNA, 20 bp, synthetic construct
  misc_feature 1..20: note = CRISPR gRNA sequence
  source 1..20: mol_type = other DNA
ctattggtcacttagcttag

SEQ ID NO: 63148 - DNA, 20 bp, synthetic construct
  misc_feature 1..20: note = CRISPR gRNA sequence
  source 1..20: mol_type = other DNA
ttggtcacttagcttagctg

SEQ ID NO: 63149 - DNA, 20 bp, synthetic construct
  misc_feature 1..20: note = CRISPR gRNA sequence
  source 1..20: mol_type = other DNA
gtcacttagcttagctgtag

SEQ ID NO: 63150 - DNA, 20 bp, synthetic construct
  misc_feature 1..20: note = CRISPR gRNA sequence
  source 1..20: mol_type = other DNA
agcttagctgtaggaggacc

SEQ ID NO: 63151 - DNA, 20 bp, synthetic construct
  misc_feature 1..20: note = CRISPR gRNA sequence
  source 1..20: mol_type = other DNA
gcttagctgtaggaggaccc

SEQ ID NO: 63152 - DNA, 20 bp, synthetic construct
  misc_feature 1..20: note = CRISPR gRNA sequence
  source 1..20: mol_type = other DNA
agctgtaggaggaccctgct

SEQ ID NO: 63153 - DNA, 20 bp, synthetic construct
  misc_feature 1..20: note = CRISPR gRNA sequence
  source 1..20: mol_type = other DNA
gctgtaggaggaccctgctt

SEQ ID NO: 63154 - DNA, 20 bp, synthetic construct
  misc_feature 1..20: note = CRISPR gRNA sequence
  source 1..20: mol_type = other DNA
taggaggaccctgcttgact

SEQ ID NO: 63155 - DNA, 20 bp, synthetic construct
  misc_feature 1..20: note = CRISPR gRNA sequence
  source 1..20: mol_type = other DNA
cttgacttcttaaaattctt

SEQ ID NO: 63156 - DNA, 20 bp, synthetic construct
  misc_feature 1..20: note = CRISPR gRNA sequence
  source 1..20: mol_type = other DNA
gacttcttaaaattctttcc

SEQ ID NO: 63157 - DNA, 20 bp, synthetic construct
  misc_feature 1..20: note = CRISPR gRNA sequence
  source 1..20: mol_type = other DNA
acttcttaaaattctttcct

SEQ ID NO: 63158 - DNA, 20 bp, synthetic construct
  misc_feature 1..20: note = CRISPR gRNA sequence
  source 1..20: mol_type = other DNA
cttaaaattctttcctgagt

SEQ ID NO: 63159 - DNA, 20 bp, synthetic construct
  misc_feature 1..20: note = CRISPR gRNA sequence
  source 1..20: mol_type = other DNA
ttaaaattctttcctgagtc

SEQ ID NO: 63160 - DNA, 20 bp, synthetic construct
  misc_feature 1..20: note = CRISPR gRNA sequence
  source 1..20: mol_type = other DNA
aaaattctttcctgagtcct

SEQ ID NO: 63161 - DNA, 20 bp, synthetic construct
  misc_feature 1..20: note = CRISPR gRNA sequence
  source 1..20: mol_type = other DNA
aaattctttcctgagtcctc

SEQ ID NO: 63162 - DNA, 20 bp, synthetic construct
  misc_feature 1..20: note = CRISPR gRNA sequence
  source 1..20: mol_type = other DNA
tttcctgagtcctctttcct

SEQ ID NO: 63163 - DNA, 20 bp, synthetic construct
  misc_feature 1..20: note = CRISPR gRNA sequence
  source 1..20: mol_type = other DNA
tcctgagtcctctttccttt

SEQ ID NO: 63164 - DNA, 20 bp, synthetic construct
  misc_feature 1..20: note = CRISPR gRNA sequence
  source 1..20: mol_type = other DNA
cctgagtcctctttcctttc

SEQ ID NO: 63165 - DNA, 20 bp, synthetic construct
  misc_feature 1..20: note = CRISPR gRNA sequence
  source 1..20: mol_type = other DNA
ctgagtcctctttcctttct

SEQ ID NO: 63166 - DNA, 20 bp, synthetic construct
  misc_feature 1..20: note = CRISPR gRNA sequence
  source 1..20: mol_type = other DNA
agtcctctttcctttctccc

SEQ ID NO: 63167 - DNA, 20 bp, synthetic construct
  misc_feature 1..20: note = CRISPR gRNA sequence
  source 1..20: mol_type = other DNA
tttcctttctccctcccttc

SEQ ID NO: 63168 - DNA, 20 bp, synthetic construct
  misc_feature 1..20: note = CRISPR gRNA sequence
  source 1..20: mol_type = other DNA
tcctttctccctcccttcct

SEQ ID NO: 63169 - DNA, 20 bp, synthetic construct
  misc_feature 1..20: note = CRISPR gRNA sequence
  source 1..20: mol_type = other DNA
cctttctccctcccttcctt

SEQ ID NO: 63170 - DNA, 20 bp, synthetic construct
  misc_feature 1..20: note = CRISPR gRNA sequence
  source 1..20: mol_type = other DNA
ctttctccctcccttccttt

SEQ ID NO: 63171 - DNA, 20 bp, synthetic construct
  misc_feature 1..20: note = CRISPR gRNA sequence
  source 1..20: mol_type = other DNA
tctccctcccttcctttctg

SEQ ID NO: 63172 - DNA, 20 bp, synthetic construct
  misc_feature 1..20: note = CRISPR gRNA sequence
  source 1..20: mol_type = other DNA
ctccctcccttcctttctgg

SEQ ID NO: 63173 - DNA, 20 bp, synthetic construct
  misc_feature 1..20: note = CRISPR gRNA sequence
  source 1..20: mol_type = other DNA
tccctcccttcctttctggg

SEQ ID NO: 63174 - DNA, 20 bp, synthetic construct
  misc_feature 1..20: note = CRISPR gRNA sequence
  source 1..20: mol_type = other DNA
cctcccttcctttctgggtc

SEQ ID NO: 63175 - DNA, 20 bp, synthetic construct
  misc_feature 1..20: note = CRISPR gRNA sequence
  source 1..20: mol_type = other DNA
ccttcctttctgggtcccct

SEQ ID NO: 63176 - DNA, 20 bp, synthetic construct
  misc_feature 1..20: note = CRISPR gRNA sequence
  source 1..20: mol_type = other DNA
cctttctgggtccccttcct

SEQ ID NO: 63177 - DNA, 20 bp, synthetic construct
  misc_feature 1..20: note = CRISPR gRNA sequence
  source 1..20: mol_type = other DNA
ctttctgggtccccttcctt

SEQ ID NO: 63178 - DNA, 20 bp, synthetic construct
  misc_feature 1..20: note = CRISPR gRNA sequence
  source 1..20: mol_type = other DNA
tctgggtccccttccttctt

SEQ ID NO: 63179 - DNA, 20 bp, synthetic construct
  misc_feature 1..20: note = CRISPR gRNA sequence
  source 1..20: mol_type = other DNA
ctgggtccccttccttcttg

SEQ ID NO: 63180 - DNA, 20 bp, synthetic construct
  misc_feature 1..20: note = CRISPR gRNA sequence
  source 1..20: mol_type = other DNA
tgggtccccttccttcttgt

SEQ ID NO: 63181 - DNA, 20 bp, synthetic construct
  misc_feature 1..20: note = CRISPR gRNA sequence
  source 1..20: mol_type = other DNA
ggtccccttccttcttgttt

SEQ ID NO: 63182 - DNA, 20 bp, synthetic construct
  misc_feature 1..20: note = CRISPR gRNA sequence
  source 1..20: mol_type = other DNA
ccttcttgttttccttcttc

SEQ ID NO: 63183 - DNA, 20 bp, synthetic construct
  misc_feature 1..20: note = CRISPR gRNA sequence
  source 1..20: mol_type = other DNA
cttcttgttttccttcttcc

SEQ ID NO: 63184 - DNA, 20 bp, synthetic construct
  misc_feature 1..20: note = CRISPR gRNA sequence
  source 1..20: mol_type = other DNA
cttgttttccttcttccttt

SEQ ID NO: 63185 - DNA, 20 bp, synthetic construct
  misc_feature 1..20: note = CRISPR gRNA sequence
  source 1..20: mol_type = other DNA
ttgttttccttcttcctttc

SEQ ID NO: 63186 - DNA, 20 bp, synthetic construct
  misc_feature 1..20: note = CRISPR gRNA sequence
  source 1..20: mol_type = other DNA
gttttccttcttcctttctc

SEQ ID NO: 63187 - DNA, 20 bp, synthetic construct
  misc_feature 1..20: note = CRISPR gRNA sequence
  source 1..20: mol_type = other DNA
ttttccttcttcctttctca

SEQ ID NO: 63188 - DNA, 20 bp, synthetic construct
  misc_feature 1..20: note = CRISPR gRNA sequence
  source 1..20: mol_type = other DNA
tccttcttcctttctcaaac

SEQ ID NO: 63189 - DNA, 20 bp, synthetic construct
  misc_feature 1..20: note = CRISPR gRNA sequence
  source 1..20: mol_type = other DNA
ccttcttcctttctcaaact

SEQ ID NO: 63190 - DNA, 20 bp, synthetic construct
  misc_feature 1..20: note = CRISPR gRNA sequence
  source 1..20: mol_type = other DNA
cttcttcctttctcaaactc

SEQ ID NO: 63191 - DNA, 20 bp, synthetic construct
  misc_feature 1..20: note = CRISPR gRNA sequence
  source 1..20: mol_type = other DNA
cttcctttctcaaactcttc

SEQ ID NO: 63192 - DNA, 20 bp, synthetic construct
  misc_feature 1..20: note = CRISPR gRNA sequence
  source 1..20: mol_type = other DNA
ttcctttctcaaactcttcc

SEQ ID NO: 63193 - DNA, 20 bp, synthetic construct
  misc_feature 1..20: note = CRISPR gRNA sequence
  source 1..20: mol_type = other DNA
cctttctcaaactcttccag

SEQ ID NO: 63194 - DNA, 20 bp, synthetic construct
  misc_feature 1..20: note = CRISPR gRNA sequence
  source 1..20: mol_type = other DNA
ctttctcaaactcttccaga

SEQ ID NO: 63195 - DNA, 20 bp, synthetic construct
  misc_feature 1..20: note = CRISPR gRNA sequence
  source 1..20: mol_type = other DNA
tctcaaactcttccagaaag

SEQ ID NO: 63196 - DNA, 20 bp, synthetic construct
  misc_feature 1..20: note = CRISPR gRNA sequence
  source 1..20: mol_type = other DNA
ctcaaactcttccagaaagg

SEQ ID NO: 63197 - DNA, 20 bp, synthetic construct
  misc_feature 1..20: note = CRISPR gRNA sequence
  source 1..20: mol_type = other DNA
tcaaactcttccagaaaggc

SEQ ID NO: 63198 - DNA, 20 bp, synthetic construct
  misc_feature 1..20: note = CRISPR gRNA sequence
  source 1..20: mol_type = other DNA
aaactcttccagaaaggcat

SEQ ID NO: 63199 - DNA, 20 bp, synthetic construct
  misc_feature 1..20: note = CRISPR gRNA sequence
  source 1..20: mol_type = other DNA
ttccagaaaggcattaaagt

SEQ ID NO: 63200 - DNA, 20 bp, synthetic construct
  misc_feature 1..20: note = CRISPR gRNA sequence
  source 1..20: mol_type = other DNA
ccagaaaggcattaaagtga

SEQ ID NO: 63201 - DNA, 20 bp, synthetic construct
  misc_feature 1..20: note = CRISPR gRNA sequence
  source 1..20: mol_type = other DNA
cagaaaggcattaaagtgat

SEQ ID NO: 63202 - DNA, 20 bp, synthetic construct
  misc_feature 1..20: note = CRISPR gRNA sequence
  source 1..20: mol_type = other DNA
aagtgattgttgaaaatcca

SEQ ID NO: 63203 - DNA, 20 bp, synthetic construct
  misc_feature 1..20: note = CRISPR gRNA sequence
  source 1..20: mol_type = other DNA
ttgaaaatccatacaatgag

SEQ ID NO: 63204 - DNA, 20 bp, synthetic construct
  misc_feature 1..20: note = CRISPR gRNA sequence
  source 1..20: mol_type = other DNA
aaaatccatacaatgagaca

SEQ ID NO: 63205 - DNA, 20 bp, synthetic construct
  misc_feature 1..20: note = CRISPR gRNA sequence
  source 1..20: mol_type = other DNA
cagaaactattaagggaagt

SEQ ID NO: 63206 - DNA, 20 bp, synthetic construct
  misc_feature 1..20: note = CRISPR gRNA sequence
  source 1..20: mol_type = other DNA
ttaagggaagtgaggaaatg

SEQ ID NO: 63207 - DNA, 20 bp, synthetic construct
  misc_feature 1..20: note = CRISPR gRNA sequence
  source 1..20: mol_type = other DNA
agggaagtgaggaaatgtgg

SEQ ID NO: 63208 - DNA, 20 bp, synthetic construct
  misc_feature 1..20: note = CRISPR gRNA sequence
  source 1..20: mol_type = other DNA
acagaggagggaggttgcag

SEQ ID NO: 63209 - DNA, 20 bp, synthetic construct
  misc_feature 1..20: note = CRISPR gRNA sequence
  source 1..20: mol_type = other DNA
caggcctggccaaactcact

SEQ ID NO: 63210 - DNA, 20 bp, synthetic construct
  misc_feature 1..20: note = CRISPR gRNA sequence
  source 1..20: mol_type = other DNA
gccaaactcactgggaactt

SEQ ID NO: 63211 - DNA, 20 bp, synthetic construct
  misc_feature 1..20: note = CRISPR gRNA sequence
  source 1..20: mol_type = other DNA
actgggaacttcacttatat

SEQ ID NO: 63212 - DNA, 20 bp, synthetic construct
  misc_feature 1..20: note = CRISPR gRNA sequence
  source 1..20: mol_type = other DNA
ggaacttcacttatatgacc

SEQ ID NO: 63213 - DNA, 20 bp, synthetic construct
  misc_feature 1..20: note = CRISPR gRNA sequence
  source 1..20: mol_type = other DNA
cacttatatgaccaccggcg

SEQ ID NO: 63214 - DNA, 20 bp, synthetic construct
  misc_feature 1..20: note = CRISPR gRNA sequence
  source 1..20: mol_type = other DNA
acttatatgaccaccggcgg

SEQ ID NO: 63215 - DNA, 20 bp, synthetic construct
  misc_feature 1..20: note = CRISPR gRNA sequence
  source 1..20: mol_type = other DNA
atatgaccaccggcggcttc

SEQ ID NO: 63216 - DNA, 20 bp, synthetic construct
  misc_feature 1..20: note = CRISPR gRNA sequence
  source 1..20: mol_type = other DNA
tatgaccaccggcggcttcc

SEQ ID NO: 63217 - DNA, 20 bp, synthetic construct
  misc_feature 1..20: note = CRISPR gRNA sequence
  source 1..20: mol_type = other DNA
ccatagagcttggtccttcc

SEQ ID NO: 63218 - DNA, 20 bp, synthetic construct
  misc_feature 1..20: note = CRISPR gRNA sequence
  source 1..20: mol_type = other DNA
catagagcttggtccttccc

SEQ ID NO: 63219 - DNA, 20 bp, synthetic construct
  misc_feature 1..20: note = CRISPR gRNA sequence
  source 1..20: mol_type = other DNA
ggtccttccctgatggacag

SEQ ID NO: 63220 - DNA, 20 bp, synthetic construct
  misc_feature 1..20: note = CRISPR gRNA sequence
  source 1..20: mol_type = other DNA
gtccttccctgatggacaga

SEQ ID NO: 63221 - DNA, 20 bp, synthetic construct
  misc_feature 1..20: note = CRISPR gRNA sequence
  source 1..20: mol_type = other DNA
ccctgatggacagatggcca

SEQ ID NO: 63222 - DNA, 20 bp, synthetic construct
  misc_feature 1..20: note = CRISPR gRNA sequence
  source 1..20: mol_type = other DNA
cctgatggacagatggccat

SEQ ID NO: 63223 - DNA, 20 bp, synthetic construct
  misc_feature 1..20: note = CRISPR gRNA sequence
  source 1..20: mol_type = other DNA
atggacagatggccatttag

SEQ ID NO: 63224 - DNA, 20 bp, synthetic construct
  misc_feature 1..20: note = CRISPR gRNA sequence
  source 1..20: mol_type = other DNA
agtgcttggagctgagtgtt

SEQ ID NO: 63225 - DNA, 20 bp, synthetic construct
  misc_feature 1..20: note = CRISPR gRNA sequence
  source 1..20: mol_type = other DNA
gtgcttggagctgagtgttt

SEQ ID NO: 63226 - DNA, 20 bp, synthetic construct
  misc_feature 1..20: note = CRISPR gRNA sequence
  source 1..20: mol_type = other DNA
ggagctgagtgtttctgggg

SEQ ID NO: 63227 - DNA, 20 bp, synthetic construct
  misc_feature 1..20: note = CRISPR gRNA sequence
  source 1..20: mol_type = other DNA
gagctgagtgtttctggggg

SEQ ID NO: 63228 - DNA, 20 bp, synthetic construct
  misc_feature 1..20: note = CRISPR gRNA sequence
  source 1..20: mol_type = other DNA
agtgtttctgggggctgctg

SEQ ID NO: 63229 - DNA, 20 bp, synthetic construct
  misc_feature 1..20: note = CRISPR gRNA sequence
  source 1..20: mol_type = other DNA
ctgggggctgctggctgttg

SEQ ID NO: 63230 - DNA, 20 bp, synthetic construct
  misc_feature 1..20: note = CRISPR gRNA sequence
  source 1..20: mol_type = other DNA
tgggggctgctggctgttgg

SEQ ID NO: 63231 - DNA, 20 bp, synthetic construct
  misc_feature 1..20: note = CRISPR gRNA sequence
  source 1..20: mol_type = other DNA
ggggctgctggctgttggcc

SEQ ID NO: 63232 - DNA, 20 bp, synthetic construct
  misc_feature 1..20: note = CRISPR gRNA sequence
  source 1..20: mol_type = other DNA
ctggctgttggccctgcttc

SEQ ID NO: 63233 - DNA, 20 bp, synthetic construct
  misc_feature 1..20: note = CRISPR gRNA sequence
  source 1..20: mol_type = other DNA
gctgttggccctgcttcctg

SEQ ID NO: 63234 - DNA, 20 bp, synthetic construct
  misc_feature 1..20: note = CRISPR gRNA sequence
  source 1..20: mol_type = other DNA
ttggccctgcttcctgcatc

SEQ ID NO: 63235 - DNA, 20 bp, synthetic construct
  misc_feature 1..20: note = CRISPR gRNA sequence
  source 1..20: mol_type = other DNA
gccctgcttcctgcatcctg

SEQ ID NO: 63236 - DNA, 20 bp, synthetic construct
  misc_feature 1..20: note = CRISPR gRNA sequence
  source 1..20: mol_type = other DNA
cttcctgcatcctggactgc

SEQ ID NO: 63237 - DNA, 20 bp, synthetic construct
  misc_feature 1..20: note = CRISPR gRNA sequence
  source 1..20: mol_type = other DNA
cctgcatcctggactgcaag

SEQ ID NO: 63238 - DNA, 20 bp, synthetic construct
  misc_feature 1..20: note = CRISPR gRNA sequence
  source 1..20: mol_type = other DNA
ctgcatcctggactgcaaga

SEQ ID NO: 63239 - DNA, 20 bp, synthetic construct
  misc_feature 1..20: note = CRISPR gRNA sequence
  source 1..20: mol_type = other DNA
catcctggactgcaagactg

SEQ ID NO: 63240 - DNA, 20 bp, synthetic construct
  misc_feature 1..20: note = CRISPR gRNA sequence
  source 1..20: mol_type = other DNA
gactgcaagactgccaggcc

SEQ ID NO: 63241 - DNA, 20 bp, synthetic construct
  misc_feature 1..20: note = CRISPR gRNA sequence
  source 1..20: mol_type = other DNA
caagactgccaggcccagaa

SEQ ID NO: 63242 - DNA, 20 bp, synthetic construct
  misc_feature 1..20: note = CRISPR gRNA sequence
  source 1..20: mol_type = other DNA
ccaggcccagaacatccacc

SEQ ID NO: 63243 - DNA, 20 bp, synthetic construct
  misc_feature 1..20: note = CRISPR gRNA sequence
  source 1..20: mol_type = other DNA
ccaatgggggtgcctagaag

SEQ ID NO: 63244 - DNA, 20 bp, synthetic construct
  misc_feature 1..20: note = CRISPR gRNA sequence
  source 1..20: mol_type = other DNA
caatgggggtgcctagaagt

SEQ ID NO: 63245 - DNA, 20 bp, synthetic construct
  misc_feature 1..20: note = CRISPR gRNA sequence
  source 1..20: mol_type = other DNA
gaagtccactctgcaaatag

SEQ ID NO: 63246 - DNA, 20 bp, synthetic construct
  misc_feature 1..20: note = CRISPR gRNA sequence
  source 1..20: mol_type = other DNA
tgcaaatagaagctggtgtt

SEQ ID NO: 63247 - DNA, 20 bp, synthetic construct
  misc_feature 1..20: note = CRISPR gRNA sequence
  source 1..20: mol_type = other DNA
caaatagaagctggtgttga

SEQ ID NO: 63248 - DNA, 20 bp, synthetic construct
  misc_feature 1..20: note = CRISPR gRNA sequence
  source 1..20: mol_type = other DNA
gtgttgacccagcctctgcc

SEQ ID NO: 63249 - DNA, 20 bp, synthetic construct
  misc_feature 1..20: note = CRISPR gRNA sequence
  source 1..20: mol_type = other DNA
acccagcctctgcctgctgc

SEQ ID NO: 63250 - DNA, 20 bp, synthetic construct
  misc_feature 1..20: note = CRISPR gRNA sequence
  source 1..20: mol_type = other DNA
tgcctgctgcctgcctttcc

SEQ ID NO: 63251 - DNA, 20 bp, synthetic construct
  misc_feature 1..20: note = CRISPR gRNA sequence
  source 1..20: mol_type = other DNA
cctgctgcctgcctttccag

SEQ ID NO: 63252 - DNA, 20 bp, synthetic construct
  misc_feature 1..20: note = CRISPR gRNA sequence
  source 1..20: mol_type = other DNA
ctgcctgcctttccagtccc

SEQ ID NO: 63253 - DNA, 20 bp, synthetic construct
  misc_feature 1..20: note = CRISPR gRNA sequence
  source 1..20: mol_type = other DNA
cctgcctttccagtccctgc

SEQ ID NO: 63254 - DNA, 20 bp, synthetic construct
  misc_feature 1..20: note = CRISPR gRNA sequence
  source 1..20: mol_type = other DNA
cctttccagtccctgcatgt

SEQ ID NO: 63255 - DNA, 20 bp, synthetic construct
  misc_feature 1..20: note = CRISPR gRNA sequence
  source 1..20: mol_type = other DNA
tccagtccctgcatgtgggt

SEQ ID NO: 63256 - DNA, 20 bp, synthetic construct
  misc_feature 1..20: note = CRISPR gRNA sequence
  source 1..20: mol_type = other DNA
ccagtccctgcatgtgggtg

SEQ ID NO: 63257 - DNA, 20 bp, synthetic construct
  misc_feature 1..20: note = CRISPR gRNA sequence
  source 1..20: mol_type = other DNA
cagtccctgcatgtgggtgt

SEQ ID NO: 63258 - DNA, 20 bp, synthetic construct
  misc_feature 1..20: note = CRISPR gRNA sequence
  source 1..20: mol_type = other DNA
catgtgggtgtacttggctg

SEQ ID NO: 63259 - DNA, 20 bp, synthetic construct
  misc_feature 1..20: note = CRISPR gRNA sequence
  source 1..20: mol_type = other DNA
ggctgcctgccacctgtctg

SEQ ID NO: 63260 - DNA, 20 bp, synthetic construct
  misc_feature 1..20: note = CRISPR gRNA sequence
  source 1..20: mol_type = other DNA
gctgcctgccacctgtctgt

SEQ ID NO: 63261 - DNA, 20 bp, synthetic construct
  misc_feature 1..20: note = CRISPR gRNA sequence
  source 1..20: mol_type = other DNA
cctgccacctgtctgtggac

SEQ ID NO: 63262 - DNA, 20 bp, synthetic construct
  misc_feature 1..20: note = CRISPR gRNA sequence
  source 1..20: mol_type = other DNA
ccacctgtctgtggactgga

SEQ ID NO: 63263 - DNA, 20 bp, synthetic construct
  misc_feature 1..20: note = CRISPR gRNA sequence
  source 1..20: mol_type = other DNA
tctgtggactggagttcccc

SEQ ID NO: 63264 - DNA, 20 bp, synthetic construct
  misc_feature 1..20: note = CRISPR gRNA sequence
  source 1..20: mol_type = other DNA
tggactggagttccccaaag

SEQ ID NO: 63265 - DNA, 20 bp, synthetic construct
  misc_feature 1..20: note = CRISPR gRNA sequence
  source 1..20: mol_type = other DNA
gagttccccaaaggttctgg

SEQ ID NO: 63266 - DNA, 20 bp, synthetic construct
  misc_feature 1..20: note = CRISPR gRNA sequence
  source 1..20: mol_type = other DNA
cccaaaggttctgggtaacc

SEQ ID NO: 63267 - DNA, 20 bp, synthetic construct
  misc_feature 1..20: note = CRISPR gRNA sequence
  source 1..20: mol_type = other DNA
tgggtaacccctcagcccag

SEQ ID NO: 63268 - DNA, 20 bp, synthetic construct
  misc_feature 1..20: note = CRISPR gRNA sequence
  source 1..20: mol_type = other DNA
ggtaacccctcagcccagat

SEQ ID NO: 63269 - DNA, 20 bp, synthetic construct
  misc_feature 1..20: note = CRISPR gRNA sequence
  source 1..20: mol_type = other DNA
agcccagatccccagacccc

SEQ ID NO: 63270 - DNA, 20 bp, synthetic construct
  misc_feature 1..20: note = CRISPR gRNA sequence
  source 1..20: mol_type = other DNA
ctccaccccttcctttgctt

SEQ ID NO: 63271 - DNA, 20 bp, synthetic construct
  misc_feature 1..20: note = CRISPR gRNA sequence
  source 1..20: mol_type = other DNA
caccccttcctttgcttttt

SEQ ID NO: 63272 - DNA, 20 bp, synthetic construct
  misc_feature 1..20: note = CRISPR gRNA sequence
  source 1..20: mol_type = other DNA
cctttgctttttcaggcctg

SEQ ID NO: 63273 - DNA, 20 bp, synthetic construct
  misc_feature 1..20: note = CRISPR gRNA sequence
  source 1..20: mol_type = other DNA
ctttgctttttcaggcctga

SEQ ID NO: 63274 - DNA, 20 bp, synthetic construct
  misc_feature 1..20: note = CRISPR gRNA sequence
  source 1..20: mol_type = other DNA
tgctttttcaggcctgaagc

SEQ ID NO: 63275 - DNA, 20 bp, synthetic construct
  misc_feature 1..20: note = CRISPR gRNA sequence
  source 1..20: mol_type = other DNA
gctttttcaggcctgaagcg

SEQ ID NO: 63276 - DNA, 20 bp, synthetic construct
  misc_feature 1..20: note = CRISPR gRNA sequence
  source 1..20: mol_type = other DNA
ctttttcaggcctgaagcgc

SEQ ID NO: 63277 - DNA, 20 bp, synthetic construct
  misc_feature 1..20: note = CRISPR gRNA sequence
  source 1..20: mol_type = other DNA
tttcaggcctgaagcgccca

SEQ ID NO: 63278 - DNA, 20 bp, synthetic construct
  misc_feature 1..20: note = CRISPR gRNA sequence
  source 1..20: mol_type = other DNA
ttcaggcctgaagcgcccac

SEQ ID NO: 63279 - DNA, 20 bp, synthetic construct
  misc_feature 1..20: note = CRISPR gRNA sequence
  source 1..20: mol_type = other DNA
tcaggcctgaagcgcccaca

SEQ ID NO: 63280 - DNA, 20 bp, synthetic construct
  misc_feature 1..20: note = CRISPR gRNA sequence
  source 1..20: mol_type = other DNA
caggcctgaagcgcccacat

SEQ ID NO: 63281 - DNA, 20 bp, synthetic construct
  misc_feature 1..20: note = CRISPR gRNA sequence
  source 1..20: mol_type = other DNA
aggcctgaagcgcccacatc

SEQ ID NO: 63282 - DNA, 20 bp, synthetic construct
  misc_feature 1..20: note = CRISPR gRNA sequence
  source 1..20: mol_type = other DNA
aagcgcccacatcagagctg

SEQ ID NO: 63283 - DNA, 20 bp, synthetic construct
  misc_feature 1..20: note = CRISPR gRNA sequence
  source 1..20: mol_type = other DNA
tgggtcctcaccccgccgga

SEQ ID NO: 63284 - DNA, 20 bp, synthetic construct
  misc_feature 1..20: note = CRISPR gRNA sequence
  source 1..20: mol_type = other DNA
accccgccggaagcagtgca

SEQ ID NO: 63285 - DNA, 20 bp, synthetic construct
  misc_feature 1..20: note = CRISPR gRNA sequence
  source 1..20: mol_type = other DNA
ggtgggtaccagtgtgggga

SEQ ID NO: 63286 - DNA, 20 bp, synthetic construct
  misc_feature 1..20: note = CRISPR gRNA sequence
  source 1..20: mol_type = other DNA
cctgggggccaagacccgga

SEQ ID NO: 63287 - DNA, 20 bp, synthetic construct
  misc_feature 1..20: note = CRISPR gRNA sequence
  source 1..20: mol_type = other DNA
ggggccaagacccggaccct

SEQ ID NO: 63288 - DNA, 20 bp, synthetic construct
  misc_feature 1..20: note = CRISPR gRNA sequence
  source 1..20: mol_type = other DNA
gaccttgtcccctgccaata

SEQ ID NO: 63289 - DNA, 20 bp, synthetic construct
  misc_feature 1..20: note = CRISPR gRNA sequence
  source 1..20: mol_type = other DNA
gtcccctgccaataagcctc

SEQ ID NO: 63290 - DNA, 20 bp, synthetic construct
  misc_feature 1..20: note = CRISPR gRNA sequence
  source 1..20: mol_type = other DNA
tcccctgccaataagcctcc

SEQ ID NO: 63291 - DNA, 20 bp, synthetic construct
  misc_feature 1..20: note = CRISPR gRNA sequence
  source 1..20: mol_type = other DNA
ccaataagcctccagaggcc

SEQ ID NO: 63292 - DNA, 20 bp, synthetic construct
  misc_feature 1..20: note = CRISPR gRNA sequence
  source 1..20: mol_type = other DNA
cagaggcccagtgactcttg

SEQ ID NO: 63293 - DNA, 20 bp, synthetic construct
  misc_feature 1..20: note = CRISPR gRNA sequence
  source 1..20: mol_type = other DNA
ttgtctcgcaagtttccagg

SEQ ID NO: 63294 - DNA, 20 bp, synthetic construct
  misc_feature 1..20: note = CRISPR gRNA sequence
  source 1..20: mol_type = other DNA
gtctcgcaagtttccaggag

SEQ ID NO: 63295 - DNA, 20 bp, synthetic construct
  misc_feature 1..20: note = CRISPR gRNA sequence
  source 1..20: mol_type = other DNA
tctcgcaagtttccaggaga

SEQ ID NO: 63296 - DNA, 20 bp, synthetic construct
  misc_feature 1..20: note = CRISPR gRNA sequence
  source 1..20: mol_type = other DNA
gcaagtttccaggagaaaag

SEQ ID NO: 63297 - DNA, 20 bp, synthetic construct
  misc_feature 1..20: note = CRISPR gRNA sequence
  source 1..20: mol_type = other DNA
ccaggagaaaaggactggag

SEQ ID NO: 63298 - DNA, 20 bp, synthetic construct
  misc_feature 1..20: note = CRISPR gRNA sequence
  source 1..20: mol_type = other DNA
caggagaaaaggactggagg

SEQ ID NO: 63299 - DNA, 20 bp, synthetic construct
  misc_feature 1..20: note = CRISPR gRNA sequence
  source 1..20: mol_type = other DNA
gaggtcttgcacaggcagag

SEQ ID NO: 63300 - DNA, 20 bp, synthetic construct
  misc_feature 1..20: note = CRISPR gRNA sequence
  source 1..20: mol_type = other DNA
gcacaggcagaggagaggcc

SEQ ID NO: 63301 - DNA, 20 bp, synthetic construct
  misc_feature 1..20: note = CRISPR gRNA sequence
  source 1..20: mol_type = other DNA
cacaggcagaggagaggcct

SEQ ID NO: 63302 - DNA, 20 bp, synthetic construct
  misc_feature 1..20: note = CRISPR gRNA sequence
  source 1..20: mol_type = other DNA
ggctggcagcgaaggggctc

SEQ ID NO: 63303 - DNA, 20 bp, synthetic construct
  misc_feature 1..20: note = CRISPR gRNA sequence
  source 1..20: mol_type = other DNA
gcagcgaaggggctccccac

SEQ ID NO: 63304 - DNA, 20 bp, synthetic construct
  misc_feature 1..20: note = CRISPR gRNA sequence
  source 1..20: mol_type = other DNA
cccacccatctggctgcatg

SEQ ID NO: 63305 - DNA, 20 bp, synthetic construct
  misc_feature 1..20: note = CRISPR gRNA sequence
  source 1..20: mol_type = other DNA
gctgcatggggacttctctg

SEQ ID NO: 63306 - DNA, 20 bp, synthetic construct
  misc_feature 1..20: note = CRISPR gRNA sequence
  source 1..20: mol_type = other DNA
catggggacttctctgaaga

SEQ ID NO: 63307 - DNA, 20 bp, synthetic construct
  misc_feature 1..20: note = CRISPR gRNA sequence
  source 1..20: mol_type = other DNA
ctctgaagagggctccgctg

SEQ ID NO: 63308 - DNA, 20 bp, synthetic construct
  misc_feature 1..20: note = CRISPR gRNA sequence
  source 1..20: mol_type = other DNA
tctgaagagggctccgctga

SEQ ID NO: 63309 - DNA, 20 bp, synthetic construct
  misc_feature 1..20: note = CRISPR gRNA sequence
  source 1..20: mol_type = other DNA
tgaagagggctccgctgaag

SEQ ID NO: 63310 - DNA, 20 bp, synthetic construct
  misc_feature 1..20: note = CRISPR gRNA sequence
  source 1..20: mol_type = other DNA
aagagggctccgctgaagga

SEQ ID NO: 63311 - DNA, 20 bp, synthetic construct
  misc_feature 1..20: note = CRISPR gRNA sequence
  source 1..20: mol_type = other DNA
cgctgaaggagctggaagca

SEQ ID NO: 63312 - DNA, 20 bp, synthetic construct
  misc_feature 1..20: note = CRISPR gRNA sequence
  source 1..20: mol_type = other DNA
aaggagctggaagcaccata

SEQ ID NO: 63313 - DNA, 20 bp, synthetic construct
  misc_feature 1..20: note = CRISPR gRNA sequence
  source 1..20: mol_type = other DNA
gaagcaccatacaggtctca

SEQ ID NO: 63314 - DNA, 20 bp, synthetic construct
  misc_feature 1..20: note = CRISPR gRNA sequence
  source 1..20: mol_type = other DNA
agcttcgctgtccaggcttt

SEQ ID NO: 63315 - DNA, 20 bp, synthetic construct
  misc_feature 1..20: note = CRISPR gRNA sequence
  source 1..20: mol_type = other DNA
cgctgtccaggcttttccag

SEQ ID NO: 63316 - DNA, 20 bp, synthetic construct
  misc_feature 1..20: note = CRISPR gRNA sequence
  source 1..20: mol_type = other DNA
gctgtccaggcttttccagg

SEQ ID NO: 63317 - DNA, 20 bp, synthetic construct
  misc_feature 1..20: note = CRISPR gRNA sequence
  source 1..20: mol_type = other DNA
tccaggcttttccagggaca

SEQ ID NO: 63318 - DNA, 20 bp, synthetic construct
  misc_feature 1..20: note = CRISPR gRNA sequence
  source 1..20: mol_type = other DNA
ttccagggacaccctatgtc

SEQ ID NO: 63319 - DNA, 20 bp, synthetic construct
  misc_feature 1..20: note = CRISPR gRNA sequence
  source 1..20: mol_type = other DNA
tccagggacaccctatgtcc

SEQ ID NO: 63320 - DNA, 20 bp, synthetic construct
  misc_feature 1..20: note = CRISPR gRNA sequence
  source 1..20: mol_type = other DNA
ccagggacaccctatgtcct

SEQ ID NO: 63321 - DNA, 20 bp, synthetic construct
  misc_feature 1..20: note = CRISPR gRNA sequence
  source 1..20: mol_type = other DNA
cagggacaccctatgtcctc

SEQ ID NO: 63322 - DNA, 20 bp, synthetic construct
  misc_feature 1..20: note = CRISPR gRNA sequence
  source 1..20: mol_type = other DNA
tgtcctcagtgttgaaggag

SEQ ID NO: 63323 - DNA, 20 bp, synthetic construct
  misc_feature 1..20: note = CRISPR gRNA sequence
  source 1..20: mol_type = other DNA
agtgttgaaggagacccagg

SEQ ID NO: 63324 - DNA, 20 bp, synthetic construct
  misc_feature 1..20: note = CRISPR gRNA sequence
  source 1..20: mol_type = other DNA
aaggagacccagggaggaga

SEQ ID NO: 63325 - DNA, 20 bp, synthetic construct
  misc_feature 1..20: note = CRISPR gRNA sequence
  source 1..20: mol_type = other DNA
gggggtgagcagggatgggg

SEQ ID NO: 63326 - DNA, 20 bp, synthetic construct
  misc_feature 1..20: note = CRISPR gRNA sequence
  source 1..20: mol_type = other DNA
ggggtgagcagggatgggga

SEQ ID NO: 63327 - DNA, 20 bp, synthetic construct
  misc_feature 1..20: note = CRISPR gRNA sequence
  source 1..20: mol_type = other DNA
ggagaaaccttcaagacaga

SEQ ID NO: 63328 - DNA, 20 bp, synthetic construct
  misc_feature 1..20: note = CRISPR gRNA sequence
  source 1..20: mol_type = other DNA
caagacagaggccctggggg

SEQ ID NO: 63329 - DNA, 20 bp, synthetic construct
  misc_feature 1..20: note = CRISPR gRNA sequence
  source 1..20: mol_type = other DNA
aagacagaggccctgggggc

SEQ ID NO: 63330 - DNA, 20 bp, synthetic construct
  misc_feature 1..20: note = CRISPR gRNA sequence
  source 1..20: mol_type = other DNA
ggggcccatggggagacatg

SEQ ID NO: 63331 - DNA, 20 bp, synthetic construct
  misc_feature 1..20: note = CRISPR gRNA sequence
  source 1..20: mol_type = other DNA
cttagggcaggccaggccag

SEQ ID NO: 63332 - DNA, 20 bp, synthetic construct
  misc_feature 1..20: note = CRISPR gRNA sequence
  source 1..20: mol_type = other DNA
agggcaggccaggccagtga

SEQ ID NO: 63333 - DNA, 20 bp, synthetic construct
  misc_feature 1..20: note = CRISPR gRNA sequence
  source 1..20: mol_type = other DNA
gggcaggccaggccagtgag

SEQ ID NO: 63334 - DNA, 20 bp, synthetic construct
  misc_feature 1..20: note = CRISPR gRNA sequence
  source 1..20: mol_type = other DNA
ctctcattcttgaccagttc

SEQ ID NO: 63335 - DNA, 20 bp, synthetic construct
  misc_feature 1..20: note = CRISPR gRNA sequence
  source 1..20: mol_type = other DNA
tctcattcttgaccagttct

SEQ ID NO: 63336 - DNA, 20 bp, synthetic construct
  misc_feature 1..20: note = CRISPR gRNA sequence
  source 1..20: mol_type = other DNA
tcattcttgaccagttctca

SEQ ID NO: 63337 - DNA, 20 bp, synthetic construct
  misc_feature 1..20: note = CRISPR gRNA sequence
  source 1..20: mol_type = other DNA
attcttgaccagttctcaga

SEQ ID NO: 63338 - DNA, 20 bp, synthetic construct
  misc_feature 1..20: note = CRISPR gRNA sequence
  source 1..20: mol_type = other DNA
ttgaccagttctcagaatgg

SEQ ID NO: 63339 - DNA, 20 bp, synthetic construct
  misc_feature 1..20: note = CRISPR gRNA sequence
  source 1..20: mol_type = other DNA
gaccagttctcagaatggtc

SEQ ID NO: 63340 - DNA, 20 bp, synthetic construct
  misc_feature 1..20: note = CRISPR gRNA sequence
  source 1..20: mol_type = other DNA
accagttctcagaatggtcc

SEQ ID NO: 63341 - DNA, 20 bp, synthetic construct
  misc_feature 1..20: note = CRISPR gRNA sequence
  source 1..20: mol_type = other DNA
tcagaatggtcctcgttctc

SEQ ID NO: 63342 - DNA, 20 bp, synthetic construct
  misc_feature 1..20: note = CRISPR gRNA sequence
  source 1..20: mol_type = other DNA
agaatggtcctcgttctcca

SEQ ID NO: 63343 - DNA, 20 bp, synthetic construct
  misc_feature 1..20: note = CRISPR gRNA sequence
  source 1..20: mol_type = other DNA
gttctccacgagttgtccca

SEQ ID NO: 63344 - DNA, 20 bp, synthetic construct
  misc_feature 1..20: note = CRISPR gRNA sequence
  source 1..20: mol_type = other DNA
tccacgagttgtcccactaa

SEQ ID NO: 63345 - DNA, 20 bp, synthetic construct
  misc_feature 1..20: note = CRISPR gRNA sequence
  source 1..20: mol_type = other DNA
cacgagttgtcccactaact

SEQ ID NO: 63346 - DNA, 20 bp, synthetic construct
  misc_feature 1..20: note = CRISPR gRNA sequence
  source 1..20: mol_type = other DNA
tcccactaactagagccttc

SEQ ID NO: 63347 - DNA, 20 bp, synthetic construct
  misc_feature 1..20: note = CRISPR gRNA sequence
  source 1..20: mol_type = other DNA
actagagccttctctgcccc

SEQ ID NO: 63348 - DNA, 20 bp, synthetic construct
  misc_feature 1..20: note = CRISPR gRNA sequence
  source 1..20: mol_type = other DNA
gagccttctctgcccccact

SEQ ID NO: 63349 - DNA, 20 bp, synthetic construct
  misc_feature 1..20: note = CRISPR gRNA sequence
  source 1..20: mol_type = other DNA
ctctgcccccactgctgcca

SEQ ID NO: 63350 - DNA, 20 bp, synthetic construct
  misc_feature 1..20: note = CRISPR gRNA sequence
  source 1..20: mol_type = other DNA
tctgcccccactgctgccaa

SEQ ID NO: 63351 - DNA, 20 bp, synthetic construct
  misc_feature 1..20: note = CRISPR gRNA sequence
  source 1..20: mol_type = other DNA
tgcccccactgctgccaacc

SEQ ID NO: 63352 - DNA, 20 bp, synthetic construct
  misc_feature 1..20: note = CRISPR gRNA sequence
  source 1..20: mol_type = other DNA
cccccactgctgccaaccat

SEQ ID NO: 63353 - DNA, 20 bp, synthetic construct
  misc_feature 1..20: note = CRISPR gRNA sequence
  source 1..20: mol_type = other DNA
ctgccaaccatggctataac

SEQ ID NO: 63354 - DNA, 20 bp, synthetic construct
  misc_feature 1..20: note = CRISPR gRNA sequence
  source 1..20: mol_type = other DNA
ccaaccatggctataaccag

SEQ ID NO: 63355 - DNA, 20 bp, synthetic construct
  misc_feature 1..20: note = CRISPR gRNA sequence
  source 1..20: mol_type = other DNA
taaccagaggattcacatcc

SEQ ID NO: 63356 - DNA, 20 bp, synthetic construct
  misc_feature 1..20: note = CRISPR gRNA sequence
  source 1..20: mol_type = other DNA
acatccgctcaaaatagttc

SEQ ID NO: 63357 - DNA, 20 bp, synthetic construct
  misc_feature 1..20: note = CRISPR gRNA sequence
  source 1..20: mol_type = other DNA
aaaatagttcactaccttgg

SEQ ID NO: 63358 - DNA, 20 bp, synthetic construct
  misc_feature 1..20: note = CRISPR gRNA sequence
  source 1..20: mol_type = other DNA
actaccttggcctttcccca

SEQ ID NO: 63359 - DNA, 20 bp, synthetic construct
  misc_feature 1..20: note = CRISPR gRNA sequence
  source 1..20: mol_type = other DNA
ccttggcctttccccatagg

SEQ ID NO: 63360 - DNA, 20 bp, synthetic construct
  misc_feature 1..20: note = CRISPR gRNA sequence
  source 1..20: mol_type = other DNA
ggcctttccccatagggttc

SEQ ID NO: 63361 - DNA, 20 bp, synthetic construct
  misc_feature 1..20: note = CRISPR gRNA sequence
  source 1..20: mol_type = other DNA
gcctttccccatagggttcc

SEQ ID NO: 63362 - DNA, 20 bp, synthetic construct
  misc_feature 1..20: note = CRISPR gRNA sequence
  source 1..20: mol_type = other DNA
tccccatagggttcccccaa

SEQ ID NO: 63363 - DNA, 20 bp, synthetic construct
  misc_feature 1..20: note = CRISPR gRNA sequence
  source 1..20: mol_type = other DNA
ccccatagggttcccccaaa

SEQ ID NO: 63364 - DNA, 20 bp, synthetic construct
  misc_feature 1..20: note = CRISPR gRNA sequence
  source 1..20: mol_type = other DNA
cccatagggttcccccaaaa

SEQ ID NO: 63365 - DNA, 20 bp, synthetic construct
  misc_feature 1..20: note = CRISPR gRNA sequence
  source 1..20: mol_type = other DNA
ccccaaaagcagccccagcc

SEQ ID NO: 63366 - DNA, 20 bp, synthetic construct
  misc_feature 1..20: note = CRISPR gRNA sequence
  source 1..20: mol_type = other DNA
tccctgggtcacctgagacc

SEQ ID NO: 63367 - DNA, 20 bp, synthetic construct
  misc_feature 1..20: note = CRISPR gRNA sequence
  source 1..20: mol_type = other DNA
ccctgggtcacctgagacct

SEQ ID NO: 63368 - DNA, 20 bp, synthetic construct
  misc_feature 1..20: note = CRISPR gRNA sequence
  source 1..20: mol_type = other DNA
cctgggtcacctgagacctc

SEQ ID NO: 63369 - DNA, 20 bp, synthetic construct
  misc_feature 1..20: note = CRISPR gRNA sequence
  source 1..20: mol_type = other DNA
ggtcacctgagacctctcaa

SEQ ID NO: 63370 - DNA, 20 bp, synthetic construct
  misc_feature 1..20: note = CRISPR gRNA sequence
  source 1..20: mol_type = other DNA
agacctctcaatgacccagg

SEQ ID NO: 63371 - DNA, 20 bp, synthetic construct
  misc_feature 1..20: note = CRISPR gRNA sequence
  source 1..20: mol_type = other DNA
tcaatgacccaggaattaaa

SEQ ID NO: 63372 - DNA, 20 bp, synthetic construct
  misc_feature 1..20: note = CRISPR gRNA sequence
  source 1..20: mol_type = other DNA
aatgacccaggaattaaaag

SEQ ID NO: 63373 - DNA, 20 bp, synthetic construct
  misc_feature 1..20: note = CRISPR gRNA sequence
  source 1..20: mol_type = other DNA
aaaggttaacatctggcact

SEQ ID NO: 63374 - DNA, 20 bp, synthetic construct
  misc_feature 1..20: note = CRISPR gRNA sequence
  source 1..20: mol_type = other DNA
acatctggcactgtaggggc

SEQ ID NO: 63375 - DNA, 20 bp, synthetic construct
  misc_feature 1..20: note = CRISPR gRNA sequence
  source 1..20: mol_type = other DNA
gcactgtaggggcccagctc

SEQ ID NO: 63376 - DNA, 20 bp, synthetic construct
  misc_feature 1..20: note = CRISPR gRNA sequence
  source 1..20: mol_type = other DNA
taggggcccagctcccacag

SEQ ID NO: 63377 - DNA, 20 bp, synthetic construct
  misc_feature 1..20: note = CRISPR gRNA sequence
  source 1..20: mol_type = other DNA
ccacagttccgatcggtaat

SEQ ID NO: 63378 - DNA, 20 bp, synthetic construct
  misc_feature 1..20: note = CRISPR gRNA sequence
  source 1..20: mol_type = other DNA
cgatcggtaatgcctaggcc

SEQ ID NO: 63379 - DNA, 20 bp, synthetic construct
  misc_feature 1..20: note = CRISPR gRNA sequence
  source 1..20: mol_type = other DNA
ggcctacaggttgttagtgc

SEQ ID NO: 63380 - DNA, 20 bp, synthetic construct
  misc_feature 1..20: note = CRISPR gRNA sequence
  source 1..20: mol_type = other DNA
caggttgttagtgctcaccc

SEQ ID NO: 63381 - DNA, 20 bp, synthetic construct
  misc_feature 1..20: note = CRISPR gRNA sequence
  source 1..20: mol_type = other DNA
ttagtgctcacccctgggca

SEQ ID NO: 63382 - DNA, 20 bp, synthetic construct
  misc_feature 1..20: note = CRISPR gRNA sequence
  source 1..20: mol_type = other DNA
gtgctcacccctgggcattg

SEQ ID NO: 63383 - DNA, 20 bp, synthetic construct
  misc_feature 1..20: note = CRISPR gRNA sequence
  source 1..20: mol_type = other DNA
acccctgggcattgcagaac

SEQ ID NO: 63384 - DNA, 20 bp, synthetic construct
  misc_feature 1..20: note = CRISPR gRNA sequence
  source 1..20: mol_type = other DNA
ggcattgcagaactgaaata

SEQ ID NO: 63385 - DNA, 20 bp, synthetic construct
  misc_feature 1..20: note = CRISPR gRNA sequence
  source 1..20: mol_type = other DNA
cagaactgaaatattgggaa

SEQ ID NO: 63386 - DNA, 20 bp, synthetic construct
  misc_feature 1..20: note = CRISPR gRNA sequence
  source 1..20: mol_type = other DNA
aaatattgggaagaggcact

SEQ ID NO: 63387 - DNA, 20 bp, synthetic construct
  misc_feature 1..20: note = CRISPR gRNA sequence
  source 1..20: mol_type = other DNA
ggaagaggcactggggatcc

SEQ ID NO: 63388 - DNA, 20 bp, synthetic construct
  misc_feature 1..20: note = CRISPR gRNA sequence
  source 1..20: mol_type = other DNA
gggatccagatattacagaa

SEQ ID NO: 63389 - DNA, 20 bp, synthetic construct
  misc_feature 1..20: note = CRISPR gRNA sequence
  source 1..20: mol_type = other DNA
cagaaagaggttgtttcaat

SEQ ID NO: 63390 - DNA, 20 bp, synthetic construct
  misc_feature 1..20: note = CRISPR gRNA sequence
  source 1..20: mol_type = other DNA
tttcaataagatattgcaaa

SEQ ID NO: 63391 - DNA, 20 bp, synthetic construct
  misc_feature 1..20: note = CRISPR gRNA sequence
  source 1..20: mol_type = other DNA
caataagatattgcaaagta

SEQ ID NO: 63392 - DNA, 20 bp, synthetic construct
  misc_feature 1..20: note = CRISPR gRNA sequence
  source 1..20: mol_type = other DNA
aataagatattgcaaagtag

SEQ ID NO: 63393 - DNA, 20 bp, synthetic construct
  misc_feature 1..20: note = CRISPR gRNA sequence
  source 1..20: mol_type = other DNA
caaagtagctgggcgcggtg

SEQ ID NO: 63394 - DNA, 20 bp, synthetic construct
  misc_feature 1..20: note = CRISPR gRNA sequence
  source 1..20: mol_type = other DNA
ggcgcggtggctcacacctg

SEQ ID NO: 63395 - DNA, 20 bp, synthetic construct
  misc_feature 1..20: note = CRISPR gRNA sequence
  source 1..20: mol_type = other DNA
acacctgtaatcccagcact

SEQ ID NO: 63396 - DNA, 20 bp, synthetic construct
  misc_feature 1..20: note = CRISPR gRNA sequence
  source 1..20: mol_type = other DNA
taatcccagcactttggagg

SEQ ID NO: 63397 - DNA, 20 bp, synthetic construct
  misc_feature 1..20: note = CRISPR gRNA sequence
  source 1..20: mol_type = other DNA
tggagggctgaggcaggtgg

SEQ ID NO: 63398 - DNA, 20 bp, synthetic construct
  misc_feature 1..20: note = CRISPR gRNA sequence
  source 1..20: mol_type = other DNA
ggagggctgaggcaggtgga

SEQ ID NO: 63399 - DNA, 20 bp, synthetic construct
  misc_feature 1..20: note = CRISPR gRNA sequence
  source 1..20: mol_type = other DNA
gagggctgaggcaggtggat

SEQ ID NO: 63400 - DNA, 20 bp, synthetic construct
  misc_feature 1..20: note = CRISPR gRNA sequence
  source 1..20: mol_type = other DNA
aggcaggtggatcagttgag

SEQ ID NO: 63401 - DNA, 20 bp, synthetic construct
  misc_feature 1..20: note = CRISPR gRNA sequence
  source 1..20: mol_type = other DNA
agcccaggaattcaatacta

SEQ ID NO: 63402 - DNA, 20 bp, synthetic construct
  misc_feature 1..20: note = CRISPR gRNA sequence
  source 1..20: mol_type = other DNA
aatactagcctggccaacgt

SEQ ID NO: 63403 - DNA, 20 bp, synthetic construct
  misc_feature 1..20: note = CRISPR gRNA sequence
  source 1..20: mol_type = other DNA
gcctggccaacgtgacaaaa

SEQ ID NO: 63404 - DNA, 20 bp, synthetic construct
  misc_feature 1..20: note = CRISPR gRNA sequence
  source 1..20: mol_type = other DNA
gccaacgtgacaaaaccttg

SEQ ID NO: 63405 - DNA, 20 bp, synthetic construct
  misc_feature 1..20: note = CRISPR gRNA sequence
  source 1..20: mol_type = other DNA
gtctctactaaaaatacaaa

SEQ ID NO: 63406 - DNA, 20 bp, synthetic construct
  misc_feature 1..20: note = CRISPR gRNA sequence
  source 1..20: mol_type = other DNA
tctctactaaaaatacaaaa

SEQ ID NO: 63407 - DNA, 20 bp, synthetic construct
  misc_feature 1..20: note = CRISPR gRNA sequence
  source 1..20: mol_type = other DNA
tactaaaaatacaaaaatta

SEQ ID NO: 63408 - DNA, 20 bp, synthetic construct
  misc_feature 1..20: note = CRISPR gRNA sequence
  source 1..20: mol_type = other DNA
ctaaaaatacaaaaattagc

SEQ ID NO: 63409 - DNA, 20 bp, synthetic construct
  misc_feature 1..20: note = CRISPR gRNA sequence
  source 1..20: mol_type = other DNA
aaaatacaaaaattagctgg

SEQ ID NO: 63410 - DNA, 20 bp, synthetic construct
  misc_feature 1..20: note = CRISPR gRNA sequence
  source 1..20: mol_type = other DNA
gctgggtgtggtggtgtgca

SEQ ID NO: 63411 - DNA, 20 bp, synthetic construct
  misc_feature 1..20: note = CRISPR gRNA sequence
  source 1..20: mol_type = other DNA
ggtgtggtggtgtgcacctg

SEQ ID NO: 63412 - DNA, 20 bp, synthetic construct
  misc_feature 1..20: note = CRISPR gRNA sequence
  source 1..20: mol_type = other DNA
tagtcccagctactcaggag

SEQ ID NO: 63413 - DNA, 20 bp, synthetic construct
  misc_feature 1..20: note = CRISPR gRNA sequence
  source 1..20: mol_type = other DNA
ctcaggaggctgaggcagga

SEQ ID NO: 63414 - DNA, 20 bp, synthetic construct
  misc_feature 1..20: note = CRISPR gRNA sequence
  source 1..20: mol_type = other DNA
aggaggctgaggcaggagga

SEQ ID NO: 63415 - DNA, 20 bp, synthetic construct
  misc_feature 1..20: note = CRISPR gRNA sequence
  source 1..20: mol_type = other DNA
aggcaggaggatcacttgag

SEQ ID NO: 63416 - DNA, 20 bp, synthetic construct
  misc_feature 1..20: note = CRISPR gRNA sequence
  source 1..20: mol_type = other DNA
gagaccaggagtttgcggct

SEQ ID NO: 63417 - DNA, 20 bp, synthetic construct
  misc_feature 1..20: note = CRISPR gRNA sequence
  source 1..20: mol_type = other DNA
agaccaggagtttgcggcta

SEQ ID NO: 63418 - DNA, 20 bp, synthetic construct
  misc_feature 1..20: note = CRISPR gRNA sequence
  source 1..20: mol_type = other DNA
gcggctacagtaagctagga

SEQ ID NO: 63419 - DNA, 20 bp, synthetic construct
  misc_feature 1..20: note = CRISPR gRNA sequence
  source 1..20: mol_type = other DNA
cggctacagtaagctaggat

SEQ ID NO: 63420 - DNA, 20 bp, synthetic construct
  misc_feature 1..20: note = CRISPR gRNA sequence
  source 1..20: mol_type = other DNA
cagtaagctaggatcgtgcc

SEQ ID NO: 63421 - DNA, 20 bp, synthetic construct
  misc_feature 1..20: note = CRISPR gRNA sequence
  source 1..20: mol_type = other DNA
ggatcgtgccactgcactgg

SEQ ID NO: 63422 - DNA, 20 bp, synthetic construct
  misc_feature 1..20: note = CRISPR gRNA sequence
  source 1..20: mol_type = other DNA
cactggagcctgggcaagac

SEQ ID NO: 63423 - DNA, 20 bp, synthetic construct
  misc_feature 1..20: note = CRISPR gRNA sequence
  source 1..20: mol_type = other DNA
gagcctgggcaagactgaga

SEQ ID NO: 63424 - DNA, 20 bp, synthetic construct
  misc_feature 1..20: note = CRISPR gRNA sequence
  source 1..20: mol_type = other DNA
ggcaagactgagactctgtc

SEQ ID NO: 63425 - DNA, 20 bp, synthetic construct
  misc_feature 1..20: note = CRISPR gRNA sequence
  source 1..20: mol_type = other DNA
agactctgtctctgggaaaa

SEQ ID NO: 63426 - DNA, 20 bp, synthetic construct
  misc_feature 1..20: note = CRISPR gRNA sequence
  source 1..20: mol_type = other DNA
tgtctctgggaaaaaagaaa

SEQ ID NO: 63427 - DNA, 20 bp, synthetic construct
  misc_feature 1..20: note = CRISPR gRNA sequence
  source 1..20: mol_type = other DNA
tctctgggaaaaaagaaaaa

SEQ ID NO: 63428 - DNA, 20 bp, synthetic construct
  misc_feature 1..20: note = CRISPR gRNA sequence
  source 1..20: mol_type = other DNA
tgggaaaaaagaaaaaaaag

SEQ ID NO: 63429 - DNA, 20 bp, synthetic construct
  misc_feature 1..20: note = CRISPR gRNA sequence
  source 1..20: mol_type = other DNA
ggaaaaaagaaaaaaaagag

SEQ ID NO: 63430 - DNA, 20 bp, synthetic construct
  misc_feature 1..20: note = CRISPR gRNA sequence
  source 1..20: mol_type = other DNA
caaaggaggtgccctattcc

SEQ ID NO: 63431 - DNA, 20 bp, synthetic construct
  misc_feature 1..20: note = CRISPR gRNA sequence
  source 1..20: mol_type = other DNA
ttcccctccccccatcttac

SEQ ID NO: 63432 - DNA, 20 bp, synthetic construct
  misc_feature 1..20: note = CRISPR gRNA sequence
  source 1..20: mol_type = other DNA
ccctccccccatcttactga

SEQ ID NO: 63433 - DNA, 20 bp, synthetic construct
  misc_feature 1..20: note = CRISPR gRNA sequence
  source 1..20: mol_type = other DNA
cccccatcttactgaaccct

SEQ ID NO: 63434 - DNA, 20 bp, synthetic construct
  misc_feature 1..20: note = CRISPR gRNA sequence
  source 1..20: mol_type = other DNA
actgaacccttacaccacgt

SEQ ID NO: 63435 - DNA, 20 bp, synthetic construct
  misc_feature 1..20: note = CRISPR gRNA sequence
  source 1..20: mol_type = other DNA
ctgaacccttacaccacgtg

SEQ ID NO: 63436 - DNA, 20 bp, synthetic construct
  misc_feature 1..20: note = CRISPR gRNA sequence
  source 1..20: mol_type = other DNA
aacccttacaccacgtgtac

SEQ ID NO: 63437 - DNA, 20 bp, synthetic construct
  misc_feature 1..20: note = CRISPR gRNA sequence
  source 1..20: mol_type = other DNA
acaccacgtgtactattgca

SEQ ID NO: 63438 - DNA, 20 bp, synthetic construct
  misc_feature 1..20: note = CRISPR gRNA sequence
  source 1..20: mol_type = other DNA
caccacgtgtactattgcag

SEQ ID NO: 63439 - DNA, 20 bp, synthetic construct
  misc_feature 1..20: note = CRISPR gRNA sequence
  source 1..20: mol_type = other DNA
ttgcagaatggatagaaccg

SEQ ID NO: 63440 - DNA, 20 bp, synthetic construct
  misc_feature 1..20: note = CRISPR gRNA sequence
  source 1..20: mol_type = other DNA
cagaatggatagaaccgtga

SEQ ID NO: 63441 - DNA, 20 bp, synthetic construct
  misc_feature 1..20: note = CRISPR gRNA sequence
  source 1..20: mol_type = other DNA
ccccattcccacctgcctgt

SEQ ID NO: 63442 - DNA, 20 bp, synthetic construct
  misc_feature 1..20: note = CRISPR gRNA sequence
  source 1..20: mol_type = other DNA
cccattcccacctgcctgtt

SEQ ID NO: 63443 - DNA, 20 bp, synthetic construct
  misc_feature 1..20: note = CRISPR gRNA sequence
  source 1..20: mol_type = other DNA
ccacctgcctgtttaaatag

SEQ ID NO: 63444 - DNA, 20 bp, synthetic construct
  misc_feature 1..20: note = CRISPR gRNA sequence
  source 1..20: mol_type = other DNA
cctgtttaaatagctaccgg

SEQ ID NO: 63445 - DNA, 20 bp, synthetic construct
  misc_feature 1..20: note = CRISPR gRNA sequence
  source 1..20: mol_type = other DNA
tttaaatagctaccggagag

SEQ ID NO: 63446 - DNA, 20 bp, synthetic construct
  misc_feature 1..20: note = CRISPR gRNA sequence
  source 1..20: mol_type = other DNA
aaatagctaccggagagcct

SEQ ID NO: 63447 - DNA, 20 bp, synthetic construct
  misc_feature 1..20: note = CRISPR gRNA sequence
  source 1..20: mol_type = other DNA
aatagctaccggagagccta

SEQ ID NO: 63448 - DNA, 20 bp, synthetic construct
  misc_feature 1..20: note = CRISPR gRNA sequence
  source 1..20: mol_type = other DNA
ccggagagcctatgctccct

SEQ ID NO: 63449 - DNA, 20 bp, synthetic construct
  misc_feature 1..20: note = CRISPR gRNA sequence
  source 1..20: mol_type = other DNA
tgctcccttagaactgattc

SEQ ID NO: 63450 - DNA, 20 bp, synthetic construct
  misc_feature 1..20: note = CRISPR gRNA sequence
  source 1..20: mol_type = other DNA
ccttagaactgattccttct

SEQ ID NO: 63451 - DNA, 20 bp, synthetic construct
  misc_feature 1..20: note = CRISPR gRNA sequence
  source 1..20: mol_type = other DNA
agaactgattccttctggaa

SEQ ID NO: 63452 - DNA, 20 bp, synthetic construct
  misc_feature 1..20: note = CRISPR gRNA sequence
  source 1..20: mol_type = other DNA
gaactgattccttctggaag

SEQ ID NO: 63453 - DNA, 20 bp, synthetic construct
  misc_feature 1..20: note = CRISPR gRNA sequence
  source 1..20: mol_type = other DNA
attccttctggaagttgggg

SEQ ID NO: 63454 - DNA, 20 bp, synthetic construct
  misc_feature 1..20: note = CRISPR gRNA sequence
  source 1..20: mol_type = other DNA
cttctggaagttggggtggc

SEQ ID NO: 63455 - DNA, 20 bp, synthetic construct
  misc_feature 1..20: note = CRISPR gRNA sequence
  source 1..20: mol_type = other DNA
ctggaagttggggtggcaca

SEQ ID NO: 63456 - DNA, 20 bp, synthetic construct
  misc_feature 1..20: note = CRISPR gRNA sequence
  source 1..20: mol_type = other DNA
tggaagttggggtggcacag

SEQ ID NO: 63457 - DNA, 20 bp, synthetic construct
  misc_feature 1..20: note = CRISPR gRNA sequence
  source 1..20: mol_type = other DNA
gaagttggggtggcacagat

SEQ ID NO: 63458 - DNA, 20 bp, synthetic construct
  misc_feature 1..20: note = CRISPR gRNA sequence
  source 1..20: mol_type = other DNA
gggtggcacagatcccccta

SEQ ID NO: 63459 - DNA, 20 bp, synthetic construct
  misc_feature 1..20: note = CRISPR gRNA sequence
  source 1..20: mol_type = other DNA
tggtgctcttgacaccccca

SEQ ID NO: 63460 - DNA, 20 bp, synthetic construct
  misc_feature 1..20: note = CRISPR gRNA sequence
  source 1..20: mol_type = other DNA
ttgacacccccaccctcacc

SEQ ID NO: 63461 - DNA, 20 bp, synthetic construct
  misc_feature 1..20: note = CRISPR gRNA sequence
  source 1..20: mol_type = other DNA
gacacccccaccctcacccc

SEQ ID NO: 63462 - DNA, 20 bp, synthetic construct
  misc_feature 1..20: note = CRISPR gRNA sequence
  source 1..20: mol_type = other DNA
acacccccaccctcacccca

SEQ ID NO: 63463 - DNA, 20 bp, synthetic construct
  misc_feature 1..20: note = CRISPR gRNA sequence
  source 1..20: mol_type = other DNA
accccatcatacatacacat

SEQ ID NO: 63464 - DNA, 20 bp, synthetic construct
  misc_feature 1..20: note = CRISPR gRNA sequence
  source 1..20: mol_type = other DNA
gggctacaggctcccaacag

SEQ ID NO: 63465 - DNA, 20 bp, synthetic construct
  misc_feature 1..20: note = CRISPR gRNA sequence
  source 1..20: mol_type = other DNA
caggctcccaacagcccaat

SEQ ID NO: 63466 - DNA, 20 bp, synthetic construct
  misc_feature 1..20: note = CRISPR gRNA sequence
  source 1..20: mol_type = other DNA
ccaacagcccaatactgggg

SEQ ID NO: 63467 - DNA, 20 bp, synthetic construct
  misc_feature 1..20: note = CRISPR gRNA sequence
  source 1..20: mol_type = other DNA
gggcaagaagacatgagcag

SEQ ID NO: 63468 - DNA, 20 bp, synthetic construct
  misc_feature 1..20: note = CRISPR gRNA sequence
  source 1..20: mol_type = other DNA
tcctcatgccatgtccctgc

SEQ ID NO: 63469 - DNA, 20 bp, synthetic construct
  misc_feature 1..20: note = CRISPR gRNA sequence
  source 1..20: mol_type = other DNA
ctcatgccatgtccctgccc

SEQ ID NO: 63470 - DNA, 20 bp, synthetic construct
  misc_feature 1..20: note = CRISPR gRNA sequence
  source 1..20: mol_type = other DNA
atgccatgtccctgcccctt

SEQ ID NO: 63471 - DNA, 20 bp, synthetic construct
  misc_feature 1..20: note = CRISPR gRNA sequence
  source 1..20: mol_type = other DNA
ccccttgcagagttggccaa

SEQ ID NO: 63472 - DNA, 20 bp, synthetic construct
  misc_feature 1..20: note = CRISPR gRNA sequence
  source 1..20: mol_type = other DNA
gcagagttggccaagaagta

SEQ ID NO: 63473 - DNA, 20 bp, synthetic construct
  misc_feature 1..20: note = CRISPR gRNA sequence
  source 1..20: mol_type = other DNA
cagagttggccaagaagtac

SEQ ID NO: 63474 - DNA, 20 bp, synthetic construct
  misc_feature 1..20: note = CRISPR gRNA sequence
  source 1..20: mol_type = other DNA
gccaagaagtacctgcagct

SEQ ID NO: 63475 - DNA, 20 bp, synthetic construct
  misc_feature 1..20: note = CRISPR gRNA sequence
  source 1..20: mol_type = other DNA
cagctcctgcggacctctgc

SEQ ID NO: 63476 - DNA, 20 bp, synthetic construct
  misc_feature 1..20: note = CRISPR gRNA sequence
  source 1..20: mol_type = other DNA
ctgcggacctctgcccagca

SEQ ID NO: 63477 - DNA, 20 bp, synthetic construct
  misc_feature 1..20: note = CRISPR gRNA sequence
  source 1..20: mol_type = other DNA
cggacctctgcccagcagcg

SEQ ID NO: 63478 - DNA, 20 bp, synthetic construct
  misc_feature 1..20: note = CRISPR gRNA sequence
  source 1..20: mol_type = other DNA
tgcccagcagcgctacagga

SEQ ID NO: 63479 - DNA, 20 bp, synthetic construct
  misc_feature 1..20: note = CRISPR gRNA sequence
  source 1..20: mol_type = other DNA
cccagcagcgctacaggagc

SEQ ID NO: 63480 - DNA, 20 bp, synthetic construct
  misc_feature 1..20: note = CRISPR gRNA sequence
  source 1..20: mol_type = other DNA
caggagccaaatccctgggt

SEQ ID NO: 63481 - DNA, 20 bp, synthetic construct
  misc_feature 1..20: note = CRISPR gRNA sequence
  source 1..20: mol_type = other DNA
ggtcagggcagccccacgcc

SEQ ID NO: 63482 - DNA, 20 bp, synthetic construct
  misc_feature 1..20: note = CRISPR gRNA sequence
  source 1..20: mol_type = other DNA
ccaccaggtctatgtccctc

SEQ ID NO: 63483 - DNA, 20 bp, synthetic construct
  misc_feature 1..20: note = CRISPR gRNA sequence
  source 1..20: mol_type = other DNA
caccaggtctatgtccctcc

SEQ ID NO: 63484 - DNA, 20 bp, synthetic construct
  misc_feature 1..20: note = CRISPR gRNA sequence
  source 1..20: mol_type = other DNA
tgtccctccaatcctgcgcc

SEQ ID NO: 63485 - DNA, 20 bp, synthetic construct
  misc_feature 1..20: note = CRISPR gRNA sequence
  source 1..20: mol_type = other DNA
caatcctgcgccgggccaca

SEQ ID NO: 63486 - DNA, 20 bp, synthetic construct
  misc_feature 1..20: note = CRISPR gRNA sequence
  source 1..20: mol_type = other DNA
cgccgggccacagcatcctt

SEQ ID NO: 63487 - DNA, 20 bp, synthetic construct
  misc_feature 1..20: note = CRISPR gRNA sequence
  source 1..20: mol_type = other DNA
agacactccggagggggcca

SEQ ID NO: 63488 - DNA, 20 bp, synthetic construct
  misc_feature 1..20: note = CRISPR gRNA sequence
  source 1..20: mol_type = other DNA
gacactccggagggggccat

SEQ ID NO: 63489 - DNA, 20 bp, synthetic construct
  misc_feature 1..20: note = CRISPR gRNA sequence
  source 1..20: mol_type = other DNA
cggagggggccattatgggg

SEQ ID NO: 63490 - DNA, 20 bp, synthetic construct
  misc_feature 1..20: note = CRISPR gRNA sequence
  source 1..20: mol_type = other DNA
tgggggacgtcaaggtggaa

SEQ ID NO: 63491 - DNA, 20 bp, synthetic construct
  misc_feature 1..20: note = CRISPR gRNA sequence
  source 1..20: mol_type = other DNA
acgtgagcatctcggacctc

SEQ ID NO: 63492 - DNA, 20 bp, synthetic construct
  misc_feature 1..20: note = CRISPR gRNA sequence
  source 1..20: mol_type = other DNA
ggacctcttcaacaccaggg

SEQ ID NO: 63493 - DNA, 20 bp, synthetic construct
  misc_feature 1..20: note = CRISPR gRNA sequence
  source 1..20: mol_type = other DNA
ttcaacaccagggttaacaa

SEQ ID NO: 63494 - DNA, 20 bp, synthetic construct
  misc_feature 1..20: note = CRISPR gRNA sequence
  source 1..20: mol_type = other DNA
caacaccagggttaacaagg

SEQ ID NO: 63495 - DNA, 20 bp, synthetic construct
  misc_feature 1..20: note = CRISPR gRNA sequence
  source 1..20: mol_type = other DNA
aacaccagggttaacaaggg

SEQ ID NO: 63496 - DNA, 20 bp, synthetic construct
  misc_feature 1..20: note = CRISPR gRNA sequence
  source 1..20: mol_type = other DNA
acaagggcccgagggtgacc

SEQ ID NO: 63497 - DNA, 20 bp, synthetic construct
  misc_feature 1..20: note = CRISPR gRNA sequence
  source 1..20: mol_type = other DNA
ttggggaaggctggcatggg

SEQ ID NO: 63498 - DNA, 20 bp, synthetic construct
  misc_feature 1..20: note = CRISPR gRNA sequence
  source 1..20: mol_type = other DNA
tggggaaggctggcatgggc

SEQ ID NO: 63499 - DNA, 20 bp, synthetic construct
  misc_feature 1..20: note = CRISPR gRNA sequence
  source 1..20: mol_type = other DNA
ggggaaggctggcatgggca

SEQ ID NO: 63500 - DNA, 20 bp, synthetic construct
  misc_feature 1..20: note = CRISPR gRNA sequence
  source 1..20: mol_type = other DNA
gggaaggctggcatgggcaa

SEQ ID NO: 63501 - DNA, 20 bp, synthetic construct
  misc_feature 1..20: note = CRISPR gRNA sequence
  source 1..20: mol_type = other DNA
gcatgggcaagaccacgctg

SEQ ID NO: 63502 - DNA, 20 bp, synthetic construct
  misc_feature 1..20: note = CRISPR gRNA sequence
  source 1..20: mol_type = other DNA
gcccaccggctctgccagaa

SEQ ID NO: 63503 - DNA, 20 bp, synthetic construct
  misc_feature 1..20: note = CRISPR gRNA sequence
  source 1..20: mol_type = other DNA
tgccagaagtgggcagaggg

SEQ ID NO: 63504 - DNA, 20 bp, synthetic construct
  misc_feature 1..20: note = CRISPR gRNA sequence
  source 1..20: mol_type = other DNA
ccagaagtgggcagagggcc

SEQ ID NO: 63505 - DNA, 20 bp, synthetic construct
  misc_feature 1..20: note = CRISPR gRNA sequence
  source 1..20: mol_type = other DNA
aactgtttccaggccctgtt

SEQ ID NO: 63506 - DNA, 20 bp, synthetic construct
  misc_feature 1..20: note = CRISPR gRNA sequence
  source 1..20: mol_type = other DNA
tttccaggccctgttccttt

SEQ ID NO: 63507 - DNA, 20 bp, synthetic construct
  misc_feature 1..20: note = CRISPR gRNA sequence
  source 1..20: mol_type = other DNA
ccaggccctgttcctttttg

SEQ ID NO: 63508 - DNA, 20 bp, synthetic construct
  misc_feature 1..20: note = CRISPR gRNA sequence
  source 1..20: mol_type = other DNA
caggccctgttcctttttga

SEQ ID NO: 63509 - DNA, 20 bp, synthetic construct
  misc_feature 1..20: note = CRISPR gRNA sequence
  source 1..20: mol_type = other DNA
ttcctttttgaattccgcca

SEQ ID NO: 63510 - DNA, 20 bp, synthetic construct
  misc_feature 1..20: note = CRISPR gRNA sequence
  source 1..20: mol_type = other DNA
ctttttgaattccgccagct

SEQ ID NO: 63511 - DNA, 20 bp, synthetic construct
  misc_feature 1..20: note = CRISPR gRNA sequence
  source 1..20: mol_type = other DNA
tttgaattccgccagctcaa

SEQ ID NO: 63512 - DNA, 20 bp, synthetic construct
  misc_feature 1..20: note = CRISPR gRNA sequence
  source 1..20: mol_type = other DNA
ttgaattccgccagctcaac

SEQ ID NO: 63513 - DNA, 20 bp, synthetic construct
  misc_feature 1..20: note = CRISPR gRNA sequence
  source 1..20: mol_type = other DNA
tgaattccgccagctcaact

SEQ ID NO: 63514 - DNA, 20 bp, synthetic construct
  misc_feature 1..20: note = CRISPR gRNA sequence
  source 1..20: mol_type = other DNA
gaattccgccagctcaactt

SEQ ID NO: 63515 - DNA, 20 bp, synthetic construct
  misc_feature 1..20: note = CRISPR gRNA sequence
  source 1..20: mol_type = other DNA
aattccgccagctcaacttg

SEQ ID NO: 63516 - DNA, 20 bp, synthetic construct
  misc_feature 1..20: note = CRISPR gRNA sequence
  source 1..20: mol_type = other DNA
cgccagctcaacttgatcac

SEQ ID NO: 63517 - DNA, 20 bp, synthetic construct
  misc_feature 1..20: note = CRISPR gRNA sequence
  source 1..20: mol_type = other DNA
aacttgatcacgaggttcct

SEQ ID NO: 63518 - DNA, 20 bp, synthetic construct
  misc_feature 1..20: note = CRISPR gRNA sequence
  source 1..20: mol_type = other DNA
gatcacgaggttcctgacac

SEQ ID NO: 63519 - DNA, 20 bp, synthetic construct
  misc_feature 1..20: note = CRISPR gRNA sequence
  source 1..20: mol_type = other DNA
atcacgaggttcctgacacc

SEQ ID NO: 63520 - DNA, 20 bp, synthetic construct
  misc_feature 1..20: note = CRISPR gRNA sequence
  source 1..20: mol_type = other DNA
ctgacaccgtccgagctcct

SEQ ID NO: 63521 - DNA, 20 bp, synthetic construct
  misc_feature 1..20: note = CRISPR gRNA sequence
  source 1..20: mol_type = other DNA
acaccgtccgagctcctttt

SEQ ID NO: 63522 - DNA, 20 bp, synthetic construct
  misc_feature 1..20: note = CRISPR gRNA sequence
  source 1..20: mol_type = other DNA
ctttttgatctgtacctgag

SEQ ID NO: 63523 - DNA, 20 bp, synthetic construct
  misc_feature 1..20: note = CRISPR gRNA sequence
  source 1..20: mol_type = other DNA
tttgatctgtacctgagccc

SEQ ID NO: 63524 - DNA, 20 bp, synthetic construct
  misc_feature 1..20: note = CRISPR gRNA sequence
  source 1..20: mol_type = other DNA
ttgatctgtacctgagccct

SEQ ID NO: 63525 - DNA, 20 bp, synthetic construct
  misc_feature 1..20: note = CRISPR gRNA sequence
  source 1..20: mol_type = other DNA
tgatctgtacctgagccctg

SEQ ID NO: 63526 - DNA, 20 bp, synthetic construct
  misc_feature 1..20: note = CRISPR gRNA sequence
  source 1..20: mol_type = other DNA
gatctgtacctgagccctga

SEQ ID NO: 63527 - DNA, 20 bp, synthetic construct
  misc_feature 1..20: note = CRISPR gRNA sequence
  source 1..20: mol_type = other DNA
atctgtacctgagccctgaa

SEQ ID NO: 63528 - DNA, 20 bp, synthetic construct
  misc_feature 1..20: note = CRISPR gRNA sequence
  source 1..20: mol_type = other DNA
tacctgagccctgaatcgga

SEQ ID NO: 63529 - DNA, 20 bp, synthetic construct
  misc_feature 1..20: note = CRISPR gRNA sequence
  source 1..20: mol_type = other DNA
agccctgaatcggaccacga

SEQ ID NO: 63530 - DNA, 20 bp, synthetic construct
  misc_feature 1..20: note = CRISPR gRNA sequence
  source 1..20: mol_type = other DNA
aatcggaccacgacactgtc

SEQ ID NO: 63531 - DNA, 20 bp, synthetic construct
  misc_feature 1..20: note = CRISPR gRNA sequence
  source 1..20: mol_type = other DNA
tcttccagtacctggagaag

SEQ ID NO: 63532 - DNA, 20 bp, synthetic construct
  misc_feature 1..20: note = CRISPR gRNA sequence
  source 1..20: mol_type = other DNA
ccagtacctggagaagaacg

SEQ ID NO: 63533 - DNA, 20 bp, synthetic construct
  misc_feature 1..20: note = CRISPR gRNA sequence
  source 1..20: mol_type = other DNA
cagtacctggagaagaacgc

SEQ ID NO: 63534 - DNA, 20 bp, synthetic construct
  misc_feature 1..20: note = CRISPR gRNA sequence
  source 1..20: mol_type = other DNA
gagaagaacgctgaccaagt

SEQ ID NO: 63535 - DNA, 20 bp, synthetic construct
  misc_feature 1..20: note = CRISPR gRNA sequence
  source 1..20: mol_type = other DNA
accaagtcctgctgatcttt

SEQ ID NO: 63536 - DNA, 20 bp, synthetic construct
  misc_feature 1..20: note = CRISPR gRNA sequence
  source 1..20: mol_type = other DNA
ctgatctttgatgggctaga

SEQ ID NO: 63537 - DNA, 20 bp, synthetic construct
  misc_feature 1..20: note = CRISPR gRNA sequence
  source 1..20: mol_type = other DNA
atctttgatgggctagatga

SEQ ID NO: 63538 - DNA, 20 bp, synthetic construct
  misc_feature 1..20: note = CRISPR gRNA sequence
  source 1..20: mol_type = other DNA
tgatgggctagatgaggccc

SEQ ID NO: 63539 - DNA, 20 bp, synthetic construct
  misc_feature 1..20: note = CRISPR gRNA sequence
  source 1..20: mol_type = other DNA
gatgggctagatgaggccct

SEQ ID NO: 63540 - DNA, 20 bp, synthetic construct
  misc_feature 1..20: note = CRISPR gRNA sequence
  source 1..20: mol_type = other DNA
atgggctagatgaggccctc

SEQ ID NO: 63541 - DNA, 20 bp, synthetic construct
  misc_feature 1..20: note = CRISPR gRNA sequence
  source 1..20: mol_type = other DNA
gatgaggccctccagcctat

SEQ ID NO: 63542 - DNA, 20 bp, synthetic construct
  misc_feature 1..20: note = CRISPR gRNA sequence
  source 1..20: mol_type = other DNA
cagcctatgggtcctgatgg

SEQ ID NO: 63543 - DNA, 20 bp, synthetic construct
  misc_feature 1..20: note = CRISPR gRNA sequence
  source 1..20: mol_type = other DNA
tgggtcctgatggcccaggc

SEQ ID NO: 63544 - DNA, 20 bp, synthetic construct
  misc_feature 1..20: note = CRISPR gRNA sequence
  source 1..20: mol_type = other DNA
atggcccaggcccagtcctc

SEQ ID NO: 63545 - DNA, 20 bp, synthetic construct
  misc_feature 1..20: note = CRISPR gRNA sequence
  source 1..20: mol_type = other DNA
acccttttctcccatctctg

SEQ ID NO: 63546 - DNA, 20 bp, synthetic construct
  misc_feature 1..20: note = CRISPR gRNA sequence
  source 1..20: mol_type = other DNA
ttctcccatctctgcaatgg

SEQ ID NO: 63547 - DNA, 20 bp, synthetic construct
  misc_feature 1..20: note = CRISPR gRNA sequence
  source 1..20: mol_type = other DNA
tctcccatctctgcaatggg

SEQ ID NO: 63548 - DNA, 20 bp, synthetic construct
  misc_feature 1..20: note = CRISPR gRNA sequence
  source 1..20: mol_type = other DNA
ctcccatctctgcaatggga

SEQ ID NO: 63549 - DNA, 20 bp, synthetic construct
  misc_feature 1..20: note = CRISPR gRNA sequence
  source 1..20: mol_type = other DNA
tcccatctctgcaatgggac

SEQ ID NO: 63550 - DNA, 20 bp, synthetic construct
  misc_feature 1..20: note = CRISPR gRNA sequence
  source 1..20: mol_type = other DNA
ccatctctgcaatgggaccc

SEQ ID NO: 63551 - DNA, 20 bp, synthetic construct
  misc_feature 1..20: note = CRISPR gRNA sequence
  source 1..20: mol_type = other DNA
tgcaatgggaccctcctgcc

SEQ ID NO: 63552 - DNA, 20 bp, synthetic construct
  misc_feature 1..20: note = CRISPR gRNA sequence
  source 1..20: mol_type = other DNA
caatgggaccctcctgcctg

SEQ ID NO: 63553 - DNA, 20 bp, synthetic construct
  misc_feature 1..20: note = CRISPR gRNA sequence
  source 1..20: mol_type = other DNA
ctgcctggctgccgggtgat

SEQ ID NO: 63554 - DNA, 20 bp, synthetic construct
  misc_feature 1..20: note = CRISPR gRNA sequence
  source 1..20: mol_type = other DNA
cctggctgccgggtgatggc

SEQ ID NO: 63555 - DNA, 20 bp, synthetic construct
  misc_feature 1..20: note = CRISPR gRNA sequence
  source 1..20: mol_type = other DNA
gctgccgggtgatggctacc

SEQ ID NO: 63556 - DNA, 20 bp, synthetic construct
  misc_feature 1..20: note = CRISPR gRNA sequence
  source 1..20: mol_type = other DNA
ccgggtgatggctacctccc

SEQ ID NO: 63557 - DNA, 20 bp, synthetic construct
  misc_feature 1..20: note = CRISPR gRNA sequence
  source 1..20: mol_type = other DNA
cctcccgtccagggaagctg

SEQ ID NO: 63558 - DNA, 20 bp, synthetic construct
  misc_feature 1..20: note = CRISPR gRNA sequence
  source 1..20: mol_type = other DNA
ccgtccagggaagctgcctg

SEQ ID NO: 63559 - DNA, 20 bp, synthetic construct
  misc_feature 1..20: note = CRISPR gRNA sequence
  source 1..20: mol_type = other DNA
cctgcctgcctgcctgcaga

SEQ ID NO: 63560 - DNA, 20 bp, synthetic construct
  misc_feature 1..20: note = CRISPR gRNA sequence
  source 1..20: mol_type = other DNA
cctgcctgcctgcagaggca

SEQ ID NO: 63561 - DNA, 20 bp, synthetic construct
  misc_feature 1..20: note = CRISPR gRNA sequence
  source 1..20: mol_type = other DNA
cctgcctgcagaggcagcca

SEQ ID NO: 63562 - DNA, 20 bp, synthetic construct
  misc_feature 1..20: note = CRISPR gRNA sequence
  source 1..20: mol_type = other DNA
cctgcagaggcagccatggt

SEQ ID NO: 63563 - DNA, 20 bp, synthetic construct
  misc_feature 1..20: note = CRISPR gRNA sequence
  source 1..20: mol_type = other DNA
cagaggcagccatggtccac

SEQ ID NO: 63564 - DNA, 20 bp, synthetic construct
  misc_feature 1..20: note = CRISPR gRNA sequence
  source 1..20: mol_type = other DNA
ggctttgatgggccacgggt

SEQ ID NO: 63565 - DNA, 20 bp, synthetic construct
  misc_feature 1..20: note = CRISPR gRNA sequence
  source 1..20: mol_type = other DNA
tgatgggccacgggtggaag

SEQ ID NO: 63566 - DNA, 20 bp, synthetic construct
  misc_feature 1..20: note = CRISPR gRNA sequence
  source 1..20: mol_type = other DNA
gatgggccacgggtggaaga

SEQ ID NO: 63567 - DNA, 20 bp, synthetic construct
  misc_feature 1..20: note = CRISPR gRNA sequence
  source 1..20: mol_type = other DNA
atgggccacgggtggaagaa

SEQ ID NO: 63568 - DNA, 20 bp, synthetic construct
  misc_feature 1..20: note = CRISPR gRNA sequence
  source 1..20: mol_type = other DNA
cttcagcgcccagccatcgc

SEQ ID NO: 63569 - DNA, 20 bp, synthetic construct
  misc_feature 1..20: note = CRISPR gRNA sequence
  source 1..20: mol_type = other DNA
ttcagcgcccagccatcgcg

SEQ ID NO: 63570 - DNA, 20 bp, synthetic construct
  misc_feature 1..20: note = CRISPR gRNA sequence
  source 1..20: mol_type = other DNA
cagcgcccagccatcgcggg

SEQ ID NO: 63571 - DNA, 20 bp, synthetic construct
  misc_feature 1..20: note = CRISPR gRNA sequence
  source 1..20: mol_type = other DNA
agcgcccagccatcgcggga

SEQ ID NO: 63572 - DNA, 20 bp, synthetic construct
  misc_feature 1..20: note = CRISPR gRNA sequence
  source 1..20: mol_type = other DNA
gtggagttacagacaaatgg

SEQ ID NO: 63573 - DNA, 20 bp, synthetic construct
  misc_feature 1..20: note = CRISPR gRNA sequence
  source 1..20: mol_type = other DNA
cagacaaatggacgtctccg

SEQ ID NO: 63574 - DNA, 20 bp, synthetic construct
  misc_feature 1..20: note = CRISPR gRNA sequence
  source 1..20: mol_type = other DNA
cgaagcctgtgtgcggtgcc

SEQ ID NO: 63575 - DNA, 20 bp, synthetic construct
  misc_feature 1..20: note = CRISPR gRNA sequence
  source 1..20: mol_type = other DNA
tgtgcggtgcccgcactgtg

SEQ ID NO: 63576 - DNA, 20 bp, synthetic construct
  misc_feature 1..20: note = CRISPR gRNA sequence
  source 1..20: mol_type = other DNA
tgccaagtcgcctgtctctg

SEQ ID NO: 63577 - DNA, 20 bp, synthetic construct
  misc_feature 1..20: note = CRISPR gRNA sequence
  source 1..20: mol_type = other DNA
tctctgcctccaccatctgc

SEQ ID NO: 63578 - DNA, 20 bp, synthetic construct
  misc_feature 1..20: note = CRISPR gRNA sequence
  source 1..20: mol_type = other DNA
tgcctccaccatctgcttcc

SEQ ID NO: 63579 - DNA, 20 bp, synthetic construct
  misc_feature 1..20: note = CRISPR gRNA sequence
  source 1..20: mol_type = other DNA
cctccaccatctgcttcctg

SEQ ID NO: 63580 - DNA, 20 bp, synthetic construct
  misc_feature 1..20: note = CRISPR gRNA sequence
  source 1..20: mol_type = other DNA
caccatctgcttcctgacca

SEQ ID NO: 63581 - DNA, 20 bp, synthetic construct
  misc_feature 1..20: note = CRISPR gRNA sequence
  source 1..20: mol_type = other DNA
cttcctgaccacgccccagg

SEQ ID NO: 63582 - DNA, 20 bp, synthetic construct
  misc_feature 1..20: note = CRISPR gRNA sequence
  source 1..20: mol_type = other DNA
cctgaccacgccccaggcca

SEQ ID NO: 63583 - DNA, 20 bp, synthetic construct
  misc_feature 1..20: note = CRISPR gRNA sequence
  source 1..20: mol_type = other DNA
ctgaccacgccccaggccag

SEQ ID NO: 63584 - DNA, 20 bp, synthetic construct
  misc_feature 1..20: note = CRISPR gRNA sequence
  source 1..20: mol_type = other DNA
accacgccccaggccagtct

SEQ ID NO: 63585 - DNA, 20 bp, synthetic construct
  misc_feature 1..20: note = CRISPR gRNA sequence
  source 1..20: mol_type = other DNA
tggccctcctgcccaacatg

SEQ ID NO: 63586 - DNA, 20 bp, synthetic construct
  misc_feature 1..20: note = CRISPR gRNA sequence
  source 1..20: mol_type = other DNA
ctgcccaacatgactcagct

SEQ ID NO: 63587 - DNA, 20 bp, synthetic construct
  misc_feature 1..20: note = CRISPR gRNA sequence
  source 1..20: mol_type = other DNA
cccaacatgactcagctcta

SEQ ID NO: 63588 - DNA, 20 bp, synthetic construct
  misc_feature 1..20: note = CRISPR gRNA sequence
  source 1..20: mol_type = other DNA
agctctatatgcagatggtg

SEQ ID NO: 63589 - DNA, 20 bp, synthetic construct
  misc_feature 1..20: note = CRISPR gRNA sequence
  source 1..20: mol_type = other DNA
tatatgcagatggtgctcgc

SEQ ID NO: 63590 - DNA, 20 bp, synthetic construct
  misc_feature 1..20: note = CRISPR gRNA sequence
  source 1..20: mol_type = other DNA
tatgcagatggtgctcgccc

SEQ ID NO: 63591 - DNA, 20 bp, synthetic construct
  misc_feature 1..20: note = CRISPR gRNA sequence
  source 1..20: mol_type = other DNA
gccctcagcccccctgggca

SEQ ID NO: 63592 - DNA, 20 bp, synthetic construct
  misc_feature 1..20: note = CRISPR gRNA sequence
  source 1..20: mol_type = other DNA
agcccccctgggcacttgcc

SEQ ID NO: 63593 - DNA, 20 bp, synthetic construct
  misc_feature 1..20: note = CRISPR gRNA sequence
  source 1..20: mol_type = other DNA
ggcacttgcccacctcgtcc

SEQ ID NO: 63594 - DNA, 20 bp, synthetic construct
  misc_feature 1..20: note = CRISPR gRNA sequence
  source 1..20: mol_type = other DNA
gcccacctcgtccctactgg

SEQ ID NO: 63595 - DNA, 20 bp, synthetic construct
  misc_feature 1..20: note = CRISPR gRNA sequence
  source 1..20: mol_type = other DNA
cccacctcgtccctactgga

SEQ ID NO: 63596 - DNA, 20 bp, synthetic construct
  misc_feature 1..20: note = CRISPR gRNA sequence
  source 1..20: mol_type = other DNA
gtccctactggacctggggg

SEQ ID NO: 63597 - DNA, 20 bp, synthetic construct
  misc_feature 1..20: note = CRISPR gRNA sequence
  source 1..20: mol_type = other DNA
ctggacctgggggaggtggc

SEQ ID NO: 63598 - DNA, 20 bp, synthetic construct
  misc_feature 1..20: note = CRISPR gRNA sequence
  source 1..20: mol_type = other DNA
gacctgggggaggtggccct

SEQ ID NO: 63599 - DNA, 20 bp, synthetic construct
  misc_feature 1..20: note = CRISPR gRNA sequence
  source 1..20: mol_type = other DNA
ggggaggtggccctgagggg

SEQ ID NO: 63600 - DNA, 20 bp, synthetic construct
  misc_feature 1..20: note = CRISPR gRNA sequence
  source 1..20: mol_type = other DNA
aggggcctggagacagggaa

SEQ ID NO: 63601 - DNA, 20 bp, synthetic construct
  misc_feature 1..20: note = CRISPR gRNA sequence
  source 1..20: mol_type = other DNA
gagacagggaaggttatctt

SEQ ID NO: 63602 - DNA, 20 bp, synthetic construct
  misc_feature 1..20: note = CRISPR gRNA sequence
  source 1..20: mol_type = other DNA
tcttctatgcaaaagatatt

SEQ ID NO: 63603 - DNA, 20 bp, synthetic construct
  misc_feature 1..20: note = CRISPR gRNA sequence
  source 1..20: mol_type = other DNA
ctatgcaaaagatattgctc

SEQ ID NO: 63604 - DNA, 20 bp, synthetic construct
  misc_feature 1..20: note = CRISPR gRNA sequence
  source 1..20: mol_type = other DNA
tatgcaaaagatattgctcc

SEQ ID NO: 63605 - DNA, 20 bp, synthetic construct
  misc_feature 1..20: note = CRISPR gRNA sequence
  source 1..20: mol_type = other DNA
tgcaaaagatattgctccac

SEQ ID NO: 63606 - DNA, 20 bp, synthetic construct
  misc_feature 1..20: note = CRISPR gRNA sequence
  source 1..20: mol_type = other DNA
ctccacccttgatagctttt

SEQ ID NO: 63607 - DNA, 20 bp, synthetic construct
  misc_feature 1..20: note = CRISPR gRNA sequence
  source 1..20: mol_type = other DNA
cacccttgatagcttttggg

SEQ ID NO: 63608 - DNA, 20 bp, synthetic construct
  misc_feature 1..20: note = CRISPR gRNA sequence
  source 1..20: mol_type = other DNA
gatagcttttggggccactc

SEQ ID NO: 63609 - DNA, 20 bp, synthetic construct
  misc_feature 1..20: note = CRISPR gRNA sequence
  source 1..20: mol_type = other DNA
atagcttttggggccactca

SEQ ID NO: 63610 - DNA, 20 bp, synthetic construct
  misc_feature 1..20: note = CRISPR gRNA sequence
  source 1..20: mol_type = other DNA
ttggggccactcacagcctg

SEQ ID NO: 63611 - DNA, 20 bp, synthetic construct
  misc_feature 1..20: note = CRISPR gRNA sequence
  source 1..20: mol_type = other DNA
tggggccactcacagcctgc

SEQ ID NO: 63612 - DNA, 20 bp, synthetic construct
  misc_feature 1..20: note = CRISPR gRNA sequence
  source 1..20: mol_type = other DNA
ggggccactcacagcctgct

SEQ ID NO: 63613 - DNA, 20 bp, synthetic construct
  misc_feature 1..20: note = CRISPR gRNA sequence
  source 1..20: mol_type = other DNA
gggccactcacagcctgctg

SEQ ID NO: 63614 - DNA, 20 bp, synthetic construct
  misc_feature 1..20: note = CRISPR gRNA sequence
  source 1..20: mol_type = other DNA
acagcctgctgacttccttc

SEQ ID NO: 63615 - DNA, 20 bp, synthetic construct
  misc_feature 1..20: note = CRISPR gRNA sequence
  source 1..20: mol_type = other DNA
ctgacttccttctgcgtctg

SEQ ID NO: 63616 - DNA, 20 bp, synthetic construct
  misc_feature 1..20: note = CRISPR gRNA sequence
  source 1..20: mol_type = other DNA
acttccttctgcgtctgcac

SEQ ID NO: 63617 - DNA, 20 bp, synthetic construct
  misc_feature 1..20: note = CRISPR gRNA sequence
  source 1..20: mol_type = other DNA
ccttctgcgtctgcacaggc

SEQ ID NO: 63618 - DNA, 20 bp, synthetic construct
  misc_feature 1..20: note = CRISPR gRNA sequence
  source 1..20: mol_type = other DNA
cttctgcgtctgcacaggcc

SEQ ID NO: 63619 - DNA, 20 bp, synthetic construct
  misc_feature 1..20: note = CRISPR gRNA sequence
  source 1..20: mol_type = other DNA
ctgcgtctgcacaggccctg

SEQ ID NO: 63620 - DNA, 20 bp, synthetic construct
  misc_feature 1..20: note = CRISPR gRNA sequence
  source 1..20: mol_type = other DNA
tgcgtctgcacaggccctgg

SEQ ID NO: 63621 - DNA, 20 bp, synthetic construct
  misc_feature 1..20: note = CRISPR gRNA sequence
  source 1..20: mol_type = other DNA
cgtctgcacaggccctgggc

SEQ ID NO: 63622 - DNA, 20 bp, synthetic construct
  misc_feature 1..20: note = CRISPR gRNA sequence
  source 1..20: mol_type = other DNA
cacaggccctgggcaccagc

SEQ ID NO: 63623 - DNA, 20 bp, synthetic construct
  misc_feature 1..20: note = CRISPR gRNA sequence
  source 1..20: mol_type = other DNA
ggcaccagcagacaggctat

SEQ ID NO: 63624 - DNA, 20 bp, synthetic construct
  misc_feature 1..20: note = CRISPR gRNA sequence
  source 1..20: mol_type = other DNA
tgctttcacccacctcagcc

SEQ ID NO: 63625 - DNA, 20 bp, synthetic construct
  misc_feature 1..20: note = CRISPR gRNA sequence
  source 1..20: mol_type = other DNA
tcacccacctcagcctgcag

SEQ ID NO: 63626 - DNA, 20 bp, synthetic construct
  misc_feature 1..20: note = CRISPR gRNA sequence
  source 1..20: mol_type = other DNA
cacccacctcagcctgcagg

SEQ ID NO: 63627 - DNA, 20 bp, synthetic construct
  misc_feature 1..20: note = CRISPR gRNA sequence
  source 1..20: mol_type = other DNA
acccacctcagcctgcagga

SEQ ID NO: 63628 - DNA, 20 bp, synthetic construct
  misc_feature 1..20: note = CRISPR gRNA sequence
  source 1..20: mol_type = other DNA
agcctgcaggagtttcttgc

SEQ ID NO: 63629 - DNA, 20 bp, synthetic construct
  misc_feature 1..20: note = CRISPR gRNA sequence
  source 1..20: mol_type = other DNA
caggagtttcttgctgccct

SEQ ID NO: 63630 - DNA, 20 bp, synthetic construct
  misc_feature 1..20: note = CRISPR gRNA sequence
  source 1..20: mol_type = other DNA
cttgctgccctgcacctgat

SEQ ID NO: 63631 - DNA, 20 bp, synthetic construct
  misc_feature 1..20: note = CRISPR gRNA sequence
  source 1..20: mol_type = other DNA
ttgctgccctgcacctgatg

SEQ ID NO: 63632 - DNA, 20 bp, synthetic construct
  misc_feature 1..20: note = CRISPR gRNA sequence
  source 1..20: mol_type = other DNA
gctgccctgcacctgatggc

SEQ ID NO: 63633 - DNA, 20 bp, synthetic construct
  misc_feature 1..20: note = CRISPR gRNA sequence
  source 1..20: mol_type = other DNA
ctgccctgcacctgatggcc

SEQ ID NO: 63634 - DNA, 20 bp, synthetic construct
  misc_feature 1..20: note = CRISPR gRNA sequence
  source 1..20: mol_type = other DNA
ccctgcacctgatggccagc

SEQ ID NO: 63635 - DNA, 20 bp, synthetic construct
  misc_feature 1..20: note = CRISPR gRNA sequence
  source 1..20: mol_type = other DNA
cacctgatggccagccccaa

SEQ ID NO: 63636 - DNA, 20 bp, synthetic construct
  misc_feature 1..20: note = CRISPR gRNA sequence
  source 1..20: mol_type = other DNA
atggccagccccaaggtgaa

SEQ ID NO: 63637 - DNA, 20 bp, synthetic construct
  misc_feature 1..20: note = CRISPR gRNA sequence
  source 1..20: mol_type = other DNA
acccagtatgttaccctcca

SEQ ID NO: 63638 - DNA, 20 bp, synthetic construct
  misc_feature 1..20: note = CRISPR gRNA sequence
  source 1..20: mol_type = other DNA
cccagtatgttaccctccat

SEQ ID NO: 63639 - DNA, 20 bp, synthetic construct
  misc_feature 1..20: note = CRISPR gRNA sequence
  source 1..20: mol_type = other DNA
ccctccattcccgctgggta

SEQ ID NO: 63640 - DNA, 20 bp, synthetic construct
  misc_feature 1..20: note = CRISPR gRNA sequence
  source 1..20: mol_type = other DNA
cattcccgctgggtacagcg

SEQ ID NO: 63641 - DNA, 20 bp, synthetic construct
  misc_feature 1..20: note = CRISPR gRNA sequence
  source 1..20: mol_type = other DNA
ccgctgggtacagcggacca

SEQ ID NO: 63642 - DNA, 20 bp, synthetic construct
  misc_feature 1..20: note = CRISPR gRNA sequence
  source 1..20: mol_type = other DNA
ggtacagcggaccaaagcta

SEQ ID NO: 63643 - DNA, 20 bp, synthetic construct
  misc_feature 1..20: note = CRISPR gRNA sequence
  source 1..20: mol_type = other DNA
gactgggcctctcagaccac

SEQ ID NO: 63644 - DNA, 20 bp, synthetic construct
  misc_feature 1..20: note = CRISPR gRNA sequence
  source 1..20: mol_type = other DNA
ggcctctcagaccacctccc

SEQ ID NO: 63645 - DNA, 20 bp, synthetic construct
  misc_feature 1..20: note = CRISPR gRNA sequence
  source 1..20: mol_type = other DNA
tcagaccacctccccacctt

SEQ ID NO: 63646 - DNA, 20 bp, synthetic construct
  misc_feature 1..20: note = CRISPR gRNA sequence
  source 1..20: mol_type = other DNA
agaccacctccccaccttcc

SEQ ID NO: 63647 - DNA, 20 bp, synthetic construct
  misc_feature 1..20: note = CRISPR gRNA sequence
  source 1..20: mol_type = other DNA
cccaccttcctggcgggcct

SEQ ID NO: 63648 - DNA, 20 bp, synthetic construct
  misc_feature 1..20: note = CRISPR gRNA sequence
  source 1..20: mol_type = other DNA
cctggcgggcctggcatcct

SEQ ID NO: 63649 - DNA, 20 bp, synthetic construct
  misc_feature 1..20: note = CRISPR gRNA sequence
  source 1..20: mol_type = other DNA
ctggcgggcctggcatcctg

SEQ ID NO: 63650 - DNA, 20 bp, synthetic construct
  misc_feature 1..20: note = CRISPR gRNA sequence
  source 1..20: mol_type = other DNA
gcgggcctggcatcctgcac

SEQ ID NO: 63651 - DNA, 20 bp, synthetic construct
  misc_feature 1..20: note = CRISPR gRNA sequence
  source 1..20: mol_type = other DNA
gcatcctgcacctgccgccc

SEQ ID NO: 63652 - DNA, 20 bp, synthetic construct
  misc_feature 1..20: note = CRISPR gRNA sequence
  source 1..20: mol_type = other DNA
cacctgccgccccttcctta

SEQ ID NO: 63653 - DNA, 20 bp, synthetic construct
  misc_feature 1..20: note = CRISPR gRNA sequence
  source 1..20: mol_type = other DNA
ccgccccttccttagccacc

SEQ ID NO: 63654 - DNA, 20 bp, synthetic construct
  misc_feature 1..20: note = CRISPR gRNA sequence
  source 1..20: mol_type = other DNA
ccttagccacctggcgcagg

SEQ ID NO: 63655 - DNA, 20 bp, synthetic construct
  misc_feature 1..20: note = CRISPR gRNA sequence
  source 1..20: mol_type = other DNA
cttagccacctggcgcaggg

SEQ ID NO: 63656 - DNA, 20 bp, synthetic construct
  misc_feature 1..20: note = CRISPR gRNA sequence
  source 1..20: mol_type = other DNA
agccacctggcgcagggcaa

SEQ ID NO: 63657 - DNA, 20 bp, synthetic construct
  misc_feature 1..20: note = CRISPR gRNA sequence
  source 1..20: mol_type = other DNA
gccacctggcgcagggcaat

SEQ ID NO: 63658 - DNA, 20 bp, synthetic construct
  misc_feature 1..20: note = CRISPR gRNA sequence
  source 1..20: mol_type = other DNA
gcgcagggcaatgaggactg

SEQ ID NO: 63659 - DNA, 20 bp, synthetic construct
  misc_feature 1..20: note = CRISPR gRNA sequence
  source 1..20: mol_type = other DNA
tgtgggtgccaagcaggctg

SEQ ID NO: 63660 - DNA, 20 bp, synthetic construct
  misc_feature 1..20: note = CRISPR gRNA sequence
  source 1..20: mol_type = other DNA
ctgtagtgcaggtgttgaag

SEQ ID NO: 63661 - DNA, 20 bp, synthetic construct
  misc_feature 1..20: note = CRISPR gRNA sequence
  source 1..20: mol_type = other DNA
tagtgcaggtgttgaagaag

SEQ ID NO: 63662 - DNA, 20 bp, synthetic construct
  misc_feature 1..20: note = CRISPR gRNA sequence
  source 1..20: mol_type = other DNA
aagaagttggccacccgcaa

SEQ ID NO: 63663 - DNA, 20 bp, synthetic construct
  misc_feature 1..20: note = CRISPR gRNA sequence
  source 1..20: mol_type = other DNA
gccacccgcaagctcacagg

SEQ ID NO: 63664 - DNA, 20 bp, synthetic construct
  misc_feature 1..20: note = CRISPR gRNA sequence
  source 1..20: mol_type = other DNA
acagggccaaaggttgtaga

SEQ ID NO: 63665 - DNA, 20 bp, synthetic construct
  misc_feature 1..20: note = CRISPR gRNA sequence
  source 1..20: mol_type = other DNA
tagagctgtgtcactgtgtg

SEQ ID NO: 63666 - DNA, 20 bp, synthetic construct
  misc_feature 1..20: note = CRISPR gRNA sequence
  source 1..20: mol_type = other DNA
tgtcactgtgtggatgagac

SEQ ID NO: 63667 - DNA, 20 bp, synthetic construct
  misc_feature 1..20: note = CRISPR gRNA sequence
  source 1..20: mol_type = other DNA
tgtggatgagacacaggagc

SEQ ID NO: 63668 - DNA, 20 bp, synthetic construct
  misc_feature 1..20: note = CRISPR gRNA sequence
  source 1..20: mol_type = other DNA
agctggccagtctcaccgca

SEQ ID NO: 63669 - DNA, 20 bp, synthetic construct
  misc_feature 1..20: note = CRISPR gRNA sequence
  source 1..20: mol_type = other DNA
gccagtctcaccgcacaaag

SEQ ID NO: 63670 - DNA, 20 bp, synthetic construct
  misc_feature 1..20: note = CRISPR gRNA sequence
  source 1..20: mol_type = other DNA
accgcacaaagcctccccta

SEQ ID NO: 63671 - DNA, 20 bp, synthetic construct
  misc_feature 1..20: note = CRISPR gRNA sequence
  source 1..20: mol_type = other DNA
ccctatcaactgcccttcca

SEQ ID NO: 63672 - DNA, 20 bp, synthetic construct
  misc_feature 1..20: note = CRISPR gRNA sequence
  source 1..20: mol_type = other DNA
tcaactgcccttccacaatt

SEQ ID NO: 63673 - DNA, 20 bp, synthetic construct
  misc_feature 1..20: note = CRISPR gRNA sequence
  source 1..20: mol_type = other DNA
cccttccacaatttcccact

SEQ ID NO: 63674 - DNA, 20 bp, synthetic construct
  misc_feature 1..20: note = CRISPR gRNA sequence
  source 1..20: mol_type = other DNA
ccacaatttcccactgacct

SEQ ID NO: 63675 - DNA, 20 bp, synthetic construct
  misc_feature 1..20: note = CRISPR gRNA sequence
  source 1..20: mol_type = other DNA
cacaatttcccactgacctg

SEQ ID NO: 63676 - DNA, 20 bp, synthetic construct
  misc_feature 1..20: note = CRISPR gRNA sequence
  source 1..20: mol_type = other DNA
cccactgacctgcaccgacc

SEQ ID NO: 63677 - DNA, 20 bp, synthetic construct
  misc_feature 1..20: note = CRISPR gRNA sequence
  source 1..20: mol_type = other DNA
ccactgacctgcaccgacct

SEQ ID NO: 63678 - DNA, 20 bp, synthetic construct
  misc_feature 1..20: note = CRISPR gRNA sequence
  source 1..20: mol_type = other DNA
acctgcaccgacctggccac

SEQ ID NO: 63679 - DNA, 20 bp, synthetic construct
  misc_feature 1..20: note = CRISPR gRNA sequence
  source 1..20: mol_type = other DNA
caccgacctggccaccctga

SEQ ID NO: 63680 - DNA, 20 bp, synthetic construct
  misc_feature 1..20: note = CRISPR gRNA sequence
  source 1..20: mol_type = other DNA
gccaccctgaccaacatcct

SEQ ID NO: 63681 - DNA, 20 bp, synthetic construct
  misc_feature 1..20: note = CRISPR gRNA sequence
  source 1..20: mol_type = other DNA
accaacatcctagagcacag

SEQ ID NO: 63682 - DNA, 20 bp, synthetic construct
  misc_feature 1..20: note = CRISPR gRNA sequence
  source 1..20: mol_type = other DNA
gagcacagggaggcccccat

SEQ ID NO: 63683 - DNA, 20 bp, synthetic construct
  misc_feature 1..20: note = CRISPR gRNA sequence
  source 1..20: mol_type = other DNA
gattttgatggctgtcccct

SEQ ID NO: 63684 - DNA, 20 bp, synthetic construct
  misc_feature 1..20: note = CRISPR gRNA sequence
  source 1..20: mol_type = other DNA
tgatggctgtcccctggagc

SEQ ID NO: 63685 - DNA, 20 bp, synthetic construct
  misc_feature 1..20: note = CRISPR gRNA sequence
  source 1..20: mol_type = other DNA
gatggctgtcccctggagcc

SEQ ID NO: 63686 - DNA, 20 bp, synthetic construct
  misc_feature 1..20: note = CRISPR gRNA sequence
  source 1..20: mol_type = other DNA
atggctgtcccctggagccc

SEQ ID NO: 63687 - DNA, 20 bp, synthetic construct
  misc_feature 1..20: note = CRISPR gRNA sequence
  source 1..20: mol_type = other DNA
tcccctggagccccactgcc

SEQ ID NO: 63688 - DNA, 20 bp, synthetic construct
  misc_feature 1..20: note = CRISPR gRNA sequence
  source 1..20: mol_type = other DNA
gagccccactgccctgaggc

SEQ ID NO: 63689 - DNA, 20 bp, synthetic construct
  misc_feature 1..20: note = CRISPR gRNA sequence
  source 1..20: mol_type = other DNA
ccctgaggctctggtaggct

SEQ ID NO: 63690 - DNA, 20 bp, synthetic construct
  misc_feature 1..20: note = CRISPR gRNA sequence
  source 1..20: mol_type = other DNA
aggctctggtaggctgtggg

SEQ ID NO: 63691 - DNA, 20 bp, synthetic construct
  misc_feature 1..20: note = CRISPR gRNA sequence
  source 1..20: mol_type = other DNA
tggtaggctgtgggcagata

SEQ ID NO: 63692 - DNA, 20 bp, synthetic construct
  misc_feature 1..20: note = CRISPR gRNA sequence
  source 1..20: mol_type = other DNA
gtaggctgtgggcagataga

SEQ ID NO: 63693 - DNA, 20 bp, synthetic construct
  misc_feature 1..20: note = CRISPR gRNA sequence
  source 1..20: mol_type = other DNA
tgggcagatagagaatctca

SEQ ID NO: 63694 - DNA, 20 bp, synthetic construct
  misc_feature 1..20: note = CRISPR gRNA sequence
  source 1..20: mol_type = other DNA
aggtgagtaagagtggagga

SEQ ID NO: 63695 - DNA, 20 bp, synthetic construct
  misc_feature 1..20: note = CRISPR gRNA sequence
  source 1..20: mol_type = other DNA
ggcttttgggggagcagagg

SEQ ID NO: 63696 - DNA, 20 bp, synthetic construct
  misc_feature 1..20: note = CRISPR gRNA sequence
  source 1..20: mol_type = other DNA
ttgggggagcagaggccaac

SEQ ID NO: 63697 - DNA, 20 bp, synthetic construct
  misc_feature 1..20: note = CRISPR gRNA sequence
  source 1..20: mol_type = other DNA
tgggggagcagaggccaacc

SEQ ID NO: 63698 - DNA, 20 bp, synthetic construct
  misc_feature 1..20: note = CRISPR gRNA sequence
  source 1..20: mol_type = other DNA
gggggagcagaggccaacca

SEQ ID NO: 63699 - DNA, 20 bp, synthetic construct
  misc_feature 1..20: note = CRISPR gRNA sequence
  source 1..20: mol_type = other DNA
ggggagcagaggccaaccag

SEQ ID NO: 63700 - DNA, 20 bp, synthetic construct
  misc_feature 1..20: note = CRISPR gRNA sequence
  source 1..20: mol_type = other DNA
gcaaacctctgccaagagga

SEQ ID NO: 63701 - DNA, 20 bp, synthetic construct
  misc_feature 1..20: note = CRISPR gRNA sequence
  source 1..20: mol_type = other DNA
tgccaagaggactggataag

SEQ ID NO: 63702 - DNA, 20 bp, synthetic construct
  misc_feature 1..20: note = CRISPR gRNA sequence
  source 1..20: mol_type = other DNA
ccaagaggactggataagaa

SEQ ID NO: 63703 - DNA, 20 bp, synthetic construct
  misc_feature 1..20: note = CRISPR gRNA sequence
  source 1..20: mol_type = other DNA
gataagaatcttgaatatca

SEQ ID NO: 63704 - DNA, 20 bp, synthetic construct
  misc_feature 1..20: note = CRISPR gRNA sequence
  source 1..20: mol_type = other DNA
gaatatcagaacataatggc

SEQ ID NO: 63705 - DNA, 20 bp, synthetic construct
  misc_feature 1..20: note = CRISPR gRNA sequence
  source 1..20: mol_type = other DNA
aatatcagaacataatggcc

SEQ ID NO: 63706 - DNA, 20 bp, synthetic construct
  misc_feature 1..20: note = CRISPR gRNA sequence
  source 1..20: mol_type = other DNA
caatgcaagagaggaagctc

SEQ ID NO: 63707 - DNA, 20 bp, synthetic construct
  misc_feature 1..20: note = CRISPR gRNA sequence
  source 1..20: mol_type = other DNA
cataccttgacaggacctct

SEQ ID NO: 63708 - DNA, 20 bp, synthetic construct
  misc_feature 1..20: note = CRISPR gRNA sequence
  source 1..20: mol_type = other DNA
gacaggacctctggagtcca

SEQ ID NO: 63709 - DNA, 20 bp, synthetic construct
  misc_feature 1..20: note = CRISPR gRNA sequence
  source 1..20: mol_type = other DNA
acaggacctctggagtccaa

SEQ ID NO: 63710 - DNA, 20 bp, synthetic construct
  misc_feature 1..20: note = CRISPR gRNA sequence
  source 1..20: mol_type = other DNA
tggagtccaaatggatcctc

SEQ ID NO: 63711 - DNA, 20 bp, synthetic construct
  misc_feature 1..20: note = CRISPR gRNA sequence
  source 1..20: mol_type = other DNA
gagtccaaatggatcctcct

SEQ ID NO: 63712 - DNA, 20 bp, synthetic construct
  misc_feature 1..20: note = CRISPR gRNA sequence
  source 1..20: mol_type = other DNA
ctcttgtctgtggtttctgg

SEQ ID NO: 63713 - DNA, 20 bp, synthetic construct
  misc_feature 1..20: note = CRISPR gRNA sequence
  source 1..20: mol_type = other DNA
ttgtctgtggtttctggact

SEQ ID NO: 63714 - DNA, 20 bp, synthetic construct
  misc_feature 1..20: note = CRISPR gRNA sequence
  source 1..20: mol_type = other DNA
gtctgtggtttctggactct

SEQ ID NO: 63715 - DNA, 20 bp, synthetic construct
  misc_feature 1..20: note = CRISPR gRNA sequence
  source 1..20: mol_type = other DNA
tctgtggtttctggactctc

SEQ ID NO: 63716 - DNA, 20 bp, synthetic construct
  misc_feature 1..20: note = CRISPR gRNA sequence
  source 1..20: mol_type = other DNA
tggtttctggactctcagtc

SEQ ID NO: 63717 - DNA, 20 bp, synthetic construct
  misc_feature 1..20: note = CRISPR gRNA sequence
  source 1..20: mol_type = other DNA
ctggactctcagtctctctg

SEQ ID NO: 63718 - DNA, 20 bp, synthetic construct
  misc_feature 1..20: note = CRISPR gRNA sequence
  source 1..20: mol_type = other DNA
tggactctcagtctctctgt

SEQ ID NO: 63719 - DNA, 20 bp, synthetic construct
  misc_feature 1..20: note = CRISPR gRNA sequence
  source 1..20: mol_type = other DNA
gactctcagtctctctgtca

SEQ ID NO: 63720 - DNA, 20 bp, synthetic construct
  misc_feature 1..20: note = CRISPR gRNA sequence
  source 1..20: mol_type = other DNA
tcagtctctctgtcaatcat

SEQ ID NO: 63721 - DNA, 20 bp, synthetic construct
  misc_feature 1..20: note = CRISPR gRNA sequence
  source 1..20: mol_type = other DNA
agtctctctgtcaatcatgg

SEQ ID NO: 63722 - DNA, 20 bp, synthetic construct
  misc_feature 1..20: note = CRISPR gRNA sequence
  source 1..20: mol_type = other DNA
tctgtcaatcatgggctgaa

SEQ ID NO: 63723 - DNA, 20 bp, synthetic construct
  misc_feature 1..20: note = CRISPR gRNA sequence
  source 1..20: mol_type = other DNA
tgtcaatcatgggctgaaac

SEQ ID NO: 63724 - DNA, 20 bp, synthetic construct
  misc_feature 1..20: note = CRISPR gRNA sequence
  source 1..20: mol_type = other DNA
tcaatcatgggctgaaacca

SEQ ID NO: 63725 - DNA, 20 bp, synthetic construct
  misc_feature 1..20: note = CRISPR gRNA sequence
  source 1..20: mol_type = other DNA
aaaccacagatccaggctgt

SEQ ID NO: 63726 - DNA, 20 bp, synthetic construct
  misc_feature 1..20: note = CRISPR gRNA sequence
  source 1..20: mol_type = other DNA
tctatagaggctggtggact

SEQ ID NO: 63727 - DNA, 20 bp, synthetic construct
  misc_feature 1..20: note = CRISPR gRNA sequence
  source 1..20: mol_type = other DNA
tagaggctggtggactttgg

SEQ ID NO: 63728 - DNA, 20 bp, synthetic construct
  misc_feature 1..20: note = CRISPR gRNA sequence
  source 1..20: mol_type = other DNA
gtggactttgggcaagtata

SEQ ID NO: 63729 - DNA, 20 bp, synthetic construct
  misc_feature 1..20: note = CRISPR gRNA sequence
  source 1..20: mol_type = other DNA
tgggcaagtatatggagcac

SEQ ID NO: 63730 - DNA, 20 bp, synthetic construct
  misc_feature 1..20: note = CRISPR gRNA sequence
  source 1..20: mol_type = other DNA
gggcaagtatatggagcaca

SEQ ID NO: 63731 - DNA, 20 bp, synthetic construct
  misc_feature 1..20: note = CRISPR gRNA sequence
  source 1..20: mol_type = other DNA
ggcaagtatatggagcacac

SEQ ID NO: 63732 - DNA, 20 bp, synthetic construct
  misc_feature 1..20: note = CRISPR gRNA sequence
  source 1..20: mol_type = other DNA
tctaggccagagtttcttcg

SEQ ID NO: 63733 - DNA, 20 bp, synthetic construct
  misc_feature 1..20: note = CRISPR gRNA sequence
  source 1..20: mol_type = other DNA
ggccagagtttcttcgttcc

SEQ ID NO: 63734 - DNA, 20 bp, synthetic construct
  misc_feature 1..20: note = CRISPR gRNA sequence
  source 1..20: mol_type = other DNA
cttcgttcctaaaacgaatc

SEQ ID NO: 63735 - DNA, 20 bp, synthetic construct
  misc_feature 1..20: note = CRISPR gRNA sequence
  source 1..20: mol_type = other DNA
ttcgttcctaaaacgaatct

SEQ ID NO: 63736 - DNA, 20 bp, synthetic construct
  misc_feature 1..20: note = CRISPR gRNA sequence
  source 1..20: mol_type = other DNA
cgttcctaaaacgaatctgt

SEQ ID NO: 63737 - DNA, 20 bp, synthetic construct
  misc_feature 1..20: note = CRISPR gRNA sequence
  source 1..20: mol_type = other DNA
gttcctaaaacgaatctgta

SEQ ID NO: 63738 - DNA, 20 bp, synthetic construct
  misc_feature 1..20: note = CRISPR gRNA sequence
  source 1..20: mol_type = other DNA
ctaaaacgaatctgtaacaa

SEQ ID NO: 63739 - DNA, 20 bp, synthetic construct
  misc_feature 1..20: note = CRISPR gRNA sequence
  source 1..20: mol_type = other DNA
aaacgaatctgtaacaatag

SEQ ID NO: 63740 - DNA, 20 bp, synthetic construct
  misc_feature 1..20: note = CRISPR gRNA sequence
  source 1..20: mol_type = other DNA
taacaatagccaactcatat

SEQ ID NO: 63741 - DNA, 20 bp, synthetic construct
  misc_feature 1..20: note = CRISPR gRNA sequence
  source 1..20: mol_type = other DNA
atatggtcattgcaagaatg

SEQ ID NO: 63742 - DNA, 20 bp, synthetic construct
  misc_feature 1..20: note = CRISPR gRNA sequence
  source 1..20: mol_type = other DNA
caagaatgagatgggatggt

SEQ ID NO: 63743 - DNA, 20 bp, synthetic construct
  misc_feature 1..20: note = CRISPR gRNA sequence
  source 1..20: mol_type = other DNA
tgtagcacagtgcctagcac

SEQ ID NO: 63744 - DNA, 20 bp, synthetic construct
  misc_feature 1..20: note = CRISPR gRNA sequence
  source 1..20: mol_type = other DNA
gtagcacagtgcctagcaca

SEQ ID NO: 63745 - DNA, 20 bp, synthetic construct
  misc_feature 1..20: note = CRISPR gRNA sequence
  source 1..20: mol_type = other DNA
tagcacagtgcctagcacag

SEQ ID NO: 63746 - DNA, 20 bp, synthetic construct
  misc_feature 1..20: note = CRISPR gRNA sequence
  source 1..20: mol_type = other DNA
gcacagagcaaaggctcagt

SEQ ID NO: 63747 - DNA, 20 bp, synthetic construct
  misc_feature 1..20: note = CRISPR gRNA sequence
  source 1..20: mol_type = other DNA
agtgtgcatattagctagag

SEQ ID NO: 63748 - DNA, 20 bp, synthetic construct
  misc_feature 1..20: note = CRISPR gRNA sequence
  source 1..20: mol_type = other DNA
gctagagaaaaggctaggct

SEQ ID NO: 63749 - DNA, 20 bp, synthetic construct
  misc_feature 1..20: note = CRISPR gRNA sequence
  source 1..20: mol_type = other DNA
gagaaaaggctaggctgcag

SEQ ID NO: 63750 - DNA, 20 bp, synthetic construct
  misc_feature 1..20: note = CRISPR gRNA sequence
  source 1..20: mol_type = other DNA
ggctgcagtaacagagaaac

SEQ ID NO: 63751 - DNA, 20 bp, synthetic construct
  misc_feature 1..20: note = CRISPR gRNA sequence
  source 1..20: mol_type = other DNA
cagtaacagagaaacctcct

SEQ ID NO: 63752 - DNA, 20 bp, synthetic construct
  misc_feature 1..20: note = CRISPR gRNA sequence
  source 1..20: mol_type = other DNA
ctccccaaatacagtaggtt

SEQ ID NO: 63753 - DNA, 20 bp, synthetic construct
  misc_feature 1..20: note = CRISPR gRNA sequence
  source 1..20: mol_type = other DNA
cccaaatacagtaggttaaa

SEQ ID NO: 63754 - DNA, 20 bp, synthetic construct
  misc_feature 1..20: note = CRISPR gRNA sequence
  source 1..20: mol_type = other DNA
aataatgtagaattttattt

SEQ ID NO: 63755 - DNA, 20 bp, synthetic construct
  misc_feature 1..20: note = CRISPR gRNA sequence
  source 1..20: mol_type = other DNA
tatttctctctcatggaaga

SEQ ID NO: 63756 - DNA, 20 bp, synthetic construct
  misc_feature 1..20: note = CRISPR gRNA sequence
  source 1..20: mol_type = other DNA
atttctctctcatggaagag

SEQ ID NO: 63757 - DNA, 20 bp, synthetic construct
  misc_feature 1..20: note = CRISPR gRNA sequence
  source 1..20: mol_type = other DNA
tttctctctcatggaagagt

SEQ ID NO: 63758 - DNA, 20 bp, synthetic construct
  misc_feature 1..20: note = CRISPR gRNA sequence
  source 1..20: mol_type = other DNA
ctctctcatggaagagtcag

SEQ ID NO: 63759 - DNA, 20 bp, synthetic construct
  misc_feature 1..20: note = CRISPR gRNA sequence
  source 1..20: mol_type = other DNA
tctctcatggaagagtcaga

SEQ ID NO: 63760 - DNA, 20 bp, synthetic construct
  misc_feature 1..20: note = CRISPR gRNA sequence
  source 1..20: mol_type = other DNA
tctcatggaagagtcagagg

SEQ ID NO: 63761 - DNA, 20 bp, synthetic construct
  misc_feature 1..20: note = CRISPR gRNA sequence
  source 1..20: mol_type = other DNA
tcatggaagagtcagaggta

SEQ ID NO: 63762 - DNA, 20 bp, synthetic construct
  misc_feature 1..20: note = CRISPR gRNA sequence
  source 1..20: mol_type = other DNA
atggaagagtcagaggtagg

SEQ ID NO: 63763 - DNA, 20 bp, synthetic construct
  misc_feature 1..20: note = CRISPR gRNA sequence
  source 1..20: mol_type = other DNA
agctccacgcagtcatgcag

SEQ ID NO: 63764 - DNA, 20 bp, synthetic construct
  misc_feature 1..20: note = CRISPR gRNA sequence
  source 1..20: mol_type = other DNA
cacgcagtcatgcaggtacc

SEQ ID NO: 63765 - DNA, 20 bp, synthetic construct
  misc_feature 1..20: note = CRISPR gRNA sequence
  source 1..20: mol_type = other DNA
ccattttgctccattatccc

SEQ ID NO: 63766 - DNA, 20 bp, synthetic construct
  misc_feature 1..20: note = CRISPR gRNA sequence
  source 1..20: mol_type = other DNA
tgctccattatccccttggg

SEQ ID NO: 63767 - DNA, 20 bp, synthetic construct
  misc_feature 1..20: note = CRISPR gRNA sequence
  source 1..20: mol_type = other DNA
gctccattatccccttggga

SEQ ID NO: 63768 - DNA, 20 bp, synthetic construct
  misc_feature 1..20: note = CRISPR gRNA sequence
  source 1..20: mol_type = other DNA
ctccattatccccttgggaa

SEQ ID NO: 63769 - DNA, 20 bp, synthetic construct
  misc_feature 1..20: note = CRISPR gRNA sequence
  source 1..20: mol_type = other DNA
cattatccccttgggaatcc

SEQ ID NO: 63770 - DNA, 20 bp, synthetic construct
  misc_feature 1..20: note = CRISPR gRNA sequence
  source 1..20: mol_type = other DNA
tccccttgggaatcctatct

SEQ ID NO: 63771 - DNA, 20 bp, synthetic construct
  misc_feature 1..20: note = CRISPR gRNA sequence
  source 1..20: mol_type = other DNA
gggaatcctatctgcacagt

SEQ ID NO: 63772 - DNA, 20 bp, synthetic construct
  misc_feature 1..20: note = CRISPR gRNA sequence
  source 1..20: mol_type = other DNA
ggaatcctatctgcacagtc

SEQ ID NO: 63773 - DNA, 20 bp, synthetic construct
  misc_feature 1..20: note = CRISPR gRNA sequence
  source 1..20: mol_type = other DNA
tctgcacagtcaaagctacg

SEQ ID NO: 63774 - DNA, 20 bp, synthetic construct
  misc_feature 1..20: note = CRISPR gRNA sequence
  source 1..20: mol_type = other DNA
cacagtcaaagctacgtcat

SEQ ID NO: 63775 - DNA, 20 bp, synthetic construct
  misc_feature 1..20: note = CRISPR gRNA sequence
  source 1..20: mol_type = other DNA
cgtcatgggtatatctgtgc

SEQ ID NO: 63776 - DNA, 20 bp, synthetic construct
  misc_feature 1..20: note = CRISPR gRNA sequence
  source 1..20: mol_type = other DNA
tgctctggcttgggaacaag

SEQ ID NO: 63777 - DNA, 20 bp, synthetic construct
  misc_feature 1..20: note = CRISPR gRNA sequence
  source 1..20: mol_type = other DNA
tggcttgggaacaaggaaag

SEQ ID NO: 63778 - DNA, 20 bp, synthetic construct
  misc_feature 1..20: note = CRISPR gRNA sequence
  source 1..20: mol_type = other DNA
gcttgggaacaaggaaagag

SEQ ID NO: 63779 - DNA, 20 bp, synthetic construct
  misc_feature 1..20: note = CRISPR gRNA sequence
  source 1..20: mol_type = other DNA
gggaacaaggaaagagcatg

SEQ ID NO: 63780 - DNA, 20 bp, synthetic construct
  misc_feature 1..20: note = CRISPR gRNA sequence
  source 1..20: mol_type = other DNA
ggaacaaggaaagagcatgg

SEQ ID NO: 63781 - DNA, 20 bp, synthetic construct
  misc_feature 1..20: note = CRISPR gRNA sequence
  source 1..20: mol_type = other DNA
aagttcagtcctgaaactag

SEQ ID NO: 63782 - DNA, 20 bp, synthetic construct
  misc_feature 1..20: note = CRISPR gRNA sequence
  source 1..20: mol_type = other DNA
agtcctgaaactaggataca

SEQ ID NO: 63783 - DNA, 20 bp, synthetic construct
  misc_feature 1..20: note = CRISPR gRNA sequence
  source 1..20: mol_type = other DNA
aaactaggatacatcccttc

SEQ ID NO: 63784 - DNA, 20 bp, synthetic construct
  misc_feature 1..20: note = CRISPR gRNA sequence
  source 1..20: mol_type = other DNA
ggatacatcccttccactca

SEQ ID NO: 63785 - DNA, 20 bp, synthetic construct
  misc_feature 1..20: note = CRISPR gRNA sequence
  source 1..20: mol_type = other DNA
ccactcacattccattggtg

SEQ ID NO: 63786 - DNA, 20 bp, synthetic construct
  misc_feature 1..20: note = CRISPR gRNA sequence
  source 1..20: mol_type = other DNA
cactcacattccattggtga

SEQ ID NO: 63787 - DNA, 20 bp, synthetic construct
  misc_feature 1..20: note = CRISPR gRNA sequence
  source 1..20: mol_type = other DNA
acattccattggtgagaaca

SEQ ID NO: 63788 - DNA, 20 bp, synthetic construct
  misc_feature 1..20: note = CRISPR gRNA sequence
  source 1..20: mol_type = other DNA
cattggtgagaacatagtca

SEQ ID NO: 63789 - DNA, 20 bp, synthetic construct
  misc_feature 1..20: note = CRISPR gRNA sequence
  source 1..20: mol_type = other DNA
gtgagaacatagtcacctgg

SEQ ID NO: 63790 - DNA, 20 bp, synthetic construct
  misc_feature 1..20: note = CRISPR gRNA sequence
  source 1..20: mol_type = other DNA
gccacactgagctgcaaggg

SEQ ID NO: 63791 - DNA, 20 bp, synthetic construct
  misc_feature 1..20: note = CRISPR gRNA sequence
  source 1..20: mol_type = other DNA
agctgcaagggaggctggga

SEQ ID NO: 63792 - DNA, 20 bp, synthetic construct
  misc_feature 1..20: note = CRISPR gRNA sequence
  source 1..20: mol_type = other DNA
caagggaggctgggaaatgt

SEQ ID NO: 63793 - DNA, 20 bp, synthetic construct
  misc_feature 1..20: note = CRISPR gRNA sequence
  source 1..20: mol_type = other DNA
ggaaatgtgatctctggctg

SEQ ID NO: 63794 - DNA, 20 bp, synthetic construct
  misc_feature 1..20: note = CRISPR gRNA sequence
  source 1..20: mol_type = other DNA
tggctgggaaaccatgttcc

SEQ ID NO: 63795 - DNA, 20 bp, synthetic construct
  misc_feature 1..20: note = CRISPR gRNA sequence
  source 1..20: mol_type = other DNA
gctgggaaaccatgttcctc

SEQ ID NO: 63796 - DNA, 20 bp, synthetic construct
  misc_feature 1..20: note = CRISPR gRNA sequence
  source 1..20: mol_type = other DNA
ggaaaccatgttcctcatga

SEQ ID NO: 63797 - DNA, 20 bp, synthetic construct
  misc_feature 1..20: note = CRISPR gRNA sequence
  source 1..20: mol_type = other DNA
ctcatgatagctctattgct

SEQ ID NO: 63798 - DNA, 20 bp, synthetic construct
  misc_feature 1..20: note = CRISPR gRNA sequence
  source 1..20: mol_type = other DNA
atgatagctctattgctgta

SEQ ID NO: 63799 - DNA, 20 bp, synthetic construct
  misc_feature 1..20: note = CRISPR gRNA sequence
  source 1..20: mol_type = other DNA
tattgctgtagatgaagtgg

SEQ ID NO: 63800 - DNA, 20 bp, synthetic construct
  misc_feature 1..20: note = CRISPR gRNA sequence
  source 1..20: mol_type = other DNA
ttgctgtagatgaagtggag

SEQ ID NO: 63801 - DNA, 20 bp, synthetic construct
  misc_feature 1..20: note = CRISPR gRNA sequence
  source 1..20: mol_type = other DNA
ctgtagatgaagtggagaat

SEQ ID NO: 63802 - DNA, 20 bp, synthetic construct
  misc_feature 1..20: note = CRISPR gRNA sequence
  source 1..20: mol_type = other DNA
tagatgaagtggagaatggg

SEQ ID NO: 63803 - DNA, 20 bp, synthetic construct
  misc_feature 1..20: note = CRISPR gRNA sequence
  source 1..20: mol_type = other DNA
tggtggacgattagaagtct

SEQ ID NO: 63804 - DNA, 20 bp, synthetic construct
  misc_feature 1..20: note = CRISPR gRNA sequence
  source 1..20: mol_type = other DNA
ggtggacgattagaagtctc

SEQ ID NO: 63805 - DNA, 20 bp, synthetic construct
  misc_feature 1..20: note = CRISPR gRNA sequence
  source 1..20: mol_type = other DNA
gtggacgattagaagtctcg

SEQ ID NO: 63806 - DNA, 20 bp, synthetic construct
  misc_feature 1..20: note = CRISPR gRNA sequence
  source 1..20: mol_type = other DNA
gaagtctcggccataatatg

SEQ ID NO: 63807 - DNA, 20 bp, synthetic construct
  misc_feature 1..20: note = CRISPR gRNA sequence
  source 1..20: mol_type = other DNA
ggccataatatgtatttgtt

SEQ ID NO: 63808 - DNA, 20 bp, synthetic construct
  misc_feature 1..20: note = CRISPR gRNA sequence
  source 1..20: mol_type = other DNA
gttagtactactgtattaag

SEQ ID NO: 63809 - DNA, 20 bp, synthetic construct
  misc_feature 1..20: note = CRISPR gRNA sequence
  source 1..20: mol_type = other DNA
ttagtactactgtattaagc

SEQ ID NO: 63810 - DNA, 20 bp, synthetic construct
  misc_feature 1..20: note = CRISPR gRNA sequence
  source 1..20: mol_type = other DNA
gtactactgtattaagcccc

SEQ ID NO: 63811 - DNA, 20 bp, synthetic construct
  misc_feature 1..20: note = CRISPR gRNA sequence
  source 1..20: mol_type = other DNA
ctgtattaagccccatctct

SEQ ID NO: 63812 - DNA, 20 bp, synthetic construct
  misc_feature 1..20: note = CRISPR gRNA sequence
  source 1..20: mol_type = other DNA
tattaagccccatctctctg

SEQ ID NO: 63813 - DNA, 20 bp, synthetic construct
  misc_feature 1..20: note = CRISPR gRNA sequence
  source 1..20: mol_type = other DNA
agccccatctctctgagggg

SEQ ID NO: 63814 - DNA, 20 bp, synthetic construct
  misc_feature 1..20: note = CRISPR gRNA sequence
  source 1..20: mol_type = other DNA
tctgaggggatggcgatgac

SEQ ID NO: 63815 - DNA, 20 bp, synthetic construct
  misc_feature 1..20: note = CRISPR gRNA sequence
  source 1..20: mol_type = other DNA
tgaggggatggcgatgactt

SEQ ID NO: 63816 - DNA, 20 bp, synthetic construct
  misc_feature 1..20: note = CRISPR gRNA sequence
  source 1..20: mol_type = other DNA
aggggatggcgatgacttct

SEQ ID NO: 63817 - DNA, 20 bp, synthetic construct
  misc_feature 1..20: note = CRISPR gRNA sequence
  source 1..20: mol_type = other DNA
ctcagctctgcccagcactg

SEQ ID NO: 63818 - DNA, 20 bp, synthetic construct
  misc_feature 1..20: note = CRISPR gRNA sequence
  source 1..20: mol_type = other DNA
tcagctctgcccagcactga

SEQ ID NO: 63819 - DNA, 20 bp, synthetic construct
  misc_feature 1..20: note = CRISPR gRNA sequence
  source 1..20: mol_type = other DNA
agctctgcccagcactgatc

SEQ ID NO: 63820 - DNA, 20 bp, synthetic construct
  misc_feature 1..20: note = CRISPR gRNA sequence
  source 1..20: mol_type = other DNA
tgcccagcactgatcctctg

SEQ ID NO: 63821 - DNA, 20 bp, synthetic construct
  misc_feature 1..20: note = CRISPR gRNA sequence
  source 1..20: mol_type = other DNA
cccagcactgatcctctgac

SEQ ID NO: 63822 - DNA, 20 bp, synthetic construct
  misc_feature 1..20: note = CRISPR gRNA sequence
  source 1..20: mol_type = other DNA
atcctctgacacttcgcttc

SEQ ID NO: 63823 - DNA, 20 bp, synthetic construct
  misc_feature 1..20: note = CRISPR gRNA sequence
  source 1..20: mol_type = other DNA
tgacacttcgcttcttctta

SEQ ID NO: 63824 - DNA, 20 bp, synthetic construct
  misc_feature 1..20: note = CRISPR gRNA sequence
  source 1..20: mol_type = other DNA
acacttcgcttcttcttatg

SEQ ID NO: 63825 - DNA, 20 bp, synthetic construct
  misc_feature 1..20: note = CRISPR gRNA sequence
  source 1..20: mol_type = other DNA
cgcttcttcttatggcagct

SEQ ID NO: 63826 - DNA, 20 bp, synthetic construct
  misc_feature 1..20: note = CRISPR gRNA sequence
  source 1..20: mol_type = other DNA
gcttcttcttatggcagctt

SEQ ID NO: 63827 - DNA, 20 bp, synthetic construct
  misc_feature 1..20: note = CRISPR gRNA sequence
  source 1..20: mol_type = other DNA
cttcttatggcagctttaag

SEQ ID NO: 63828 - DNA, 20 bp, synthetic construct
  misc_feature 1..20: note = CRISPR gRNA sequence
  source 1..20: mol_type = other DNA
ttcttatggcagctttaaga

SEQ ID NO: 63829 - DNA, 20 bp, synthetic construct
  misc_feature 1..20: note = CRISPR gRNA sequence
  source 1..20: mol_type = other DNA
cttatggcagctttaagagc

SEQ ID NO: 63830 - DNA, 20 bp, synthetic construct
  misc_feature 1..20: note = CRISPR gRNA sequence
  source 1..20: mol_type = other DNA
ttatggcagctttaagagca

SEQ ID NO: 63831 - DNA, 20 bp, synthetic construct
  misc_feature 1..20: note = CRISPR gRNA sequence
  source 1..20: mol_type = other DNA
atggcagctttaagagcagg

SEQ ID NO: 63832 - DNA, 20 bp, synthetic construct
  misc_feature 1..20: note = CRISPR gRNA sequence
  source 1..20: mol_type = other DNA
tggcagctttaagagcagga

SEQ ID NO: 63833 - DNA, 20 bp, synthetic construct
  misc_feature 1..20: note = CRISPR gRNA sequence
  source 1..20: mol_type = other DNA
taagagcaggaagtgtgggg

SEQ ID NO: 63834 - DNA, 20 bp, synthetic construct
  misc_feature 1..20: note = CRISPR gRNA sequence
  source 1..20: mol_type = other DNA
aagagcaggaagtgtgggga

SEQ ID NO: 63835 - DNA, 20 bp, synthetic construct
  misc_feature 1..20: note = CRISPR gRNA sequence
  source 1..20: mol_type = other DNA
agagcaggaagtgtggggat

SEQ ID NO: 63836 - DNA, 20 bp, synthetic construct
  misc_feature 1..20: note = CRISPR gRNA sequence
  source 1..20: mol_type = other DNA
tgcagaagccctctccagga

SEQ ID NO: 63837 - DNA, 20 bp, synthetic construct
  misc_feature 1..20: note = CRISPR gRNA sequence
  source 1..20: mol_type = other DNA
gcagaagccctctccaggag

SEQ ID NO: 63838 - DNA, 20 bp, synthetic construct
  misc_feature 1..20: note = CRISPR gRNA sequence
  source 1..20: mol_type = other DNA
cagaagccctctccaggagc

SEQ ID NO: 63839 - DNA, 20 bp, synthetic construct
  misc_feature 1..20: note = CRISPR gRNA sequence
  source 1..20: mol_type = other DNA
tccaggagcttgccgacaat

SEQ ID NO: 63840 - DNA, 20 bp, synthetic construct
  misc_feature 1..20: note = CRISPR gRNA sequence
  source 1..20: mol_type = other DNA
caggagcttgccgacaatgg

SEQ ID NO: 63841 - DNA, 20 bp, synthetic construct
  misc_feature 1..20: note = CRISPR gRNA sequence
  source 1..20: mol_type = other DNA
gccgacaatggggaggctgc

SEQ ID NO: 63842 - DNA, 20 bp, synthetic construct
  misc_feature 1..20: note = CRISPR gRNA sequence
  source 1..20: mol_type = other DNA
ccgacaatggggaggctgca

SEQ ID NO: 63843 - DNA, 20 bp, synthetic construct
  misc_feature 1..20: note = CRISPR gRNA sequence
  source 1..20: mol_type = other DNA
cagatgctggggtgagccag

SEQ ID NO: 63844 - DNA, 20 bp, synthetic construct
  misc_feature 1..20: note = CRISPR gRNA sequence
  source 1..20: mol_type = other DNA
gggtgagccaggccttggag

SEQ ID NO: 63845 - DNA, 20 bp, synthetic construct
  misc_feature 1..20: note = CRISPR gRNA sequence
  source 1..20: mol_type = other DNA
ggagctgagaagggtcttca

SEQ ID NO: 63846 - DNA, 20 bp, synthetic construct
  misc_feature 1..20: note = CRISPR gRNA sequence
  source 1..20: mol_type = other DNA
gagctgagaagggtcttcag

SEQ ID NO: 63847 - DNA, 20 bp, synthetic construct
  misc_feature 1..20: note = CRISPR gRNA sequence
  source 1..20: mol_type = other DNA
agaagggtcttcagctgggg

SEQ ID NO: 63848 - DNA, 20 bp, synthetic construct
  misc_feature 1..20: note = CRISPR gRNA sequence
  source 1..20: mol_type = other DNA
cagctggggatgcctggtac

SEQ ID NO: 63849 - DNA, 20 bp, synthetic construct
  misc_feature 1..20: note = CRISPR gRNA sequence
  source 1..20: mol_type = other DNA
agctggggatgcctggtact

SEQ ID NO: 63850 - DNA, 20 bp, synthetic construct
  misc_feature 1..20: note = CRISPR gRNA sequence
  source 1..20: mol_type = other DNA
gggatgcctggtactctcct

SEQ ID NO: 63851 - DNA, 20 bp, synthetic construct
  misc_feature 1..20: note = CRISPR gRNA sequence
  source 1..20: mol_type = other DNA
gtactctcctccctctcctt

SEQ ID NO: 63852 - DNA, 20 bp, synthetic construct
  misc_feature 1..20: note = CRISPR gRNA sequence
  source 1..20: mol_type = other DNA
tcctccctctccttaatcct

SEQ ID NO: 63853 - DNA, 20 bp, synthetic construct
  misc_feature 1..20: note = CRISPR gRNA sequence
  source 1..20: mol_type = other DNA
ctccctctccttaatcctac

SEQ ID NO: 63854 - DNA, 20 bp, synthetic construct
  misc_feature 1..20: note = CRISPR gRNA sequence
  source 1..20: mol_type = other DNA
cctctccttaatcctacaca

SEQ ID NO: 63855 - DNA, 20 bp, synthetic construct
  misc_feature 1..20: note = CRISPR gRNA sequence
  source 1..20: mol_type = other DNA
tccttaatcctacacaaggc

SEQ ID NO: 63856 - DNA, 20 bp, synthetic construct
  misc_feature 1..20: note = CRISPR gRNA sequence
  source 1..20: mol_type = other DNA
cttaatcctacacaaggcag

SEQ ID NO: 63857 - DNA, 20 bp, synthetic construct
  misc_feature 1..20: note = CRISPR gRNA sequence
  source 1..20: mol_type = other DNA
aatcctacacaaggcagatt

SEQ ID NO: 63858 - DNA, 20 bp, synthetic construct
  misc_feature 1..20: note = CRISPR gRNA sequence
  source 1..20: mol_type = other DNA
atcctacacaaggcagattc

SEQ ID NO: 63859 - DNA, 20 bp, synthetic construct
  misc_feature 1..20: note = CRISPR gRNA sequence
  source 1..20: mol_type = other DNA
cacaaggcagattcctggcc

SEQ ID NO: 63860 - DNA, 20 bp, synthetic construct
  misc_feature 1..20: note = CRISPR gRNA sequence
  source 1..20: mol_type = other DNA
ctggccccgcccttttcccc

SEQ ID NO: 63861 - DNA, 20 bp, synthetic construct
  misc_feature 1..20: note = CRISPR gRNA sequence
  source 1..20: mol_type = other DNA
gccccgcccttttcccctcc

SEQ ID NO: 63862 - DNA, 20 bp, synthetic construct
  misc_feature 1..20: note = CRISPR gRNA sequence
  source 1..20: mol_type = other DNA
ttcccctcctcgttcctccc

SEQ ID NO: 63863 - DNA, 20 bp, synthetic construct
  misc_feature 1..20: note = CRISPR gRNA sequence
  source 1..20: mol_type = other DNA
tcccctcctcgttcctcccc

SEQ ID NO: 63864 - DNA, 20 bp, synthetic construct
  misc_feature 1..20: note = CRISPR gRNA sequence
  source 1..20: mol_type = other DNA
cccctcctcgttcctcccca

SEQ ID NO: 63865 - DNA, 20 bp, synthetic construct
  misc_feature 1..20: note = CRISPR gRNA sequence
  source 1..20: mol_type = other DNA
ccctcctcgttcctccccac

SEQ ID NO: 63866 - DNA, 20 bp, synthetic construct
  misc_feature 1..20: note = CRISPR gRNA sequence
  source 1..20: mol_type = other DNA
ctcgttcctccccaccatct

SEQ ID NO: 63867 - DNA, 20 bp, synthetic construct
  misc_feature 1..20: note = CRISPR gRNA sequence
  source 1..20: mol_type = other DNA
gttcctccccaccatctttg

SEQ ID NO: 63868 - DNA, 20 bp, synthetic construct
  misc_feature 1..20: note = CRISPR gRNA sequence
  source 1..20: mol_type = other DNA
ctccccaccatctttgctta

SEQ ID NO: 63869 - DNA, 20 bp, synthetic construct
  misc_feature 1..20: note = CRISPR gRNA sequence
  source 1..20: mol_type = other DNA
cccaccatctttgcttactc

SEQ ID NO: 63870 - DNA, 20 bp, synthetic construct
  misc_feature 1..20: note = CRISPR gRNA sequence
  source 1..20: mol_type = other DNA
tgcttactctgtaggttagc

SEQ ID NO: 63871 - DNA, 20 bp, synthetic construct
  misc_feature 1..20: note = CRISPR gRNA sequence
  source 1..20: mol_type = other DNA
gcttactctgtaggttagca

SEQ ID NO: 63872 - DNA, 20 bp, synthetic construct
  misc_feature 1..20: note = CRISPR gRNA sequence
  source 1..20: mol_type = other DNA
cttactctgtaggttagcag

SEQ ID NO: 63873 - DNA, 20 bp, synthetic construct
  misc_feature 1..20: note = CRISPR gRNA sequence
  source 1..20: mol_type = other DNA
actctgtaggttagcaggaa

SEQ ID NO: 63874 - DNA, 20 bp, synthetic construct
  misc_feature 1..20: note = CRISPR gRNA sequence
  source 1..20: mol_type = other DNA
ctctgtaggttagcaggaag

SEQ ID NO: 63875 - DNA, 20 bp, synthetic construct
  misc_feature 1..20: note = CRISPR gRNA sequence
  source 1..20: mol_type = other DNA
tgtaggttagcaggaagtaa

SEQ ID NO: 63876 - DNA, 20 bp, synthetic construct
  misc_feature 1..20: note = CRISPR gRNA sequence
  source 1..20: mol_type = other DNA
taggttagcaggaagtaaaa

SEQ ID NO: 63877 - DNA, 20 bp, synthetic construct
  misc_feature 1..20: note = CRISPR gRNA sequence
  source 1..20: mol_type = other DNA
gcaggaagtaaaatcactgc

SEQ ID NO: 63878 - DNA, 20 bp, synthetic construct
  misc_feature 1..20: note = CRISPR gRNA sequence
  source 1..20: mol_type = other DNA
cccgaggcatcagccacctg

SEQ ID NO: 63879 - DNA, 20 bp, synthetic construct
  misc_feature 1..20: note = CRISPR gRNA sequence
  source 1..20: mol_type = other DNA
gtgaaagctttgcctctctg

SEQ ID NO: 63880 - DNA, 20 bp, synthetic construct
  misc_feature 1..20: note = CRISPR gRNA sequence
  source 1..20: mol_type = other DNA
tgcctctctgtccacagctg

SEQ ID NO: 63881 - DNA, 20 bp, synthetic construct
  misc_feature 1..20: note = CRISPR gRNA sequence
  source 1..20: mol_type = other DNA
gcctctctgtccacagctga

SEQ ID NO: 63882 - DNA, 20 bp, synthetic construct
  misc_feature 1..20: note = CRISPR gRNA sequence
  source 1..20: mol_type = other DNA
cctctctgtccacagctgaa

SEQ ID NO: 63883 - DNA, 20 bp, synthetic construct
  misc_feature 1..20: note = CRISPR gRNA sequence
  source 1..20: mol_type = other DNA
tctgtccacagctgaaagaa

SEQ ID NO: 63884 - DNA, 20 bp, synthetic construct
  misc_feature 1..20: note = CRISPR gRNA sequence
  source 1..20: mol_type = other DNA
tgtccacagctgaaagaagt

SEQ ID NO: 63885 - DNA, 20 bp, synthetic construct
  misc_feature 1..20: note = CRISPR gRNA sequence
  source 1..20: mol_type = other DNA
tccacagctgaaagaagtca

SEQ ID NO: 63886 - DNA, 20 bp, synthetic construct
  misc_feature 1..20: note = CRISPR gRNA sequence
  source 1..20: mol_type = other DNA
aaagaagtcaggtgagtgat

SEQ ID NO: 63887 - DNA, 20 bp, synthetic construct
  misc_feature 1..20: note = CRISPR gRNA sequence
  source 1..20: mol_type = other DNA
caggagggctcactgactgg

SEQ ID NO: 63888 - DNA, 20 bp, synthetic construct
  misc_feature 1..20: note = CRISPR gRNA sequence
  source 1..20: mol_type = other DNA
actgactggggagatgagcc

SEQ ID NO: 63889 - DNA, 20 bp, synthetic construct
  misc_feature 1..20: note = CRISPR gRNA sequence
  source 1..20: mol_type = other DNA
actggggagatgagccactg

SEQ ID NO: 63890 - DNA, 20 bp, synthetic construct
  misc_feature 1..20: note = CRISPR gRNA sequence
  source 1..20: mol_type = other DNA
gggagatgagccactgccca

SEQ ID NO: 63891 - DNA, 20 bp, synthetic construct
  misc_feature 1..20: note = CRISPR gRNA sequence
  source 1..20: mol_type = other DNA
cccaggtcccagagtccccc

SEQ ID NO: 63892 - DNA, 20 bp, synthetic construct
  misc_feature 1..20: note = CRISPR gRNA sequence
  source 1..20: mol_type = other DNA
gggcctgcatgttcctccaa

SEQ ID NO: 63893 - DNA, 20 bp, synthetic construct
  misc_feature 1..20: note = CRISPR gRNA sequence
  source 1..20: mol_type = other DNA
catgttcctccaagtctgac

SEQ ID NO: 63894 - DNA, 20 bp, synthetic construct
  misc_feature 1..20: note = CRISPR gRNA sequence
  source 1..20: mol_type = other DNA
ctccaagtctgaccagtagt

SEQ ID NO: 63895 - DNA, 20 bp, synthetic construct
  misc_feature 1..20: note = CRISPR gRNA sequence
  source 1..20: mol_type = other DNA
caagtctgaccagtagtttt

SEQ ID NO: 63896 - DNA, 20 bp, synthetic construct
  misc_feature 1..20: note = CRISPR gRNA sequence
  source 1..20: mol_type = other DNA
accagtagtttttcagtgag

SEQ ID NO: 63897 - DNA, 20 bp, synthetic construct
  misc_feature 1..20: note = CRISPR gRNA sequence
  source 1..20: mol_type = other DNA
ttcagtgagacccagagagg

SEQ ID NO: 63898 - DNA, 20 bp, synthetic construct
  misc_feature 1..20: note = CRISPR gRNA sequence
  source 1..20: mol_type = other DNA
tcagtgagacccagagaggg

SEQ ID NO: 63899 - DNA, 20 bp, synthetic construct
  misc_feature 1..20: note = CRISPR gRNA sequence
  source 1..20: mol_type = other DNA
cagtgagacccagagaggga

SEQ ID NO: 63900 - DNA, 20 bp, synthetic construct
  misc_feature 1..20: note = CRISPR gRNA sequence
  source 1..20: mol_type = other DNA
agtgagacccagagagggaa

SEQ ID NO: 63901 - DNA, 20 bp, synthetic construct
  misc_feature 1..20: note = CRISPR gRNA sequence
  source 1..20: mol_type = other DNA
agtagggctgagtccaaacc

SEQ ID NO: 63902 - DNA, 20 bp, synthetic construct
  misc_feature 1..20: note = CRISPR gRNA sequence
  source 1..20: mol_type = other DNA
agtccaaacccaaggctccc

SEQ ID NO: 63903 - DNA, 20 bp, synthetic construct
  misc_feature 1..20: note = CRISPR gRNA sequence
  source 1..20: mol_type = other DNA
ccagagtccccagagcaagg

SEQ ID NO: 63904 - DNA, 20 bp, synthetic construct
  misc_feature 1..20: note = CRISPR gRNA sequence
  source 1..20: mol_type = other DNA
ccttcatctaatattttaga

SEQ ID NO: 63905 - DNA, 20 bp, synthetic construct
  misc_feature 1..20: note = CRISPR gRNA sequence
  source 1..20: mol_type = other DNA
cttcatctaatattttagac

SEQ ID NO: 63906 - DNA, 20 bp, synthetic construct
  misc_feature 1..20: note = CRISPR gRNA sequence
  source 1..20: mol_type = other DNA
catctaatattttagactgt

SEQ ID NO: 63907 - DNA, 20 bp, synthetic construct
  misc_feature 1..20: note = CRISPR gRNA sequence
  source 1..20: mol_type = other DNA
atctaatattttagactgtc

SEQ ID NO: 63908 - DNA, 20 bp, synthetic construct
  misc_feature 1..20: note = CRISPR gRNA sequence
  source 1..20: mol_type = other DNA
atattttagactgtcttgga

SEQ ID NO: 63909 - DNA, 20 bp, synthetic construct
  misc_feature 1..20: note = CRISPR gRNA sequence
  source 1..20: mol_type = other DNA
tagactgtcttggaggagca

SEQ ID NO: 63910 - DNA, 20 bp, synthetic construct
  misc_feature 1..20: note = CRISPR gRNA sequence
  source 1..20: mol_type = other DNA
agactgtcttggaggagcat

SEQ ID NO: 63911 - DNA, 20 bp, synthetic construct
  misc_feature 1..20: note = CRISPR gRNA sequence
  source 1..20: mol_type = other DNA
gactgtcttggaggagcatg

SEQ ID NO: 63912 - DNA, 20 bp, synthetic construct
  misc_feature 1..20: note = CRISPR gRNA sequence
  source 1..20: mol_type = other DNA
tcttggaggagcatgagtgt

SEQ ID NO: 63913 - DNA, 20 bp, synthetic construct
  misc_feature 1..20: note = CRISPR gRNA sequence
  source 1..20: mol_type = other DNA
ggaggagcatgagtgttaag

SEQ ID NO: 63914 - DNA, 20 bp, synthetic construct
  misc_feature 1..20: note = CRISPR gRNA sequence
  source 1..20: mol_type = other DNA
gaggagcatgagtgttaagg

SEQ ID NO: 63915 - DNA, 20 bp, synthetic construct
  misc_feature 1..20: note = CRISPR gRNA sequence
  source 1..20: mol_type = other DNA
aggctccctccctctttctg

SEQ ID NO: 63916 - DNA, 20 bp, synthetic construct
  misc_feature 1..20: note = CRISPR gRNA sequence
  source 1..20: mol_type = other DNA
cctccctctttctgaaatcc

SEQ ID NO: 63917 - DNA, 20 bp, synthetic construct
  misc_feature 1..20: note = CRISPR gRNA sequence
  source 1..20: mol_type = other DNA
cctctttctgaaatcccagg

SEQ ID NO: 63918 - DNA, 20 bp, synthetic construct
  misc_feature 1..20: note = CRISPR gRNA sequence
  source 1..20: mol_type = other DNA
tttctgaaatcccaggagaa

SEQ ID NO: 63919 - DNA, 20 bp, synthetic construct
  misc_feature 1..20: note = CRISPR gRNA sequence
  source 1..20: mol_type = other DNA
tctgaaatcccaggagaagg

SEQ ID NO: 63920 - DNA, 20 bp, synthetic construct
  misc_feature 1..20: note = CRISPR gRNA sequence
  source 1..20: mol_type = other DNA
ctgaaatcccaggagaaggg

SEQ ID NO: 63921 - DNA, 20 bp, synthetic construct
  misc_feature 1..20: note = CRISPR gRNA sequence
  source 1..20: mol_type = other DNA
tgaaatcccaggagaaggga

SEQ ID NO: 63922 - DNA, 20 bp, synthetic construct
  misc_feature 1..20: note = CRISPR gRNA sequence
  source 1..20: mol_type = other DNA
aaatcccaggagaagggata

SEQ ID NO: 63923 - DNA, 20 bp, synthetic construct
  misc_feature 1..20: note = CRISPR gRNA sequence
  source 1..20: mol_type = other DNA
tgggtacacataactacatg

SEQ ID NO: 63924 - DNA, 20 bp, synthetic construct
  misc_feature 1..20: note = CRISPR gRNA sequence
  source 1..20: mol_type = other DNA
catgaagcaccacacacctt

SEQ ID NO: 63925 - DNA, 20 bp, synthetic construct
  misc_feature 1..20: note = CRISPR gRNA sequence
  source 1..20: mol_type = other DNA
cacatttgttcacacatgtc

SEQ ID NO: 63926 - DNA, 20 bp, synthetic construct
  misc_feature 1..20: note = CRISPR gRNA sequence
  source 1..20: mol_type = other DNA
acatttgttcacacatgtct

SEQ ID NO: 63927 - DNA, 20 bp, synthetic construct
  misc_feature 1..20: note = CRISPR gRNA sequence
  source 1..20: mol_type = other DNA
gttcacacatgtctacactt

SEQ ID NO: 63928 - DNA, 20 bp, synthetic construct
  misc_feature 1..20: note = CRISPR gRNA sequence
  source 1..20: mol_type = other DNA
ttcacacatgtctacacttg

SEQ ID NO: 63929 - DNA, 20 bp, synthetic construct
  misc_feature 1..20: note = CRISPR gRNA sequence
  source 1..20: mol_type = other DNA
acacatgtctacacttgcac

SEQ ID NO: 63930 - DNA, 20 bp, synthetic construct
  misc_feature 1..20: note = CRISPR gRNA sequence
  source 1..20: mol_type = other DNA
cacttgcacagaagtacaca

SEQ ID NO: 63931 - DNA, 20 bp, synthetic construct
  misc_feature 1..20: note = CRISPR gRNA sequence
  source 1..20: mol_type = other DNA
gcacagaagtacacaggcat

SEQ ID NO: 63932 - DNA, 20 bp, synthetic construct
  misc_feature 1..20: note = CRISPR gRNA sequence
  source 1..20: mol_type = other DNA
cacagaagtacacaggcata

SEQ ID NO: 63933 - DNA, 20 bp, synthetic construct
  misc_feature 1..20: note = CRISPR gRNA sequence
  source 1..20: mol_type = other DNA
ataggtgtgcacatgtatgc

SEQ ID NO: 63934 - DNA, 20 bp, synthetic construct
  misc_feature 1..20: note = CRISPR gRNA sequence
  source 1..20: mol_type = other DNA
taactacatgtacacatttt

SEQ ID NO: 63935 - DNA, 20 bp, synthetic construct
  misc_feature 1..20: note = CRISPR gRNA sequence
  source 1..20: mol_type = other DNA
aactacatgtacacattttg

SEQ ID NO: 63936 - DNA, 20 bp, synthetic construct
  misc_feature 1..20: note = CRISPR gRNA sequence
  source 1..20: mol_type = other DNA
actacatgtacacattttga

SEQ ID NO: 63937 - DNA, 20 bp, synthetic construct
  misc_feature 1..20: note = CRISPR gRNA sequence
  source 1..20: mol_type = other DNA
catgtacacattttgatgcc

SEQ ID NO: 63938 - DNA, 20 bp, synthetic construct
  misc_feature 1..20: note = CRISPR gRNA sequence
  source 1..20: mol_type = other DNA
tgatgccagcacactctaac

SEQ ID NO: 63939 - DNA, 20 bp, synthetic construct
  misc_feature 1..20: note = CRISPR gRNA sequence
  source 1..20: mol_type = other DNA
gatgccagcacactctaact

SEQ ID NO: 63940 - DNA, 20 bp, synthetic construct
  misc_feature 1..20: note = CRISPR gRNA sequence
  source 1..20: mol_type = other DNA
atgccagcacactctaacta

SEQ ID NO: 63941 - DNA, 20 bp, synthetic construct
  misc_feature 1..20: note = CRISPR gRNA sequence
  source 1..20: mol_type = other DNA
taactaactaagcttgtatg

SEQ ID NO: 63942 - DNA, 20 bp, synthetic construct
  misc_feature 1..20: note = CRISPR gRNA sequence
  source 1..20: mol_type = other DNA
actaactaagcttgtatgca

SEQ ID NO: 63943 - DNA, 20 bp, synthetic construct
  misc_feature 1..20: note = CRISPR gRNA sequence
  source 1..20: mol_type = other DNA
actaagcttgtatgcacaaa

SEQ ID NO: 63944 - DNA, 20 bp, synthetic construct
  misc_feature 1..20: note = CRISPR gRNA sequence
  source 1..20: mol_type = other DNA
agcttgtatgcacaaatata

SEQ ID NO: 63945 - DNA, 20 bp, synthetic construct
  misc_feature 1..20: note = CRISPR gRNA sequence
  source 1..20: mol_type = other DNA
gtatgcacaaatatactcct

SEQ ID NO: 63946 - DNA, 20 bp, synthetic construct
  misc_feature 1..20: note = CRISPR gRNA sequence
  source 1..20: mol_type = other DNA
tatgcacaaatatactcctg

SEQ ID NO: 63947 - DNA, 20 bp, synthetic construct
  misc_feature 1..20: note = CRISPR gRNA sequence
  source 1..20: mol_type = other DNA
ctgccctgtgtctgggactc

SEQ ID NO: 63948 - DNA, 20 bp, synthetic construct
  misc_feature 1..20: note = CRISPR gRNA sequence
  source 1..20: mol_type = other DNA
ccctgtgtctgggactcagt

SEQ ID NO: 63949 - DNA, 20 bp, synthetic construct
  misc_feature 1..20: note = CRISPR gRNA sequence
  source 1..20: mol_type = other DNA
tgtctgggactcagtaccat

SEQ ID NO: 63950 - DNA, 20 bp, synthetic construct
  misc_feature 1..20: note = CRISPR gRNA sequence
  source 1..20: mol_type = other DNA
ggactcagtaccatggggag

SEQ ID NO: 63951 - DNA, 20 bp, synthetic construct
  misc_feature 1..20: note = CRISPR gRNA sequence
  source 1..20: mol_type = other DNA
agtaccatggggaggagtgg

SEQ ID NO: 63952 - DNA, 20 bp, synthetic construct
  misc_feature 1..20: note = CRISPR gRNA sequence
  source 1..20: mol_type = other DNA
ctccctggcagaacgctgct

SEQ ID NO: 63953 - DNA, 20 bp, synthetic construct
  misc_feature 1..20: note = CRISPR gRNA sequence
  source 1..20: mol_type = other DNA
cctggcagaacgctgctagt

SEQ ID NO: 63954 - DNA, 20 bp, synthetic construct
  misc_feature 1..20: note = CRISPR gRNA sequence
  source 1..20: mol_type = other DNA
gcagaacgctgctagtttat

SEQ ID NO: 63955 - DNA, 20 bp, synthetic construct
  misc_feature 1..20: note = CRISPR gRNA sequence
  source 1..20: mol_type = other DNA
ctagtttatatggcaccttt

SEQ ID NO: 63956 - DNA, 20 bp, synthetic construct
  misc_feature 1..20: note = CRISPR gRNA sequence
  source 1..20: mol_type = other DNA
gtttatatggcacctttatg

SEQ ID NO: 63957 - DNA, 20 bp, synthetic construct
  misc_feature 1..20: note = CRISPR gRNA sequence
  source 1..20: mol_type = other DNA
atatggcacctttatgacat

SEQ ID NO: 63958 - DNA, 20 bp, synthetic construct
  misc_feature 1..20: note = CRISPR gRNA sequence
  source 1..20: mol_type = other DNA
tatggcacctttatgacatt

SEQ ID NO: 63959 - DNA, 20 bp, synthetic construct
  misc_feature 1..20: note = CRISPR gRNA sequence
  source 1..20: mol_type = other DNA
tatgacatttagagaaggca

SEQ ID NO: 63960 - DNA, 20 bp, synthetic construct
  misc_feature 1..20: note = CRISPR gRNA sequence
  source 1..20: mol_type = other DNA
atgacatttagagaaggcac

SEQ ID NO: 63961 - DNA, 20 bp, synthetic construct
  misc_feature 1..20: note = CRISPR gRNA sequence
  source 1..20: mol_type = other DNA
tgacatttagagaaggcacc

SEQ ID NO: 63962 - DNA, 20 bp, synthetic construct
  misc_feature 1..20: note = CRISPR gRNA sequence
  source 1..20: mol_type = other DNA
agagaaggcaccacttcatc

SEQ ID NO: 63963 - DNA, 20 bp, synthetic construct
  misc_feature 1..20: note = CRISPR gRNA sequence
  source 1..20: mol_type = other DNA
gagaaggcaccacttcatcc

SEQ ID NO: 63964 - DNA, 20 bp, synthetic construct
  misc_feature 1..20: note = CRISPR gRNA sequence
  source 1..20: mol_type = other DNA
catccacacagatgcagcct

SEQ ID NO: 63965 - DNA, 20 bp, synthetic construct
  misc_feature 1..20: note = CRISPR gRNA sequence
  source 1..20: mol_type = other DNA
atccacacagatgcagcctg

SEQ ID NO: 63966 - DNA, 20 bp, synthetic construct
  misc_feature 1..20: note = CRISPR gRNA sequence
  source 1..20: mol_type = other DNA
tcactaaggttcagcacttg

SEQ ID NO: 63967 - DNA, 20 bp, synthetic construct
  misc_feature 1..20: note = CRISPR gRNA sequence
  source 1..20: mol_type = other DNA
aggttcagcacttgttgagt

SEQ ID NO: 63968 - DNA, 20 bp, synthetic construct
  misc_feature 1..20: note = CRISPR gRNA sequence
  source 1..20: mol_type = other DNA
agcacttgttgagtgaaaat

SEQ ID NO: 63969 - DNA, 20 bp, synthetic construct
  misc_feature 1..20: note = CRISPR gRNA sequence
  source 1..20: mol_type = other DNA
gttgagtgaaaataataagt

SEQ ID NO: 63970 - DNA, 20 bp, synthetic construct
  misc_feature 1..20: note = CRISPR gRNA sequence
  source 1..20: mol_type = other DNA
ttgagtgaaaataataagtt

SEQ ID NO: 63971 - DNA, 20 bp, synthetic construct
  misc_feature 1..20: note = CRISPR gRNA sequence
  source 1..20: mol_type = other DNA
agtgaaaataataagttgga

SEQ ID NO: 63972 - DNA, 20 bp, synthetic construct
  misc_feature 1..20: note = CRISPR gRNA sequence
  source 1..20: mol_type = other DNA
gaccacagtccctattgtcg

SEQ ID NO: 63973 - DNA, 20 bp, synthetic construct
  misc_feature 1..20: note = CRISPR gRNA sequence
  source 1..20: mol_type = other DNA
ttgtcgtctcggctgggcat

SEQ ID NO: 63974 - DNA, 20 bp, synthetic construct
  misc_feature 1..20: note = CRISPR gRNA sequence
  source 1..20: mol_type = other DNA
tcgtctcggctgggcatctg

SEQ ID NO: 63975 - DNA, 20 bp, synthetic construct
  misc_feature 1..20: note = CRISPR gRNA sequence
  source 1..20: mol_type = other DNA
ggctgggcatctgtgaaccg

SEQ ID NO: 63976 - DNA, 20 bp, synthetic construct
  misc_feature 1..20: note = CRISPR gRNA sequence
  source 1..20: mol_type = other DNA
ggcatctgtgaaccgtgatt

SEQ ID NO: 63977 - DNA, 20 bp, synthetic construct
  misc_feature 1..20: note = CRISPR gRNA sequence
  source 1..20: mol_type = other DNA
tgaaccgtgattaagccaag

SEQ ID NO: 63978 - DNA, 20 bp, synthetic construct
  misc_feature 1..20: note = CRISPR gRNA sequence
  source 1..20: mol_type = other DNA
agccaaggttcagaagtact

SEQ ID NO: 63979 - DNA, 20 bp, synthetic construct
  misc_feature 1..20: note = CRISPR gRNA sequence
  source 1..20: mol_type = other DNA
agaagtactgaacttgttga

SEQ ID NO: 63980 - DNA, 20 bp, synthetic construct
  misc_feature 1..20: note = CRISPR gRNA sequence
  source 1..20: mol_type = other DNA
aacttgttgacatttttctt

SEQ ID NO: 63981 - DNA, 20 bp, synthetic construct
  misc_feature 1..20: note = CRISPR gRNA sequence
  source 1..20: mol_type = other DNA
gttgacatttttcttccctg

SEQ ID NO: 63982 - DNA, 20 bp, synthetic construct
  misc_feature 1..20: note = CRISPR gRNA sequence
  source 1..20: mol_type = other DNA
ttgacatttttcttccctgg

SEQ ID NO: 63983 - DNA, 20 bp, synthetic construct
  misc_feature 1..20: note = CRISPR gRNA sequence
  source 1..20: mol_type = other DNA
acatttttcttccctggcta

SEQ ID NO: 63984 - DNA, 20 bp, synthetic construct
  misc_feature 1..20: note = CRISPR gRNA sequence
  source 1..20: mol_type = other DNA
ttcttccctggctattgaaa

SEQ ID NO: 63985 - DNA, 20 bp, synthetic construct
  misc_feature 1..20: note = CRISPR gRNA sequence
  source 1..20: mol_type = other DNA
tcttccctggctattgaaag

SEQ ID NO: 63986 - DNA, 20 bp, synthetic construct
  misc_feature 1..20: note = CRISPR gRNA sequence
  source 1..20: mol_type = other DNA
cttccctggctattgaaagt

SEQ ID NO: 63987 - DNA, 20 bp, synthetic construct
  misc_feature 1..20: note = CRISPR gRNA sequence
  source 1..20: mol_type = other DNA
ttccctggctattgaaagtg

SEQ ID NO: 63988 - DNA, 20 bp, synthetic construct
  misc_feature 1..20: note = CRISPR gRNA sequence
  source 1..20: mol_type = other DNA
ccctggctattgaaagtgac

SEQ ID NO: 63989 - DNA, 20 bp, synthetic construct
  misc_feature 1..20: note = CRISPR gRNA sequence
  source 1..20: mol_type = other DNA
cctggctattgaaagtgact

SEQ ID NO: 63990 - DNA, 20 bp, synthetic construct
  misc_feature 1..20: note = CRISPR gRNA sequence
  source 1..20: mol_type = other DNA
gctattgaaagtgactttaa

SEQ ID NO: 63991 - DNA, 20 bp, synthetic construct
  misc_feature 1..20: note = CRISPR gRNA sequence
  source 1..20: mol_type = other DNA
ttgaaagtgactttaatttt

SEQ ID NO: 63992 - DNA, 20 bp, synthetic construct
  misc_feature 1..20: note = CRISPR gRNA sequence
  source 1..20: mol_type = other DNA
aaagtgactttaattttgtc

SEQ ID NO: 63993 - DNA, 20 bp, synthetic construct
  misc_feature 1..20: note = CRISPR gRNA sequence
  source 1..20: mol_type = other DNA
taattttgtctttcatcacc

SEQ ID NO: 63994 - DNA, 20 bp, synthetic construct
  misc_feature 1..20: note = CRISPR gRNA sequence
  source 1..20: mol_type = other DNA
aattttgtctttcatcaccc

SEQ ID NO: 63995 - DNA, 20 bp, synthetic construct
  misc_feature 1..20: note = CRISPR gRNA sequence
  source 1..20: mol_type = other DNA
attttgtctttcatcaccca

SEQ ID NO: 63996 - DNA, 20 bp, synthetic construct
  misc_feature 1..20: note = CRISPR gRNA sequence
  source 1..20: mol_type = other DNA
tgtctttcatcacccaccat

SEQ ID NO: 63997 - DNA, 20 bp, synthetic construct
  misc_feature 1..20: note = CRISPR gRNA sequence
  source 1..20: mol_type = other DNA
gtctttcatcacccaccatt

SEQ ID NO: 63998 - DNA, 20 bp, synthetic construct
  misc_feature 1..20: note = CRISPR gRNA sequence
  source 1..20: mol_type = other DNA
tctttcatcacccaccattg

SEQ ID NO: 63999 - DNA, 20 bp, synthetic construct
  misc_feature 1..20: note = CRISPR gRNA sequence
  source 1..20: mol_type = other DNA
tcatcacccaccattgttct

SEQ ID NO: 64000 - DNA, 20 bp, synthetic construct
  misc_feature 1..20: note = CRISPR gRNA sequence
  source 1..20: mol_type = other DNA
catcacccaccattgttctt

SEQ ID NO: 64001 - DNA, 20 bp, synthetic construct
  misc_feature 1..20: note = CRISPR gRNA sequence
  source 1..20: mol_type = other DNA
atcacccaccattgttctta

SEQ ID NO: 64002 - DNA, 20 bp, synthetic construct
  misc_feature 1..20: note = CRISPR gRNA sequence
  source 1..20: mol_type = other DNA
ttcttaatcaccctcactcc

SEQ ID NO: 64003 - DNA, 20 bp, synthetic construct
  misc_feature 1..20: note = CRISPR gRNA sequence
  source 1..20: mol_type = other DNA
ttaatcaccctcactcccct

SEQ ID NO: 64004 - DNA, 20 bp, synthetic construct
  misc_feature 1..20: note = CRISPR gRNA sequence
  source 1..20: mol_type = other DNA
aatcaccctcactcccctca

SEQ ID NO: 64005 - DNA, 20 bp, synthetic construct
  misc_feature 1..20: note = CRISPR gRNA sequence
  source 1..20: mol_type = other DNA
atcaccctcactcccctcaa

SEQ ID NO: 64006 - DNA, 20 bp, synthetic construct
  misc_feature 1..20: note = CRISPR gRNA sequence
  source 1..20: mol_type = other DNA
actcccctcaactcatctgt

SEQ ID NO: 64007 - DNA, 20 bp, synthetic construct
  misc_feature 1..20: note = CRISPR gRNA sequence
  source 1..20: mol_type = other DNA
ccctcaactcatctgtctcc

SEQ ID NO: 64008 - DNA, 20 bp, synthetic construct
  misc_feature 1..20: note = CRISPR gRNA sequence
  source 1..20: mol_type = other DNA
aactcatctgtctccccagc

SEQ ID NO: 64009 - DNA, 20 bp, synthetic construct
  misc_feature 1..20: note = CRISPR gRNA sequence
  source 1..20: mol_type = other DNA
atctgtctccccagctagga

SEQ ID NO: 64010 - DNA, 20 bp, synthetic construct
  misc_feature 1..20: note = CRISPR gRNA sequence
  source 1..20: mol_type = other DNA
tctccccagctaggaaccca

SEQ ID NO: 64011 - DNA, 20 bp, synthetic construct
  misc_feature 1..20: note = CRISPR gRNA sequence
  source 1..20: mol_type = other DNA
cccagctaggaacccaggca

SEQ ID NO: 64012 - DNA, 20 bp, synthetic construct
  misc_feature 1..20: note = CRISPR gRNA sequence
  source 1..20: mol_type = other DNA
ggaacccaggcaaggctggc

SEQ ID NO: 64013 - DNA, 20 bp, synthetic construct
  misc_feature 1..20: note = CRISPR gRNA sequence
  source 1..20: mol_type = other DNA
gcttgtgaacaggtggggaa

SEQ ID NO: 64014 - DNA, 20 bp, synthetic construct
  misc_feature 1..20: note = CRISPR gRNA sequence
  source 1..20: mol_type = other DNA
gtgaacaggtggggaaagtg

SEQ ID NO: 64015 - DNA, 20 bp, synthetic construct
  misc_feature 1..20: note = CRISPR gRNA sequence
  source 1..20: mol_type = other DNA
tgaacaggtggggaaagtga

SEQ ID NO: 64016 - DNA, 20 bp, synthetic construct
  misc_feature 1..20: note = CRISPR gRNA sequence
  source 1..20: mol_type = other DNA
ggctcagggctctgggtgag

SEQ ID NO: 64017 - DNA, 20 bp, synthetic construct
  misc_feature 1..20: note = CRISPR gRNA sequence
  source 1..20: mol_type = other DNA
gctcagggctctgggtgagt

SEQ ID NO: 64018 - DNA, 20 bp, synthetic construct
  misc_feature 1..20: note = CRISPR gRNA sequence
  source 1..20: mol_type = other DNA
agggctctgggtgagtcagg

SEQ ID NO: 64019 - DNA, 20 bp, synthetic construct
  misc_feature 1..20: note = CRISPR gRNA sequence
  source 1..20: mol_type = other DNA
tgggtgagtcagggccacag

SEQ ID NO: 64020 - DNA, 20 bp, synthetic construct
  misc_feature 1..20: note = CRISPR gRNA sequence
  source 1..20: mol_type = other DNA
ggtgagtcagggccacagcc

SEQ ID NO: 64021 - DNA, 20 bp, synthetic construct
  misc_feature 1..20: note = CRISPR gRNA sequence
  source 1..20: mol_type = other DNA
gaagcgatgtctgcagcgtc

SEQ ID NO: 64022 - DNA, 20 bp, synthetic construct
  misc_feature 1..20: note = CRISPR gRNA sequence
  source 1..20: mol_type = other DNA
cagcgtcccagtctagactt

SEQ ID NO: 64023 - DNA, 20 bp, synthetic construct
  misc_feature 1..20: note = CRISPR gRNA sequence
  source 1..20: mol_type = other DNA
gactttactcattgcctggg

SEQ ID NO: 64024 - DNA, 20 bp, synthetic construct
  misc_feature 1..20: note = CRISPR gRNA sequence
  source 1..20: mol_type = other DNA
tactcattgcctggggggcc

SEQ ID NO: 64025 - DNA, 20 bp, synthetic construct
  misc_feature 1..20: note = CRISPR gRNA sequence
  source 1..20: mol_type = other DNA
actcattgcctggggggcct

SEQ ID NO: 64026 - DNA, 20 bp, synthetic construct
  misc_feature 1..20: note = CRISPR gRNA sequence
  source 1..20: mol_type = other DNA
ctcattgcctggggggccta

SEQ ID NO: 64027 - DNA, 20 bp, synthetic construct
  misc_feature 1..20: note = CRISPR gRNA sequence
  source 1..20: mol_type = other DNA
attgcctggggggcctatcc

SEQ ID NO: 64028 - DNA, 20 bp, synthetic construct
  misc_feature 1..20: note = CRISPR gRNA sequence
  source 1..20: mol_type = other DNA
cctggggggcctatcccagg

SEQ ID NO: 64029 - DNA, 20 bp, synthetic construct
  misc_feature 1..20: note = CRISPR gRNA sequence
  source 1..20: mol_type = other DNA
gggggcctatcccaggcaca

SEQ ID NO: 64030 - DNA, 20 bp, synthetic construct
  misc_feature 1..20: note = CRISPR gRNA sequence
  source 1..20: mol_type = other DNA
tcccaggcacatcccaggca

SEQ ID NO: 64031 - DNA, 20 bp, synthetic construct
  misc_feature 1..20: note = CRISPR gRNA sequence
  source 1..20: mol_type = other DNA
ggagcagggtgctaggtctc

SEQ ID NO: 64032 - DNA, 20 bp, synthetic construct
  misc_feature 1..20: note = CRISPR gRNA sequence
  source 1..20: mol_type = other DNA
ggtctcctcattgtgcctca

SEQ ID NO: 64033 - DNA, 20 bp, synthetic construct
  misc_feature 1..20: note = CRISPR gRNA sequence
  source 1..20: mol_type = other DNA
ctcattgtgcctcatgaaga

SEQ ID NO: 64034 - DNA, 20 bp, synthetic construct
  misc_feature 1..20: note = CRISPR gRNA sequence
  source 1..20: mol_type = other DNA
attgtgcctcatgaagaggc

SEQ ID NO: 64035 - DNA, 20 bp, synthetic construct
  misc_feature 1..20: note = CRISPR gRNA sequence
  source 1..20: mol_type = other DNA
tgcctcatgaagaggccgtc

SEQ ID NO: 64036 - DNA, 20 bp, synthetic construct
  misc_feature 1..20: note = CRISPR gRNA sequence
  source 1..20: mol_type = other DNA
atgaagaggccgtcagtctg

SEQ ID NO: 64037 - DNA, 20 bp, synthetic construct
  misc_feature 1..20: note = CRISPR gRNA sequence
  source 1..20: mol_type = other DNA
tcttctagatcccttgagcc

SEQ ID NO: 64038 - DNA, 20 bp, synthetic construct
  misc_feature 1..20: note = CRISPR gRNA sequence
  source 1..20: mol_type = other DNA
ctagatcccttgagccgcca

SEQ ID NO: 64039 - DNA, 20 bp, synthetic construct
  misc_feature 1..20: note = CRISPR gRNA sequence
  source 1..20: mol_type = other DNA
tagatcccttgagccgccag

SEQ ID NO: 64040 - DNA, 20 bp, synthetic construct
  misc_feature 1..20: note = CRISPR gRNA sequence
  source 1..20: mol_type = other DNA
gatcccttgagccgccaggc

SEQ ID NO: 64041 - DNA, 20 bp, synthetic construct
  misc_feature 1..20: note = CRISPR gRNA sequence
  source 1..20: mol_type = other DNA
gagccgccaggcaaaaactt

SEQ ID NO: 64042 - DNA, 20 bp, synthetic construct
  misc_feature 1..20: note = CRISPR gRNA sequence
  source 1..20: mol_type = other DNA
agccgccaggcaaaaacttc

SEQ ID NO: 64043 - DNA, 20 bp, synthetic construct
  misc_feature 1..20: note = CRISPR gRNA sequence
  source 1..20: mol_type = other DNA
ccccataggaacagaataga

SEQ ID NO: 64044 - DNA, 20 bp, synthetic construct
  misc_feature 1..20: note = CRISPR gRNA sequence
  source 1..20: mol_type = other DNA
cccataggaacagaatagac

SEQ ID NO: 64045 - DNA, 20 bp, synthetic construct
  misc_feature 1..20: note = CRISPR gRNA sequence
  source 1..20: mol_type = other DNA
aggccagcagagggtctttc

SEQ ID NO: 64046 - DNA, 20 bp, synthetic construct
  misc_feature 1..20: note = CRISPR gRNA sequence
  source 1..20: mol_type = other DNA
tcctcctagccgtgcctgct

SEQ ID NO: 64047 - DNA, 20 bp, synthetic construct
  misc_feature 1..20: note = CRISPR gRNA sequence
  source 1..20: mol_type = other DNA
cctcctagccgtgcctgctg

SEQ ID NO: 64048 - DNA, 20 bp, synthetic construct
  misc_feature 1..20: note = CRISPR gRNA sequence
  source 1..20: mol_type = other DNA
ctcctagccgtgcctgctgg

SEQ ID NO: 64049 - DNA, 20 bp, synthetic construct
  misc_feature 1..20: note = CRISPR gRNA sequence
  source 1..20: mol_type = other DNA
ctagccgtgcctgctggaat

SEQ ID NO: 64050 - DNA, 20 bp, synthetic construct
  misc_feature 1..20: note = CRISPR gRNA sequence
  source 1..20: mol_type = other DNA
gccgtgcctgctggaatccg

SEQ ID NO: 64051 - DNA, 20 bp, synthetic construct
  misc_feature 1..20: note = CRISPR gRNA sequence
  source 1..20: mol_type = other DNA
ctggaatccggcgagcaggc

SEQ ID NO: 64052 - DNA, 20 bp, synthetic construct
  misc_feature 1..20: note = CRISPR gRNA sequence
  source 1..20: mol_type = other DNA
gaatccggcgagcaggccat

SEQ ID NO: 64053 - DNA, 20 bp, synthetic construct
  misc_feature 1..20: note = CRISPR gRNA sequence
  source 1..20: mol_type = other DNA
tttctgggcccctgtcttat

SEQ ID NO: 64054 - DNA, 20 bp, synthetic construct
  misc_feature 1..20: note = CRISPR gRNA sequence
  source 1..20: mol_type = other DNA
tctgggcccctgtcttatgt

SEQ ID NO: 64055 - DNA, 20 bp, synthetic construct
  misc_feature 1..20: note = CRISPR gRNA sequence
  source 1..20: mol_type = other DNA
ctgggcccctgtcttatgtc

SEQ ID NO: 64056 - DNA, 20 bp, synthetic construct
  misc_feature 1..20: note = CRISPR gRNA sequence
  source 1..20: mol_type = other DNA
tgggcccctgtcttatgtct

SEQ ID NO: 64057 - DNA, 20 bp, synthetic construct
  misc_feature 1..20: note = CRISPR gRNA sequence
  source 1..20: mol_type = other DNA
ggcccctgtcttatgtctcc

SEQ ID NO: 64058 - DNA, 20 bp, synthetic construct
  misc_feature 1..20: note = CRISPR gRNA sequence
  source 1..20: mol_type = other DNA
tcttatgtctcccacatgag

SEQ ID NO: 64059 - DNA, 20 bp, synthetic construct
  misc_feature 1..20: note = CRISPR gRNA sequence
  source 1..20: mol_type = other DNA
atgtctcccacatgagggtg

SEQ ID NO: 64060 - DNA, 20 bp, synthetic construct
  misc_feature 1..20: note = CRISPR gRNA sequence
  source 1..20: mol_type = other DNA
tgtctcccacatgagggtgg

SEQ ID NO: 64061 - DNA, 20 bp, synthetic construct
  misc_feature 1..20: note = CRISPR gRNA sequence
  source 1..20: mol_type = other DNA
ccacatgagggtggccatcc

SEQ ID NO: 64062 - DNA, 20 bp, synthetic construct
  misc_feature 1..20: note = CRISPR gRNA sequence
  source 1..20: mol_type = other DNA
tcacttgctaactggggctt

SEQ ID NO: 64063 - DNA, 20 bp, synthetic construct
  misc_feature 1..20: note = CRISPR gRNA sequence
  source 1..20: mol_type = other DNA
gctaactggggcttgcaagt

SEQ ID NO: 64064 - DNA, 20 bp, synthetic construct
  misc_feature 1..20: note = CRISPR gRNA sequence
  source 1..20: mol_type = other DNA
ctaactggggcttgcaagtg

SEQ ID NO: 64065 - DNA, 20 bp, synthetic construct
  misc_feature 1..20: note = CRISPR gRNA sequence
  source 1..20: mol_type = other DNA
actggggcttgcaagtgccc

SEQ ID NO: 64066 - DNA, 20 bp, synthetic construct
  misc_feature 1..20: note = CRISPR gRNA sequence
  source 1..20: mol_type = other DNA
gggcttgcaagtgccccaac

SEQ ID NO: 64067 - DNA, 20 bp, synthetic construct
  misc_feature 1..20: note = CRISPR gRNA sequence
  source 1..20: mol_type = other DNA
gcaagtgccccaaccccagg

SEQ ID NO: 64068 - DNA, 20 bp, synthetic construct
  misc_feature 1..20: note = CRISPR gRNA sequence
  source 1..20: mol_type = other DNA
caagtgccccaaccccaggg

SEQ ID NO: 64069 - DNA, 20 bp, synthetic construct
  misc_feature 1..20: note = CRISPR gRNA sequence
  source 1..20: mol_type = other DNA
ggccttggtctcctcgcagt

SEQ ID NO: 64070 - DNA, 20 bp, synthetic construct
  misc_feature 1..20: note = CRISPR gRNA sequence
  source 1..20: mol_type = other DNA
ggtctcctcgcagttttcgg

SEQ ID NO: 64071 - DNA, 20 bp, synthetic construct
  misc_feature 1..20: note = CRISPR gRNA sequence
  source 1..20: mol_type = other DNA
gtctcctcgcagttttcggg

SEQ ID NO: 64072 - DNA, 20 bp, synthetic construct
  misc_feature 1..20: note = CRISPR gRNA sequence
  source 1..20: mol_type = other DNA
ctcgcagttttcgggacaac

SEQ ID NO: 64073 - DNA, 20 bp, synthetic construct
  misc_feature 1..20: note = CRISPR gRNA sequence
  source 1..20: mol_type = other DNA
gcagttttcgggacaaccag

SEQ ID NO: 64074 - DNA, 20 bp, synthetic construct
  misc_feature 1..20: note = CRISPR gRNA sequence
  source 1..20: mol_type = other DNA
tcgggacaaccagctcagtg

SEQ ID NO: 64075 - DNA, 20 bp, synthetic construct
  misc_feature 1..20: note = CRISPR gRNA sequence
  source 1..20: mol_type = other DNA
cgggacaaccagctcagtga

SEQ ID NO: 64076 - DNA, 20 bp, synthetic construct
  misc_feature 1..20: note = CRISPR gRNA sequence
  source 1..20: mol_type = other DNA
gggacaaccagctcagtgac

SEQ ID NO: 64077 - DNA, 20 bp, synthetic construct
  misc_feature 1..20: note = CRISPR gRNA sequence
  source 1..20: mol_type = other DNA
agtgaccaggtggtgctgaa

SEQ ID NO: 64078 - DNA, 20 bp, synthetic construct
  misc_feature 1..20: note = CRISPR gRNA sequence
  source 1..20: mol_type = other DNA
aacattgtggaggttctccc

SEQ ID NO: 64079 - DNA, 20 bp, synthetic construct
  misc_feature 1..20: note = CRISPR gRNA sequence
  source 1..20: mol_type = other DNA
tggaggttctccctcaccta

SEQ ID NO: 64080 - DNA, 20 bp, synthetic construct
  misc_feature 1..20: note = CRISPR gRNA sequence
  source 1..20: mol_type = other DNA
tccctcacctaccacggctc

SEQ ID NO: 64081 - DNA, 20 bp, synthetic construct
  misc_feature 1..20: note = CRISPR gRNA sequence
  source 1..20: mol_type = other DNA
cctcacctaccacggctccg

SEQ ID NO: 64082 - DNA, 20 bp, synthetic construct
  misc_feature 1..20: note = CRISPR gRNA sequence
  source 1..20: mol_type = other DNA
acctaccacggctccggaag

SEQ ID NO: 64083 - DNA, 20 bp, synthetic construct
  misc_feature 1..20: note = CRISPR gRNA sequence
  source 1..20: mol_type = other DNA
ccacggctccggaagcttga

SEQ ID NO: 64084 - DNA, 20 bp, synthetic construct
  misc_feature 1..20: note = CRISPR gRNA sequence
  source 1..20: mol_type = other DNA
cggaagcttgagtaagtgat

SEQ ID NO: 64085 - DNA, 20 bp, synthetic construct
  misc_feature 1..20: note = CRISPR gRNA sequence
  source 1..20: mol_type = other DNA
gagtaagtgatctttccact

SEQ ID NO: 64086 - DNA, 20 bp, synthetic construct
  misc_feature 1..20: note = CRISPR gRNA sequence
  source 1..20: mol_type = other DNA
agtaagtgatctttccactg

SEQ ID NO: 64087 - DNA, 20 bp, synthetic construct
  misc_feature 1..20: note = CRISPR gRNA sequence
  source 1..20: mol_type = other DNA
tccactgcctctgcagccca

SEQ ID NO: 64088 - DNA, 20 bp, synthetic construct
  misc_feature 1..20: note = CRISPR gRNA sequence
  source 1..20: mol_type = other DNA
ccactgcctctgcagcccag

SEQ ID NO: 64089 - DNA, 20 bp, synthetic construct
  misc_feature 1..20: note = CRISPR gRNA sequence
  source 1..20: mol_type = other DNA
cactgcctctgcagcccagt

SEQ ID NO: 64090 - DNA, 20 bp, synthetic construct
  misc_feature 1..20: note = CRISPR gRNA sequence
  source 1..20: mol_type = other DNA
cctctgcagcccagtccctc

SEQ ID NO: 64091 - DNA, 20 bp, synthetic construct
  misc_feature 1..20: note = CRISPR gRNA sequence
  source 1..20: mol_type = other DNA
tgcagcccagtccctctcta

SEQ ID NO: 64092 - DNA, 20 bp, synthetic construct
  misc_feature 1..20: note = CRISPR gRNA sequence
  source 1..20: mol_type = other DNA
cagcccagtccctctctata

SEQ ID NO: 64093 - DNA, 20 bp, synthetic construct
  misc_feature 1..20: note = CRISPR gRNA sequence
  source 1..20: mol_type = other DNA
tctatacctgattcacccca

SEQ ID NO: 64094 - DNA, 20 bp, synthetic construct
  misc_feature 1..20: note = CRISPR gRNA sequence
  source 1..20: mol_type = other DNA
tatacctgattcaccccact

SEQ ID NO: 64095 - DNA, 20 bp, synthetic construct
  misc_feature 1..20: note = CRISPR gRNA sequence
  source 1..20: mol_type = other DNA
tacctgattcaccccactcc

SEQ ID NO: 64096 - DNA, 20 bp, synthetic construct
  misc_feature 1..20: note = CRISPR gRNA sequence
  source 1..20: mol_type = other DNA
attcaccccactcccttgca

SEQ ID NO: 64097 - DNA, 20 bp, synthetic construct
  misc_feature 1..20: note = CRISPR gRNA sequence
  source 1..20: mol_type = other DNA
accccactcccttgcaaggc

SEQ ID NO: 64098 - DNA, 20 bp, synthetic construct
  misc_feature 1..20: note = CRISPR gRNA sequence
  source 1..20: mol_type = other DNA
ccttgcaaggcaaggaaggt

SEQ ID NO: 64099 - DNA, 20 bp, synthetic construct
  misc_feature 1..20: note = CRISPR gRNA sequence
  source 1..20: mol_type = other DNA
gcaaggcaaggaaggtctgg

SEQ ID NO: 64100 - DNA, 20 bp, synthetic construct
  misc_feature 1..20: note = CRISPR gRNA sequence
  source 1..20: mol_type = other DNA
caaggcaaggaaggtctggg

SEQ ID NO: 64101 - DNA, 20 bp, synthetic construct
  misc_feature 1..20: note = CRISPR gRNA sequence
  source 1..20: mol_type = other DNA
gggcccctggggtaggggat

SEQ ID NO: 64102 - DNA, 20 bp, synthetic construct
  misc_feature 1..20: note = CRISPR gRNA sequence
  source 1..20: mol_type = other DNA
gggtaggggattccactcct

SEQ ID NO: 64103 - DNA, 20 bp, synthetic construct
  misc_feature 1..20: note = CRISPR gRNA sequence
  source 1..20: mol_type = other DNA
cactcctgacacctttgcca

SEQ ID NO: 64104 - DNA, 20 bp, synthetic construct
  misc_feature 1..20: note = CRISPR gRNA sequence
  source 1..20: mol_type = other DNA
ctgacacctttgccacaatc

SEQ ID NO: 64105 - DNA, 20 bp, synthetic construct
  misc_feature 1..20: note = CRISPR gRNA sequence
  source 1..20: mol_type = other DNA
acacctttgccacaatcttg

SEQ ID NO: 64106 - DNA, 20 bp, synthetic construct
  misc_feature 1..20: note = CRISPR gRNA sequence
  source 1..20: mol_type = other DNA
tgccacaatcttgcagcctg

SEQ ID NO: 64107 - DNA, 20 bp, synthetic construct
  misc_feature 1..20: note = CRISPR gRNA sequence
  source 1..20: mol_type = other DNA
gccacaatcttgcagcctga

SEQ ID NO: 64108 - DNA, 20 bp, synthetic construct
  misc_feature 1..20: note = CRISPR gRNA sequence
  source 1..20: mol_type = other DNA
ccacaatcttgcagcctgag

SEQ ID NO: 64109 - DNA, 20 bp, synthetic construct
  misc_feature 1..20: note = CRISPR gRNA sequence
  source 1..20: mol_type = other DNA
gcagcctgagcagcaacagc

SEQ ID NO: 64110 - DNA, 20 bp, synthetic construct
  misc_feature 1..20: note = CRISPR gRNA sequence
  source 1..20: mol_type = other DNA
cagcctgagcagcaacagca

SEQ ID NO: 64111 - DNA, 20 bp, synthetic construct
  misc_feature 1..20: note = CRISPR gRNA sequence
  source 1..20: mol_type = other DNA
agcagcaacagcatctgcgt

SEQ ID NO: 64112 - DNA, 20 bp, synthetic construct
  misc_feature 1..20: note = CRISPR gRNA sequence
  source 1..20: mol_type = other DNA
cgtgtcaaccctactctgct

SEQ ID NO: 64113 - DNA, 20 bp, synthetic construct
  misc_feature 1..20: note = CRISPR gRNA sequence
  source 1..20: mol_type = other DNA
ctctgcttggcaagggtggc

SEQ ID NO: 64114 - DNA, 20 bp, synthetic construct
  misc_feature 1..20: note = CRISPR gRNA sequence
  source 1..20: mol_type = other DNA
tgcttggcaagggtggcagt

SEQ ID NO: 64115 - DNA, 20 bp, synthetic construct
  misc_feature 1..20: note = CRISPR gRNA sequence
  source 1..20: mol_type = other DNA
cttggcaagggtggcagtca

SEQ ID NO: 64116 - DNA, 20 bp, synthetic construct
  misc_feature 1..20: note = CRISPR gRNA sequence
  source 1..20: mol_type = other DNA
ggcaagggtggcagtcacgt

SEQ ID NO: 64117 - DNA, 20 bp, synthetic construct
  misc_feature 1..20: note = CRISPR gRNA sequence
  source 1..20: mol_type = other DNA
gcaagggtggcagtcacgtg

SEQ ID NO: 64118 - DNA, 20 bp, synthetic construct
  misc_feature 1..20: note = CRISPR gRNA sequence
  source 1..20: mol_type = other DNA
ccgtcaggatgcttcaggcc

SEQ ID NO: 64119 - DNA, 20 bp, synthetic construct
  misc_feature 1..20: note = CRISPR gRNA sequence
  source 1..20: mol_type = other DNA
caggccaggtgagcagaagg

SEQ ID NO: 64120 - DNA, 20 bp, synthetic construct
  misc_feature 1..20: note = CRISPR gRNA sequence
  source 1..20: mol_type = other DNA
aggccaggtgagcagaagga

SEQ ID NO: 64121 - DNA, 20 bp, synthetic construct
  misc_feature 1..20: note = CRISPR gRNA sequence
  source 1..20: mol_type = other DNA
ggccttatgggccttgagaa

SEQ ID NO: 64122 - DNA, 20 bp, synthetic construct
  misc_feature 1..20: note = CRISPR gRNA sequence
  source 1..20: mol_type = other DNA
gccttatgggccttgagaaa

SEQ ID NO: 64123 - DNA, 20 bp, synthetic construct
  misc_feature 1..20: note = CRISPR gRNA sequence
  source 1..20: mol_type = other DNA
atgggccttgagaaaagagg

SEQ ID NO: 64124 - DNA, 20 bp, synthetic construct
  misc_feature 1..20: note = CRISPR gRNA sequence
  source 1..20: mol_type = other DNA
tgggccttgagaaaagagga

SEQ ID NO: 64125 - DNA, 20 bp, synthetic construct
  misc_feature 1..20: note = CRISPR gRNA sequence
  source 1..20: mol_type = other DNA
gagaaaagaggaggggaaag

SEQ ID NO: 64126 - DNA, 20 bp, synthetic construct
  misc_feature 1..20: note = CRISPR gRNA sequence
  source 1..20: mol_type = other DNA
agaaaagaggaggggaaagt

SEQ ID NO: 64127 - DNA, 20 bp, synthetic construct
  misc_feature 1..20: note = CRISPR gRNA sequence
  source 1..20: mol_type = other DNA
gtctgcaggataaatctgtg

SEQ ID NO: 64128 - DNA, 20 bp, synthetic construct
  misc_feature 1..20: note = CRISPR gRNA sequence
  source 1..20: mol_type = other DNA
caggataaatctgtgcatac

SEQ ID NO: 64129 - DNA, 20 bp, synthetic construct
  misc_feature 1..20: note = CRISPR gRNA sequence
  source 1..20: mol_type = other DNA
tgcataccctactgttttac

SEQ ID NO: 64130 - DNA, 20 bp, synthetic construct
  misc_feature 1..20: note = CRISPR gRNA sequence
  source 1..20: mol_type = other DNA
ctgttttactcacagcttta

SEQ ID NO: 64131 - DNA, 20 bp, synthetic construct
  misc_feature 1..20: note = CRISPR gRNA sequence
  source 1..20: mol_type = other DNA
ttttactcacagctttacct

SEQ ID NO: 64132 - DNA, 20 bp, synthetic construct
  misc_feature 1..20: note = CRISPR gRNA sequence
  source 1..20: mol_type = other DNA
tactcacagctttaccttca

SEQ ID NO: 64133 - DNA, 20 bp, synthetic construct
  misc_feature 1..20: note = CRISPR gRNA sequence
  source 1..20: mol_type = other DNA
actcacagctttaccttcag

SEQ ID NO: 64134 - DNA, 20 bp, synthetic construct
  misc_feature 1..20: note = CRISPR gRNA sequence
  source 1..20: mol_type = other DNA
ctcacagctttaccttcaga

SEQ ID NO: 64135 - DNA, 20 bp, synthetic construct
  misc_feature 1..20: note = CRISPR gRNA sequence
  source 1..20: mol_type = other DNA
acagctttaccttcagaacc

SEQ ID NO: 64136 - DNA, 20 bp, synthetic construct
  misc_feature 1..20: note = CRISPR gRNA sequence
  source 1..20: mol_type = other DNA
taccttcagaacctagctca

SEQ ID NO: 64137 - DNA, 20 bp, synthetic construct
  misc_feature 1..20: note = CRISPR gRNA sequence
  source 1..20: mol_type = other DNA
accttcagaacctagctcag

SEQ ID NO: 64138 - DNA, 20 bp, synthetic construct
  misc_feature 1..20: note = CRISPR gRNA sequence
  source 1..20: mol_type = other DNA
ccttcagaacctagctcagg

SEQ ID NO: 64139 - DNA, 20 bp, synthetic construct
  misc_feature 1..20: note = CRISPR gRNA sequence
  source 1..20: mol_type = other DNA
cagaacctagctcaggcttg

SEQ ID NO: 64140 - DNA, 20 bp, synthetic construct
  misc_feature 1..20: note = CRISPR gRNA sequence
  source 1..20: mol_type = other DNA
agaacctagctcaggcttgg

SEQ ID NO: 64141 - DNA, 20 bp, synthetic construct
  misc_feature 1..20: note = CRISPR gRNA sequence
  source 1..20: mol_type = other DNA
gctcaggcttggcacctggt

SEQ ID NO: 64142 - DNA, 20 bp, synthetic construct
  misc_feature 1..20: note = CRISPR gRNA sequence
  source 1..20: mol_type = other DNA
aggcttggcacctggtactt

SEQ ID NO: 64143 - DNA, 20 bp, synthetic construct
  misc_feature 1..20: note = CRISPR gRNA sequence
  source 1..20: mol_type = other DNA
ggcacctggtacttggtata

SEQ ID NO: 64144 - DNA, 20 bp, synthetic construct
  misc_feature 1..20: note = CRISPR gRNA sequence
  source 1..20: mol_type = other DNA
gcacctggtacttggtatat

SEQ ID NO: 64145 - DNA, 20 bp, synthetic construct
  misc_feature 1..20: note = CRISPR gRNA sequence
  source 1..20: mol_type = other DNA
gtacttggtatatattgaat

SEQ ID NO: 64146 - DNA, 20 bp, synthetic construct
  misc_feature 1..20: note = CRISPR gRNA sequence
  source 1..20: mol_type = other DNA
ggtatatattgaattaatgg

SEQ ID NO: 64147 - DNA, 20 bp, synthetic construct
  misc_feature 1..20: note = CRISPR gRNA sequence
  source 1..20: mol_type = other DNA
gtatatattgaattaatgga

SEQ ID NO: 64148 - DNA, 20 bp, synthetic construct
  misc_feature 1..20: note = CRISPR gRNA sequence
  source 1..20: mol_type = other DNA
aattaatggatggatgaaaa

SEQ ID NO: 64149 - DNA, 20 bp, synthetic construct
  misc_feature 1..20: note = CRISPR gRNA sequence
  source 1..20: mol_type = other DNA
atggatggatgaaaagatgg

SEQ ID NO: 64150 - DNA, 20 bp, synthetic construct
  misc_feature 1..20: note = CRISPR gRNA sequence
  source 1..20: mol_type = other DNA
aaaagatggatgggtggatg

SEQ ID NO: 64151 - DNA, 20 bp, synthetic construct
  misc_feature 1..20: note = CRISPR gRNA sequence
  source 1..20: mol_type = other DNA
aaaagatggatgggtggatg

SEQ ID NO: 64152 - DNA, 20 bp, synthetic construct
  misc_feature 1..20: note = CRISPR gRNA sequence
  source 1..20: mol_type = other DNA
aaaagatggatgggtggatg

SEQ ID NO: 64153 - DNA, 20 bp, synthetic construct
  misc_feature 1..20: note = CRISPR gRNA sequence
  source 1..20: mol_type = other DNA
atgggtggatgaaaagatga

SEQ ID NO: 64154 - DNA, 20 bp, synthetic construct
  misc_feature 1..20: note = CRISPR gRNA sequence
  source 1..20: mol_type = other DNA
gctgaaaagatggataggtg

SEQ ID NO: 64155 - DNA, 20 bp, synthetic construct
  misc_feature 1..20: note = CRISPR gRNA sequence
  source 1..20: mol_type = other DNA
aaaagatggataggtgtgtg

SEQ ID NO: 64156 - DNA, 20 bp, synthetic construct
  misc_feature 1..20: note = CRISPR gRNA sequence
  source 1..20: mol_type = other DNA
cgaagcacaggcatagccaa

SEQ ID NO: 64157 - DNA, 20 bp, synthetic construct
  misc_feature 1..20: note = CRISPR gRNA sequence
  source 1..20: mol_type = other DNA
gctgtgtgttgccctccatg

SEQ ID NO: 64158 - DNA, 20 bp, synthetic construct
  misc_feature 1..20: note = CRISPR gRNA sequence
  source 1..20: mol_type = other DNA
tgtgttgccctccatggtgc

SEQ ID NO: 64159 - DNA, 20 bp, synthetic construct
  misc_feature 1..20: note = CRISPR gRNA sequence
  source 1..20: mol_type = other DNA
ccctccatggtgctgaacca

SEQ ID NO: 64160 - DNA, 20 bp, synthetic construct
  misc_feature 1..20: note = CRISPR gRNA sequence
  source 1..20: mol_type = other DNA
catggtgctgaaccaatata

SEQ ID NO: 64161 - DNA, 20 bp, synthetic construct
  misc_feature 1..20: note = CRISPR gRNA sequence
  source 1..20: mol_type = other DNA
aaccaatatagccagttttg

SEQ ID NO: 64162 - DNA, 20 bp, synthetic construct
  misc_feature 1..20: note = CRISPR gRNA sequence
  source 1..20: mol_type = other DNA
tgatcatggggtaggttagg

SEQ ID NO: 64163 - DNA, 20 bp, synthetic construct
  misc_feature 1..20: note = CRISPR gRNA sequence
  source 1..20: mol_type = other DNA
gatcatggggtaggttaggt

SEQ ID NO: 64164 - DNA, 20 bp, synthetic construct
  misc_feature 1..20: note = CRISPR gRNA sequence
  source 1..20: mol_type = other DNA
atcatggggtaggttaggtg

SEQ ID NO: 64165 - DNA, 20 bp, synthetic construct
  misc_feature 1..20: note = CRISPR gRNA sequence
  source 1..20: mol_type = other DNA
ggtgtcatttttcttactca

SEQ ID NO: 64166 - DNA, 20 bp, synthetic construct
  misc_feature 1..20: note = CRISPR gRNA sequence
  source 1..20: mol_type = other DNA
ttcttactcataaaaatttc

SEQ ID NO: 64167 - DNA, 20 bp, synthetic construct
  misc_feature 1..20: note = CRISPR gRNA sequence
  source 1..20: mol_type = other DNA
tcttactcataaaaatttct

SEQ ID NO: 64168 - DNA, 20 bp, synthetic construct
  misc_feature 1..20: note = CRISPR gRNA sequence
  source 1..20: mol_type = other DNA
cttactcataaaaatttcta

SEQ ID NO: 64169 - DNA, 20 bp, synthetic construct
  misc_feature 1..20: note = CRISPR gRNA sequence
  source 1..20: mol_type = other DNA
ttactcataaaaatttctat

SEQ ID NO: 64170 - DNA, 20 bp, synthetic construct
  misc_feature 1..20: note = CRISPR gRNA sequence
  source 1..20: mol_type = other DNA
actcataaaaatttctatta

SEQ ID NO: 64171 - DNA, 20 bp, synthetic construct
  misc_feature 1..20: note = CRISPR gRNA sequence
  source 1..20: mol_type = other DNA
ctcataaaaatttctattaa

SEQ ID NO: 64172 - DNA, 20 bp, synthetic construct
  misc_feature 1..20: note = CRISPR gRNA sequence
  source 1..20: mol_type = other DNA
ataaaaatttctattaaaaa

SEQ ID NO: 64173 - DNA, 20 bp, synthetic construct
  misc_feature 1..20: note = CRISPR gRNA sequence
  source 1..20: mol_type = other DNA
ctattaaaaaaaattcagcc

SEQ ID NO: 64174 - DNA, 20 bp, synthetic construct
  misc_feature 1..20: note = CRISPR gRNA sequence
  source 1..20: mol_type = other DNA
tattaaaaaaaattcagccg

SEQ ID NO: 64175 - DNA, 20 bp, synthetic construct
  misc_feature 1..20: note = CRISPR gRNA sequence
  source 1..20: mol_type = other DNA
ttaaaaaaaattcagccggg

SEQ ID NO: 64176 - DNA, 20 bp, synthetic construct
  misc_feature 1..20: note = CRISPR gRNA sequence
  source 1..20: mol_type = other DNA
aaaaaaattcagccgggctc

SEQ ID NO: 64177 - DNA, 20 bp, synthetic construct
  misc_feature 1..20: note = CRISPR gRNA sequence
  source 1..20: mol_type = other DNA
agccgggctcagtggctcat

SEQ ID NO: 64178 - DNA, 20 bp, synthetic construct
  misc_feature 1..20: note = CRISPR gRNA sequence
  source 1..20: mol_type = other DNA
agtggctcatgcctgtaatt

SEQ ID NO: 64179 - DNA, 20 bp, synthetic construct
  misc_feature 1..20: note = CRISPR gRNA sequence
  source 1..20: mol_type = other DNA
atgcctgtaattccaacact

SEQ ID NO: 64180 - DNA, 20 bp, synthetic construct
  misc_feature 1..20: note = CRISPR gRNA sequence
  source 1..20: mol_type = other DNA
taattccaacactttggaag

SEQ ID NO: 64181 - DNA, 20 bp, synthetic construct
  misc_feature 1..20: note = CRISPR gRNA sequence
  source 1..20: mol_type = other DNA
caacactttggaaggccaag

SEQ ID NO: 64182 - DNA, 20 bp, synthetic construct
  misc_feature 1..20: note = CRISPR gRNA sequence
  source 1..20: mol_type = other DNA
tggaaggccaaggcaagagg

SEQ ID NO: 64183 - DNA, 20 bp, synthetic construct
  misc_feature 1..20: note = CRISPR gRNA sequence
  source 1..20: mol_type = other DNA
ggaaggccaaggcaagagga

SEQ ID NO: 64184 - DNA, 20 bp, synthetic construct
  misc_feature 1..20: note = CRISPR gRNA sequence
  source 1..20: mol_type = other DNA
gaaggccaaggcaagaggat

SEQ ID NO: 64185 - DNA, 20 bp, synthetic construct
  misc_feature 1..20: note = CRISPR gRNA sequence
  source 1..20: mol_type = other DNA
cttgagctcaggagttcgag

SEQ ID NO: 64186 - DNA, 20 bp, synthetic construct
  misc_feature 1..20: note = CRISPR gRNA sequence
  source 1..20: mol_type = other DNA
gagctcaggagttcgagacc

SEQ ID NO: 64187 - DNA, 20 bp, synthetic construct
  misc_feature 1..20: note = CRISPR gRNA sequence
  source 1..20: mol_type = other DNA
agctcaggagttcgagacca

SEQ ID NO: 64188 - DNA, 20 bp, synthetic construct
  misc_feature 1..20: note = CRISPR gRNA sequence
  source 1..20: mol_type = other DNA
aggagttcgagaccaacctg

SEQ ID NO: 64189 - DNA, 20 bp, synthetic construct
  misc_feature 1..20: note = CRISPR gRNA sequence
  source 1..20: mol_type = other DNA
gagaccaacctgggcaacat

SEQ ID NO: 64190 - DNA, 20 bp, synthetic construct
  misc_feature 1..20: note = CRISPR gRNA sequence
  source 1..20: mol_type = other DNA
ggcaacatagtctctacaaa

SEQ ID NO: 64191 - DNA, 20 bp, synthetic construct
  misc_feature 1..20: note = CRISPR gRNA sequence
  source 1..20: mol_type = other DNA
tacaaaaaatgaacaaaatt

SEQ ID NO: 64192 - DNA, 20 bp, synthetic construct
  misc_feature 1..20: note = CRISPR gRNA sequence
  source 1..20: mol_type = other DNA
caaaaaatgaacaaaattaa

SEQ ID NO: 64193 - DNA, 20 bp, synthetic construct
  misc_feature 1..20: note = CRISPR gRNA sequence
  source 1..20: mol_type = other DNA
atggggcatggtggtgcatg

SEQ ID NO: 64194 - DNA, 20 bp, synthetic construct
  misc_feature 1..20: note = CRISPR gRNA sequence
  source 1..20: mol_type = other DNA
tggttccagctatttgggag

SEQ ID NO: 64195 - DNA, 20 bp, synthetic construct
  misc_feature 1..20: note = CRISPR gRNA sequence
  source 1..20: mol_type = other DNA
cagctatttgggaggctgag

SEQ ID NO: 64196 - DNA, 20 bp, synthetic construct
  misc_feature 1..20: note = CRISPR gRNA sequence
  source 1..20: mol_type = other DNA
tttgggaggctgaggtggga

SEQ ID NO: 64197 - DNA, 20 bp, synthetic construct
  misc_feature 1..20: note = CRISPR gRNA sequence
  source 1..20: mol_type = other DNA
gggaggctgaggtgggaaga

SEQ ID NO: 64198 - DNA, 20 bp, synthetic construct
  misc_feature 1..20: note = CRISPR gRNA sequence
  source 1..20: mol_type = other DNA
ggaggctgaggtgggaagat

SEQ ID NO: 64199 - DNA, 20 bp, synthetic construct
  misc_feature 1..20: note = CRISPR gRNA sequence
  source 1..20: mol_type = other DNA
aggtgggaagattgcttgag

SEQ ID NO: 64200 - DNA, 20 bp, synthetic construct
  misc_feature 1..20: note = CRISPR gRNA sequence
  source 1..20: mol_type = other DNA
cttgagccgtggaggttgag

SEQ ID NO: 64201 - DNA, 20 bp, synthetic construct
  misc_feature 1..20: note = CRISPR gRNA sequence
  source 1..20: mol_type = other DNA
gagccgtggaggttgaggct

SEQ ID NO: 64202 - DNA, 20 bp, synthetic construct
  misc_feature 1..20: note = CRISPR gRNA sequence
  source 1..20: mol_type = other DNA
agccgtggaggttgaggctg

SEQ ID NO: 64203 - DNA, 20 bp, synthetic construct
  misc_feature 1..20: note = CRISPR gRNA sequence
  source 1..20: mol_type = other DNA
aggctgcagtgaggtgtgaa

SEQ ID NO: 64204 - DNA, 20 bp, synthetic construct
  misc_feature 1..20: note = CRISPR gRNA sequence
  source 1..20: mol_type = other DNA
cagtgaggtgtgaacacacc

SEQ ID NO: 64205 - DNA, 20 bp, synthetic construct
  misc_feature 1..20: note = CRISPR gRNA sequence
  source 1..20: mol_type = other DNA
cactccagcctgagtagcag

SEQ ID NO: 64206 - DNA, 20 bp, synthetic construct
  misc_feature 1..20: note = CRISPR gRNA sequence
  source 1..20: mol_type = other DNA
cagcctgagtagcagagtga

SEQ ID NO: 64207 - DNA, 20 bp, synthetic construct
  misc_feature 1..20: note = CRISPR gRNA sequence
  source 1..20: mol_type = other DNA
agtagcagagtgagatctcc

SEQ ID NO: 64208 - DNA, 20 bp, synthetic construct
  misc_feature 1..20: note = CRISPR gRNA sequence
  source 1..20: mol_type = other DNA
catctcaaatttaaaaagaa

SEQ ID NO: 64209 - DNA, 20 bp, synthetic construct
  misc_feature 1..20: note = CRISPR gRNA sequence
  source 1..20: mol_type = other DNA
aaatttaaaaagaaaggaaa

SEQ ID NO: 64210 - DNA, 20 bp, synthetic construct
  misc_feature 1..20: note = CRISPR gRNA sequence
  source 1..20: mol_type = other DNA
aaaaagaaaggaaaaaaaaa

SEQ ID NO: 64211 - DNA, 20 bp, synthetic construct
  misc_feature 1..20: note = CRISPR gRNA sequence
  source 1..20: mol_type = other DNA
aaaagaaaggaaaaaaaaaa

SEQ ID NO: 64212 - DNA, 20 bp, synthetic construct
  misc_feature 1..20: note = CRISPR gRNA sequence
  source 1..20: mol_type = other DNA
acaacattcttaatttttat

SEQ ID NO: 64213 - DNA, 20 bp, synthetic construct
  misc_feature 1..20: note = CRISPR gRNA sequence
  source 1..20: mol_type = other DNA
ttaatttttattatatttct

SEQ ID NO: 64214 - DNA, 20 bp, synthetic construct
  misc_feature 1..20: note = CRISPR gRNA sequence
  source 1..20: mol_type = other DNA
aatttttattatatttcttg

SEQ ID NO: 64215 - DNA, 20 bp, synthetic construct
  misc_feature 1..20: note = CRISPR gRNA sequence
  source 1..20: mol_type = other DNA
atttttattatatttcttgt

SEQ ID NO: 64216 - DNA, 20 bp, synthetic construct
  misc_feature 1..20: note = CRISPR gRNA sequence
  source 1..20: mol_type = other DNA
ttattatatttcttgtgaaa

SEQ ID NO: 64217 - DNA, 20 bp, synthetic construct
  misc_feature 1..20: note = CRISPR gRNA sequence
  source 1..20: mol_type = other DNA
tattatatttcttgtgaaaa

SEQ ID NO: 64218 - DNA, 20 bp, synthetic construct
  misc_feature 1..20: note = CRISPR gRNA sequence
  source 1..20: mol_type = other DNA
attatatttcttgtgaaaat

SEQ ID NO: 64219 - DNA, 20 bp, synthetic construct
  misc_feature 1..20: note = CRISPR gRNA sequence
  source 1..20: mol_type = other DNA
ttatatttcttgtgaaaatt

SEQ ID NO: 64220 - DNA, 20 bp, synthetic construct
  misc_feature 1..20: note = CRISPR gRNA sequence
  source 1..20: mol_type = other DNA
tatttcttgtgaaaattgtt

SEQ ID NO: 64221 - DNA, 20 bp, synthetic construct
  misc_feature 1..20: note = CRISPR gRNA sequence
  source 1..20: mol_type = other DNA
cttgtgaaaattgtttttct

SEQ ID NO: 64222 - DNA, 20 bp, synthetic construct
  misc_feature 1..20: note = CRISPR gRNA sequence
  source 1..20: mol_type = other DNA
ttgtgaaaattgtttttctg

SEQ ID NO: 64223 - DNA, 20 bp, synthetic construct
  misc_feature 1..20: note = CRISPR gRNA sequence
  source 1..20: mol_type = other DNA
gtgaaaattgtttttctgac

SEQ ID NO: 64224 - DNA, 20 bp, synthetic construct
  misc_feature 1..20: note = CRISPR gRNA sequence
  source 1..20: mol_type = other DNA
tgaaaattgtttttctgact

SEQ ID NO: 64225 - DNA, 20 bp, synthetic construct
  misc_feature 1..20: note = CRISPR gRNA sequence
  source 1..20: mol_type = other DNA
tttttctgactttttaaaac

SEQ ID NO: 64226 - DNA, 20 bp, synthetic construct
  misc_feature 1..20: note = CRISPR gRNA sequence
  source 1..20: mol_type = other DNA
ttctgactttttaaaacact

SEQ ID NO: 64227 - DNA, 20 bp, synthetic construct
  misc_feature 1..20: note = CRISPR gRNA sequence
  source 1..20: mol_type = other DNA
tctgactttttaaaacactc

SEQ ID NO: 64228 - DNA, 20 bp, synthetic construct
  misc_feature 1..20: note = CRISPR gRNA sequence
  source 1..20: mol_type = other DNA
ctgactttttaaaacactct

SEQ ID NO: 64229 - DNA, 20 bp, synthetic construct
  misc_feature 1..20: note = CRISPR gRNA sequence
  source 1..20: mol_type = other DNA
tgactttttaaaacactctt

SEQ ID NO: 64230 - DNA, 20 bp, synthetic construct
  misc_feature 1..20: note = CRISPR gRNA sequence
  source 1..20: mol_type = other DNA
actttttaaaacactcttgc

SEQ ID NO: 64231 - DNA, 20 bp, synthetic construct
  misc_feature 1..20: note = CRISPR gRNA sequence
  source 1..20: mol_type = other DNA
tttaaaacactcttgcagga

SEQ ID NO: 64232 - DNA, 20 bp, synthetic construct
  misc_feature 1..20: note = CRISPR gRNA sequence
  source 1..20: mol_type = other DNA
ttaaaacactcttgcaggat

SEQ ID NO: 64233 - DNA, 20 bp, synthetic construct
  misc_feature 1..20: note = CRISPR gRNA sequence
  source 1..20: mol_type = other DNA
taaaacactcttgcaggatt

SEQ ID NO: 64234 - DNA, 20 bp, synthetic construct
  misc_feature 1..20: note = CRISPR gRNA sequence
  source 1..20: mol_type = other DNA
aaaacactcttgcaggattc

SEQ ID NO: 64235 - DNA, 20 bp, synthetic construct
  misc_feature 1..20: note = CRISPR gRNA sequence
  source 1..20: mol_type = other DNA
aaacactcttgcaggattca

SEQ ID NO: 64236 - DNA, 20 bp, synthetic construct
  misc_feature 1..20: note = CRISPR gRNA sequence
  source 1..20: mol_type = other DNA
ttgcaggattcatcaagcaa

SEQ ID NO: 64237 - DNA, 20 bp, synthetic construct
  misc_feature 1..20: note = CRISPR gRNA sequence
  source 1..20: mol_type = other DNA
gcaggattcatcaagcaaag

SEQ ID NO: 64238 - DNA, 20 bp, synthetic construct
  misc_feature 1..20: note = CRISPR gRNA sequence
  source 1..20: mol_type = other DNA
caggattcatcaagcaaaga

SEQ ID NO: 64239 - DNA, 20 bp, synthetic construct
  misc_feature 1..20: note = CRISPR gRNA sequence
  source 1..20: mol_type = other DNA
atcaagcaaagacataatca

SEQ ID NO: 64240 - DNA, 20 bp, synthetic construct
  misc_feature 1..20: note = CRISPR gRNA sequence
  source 1..20: mol_type = other DNA
cacatgcctgatttaaaaca

SEQ ID NO: 64241 - DNA, 20 bp, synthetic construct
  misc_feature 1..20: note = CRISPR gRNA sequence
  source 1..20: mol_type = other DNA
acatgcctgatttaaaacac

SEQ ID NO: 64242 - DNA, 20 bp, synthetic construct
  misc_feature 1..20: note = CRISPR gRNA sequence
  source 1..20: mol_type = other DNA
atttaaaacacttttgctag

SEQ ID NO: 64243 - DNA, 20 bp, synthetic construct
  misc_feature 1..20: note = CRISPR gRNA sequence
  source 1..20: mol_type = other DNA
aaaacacttttgctagttcc

SEQ ID NO: 64244 - DNA, 20 bp, synthetic construct
  misc_feature 1..20: note = CRISPR gRNA sequence
  source 1..20: mol_type = other DNA
aaacacttttgctagttccg

SEQ ID NO: 64245 - DNA, 20 bp, synthetic construct
  misc_feature 1..20: note = CRISPR gRNA sequence
  source 1..20: mol_type = other DNA
ttgctagttccgttatgttt

SEQ ID NO: 64246 - DNA, 20 bp, synthetic construct
  misc_feature 1..20: note = CRISPR gRNA sequence
  source 1..20: mol_type = other DNA
tgctagttccgttatgtttc

SEQ ID NO: 64247 - DNA, 20 bp, synthetic construct
  misc_feature 1..20: note = CRISPR gRNA sequence
  source 1..20: mol_type = other DNA
gctagttccgttatgtttcc

SEQ ID NO: 64248 - DNA, 20 bp, synthetic construct
  misc_feature 1..20: note = CRISPR gRNA sequence
  source 1..20: mol_type = other DNA
ctagttccgttatgtttccc

SEQ ID NO: 64249 - DNA, 20 bp, synthetic construct
  misc_feature 1..20: note = CRISPR gRNA sequence
  source 1..20: mol_type = other DNA
gttccgttatgtttccctgt

SEQ ID NO: 64250 - DNA, 20 bp, synthetic construct
  misc_feature 1..20: note = CRISPR gRNA sequence
  source 1..20: mol_type = other DNA
cgttatgtttccctgtcaat

SEQ ID NO: 64251 - DNA, 20 bp, synthetic construct
  misc_feature 1..20: note = CRISPR gRNA sequence
  source 1..20: mol_type = other DNA
tgtttccctgtcaattgcaa

SEQ ID NO: 64252 - DNA, 20 bp, synthetic construct
  misc_feature 1..20: note = CRISPR gRNA sequence
  source 1..20: mol_type = other DNA
ccctgtcaattgcaaaatca

SEQ ID NO: 64253 - DNA, 20 bp, synthetic construct
  misc_feature 1..20: note = CRISPR gRNA sequence
  source 1..20: mol_type = other DNA
cctgtcaattgcaaaatcag

SEQ ID NO: 64254 - DNA, 20 bp, synthetic construct
  misc_feature 1..20: note = CRISPR gRNA sequence
  source 1..20: mol_type = other DNA
tcaattgcaaaatcagcttt

SEQ ID NO: 64255 - DNA, 20 bp, synthetic construct
  misc_feature 1..20: note = CRISPR gRNA sequence
  source 1..20: mol_type = other DNA
caaaatcagctttatctgga

SEQ ID NO: 64256 - DNA, 20 bp, synthetic construct
  misc_feature 1..20: note = CRISPR gRNA sequence
  source 1..20: mol_type = other DNA
tatctggatgtttgaacatt

SEQ ID NO: 64257 - DNA, 20 bp, synthetic construct
  misc_feature 1..20: note = CRISPR gRNA sequence
  source 1..20: mol_type = other DNA
atctggatgtttgaacattt

SEQ ID NO: 64258 - DNA, 20 bp, synthetic construct
  misc_feature 1..20: note = CRISPR gRNA sequence
  source 1..20: mol_type = other DNA
tctggatgtttgaacatttg

SEQ ID NO: 64259 - DNA, 20 bp, synthetic construct
  misc_feature 1..20: note = CRISPR gRNA sequence
  source 1..20: mol_type = other DNA
gatgtttgaacatttggggc

SEQ ID NO: 64260 - DNA, 20 bp, synthetic construct
  misc_feature 1..20: note = CRISPR gRNA sequence
  source 1..20: mol_type = other DNA
gaacatttggggcagaaaag

SEQ ID NO: 64261 - DNA, 20 bp, synthetic construct
  misc_feature 1..20: note = CRISPR gRNA sequence
  source 1..20: mol_type = other DNA
aacatttggggcagaaaagg

SEQ ID NO: 64262 - DNA, 20 bp, synthetic construct
  misc_feature 1..20: note = CRISPR gRNA sequence
  source 1..20: mol_type = other DNA
ggggcagaaaagggtgtgcc

SEQ ID NO: 64263 - DNA, 20 bp, synthetic construct
  misc_feature 1..20: note = CRISPR gRNA sequence
  source 1..20: mol_type = other DNA
gggcagaaaagggtgtgcct

SEQ ID NO: 64264 - DNA, 20 bp, synthetic construct
  misc_feature 1..20: note = CRISPR gRNA sequence
  source 1..20: mol_type = other DNA
tggtgggtgatgtgctggtt

SEQ ID NO: 64265 - DNA, 20 bp, synthetic construct
  misc_feature 1..20: note = CRISPR gRNA sequence
  source 1..20: mol_type = other DNA
gtttccagtctctgggtttc

SEQ ID NO: 64266 - DNA, 20 bp, synthetic construct
  misc_feature 1..20: note = CRISPR gRNA sequence
  source 1..20: mol_type = other DNA
ccagtctctgggtttcatgg

SEQ ID NO: 64267 - DNA, 20 bp, synthetic construct
  misc_feature 1..20: note = CRISPR gRNA sequence
  source 1..20: mol_type = other DNA
cagtctctgggtttcatggc

SEQ ID NO: 64268 - DNA, 20 bp, synthetic construct
  misc_feature 1..20: note = CRISPR gRNA sequence
  source 1..20: mol_type = other DNA
tgggtttcatggcttggtat

SEQ ID NO: 64269 - DNA, 20 bp, synthetic construct
  misc_feature 1..20: note = CRISPR gRNA sequence
  source 1..20: mol_type = other DNA
ggtttcatggcttggtatct

SEQ ID NO: 64270 - DNA, 20 bp, synthetic construct
  misc_feature 1..20: note = CRISPR gRNA sequence
  source 1..20: mol_type = other DNA
catggcttggtatctgatcc

SEQ ID NO: 64271 - DNA, 20 bp, synthetic construct
  misc_feature 1..20: note = CRISPR gRNA sequence
  source 1..20: mol_type = other DNA
atggcttggtatctgatcct

SEQ ID NO: 64272 - DNA, 20 bp, synthetic construct
  misc_feature 1..20: note = CRISPR gRNA sequence
  source 1..20: mol_type = other DNA
ggtatctgatcctgcaggga

SEQ ID NO: 64273 - DNA, 20 bp, synthetic construct
  misc_feature 1..20: note = CRISPR gRNA sequence
  source 1..20: mol_type = other DNA
gtatctgatcctgcagggag

SEQ ID NO: 64274 - DNA, 20 bp, synthetic construct
  misc_feature 1..20: note = CRISPR gRNA sequence
  source 1..20: mol_type = other DNA
atcctgcagggaggcggacc

SEQ ID NO: 64275 - DNA, 20 bp, synthetic construct
  misc_feature 1..20: note = CRISPR gRNA sequence
  source 1..20: mol_type = other DNA
cagggaggcggacctcatct

SEQ ID NO: 64276 - DNA, 20 bp, synthetic construct
  misc_feature 1..20: note = CRISPR gRNA sequence
  source 1..20: mol_type = other DNA
atcttccttctttccccgcc

SEQ ID NO: 64277 - DNA, 20 bp, synthetic construct
  misc_feature 1..20: note = CRISPR gRNA sequence
  source 1..20: mol_type = other DNA
ccttctttccccgcccacag

SEQ ID NO: 64278 - DNA, 20 bp, synthetic construct
  misc_feature 1..20: note = CRISPR gRNA sequence
  source 1..20: mol_type = other DNA
cttctttccccgcccacaga

SEQ ID NO: 64279 - DNA, 20 bp, synthetic construct
  misc_feature 1..20: note = CRISPR gRNA sequence
  source 1..20: mol_type = other DNA
ctttccccgcccacagagac

SEQ ID NO: 64280 - DNA, 20 bp, synthetic construct
  misc_feature 1..20: note = CRISPR gRNA sequence
  source 1..20: mol_type = other DNA
tttccccgcccacagagaca

SEQ ID NO: 64281 - DNA, 20 bp, synthetic construct
  misc_feature 1..20: note = CRISPR gRNA sequence
  source 1..20: mol_type = other DNA
tccccgcccacagagacaac

SEQ ID NO: 64282 - DNA, 20 bp, synthetic construct
  misc_feature 1..20: note = CRISPR gRNA sequence
  source 1..20: mol_type = other DNA
ccccgcccacagagacaact

SEQ ID NO: 64283 - DNA, 20 bp, synthetic construct
  misc_feature 1..20: note = CRISPR gRNA sequence
  source 1..20: mol_type = other DNA
cccgcccacagagacaactg

SEQ ID NO: 64284 - DNA, 20 bp, synthetic construct
  misc_feature 1..20: note = CRISPR gRNA sequence
  source 1..20: mol_type = other DNA
cagagctacaaaggtaagaa

SEQ ID NO: 64285 - DNA, 20 bp, synthetic construct
  misc_feature 1..20: note = CRISPR gRNA sequence
  source 1..20: mol_type = other DNA
caaaggtaagaagccaagag

SEQ ID NO: 64286 - DNA, 20 bp, synthetic construct
  misc_feature 1..20: note = CRISPR gRNA sequence
  source 1..20: mol_type = other DNA
gggccatccttagaagcaac

SEQ ID NO: 64287 - DNA, 20 bp, synthetic construct
  misc_feature 1..20: note = CRISPR gRNA sequence
  source 1..20: mol_type = other DNA
agaagcaacttgggctcagg

SEQ ID NO: 64288 - DNA, 20 bp, synthetic construct
  misc_feature 1..20: note = CRISPR gRNA sequence
  source 1..20: mol_type = other DNA
gaagcaacttgggctcaggc

SEQ ID NO: 64289 - DNA, 20 bp, synthetic construct
  misc_feature 1..20: note = CRISPR gRNA sequence
  source 1..20: mol_type = other DNA
gggctcaggcagttgagggg

SEQ ID NO: 64290 - DNA, 20 bp, synthetic construct
  misc_feature 1..20: note = CRISPR gRNA sequence
  source 1..20: mol_type = other DNA
ggctcaggcagttgagggga

SEQ ID NO: 64291 - DNA, 20 bp, synthetic construct
  misc_feature 1..20: note = CRISPR gRNA sequence
  source 1..20: mol_type = other DNA
aggcagttgaggggaaaggt

SEQ ID NO: 64292 - DNA, 20 bp, synthetic construct
  misc_feature 1..20: note = CRISPR gRNA sequence
  source 1..20: mol_type = other DNA
aggggaaaggtgaccaagag

SEQ ID NO: 64293 - DNA, 20 bp, synthetic construct
  misc_feature 1..20: note = CRISPR gRNA sequence
  source 1..20: mol_type = other DNA
ggaagagctggggtatggga

SEQ ID NO: 64294 - DNA, 20 bp, synthetic construct
  misc_feature 1..20: note = CRISPR gRNA sequence
  source 1..20: mol_type = other DNA
gggtatgggaattcttcctg

SEQ ID NO: 64295 - DNA, 20 bp, synthetic construct
  misc_feature 1..20: note = CRISPR gRNA sequence
  source 1..20: mol_type = other DNA
ttcctgctactgctgcactg

SEQ ID NO: 64296 - DNA, 20 bp, synthetic construct
  misc_feature 1..20: note = CRISPR gRNA sequence
  source 1..20: mol_type = other DNA
cctgctactgctgcactgag

SEQ ID NO: 64297 - DNA, 20 bp, synthetic construct
  misc_feature 1..20: note = CRISPR gRNA sequence
  source 1..20: mol_type = other DNA
ctgctactgctgcactgagg

SEQ ID NO: 64298 - DNA, 20 bp, synthetic construct
  misc_feature 1..20: note = CRISPR gRNA sequence
  source 1..20: mol_type = other DNA
ctactgctgcactgaggaat

SEQ ID NO: 64299 - DNA, 20 bp, synthetic construct
  misc_feature 1..20: note = CRISPR gRNA sequence
  source 1..20: mol_type = other DNA
ctgctgcactgaggaatgaa

SEQ ID NO: 64300 - DNA, 20 bp, synthetic construct
  misc_feature 1..20: note = CRISPR gRNA sequence
  source 1..20: mol_type = other DNA
ctgcactgaggaatgaatta

SEQ ID NO: 64301 - DNA, 20 bp, synthetic construct
  misc_feature 1..20: note = CRISPR gRNA sequence
  source 1..20: mol_type = other DNA
cactgaggaatgaattactg

SEQ ID NO: 64302 - DNA, 20 bp, synthetic construct
  misc_feature 1..20: note = CRISPR gRNA sequence
  source 1..20: mol_type = other DNA
aggaatgaattactgcttag

SEQ ID NO: 64303 - DNA, 20 bp, synthetic construct
  misc_feature 1..20: note = CRISPR gRNA sequence
  source 1..20: mol_type = other DNA
ctgcttaggttggcaaagga

SEQ ID NO: 64304 - DNA, 20 bp, synthetic construct
  misc_feature 1..20: note = CRISPR gRNA sequence
  source 1..20: mol_type = other DNA
cttaggttggcaaaggattt

SEQ ID NO: 64305 - DNA, 20 bp, synthetic construct
  misc_feature 1..20: note = CRISPR gRNA sequence
  source 1..20: mol_type = other DNA
aggttggcaaaggattttaa

SEQ ID NO: 64306 - DNA, 20 bp, synthetic construct
  misc_feature 1..20: note = CRISPR gRNA sequence
  source 1..20: mol_type = other DNA
ggttggcaaaggattttaac

SEQ ID NO: 64307 - DNA, 20 bp, synthetic construct
  misc_feature 1..20: note = CRISPR gRNA sequence
  source 1..20: mol_type = other DNA
gcaaaggattttaacttcct

SEQ ID NO: 64308 - DNA, 20 bp, synthetic construct
  misc_feature 1..20: note = CRISPR gRNA sequence
  source 1..20: mol_type = other DNA
taacttcctctagcgtgtcc

SEQ ID NO: 64309 - DNA, 20 bp, synthetic construct
  misc_feature 1..20: note = CRISPR gRNA sequence
  source 1..20: mol_type = other DNA
aacttcctctagcgtgtcca

SEQ ID NO: 64310 - DNA, 20 bp, synthetic construct
  misc_feature 1..20: note = CRISPR gRNA sequence
  source 1..20: mol_type = other DNA
acttcctctagcgtgtccag

SEQ ID NO: 64311 - DNA, 20 bp, synthetic construct
  misc_feature 1..20: note = CRISPR gRNA sequence
  source 1..20: mol_type = other DNA
cctctagcgtgtccagacca

SEQ ID NO: 64312 - DNA, 20 bp, synthetic construct
  misc_feature 1..20: note = CRISPR gRNA sequence
  source 1..20: mol_type = other DNA
ctctagcgtgtccagaccac

SEQ ID NO: 64313 - DNA, 20 bp, synthetic construct
  misc_feature 1..20: note = CRISPR gRNA sequence
  source 1..20: mol_type = other DNA
tagcgtgtccagaccacatc

SEQ ID NO: 64314 - DNA, 20 bp, synthetic construct
  misc_feature 1..20: note = CRISPR gRNA sequence
  source 1..20: mol_type = other DNA
gcgtgtccagaccacatctg

SEQ ID NO: 64315 - DNA, 20 bp, synthetic construct
  misc_feature 1..20: note = CRISPR gRNA sequence
  source 1..20: mol_type = other DNA
gtccctgtggaaggaagcat

SEQ ID NO: 64316 - DNA, 20 bp, synthetic construct
  misc_feature 1..20: note = CRISPR gRNA sequence
  source 1..20: mol_type = other DNA
tggaaggaagcatccccaga

SEQ ID NO: 64317 - DNA, 20 bp, synthetic construct
  misc_feature 1..20: note = CRISPR gRNA sequence
  source 1..20: mol_type = other DNA
agaggaaggcaaacccttgg

SEQ ID NO: 64318 - DNA, 20 bp, synthetic construct
  misc_feature 1..20: note = CRISPR gRNA sequence
  source 1..20: mol_type = other DNA
ggggagaacataaagatact

SEQ ID NO: 64319 - DNA, 20 bp, synthetic construct
  misc_feature 1..20: note = CRISPR gRNA sequence
  source 1..20: mol_type = other DNA
gggagaacataaagatactg

SEQ ID NO: 64320 - DNA, 20 bp, synthetic construct
  misc_feature 1..20: note = CRISPR gRNA sequence
  source 1..20: mol_type = other DNA
ttagactggcattactagat

SEQ ID NO: 64321 - DNA, 20 bp, synthetic construct
  misc_feature 1..20: note = CRISPR gRNA sequence
  source 1..20: mol_type = other DNA
gactggcattactagatggt

SEQ ID NO: 64322 - DNA, 20 bp, synthetic construct
  misc_feature 1..20: note = CRISPR gRNA sequence
  source 1..20: mol_type = other DNA
gcattactagatggtgaaaa

SEQ ID NO: 64323 - DNA, 20 bp, synthetic construct
  misc_feature 1..20: note = CRISPR gRNA sequence
  source 1..20: mol_type = other DNA
ctagatggtgaaaactctgg

SEQ ID NO: 64324 - DNA, 20 bp, synthetic construct
  misc_feature 1..20: note = CRISPR gRNA sequence
  source 1..20: mol_type = other DNA
gatggtgaaaactctggaaa

SEQ ID NO: 64325 - DNA, 20 bp, synthetic construct
  misc_feature 1..20: note = CRISPR gRNA sequence
  source 1..20: mol_type = other DNA
tggaaaagcccttacaactg

SEQ ID NO: 64326 - DNA, 20 bp, synthetic construct
  misc_feature 1..20: note = CRISPR gRNA sequence
  source 1..20: mol_type = other DNA
gaaaagcccttacaactgaa

SEQ ID NO: 64327 - DNA, 20 bp, synthetic construct
  misc_feature 1..20: note = CRISPR gRNA sequence
  source 1..20: mol_type = other DNA
acaactgaaaaaagacaggg

SEQ ID NO: 64328 - DNA, 20 bp, synthetic construct
  misc_feature 1..20: note = CRISPR gRNA sequence
  source 1..20: mol_type = other DNA
caactgaaaaaagacaggga

SEQ ID NO: 64329 - DNA, 20 bp, synthetic construct
  misc_feature 1..20: note = CRISPR gRNA sequence
  source 1..20: mol_type = other DNA
aaaaaagacagggagggcaa

SEQ ID NO: 64330 - DNA, 20 bp, synthetic construct
  misc_feature 1..20: note = CRISPR gRNA sequence
  source 1..20: mol_type = other DNA
tggtacctacatcttagggt

SEQ ID NO: 64331 - DNA, 20 bp, synthetic construct
  misc_feature 1..20: note = CRISPR gRNA sequence
  source 1..20: mol_type = other DNA
catcttagggttgttctgag

SEQ ID NO: 64332 - DNA, 20 bp, synthetic construct
  misc_feature 1..20: note = CRISPR gRNA sequence
  source 1..20: mol_type = other DNA
agggttgttctgagaattaa

SEQ ID NO: 64333 - DNA, 20 bp, synthetic construct
  misc_feature 1..20: note = CRISPR gRNA sequence
  source 1..20: mol_type = other DNA
gggttgttctgagaattaaa

SEQ ID NO: 64334 - DNA, 20 bp, synthetic construct
  misc_feature 1..20: note = CRISPR gRNA sequence
  source 1..20: mol_type = other DNA
ttctgagaattaaatgagtt

SEQ ID NO: 64335 - DNA, 20 bp, synthetic construct
  misc_feature 1..20: note = CRISPR gRNA sequence
  source 1..20: mol_type = other DNA
tgagaattaaatgagttact

SEQ ID NO: 64336 - DNA, 20 bp, synthetic construct
  misc_feature 1..20: note = CRISPR gRNA sequence
  source 1..20: mol_type = other DNA
agaattaaatgagttactac

SEQ ID NO: 64337 - DNA, 20 bp, synthetic construct
  misc_feature 1..20: note = CRISPR gRNA sequence
  source 1..20: mol_type = other DNA
aatgagttactacacttaag

SEQ ID NO: 64338 - DNA, 20 bp, synthetic construct
  misc_feature 1..20: note = CRISPR gRNA sequence
  source 1..20: mol_type = other DNA
ctacacttaaggagtttaga

SEQ ID NO: 64339 - DNA, 20 bp, synthetic construct
  misc_feature 1..20: note = CRISPR gRNA sequence
  source 1..20: mol_type = other DNA
cacttaaggagtttagagca

SEQ ID NO: 64340 - DNA, 20 bp, synthetic construct
  misc_feature 1..20: note = CRISPR gRNA sequence
  source 1..20: mol_type = other DNA
aaggagtttagagcactgtt

SEQ ID NO: 64341 - DNA, 20 bp, synthetic construct
  misc_feature 1..20: note = CRISPR gRNA sequence
  source 1..20: mol_type = other DNA
aggagtttagagcactgttg

SEQ ID NO: 64342 - DNA, 20 bp, synthetic construct
  misc_feature 1..20: note = CRISPR gRNA sequence
  source 1..20: mol_type = other DNA
agagcactgttggcatgcag

SEQ ID NO: 64343 - DNA, 20 bp, synthetic construct
  misc_feature 1..20: note = CRISPR gRNA sequence
  source 1..20: mol_type = other DNA
gagcactgttggcatgcagt

SEQ ID NO: 64344 - DNA, 20 bp, synthetic construct
  misc_feature 1..20: note = CRISPR gRNA sequence
  source 1..20: mol_type = other DNA
ttggcatgcagtgggcagtc

SEQ ID NO: 64345 - DNA, 20 bp, synthetic construct
  misc_feature 1..20: note = CRISPR gRNA sequence
  source 1..20: mol_type = other DNA
gcatgcagtgggcagtcaaa

SEQ ID NO: 64346 - DNA, 20 bp, synthetic construct
  misc_feature 1..20: note = CRISPR gRNA sequence
  source 1..20: mol_type = other DNA
gctattccagctgtgcatgg

SEQ ID NO: 64347 - DNA, 20 bp, synthetic construct
  misc_feature 1..20: note = CRISPR gRNA sequence
  source 1..20: mol_type = other DNA
ttccagctgtgcatggattc

SEQ ID NO: 64348 - DNA, 20 bp, synthetic construct
  misc_feature 1..20: note = CRISPR gRNA sequence
  source 1..20: mol_type = other DNA
cagctgtgcatggattccag

SEQ ID NO: 64349 - DNA, 20 bp, synthetic construct
  misc_feature 1..20: note = CRISPR gRNA sequence
  source 1..20: mol_type = other DNA
tgcatggattccagcttggc

SEQ ID NO: 64350 - DNA, 20 bp, synthetic construct
  misc_feature 1..20: note = CRISPR gRNA sequence
  source 1..20: mol_type = other DNA
cagcttggccagtcttggat

SEQ ID NO: 64351 - DNA, 20 bp, synthetic construct
  misc_feature 1..20: note = CRISPR gRNA sequence
  source 1..20: mol_type = other DNA
ggccagtcttggatgggctg

SEQ ID NO: 64352 - DNA, 20 bp, synthetic construct
  misc_feature 1..20: note = CRISPR gRNA sequence
  source 1..20: mol_type = other DNA
gccagtcttggatgggctga

SEQ ID NO: 64353 - DNA, 20 bp, synthetic construct
  misc_feature 1..20: note = CRISPR gRNA sequence
  source 1..20: mol_type = other DNA
ggatgggctgagaaaaggga

SEQ ID NO: 64354 - DNA, 20 bp, synthetic construct
  misc_feature 1..20: note = CRISPR gRNA sequence
  source 1..20: mol_type = other DNA
gatgggctgagaaaagggag

SEQ ID NO: 64355 - DNA, 20 bp, synthetic construct
  misc_feature 1..20: note = CRISPR gRNA sequence
  source 1..20: mol_type = other DNA
agaaaagggagctgcttttc

SEQ ID NO: 64356 - DNA, 20 bp, synthetic construct
  misc_feature 1..20: note = CRISPR gRNA sequence
  source 1..20: mol_type = other DNA
cttttccctaaaagaccatc

SEQ ID NO: 64357 - DNA, 20 bp, synthetic construct
  misc_feature 1..20: note = CRISPR gRNA sequence
  source 1..20: mol_type = other DNA
ttccctaaaagaccatccca

SEQ ID NO: 64358 - DNA, 20 bp, synthetic construct
  misc_feature 1..20: note = CRISPR gRNA sequence
  source 1..20: mol_type = other DNA
tccctaaaagaccatcccaa

SEQ ID NO: 64359 - DNA, 20 bp, synthetic construct
  misc_feature 1..20: note = CRISPR gRNA sequence
  source 1..20: mol_type = other DNA
ccctaaaagaccatcccaac

SEQ ID NO: 64360 - DNA, 20 bp, synthetic construct
  misc_feature 1..20: note = CRISPR gRNA sequence
  source 1..20: mol_type = other DNA
cctaaaagaccatcccaact

SEQ ID NO: 64361 - DNA, 20 bp, synthetic construct
  misc_feature 1..20: note = CRISPR gRNA sequence
  source 1..20: mol_type = other DNA
aaagaccatcccaactgtgc

SEQ ID NO: 64362 - DNA, 20 bp, synthetic construct
  misc_feature 1..20: note = CRISPR gRNA sequence
  source 1..20: mol_type = other DNA
tgctctaccacactttgctc

SEQ ID NO: 64363 - DNA, 20 bp, synthetic construct
  misc_feature 1..20: note = CRISPR gRNA sequence
  source 1..20: mol_type = other DNA
taccacactttgctctcctg

SEQ ID NO: 64364 - DNA, 20 bp, synthetic construct
  misc_feature 1..20: note = CRISPR gRNA sequence
  source 1..20: mol_type = other DNA
ccacactttgctctcctggc

SEQ ID NO: 64365 - DNA, 20 bp, synthetic construct
  misc_feature 1..20: note = CRISPR gRNA sequence
  source 1..20: mol_type = other DNA
tgctctcctggctaagactc

SEQ ID NO: 64366 - DNA, 20 bp, synthetic construct
  misc_feature 1..20: note = CRISPR gRNA sequence
  source 1..20: mol_type = other DNA
gctctcctggctaagactca

SEQ ID NO: 64367 - DNA, 20 bp, synthetic construct
  misc_feature 1..20: note = CRISPR gRNA sequence
  source 1..20: mol_type = other DNA
ctctcctggctaagactcag

SEQ ID NO: 64368 - DNA, 20 bp, synthetic construct
  misc_feature 1..20: note = CRISPR gRNA sequence
  source 1..20: mol_type = other DNA
tcctggctaagactcagaga

SEQ ID NO: 64369 - DNA, 20 bp, synthetic construct
  misc_feature 1..20: note = CRISPR gRNA sequence
  source 1..20: mol_type = other DNA
ctggctaagactcagagaca

SEQ ID NO: 64370 - DNA, 20 bp, synthetic construct
  misc_feature 1..20: note = CRISPR gRNA sequence
  source 1..20: mol_type = other DNA
gctaagactcagagacagat

SEQ ID NO: 64371 - DNA, 20 bp, synthetic construct
  misc_feature 1..20: note = CRISPR gRNA sequence
  source 1..20: mol_type = other DNA
agactcagagacagatgtat

SEQ ID NO: 64372 - DNA, 20 bp, synthetic construct
  misc_feature 1..20: note = CRISPR gRNA sequence
  source 1..20: mol_type = other DNA
agagacagatgtatgtatgc

SEQ ID NO: 64373 - DNA, 20 bp, synthetic construct
  misc_feature 1..20: note = CRISPR gRNA sequence
  source 1..20: mol_type = other DNA
agcaatctctttcccttctc

SEQ ID NO: 64374 - DNA, 20 bp, synthetic construct
  misc_feature 1..20: note = CRISPR gRNA sequence
  source 1..20: mol_type = other DNA
tttcccttctctggatctcg

SEQ ID NO: 64375 - DNA, 20 bp, synthetic construct
  misc_feature 1..20: note = CRISPR gRNA sequence
  source 1..20: mol_type = other DNA
tcccttctctggatctcgat

SEQ ID NO: 64376 - DNA, 20 bp, synthetic construct
  misc_feature 1..20: note = CRISPR gRNA sequence
  source 1..20: mol_type = other DNA
cccttctctggatctcgatt

SEQ ID NO: 64377 - DNA, 20 bp, synthetic construct
  misc_feature 1..20: note = CRISPR gRNA sequence
  source 1..20: mol_type = other DNA
ccttctctggatctcgattc

SEQ ID NO: 64378 - DNA, 20 bp, synthetic construct
  misc_feature 1..20: note = CRISPR gRNA sequence
  source 1..20: mol_type = other DNA
ctctggatctcgattccttg

SEQ ID NO: 64379 - DNA, 20 bp, synthetic construct
  misc_feature 1..20: note = CRISPR gRNA sequence
  source 1..20: mol_type = other DNA
tctggatctcgattccttgc

SEQ ID NO: 64380 - DNA, 20 bp, synthetic construct
  misc_feature 1..20: note = CRISPR gRNA sequence
  source 1..20: mol_type = other DNA
tggatctcgattccttgctt

SEQ ID NO: 64381 - DNA, 20 bp, synthetic construct
  misc_feature 1..20: note = CRISPR gRNA sequence
  source 1..20: mol_type = other DNA
gatctcgattccttgcttgt

SEQ ID NO: 64382 - DNA, 20 bp, synthetic construct
  misc_feature 1..20: note = CRISPR gRNA sequence
  source 1..20: mol_type = other DNA
gattccttgcttgtataatg

SEQ ID NO: 64383 - DNA, 20 bp, synthetic construct
  misc_feature 1..20: note = CRISPR gRNA sequence
  source 1..20: mol_type = other DNA
cttgcttgtataatgacctg

SEQ ID NO: 64384 - DNA, 20 bp, synthetic construct
  misc_feature 1..20: note = CRISPR gRNA sequence
  source 1..20: mol_type = other DNA
gcttgtataatgacctggta

SEQ ID NO: 64385 - DNA, 20 bp, synthetic construct
  misc_feature 1..20: note = CRISPR gRNA sequence
  source 1..20: mol_type = other DNA
cttgtataatgacctggtag

SEQ ID NO: 64386 - DNA, 20 bp, synthetic construct
  misc_feature 1..20: note = CRISPR gRNA sequence
  source 1..20: mol_type = other DNA
gtataatgacctggtagtgt

SEQ ID NO: 64387 - DNA, 20 bp, synthetic construct
  misc_feature 1..20: note = CRISPR gRNA sequence
  source 1..20: mol_type = other DNA
tataatgacctggtagtgta

SEQ ID NO: 64388 - DNA, 20 bp, synthetic construct
  misc_feature 1..20: note = CRISPR gRNA sequence
  source 1..20: mol_type = other DNA
gtagtgtaggaccaatgttg

SEQ ID NO: 64389 - DNA, 20 bp, synthetic construct
  misc_feature 1..20: note = CRISPR gRNA sequence
  source 1..20: mol_type = other DNA
ctgggtgcggtggctcatgc

SEQ ID NO: 64390 - DNA, 20 bp, synthetic construct
  misc_feature 1..20: note = CRISPR gRNA sequence
  source 1..20: mol_type = other DNA
ggtgcggtggctcatgcctg

SEQ ID NO: 64391 - DNA, 20 bp, synthetic construct
  misc_feature 1..20: note = CRISPR gRNA sequence
  source 1..20: mol_type = other DNA
atgcctgtaatcctagcact

SEQ ID NO: 64392 - DNA, 20 bp, synthetic construct
  misc_feature 1..20: note = CRISPR gRNA sequence
  source 1..20: mol_type = other DNA
taatcctagcactttggaac

SEQ ID NO: 64393 - DNA, 20 bp, synthetic construct
  misc_feature 1..20: note = CRISPR gRNA sequence
  source 1..20: mol_type = other DNA
gcactttggaacgccaagca

SEQ ID NO: 64394 - DNA, 20 bp, synthetic construct
  misc_feature 1..20: note = CRISPR gRNA sequence
  source 1..20: mol_type = other DNA
tggaacgccaagcacgagaa

SEQ ID NO: 64395 - DNA, 20 bp, synthetic construct
  misc_feature 1..20: note = CRISPR gRNA sequence
  source 1..20: mol_type = other DNA
ggaacgccaagcacgagaat

SEQ ID NO: 64396 - DNA, 20 bp, synthetic construct
  misc_feature 1..20: note = CRISPR gRNA sequence
  source 1..20: mol_type = other DNA
gaacgccaagcacgagaatc

SEQ ID NO: 64397 - DNA, 20 bp, synthetic construct
  misc_feature 1..20: note = CRISPR gRNA sequence
  source 1..20: mol_type = other DNA
ttgattccaggtgttcaaga

SEQ ID NO: 64398 - DNA, 20 bp, synthetic construct
  misc_feature 1..20: note = CRISPR gRNA sequence
  source 1..20: mol_type = other DNA
gattccaggtgttcaagacc

SEQ ID NO: 64399 - DNA, 20 bp, synthetic construct
  misc_feature 1..20: note = CRISPR gRNA sequence
  source 1..20: mol_type = other DNA
attccaggtgttcaagacca

SEQ ID NO: 64400 - DNA, 20 bp, synthetic construct
  misc_feature 1..20: note = CRISPR gRNA sequence
  source 1..20: mol_type = other DNA
caggtgttcaagaccagcct

SEQ ID NO: 64401 - DNA, 20 bp, synthetic construct
  misc_feature 1..20: note = CRISPR gRNA sequence
  source 1..20: mol_type = other DNA
aagaccagcctgggcaacat

SEQ ID NO: 64402 - DNA, 20 bp, synthetic construct
  misc_feature 1..20: note = CRISPR gRNA sequence
  source 1..20: mol_type = other DNA
ggcaacatagcaagacccca

SEQ ID NO: 64403 - DNA, 20 bp, synthetic construct
  misc_feature 1..20: note = CRISPR gRNA sequence
  source 1..20: mol_type = other DNA
taaaaaaaaaaggcaggcgt

SEQ ID NO: 64404 - DNA, 20 bp, synthetic construct
  misc_feature 1..20: note = CRISPR gRNA sequence
  source 1..20: mol_type = other DNA
aaaaaaaaaggcaggcgtgg

SEQ ID NO: 64405 - DNA, 20 bp, synthetic construct
  misc_feature 1..20: note = CRISPR gRNA sequence
  source 1..20: mol_type = other DNA
tagtcccagctactcaagat

SEQ ID NO: 64406 - DNA, 20 bp, synthetic construct
  misc_feature 1..20: note = CRISPR gRNA sequence
  source 1..20: mol_type = other DNA
ctcaagatgctgacgttggg

SEQ ID NO: 64407 - DNA, 20 bp, synthetic construct
  misc_feature 1..20: note = CRISPR gRNA sequence
  source 1..20: mol_type = other DNA
aagatgctgacgttgggagg

SEQ ID NO: 64408 - DNA, 20 bp, synthetic construct
  misc_feature 1..20: note = CRISPR gRNA sequence
  source 1..20: mol_type = other DNA
acgttgggaggatcgcttga

SEQ ID NO: 64409 - DNA, 20 bp, synthetic construct
  misc_feature 1..20: note = CRISPR gRNA sequence
  source 1..20: mol_type = other DNA
ggaggatcgcttgagcctgg

SEQ ID NO: 64410 - DNA, 20 bp, synthetic construct
  misc_feature 1..20: note = CRISPR gRNA sequence
  source 1..20: mol_type = other DNA
gagcctgggagcttgagcca

SEQ ID NO: 64411 - DNA, 20 bp, synthetic construct
  misc_feature 1..20: note = CRISPR gRNA sequence
  source 1..20: mol_type = other DNA
agcctgggagcttgagccat

SEQ ID NO: 64412 - DNA, 20 bp, synthetic construct
  misc_feature 1..20: note = CRISPR gRNA sequence
  source 1..20: mol_type = other DNA
ggagcttgagccatgatcac

SEQ ID NO: 64413 - DNA, 20 bp, synthetic construct
  misc_feature 1..20: note = CRISPR gRNA sequence
  source 1..20: mol_type = other DNA
gagccatgatcacaccactg

SEQ ID NO: 64414 - DNA, 20 bp, synthetic construct
  misc_feature 1..20: note = CRISPR gRNA sequence
  source 1..20: mol_type = other DNA
agccatgatcacaccactgt

SEQ ID NO: 64415 - DNA, 20 bp, synthetic construct
  misc_feature 1..20: note = CRISPR gRNA sequence
  source 1..20: mol_type = other DNA
tactccagcctgggtgacag

SEQ ID NO: 64416 - DNA, 20 bp, synthetic construct
  misc_feature 1..20: note = CRISPR gRNA sequence
  source 1..20: mol_type = other DNA
cagcctgggtgacagagagg

SEQ ID NO: 64417 - DNA, 20 bp, synthetic construct
  misc_feature 1..20: note = CRISPR gRNA sequence
  source 1..20: mol_type = other DNA
ggtgacagagagggactctg

SEQ ID NO: 64418 - DNA, 20 bp, synthetic construct
  misc_feature 1..20: note = CRISPR gRNA sequence
  source 1..20: mol_type = other DNA
tgtctcaaaaaatgacccac

SEQ ID NO: 64419 - DNA, 20 bp, synthetic construct
  misc_feature 1..20: note = CRISPR gRNA sequence
  source 1..20: mol_type = other DNA
tctcaaaaaatgacccacta

SEQ ID NO: 64420 - DNA, 20 bp, synthetic construct
  misc_feature 1..20: note = CRISPR gRNA sequence
  source 1..20: mol_type = other DNA
aaaaaatgacccactaggac

SEQ ID NO: 64421 - DNA, 20 bp, synthetic construct
  misc_feature 1..20: note = CRISPR gRNA sequence
  source 1..20: mol_type = other DNA
ggaccagtgtcactttcttt

SEQ ID NO: 64422 - DNA, 20 bp, synthetic construct
  misc_feature 1..20: note = CRISPR gRNA sequence
  source 1..20: mol_type = other DNA
tcttttccctctaactgctt

SEQ ID NO: 64423 - DNA, 20 bp, synthetic construct
  misc_feature 1..20: note = CRISPR gRNA sequence
  source 1..20: mol_type = other DNA
cttttccctctaactgctta

SEQ ID NO: 64424 - DNA, 20 bp, synthetic construct
  misc_feature 1..20: note = CRISPR gRNA sequence
  source 1..20: mol_type = other DNA
ttttccctctaactgcttaa

SEQ ID NO: 64425 - DNA, 20 bp, synthetic construct
  misc_feature 1..20: note = CRISPR gRNA sequence
  source 1..20: mol_type = other DNA
ttccctctaactgcttaaag

SEQ ID NO: 64426 - DNA, 20 bp, synthetic construct
  misc_feature 1..20: note = CRISPR gRNA sequence
  source 1..20: mol_type = other DNA
tccctctaactgcttaaagc

SEQ ID NO: 64427 - DNA, 20 bp, synthetic construct
  misc_feature 1..20: note = CRISPR gRNA sequence
  source 1..20: mol_type = other DNA
ccctctaactgcttaaagct

SEQ ID NO: 64428 - DNA, 20 bp, synthetic construct
  misc_feature 1..20: note = CRISPR gRNA sequence
  source 1..20: mol_type = other DNA
cctctaactgcttaaagctg

SEQ ID NO: 64429 - DNA, 20 bp, synthetic construct
  misc_feature 1..20: note = CRISPR gRNA sequence
  source 1..20: mol_type = other DNA
taactgcttaaagctgtgat

SEQ ID NO: 64430 - DNA, 20 bp, synthetic construct
  misc_feature 1..20: note = CRISPR gRNA sequence
  source 1..20: mol_type = other DNA
actgcttaaagctgtgatgc

SEQ ID NO: 64431 - DNA, 20 bp, synthetic construct
  misc_feature 1..20: note = CRISPR gRNA sequence
  source 1..20: mol_type = other DNA
cttaaagctgtgatgctcag

SEQ ID NO: 64432 - DNA, 20 bp, synthetic construct
  misc_feature 1..20: note = CRISPR gRNA sequence
  source 1..20: mol_type = other DNA
aaagctgtgatgctcagtag

SEQ ID NO: 64433 - DNA, 20 bp, synthetic construct
  misc_feature 1..20: note = CRISPR gRNA sequence
  source 1..20: mol_type = other DNA
aagctgtgatgctcagtagg

SEQ ID NO: 64434 - DNA, 20 bp, synthetic construct
  misc_feature 1..20: note = CRISPR gRNA sequence
  source 1..20: mol_type = other DNA
tgatgctcagtaggatagcc

SEQ ID NO: 64435 - DNA, 20 bp, synthetic construct
  misc_feature 1..20: note = CRISPR gRNA sequence
  source 1..20: mol_type = other DNA
agtaggatagccactagccc

SEQ ID NO: 64436 - DNA, 20 bp, synthetic construct
  misc_feature 1..20: note = CRISPR gRNA sequence
  source 1..20: mol_type = other DNA
gccccatatggctatttcaa

SEQ ID NO: 64437 - DNA, 20 bp, synthetic construct
  misc_feature 1..20: note = CRISPR gRNA sequence
  source 1..20: mol_type = other DNA
tttcaatttaaataaattaa

SEQ ID NO: 64438 - DNA, 20 bp, synthetic construct
  misc_feature 1..20: note = CRISPR gRNA sequence
  source 1..20: mol_type = other DNA
caatttaaataaattaaaat

SEQ ID NO: 64439 - DNA, 20 bp, synthetic construct
  misc_feature 1..20: note = CRISPR gRNA sequence
  source 1..20: mol_type = other DNA
aatttaaataaattaaaatt

SEQ ID NO: 64440 - DNA, 20 bp, synthetic construct
  misc_feature 1..20: note = CRISPR gRNA sequence
  source 1..20: mol_type = other DNA
aaataaattaaaattttaat

SEQ ID NO: 64441 - DNA, 20 bp, synthetic construct
  misc_feature 1..20: note = CRISPR gRNA sequence
  source 1..20: mol_type = other DNA
aataaattaaaattttaatg

SEQ ID NO: 64442 - DNA, 20 bp, synthetic construct
  misc_feature 1..20: note = CRISPR gRNA sequence
  source 1..20: mol_type = other DNA
aaattttaatgctatttcaa

SEQ ID NO: 64443 - DNA, 20 bp, synthetic construct
  misc_feature 1..20: note = CRISPR gRNA sequence
  source 1..20: mol_type = other DNA
taatgctatttcaatttaaa

SEQ ID NO: 64444 - DNA, 20 bp, synthetic construct
  misc_feature 1..20: note = CRISPR gRNA sequence
  source 1..20: mol_type = other DNA
aatgctatttcaatttaaat

SEQ ID NO: 64445 - DNA, 20 bp, synthetic construct
  misc_feature 1..20: note = CRISPR gRNA sequence
  source 1..20: mol_type = other DNA
atgctatttcaatttaaata

SEQ ID NO: 64446 - DNA, 20 bp, synthetic construct
  misc_feature 1..20: note = CRISPR gRNA sequence
  source 1..20: mol_type = other DNA
tttcaatttaaataaattaa

SEQ ID NO: 64447 - DNA, 20 bp, synthetic construct
  misc_feature 1..20: note = CRISPR gRNA sequence
  source 1..20: mol_type = other DNA
caatttaaataaattaaaat

SEQ ID NO: 64448 - DNA, 20 bp, synthetic construct
  misc_feature 1..20: note = CRISPR gRNA sequence
  source 1..20: mol_type = other DNA
aatttaaataaattaaaatt

SEQ ID NO: 64449 - DNA, 20 bp, synthetic construct
  misc_feature 1..20: note = CRISPR gRNA sequence
  source 1..20: mol_type = other DNA
aaataaattaaaattttaat

SEQ ID NO: 64450 - DNA, 20 bp, synthetic construct
  misc_feature 1..20: note = CRISPR gRNA sequence
  source 1..20: mol_type = other DNA
aataaattaaaattttaatg

SEQ ID NO: 64451 - DNA, 20 bp, synthetic construct
  misc_feature 1..20: note = CRISPR gRNA sequence
  source 1..20: mol_type = other DNA
aaattttaatgctattttaa

SEQ ID NO: 64452 - DNA, 20 bp, synthetic construct
  misc_feature 1..20: note = CRISPR gRNA sequence
  source 1..20: mol_type = other DNA
taatgctattttaatttaaa

SEQ ID NO: 64453 - DNA, 20 bp, synthetic construct
  misc_feature 1..20: note = CRISPR gRNA sequence
  source 1..20: mol_type = other DNA
aatgctattttaatttaaat

SEQ ID NO: 64454 - DNA, 20 bp, synthetic construct
  misc_feature 1..20: note = CRISPR gRNA sequence
  source 1..20: mol_type = other DNA
atgctattttaatttaaata

SEQ ID NO: 64455 - DNA, 20 bp, synthetic construct
  misc_feature 1..20: note = CRISPR gRNA sequence
  source 1..20: mol_type = other DNA
ttttaatttaaataaattaa

SEQ ID NO: 64456 - DNA, 20 bp, synthetic construct
  misc_feature 1..20: note = CRISPR gRNA sequence
  source 1..20: mol_type = other DNA
taatttaaataaattaaaat

SEQ ID NO: 64457 - DNA, 20 bp, synthetic construct
  misc_feature 1..20: note = CRISPR gRNA sequence
  source 1..20: mol_type = other DNA
aatttaaataaattaaaatt

SEQ ID NO: 64458 - DNA, 20 bp, synthetic construct
  misc_feature 1..20: note = CRISPR gRNA sequence
  source 1..20: mol_type = other DNA
atttaaataaattaaaatta

SEQ ID NO: 64459 - DNA, 20 bp, synthetic construct
  misc_feature 1..20: note = CRISPR gRNA sequence
  source 1..20: mol_type = other DNA
aaataaattaaaattaagta

SEQ ID NO: 64460 - DNA, 20 bp, synthetic construct
  misc_feature 1..20: note = CRISPR gRNA sequence
  source 1..20: mol_type = other DNA
aataaattaaaattaagtaa

SEQ ID NO: 64461 - DNA, 20 bp, synthetic construct
  misc_feature 1..20: note = CRISPR gRNA sequence
  source 1..20: mol_type = other DNA
aaattaagtaaaatgaaatt

SEQ ID NO: 64462 - DNA, 20 bp, synthetic construct
  misc_feature 1..20: note = CRISPR gRNA sequence
  source 1..20: mol_type = other DNA
agtaaaatgaaattttcagt

SEQ ID NO: 64463 - DNA, 20 bp, synthetic construct
  misc_feature 1..20: note = CRISPR gRNA sequence
  source 1..20: mol_type = other DNA
tcagttcattagtcacatta

SEQ ID NO: 64464 - DNA, 20 bp, synthetic construct
  misc_feature 1..20: note = CRISPR gRNA sequence
  source 1..20: mol_type = other DNA
cagttcattagtcacattag

SEQ ID NO: 64465 - DNA, 20 bp, synthetic construct
  misc_feature 1..20: note = CRISPR gRNA sequence
  source 1..20: mol_type = other DNA
agttcattagtcacattagc

SEQ ID NO: 64466 - DNA, 20 bp, synthetic construct
  misc_feature 1..20: note = CRISPR gRNA sequence
  source 1..20: mol_type = other DNA
attagtcacattagctatat

SEQ ID NO: 64467 - DNA, 20 bp, synthetic construct
  misc_feature 1..20: note = CRISPR gRNA sequence
  source 1..20: mol_type = other DNA
gtcacattagctatatttca

SEQ ID NO: 64468 - DNA, 20 bp, synthetic construct
  misc_feature 1..20: note = CRISPR gRNA sequence
  source 1..20: mol_type = other DNA
gctatatttcaactgctcag

SEQ ID NO: 64469 - DNA, 20 bp, synthetic construct
  misc_feature 1..20: note = CRISPR gRNA sequence
  source 1..20: mol_type = other DNA
tatttcaactgctcagtggc

SEQ ID NO: 64470 - DNA, 20 bp, synthetic construct
  misc_feature 1..20: note = CRISPR gRNA sequence
  source 1..20: mol_type = other DNA
caactgctcagtggccatag

SEQ ID NO: 64471 - DNA, 20 bp, synthetic construct
  misc_feature 1..20: note = CRISPR gRNA sequence
  source 1..20: mol_type = other DNA
aactgctcagtggccatagg

SEQ ID NO: 64472 - DNA, 20 bp, synthetic construct
  misc_feature 1..20: note = CRISPR gRNA sequence
  source 1..20: mol_type = other DNA
ctcagtggccataggtggct

SEQ ID NO: 64473 - DNA, 20 bp, synthetic construct
  misc_feature 1..20: note = CRISPR gRNA sequence
  source 1..20: mol_type = other DNA
agtggccataggtggctagt

SEQ ID NO: 64474 - DNA, 20 bp, synthetic construct
  misc_feature 1..20: note = CRISPR gRNA sequence
  source 1..20: mol_type = other DNA
gtggctcccatagcaagtgg

SEQ ID NO: 64475 - DNA, 20 bp, synthetic construct
  misc_feature 1..20: note = CRISPR gRNA sequence
  source 1..20: mol_type = other DNA
ccatagcaagtggtacagat

SEQ ID NO: 64476 - DNA, 20 bp, synthetic construct
  misc_feature 1..20: note = CRISPR gRNA sequence
  source 1..20: mol_type = other DNA
ccatcattgcagaaagttct

SEQ ID NO: 64477 - DNA, 20 bp, synthetic construct
  misc_feature 1..20: note = CRISPR gRNA sequence
  source 1..20: mol_type = other DNA
catcattgcagaaagttcta

SEQ ID NO: 64478 - DNA, 20 bp, synthetic construct
  misc_feature 1..20: note = CRISPR gRNA sequence
  source 1..20: mol_type = other DNA
cagaaagttctattaaacag

SEQ ID NO: 64479 - DNA, 20 bp, synthetic construct
  misc_feature 1..20: note = CRISPR gRNA sequence
  source 1..20: mol_type = other DNA
tattaaacaggctggcatgg

SEQ ID NO: 64480 - DNA, 20 bp, synthetic construct
  misc_feature 1..20: note = CRISPR gRNA sequence
  source 1..20: mol_type = other DNA
ttaaacaggctggcatggtg

SEQ ID NO: 64481 - DNA, 20 bp, synthetic construct
  misc_feature 1..20: note = CRISPR gRNA sequence
  source 1..20: mol_type = other DNA
aacaggctggcatggtggct

SEQ ID NO: 64482 - DNA, 20 bp, synthetic construct
  misc_feature 1..20: note = CRISPR gRNA sequence
  source 1..20: mol_type = other DNA
gcatggtggctcatgtctgt

SEQ ID NO: 64483 - DNA, 20 bp, synthetic construct
  misc_feature 1..20: note = CRISPR gRNA sequence
  source 1..20: mol_type = other DNA
atgtctgtaaccccagcact

SEQ ID NO: 64484 - DNA, 20 bp, synthetic construct
  misc_feature 1..20: note = CRISPR gRNA sequence
  source 1..20: mol_type = other DNA
taaccccagcactttgagag

SEQ ID NO: 64485 - DNA, 20 bp, synthetic construct
  misc_feature 1..20: note = CRISPR gRNA sequence
  source 1..20: mol_type = other DNA
tgagaggctgagggggcagg

SEQ ID NO: 64486 - DNA, 20 bp, synthetic construct
  misc_feature 1..20: note = CRISPR gRNA sequence
  source 1..20: mol_type = other DNA
gagaggctgagggggcagga

SEQ ID NO: 64487 - DNA, 20 bp, synthetic construct
  misc_feature 1..20: note = CRISPR gRNA sequence
  source 1..20: mol_type = other DNA
agaggctgagggggcaggat

SEQ ID NO: 64488 - DNA, 20 bp, synthetic construct
  misc_feature 1..20: note = CRISPR gRNA sequence
  source 1..20: mol_type = other DNA
agggggcaggatcgcttgaa

SEQ ID NO: 64489 - DNA, 20 bp, synthetic construct
  misc_feature 1..20: note = CRISPR gRNA sequence
  source 1..20: mol_type = other DNA
gaagctaggagttcaagacc

SEQ ID NO: 64490 - DNA, 20 bp, synthetic construct
  misc_feature 1..20: note = CRISPR gRNA sequence
  source 1..20: mol_type = other DNA
aagctaggagttcaagacca

SEQ ID NO: 64491 - DNA, 20 bp, synthetic construct
  misc_feature 1..20: note = CRISPR gRNA sequence
  source 1..20: mol_type = other DNA
ggagttcaagaccagcctgg

SEQ ID NO: 64492 - DNA, 20 bp, synthetic construct
  misc_feature 1..20: note = CRISPR gRNA sequence
  source 1..20: mol_type = other DNA
aagaccagcctgggcaacaa

SEQ ID NO: 64493 - DNA, 20 bp, synthetic construct
  misc_feature 1..20: note = CRISPR gRNA sequence
  source 1..20: mol_type = other DNA
ggcaacaaagtgagaccccc

SEQ ID NO: 64494 - DNA, 20 bp, synthetic construct
  misc_feature 1..20: note = CRISPR gRNA sequence
  source 1..20: mol_type = other DNA
tacaaaaaaaaaaaaaaaat

SEQ ID NO: 64495 - DNA, 20 bp, synthetic construct
  misc_feature 1..20: note = CRISPR gRNA sequence
  source 1..20: mol_type = other DNA
caaaaaaaaaaaaaaaatag

SEQ ID NO: 64496 - DNA, 20 bp, synthetic construct
  misc_feature 1..20: note = CRISPR gRNA sequence
  source 1..20: mol_type = other DNA
ggcatggtgattcactccta

SEQ ID NO: 64497 - DNA, 20 bp, synthetic construct
  misc_feature 1..20: note = CRISPR gRNA sequence
  source 1..20: mol_type = other DNA
actcctatagtaccagttac

SEQ ID NO: 64498 - DNA, 20 bp, synthetic construct
  misc_feature 1..20: note = CRISPR gRNA sequence
  source 1..20: mol_type = other DNA
ctatagtaccagttactcag

SEQ ID NO: 64499 - DNA, 20 bp, synthetic construct
  misc_feature 1..20: note = CRISPR gRNA sequence
  source 1..20: mol_type = other DNA
tagtaccagttactcaggaa

SEQ ID NO: 64500 - DNA, 20 bp, synthetic construct
  misc_feature 1..20: note = CRISPR gRNA sequence
  source 1..20: mol_type = other DNA
ctcaggaagccaaggtggga

SEQ ID NO: 64501 - DNA, 20 bp, synthetic construct
  misc_feature 1..20: note = CRISPR gRNA sequence
  source 1..20: mol_type = other DNA
aggaagccaaggtgggagga

SEQ ID NO: 64502 - DNA, 20 bp, synthetic construct
  misc_feature 1..20: note = CRISPR gRNA sequence
  source 1..20: mol_type = other DNA
gagcccaggagtttgaggct

SEQ ID NO: 64503 - DNA, 20 bp, synthetic construct
  misc_feature 1..20: note = CRISPR gRNA sequence
  source 1..20: mol_type = other DNA
agcccaggagtttgaggctg

SEQ ID NO: 64504 - DNA, 20 bp, synthetic construct
  misc_feature 1..20: note = CRISPR gRNA sequence
  source 1..20: mol_type = other DNA
gaggctgcagtgaactggga

SEQ ID NO: 64505 - DNA, 20 bp, synthetic construct
  misc_feature 1..20: note = CRISPR gRNA sequence
  source 1..20: mol_type = other DNA
aggctgcagtgaactgggat

SEQ ID NO: 64506 - DNA, 20 bp, synthetic construct
  misc_feature 1..20: note = CRISPR gRNA sequence
  source 1..20: mol_type = other DNA
cagtgaactgggatagagcc

SEQ ID NO: 64507 - DNA, 20 bp, synthetic construct
  misc_feature 1..20: note = CRISPR gRNA sequence
  source 1..20: mol_type = other DNA
ggatagagccactgcactcc

SEQ ID NO: 64508 - DNA, 20 bp, synthetic construct
  misc_feature 1..20: note = CRISPR gRNA sequence
  source 1..20: mol_type = other DNA
cactccagcttggggactga

SEQ ID NO: 64509 - DNA, 20 bp, synthetic construct
  misc_feature 1..20: note = CRISPR gRNA sequence
  source 1..20: mol_type = other DNA
cagcttggggactgagtggg

SEQ ID NO: 64510 - DNA, 20 bp, synthetic construct
  misc_feature 1..20: note = CRISPR gRNA sequence
  source 1..20: mol_type = other DNA
ggggactgagtgggaccctg

SEQ ID NO: 64511 - DNA, 20 bp, synthetic construct
  misc_feature 1..20: note = CRISPR gRNA sequence
  source 1..20: mol_type = other DNA
gggactgagtgggaccctgt

SEQ ID NO: 64512 - DNA, 20 bp, synthetic construct
  misc_feature 1..20: note = CRISPR gRNA sequence
  source 1..20: mol_type = other DNA
agtgggaccctgtctctaaa

SEQ ID NO: 64513 - DNA, 20 bp, synthetic construct
  misc_feature 1..20: note = CRISPR gRNA sequence
  source 1..20: mol_type = other DNA
tctctaaaaaaaaaaaaatg

SEQ ID NO: 64514 - DNA, 20 bp, synthetic construct
  misc_feature 1..20: note = CRISPR gRNA sequence
  source 1..20: mol_type = other DNA
taaaaaaaaaaaaatggtta

SEQ ID NO: 64515 - DNA, 20 bp, synthetic construct
  misc_feature 1..20: note = CRISPR gRNA sequence
  source 1..20: mol_type = other DNA
aaaaaaaaaaaatggttagc

SEQ ID NO: 64516 - DNA, 20 bp, synthetic construct
  misc_feature 1..20: note = CRISPR gRNA sequence
  source 1..20: mol_type = other DNA
gcaccaatccaaaaagtctg

SEQ ID NO: 64517 - DNA, 20 bp, synthetic construct
  misc_feature 1..20: note = CRISPR gRNA sequence
  source 1..20: mol_type = other DNA
tgaaacctggctcatgatgt

SEQ ID NO: 64518 - DNA, 20 bp, synthetic construct
  misc_feature 1..20: note = CRISPR gRNA sequence
  source 1..20: mol_type = other DNA
gctcatgatgtcctagcttc

SEQ ID NO: 64519 - DNA, 20 bp, synthetic construct
  misc_feature 1..20: note = CRISPR gRNA sequence
  source 1..20: mol_type = other DNA
atgatgtcctagcttccctg

SEQ ID NO: 64520 - DNA, 20 bp, synthetic construct
  misc_feature 1..20: note = CRISPR gRNA sequence
  source 1..20: mol_type = other DNA
gcttccctgcatcccctaac

SEQ ID NO: 64521 - DNA, 20 bp, synthetic construct
  misc_feature 1..20: note = CRISPR gRNA sequence
  source 1..20: mol_type = other DNA
ccctgcatcccctaacgctc

SEQ ID NO: 64522 - DNA, 20 bp, synthetic construct
  misc_feature 1..20: note = CRISPR gRNA sequence
  source 1..20: mol_type = other DNA
cctgcatcccctaacgctcc

SEQ ID NO: 64523 - DNA, 20 bp, synthetic construct
  misc_feature 1..20: note = CRISPR gRNA sequence
  source 1..20: mol_type = other DNA
catcccctaacgctccctca

SEQ ID NO: 64524 - DNA, 20 bp, synthetic construct
  misc_feature 1..20: note = CRISPR gRNA sequence
  source 1..20: mol_type = other DNA
acgctccctcagcccagtgg

SEQ ID NO: 64525 - DNA, 20 bp, synthetic construct
  misc_feature 1..20: note = CRISPR gRNA sequence
  source 1..20: mol_type = other DNA
cctcagcccagtgggagaga

SEQ ID NO: 64526 - DNA, 20 bp, synthetic construct
  misc_feature 1..20: note = CRISPR gRNA sequence
  source 1..20: mol_type = other DNA
agcccagtgggagagagtct

SEQ ID NO: 64527 - DNA, 20 bp, synthetic construct
  misc_feature 1..20: note = CRISPR gRNA sequence
  source 1..20: mol_type = other DNA
tggtttaccatagcctggac

SEQ ID NO: 64528 - DNA, 20 bp, synthetic construct
  misc_feature 1..20: note = CRISPR gRNA sequence
  source 1..20: mol_type = other DNA
accatagcctggactcactg

SEQ ID NO: 64529 - DNA, 20 bp, synthetic construct
  misc_feature 1..20: note = CRISPR gRNA sequence
  source 1..20: mol_type = other DNA
ccatagcctggactcactgc

SEQ ID NO: 64530 - DNA, 20 bp, synthetic construct
  misc_feature 1..20: note = CRISPR gRNA sequence
  source 1..20: mol_type = other DNA
gactcactgcatacagctca

SEQ ID NO: 64531 - DNA, 20 bp, synthetic construct
  misc_feature 1..20: note = CRISPR gRNA sequence
  source 1..20: mol_type = other DNA
actgcatacagctcatgctc

SEQ ID NO: 64532 - DNA, 20 bp, synthetic construct
  misc_feature 1..20: note = CRISPR gRNA sequence
  source 1..20: mol_type = other DNA
catacagctcatgctcctcg

SEQ ID NO: 64533 - DNA, 20 bp, synthetic construct
  misc_feature 1..20: note = CRISPR gRNA sequence
  source 1..20: mol_type = other DNA
atgctcctcgccttctgaac

SEQ ID NO: 64534 - DNA, 20 bp, synthetic construct
  misc_feature 1..20: note = CRISPR gRNA sequence
  source 1..20: mol_type = other DNA
ctcgccttctgaaccacaga

SEQ ID NO: 64535 - DNA, 20 bp, synthetic construct
  misc_feature 1..20: note = CRISPR gRNA sequence
  source 1..20: mol_type = other DNA
gccttctgaaccacagacag

SEQ ID NO: 64536 - DNA, 20 bp, synthetic construct
  misc_feature 1..20: note = CRISPR gRNA sequence
  source 1..20: mol_type = other DNA
ctgaaccacagacagcacat

SEQ ID NO: 64537 - DNA, 20 bp, synthetic construct
  misc_feature 1..20: note = CRISPR gRNA sequence
  source 1..20: mol_type = other DNA
tgaaccacagacagcacatc

SEQ ID NO: 64538 - DNA, 20 bp, synthetic construct
  misc_feature 1..20: note = CRISPR gRNA sequence
  source 1..20: mol_type = other DNA
aaccacagacagcacatcca

SEQ ID NO: 64539 - DNA, 20 bp, synthetic construct
  misc_feature 1..20: note = CRISPR gRNA sequence
  source 1..20: mol_type = other DNA
ctgtttactaaccttcgatt

SEQ ID NO: 64540 - DNA, 20 bp, synthetic construct
  misc_feature 1..20: note = CRISPR gRNA sequence
  source 1..20: mol_type = other DNA
tgtttactaaccttcgattt

SEQ ID NO: 64541 - DNA, 20 bp, synthetic construct
  misc_feature 1..20: note = CRISPR gRNA sequence
  source 1..20: mol_type = other DNA
tttactaaccttcgatttta

SEQ ID NO: 64542 - DNA, 20 bp, synthetic construct
  misc_feature 1..20: note = CRISPR gRNA sequence
  source 1..20: mol_type = other DNA
actaaccttcgattttacac

SEQ ID NO: 64543 - DNA, 20 bp, synthetic construct
  misc_feature 1..20: note = CRISPR gRNA sequence
  source 1..20: mol_type = other DNA
ctaaccttcgattttacacc

SEQ ID NO: 64544 - DNA, 20 bp, synthetic construct
  misc_feature 1..20: note = CRISPR gRNA sequence
  source 1..20: mol_type = other DNA
accttcgattttacacctat

SEQ ID NO: 64545 - DNA, 20 bp, synthetic construct
  misc_feature 1..20: note = CRISPR gRNA sequence
  source 1..20: mol_type = other DNA
cgattttacacctatgctgg

SEQ ID NO: 64546 - DNA, 20 bp, synthetic construct
  misc_feature 1..20: note = CRISPR gRNA sequence
  source 1..20: mol_type = other DNA
gattttacacctatgctggg

SEQ ID NO: 64547 - DNA, 20 bp, synthetic construct
  misc_feature 1..20: note = CRISPR gRNA sequence
  source 1..20: mol_type = other DNA
tacacctatgctgggtactt

SEQ ID NO: 64548 - DNA, 20 bp, synthetic construct
  misc_feature 1..20: note = CRISPR gRNA sequence
  source 1..20: mol_type = other DNA
acacctatgctgggtacttg

SEQ ID NO: 64549 - DNA, 20 bp, synthetic construct
  misc_feature 1..20: note = CRISPR gRNA sequence
  source 1..20: mol_type = other DNA
cacctatgctgggtacttgg

SEQ ID NO: 64550 - DNA, 20 bp, synthetic construct
  misc_feature 1..20: note = CRISPR gRNA sequence
  source 1..20: mol_type = other DNA
tgctgggtacttggacatac

SEQ ID NO: 64551 - DNA, 20 bp, synthetic construct
  misc_feature 1..20: note = CRISPR gRNA sequence
  source 1..20: mol_type = other DNA
ggtacttggacatacattgt

SEQ ID NO: 64552 - DNA, 20 bp, synthetic construct
  misc_feature 1..20: note = CRISPR gRNA sequence
  source 1..20: mol_type = other DNA
ggacatacattgtctcattc

SEQ ID NO: 64553 - DNA, 20 bp, synthetic construct
  misc_feature 1..20: note = CRISPR gRNA sequence
  source 1..20: mol_type = other DNA
gacatacattgtctcattca

SEQ ID NO: 64554 - DNA, 20 bp, synthetic construct
  misc_feature 1..20: note = CRISPR gRNA sequence
  source 1..20: mol_type = other DNA
tctcattcaatccttcaggt

SEQ ID NO: 64555 - DNA, 20 bp, synthetic construct
  misc_feature 1..20: note = CRISPR gRNA sequence
  source 1..20: mol_type = other DNA
attcaatccttcaggtacct

SEQ ID NO: 64556 - DNA, 20 bp, synthetic construct
  misc_feature 1..20: note = CRISPR gRNA sequence
  source 1..20: mol_type = other DNA
aatccttcaggtacctatgt

SEQ ID NO: 64557 - DNA, 20 bp, synthetic construct
  misc_feature 1..20: note = CRISPR gRNA sequence
  source 1..20: mol_type = other DNA
caggtacctatgtgctagat

SEQ ID NO: 64558 - DNA, 20 bp, synthetic construct
  misc_feature 1..20: note = CRISPR gRNA sequence
  source 1..20: mol_type = other DNA
aggtacctatgtgctagatg

SEQ ID NO: 64559 - DNA, 20 bp, synthetic construct
  misc_feature 1..20: note = CRISPR gRNA sequence
  source 1..20: mol_type = other DNA
tgtgctagatgttgtcatcc

SEQ ID NO: 64560 - DNA, 20 bp, synthetic construct
  misc_feature 1..20: note = CRISPR gRNA sequence
  source 1..20: mol_type = other DNA
gatgttgtcatccgttttag

SEQ ID NO: 64561 - DNA, 20 bp, synthetic construct
  misc_feature 1..20: note = CRISPR gRNA sequence
  source 1..20: mol_type = other DNA
tcatccgttttagaaaagag

SEQ ID NO: 64562 - DNA, 20 bp, synthetic construct
  misc_feature 1..20: note = CRISPR gRNA sequence
  source 1..20: mol_type = other DNA
tagaaaagagaaaagggagc

SEQ ID NO: 64563 - DNA, 20 bp, synthetic construct
  misc_feature 1..20: note = CRISPR gRNA sequence
  source 1..20: mol_type = other DNA
agaaaagagaaaagggagcc

SEQ ID NO: 64564 - DNA, 20 bp, synthetic construct
  misc_feature 1..20: note = CRISPR gRNA sequence
  source 1..20: mol_type = other DNA
gaaaagagaaaagggagccg

SEQ ID NO: 64565 - DNA, 20 bp, synthetic construct
  misc_feature 1..20: note = CRISPR gRNA sequence
  source 1..20: mol_type = other DNA
cagtgatttgcccaaggcca

SEQ ID NO: 64566 - DNA, 20 bp, synthetic construct
  misc_feature 1..20: note = CRISPR gRNA sequence
  source 1..20: mol_type = other DNA
gcccaaggccacatggctat

SEQ ID NO: 64567 - DNA, 20 bp, synthetic construct
  misc_feature 1..20: note = CRISPR gRNA sequence
  source 1..20: mol_type = other DNA
cccaaggccacatggctata

SEQ ID NO: 64568 - DNA, 20 bp, synthetic construct
  misc_feature 1..20: note = CRISPR gRNA sequence
  source 1..20: mol_type = other DNA
tacatggcagagccaaaatt

SEQ ID NO: 64569 - DNA, 20 bp, synthetic construct
  misc_feature 1..20: note = CRISPR gRNA sequence
  source 1..20: mol_type = other DNA
gaataaaggttccatttgac

SEQ ID NO: 64570 - DNA, 20 bp, synthetic construct
  misc_feature 1..20: note = CRISPR gRNA sequence
  source 1..20: mol_type = other DNA
aataaaggttccatttgacc

SEQ ID NO: 64571 - DNA, 20 bp, synthetic construct
  misc_feature 1..20: note = CRISPR gRNA sequence
  source 1..20: mol_type = other DNA
catttgacctcaaacctgtt

SEQ ID NO: 64572 - DNA, 20 bp, synthetic construct
  misc_feature 1..20: note = CRISPR gRNA sequence
  source 1..20: mol_type = other DNA
gacctcaaacctgttgcccc

SEQ ID NO: 64573 - DNA, 20 bp, synthetic construct
  misc_feature 1..20: note = CRISPR gRNA sequence
  source 1..20: mol_type = other DNA
acctcaaacctgttgcccct

SEQ ID NO: 64574 - DNA, 20 bp, synthetic construct
  misc_feature 1..20: note = CRISPR gRNA sequence
  source 1..20: mol_type = other DNA
aaacctgttgcccctcctgc

SEQ ID NO: 64575 - DNA, 20 bp, synthetic construct
  misc_feature 1..20: note = CRISPR gRNA sequence
  source 1..20: mol_type = other DNA
ttgcccctcctgctctgctg

SEQ ID NO: 64576 - DNA, 20 bp, synthetic construct
  misc_feature 1..20: note = CRISPR gRNA sequence
  source 1..20: mol_type = other DNA
cccctcctgctctgctgaat

SEQ ID NO: 64577 - DNA, 20 bp, synthetic construct
  misc_feature 1..20: note = CRISPR gRNA sequence
  source 1..20: mol_type = other DNA
ctgctctgctgaatcacatc

SEQ ID NO: 64578 - DNA, 20 bp, synthetic construct
  misc_feature 1..20: note = CRISPR gRNA sequence
  source 1..20: mol_type = other DNA
ctctgctgaatcacatcttg

SEQ ID NO: 64579 - DNA, 20 bp, synthetic construct
  misc_feature 1..20: note = CRISPR gRNA sequence
  source 1..20: mol_type = other DNA
tgctgaatcacatcttgagc

SEQ ID NO: 64580 - DNA, 20 bp, synthetic construct
  misc_feature 1..20: note = CRISPR gRNA sequence
  source 1..20: mol_type = other DNA
ctgaatcacatcttgagcat

SEQ ID NO: 64581 - DNA, 20 bp, synthetic construct
  misc_feature 1..20: note = CRISPR gRNA sequence
  source 1..20: mol_type = other DNA
aatcacatcttgagcatctg

SEQ ID NO: 64582 - DNA, 20 bp, synthetic construct
  misc_feature 1..20: note = CRISPR gRNA sequence
  source 1..20: mol_type = other DNA
gagcatctgcaagcagtctc

SEQ ID NO: 64583 - DNA, 20 bp, synthetic construct
  misc_feature 1..20: note = CRISPR gRNA sequence
  source 1..20: mol_type = other DNA
agcatctgcaagcagtctcc

SEQ ID NO: 64584 - DNA, 20 bp, synthetic construct
  misc_feature 1..20: note = CRISPR gRNA sequence
  source 1..20: mol_type = other DNA
caagcagtctcctttgttac

SEQ ID NO: 64585 - DNA, 20 bp, synthetic construct
  misc_feature 1..20: note = CRISPR gRNA sequence
  source 1..20: mol_type = other DNA
ctttgttaccgactcacttt

SEQ ID NO: 64586 - DNA, 20 bp, synthetic construct
  misc_feature 1..20: note = CRISPR gRNA sequence
  source 1..20: mol_type = other DNA
tgttaccgactcactttggg

SEQ ID NO: 64587 - DNA, 20 bp, synthetic construct
  misc_feature 1..20: note = CRISPR gRNA sequence
  source 1..20: mol_type = other DNA
gttaccgactcactttgggt

SEQ ID NO: 64588 - DNA, 20 bp, synthetic construct
  misc_feature 1..20: note = CRISPR gRNA sequence
  source 1..20: mol_type = other DNA
ttaccgactcactttgggtt

SEQ ID NO: 64589 - DNA, 20 bp, synthetic construct
  misc_feature 1..20: note = CRISPR gRNA sequence
  source 1..20: mol_type = other DNA
ccgactcactttgggttgtg

SEQ ID NO: 64590 - DNA, 20 bp, synthetic construct
  misc_feature 1..20: note = CRISPR gRNA sequence
  source 1..20: mol_type = other DNA
actttgggttgtgcttcagg

SEQ ID NO: 64591 - DNA, 20 bp, synthetic construct
  misc_feature 1..20: note = CRISPR gRNA sequence
  source 1..20: mol_type = other DNA
tgggttgtgcttcagggtct

SEQ ID NO: 64592 - DNA, 20 bp, synthetic construct
  misc_feature 1..20: note = CRISPR gRNA sequence
  source 1..20: mol_type = other DNA
gggttgtgcttcagggtctt

SEQ ID NO: 64593 - DNA, 20 bp, synthetic construct
  misc_feature 1..20: note = CRISPR gRNA sequence
  source 1..20: mol_type = other DNA
ggttgtgcttcagggtcttc

SEQ ID NO: 64594 - DNA, 20 bp, synthetic construct
  misc_feature 1..20: note = CRISPR gRNA sequence
  source 1..20: mol_type = other DNA
tgcttcagggtcttcagcct

SEQ ID NO: 64595 - DNA, 20 bp, synthetic construct
  misc_feature 1..20: note = CRISPR gRNA sequence
  source 1..20: mol_type = other DNA
cagggtcttcagcctctaga

SEQ ID NO: 64596 - DNA, 20 bp, synthetic construct
  misc_feature 1..20: note = CRISPR gRNA sequence
  source 1..20: mol_type = other DNA
agggtcttcagcctctagaa

SEQ ID NO: 64597 - DNA, 20 bp, synthetic construct
  misc_feature 1..20: note = CRISPR gRNA sequence
  source 1..20: mol_type = other DNA
cagcctctagaagccaagga

SEQ ID NO: 64598 - DNA, 20 bp, synthetic construct
  misc_feature 1..20: note = CRISPR gRNA sequence
  source 1..20: mol_type = other DNA
agcctctagaagccaaggaa

SEQ ID NO: 64599 - DNA, 20 bp, synthetic construct
  misc_feature 1..20: note = CRISPR gRNA sequence
  source 1..20: mol_type = other DNA
tagaagccaaggaaagaggc

SEQ ID NO: 64600 - DNA, 20 bp, synthetic construct
  misc_feature 1..20: note = CRISPR gRNA sequence
  source 1..20: mol_type = other DNA
gaagccaaggaaagaggctt

SEQ ID NO: 64601 - DNA, 20 bp, synthetic construct
  misc_feature 1..20: note = CRISPR gRNA sequence
  source 1..20: mol_type = other DNA
gatccaccaggccctagatg

SEQ ID NO: 64602 - DNA, 20 bp, synthetic construct
  misc_feature 1..20: note = CRISPR gRNA sequence
  source 1..20: mol_type = other DNA
atccaccaggccctagatgc

SEQ ID NO: 64603 - DNA, 20 bp, synthetic construct
  misc_feature 1..20: note = CRISPR gRNA sequence
  source 1..20: mol_type = other DNA
gatgcctgagcccaggccaa

SEQ ID NO: 64604 - DNA, 20 bp, synthetic construct
  misc_feature 1..20: note = CRISPR gRNA sequence
  source 1..20: mol_type = other DNA
agcccaggccaatgcttgat

SEQ ID NO: 64605 - DNA, 20 bp, synthetic construct
  misc_feature 1..20: note = CRISPR gRNA sequence
  source 1..20: mol_type = other DNA
gatttgttcttgccagagct

SEQ ID NO: 64606 - DNA, 20 bp, synthetic construct
  misc_feature 1..20: note = CRISPR gRNA sequence
  source 1..20: mol_type = other DNA
atttgttcttgccagagctc

SEQ ID NO: 64607 - DNA, 20 bp, synthetic construct
  misc_feature 1..20: note = CRISPR gRNA sequence
  source 1..20: mol_type = other DNA
gttcttgccagagctccaga

SEQ ID NO: 64608 - DNA, 20 bp, synthetic construct
  misc_feature 1..20: note = CRISPR gRNA sequence
  source 1..20: mol_type = other DNA
ttcttgccagagctccagac

SEQ ID NO: 64609 - DNA, 20 bp, synthetic construct
  misc_feature 1..20: note = CRISPR gRNA sequence
  source 1..20: mol_type = other DNA
ttgccagagctccagacctg

SEQ ID NO: 64610 - DNA, 20 bp, synthetic construct
  misc_feature 1..20: note = CRISPR gRNA sequence
  source 1..20: mol_type = other DNA
gccagagctccagacctgca

SEQ ID NO: 64611 - DNA, 20 bp, synthetic construct
  misc_feature 1..20: note = CRISPR gRNA sequence
  source 1..20: mol_type = other DNA
ccagagctccagacctgcag

SEQ ID NO: 64612 - DNA, 20 bp, synthetic construct
  misc_feature 1..20: note = CRISPR gRNA sequence
  source 1..20: mol_type = other DNA
cagacctgcaggaaagtgac

SEQ ID NO: 64613 - DNA, 20 bp, synthetic construct
  misc_feature 1..20: note = CRISPR gRNA sequence
  source 1..20: mol_type = other DNA
caggaaagtgacggccagag

SEQ ID NO: 64614 - DNA, 20 bp, synthetic construct
  misc_feature 1..20: note = CRISPR gRNA sequence
  source 1..20: mol_type = other DNA
agagcagaagcttgacgctc

SEQ ID NO: 64615 - DNA, 20 bp, synthetic construct
  misc_feature 1..20: note = CRISPR gRNA sequence
  source 1..20: mol_type = other DNA
gacgctcaggtaccttggag

SEQ ID NO: 64616 - DNA, 20 bp, synthetic construct
  misc_feature 1..20: note = CRISPR gRNA sequence
  source 1..20: mol_type = other DNA
acgctcaggtaccttggagg

SEQ ID NO: 64617 - DNA, 20 bp, synthetic construct
  misc_feature 1..20: note = CRISPR gRNA sequence
  source 1..20: mol_type = other DNA
aggtaccttggagggatcta

SEQ ID NO: 64618 - DNA, 20 bp, synthetic construct
  misc_feature 1..20: note = CRISPR gRNA sequence
  source 1..20: mol_type = other DNA
ggagggatctattgccttag

SEQ ID NO: 64619 - DNA, 20 bp, synthetic construct
  misc_feature 1..20: note = CRISPR gRNA sequence
  source 1..20: mol_type = other DNA
gagggatctattgccttagg

SEQ ID NO: 64620 - DNA, 20 bp, synthetic construct
  misc_feature 1..20: note = CRISPR gRNA sequence
  source 1..20: mol_type = other DNA
ttgccttaggagagggatat

SEQ ID NO: 64621 - DNA, 20 bp, synthetic construct
  misc_feature 1..20: note = CRISPR gRNA sequence
  source 1..20: mol_type = other DNA
ccttaggagagggatatgat

SEQ ID NO: 64622 - DNA, 20 bp, synthetic construct
  misc_feature 1..20: note = CRISPR gRNA sequence
  source 1..20: mol_type = other DNA
aggagagggatatgatatgg

SEQ ID NO: 64623 - DNA, 20 bp, synthetic construct
  misc_feature 1..20: note = CRISPR gRNA sequence
  source 1..20: mol_type = other DNA
ggagagggatatgatatggg

SEQ ID NO: 64624 - DNA, 20 bp, synthetic construct
  misc_feature 1..20: note = CRISPR gRNA sequence
  source 1..20: mol_type = other DNA
gccgggtgtggtgcccatcc

SEQ ID NO: 64625 - DNA, 20 bp, synthetic construct
  misc_feature 1..20: note = CRISPR gRNA sequence
  source 1..20: mol_type = other DNA
gatagcccatcctggcttga

SEQ ID NO: 64626 - DNA, 20 bp, synthetic construct
  misc_feature 1..20: note = CRISPR gRNA sequence
  source 1..20: mol_type = other DNA
gcttgaataaggagcatctg

SEQ ID NO: 64627 - DNA, 20 bp, synthetic construct
  misc_feature 1..20: note = CRISPR gRNA sequence
  source 1..20: mol_type = other DNA
gaataaggagcatctgtcat

SEQ ID NO: 64628 - DNA, 20 bp, synthetic construct
  misc_feature 1..20: note = CRISPR gRNA sequence
  source 1..20: mol_type = other DNA
aataaggagcatctgtcata

SEQ ID NO: 64629 - DNA, 20 bp, synthetic construct
  misc_feature 1..20: note = CRISPR gRNA sequence
  source 1..20: mol_type = other DNA
tcataataacaatagctgca

SEQ ID NO: 64630 - DNA, 20 bp, synthetic construct
  misc_feature 1..20: note = CRISPR gRNA sequence
  source 1..20: mol_type = other DNA
caacttaatggaaccggcta

SEQ ID NO: 64631 - DNA, 20 bp, synthetic construct
  misc_feature 1..20: note = CRISPR gRNA sequence
  source 1..20: mol_type = other DNA
aatggaaccggctatctata

SEQ ID NO: 64632 - DNA, 20 bp, synthetic construct
  misc_feature 1..20: note = CRISPR gRNA sequence
  source 1..20: mol_type = other DNA
atggaaccggctatctatat

SEQ ID NO: 64633 - DNA, 20 bp, synthetic construct
  misc_feature 1..20: note = CRISPR gRNA sequence
  source 1..20: mol_type = other DNA
tctatatgccgggcattgca

SEQ ID NO: 64634 - DNA, 20 bp, synthetic construct
  misc_feature 1..20: note = CRISPR gRNA sequence
  source 1..20: mol_type = other DNA
tatgccgggcattgcactag

SEQ ID NO: 64635 - DNA, 20 bp, synthetic construct
  misc_feature 1..20: note = CRISPR gRNA sequence
  source 1..20: mol_type = other DNA
cactagatgttttacatcca

SEQ ID NO: 64636 - DNA, 20 bp, synthetic construct
  misc_feature 1..20: note = CRISPR gRNA sequence
  source 1..20: mol_type = other DNA
gatgttttacatccattacc

SEQ ID NO: 64637 - DNA, 20 bp, synthetic construct
  misc_feature 1..20: note = CRISPR gRNA sequence
  source 1..20: mol_type = other DNA
tacatccattacctcactgt

SEQ ID NO: 64638 - DNA, 20 bp, synthetic construct
  misc_feature 1..20: note = CRISPR gRNA sequence
  source 1..20: mol_type = other DNA
acatccattacctcactgta

SEQ ID NO: 64639 - DNA, 20 bp, synthetic construct
  misc_feature 1..20: note = CRISPR gRNA sequence
  source 1..20: mol_type = other DNA
catccattacctcactgtaa

SEQ ID NO: 64640 - DNA, 20 bp, synthetic construct
  misc_feature 1..20: note = CRISPR gRNA sequence
  source 1..20: mol_type = other DNA
cctcactgtaattcctttag

SEQ ID NO: 64641 - DNA, 20 bp, synthetic construct
  misc_feature 1..20: note = CRISPR gRNA sequence
  source 1..20: mol_type = other DNA
actgtaattcctttagaatc

SEQ ID NO: 64642 - DNA, 20 bp, synthetic construct
  misc_feature 1..20: note = CRISPR gRNA sequence
  source 1..20: mol_type = other DNA
taattcctttagaatctctg

SEQ ID NO: 64643 - DNA, 20 bp, synthetic construct
  misc_feature 1..20: note = CRISPR gRNA sequence
  source 1..20: mol_type = other DNA
ctttagaatctctgtgaagt

SEQ ID NO: 64644 - DNA, 20 bp, synthetic construct
  misc_feature 1..20: note = CRISPR gRNA sequence
  source 1..20: mol_type = other DNA
tagaatctctgtgaagtaca

SEQ ID NO: 64645 - DNA, 20 bp, synthetic construct
  misc_feature 1..20: note = CRISPR gRNA sequence
  source 1..20: mol_type = other DNA
agaatctctgtgaagtacac

SEQ ID NO: 64646 - DNA, 20 bp, synthetic construct
  misc_feature 1..20: note = CRISPR gRNA sequence
  source 1..20: mol_type = other DNA
gaatctctgtgaagtacaca

SEQ ID NO: 64647 - DNA, 20 bp, synthetic construct
  misc_feature 1..20: note = CRISPR gRNA sequence
  source 1..20: mol_type = other DNA
tgtgaagtacacattattat

SEQ ID NO: 64648 - DNA, 20 bp, synthetic construct
  misc_feature 1..20: note = CRISPR gRNA sequence
  source 1..20: mol_type = other DNA
tgaagtacacattattattc

SEQ ID NO: 64649 - DNA, 20 bp, synthetic construct
  misc_feature 1..20: note = CRISPR gRNA sequence
  source 1..20: mol_type = other DNA
ttattcccctttgagggagg

SEQ ID NO: 64650 - DNA, 20 bp, synthetic construct
  misc_feature 1..20: note = CRISPR gRNA sequence
  source 1..20: mol_type = other DNA
ttcccctttgagggaggagg

SEQ ID NO: 64651 - DNA, 20 bp, synthetic construct
  misc_feature 1..20: note = CRISPR gRNA sequence
  source 1..20: mol_type = other DNA
ccctttgagggaggaggaaa

SEQ ID NO: 64652 - DNA, 20 bp, synthetic construct
  misc_feature 1..20: note = CRISPR gRNA sequence
  source 1..20: mol_type = other DNA
tgagggaggaggaaactgag

SEQ ID NO: 64653 - DNA, 20 bp, synthetic construct
  misc_feature 1..20: note = CRISPR gRNA sequence
  source 1..20: mol_type = other DNA
gagggaggaggaaactgagt

SEQ ID NO: 64654 - DNA, 20 bp, synthetic construct
  misc_feature 1..20: note = CRISPR gRNA sequence
  source 1..20: mol_type = other DNA
agggaggaggaaactgagtc

SEQ ID NO: 64655 - DNA, 20 bp, synthetic construct
  misc_feature 1..20: note = CRISPR gRNA sequence
  source 1..20: mol_type = other DNA
agtctcagacaggttaagtc

SEQ ID NO: 64656 - DNA, 20 bp, synthetic construct
  misc_feature 1..20: note = CRISPR gRNA sequence
  source 1..20: mol_type = other DNA
agacaggttaagtcccttgc

SEQ ID NO: 64657 - DNA, 20 bp, synthetic construct
  misc_feature 1..20: note = CRISPR gRNA sequence
  source 1..20: mol_type = other DNA
agtcccttgctcaagatcac

SEQ ID NO: 64658 - DNA, 20 bp, synthetic construct
  misc_feature 1..20: note = CRISPR gRNA sequence
  source 1..20: mol_type = other DNA
gctcaagatcacccagctac

SEQ ID NO: 64659 - DNA, 20 bp, synthetic construct
  misc_feature 1..20: note = CRISPR gRNA sequence
  source 1..20: mol_type = other DNA
ctcaagatcacccagctact

SEQ ID NO: 64660 - DNA, 20 bp, synthetic construct
  misc_feature 1..20: note = CRISPR gRNA sequence
  source 1..20: mol_type = other DNA
aagatcacccagctactaag

SEQ ID NO: 64661 - DNA, 20 bp, synthetic construct
  misc_feature 1..20: note = CRISPR gRNA sequence
  source 1..20: mol_type = other DNA
ctaagaggtgtggctaggat

SEQ ID NO: 64662 - DNA, 20 bp, synthetic construct
  misc_feature 1..20: note = CRISPR gRNA sequence
  source 1..20: mol_type = other DNA
agaggtgtggctaggattag

SEQ ID NO: 64663 - DNA, 20 bp, synthetic construct
  misc_feature 1..20: note = CRISPR gRNA sequence
  source 1..20: mol_type = other DNA
ggattagacccaggtctgtg

SEQ ID NO: 64664 - DNA, 20 bp, synthetic construct
  misc_feature 1..20: note = CRISPR gRNA sequence
  source 1..20: mol_type = other DNA
gacccaggtctgtgggcccc

SEQ ID NO: 64665 - DNA, 20 bp, synthetic construct
  misc_feature 1..20: note = CRISPR gRNA sequence
  source 1..20: mol_type = other DNA
tgggccccctgactccccca

SEQ ID NO: 64666 - DNA, 20 bp, synthetic construct
  misc_feature 1..20: note = CRISPR gRNA sequence
  source 1..20: mol_type = other DNA
actcccccagcattggaagc

SEQ ID NO: 64667 - DNA, 20 bp, synthetic construct
  misc_feature 1..20: note = CRISPR gRNA sequence
  source 1..20: mol_type = other DNA
ccccagcattggaagctgga

SEQ ID NO: 64668 - DNA, 20 bp, synthetic construct
  misc_feature 1..20: note = CRISPR gRNA sequence
  source 1..20: mol_type = other DNA
gaagctggaggggccatgga

SEQ ID NO: 64669 - DNA, 20 bp, synthetic construct
  misc_feature 1..20: note = CRISPR gRNA sequence
  source 1..20: mol_type = other DNA
gaggggccatggagtagggg

SEQ ID NO: 64670 - DNA, 20 bp, synthetic construct
  misc_feature 1..20: note = CRISPR gRNA sequence
  source 1..20: mol_type = other DNA
tttgccctgagcccttctgt

SEQ ID NO: 64671 - DNA, 20 bp, synthetic construct
  misc_feature 1..20: note = CRISPR gRNA sequence
  source 1..20: mol_type = other DNA
gccctgagcccttctgtccc

SEQ ID NO: 64672 - DNA, 20 bp, synthetic construct
  misc_feature 1..20: note = CRISPR gRNA sequence
  source 1..20: mol_type = other DNA
ccctgagcccttctgtcccc

SEQ ID NO: 64673 - DNA, 20 bp, synthetic construct
  misc_feature 1..20: note = CRISPR gRNA sequence
  source 1..20: mol_type = other DNA
agcccttctgtcccccactc

SEQ ID NO: 64674 - DNA, 20 bp, synthetic construct
  misc_feature 1..20: note = CRISPR gRNA sequence
  source 1..20: mol_type = other DNA
ctgtcccccactcctaccca

SEQ ID NO: 64675 - DNA, 20 bp, synthetic construct
  misc_feature 1..20: note = CRISPR gRNA sequence
  source 1..20: mol_type = other DNA
tgtcccccactcctacccaa

SEQ ID NO: 64676 - DNA, 20 bp, synthetic construct
  misc_feature 1..20: note = CRISPR gRNA sequence
  source 1..20: mol_type = other DNA
tcccccactcctacccaagg

SEQ ID NO: 64677 - DNA, 20 bp, synthetic construct
  misc_feature 1..20: note = CRISPR gRNA sequence
  source 1..20: mol_type = other DNA
ctacccaaggctgcagaagt

SEQ ID NO: 64678 - DNA, 20 bp, synthetic construct
  misc_feature 1..20: note = CRISPR gRNA sequence
  source 1..20: mol_type = other DNA
cccaaggctgcagaagtgtc

SEQ ID NO: 64679 - DNA, 20 bp, synthetic construct
  misc_feature 1..20: note = CRISPR gRNA sequence
  source 1..20: mol_type = other DNA
cagaagtgtcagctccaggt

SEQ ID NO: 64680 - DNA, 20 bp, synthetic construct
  misc_feature 1..20: note = CRISPR gRNA sequence
  source 1..20: mol_type = other DNA
caggtccacgatgcggaggc

SEQ ID NO: 64681 - DNA, 20 bp, synthetic construct
  misc_feature 1..20: note = CRISPR gRNA sequence
  source 1..20: mol_type = other DNA
atagccctgctccaggaagg

SEQ ID NO: 64682 - DNA, 20 bp, synthetic construct
  misc_feature 1..20: note = CRISPR gRNA sequence
  source 1..20: mol_type = other DNA
ctccaggaaggccctcacct

SEQ ID NO: 64683 - DNA, 20 bp, synthetic construct
  misc_feature 1..20: note = CRISPR gRNA sequence
  source 1..20: mol_type = other DNA
caggaaggccctcacctgga

SEQ ID NO: 64684 - DNA, 20 bp, synthetic construct
  misc_feature 1..20: note = CRISPR gRNA sequence
  source 1..20: mol_type = other DNA
acctggaggaagtggagtga

SEQ ID NO: 64685 - DNA, 20 bp, synthetic construct
  misc_feature 1..20: note = CRISPR gRNA sequence
  source 1..20: mol_type = other DNA
gaggaagtggagtgagtatc

SEQ ID NO: 64686 - DNA, 20 bp, synthetic construct
  misc_feature 1..20: note = CRISPR gRNA sequence
  source 1..20: mol_type = other DNA
gcgtaggagccaggaaagga

SEQ ID NO: 64687 - DNA, 20 bp, synthetic construct
  misc_feature 1..20: note = CRISPR gRNA sequence
  source 1..20: mol_type = other DNA
gagagggtgggcagggcctc

SEQ ID NO: 64688 - DNA, 20 bp, synthetic construct
  misc_feature 1..20: note = CRISPR gRNA sequence
  source 1..20: mol_type = other DNA
gcctttgggtgggtggtgtg

SEQ ID NO: 64689 - DNA, 20 bp, synthetic construct
  misc_feature 1..20: note = CRISPR gRNA sequence
  source 1..20: mol_type = other DNA
tgggtgggtggtgtggggga

SEQ ID NO: 64690 - DNA, 20 bp, synthetic construct
  misc_feature 1..20: note = CRISPR gRNA sequence
  source 1..20: mol_type = other DNA
gggtgggtggtgtgggggag

SEQ ID NO: 64691 - DNA, 20 bp, synthetic construct
  misc_feature 1..20: note = CRISPR gRNA sequence
  source 1..20: mol_type = other DNA
ggtgggtggtgtgggggagg

SEQ ID NO: 64692 - DNA, 20 bp, synthetic construct
  misc_feature 1..20: note = CRISPR gRNA sequence
  source 1..20: mol_type = other DNA
cctcatgaagaatttggggg

SEQ ID NO: 64693 - DNA, 20 bp, synthetic construct
  misc_feature 1..20: note = CRISPR gRNA sequence
  source 1..20: mol_type = other DNA
atgaagaatttgggggaatc

SEQ ID NO: 64694 - DNA, 20 bp, synthetic construct
  misc_feature 1..20: note = CRISPR gRNA sequence
  source 1..20: mol_type = other DNA
gggggaatcagatcattgta

SEQ ID NO: 64695 - DNA, 20 bp, synthetic construct
  misc_feature 1..20: note = CRISPR gRNA sequence
  source 1..20: mol_type = other DNA
ggggaatcagatcattgtaa

SEQ ID NO: 64696 - DNA, 20 bp, synthetic construct
  misc_feature 1..20: note = CRISPR gRNA sequence
  source 1..20: mol_type = other DNA
taacagctgctactattcag

SEQ ID NO: 64697 - DNA, 20 bp, synthetic construct
  misc_feature 1..20: note = CRISPR gRNA sequence
  source 1..20: mol_type = other DNA
ctactattcagcacttgtcc

SEQ ID NO: 64698 - DNA, 20 bp, synthetic construct
  misc_feature 1..20: note = CRISPR gRNA sequence
  source 1..20: mol_type = other DNA
ctattcagcacttgtcccgg

SEQ ID NO: 64699 - DNA, 20 bp, synthetic construct
  misc_feature 1..20: note = CRISPR gRNA sequence
  source 1..20: mol_type = other DNA
ttcagcacttgtcccgggtc

SEQ ID NO: 64700 - DNA, 20 bp, synthetic construct
  misc_feature 1..20: note = CRISPR gRNA sequence
  source 1..20: mol_type = other DNA
agcacttgtcccgggtcagg

SEQ ID NO: 64701 - DNA, 20 bp, synthetic construct
  misc_feature 1..20: note = CRISPR gRNA sequence
  source 1..20: mol_type = other DNA
gtcccgggtcaggtgctgtg

SEQ ID NO: 64702 - DNA, 20 bp, synthetic construct
  misc_feature 1..20: note = CRISPR gRNA sequence
  source 1..20: mol_type = other DNA
tcccgggtcaggtgctgtgc

SEQ ID NO: 64703 - DNA, 20 bp, synthetic construct
  misc_feature 1..20: note = CRISPR gRNA sequence
  source 1..20: mol_type = other DNA
tgctagggactgtacatgcc

SEQ ID NO: 64704 - DNA, 20 bp, synthetic construct
  misc_feature 1..20: note = CRISPR gRNA sequence
  source 1..20: mol_type = other DNA
gggactgtacatgcctcctc

SEQ ID NO: 64705 - DNA, 20 bp, synthetic construct
  misc_feature 1..20: note = CRISPR gRNA sequence
  source 1..20: mol_type = other DNA
tacatgcctcctcgcattca

SEQ ID NO: 64706 - DNA, 20 bp, synthetic construct
  misc_feature 1..20: note = CRISPR gRNA sequence
  source 1..20: mol_type = other DNA
ctcgcattcactcctcacat

SEQ ID NO: 64707 - DNA, 20 bp, synthetic construct
  misc_feature 1..20: note = CRISPR gRNA sequence
  source 1..20: mol_type = other DNA
gcattcactcctcacatctc

SEQ ID NO: 64708 - DNA, 20 bp, synthetic construct
  misc_feature 1..20: note = CRISPR gRNA sequence
  source 1..20: mol_type = other DNA
actcctcacatctctgtgat

SEQ ID NO: 64709 - DNA, 20 bp, synthetic construct
  misc_feature 1..20: note = CRISPR gRNA sequence
  source 1..20: mol_type = other DNA
ctcacatctctgtgatgtaa

SEQ ID NO: 64710 - DNA, 20 bp, synthetic construct
  misc_feature 1..20: note = CRISPR gRNA sequence
  source 1..20: mol_type = other DNA
acatctctgtgatgtaagca

SEQ ID NO: 64711 - DNA, 20 bp, synthetic construct
  misc_feature 1..20: note = CRISPR gRNA sequence
  source 1..20: mol_type = other DNA
tgtgatgtaagcactgttac

SEQ ID NO: 64712 - DNA, 20 bp, synthetic construct
  misc_feature 1..20: note = CRISPR gRNA sequence
  source 1..20: mol_type = other DNA
tgatgtaagcactgttactg

SEQ ID NO: 64713 - DNA, 20 bp, synthetic construct
  misc_feature 1..20: note = CRISPR gRNA sequence
  source 1..20: mol_type = other DNA
ttactgtcctcattttatag

SEQ ID NO: 64714 - DNA, 20 bp, synthetic construct
  misc_feature 1..20: note = CRISPR gRNA sequence
  source 1..20: mol_type = other DNA
ctgtcctcattttatagagg

SEQ ID NO: 64715 - DNA, 20 bp, synthetic construct
  misc_feature 1..20: note = CRISPR gRNA sequence
  source 1..20: mol_type = other DNA
tcctcattttatagaggagg

SEQ ID NO: 64716 - DNA, 20 bp, synthetic construct
  misc_feature 1..20: note = CRISPR gRNA sequence
  source 1..20: mol_type = other DNA
attttatagaggaggaagtt

SEQ ID NO: 64717 - DNA, 20 bp, synthetic construct
  misc_feature 1..20: note = CRISPR gRNA sequence
  source 1..20: mol_type = other DNA
tatagaggaggaagttaagc

SEQ ID NO: 64718 - DNA, 20 bp, synthetic construct
  misc_feature 1..20: note = CRISPR gRNA sequence
  source 1..20: mol_type = other DNA
atagaggaggaagttaagct

SEQ ID NO: 64719 - DNA, 20 bp, synthetic construct
  misc_feature 1..20: note = CRISPR gRNA sequence
  source 1..20: mol_type = other DNA
tagaggaggaagttaagctg

SEQ ID NO: 64720 - DNA, 20 bp, synthetic construct
  misc_feature 1..20: note = CRISPR gRNA sequence
  source 1..20: mol_type = other DNA
agctgcagaaagataaactt

SEQ ID NO: 64721 - DNA, 20 bp, synthetic construct
  misc_feature 1..20: note = CRISPR gRNA sequence
  source 1..20: mol_type = other DNA
cagaaagataaacttgctca

SEQ ID NO: 64722 - DNA, 20 bp, synthetic construct
  misc_feature 1..20: note = CRISPR gRNA sequence
  source 1..20: mol_type = other DNA
gctcaaggccacacaggtag

SEQ ID NO: 64723 - DNA, 20 bp, synthetic construct
  misc_feature 1..20: note = CRISPR gRNA sequence
  source 1..20: mol_type = other DNA
ctcaaggccacacaggtagg

SEQ ID NO: 64724 - DNA, 20 bp, synthetic construct
  misc_feature 1..20: note = CRISPR gRNA sequence
  source 1..20: mol_type = other DNA
aaggccacacaggtaggaag

SEQ ID NO: 64725 - DNA, 20 bp, synthetic construct
  misc_feature 1..20: note = CRISPR gRNA sequence
  source 1..20: mol_type = other DNA
ggctagggttcaagcccaga

SEQ ID NO: 64726 - DNA, 20 bp, synthetic construct
  misc_feature 1..20: note = CRISPR gRNA sequence
  source 1..20: mol_type = other DNA
gggttcaagcccagacagtc

SEQ ID NO: 64727 - DNA, 20 bp, synthetic construct
  misc_feature 1..20: note = CRISPR gRNA sequence
  source 1..20: mol_type = other DNA
aagcccagacagtctggctc

SEQ ID NO: 64728 - DNA, 20 bp, synthetic construct
  misc_feature 1..20: note = CRISPR gRNA sequence
  source 1..20: mol_type = other DNA
gctcgcagcctcatcctcat

SEQ ID NO: 64729 - DNA, 20 bp, synthetic construct
  misc_feature 1..20: note = CRISPR gRNA sequence
  source 1..20: mol_type = other DNA
gcagcctcatcctcataacc

SEQ ID NO: 64730 - DNA, 20 bp, synthetic construct
  misc_feature 1..20: note = CRISPR gRNA sequence
  source 1..20: mol_type = other DNA
atcctcataaccactgctac

SEQ ID NO: 64731 - DNA, 20 bp, synthetic construct
  misc_feature 1..20: note = CRISPR gRNA sequence
  source 1..20: mol_type = other DNA
ataaccactgctacctctct

SEQ ID NO: 64732 - DNA, 20 bp, synthetic construct
  misc_feature 1..20: note = CRISPR gRNA sequence
  source 1..20: mol_type = other DNA
ctacctctcttgctgagatc

SEQ ID NO: 64733 - DNA, 20 bp, synthetic construct
  misc_feature 1..20: note = CRISPR gRNA sequence
  source 1..20: mol_type = other DNA
cctctcttgctgagatctgc

SEQ ID NO: 64734 - DNA, 20 bp, synthetic construct
  misc_feature 1..20: note = CRISPR gRNA sequence
  source 1..20: mol_type = other DNA
tcttgctgagatctgccaag

SEQ ID NO: 64735 - DNA, 20 bp, synthetic construct
  misc_feature 1..20: note = CRISPR gRNA sequence
  source 1..20: mol_type = other DNA
ttgctgagatctgccaagta

SEQ ID NO: 64736 - DNA, 20 bp, synthetic construct
  misc_feature 1..20: note = CRISPR gRNA sequence
  source 1..20: mol_type = other DNA
gctgagatctgccaagtaga

SEQ ID NO: 64737 - DNA, 20 bp, synthetic construct
  misc_feature 1..20: note = CRISPR gRNA sequence
  source 1..20: mol_type = other DNA
ctgagatctgccaagtagaa

SEQ ID NO: 64738 - DNA, 20 bp, synthetic construct
  misc_feature 1..20: note = CRISPR gRNA sequence
  source 1..20: mol_type = other DNA
agatctgccaagtagaaacc

SEQ ID NO: 64739 - DNA, 20 bp, synthetic construct
  misc_feature 1..20: note = CRISPR gRNA sequence
  source 1..20: mol_type = other DNA
ccaagtagaaaccccaccac

SEQ ID NO: 64740 - DNA, 20 bp, synthetic construct
  misc_feature 1..20: note = CRISPR gRNA sequence
  source 1..20: mol_type = other DNA
ggtctgccttccaaaccaca

SEQ ID NO: 64741 - DNA, 20 bp, synthetic construct
  misc_feature 1..20: note = CRISPR gRNA sequence
  source 1..20: mol_type = other DNA
ccttccaaaccacagtccct

SEQ ID NO: 64742 - DNA, 20 bp, synthetic construct
  misc_feature 1..20: note = CRISPR gRNA sequence
  source 1..20: mol_type = other DNA
ccaaaccacagtccctcagg

SEQ ID NO: 64743 - DNA, 20 bp, synthetic construct
  misc_feature 1..20: note = CRISPR gRNA sequence
  source 1..20: mol_type = other DNA
caaaccacagtccctcaggg

SEQ ID NO: 64744 - DNA, 20 bp, synthetic construct
  misc_feature 1..20: note = CRISPR gRNA sequence
  source 1..20: mol_type = other DNA
agggctccccccaccccctt

SEQ ID NO: 64745 - DNA, 20 bp, synthetic construct
  misc_feature 1..20: note = CRISPR gRNA sequence
  source 1..20: mol_type = other DNA
cccccacccccttcatcctt

SEQ ID NO: 64746 - DNA, 20 bp, synthetic construct
  misc_feature 1..20: note = CRISPR gRNA sequence
  source 1..20: mol_type = other DNA
catccttctcccagagtaga

SEQ ID NO: 64747 - DNA, 20 bp, synthetic construct
  misc_feature 1..20: note = CRISPR gRNA sequence
  source 1..20: mol_type = other DNA
atccttctcccagagtagag

SEQ ID NO: 64748 - DNA, 20 bp, synthetic construct
  misc_feature 1..20: note = CRISPR gRNA sequence
  source 1..20: mol_type = other DNA
ctcccagagtagagtgggat

SEQ ID NO: 64749 - DNA, 20 bp, synthetic construct
  misc_feature 1..20: note = CRISPR gRNA sequence
  source 1..20: mol_type = other DNA
tcccagagtagagtgggata

SEQ ID NO: 64750 - DNA, 20 bp, synthetic construct
  misc_feature 1..20: note = CRISPR gRNA sequence
  source 1..20: mol_type = other DNA
ccagagtagagtgggataac

SEQ ID NO: 64751 - DNA, 20 bp, synthetic construct
  misc_feature 1..20: note = CRISPR gRNA sequence
  source 1..20: mol_type = other DNA
ctcttttcgggatggagaaa

SEQ ID NO: 64752 - DNA, 20 bp, synthetic construct
  misc_feature 1..20: note = CRISPR gRNA sequence
  source 1..20: mol_type = other DNA
tcttttcgggatggagaaat

SEQ ID NO: 64753 - DNA, 20 bp, synthetic construct
  misc_feature 1..20: note = CRISPR gRNA sequence
  source 1..20: mol_type = other DNA
ttttcgggatggagaaattc

SEQ ID NO: 64754 - DNA, 20 bp, synthetic construct
  misc_feature 1..20: note = CRISPR gRNA sequence
  source 1..20: mol_type = other DNA
ttcgggatggagaaattccc

SEQ ID NO: 64755 - DNA, 20 bp, synthetic construct
  misc_feature 1..20: note = CRISPR gRNA sequence
  source 1..20: mol_type = other DNA
tcgggatggagaaattccca

SEQ ID NO: 64756 - DNA, 20 bp, synthetic construct
  misc_feature 1..20: note = CRISPR gRNA sequence
  source 1..20: mol_type = other DNA
cgggatggagaaattcccat

SEQ ID NO: 64757 - DNA, 20 bp, synthetic construct
  misc_feature 1..20: note = CRISPR gRNA sequence
  source 1..20: mol_type = other DNA
gggatggagaaattcccatg

SEQ ID NO: 64758 - DNA, 20 bp, synthetic construct
  misc_feature 1..20: note = CRISPR gRNA sequence
  source 1..20: mol_type = other DNA
ccatggcgtccagcccctgg

SEQ ID NO: 64759 - DNA, 20 bp, synthetic construct
  misc_feature 1..20: note = CRISPR gRNA sequence
  source 1..20: mol_type = other DNA
gctgaagccaataagagtag

SEQ ID NO: 64760 - DNA, 20 bp, synthetic construct
  misc_feature 1..20: note = CRISPR gRNA sequence
  source 1..20: mol_type = other DNA
aagccaataagagtagtgct

SEQ ID NO: 64761 - DNA, 20 bp, synthetic construct
  misc_feature 1..20: note = CRISPR gRNA sequence
  source 1..20: mol_type = other DNA
ggggatggacggaggctctg

SEQ ID NO: 64762 - DNA, 20 bp, synthetic construct
  misc_feature 1..20: note = CRISPR gRNA sequence
  source 1..20: mol_type = other DNA
gggatggacggaggctctgt

SEQ ID NO: 64763 - DNA, 20 bp, synthetic construct
  misc_feature 1..20: note = CRISPR gRNA sequence
  source 1..20: mol_type = other DNA
tgtcacgaccctaggagggg

SEQ ID NO: 64764 - DNA, 20 bp, synthetic construct
  misc_feature 1..20: note = CRISPR gRNA sequence
  source 1..20: mol_type = other DNA
tcacgaccctaggaggggcg

SEQ ID NO: 64765 - DNA, 20 bp, synthetic construct
  misc_feature 1..20: note = CRISPR gRNA sequence
  source 1..20: mol_type = other DNA
ggaggggcgcccctccagga

SEQ ID NO: 64766 - DNA, 20 bp, synthetic construct
  misc_feature 1..20: note = CRISPR gRNA sequence
  source 1..20: mol_type = other DNA
caggaaacctccaagtgaac

SEQ ID NO: 64767 - DNA, 20 bp, synthetic construct
  misc_feature 1..20: note = CRISPR gRNA sequence
  source 1..20: mol_type = other DNA
caagtgaacatgaaggcaga

SEQ ID NO: 64768 - DNA, 20 bp, synthetic construct
  misc_feature 1..20: note = CRISPR gRNA sequence
  source 1..20: mol_type = other DNA
tgggtcgagtggccccacct

SEQ ID NO: 64769 - DNA, 20 bp, synthetic construct
  misc_feature 1..20: note = CRISPR gRNA sequence
  source 1..20: mol_type = other DNA
ggtcgagtggccccacctca

SEQ ID NO: 64770 - DNA, 20 bp, synthetic construct
  misc_feature 1..20: note = CRISPR gRNA sequence
  source 1..20: mol_type = other DNA
agggtaagacggataggggt

SEQ ID NO: 64771 - DNA, 20 bp, synthetic construct
  misc_feature 1..20: note = CRISPR gRNA sequence
  source 1..20: mol_type = other DNA
tcgtggtgatcacctcttga

SEQ ID NO: 64772 - DNA, 20 bp, synthetic construct
  misc_feature 1..20: note = CRISPR gRNA sequence
  source 1..20: mol_type = other DNA
ttgatcctggacctcgtccc

SEQ ID NO: 64773 - DNA, 20 bp, synthetic construct
  misc_feature 1..20: note = CRISPR gRNA sequence
  source 1..20: mol_type = other DNA
gatcctggacctcgtcccat

SEQ ID NO: 64774 - DNA, 20 bp, synthetic construct
  misc_feature 1..20: note = CRISPR gRNA sequence
  source 1..20: mol_type = other DNA
atcctggacctcgtcccatt

SEQ ID NO: 64775 - DNA, 20 bp, synthetic construct
  misc_feature 1..20: note = CRISPR gRNA sequence
  source 1..20: mol_type = other DNA
gacctcgtcccattgggaga

SEQ ID NO: 64776 - DNA, 20 bp, synthetic construct
  misc_feature 1..20: note = CRISPR gRNA sequence
  source 1..20: mol_type = other DNA
gtcccattgggagaaccagg

SEQ ID NO: 64777 - DNA, 20 bp, synthetic construct
  misc_feature 1..20: note = CRISPR gRNA sequence
  source 1..20: mol_type = other DNA
ggagaaccaggacagaatta

SEQ ID NO: 64778 - DNA, 20 bp, synthetic construct
  misc_feature 1..20: note = CRISPR gRNA sequence
  source 1..20: mol_type = other DNA
gaaggtggttttttaacaag

SEQ ID NO: 64779 - DNA, 20 bp, synthetic construct
  misc_feature 1..20: note = CRISPR gRNA sequence
  source 1..20: mol_type = other DNA
tttaacaagctcacacactt

SEQ ID NO: 64780 - DNA, 20 bp, synthetic construct
  misc_feature 1..20: note = CRISPR gRNA sequence
  source 1..20: mol_type = other DNA
ttaacaagctcacacacttc

SEQ ID NO: 64781 - DNA, 20 bp, synthetic construct
  misc_feature 1..20: note = CRISPR gRNA sequence
  source 1..20: mol_type = other DNA
taacaagctcacacacttct

SEQ ID NO: 64782 - DNA, 20 bp, synthetic construct
  misc_feature 1..20: note = CRISPR gRNA sequence
  source 1..20: mol_type = other DNA
aacaagctcacacacttcta

SEQ ID NO: 64783 - DNA, 20 bp, synthetic construct
  misc_feature 1..20: note = CRISPR gRNA sequence
  source 1..20: mol_type = other DNA
acaagctcacacacttctac

SEQ ID NO: 64784 - DNA, 20 bp, synthetic construct
  misc_feature 1..20: note = CRISPR gRNA sequence
  source 1..20: mol_type = other DNA
acacacttctacctgcctca

SEQ ID NO: 64785 - DNA, 20 bp, synthetic construct
  misc_feature 1..20: note = CRISPR gRNA sequence
  source 1..20: mol_type = other DNA
ctacctgcctcaccagcact

SEQ ID NO: 64786 - DNA, 20 bp, synthetic construct
  misc_feature 1..20: note = CRISPR gRNA sequence
  source 1..20: mol_type = other DNA
tacctgcctcaccagcactg

SEQ ID NO: 64787 - DNA, 20 bp, synthetic construct
  misc_feature 1..20: note = CRISPR gRNA sequence
  source 1..20: mol_type = other DNA
cctgcctcaccagcactgag

SEQ ID NO: 64788 - DNA, 20 bp, synthetic construct
  misc_feature 1..20: note = CRISPR gRNA sequence
  source 1..20: mol_type = other DNA
cctcaccagcactgagcatg

SEQ ID NO: 64789 - DNA, 20 bp, synthetic construct
  misc_feature 1..20: note = CRISPR gRNA sequence
  source 1..20: mol_type = other DNA
accagcactgagcatgcccc

SEQ ID NO: 64790 - DNA, 20 bp, synthetic construct
  misc_feature 1..20: note = CRISPR gRNA sequence
  source 1..20: mol_type = other DNA
agcatgcccctccccgagtg

SEQ ID NO: 64791 - DNA, 20 bp, synthetic construct
  misc_feature 1..20: note = CRISPR gRNA sequence
  source 1..20: mol_type = other DNA
cccgagtgccatcacctgca

SEQ ID NO: 64792 - DNA, 20 bp, synthetic construct
  misc_feature 1..20: note = CRISPR gRNA sequence
  source 1..20: mol_type = other DNA
cagaagcagccccatcaccc

SEQ ID NO: 64793 - DNA, 20 bp, synthetic construct
  misc_feature 1..20: note = CRISPR gRNA sequence
  source 1..20: mol_type = other DNA
gttacgcagccacctcctag

SEQ ID NO: 64794 - DNA, 20 bp, synthetic construct
  misc_feature 1..20: note = CRISPR gRNA sequence
  source 1..20: mol_type = other DNA
cgcagccacctcctagcccc

SEQ ID NO: 64795 - DNA, 20 bp, synthetic construct
  misc_feature 1..20: note = CRISPR gRNA sequence
  source 1..20: mol_type = other DNA
ctagcccccttgcccttctc

SEQ ID NO: 64796 - DNA, 20 bp, synthetic construct
  misc_feature 1..20: note = CRISPR gRNA sequence
  source 1..20: mol_type = other DNA
gcccccttgcccttctccca

SEQ ID NO: 64797 - DNA, 20 bp, synthetic construct
  misc_feature 1..20: note = CRISPR gRNA sequence
  source 1..20: mol_type = other DNA
gcccttctcccacatttagt

SEQ ID NO: 64798 - DNA, 20 bp, synthetic construct
  misc_feature 1..20: note = CRISPR gRNA sequence
  source 1..20: mol_type = other DNA
cccttctcccacatttagtc

SEQ ID NO: 64799 - DNA, 20 bp, synthetic construct
  misc_feature 1..20: note = CRISPR gRNA sequence
  source 1..20: mol_type = other DNA
ctcccacatttagtccctcc

SEQ ID NO: 64800 - DNA, 20 bp, synthetic construct
  misc_feature 1..20: note = CRISPR gRNA sequence
  source 1..20: mol_type = other DNA
tcccacatttagtccctcca

SEQ ID NO: 64801 - DNA, 20 bp, synthetic construct
  misc_feature 1..20: note = CRISPR gRNA sequence
  source 1..20: mol_type = other DNA
ccacatttagtccctccaga

SEQ ID NO: 64802 - DNA, 20 bp, synthetic construct
  misc_feature 1..20: note = CRISPR gRNA sequence
  source 1..20: mol_type = other DNA
agtccctccagatggaccta

SEQ ID NO: 64803 - DNA, 20 bp, synthetic construct
  misc_feature 1..20: note = CRISPR gRNA sequence
  source 1..20: mol_type = other DNA
gtccctccagatggacctac

SEQ ID NO: 64804 - DNA, 20 bp, synthetic construct
  misc_feature 1..20: note = CRISPR gRNA sequence
  source 1..20: mol_type = other DNA
cagatggacctactggtagc

SEQ ID NO: 64805 - DNA, 20 bp, synthetic construct
  misc_feature 1..20: note = CRISPR gRNA sequence
  source 1..20: mol_type = other DNA
ctggtagcgctcaaaactat

SEQ ID NO: 64806 - DNA, 20 bp, synthetic construct
  misc_feature 1..20: note = CRISPR gRNA sequence
  source 1..20: mol_type = other DNA
gtagcgctcaaaactatcct

SEQ ID NO: 64807 - DNA, 20 bp, synthetic construct
  misc_feature 1..20: note = CRISPR gRNA sequence
  source 1..20: mol_type = other DNA
aaaactatcctcttttcctc

SEQ ID NO: 64808 - DNA, 20 bp, synthetic construct
  misc_feature 1..20: note = CRISPR gRNA sequence
  source 1..20: mol_type = other DNA
tcctcttttcctccaccttt

SEQ ID NO: 64809 - DNA, 20 bp, synthetic construct
  misc_feature 1..20: note = CRISPR gRNA sequence
  source 1..20: mol_type = other DNA
ttttcctccacctttctagt

SEQ ID NO: 64810 - DNA, 20 bp, synthetic construct
  misc_feature 1..20: note = CRISPR gRNA sequence
  source 1..20: mol_type = other DNA
ttcctccacctttctagtcc

SEQ ID NO: 64811 - DNA, 20 bp, synthetic construct
  misc_feature 1..20: note = CRISPR gRNA sequence
  source 1..20: mol_type = other DNA
tcctccacctttctagtcca

SEQ ID NO: 64812 - DNA, 20 bp, synthetic construct
  misc_feature 1..20: note = CRISPR gRNA sequence
  source 1..20: mol_type = other DNA
cctccacctttctagtccaa

SEQ ID NO: 64813 - DNA, 20 bp, synthetic construct
  misc_feature 1..20: note = CRISPR gRNA sequence
  source 1..20: mol_type = other DNA
ctccacctttctagtccaac

SEQ ID NO: 64814 - DNA, 20 bp, synthetic construct
  misc_feature 1..20: note = CRISPR gRNA sequence
  source 1..20: mol_type = other DNA
cacctttctagtccaaccca

SEQ ID NO: 64815 - DNA, 20 bp, synthetic construct
  misc_feature 1..20: note = CRISPR gRNA sequence
  source 1..20: mol_type = other DNA
tctagtccaacccaccctca

SEQ ID NO: 64816 - DNA, 20 bp, synthetic construct
  misc_feature 1..20: note = CRISPR gRNA sequence
  source 1..20: mol_type = other DNA
ctagtccaacccaccctcat

SEQ ID NO: 64817 - DNA, 20 bp, synthetic construct
  misc_feature 1..20: note = CRISPR gRNA sequence
  source 1..20: mol_type = other DNA
tagtccaacccaccctcatc

SEQ ID NO: 64818 - DNA, 20 bp, synthetic construct
  misc_feature 1..20: note = CRISPR gRNA sequence
  source 1..20: mol_type = other DNA
gtccaacccaccctcatctc

SEQ ID NO: 64819 - DNA, 20 bp, synthetic construct
  misc_feature 1..20: note = CRISPR gRNA sequence
  source 1..20: mol_type = other DNA
atctcttacctggatgaccc

SEQ ID NO: 64820 - DNA, 20 bp, synthetic construct
  misc_feature 1..20: note = CRISPR gRNA sequence
  source 1..20: mol_type = other DNA
ttacctggatgaccccctcg

SEQ ID NO: 64821 - DNA, 20 bp, synthetic construct
  misc_feature 1..20: note = CRISPR gRNA sequence
  source 1..20: mol_type = other DNA
acctggatgaccccctcgcc

SEQ ID NO: 64822 - DNA, 20 bp, synthetic construct
  misc_feature 1..20: note = CRISPR gRNA sequence
  source 1..20: mol_type = other DNA
cctggatgaccccctcgcct

SEQ ID NO: 64823 - DNA, 20 bp, synthetic construct
  misc_feature 1..20: note = CRISPR gRNA sequence
  source 1..20: mol_type = other DNA
gatgaccccctcgccttgcc

SEQ ID NO: 64824 - DNA, 20 bp, synthetic construct
  misc_feature 1..20: note = CRISPR gRNA sequence
  source 1..20: mol_type = other DNA
gccttgccttccttgctggc

SEQ ID NO: 64825 - DNA, 20 bp, synthetic construct
  misc_feature 1..20: note = CRISPR gRNA sequence
  source 1..20: mol_type = other DNA
gccttccttgctggcttccc

SEQ ID NO: 64826 - DNA, 20 bp, synthetic construct
  misc_feature 1..20: note = CRISPR gRNA sequence
  source 1..20: mol_type = other DNA
ccttccttgctggcttccct

SEQ ID NO: 64827 - DNA, 20 bp, synthetic construct
  misc_feature 1..20: note = CRISPR gRNA sequence
  source 1..20: mol_type = other DNA
ccttgctggcttccctgctt

SEQ ID NO: 64828 - DNA, 20 bp, synthetic construct
  misc_feature 1..20: note = CRISPR gRNA sequence
  source 1..20: mol_type = other DNA
cttgctggcttccctgcttt

SEQ ID NO: 64829 - DNA, 20 bp, synthetic construct
  misc_feature 1..20: note = CRISPR gRNA sequence
  source 1..20: mol_type = other DNA
gctggcttccctgctttcac

SEQ ID NO: 64830 - DNA, 20 bp, synthetic construct
  misc_feature 1..20: note = CRISPR gRNA sequence
  source 1..20: mol_type = other DNA
ctggcttccctgctttcacc

SEQ ID NO: 64831 - DNA, 20 bp, synthetic construct
  misc_feature 1..20: note = CRISPR gRNA sequence
  source 1..20: mol_type = other DNA
gcttccctgctttcaccctg

SEQ ID NO: 64832 - DNA, 20 bp, synthetic construct
  misc_feature 1..20: note = CRISPR gRNA sequence
  source 1..20: mol_type = other DNA
ccctgctttcaccctggcca

SEQ ID NO: 64833 - DNA, 20 bp, synthetic construct
  misc_feature 1..20: note = CRISPR gRNA sequence
  source 1..20: mol_type = other DNA
cctgctttcaccctggccac

SEQ ID NO: 64834 - DNA, 20 bp, synthetic construct
  misc_feature 1..20: note = CRISPR gRNA sequence
  source 1..20: mol_type = other DNA
ctttcaccctggccacttcc

SEQ ID NO: 64835 - DNA, 20 bp, synthetic construct
  misc_feature 1..20: note = CRISPR gRNA sequence
  source 1..20: mol_type = other DNA
tcaccctggccacttccacc

SEQ ID NO: 64836 - DNA, 20 bp, synthetic construct
  misc_feature 1..20: note = CRISPR gRNA sequence
  source 1..20: mol_type = other DNA
caccctggccacttccacct

SEQ ID NO: 64837 - DNA, 20 bp, synthetic construct
  misc_feature 1..20: note = CRISPR gRNA sequence
  source 1..20: mol_type = other DNA
accctggccacttccacctg

SEQ ID NO: 64838 - DNA, 20 bp, synthetic construct
  misc_feature 1..20: note = CRISPR gRNA sequence
  source 1..20: mol_type = other DNA
gccacttccacctggcagag

SEQ ID NO: 64839 - DNA, 20 bp, synthetic construct
  misc_feature 1..20: note = CRISPR gRNA sequence
  source 1..20: mol_type = other DNA
ccacctggcagagagtagat

SEQ ID NO: 64840 - DNA, 20 bp, synthetic construct
  misc_feature 1..20: note = CRISPR gRNA sequence
  source 1..20: mol_type = other DNA
cacctggcagagagtagatc

SEQ ID NO: 64841 - DNA, 20 bp, synthetic construct
  misc_feature 1..20: note = CRISPR gRNA sequence
  source 1..20: mol_type = other DNA
gcagagagtagatcactttt

SEQ ID NO: 64842 - DNA, 20 bp, synthetic construct
  misc_feature 1..20: note = CRISPR gRNA sequence
  source 1..20: mol_type = other DNA
ttcactgatgcctgccccct

SEQ ID NO: 64843 - DNA, 20 bp, synthetic construct
  misc_feature 1..20: note = CRISPR gRNA sequence
  source 1..20: mol_type = other DNA
tcactgatgcctgccccctt

SEQ ID NO: 64844 - DNA, 20 bp, synthetic construct
  misc_feature 1..20: note = CRISPR gRNA sequence
  source 1..20: mol_type = other DNA
cactgatgcctgcccccttc

SEQ ID NO: 64845 - DNA, 20 bp, synthetic construct
  misc_feature 1..20: note = CRISPR gRNA sequence
  source 1..20: mol_type = other DNA
actgatgcctgcccccttca

SEQ ID NO: 64846 - DNA, 20 bp, synthetic construct
  misc_feature 1..20: note = CRISPR gRNA sequence
  source 1..20: mol_type = other DNA
atgcctgcccccttcactcc

SEQ ID NO: 64847 - DNA, 20 bp, synthetic construct
  misc_feature 1..20: note = CRISPR gRNA sequence
  source 1..20: mol_type = other DNA
cccccttcactccttcccac

SEQ ID NO: 64848 - DNA, 20 bp, synthetic construct
  misc_feature 1..20: note = CRISPR gRNA sequence
  source 1..20: mol_type = other DNA
cactccttcccactgctcag

SEQ ID NO: 64849 - DNA, 20 bp, synthetic construct
  misc_feature 1..20: note = CRISPR gRNA sequence
  source 1..20: mol_type = other DNA
actccttcccactgctcagg

SEQ ID NO: 64850 - DNA, 20 bp, synthetic construct
  misc_feature 1..20: note = CRISPR gRNA sequence
  source 1..20: mol_type = other DNA
cttcccactgctcaggataa

SEQ ID NO: 64851 - DNA, 20 bp, synthetic construct
  misc_feature 1..20: note = CRISPR gRNA sequence
  source 1..20: mol_type = other DNA
cccactgctcaggataaaac

SEQ ID NO: 64852 - DNA, 20 bp, synthetic construct
  misc_feature 1..20: note = CRISPR gRNA sequence
  source 1..20: mol_type = other DNA
ccactgctcaggataaaacc

SEQ ID NO: 64853 - DNA, 20 bp, synthetic construct
  misc_feature 1..20: note = CRISPR gRNA sequence
  source 1..20: mol_type = other DNA
ctcaggataaaacccacatt

SEQ ID NO: 64854 - DNA, 20 bp, synthetic construct
  misc_feature 1..20: note = CRISPR gRNA sequence
  source 1..20: mol_type = other DNA
aggataaaacccacattcta

SEQ ID NO: 64855 - DNA, 20 bp, synthetic construct
  misc_feature 1..20: note = CRISPR gRNA sequence
  source 1..20: mol_type = other DNA
taaactcccaggtggtccag

SEQ ID NO: 64856 - DNA, 20 bp, synthetic construct
  misc_feature 1..20: note = CRISPR gRNA sequence
  source 1..20: mol_type = other DNA
aactcccaggtggtccagaa

SEQ ID NO: 64857 - DNA, 20 bp, synthetic construct
  misc_feature 1..20: note = CRISPR gRNA sequence
  source 1..20: mol_type = other DNA
ccaggtggtccagaaccctg

SEQ ID NO: 64858 - DNA, 20 bp, synthetic construct
  misc_feature 1..20: note = CRISPR gRNA sequence
  source 1..20: mol_type = other DNA
cccccagcctcctaaacccc

SEQ ID NO: 64859 - DNA, 20 bp, synthetic construct
  misc_feature 1..20: note = CRISPR gRNA sequence
  source 1..20: mol_type = other DNA
ctaaaccccatctgacccca

SEQ ID NO: 64860 - DNA, 20 bp, synthetic construct
  misc_feature 1..20: note = CRISPR gRNA sequence
  source 1..20: mol_type = other DNA
aaccccatctgaccccatcc

SEQ ID NO: 64861 - DNA, 20 bp, synthetic construct
  misc_feature 1..20: note = CRISPR gRNA sequence
  source 1..20: mol_type = other DNA
accccatccttccactcaat

SEQ ID NO: 64862 - DNA, 20 bp, synthetic construct
  misc_feature 1..20: note = CRISPR gRNA sequence
  source 1..20: mol_type = other DNA
ccactcaatctccaatccag

SEQ ID NO: 64863 - DNA, 20 bp, synthetic construct
  misc_feature 1..20: note = CRISPR gRNA sequence
  source 1..20: mol_type = other DNA
cactcaatctccaatccaga

SEQ ID NO: 64864 - DNA, 20 bp, synthetic construct
  misc_feature 1..20: note = CRISPR gRNA sequence
  source 1..20: mol_type = other DNA
aatctccaatccagacacac

SEQ ID NO: 64865 - DNA, 20 bp, synthetic construct
  misc_feature 1..20: note = CRISPR gRNA sequence
  source 1..20: mol_type = other DNA
caatccagacacactggctc

SEQ ID NO: 64866 - DNA, 20 bp, synthetic construct
  misc_feature 1..20: note = CRISPR gRNA sequence
  source 1..20: mol_type = other DNA
gctctctttcaggtcctcat

SEQ ID NO: 64867 - DNA, 20 bp, synthetic construct
  misc_feature 1..20: note = CRISPR gRNA sequence
  source 1..20: mol_type = other DNA
tctttcaggtcctcatatgt

SEQ ID NO: 64868 - DNA, 20 bp, synthetic construct
  misc_feature 1..20: note = CRISPR gRNA sequence
  source 1..20: mol_type = other DNA
tttcaggtcctcatatgtgt

SEQ ID NO: 64869 - DNA, 20 bp, synthetic construct
  misc_feature 1..20: note = CRISPR gRNA sequence
  source 1..20: mol_type = other DNA
tcaggtcctcatatgtgtta

SEQ ID NO: 64870 - DNA, 20 bp, synthetic construct
  misc_feature 1..20: note = CRISPR gRNA sequence
  source 1..20: mol_type = other DNA
caggtcctcatatgtgttat

SEQ ID NO: 64871 - DNA, 20 bp, synthetic construct
  misc_feature 1..20: note = CRISPR gRNA sequence
  source 1..20: mol_type = other DNA
aggtcctcatatgtgttatg

SEQ ID NO: 64872 - DNA, 20 bp, synthetic construct
  misc_feature 1..20: note = CRISPR gRNA sequence
  source 1..20: mol_type = other DNA
atatgtgttatgccacaggg

SEQ ID NO: 64873 - DNA, 20 bp, synthetic construct
  misc_feature 1..20: note = CRISPR gRNA sequence
  source 1..20: mol_type = other DNA
tgccacagggcctttgaatg

SEQ ID NO: 64874 - DNA, 20 bp, synthetic construct
  misc_feature 1..20: note = CRISPR gRNA sequence
  source 1..20: mol_type = other DNA
tgaatgtactgcttctacca

SEQ ID NO: 64875 - DNA, 20 bp, synthetic construct
  misc_feature 1..20: note = CRISPR gRNA sequence
  source 1..20: mol_type = other DNA
gaatgtactgcttctaccac

SEQ ID NO: 64876 - DNA, 20 bp, synthetic construct
  misc_feature 1..20: note = CRISPR gRNA sequence
  source 1..20: mol_type = other DNA
aatgtactgcttctaccacc

SEQ ID NO: 64877 - DNA, 20 bp, synthetic construct
  misc_feature 1..20: note = CRISPR gRNA sequence
  source 1..20: mol_type = other DNA
cttctaccaccaggaacacc

SEQ ID NO: 64878 - DNA, 20 bp, synthetic construct
  misc_feature 1..20: note = CRISPR gRNA sequence
  source 1..20: mol_type = other DNA
ctaccaccaggaacaccctt

SEQ ID NO: 64879 - DNA, 20 bp, synthetic construct
  misc_feature 1..20: note = CRISPR gRNA sequence
  source 1..20: mol_type = other DNA
taccaccaggaacacccttc

SEQ ID NO: 64880 - DNA, 20 bp, synthetic construct
  misc_feature 1..20: note = CRISPR gRNA sequence
  source 1..20: mol_type = other DNA
ccaccaggaacacccttcct

SEQ ID NO: 64881 - DNA, 20 bp, synthetic construct
  misc_feature 1..20: note = CRISPR gRNA sequence
  source 1..20: mol_type = other DNA
cctccatctctcccccaacc

SEQ ID NO: 64882 - DNA, 20 bp, synthetic construct
  misc_feature 1..20: note = CRISPR gRNA sequence
  source 1..20: mol_type = other DNA
ctccatctctcccccaacct

SEQ ID NO: 64883 - DNA, 20 bp, synthetic construct
  misc_feature 1..20: note = CRISPR gRNA sequence
  source 1..20: mol_type = other DNA
catctctcccccaacctttt

SEQ ID NO: 64884 - DNA, 20 bp, synthetic construct
  misc_feature 1..20: note = CRISPR gRNA sequence
  source 1..20: mol_type = other DNA
tcccccaaccttttacctac

SEQ ID NO: 64885 - DNA, 20 bp, synthetic construct
  misc_feature 1..20: note = CRISPR gRNA sequence
  source 1..20: mol_type = other DNA
ccccaaccttttacctactg

SEQ ID NO: 64886 - DNA, 20 bp, synthetic construct
  misc_feature 1..20: note = CRISPR gRNA sequence
  source 1..20: mol_type = other DNA
ttacctactgaactcccagt

SEQ ID NO: 64887 - DNA, 20 bp, synthetic construct
  misc_feature 1..20: note = CRISPR gRNA sequence
  source 1..20: mol_type = other DNA
tacctactgaactcccagtt

SEQ ID NO: 64888 - DNA, 20 bp, synthetic construct
  misc_feature 1..20: note = CRISPR gRNA sequence
  source 1..20: mol_type = other DNA
acctactgaactcccagtta

SEQ ID NO: 64889 - DNA, 20 bp, synthetic construct
  misc_feature 1..20: note = CRISPR gRNA sequence
  source 1..20: mol_type = other DNA
cctactgaactcccagttat

SEQ ID NO: 64890 - DNA, 20 bp, synthetic construct
  misc_feature 1..20: note = CRISPR gRNA sequence
  source 1..20: mol_type = other DNA
ctgaactcccagttatttca

SEQ ID NO: 64891 - DNA, 20 bp, synthetic construct
  misc_feature 1..20: note = CRISPR gRNA sequence
  source 1..20: mol_type = other DNA
aactcccagttatttcagca

SEQ ID NO: 64892 - DNA, 20 bp, synthetic construct
  misc_feature 1..20: note = CRISPR gRNA sequence
  source 1..20: mol_type = other DNA
ccagttatttcagcaagtag

SEQ ID NO: 64893 - DNA, 20 bp, synthetic construct
  misc_feature 1..20: note = CRISPR gRNA sequence
  source 1..20: mol_type = other DNA
tttcagcaagtagcttaagc

SEQ ID NO: 64894 - DNA, 20 bp, synthetic construct
  misc_feature 1..20: note = CRISPR gRNA sequence
  source 1..20: mol_type = other DNA
cagcaagtagcttaagcaac

SEQ ID NO: 64895 - DNA, 20 bp, synthetic construct
  misc_feature 1..20: note = CRISPR gRNA sequence
  source 1..20: mol_type = other DNA
agcaagtagcttaagcaaca

SEQ ID NO: 64896 - DNA, 20 bp, synthetic construct
  misc_feature 1..20: note = CRISPR gRNA sequence
  source 1..20: mol_type = other DNA
aagcaacaaataagccatcc

SEQ ID NO: 64897 - DNA, 20 bp, synthetic construct
  misc_feature 1..20: note = CRISPR gRNA sequence
  source 1..20: mol_type = other DNA
agcaacaaataagccatccc

SEQ ID NO: 64898 - DNA, 20 bp, synthetic construct
  misc_feature 1..20: note = CRISPR gRNA sequence
  source 1..20: mol_type = other DNA
ccagactaggtcagatgccc

SEQ ID NO: 64899 - DNA, 20 bp, synthetic construct
  misc_feature 1..20: note = CRISPR gRNA sequence
  source 1..20: mol_type = other DNA
ggtcagatgcccccataatc

SEQ ID NO: 64900 - DNA, 20 bp, synthetic construct
  misc_feature 1..20: note = CRISPR gRNA sequence
  source 1..20: mol_type = other DNA
atcacaaaaagcaattatgt

SEQ ID NO: 64901 - DNA, 20 bp, synthetic construct
  misc_feature 1..20: note = CRISPR gRNA sequence
  source 1..20: mol_type = other DNA
tcacaaaaagcaattatgta

SEQ ID NO: 64902 - DNA, 20 bp, synthetic construct
  misc_feature 1..20: note = CRISPR gRNA sequence
  source 1..20: mol_type = other DNA
tgtaacttgcagcataaagg

SEQ ID NO: 64903 - DNA, 20 bp, synthetic construct
  misc_feature 1..20: note = CRISPR gRNA sequence
  source 1..20: mol_type = other DNA
gcagcataaaggaagagttg

SEQ ID NO: 64904 - DNA, 20 bp, synthetic construct
  misc_feature 1..20: note = CRISPR gRNA sequence
  source 1..20: mol_type = other DNA
cagcataaaggaagagttga

SEQ ID NO: 64905 - DNA, 20 bp, synthetic construct
  misc_feature 1..20: note = CRISPR gRNA sequence
  source 1..20: mol_type = other DNA
agggtggggccttgaaggca

SEQ ID NO: 64906 - DNA, 20 bp, synthetic construct
  misc_feature 1..20: note = CRISPR gRNA sequence
  source 1..20: mol_type = other DNA
gaaggcaggctgcctgggtt

SEQ ID NO: 64907 - DNA, 20 bp, synthetic construct
  misc_feature 1..20: note = CRISPR gRNA sequence
  source 1..20: mol_type = other DNA
aaggcaggctgcctgggttc

SEQ ID NO: 64908 - DNA, 20 bp, synthetic construct
  misc_feature 1..20: note = CRISPR gRNA sequence
  source 1..20: mol_type = other DNA
cctgggttcaaatccaggtt

SEQ ID NO: 64909 - DNA, 20 bp, synthetic construct
  misc_feature 1..20: note = CRISPR gRNA sequence
  source 1..20: mol_type = other DNA
ggttcaaatccaggttctcc

SEQ ID NO: 64910 - DNA, 20 bp, synthetic construct
  misc_feature 1..20: note = CRISPR gRNA sequence
  source 1..20: mol_type = other DNA
aaatccaggttctccctcga

SEQ ID NO: 64911 - DNA, 20 bp, synthetic construct
  misc_feature 1..20: note = CRISPR gRNA sequence
  source 1..20: mol_type = other DNA
tccctcgagcaagtgcctta

SEQ ID NO: 64912 - DNA, 20 bp, synthetic construct
  misc_feature 1..20: note = CRISPR gRNA sequence
  source 1..20: mol_type = other DNA
cctcgagcaagtgccttaac

SEQ ID NO: 64913 - DNA, 20 bp, synthetic construct
  misc_feature 1..20: note = CRISPR gRNA sequence
  source 1..20: mol_type = other DNA
gagcaagtgccttaacttta

SEQ ID NO: 64914 - DNA, 20 bp, synthetic construct
  misc_feature 1..20: note = CRISPR gRNA sequence
  source 1..20: mol_type = other DNA
aactttactctgcacttaac

SEQ ID NO: 64915 - DNA, 20 bp, synthetic construct
  misc_feature 1..20: note = CRISPR gRNA sequence
  source 1..20: mol_type = other DNA
actttactctgcacttaacc

SEQ ID NO: 64916 - DNA, 20 bp, synthetic construct
  misc_feature 1..20: note = CRISPR gRNA sequence
  source 1..20: mol_type = other DNA
tactctgcacttaaccactc

SEQ ID NO: 64917 - DNA, 20 bp, synthetic construct
  misc_feature 1..20: note = CRISPR gRNA sequence
  source 1..20: mol_type = other DNA
actctgcacttaaccactct

SEQ ID NO: 64918 - DNA, 20 bp, synthetic construct
  misc_feature 1..20: note = CRISPR gRNA sequence
  source 1..20: mol_type = other DNA
ctctgcacttaaccactctg

SEQ ID NO: 64919 - DNA, 20 bp, synthetic construct
  misc_feature 1..20: note = CRISPR gRNA sequence
  source 1..20: mol_type = other DNA
tgcacttaaccactctgcac

SEQ ID NO: 64920 - DNA, 20 bp, synthetic construct
  misc_feature 1..20: note = CRISPR gRNA sequence
  source 1..20: mol_type = other DNA
cacttaaccactctgcactt

SEQ ID NO: 64921 - DNA, 20 bp, synthetic construct
  misc_feature 1..20: note = CRISPR gRNA sequence
  source 1..20: mol_type = other DNA
aaccactctgcacttgagtt

SEQ ID NO: 64922 - DNA, 20 bp, synthetic construct
  misc_feature 1..20: note = CRISPR gRNA sequence
  source 1..20: mol_type = other DNA
accactctgcacttgagttt

SEQ ID NO: 64923 - DNA, 20 bp, synthetic construct
  misc_feature 1..20: note = CRISPR gRNA sequence
  source 1..20: mol_type = other DNA
tgcacttgagtttactcatc

SEQ ID NO: 64924 - DNA, 20 bp, synthetic construct
  misc_feature 1..20: note = CRISPR gRNA sequence
  source 1..20: mol_type = other DNA
cacttgagtttactcatcag

SEQ ID NO: 64925 - DNA, 20 bp, synthetic construct
  misc_feature 1..20: note = CRISPR gRNA sequence
  source 1..20: mol_type = other DNA
gagtttactcatcagtaagg

SEQ ID NO: 64926 - DNA, 20 bp, synthetic construct
  misc_feature 1..20: note = CRISPR gRNA sequence
  source 1..20: mol_type = other DNA
agtttactcatcagtaaggt

SEQ ID NO: 64927 - DNA, 20 bp, synthetic construct
  misc_feature 1..20: note = CRISPR gRNA sequence
  source 1..20: mol_type = other DNA
actcatcagtaaggtgagga

SEQ ID NO: 64928 - DNA, 20 bp, synthetic construct
  misc_feature 1..20: note = CRISPR gRNA sequence
  source 1..20: mol_type = other DNA
ctcatcagtaaggtgaggat

SEQ ID NO: 64929 - DNA, 20 bp, synthetic construct
  misc_feature 1..20: note = CRISPR gRNA sequence
  source 1..20: mol_type = other DNA
atcagtaaggtgaggataat

SEQ ID NO: 64930 - DNA, 20 bp, synthetic construct
  misc_feature 1..20: note = CRISPR gRNA sequence
  source 1..20: mol_type = other DNA
cagtgcccacgtcatcggca

SEQ ID NO: 64931 - DNA, 20 bp, synthetic construct
  misc_feature 1..20: note = CRISPR gRNA sequence
  source 1..20: mol_type = other DNA
tgaggatgaaataggccaat

SEQ ID NO: 64932 - DNA, 20 bp, synthetic construct
  misc_feature 1..20: note = CRISPR gRNA sequence
  source 1..20: mol_type = other DNA
ggatgttgccaggcatgtgg

SEQ ID NO: 64933 - DNA, 20 bp, synthetic construct
  misc_feature 1..20: note = CRISPR gRNA sequence
  source 1..20: mol_type = other DNA
ccaggcatgtggtatggagt

SEQ ID NO: 64934 - DNA, 20 bp, synthetic construct
  misc_feature 1..20: note = CRISPR gRNA sequence
  source 1..20: mol_type = other DNA
tcgatttcagttattatcaa

SEQ ID NO: 64935 - DNA, 20 bp, synthetic construct
  misc_feature 1..20: note = CRISPR gRNA sequence
  source 1..20: mol_type = other DNA
cagttattatcaaggttcat

SEQ ID NO: 64936 - DNA, 20 bp, synthetic construct
  misc_feature 1..20: note = CRISPR gRNA sequence
  source 1..20: mol_type = other DNA
agttattatcaaggttcatt

SEQ ID NO: 64937 - DNA, 20 bp, synthetic construct
  misc_feature 1..20: note = CRISPR gRNA sequence
  source 1..20: mol_type = other DNA
ttatcaaggttcattcctga

SEQ ID NO: 64938 - DNA, 20 bp, synthetic construct
  misc_feature 1..20: note = CRISPR gRNA sequence
  source 1..20: mol_type = other DNA
tcaaggttcattcctgagag

SEQ ID NO: 64939 - DNA, 20 bp, synthetic construct
  misc_feature 1..20: note = CRISPR gRNA sequence
  source 1..20: mol_type = other DNA
attcctgagagtgacacttt

SEQ ID NO: 64940 - DNA, 20 bp, synthetic construct
  misc_feature 1..20: note = CRISPR gRNA sequence
  source 1..20: mol_type = other DNA
ctgagagtgacactttgact

SEQ ID NO: 64941 - DNA, 20 bp, synthetic construct
  misc_feature 1..20: note = CRISPR gRNA sequence
  source 1..20: mol_type = other DNA
agagtgacactttgactaaa

SEQ ID NO: 64942 - DNA, 20 bp, synthetic construct
  misc_feature 1..20: note = CRISPR gRNA sequence
  source 1..20: mol_type = other DNA
tgactaaagttagcaaagga

SEQ ID NO: 64943 - DNA, 20 bp, synthetic construct
  misc_feature 1..20: note = CRISPR gRNA sequence
  source 1..20: mol_type = other DNA
gactaaagttagcaaaggag

SEQ ID NO: 64944 - DNA, 20 bp, synthetic construct
  misc_feature 1..20: note = CRISPR gRNA sequence
  source 1..20: mol_type = other DNA
actaaagttagcaaaggagg

SEQ ID NO: 64945 - DNA, 20 bp, synthetic construct
  misc_feature 1..20: note = CRISPR gRNA sequence
  source 1..20: mol_type = other DNA
aagttagcaaaggaggagta

SEQ ID NO: 64946 - DNA, 20 bp, synthetic construct
  misc_feature 1..20: note = CRISPR gRNA sequence
  source 1..20: mol_type = other DNA
gcaaaggaggagtaagtgat

SEQ ID NO: 64947 - DNA, 20 bp, synthetic construct
  misc_feature 1..20: note = CRISPR gRNA sequence
  source 1..20: mol_type = other DNA
agggaggactccagccccac

SEQ ID NO: 64948 - DNA, 20 bp, synthetic construct
  misc_feature 1..20: note = CRISPR gRNA sequence
  source 1..20: mol_type = other DNA
cagccccacaatacagtgca

SEQ ID NO: 64949 - DNA, 20 bp, synthetic construct
  misc_feature 1..20: note = CRISPR gRNA sequence
  source 1..20: mol_type = other DNA
ggccccccgtctcagcctct

SEQ ID NO: 64950 - DNA, 20 bp, synthetic construct
  misc_feature 1..20: note = CRISPR gRNA sequence
  source 1..20: mol_type = other DNA
agcctctcagggaaccagct

SEQ ID NO: 64951 - DNA, 20 bp, synthetic construct
  misc_feature 1..20: note = CRISPR gRNA sequence
  source 1..20: mol_type = other DNA
tcagggaaccagctggaaga

SEQ ID NO: 64952 - DNA, 20 bp, synthetic construct
  misc_feature 1..20: note = CRISPR gRNA sequence
  source 1..20: mol_type = other DNA
agggaaccagctggaagatg

SEQ ID NO: 64953 - DNA, 20 bp, synthetic construct
  misc_feature 1..20: note = CRISPR gRNA sequence
  source 1..20: mol_type = other DNA
gaagatgaaggctgtcggct

SEQ ID NO: 64954 - DNA, 20 bp, synthetic construct
  misc_feature 1..20: note = CRISPR gRNA sequence
  source 1..20: mol_type = other DNA
tcggctgatggcagaggctg

SEQ ID NO: 64955 - DNA, 20 bp, synthetic construct
  misc_feature 1..20: note = CRISPR gRNA sequence
  source 1..20: mol_type = other DNA
atggcagaggctgcatccca

SEQ ID NO: 64956 - DNA, 20 bp, synthetic construct
  misc_feature 1..20: note = CRISPR gRNA sequence
  source 1..20: mol_type = other DNA
catcccagctgcacatcgcc

SEQ ID NO: 64957 - DNA, 20 bp, synthetic construct
  misc_feature 1..20: note = CRISPR gRNA sequence
  source 1..20: mol_type = other DNA
cacatcgccaggaagctgga

SEQ ID NO: 64958 - DNA, 20 bp, synthetic construct
  misc_feature 1..20: note = CRISPR gRNA sequence
  source 1..20: mol_type = other DNA
gagtgagttgtccaccccac

SEQ ID NO: 64959 - DNA, 20 bp, synthetic construct
  misc_feature 1..20: note = CRISPR gRNA sequence
  source 1..20: mol_type = other DNA
tccaccccaccgctgggtac

SEQ ID NO: 64960 - DNA, 20 bp, synthetic construct
  misc_feature 1..20: note = CRISPR gRNA sequence
  source 1..20: mol_type = other DNA
ggtaccagggaaggccctgt

SEQ ID NO: 64961 - DNA, 20 bp, synthetic construct
  misc_feature 1..20: note = CRISPR gRNA sequence
  source 1..20: mol_type = other DNA
tagagccccaggaggtcccc

SEQ ID NO: 64962 - DNA, 20 bp, synthetic construct
  misc_feature 1..20: note = CRISPR gRNA sequence
  source 1..20: mol_type = other DNA
gtaatcagcagtaagggtgc

SEQ ID NO: 64963 - DNA, 20 bp, synthetic construct
  misc_feature 1..20: note = CRISPR gRNA sequence
  source 1..20: mol_type = other DNA
atccactgccacccctgctt

SEQ ID NO: 64964 - DNA, 20 bp, synthetic construct
  misc_feature 1..20: note = CRISPR gRNA sequence
  source 1..20: mol_type = other DNA
ccacccctgcttcctcccaa

SEQ ID NO: 64965 - DNA, 20 bp, synthetic construct
  misc_feature 1..20: note = CRISPR gRNA sequence
  source 1..20: mol_type = other DNA
cttcctcccaactccagcaa

SEQ ID NO: 64966 - DNA, 20 bp, synthetic construct
  misc_feature 1..20: note = CRISPR gRNA sequence
  source 1..20: mol_type = other DNA
cctcccaactccagcaaagt

SEQ ID NO: 64967 - DNA, 20 bp, synthetic construct
  misc_feature 1..20: note = CRISPR gRNA sequence
  source 1..20: mol_type = other DNA
ctcccaactccagcaaagtc

SEQ ID NO: 64968 - DNA, 20 bp, synthetic construct
  misc_feature 1..20: note = CRISPR gRNA sequence
  source 1..20: mol_type = other DNA
ccaactccagcaaagtcaag

SEQ ID NO: 64969 - DNA, 20 bp, synthetic construct
  misc_feature 1..20: note = CRISPR gRNA sequence
  source 1..20: mol_type = other DNA
cagcaaagtcaagatggttt

SEQ ID NO: 64970 - DNA, 20 bp, synthetic construct
  misc_feature 1..20: note = CRISPR gRNA sequence
  source 1..20: mol_type = other DNA
gaccatgccttgccttcacc

SEQ ID NO: 64971 - DNA, 20 bp, synthetic construct
  misc_feature 1..20: note = CRISPR gRNA sequence
  source 1..20: mol_type = other DNA
accatgccttgccttcacct

SEQ ID NO: 64972 - DNA, 20 bp, synthetic construct
  misc_feature 1..20: note = CRISPR gRNA sequence
  source 1..20: mol_type = other DNA
gccttcacctccggcatgag

SEQ ID NO: 64973 - DNA, 20 bp, synthetic construct
  misc_feature 1..20: note = CRISPR gRNA sequence
  source 1..20: mol_type = other DNA
ccttcacctccggcatgagc

SEQ ID NO: 64974 - DNA, 20 bp, synthetic construct
  misc_feature 1..20: note = CRISPR gRNA sequence
  source 1..20: mol_type = other DNA
cacctccggcatgagccact

SEQ ID NO: 64975 - DNA, 20 bp, synthetic construct
  misc_feature 1..20: note = CRISPR gRNA sequence
  source 1..20: mol_type = other DNA
acctccggcatgagccactg

SEQ ID NO: 64976 - DNA, 20 bp, synthetic construct
  misc_feature 1..20: note = CRISPR gRNA sequence
  source 1..20: mol_type = other DNA
cggcatgagccactgtctta

SEQ ID NO: 64977 - DNA, 20 bp, synthetic construct
  misc_feature 1..20: note = CRISPR gRNA sequence
  source 1..20: mol_type = other DNA
tcttagtccaatcatctagc

SEQ ID NO: 64978 - DNA, 20 bp, synthetic construct
  misc_feature 1..20: note = CRISPR gRNA sequence
  source 1..20: mol_type = other DNA
agtccaatcatctagcaccc

SEQ ID NO: 64979 - DNA, 20 bp, synthetic construct
  misc_feature 1..20: note = CRISPR gRNA sequence
  source 1..20: mol_type = other DNA
gtccaatcatctagcaccct

SEQ ID NO: 64980 - DNA, 20 bp, synthetic construct
  misc_feature 1..20: note = CRISPR gRNA sequence
  source 1..20: mol_type = other DNA
gcacccttacatgtgtaaaa

SEQ ID NO: 64981 - DNA, 20 bp, synthetic construct
  misc_feature 1..20: note = CRISPR gRNA sequence
  source 1..20: mol_type = other DNA
acatgtgtaaaatgcgttca

SEQ ID NO: 64982 - DNA, 20 bp, synthetic construct
  misc_feature 1..20: note = CRISPR gRNA sequence
  source 1..20: mol_type = other DNA
catgtgtaaaatgcgttcat

SEQ ID NO: 64983 - DNA, 20 bp, synthetic construct
  misc_feature 1..20: note = CRISPR gRNA sequence
  source 1..20: mol_type = other DNA
attatacatcagtggcttgc

SEQ ID NO: 64984 - DNA, 20 bp, synthetic construct
  misc_feature 1..20: note = CRISPR gRNA sequence
  source 1..20: mol_type = other DNA
tacatcagtggcttgcattc

SEQ ID NO: 64985 - DNA, 20 bp, synthetic construct
  misc_feature 1..20: note = CRISPR gRNA sequence
  source 1..20: mol_type = other DNA
gcattccaattcatctttgt

SEQ ID NO: 64986 - DNA, 20 bp, synthetic construct
  misc_feature 1..20: note = CRISPR gRNA sequence
  source 1..20: mol_type = other DNA
cattccaattcatctttgta

SEQ ID NO: 64987 - DNA, 20 bp, synthetic construct
  misc_feature 1..20: note = CRISPR gRNA sequence
  source 1..20: mol_type = other DNA
caattcatctttgtagctgc

SEQ ID NO: 64988 - DNA, 20 bp, synthetic construct
  misc_feature 1..20: note = CRISPR gRNA sequence
  source 1..20: mol_type = other DNA
atctttgtagctgccctgga

SEQ ID NO: 64989 - DNA, 20 bp, synthetic construct
  misc_feature 1..20: note = CRISPR gRNA sequence
  source 1..20: mol_type = other DNA
tgtagctgccctggagcacg

SEQ ID NO: 64990 - DNA, 20 bp, synthetic construct
  misc_feature 1..20: note = CRISPR gRNA sequence
  source 1..20: mol_type = other DNA
gtagctgccctggagcacgg

SEQ ID NO: 64991 - DNA, 20 bp, synthetic construct
  misc_feature 1..20: note = CRISPR gRNA sequence
  source 1..20: mol_type = other DNA
tagctgccctggagcacggt

SEQ ID NO: 64992 - DNA, 20 bp, synthetic construct
  misc_feature 1..20: note = CRISPR gRNA sequence
  source 1..20: mol_type = other DNA
ccctggagcacggtggggtg

SEQ ID NO: 64993 - DNA, 20 bp, synthetic construct
  misc_feature 1..20: note = CRISPR gRNA sequence
  source 1..20: mol_type = other DNA
gagcacggtggggtggggtg

SEQ ID NO: 64994 - DNA, 20 bp, synthetic construct
  misc_feature 1..20: note = CRISPR gRNA sequence
  source 1..20: mol_type = other DNA
cactggggaggtgtcagggt

SEQ ID NO: 64995 - DNA, 20 bp, synthetic construct
  misc_feature 1..20: note = CRISPR gRNA sequence
  source 1..20: mol_type = other DNA
gggaggtgtcagggtgggtg

SEQ ID NO: 64996 - DNA, 20 bp, synthetic construct
  misc_feature 1..20: note = CRISPR gRNA sequence
  source 1..20: mol_type = other DNA
cactgtggaggtgtcatgct

SEQ ID NO: 64997 - DNA, 20 bp, synthetic construct
  misc_feature 1..20: note = CRISPR gRNA sequence
  source 1..20: mol_type = other DNA
tggaggtgtcatgctggggt

SEQ ID NO: 64998 - DNA, 20 bp, synthetic construct
  misc_feature 1..20: note = CRISPR gRNA sequence
  source 1..20: mol_type = other DNA
gggtgctagggtagggagtg

SEQ ID NO: 64999 - DNA, 20 bp, synthetic construct
  misc_feature 1..20: note = CRISPR gRNA sequence
  source 1..20: mol_type = other DNA
gggtagggagtggtgtgttc

SEQ ID NO: 65000 - DNA, 20 bp, synthetic construct
  misc_feature 1..20: note = CRISPR gRNA sequence
  source 1..20: mol_type = other DNA
ctgtggggatacactgttgg

SEQ ID NO: 65001 - DNA, 20 bp, synthetic construct
  misc_feature 1..20: note = CRISPR gRNA sequence
  source 1..20: mol_type = other DNA
tggggatacactgttggggt

SEQ ID NO: 65002 - DNA, 20 bp, synthetic construct
  misc_feature 1..20: note = CRISPR gRNA sequence
  source 1..20: mol_type = other DNA
ttggggtgaggggtggtgag

SEQ ID NO: 65003 - DNA, 20 bp, synthetic construct
  misc_feature 1..20: note = CRISPR gRNA sequence
  source 1..20: mol_type = other DNA
gggtgaggggtggtgagatg

SEQ ID NO: 65004 - DNA, 20 bp, synthetic construct
  misc_feature 1..20: note = CRISPR gRNA sequence
  source 1..20: mol_type = other DNA
ttaggctgctgggtgtgctg

SEQ ID NO: 65005 - DNA, 20 bp, synthetic construct
  misc_feature 1..20: note = CRISPR gRNA sequence
  source 1..20: mol_type = other DNA
ggctgctgggtgtgctgtgg

SEQ ID NO: 65006 - DNA, 20 bp, synthetic construct
  misc_feature 1..20: note = CRISPR gRNA sequence
  source 1..20: mol_type = other DNA
ctgggtgtgctgtggtgttg

SEQ ID NO: 65007 - DNA, 20 bp, synthetic construct
  misc_feature 1..20: note = CRISPR gRNA sequence
  source 1..20: mol_type = other DNA
ggtgtgctgtggtgttgcat

SEQ ID NO: 65008 - DNA, 20 bp, synthetic construct
  misc_feature 1..20: note = CRISPR gRNA sequence
  source 1..20: mol_type = other DNA
tggtgttgcatggggtgagg

SEQ ID NO: 65009 - DNA, 20 bp, synthetic construct
  misc_feature 1..20: note = CRISPR gRNA sequence
  source 1..20: mol_type = other DNA
catggggtgagggtgatgtt

SEQ ID NO: 65010 - DNA, 20 bp, synthetic construct
  misc_feature 1..20: note = CRISPR gRNA sequence
  source 1..20: mol_type = other DNA
gggtgggggtgtcttggggg

SEQ ID NO: 65011 - DNA, 20 bp, synthetic construct
  misc_feature 1..20: note = CRISPR gRNA sequence
  source 1..20: mol_type = other DNA
ggtgggggtgtcttgggggt

SEQ ID NO: 65012 - DNA, 20 bp, synthetic construct
  misc_feature 1..20: note = CRISPR gRNA sequence
  source 1..20: mol_type = other DNA
gggggtcttaggatcaagtg

SEQ ID NO: 65013 - DNA, 20 bp, synthetic construct
  misc_feature 1..20: note = CRISPR gRNA sequence
  source 1..20: mol_type = other DNA
ggggtcttaggatcaagtgt

SEQ ID NO: 65014 - DNA, 20 bp, synthetic construct
  misc_feature 1..20: note = CRISPR gRNA sequence
  source 1..20: mol_type = other DNA
aggatcaagtgtgggtcggg

SEQ ID NO: 65015 - DNA, 20 bp, synthetic construct
  misc_feature 1..20: note = CRISPR gRNA sequence
  source 1..20: mol_type = other DNA
ggatcaagtgtgggtcgggt

SEQ ID NO: 65016 - DNA, 20 bp, synthetic construct
  misc_feature 1..20: note = CRISPR gRNA sequence
  source 1..20: mol_type = other DNA
ggggagtgttgagattgggt

SEQ ID NO: 65017 - DNA, 20 bp, synthetic construct
  misc_feature 1..20: note = CRISPR gRNA sequence
  source 1..20: mol_type = other DNA
gggagtgttgagattgggta

SEQ ID NO: 65018 - DNA, 20 bp, synthetic construct
  misc_feature 1..20: note = CRISPR gRNA sequence
  source 1..20: mol_type = other DNA
agattgggtagcagtggttt

SEQ ID NO: 65019 - DNA, 20 bp, synthetic construct
  misc_feature 1..20: note = CRISPR gRNA sequence
  source 1..20: mol_type = other DNA
ggtagcagtggtttggggcc

SEQ ID NO: 65020 - DNA, 20 bp, synthetic construct
  misc_feature 1..20: note = CRISPR gRNA sequence
  source 1..20: mol_type = other DNA
ggggcctcagctttggattt

SEQ ID NO: 65021 - DNA, 20 bp, synthetic construct
  misc_feature 1..20: note = CRISPR gRNA sequence
  source 1..20: mol_type = other DNA
gggcctcagctttggatttc

SEQ ID NO: 65022 - DNA, 20 bp, synthetic construct
  misc_feature 1..20: note = CRISPR gRNA sequence
  source 1..20: mol_type = other DNA
agctttggatttcaatcttc

SEQ ID NO: 65023 - DNA, 20 bp, synthetic construct
  misc_feature 1..20: note = CRISPR gRNA sequence
  source 1..20: mol_type = other DNA
tggatttcaatcttcgctct

SEQ ID NO: 65024 - DNA, 20 bp, synthetic construct
  misc_feature 1..20: note = CRISPR gRNA sequence
  source 1..20: mol_type = other DNA
ggatttcaatcttcgctctg

SEQ ID NO: 65025 - DNA, 20 bp, synthetic construct
  misc_feature 1..20: note = CRISPR gRNA sequence
  source 1..20: mol_type = other DNA
gatttcaatcttcgctctgt

SEQ ID NO: 65026 - DNA, 20 bp, synthetic construct
  misc_feature 1..20: note = CRISPR gRNA sequence
  source 1..20: mol_type = other DNA
caatcttcgctctgtcactt

SEQ ID NO: 65027 - DNA, 20 bp, synthetic construct
  misc_feature 1..20: note = CRISPR gRNA sequence
  source 1..20: mol_type = other DNA
aatcttcgctctgtcactta

SEQ ID NO: 65028 - DNA, 20 bp, synthetic construct
  misc_feature 1..20: note = CRISPR gRNA sequence
  source 1..20: mol_type = other DNA
cgctctgtcacttagtagca

SEQ ID NO: 65029 - DNA, 20 bp, synthetic construct
  misc_feature 1..20: note = CRISPR gRNA sequence
  source 1..20: mol_type = other DNA
gctctgtcacttagtagcat

SEQ ID NO: 65030 - DNA, 20 bp, synthetic construct
  misc_feature 1..20: note = CRISPR gRNA sequence
  source 1..20: mol_type = other DNA
tgtcacttagtagcattgtg

SEQ ID NO: 65031 - DNA, 20 bp, synthetic construct
  misc_feature 1..20: note = CRISPR gRNA sequence
  source 1..20: mol_type = other DNA
tcacttagtagcattgtgaa

SEQ ID NO: 65032 - DNA, 20 bp, synthetic construct
  misc_feature 1..20: note = CRISPR gRNA sequence
  source 1..20: mol_type = other DNA
agtagcattgtgaacctggg

SEQ ID NO: 65033 - DNA, 20 bp, synthetic construct
  misc_feature 1..20: note = CRISPR gRNA sequence
  source 1..20: mol_type = other DNA
gtagcattgtgaacctggga

SEQ ID NO: 65034 - DNA, 20 bp, synthetic construct
  misc_feature 1..20: note = CRISPR gRNA sequence
  source 1..20: mol_type = other DNA
tgaacctgggaaagtaattg

SEQ ID NO: 65035 - DNA, 20 bp, synthetic construct
  misc_feature 1..20: note = CRISPR gRNA sequence
  source 1..20: mol_type = other DNA
ggaaagtaattgaatgtctc

SEQ ID NO: 65036 - DNA, 20 bp, synthetic construct
  misc_feature 1..20: note = CRISPR gRNA sequence
  source 1..20: mol_type = other DNA
aatgtctctgggcctcggtt

SEQ ID NO: 65037 - DNA, 20 bp, synthetic construct
  misc_feature 1..20: note = CRISPR gRNA sequence
  source 1..20: mol_type = other DNA
tgggcctcggtttcccctct

SEQ ID NO: 65038 - DNA, 20 bp, synthetic construct
  misc_feature 1..20: note = CRISPR gRNA sequence
  source 1..20: mol_type = other DNA
ggcctcggtttcccctctgt

SEQ ID NO: 65039 - DNA, 20 bp, synthetic construct
  misc_feature 1..20: note = CRISPR gRNA sequence
  source 1..20: mol_type = other DNA
ggtttcccctctgtaaaatg

SEQ ID NO: 65040 - DNA, 20 bp, synthetic construct
  misc_feature 1..20: note = CRISPR gRNA sequence
  source 1..20: mol_type = other DNA
cccctctgtaaaatgggatc

SEQ ID NO: 65041 - DNA, 20 bp, synthetic construct
  misc_feature 1..20: note = CRISPR gRNA sequence
  source 1..20: mol_type = other DNA
ccctctgtaaaatgggatca

SEQ ID NO: 65042 - DNA, 20 bp, synthetic construct
  misc_feature 1..20: note = CRISPR gRNA sequence
  source 1..20: mol_type = other DNA
tgtaaaatgggatcacatga

SEQ ID NO: 65043 - DNA, 20 bp, synthetic construct
  misc_feature 1..20: note = CRISPR gRNA sequence
  source 1..20: mol_type = other DNA
taaaatgggatcacatgaaa

SEQ ID NO: 65044 - DNA, 20 bp, synthetic construct
  misc_feature 1..20: note = CRISPR gRNA sequence
  source 1..20: mol_type = other DNA
ttgtacagagtctggtatag

SEQ ID NO: 65045 - DNA, 20 bp, synthetic construct
  misc_feature 1..20: note = CRISPR gRNA sequence
  source 1..20: mol_type = other DNA
tgtacagagtctggtatagt

SEQ ID NO: 65046 - DNA, 20 bp, synthetic construct
  misc_feature 1..20: note = CRISPR gRNA sequence
  source 1..20: mol_type = other DNA
gtacagagtctggtatagtc

SEQ ID NO: 65047 - DNA, 20 bp, synthetic construct
  misc_feature 1..20: note = CRISPR gRNA sequence
  source 1..20: mol_type = other DNA
tacagagtctggtatagtca

SEQ ID NO: 65048 - DNA, 20 bp, synthetic construct
  misc_feature 1..20: note = CRISPR gRNA sequence
  source 1..20: mol_type = other DNA
gtatagtcagggctcagaaa

SEQ ID NO: 65049 - DNA, 20 bp, synthetic construct
  misc_feature 1..20: note = CRISPR gRNA sequence
  source 1..20: mol_type = other DNA
agaaaatggtggttatttta

SEQ ID NO: 65050 - DNA, 20 bp, synthetic construct
  misc_feature 1..20: note = CRISPR gRNA sequence
  source 1..20: mol_type = other DNA
ttttacagatgagaaaactg

SEQ ID NO: 65051 - DNA, 20 bp, synthetic construct
  misc_feature 1..20: note = CRISPR gRNA sequence
  source 1..20: mol_type = other DNA
tacagatgagaaaactgggg

SEQ ID NO: 65052 - DNA, 20 bp, synthetic construct
  misc_feature 1..20: note = CRISPR gRNA sequence
  source 1..20: mol_type = other DNA
acagatgagaaaactggggg

SEQ ID NO: 65053 - DNA, 20 bp, synthetic construct
  misc_feature 1..20: note = CRISPR gRNA sequence
  source 1..20: mol_type = other DNA
cagatgagaaaactgggggt

SEQ ID NO: 65054 - DNA, 20 bp, synthetic construct
  misc_feature 1..20: note = CRISPR gRNA sequence
  source 1..20: mol_type = other DNA
ggggtcagagaggtgaaaac

SEQ ID NO: 65055 - DNA, 20 bp, synthetic construct
  misc_feature 1..20: note = CRISPR gRNA sequence
  source 1..20: mol_type = other DNA
agttcttgctgtcaagctgg

SEQ ID NO: 65056 - DNA, 20 bp, synthetic construct
  misc_feature 1..20: note = CRISPR gRNA sequence
  source 1..20: mol_type = other DNA
ttgctgtcaagctggacaac

SEQ ID NO: 65057 - DNA, 20 bp, synthetic construct
  misc_feature 1..20: note = CRISPR gRNA sequence
  source 1..20: mol_type = other DNA
gctgtcaagctggacaactt

SEQ ID NO: 65058 - DNA, 20 bp, synthetic construct
  misc_feature 1..20: note = CRISPR gRNA sequence
  source 1..20: mol_type = other DNA
ctgtcaagctggacaacttt

SEQ ID NO: 65059 - DNA, 20 bp, synthetic construct
  misc_feature 1..20: note = CRISPR gRNA sequence
  source 1..20: mol_type = other DNA
tcaagctggacaactttatt

SEQ ID NO: 65060 - DNA, 20 bp, synthetic construct
  misc_feature 1..20: note = CRISPR gRNA sequence
  source 1..20: mol_type = other DNA
gacaactttattttccaaat

SEQ ID NO: 65061 - DNA, 20 bp, synthetic construct
  misc_feature 1..20: note = CRISPR gRNA sequence
  source 1..20: mol_type = other DNA
tattttccaaatgggatggg

SEQ ID NO: 65062 - DNA, 20 bp, synthetic construct
  misc_feature 1..20: note = CRISPR gRNA sequence
  source 1..20: mol_type = other DNA
attttccaaatgggatgggg

SEQ ID NO: 65063 - DNA, 20 bp, synthetic construct
  misc_feature 1..20: note = CRISPR gRNA sequence
  source 1..20: mol_type = other DNA
ttttccaaatgggatggggg

SEQ ID NO: 65064 - DNA, 20 bp, synthetic construct
  misc_feature 1..20: note = CRISPR gRNA sequence
  source 1..20: mol_type = other DNA
tccaaatgggatgggggtgt

SEQ ID NO: 65065 - DNA, 20 bp, synthetic construct
  misc_feature 1..20: note = CRISPR gRNA sequence
  source 1..20: mol_type = other DNA
ccaaatgggatgggggtgtc

SEQ ID NO: 65066 - DNA, 20 bp, synthetic construct
  misc_feature 1..20: note = CRISPR gRNA sequence
  source 1..20: mol_type = other DNA
caaatgggatgggggtgtca

SEQ ID NO: 65067 - DNA, 20 bp, synthetic construct
  misc_feature 1..20: note = CRISPR gRNA sequence
  source 1..20: mol_type = other DNA
tttggcttactcacacgcac

SEQ ID NO: 65068 - DNA, 20 bp, synthetic construct
  misc_feature 1..20: note = CRISPR gRNA sequence
  source 1..20: mol_type = other DNA
ttggcttactcacacgcacc

SEQ ID NO: 65069 - DNA, 20 bp, synthetic construct
  misc_feature 1..20: note = CRISPR gRNA sequence
  source 1..20: mol_type = other DNA
tggcttactcacacgcacca

SEQ ID NO: 65070 - DNA, 20 bp, synthetic construct
  misc_feature 1..20: note = CRISPR gRNA sequence
  source 1..20: mol_type = other DNA
ggcttactcacacgcaccag

SEQ ID NO: 65071 - DNA, 20 bp, synthetic construct
  misc_feature 1..20: note = CRISPR gRNA sequence
  source 1..20: mol_type = other DNA
gcttactcacacgcaccaga

SEQ ID NO: 65072 - DNA, 20 bp, synthetic construct
  misc_feature 1..20: note = CRISPR gRNA sequence
  source 1..20: mol_type = other DNA
actcacacgcaccagaatcc

SEQ ID NO: 65073 - DNA, 20 bp, synthetic construct
  misc_feature 1..20: note = CRISPR gRNA sequence
  source 1..20: mol_type = other DNA
ctcacacgcaccagaatcct

SEQ ID NO: 65074 - DNA, 20 bp, synthetic construct
  misc_feature 1..20: note = CRISPR gRNA sequence
  source 1..20: mol_type = other DNA
acacgcaccagaatcctttg

SEQ ID NO: 65075 - DNA, 20 bp, synthetic construct
  misc_feature 1..20: note = CRISPR gRNA sequence
  source 1..20: mol_type = other DNA
tgagatcccctggcaaggga

SEQ ID NO: 65076 - DNA, 20 bp, synthetic construct
  misc_feature 1..20: note = CRISPR gRNA sequence
  source 1..20: mol_type = other DNA
gagatcccctggcaagggac

SEQ ID NO: 65077 - DNA, 20 bp, synthetic construct
  misc_feature 1..20: note = CRISPR gRNA sequence
  source 1..20: mol_type = other DNA
agatcccctggcaagggacc

SEQ ID NO: 65078 - DNA, 20 bp, synthetic construct
  misc_feature 1..20: note = CRISPR gRNA sequence
  source 1..20: mol_type = other DNA
gcaagggacctaggacatcc

SEQ ID NO: 65079 - DNA, 20 bp, synthetic construct
  misc_feature 1..20: note = CRISPR gRNA sequence
  source 1..20: mol_type = other DNA
ggacatccaggagtgacagc

SEQ ID NO: 65080 - DNA, 20 bp, synthetic construct
  misc_feature 1..20: note = CRISPR gRNA sequence
  source 1..20: mol_type = other DNA
ctgagccacagggaggggct

SEQ ID NO: 65081 - DNA, 20 bp, synthetic construct
  misc_feature 1..20: note = CRISPR gRNA sequence
  source 1..20: mol_type = other DNA
agccacagggaggggctaga

SEQ ID NO: 65082 - DNA, 20 bp, synthetic construct
  misc_feature 1..20: note = CRISPR gRNA sequence
  source 1..20: mol_type = other DNA
gagctggctggggctgggta

SEQ ID NO: 65083 - DNA, 20 bp, synthetic construct
  misc_feature 1..20: note = CRISPR gRNA sequence
  source 1..20: mol_type = other DNA
gctggggctgggtacctcag

SEQ ID NO: 65084 - DNA, 20 bp, synthetic construct
  misc_feature 1..20: note = CRISPR gRNA sequence
  source 1..20: mol_type = other DNA
gggctgggtacctcagccac

SEQ ID NO: 65085 - DNA, 20 bp, synthetic construct
  misc_feature 1..20: note = CRISPR gRNA sequence
  source 1..20: mol_type = other DNA
ggtacctcagccacatgcca

SEQ ID NO: 65086 - DNA, 20 bp, synthetic construct
  misc_feature 1..20: note = CRISPR gRNA sequence
  source 1..20: mol_type = other DNA
agccacatgccaacggctgc

SEQ ID NO: 65087 - DNA, 20 bp, synthetic construct
  misc_feature 1..20: note = CRISPR gRNA sequence
  source 1..20: mol_type = other DNA
ccttctcctgctctccacag

SEQ ID NO: 65088 - DNA, 20 bp, synthetic construct
  misc_feature 1..20: note = CRISPR gRNA sequence
  source 1..20: mol_type = other DNA
ctcctgctctccacagcctc

SEQ ID NO: 65089 - DNA, 20 bp, synthetic construct
  misc_feature 1..20: note = CRISPR gRNA sequence
  source 1..20: mol_type = other DNA
tcctgctctccacagcctca

SEQ ID NO: 65090 - DNA, 20 bp, synthetic construct
  misc_feature 1..20: note = CRISPR gRNA sequence
  source 1..20: mol_type = other DNA
ctgctctccacagcctcagt

SEQ ID NO: 65091 - DNA, 20 bp, synthetic construct
  misc_feature 1..20: note = CRISPR gRNA sequence
  source 1..20: mol_type = other DNA
ctctccacagcctcagtaac

SEQ ID NO: 65092 - DNA, 20 bp, synthetic construct
  misc_feature 1..20: note = CRISPR gRNA sequence
  source 1..20: mol_type = other DNA
tccacagcctcagtaacaac

SEQ ID NO: 65093 - DNA, 20 bp, synthetic construct
  misc_feature 1..20: note = CRISPR gRNA sequence
  source 1..20: mol_type = other DNA
cacagcctcagtaacaacgg

SEQ ID NO: 65094 - DNA, 20 bp, synthetic construct
  misc_feature 1..20: note = CRISPR gRNA sequence
  source 1..20: mol_type = other DNA
agtaacaacgggctttctgt

SEQ ID NO: 65095 - DNA, 20 bp, synthetic construct
  misc_feature 1..20: note = CRISPR gRNA sequence
  source 1..20: mol_type = other DNA
tctgtggccggggtgcattg

SEQ ID NO: 65096 - DNA, 20 bp, synthetic construct
  misc_feature 1..20: note = CRISPR gRNA sequence
  source 1..20: mol_type = other DNA
ctgtggccggggtgcattgt

SEQ ID NO: 65097 - DNA, 20 bp, synthetic construct
  misc_feature 1..20: note = CRISPR gRNA sequence
  source 1..20: mol_type = other DNA
tgtggccggggtgcattgtg

SEQ ID NO: 65098 - DNA, 20 bp, synthetic construct
  misc_feature 1..20: note = CRISPR gRNA sequence
  source 1..20: mol_type = other DNA
tggccggggtgcattgtgtg

SEQ ID NO: 65099 - DNA, 20 bp, synthetic construct
  misc_feature 1..20: note = CRISPR gRNA sequence
  source 1..20: mol_type = other DNA
tgtgctgagggccgtgagtg

SEQ ID NO: 65100 - DNA, 20 bp, synthetic construct
  misc_feature 1..20: note = CRISPR gRNA sequence
  source 1..20: mol_type = other DNA
agggccgtgagtgcgtgctg

SEQ ID NO: 65101 - DNA, 20 bp, synthetic construct
  misc_feature 1..20: note = CRISPR gRNA sequence
  source 1..20: mol_type = other DNA
gaccctggcagagctgcaca

SEQ ID NO: 65102 - DNA, 20 bp, synthetic construct
  misc_feature 1..20: note = CRISPR gRNA sequence
  source 1..20: mol_type = other DNA
gcagagctgcacatcaggtg

SEQ ID NO: 65103 - DNA, 20 bp, synthetic construct
  misc_feature 1..20: note = CRISPR gRNA sequence
  source 1..20: mol_type = other DNA
cacatcaggtgggagctccc

SEQ ID NO: 65104 - DNA, 20 bp, synthetic construct
  misc_feature 1..20: note = CRISPR gRNA sequence
  source 1..20: mol_type = other DNA
cctcagaccacggtacccat

SEQ ID NO: 65105 - DNA, 20 bp, synthetic construct
  misc_feature 1..20: note = CRISPR gRNA sequence
  source 1..20: mol_type = other DNA
agaccacggtacccatcccc

SEQ ID NO: 65106 - DNA, 20 bp, synthetic construct
  misc_feature 1..20: note = CRISPR gRNA sequence
  source 1..20: mol_type = other DNA
tctctgaagcccttggaatt

SEQ ID NO: 65107 - DNA, 20 bp, synthetic construct
  misc_feature 1..20: note = CRISPR gRNA sequence
  source 1..20: mol_type = other DNA
tctgaagcccttggaattcc

SEQ ID NO: 65108 - DNA, 20 bp, synthetic construct
  misc_feature 1..20: note = CRISPR gRNA sequence
  source 1..20: mol_type = other DNA
tgaagcccttggaattcctt

SEQ ID NO: 65109 - DNA, 20 bp, synthetic construct
  misc_feature 1..20: note = CRISPR gRNA sequence
  source 1..20: mol_type = other DNA
aagcccttggaattccttct

SEQ ID NO: 65110 - DNA, 20 bp, synthetic construct
  misc_feature 1..20: note = CRISPR gRNA sequence
  source 1..20: mol_type = other DNA
ggaattccttctgggcccag

SEQ ID NO: 65111 - DNA, 20 bp, synthetic construct
  misc_feature 1..20: note = CRISPR gRNA sequence
  source 1..20: mol_type = other DNA
gaattccttctgggcccagg

SEQ ID NO: 65112 - DNA, 20 bp, synthetic construct
  misc_feature 1..20: note = CRISPR gRNA sequence
  source 1..20: mol_type = other DNA
cttctgggcccaggccttgg

SEQ ID NO: 65113 - DNA, 20 bp, synthetic construct
  misc_feature 1..20: note = CRISPR gRNA sequence
  source 1..20: mol_type = other DNA
ctgggcccaggccttgggac

SEQ ID NO: 65114 - DNA, 20 bp, synthetic construct
  misc_feature 1..20: note = CRISPR gRNA sequence
  source 1..20: mol_type = other DNA
tgggcccaggccttgggacg

SEQ ID NO: 65115 - DNA, 20 bp, synthetic construct
  misc_feature 1..20: note = CRISPR gRNA sequence
  source 1..20: mol_type = other DNA
ggcccaggccttgggacggg

SEQ ID NO: 65116 - DNA, 20 bp, synthetic construct
  misc_feature 1..20: note = CRISPR gRNA sequence
  source 1..20: mol_type = other DNA
gggacgggcagaagatgctg

SEQ ID NO: 65117 - DNA, 20 bp, synthetic construct
  misc_feature 1..20: note = CRISPR gRNA sequence
  source 1..20: mol_type = other DNA
ggacgggcagaagatgctgc

SEQ ID NO: 65118 - DNA, 20 bp, synthetic construct
  misc_feature 1..20: note = CRISPR gRNA sequence
  source 1..20: mol_type = other DNA
ctgctgtcccacccagaccc

SEQ ID NO: 65119 - DNA, 20 bp, synthetic construct
  misc_feature 1..20: note = CRISPR gRNA sequence
  source 1..20: mol_type = other DNA
ctgtcccacccagaccccgt

SEQ ID NO: 65120 - DNA, 20 bp, synthetic construct
  misc_feature 1..20: note = CRISPR gRNA sequence
  source 1..20: mol_type = other DNA
tcccacccagaccccgttac

SEQ ID NO: 65121 - DNA, 20 bp, synthetic construct
  misc_feature 1..20: note = CRISPR gRNA sequence
  source 1..20: mol_type = other DNA
cagccggcacccctcttcct

SEQ ID NO: 65122 - DNA, 20 bp, synthetic construct
  misc_feature 1..20: note = CRISPR gRNA sequence
  source 1..20: mol_type = other DNA
ttcctagctgctgtggatat

SEQ ID NO: 65123 - DNA, 20 bp, synthetic construct
  misc_feature 1..20: note = CRISPR gRNA sequence
  source 1..20: mol_type = other DNA
cctagctgctgtggatatag

SEQ ID NO: 65124 - DNA, 20 bp, synthetic construct
  misc_feature 1..20: note = CRISPR gRNA sequence
  source 1..20: mol_type = other DNA
ctagctgctgtggatatagg

SEQ ID NO: 65125 - DNA, 20 bp, synthetic construct
  misc_feature 1..20: note = CRISPR gRNA sequence
  source 1..20: mol_type = other DNA
gctgctgtggatataggctg

SEQ ID NO: 65126 - DNA, 20 bp, synthetic construct
  misc_feature 1..20: note = CRISPR gRNA sequence
  source 1..20: mol_type = other DNA
ctgtggatataggctgctca

SEQ ID NO: 65127 - DNA, 20 bp, synthetic construct
  misc_feature 1..20: note = CRISPR gRNA sequence
  source 1..20: mol_type = other DNA
tggatataggctgctcatgg

SEQ ID NO: 65128 - DNA, 20 bp, synthetic construct
  misc_feature 1..20: note = CRISPR gRNA sequence
  source 1..20: mol_type = other DNA
ctcatggtttatacctctgg

SEQ ID NO: 65129 - DNA, 20 bp, synthetic construct
  misc_feature 1..20: note = CRISPR gRNA sequence
  source 1..20: mol_type = other DNA
atggtttatacctctggaga

SEQ ID NO: 65130 - DNA, 20 bp, synthetic construct
  misc_feature 1..20: note = CRISPR gRNA sequence
  source 1..20: mol_type = other DNA
atacctctggagaactaccc

SEQ ID NO: 65131 - DNA, 20 bp, synthetic construct
  misc_feature 1..20: note = CRISPR gRNA sequence
  source 1..20: mol_type = other DNA
tacctctggagaactaccct

SEQ ID NO: 65132 - DNA, 20 bp, synthetic construct
  misc_feature 1..20: note = CRISPR gRNA sequence
  source 1..20: mol_type = other DNA
tggagaactacccttggctg

SEQ ID NO: 65133 - DNA, 20 bp, synthetic construct
  misc_feature 1..20: note = CRISPR gRNA sequence
  source 1..20: mol_type = other DNA
gagaactacccttggctgat

SEQ ID NO: 65134 - DNA, 20 bp, synthetic construct
  misc_feature 1..20: note = CRISPR gRNA sequence
  source 1..20: mol_type = other DNA
cccttggctgataagaacca

SEQ ID NO: 65135 - DNA, 20 bp, synthetic construct
  misc_feature 1..20: note = CRISPR gRNA sequence
  source 1..20: mol_type = other DNA
ggctgataagaaccagagac

SEQ ID NO: 65136 - DNA, 20 bp, synthetic construct
  misc_feature 1..20: note = CRISPR gRNA sequence
  source 1..20: mol_type = other DNA
gctgataagaaccagagacg

SEQ ID NO: 65137 - DNA, 20 bp, synthetic construct
  misc_feature 1..20: note = CRISPR gRNA sequence
  source 1..20: mol_type = other DNA
ataagaaccagagacgcctg

SEQ ID NO: 65138 - DNA, 20 bp, synthetic construct
  misc_feature 1..20: note = CRISPR gRNA sequence
  source 1..20: mol_type = other DNA
gcagggtacaacccccactt

SEQ ID NO: 65139 - DNA, 20 bp, synthetic construct
  misc_feature 1..20: note = CRISPR gRNA sequence
  source 1..20: mol_type = other DNA
tcccctaacctagagtggcc

SEQ ID NO: 65140 - DNA, 20 bp, synthetic construct
  misc_feature 1..20: note = CRISPR gRNA sequence
  source 1..20: mol_type = other DNA
cccctaacctagagtggcca

SEQ ID NO: 65141 - DNA, 20 bp, synthetic construct
  misc_feature 1..20: note = CRISPR gRNA sequence
  source 1..20: mol_type = other DNA
ccctaacctagagtggccaa

SEQ ID NO: 65142 - DNA, 20 bp, synthetic construct
  misc_feature 1..20: note = CRISPR gRNA sequence
  source 1..20: mol_type = other DNA
acctagagtggccaatgaca

SEQ ID NO: 65143 - DNA, 20 bp, synthetic construct
  misc_feature 1..20: note = CRISPR gRNA sequence
  source 1..20: mol_type = other DNA
gagtggccaatgacagaggc

SEQ ID NO: 65144 - DNA, 20 bp, synthetic construct
  misc_feature 1..20: note = CRISPR gRNA sequence
  source 1..20: mol_type = other DNA
tccagcccaaactctccagt

SEQ ID NO: 65145 - DNA, 20 bp, synthetic construct
  misc_feature 1..20: note = CRISPR gRNA sequence
  source 1..20: mol_type = other DNA
cagcccaaactctccagtgg

SEQ ID NO: 65146 - DNA, 20 bp, synthetic construct
  misc_feature 1..20: note = CRISPR gRNA sequence
  source 1..20: mol_type = other DNA
tccagtgggacaaagctccc

SEQ ID NO: 65147 - DNA, 20 bp, synthetic construct
  misc_feature 1..20: note = CRISPR gRNA sequence
  source 1..20: mol_type = other DNA
cagtgggacaaagctccctg

SEQ ID NO: 65148 - DNA, 20 bp, synthetic construct
  misc_feature 1..20: note = CRISPR gRNA sequence
  source 1..20: mol_type = other DNA
cctgggagactaggccaagg

SEQ ID NO: 65149 - DNA, 20 bp, synthetic construct
  misc_feature 1..20: note = CRISPR gRNA sequence
  source 1..20: mol_type = other DNA
ggagactaggccaaggactt

SEQ ID NO: 65150 - DNA, 20 bp, synthetic construct
  misc_feature 1..20: note = CRISPR gRNA sequence
  source 1..20: mol_type = other DNA
ggccaaggacttgctccgtt

SEQ ID NO: 65151 - DNA, 20 bp, synthetic construct
  misc_feature 1..20: note = CRISPR gRNA sequence
  source 1..20: mol_type = other DNA
gctccgtttggcttccctca

SEQ ID NO: 65152 - DNA, 20 bp, synthetic construct
  misc_feature 1..20: note = CRISPR gRNA sequence
  source 1..20: mol_type = other DNA
ctccgtttggcttccctcag

SEQ ID NO: 65153 - DNA, 20 bp, synthetic construct
  misc_feature 1..20: note = CRISPR gRNA sequence
  source 1..20: mol_type = other DNA
cgtttggcttccctcagtcc

SEQ ID NO: 65154 - DNA, 20 bp, synthetic construct
  misc_feature 1..20: note = CRISPR gRNA sequence
  source 1..20: mol_type = other DNA
ggcttccctcagtcccttac

SEQ ID NO: 65155 - DNA, 20 bp, synthetic construct
  misc_feature 1..20: note = CRISPR gRNA sequence
  source 1..20: mol_type = other DNA
gcttccctcagtcccttact

SEQ ID NO: 65156 - DNA, 20 bp, synthetic construct
  misc_feature 1..20: note = CRISPR gRNA sequence
  source 1..20: mol_type = other DNA
ccctcagtcccttactgttt

SEQ ID NO: 65157 - DNA, 20 bp, synthetic construct
  misc_feature 1..20: note = CRISPR gRNA sequence
  source 1..20: mol_type = other DNA
cctcagtcccttactgtttc

SEQ ID NO: 65158 - DNA, 20 bp, synthetic construct
  misc_feature 1..20: note = CRISPR gRNA sequence
  source 1..20: mol_type = other DNA
agtcccttactgtttctcct

SEQ ID NO: 65159 - DNA, 20 bp, synthetic construct
  misc_feature 1..20: note = CRISPR gRNA sequence
  source 1..20: mol_type = other DNA
actgtttctcctgagagcag

SEQ ID NO: 65160 - DNA, 20 bp, synthetic construct
  misc_feature 1..20: note = CRISPR gRNA sequence
  source 1..20: mol_type = other DNA
ctgtttctcctgagagcaga

SEQ ID NO: 65161 - DNA, 20 bp, synthetic construct
  misc_feature 1..20: note = CRISPR gRNA sequence
  source 1..20: mol_type = other DNA
tttctcctgagagcagaccg

SEQ ID NO: 65162 - DNA, 20 bp, synthetic construct
  misc_feature 1..20: note = CRISPR gRNA sequence
  source 1..20: mol_type = other DNA
ctcctgagagcagaccgtca

SEQ ID NO: 65163 - DNA, 20 bp, synthetic construct
  misc_feature 1..20: note = CRISPR gRNA sequence
  source 1..20: mol_type = other DNA
tcctgagagcagaccgtcag

SEQ ID NO: 65164 - DNA, 20 bp, synthetic construct
  misc_feature 1..20: note = CRISPR gRNA sequence
  source 1..20: mol_type = other DNA
ctgagagcagaccgtcagtt

SEQ ID NO: 65165 - DNA, 20 bp, synthetic construct
  misc_feature 1..20: note = CRISPR gRNA sequence
  source 1..20: mol_type = other DNA
agagcagaccgtcagttcat

SEQ ID NO: 65166 - DNA, 20 bp, synthetic construct
  misc_feature 1..20: note = CRISPR gRNA sequence
  source 1..20: mol_type = other DNA
atgatgtgcgcaactgacaa

SEQ ID NO: 65167 - DNA, 20 bp, synthetic construct
  misc_feature 1..20: note = CRISPR gRNA sequence
  source 1..20: mol_type = other DNA
acaagtgacatgcgaccccc

SEQ ID NO: 65168 - DNA, 20 bp, synthetic construct
  misc_feature 1..20: note = CRISPR gRNA sequence
  source 1..20: mol_type = other DNA
ccccactcacagacccaggc

SEQ ID NO: 65169 - DNA, 20 bp, synthetic construct
  misc_feature 1..20: note = CRISPR gRNA sequence
  source 1..20: mol_type = other DNA
acagacccaggctctgccac

SEQ ID NO: 65170 - DNA, 20 bp, synthetic construct
  misc_feature 1..20: note = CRISPR gRNA sequence
  source 1..20: mol_type = other DNA
tgccactagggaacccaatc

SEQ ID NO: 65171 - DNA, 20 bp, synthetic construct
  misc_feature 1..20: note = CRISPR gRNA sequence
  source 1..20: mol_type = other DNA
ccactagggaacccaatcct

SEQ ID NO: 65172 - DNA, 20 bp, synthetic construct
  misc_feature 1..20: note = CRISPR gRNA sequence
  source 1..20: mol_type = other DNA
gggaacccaatcctatttct

SEQ ID NO: 65173 - DNA, 20 bp, synthetic construct
  misc_feature 1..20: note = CRISPR gRNA sequence
  source 1..20: mol_type = other DNA
tttctgtaagtctcgccgtt

SEQ ID NO: 65174 - DNA, 20 bp, synthetic construct
  misc_feature 1..20: note = CRISPR gRNA sequence
  source 1..20: mol_type = other DNA
ctgtaagtctcgccgttgag

SEQ ID NO: 65175 - DNA, 20 bp, synthetic construct
  misc_feature 1..20: note = CRISPR gRNA sequence
  source 1..20: mol_type = other DNA
tgtaagtctcgccgttgagt

SEQ ID NO: 65176 - DNA, 20 bp, synthetic construct
  misc_feature 1..20: note = CRISPR gRNA sequence
  source 1..20: mol_type = other DNA
taagtctcgccgttgagtat

SEQ ID NO: 65177 - DNA, 20 bp, synthetic construct
  misc_feature 1..20: note = CRISPR gRNA sequence
  source 1..20: mol_type = other DNA
gccgttgagtatggggaggt

SEQ ID NO: 65178 - DNA, 20 bp, synthetic construct
  misc_feature 1..20: note = CRISPR gRNA sequence
  source 1..20: mol_type = other DNA
agtatggggaggtgaggaca

SEQ ID NO: 65179 - DNA, 20 bp, synthetic construct
  misc_feature 1..20: note = CRISPR gRNA sequence
  source 1..20: mol_type = other DNA
atgtcaactcagttcccact

SEQ ID NO: 65180 - DNA, 20 bp, synthetic construct
  misc_feature 1..20: note = CRISPR gRNA sequence
  source 1..20: mol_type = other DNA
agttcccactcggaggaaag

SEQ ID NO: 65181 - DNA, 20 bp, synthetic construct
  misc_feature 1..20: note = CRISPR gRNA sequence
  source 1..20: mol_type = other DNA
ccactcggaggaaagcctca

SEQ ID NO: 65182 - DNA, 20 bp, synthetic construct
  misc_feature 1..20: note = CRISPR gRNA sequence
  source 1..20: mol_type = other DNA
ggaggaaagcctcattctca

SEQ ID NO: 65183 - DNA, 20 bp, synthetic construct
  misc_feature 1..20: note = CRISPR gRNA sequence
  source 1..20: mol_type = other DNA
attctcaacccagtagggtg

SEQ ID NO: 65184 - DNA, 20 bp, synthetic construct
  misc_feature 1..20: note = CRISPR gRNA sequence
  source 1..20: mol_type = other DNA
tcaacccagtagggtggtcc

SEQ ID NO: 65185 - DNA, 20 bp, synthetic construct
  misc_feature 1..20: note = CRISPR gRNA sequence
  source 1..20: mol_type = other DNA
aacccagtagggtggtccct

SEQ ID NO: 65186 - DNA, 20 bp, synthetic construct
  misc_feature 1..20: note = CRISPR gRNA sequence
  source 1..20: mol_type = other DNA
ctttaaacacccctcaaggg

SEQ ID NO: 65187 - DNA, 20 bp, synthetic construct
  misc_feature 1..20: note = CRISPR gRNA sequence
  source 1..20: mol_type = other DNA
taaacacccctcaagggagg

SEQ ID NO: 65188 - DNA, 20 bp, synthetic construct
  misc_feature 1..20: note = CRISPR gRNA sequence
  source 1..20: mol_type = other DNA
aaacacccctcaagggagga

SEQ ID NO: 65189 - DNA, 20 bp, synthetic construct
  misc_feature 1..20: note = CRISPR gRNA sequence
  source 1..20: mol_type = other DNA
aacacccctcaagggaggag

SEQ ID NO: 65190 - DNA, 20 bp, synthetic construct
  misc_feature 1..20: note = CRISPR gRNA sequence
  source 1..20: mol_type = other DNA
aagggaggagagggaaaccg

SEQ ID NO: 65191 - DNA, 20 bp, synthetic construct
  misc_feature 1..20: note = CRISPR gRNA sequence
  source 1..20: mol_type = other DNA
acccaaaaggtagattaggg

SEQ ID NO: 65192 - DNA, 20 bp, synthetic construct
  misc_feature 1..20: note = CRISPR gRNA sequence
  source 1..20: mol_type = other DNA
ggggaccttggttcactgta

SEQ ID NO: 65193 - DNA, 20 bp, synthetic construct
  misc_feature 1..20: note = CRISPR gRNA sequence
  source 1..20: mol_type = other DNA
ggttcactgtatatgatgat

SEQ ID NO: 65194 - DNA, 20 bp, synthetic construct
  misc_feature 1..20: note = CRISPR gRNA sequence
  source 1..20: mol_type = other DNA
gttcactgtatatgatgatt

SEQ ID NO: 65195 - DNA, 20 bp, synthetic construct
  misc_feature 1..20: note = CRISPR gRNA sequence
  source 1..20: mol_type = other DNA
actgtatatgatgattcaat

SEQ ID NO: 65196 - DNA, 20 bp, synthetic construct
  misc_feature 1..20: note = CRISPR gRNA sequence
  source 1..20: mol_type = other DNA
tatatgatgattcaataaag

SEQ ID NO: 65197 - DNA, 20 bp, synthetic construct
  misc_feature 1..20: note = CRISPR gRNA sequence
  source 1..20: mol_type = other DNA
aataaagggtccctagtgca

SEQ ID NO: 65198 - DNA, 20 bp, synthetic construct
  misc_feature 1..20: note = CRISPR gRNA sequence
  source 1..20: mol_type = other DNA
gtgcattccaagcgatgccc

SEQ ID NO: 65199 - DNA, 20 bp, synthetic construct
  misc_feature 1..20: note = CRISPR gRNA sequence
  source 1..20: mol_type = other DNA
caagcgatgccctgttcact

SEQ ID NO: 65200 - DNA, 20 bp, synthetic construct
  misc_feature 1..20: note = CRISPR gRNA sequence
  source 1..20: mol_type = other DNA
ttcacttccaggaacttata

SEQ ID NO: 65201 - DNA, 20 bp, synthetic construct
  misc_feature 1..20: note = CRISPR gRNA sequence
  source 1..20: mol_type = other DNA
acttccaggaacttatacta

SEQ ID NO: 65202 - DNA, 20 bp, synthetic construct
  misc_feature 1..20: note = CRISPR gRNA sequence
  source 1..20: mol_type = other DNA
ccaggaacttatactaaata

SEQ ID NO: 65203 - DNA, 20 bp, synthetic construct
  misc_feature 1..20: note = CRISPR gRNA sequence
  source 1..20: mol_type = other DNA
caggaacttatactaaataa

SEQ ID NO: 65204 - DNA, 20 bp, synthetic construct
  misc_feature 1..20: note = CRISPR gRNA sequence
  source 1..20: mol_type = other DNA
atactaaataaattatcacg

SEQ ID NO: 65205 - DNA, 20 bp, synthetic construct
  misc_feature 1..20: note = CRISPR gRNA sequence
  source 1..20: mol_type = other DNA
tactaaataaattatcacga

SEQ ID NO: 65206 - DNA, 20 bp, synthetic construct
  misc_feature 1..20: note = CRISPR gRNA sequence
  source 1..20: mol_type = other DNA
aataaattatcacgattgtg

SEQ ID NO: 65207 - DNA, 20 bp, synthetic construct
  misc_feature 1..20: note = CRISPR gRNA sequence
  source 1..20: mol_type = other DNA
tcacgattgtgcaaacacat

SEQ ID NO: 65208 - DNA, 20 bp, synthetic construct
  misc_feature 1..20: note = CRISPR gRNA sequence
  source 1..20: mol_type = other DNA
tgcaaacacatttagctgta

SEQ ID NO: 65209 - DNA, 20 bp, synthetic construct
  misc_feature 1..20: note = CRISPR gRNA sequence
  source 1..20: mol_type = other DNA
agctgtagggatgttcacct

SEQ ID NO: 65210 - DNA, 20 bp, synthetic construct
  misc_feature 1..20: note = CRISPR gRNA sequence
  source 1..20: mol_type = other DNA
gctgtagggatgttcacctc

SEQ ID NO: 65211 - DNA, 20 bp, synthetic construct
  misc_feature 1..20: note = CRISPR gRNA sequence
  source 1..20: mol_type = other DNA
tagggatgttcacctcagta

SEQ ID NO: 65212 - DNA, 20 bp, synthetic construct
  misc_feature 1..20: note = CRISPR gRNA sequence
  source 1..20: mol_type = other DNA
acctcagtattggttataat

SEQ ID NO: 65213 - DNA, 20 bp, synthetic construct
  misc_feature 1..20: note = CRISPR gRNA sequence
  source 1..20: mol_type = other DNA
agtattggttataataggaa

SEQ ID NO: 65214 - DNA, 20 bp, synthetic construct
  misc_feature 1..20: note = CRISPR gRNA sequence
  source 1..20: mol_type = other DNA
gttataataggaaaaaaaaa

SEQ ID NO: 65215 - DNA, 20 bp, synthetic construct
  misc_feature 1..20: note = CRISPR gRNA sequence
  source 1..20: mol_type = other DNA
taataggaaaaaaaaagaaa

SEQ ID NO: 65216 - DNA, 20 bp, synthetic construct
  misc_feature 1..20: note = CRISPR gRNA sequence
  source 1..20: mol_type = other DNA
gaatgtttaaccgagggata

SEQ ID NO: 65217 - DNA, 20 bp, synthetic construct
  misc_feature 1..20: note = CRISPR gRNA sequence
  source 1..20: mol_type = other DNA
aaccgagggatattagttag

SEQ ID NO: 65218 - DNA, 20 bp, synthetic construct
  misc_feature 1..20: note = CRISPR gRNA sequence
  source 1..20: mol_type = other DNA
accgagggatattagttaga

SEQ ID NO: 65219 - DNA, 20 bp, synthetic construct
  misc_feature 1..20: note = CRISPR gRNA sequence
  source 1..20: mol_type = other DNA
gttagactaagttacttcca

SEQ ID NO: 65220 - DNA, 20 bp, synthetic construct
  misc_feature 1..20: note = CRISPR gRNA sequence
  source 1..20: mol_type = other DNA
gactaagttacttccagaga

SEQ ID NO: 65221 - DNA, 20 bp, synthetic construct
  misc_feature 1..20: note = CRISPR gRNA sequence
  source 1..20: mol_type = other DNA
agttacttccagagagaact

SEQ ID NO: 65222 - DNA, 20 bp, synthetic construct
  misc_feature 1..20: note = CRISPR gRNA sequence
  source 1..20: mol_type = other DNA
cttccagagagaactcagtg

SEQ ID NO: 65223 - DNA, 20 bp, synthetic construct
  misc_feature 1..20: note = CRISPR gRNA sequence
  source 1..20: mol_type = other DNA
ccagagagaactcagtggaa

SEQ ID NO: 65224 - DNA, 20 bp, synthetic construct
  misc_feature 1..20: note = CRISPR gRNA sequence
  source 1..20: mol_type = other DNA
cagagagaactcagtggaac

SEQ ID NO: 65225 - DNA, 20 bp, synthetic construct
  misc_feature 1..20: note = CRISPR gRNA sequence
  source 1..20: mol_type = other DNA
agtggaaccatagaaaaaaa

SEQ ID NO: 65226 - DNA, 20 bp, synthetic construct
  misc_feature 1..20: note = CRISPR gRNA sequence
  source 1..20: mol_type = other DNA
caatatggaggggtgacggg

SEQ ID NO: 65227 - DNA, 20 bp, synthetic construct
  misc_feature 1..20: note = CRISPR gRNA sequence
  source 1..20: mol_type = other DNA
aatatggaggggtgacgggg

SEQ ID NO: 65228 - DNA, 20 bp, synthetic construct
  misc_feature 1..20: note = CRISPR gRNA sequence
  source 1..20: mol_type = other DNA
ttaagtaaacataaagaaat

SEQ ID NO: 65229 - DNA, 20 bp, synthetic construct
  misc_feature 1..20: note = CRISPR gRNA sequence
  source 1..20: mol_type = other DNA
agtaaacataaagaaatttc

SEQ ID NO: 65230 - DNA, 20 bp, synthetic construct
  misc_feature 1..20: note = CRISPR gRNA sequence
  source 1..20: mol_type = other DNA
ctttagagacaggatcttgc

SEQ ID NO: 65231 - DNA, 20 bp, synthetic construct
  misc_feature 1..20: note = CRISPR gRNA sequence
  source 1..20: mol_type = other DNA
tttagagacaggatcttgct

SEQ ID NO: 65232 - DNA, 20 bp, synthetic construct
  misc_feature 1..20: note = CRISPR gRNA sequence
  source 1..20: mol_type = other DNA
tagagacaggatcttgctct

SEQ ID NO: 65233 - DNA, 20 bp, synthetic construct
  misc_feature 1..20: note = CRISPR gRNA sequence
  source 1..20: mol_type = other DNA
agagacaggatcttgctctg

SEQ ID NO: 65234 - DNA, 20 bp, synthetic construct
  misc_feature 1..20: note = CRISPR gRNA sequence
  source 1..20: mol_type = other DNA
gagacaggatcttgctctgt

SEQ ID NO: 65235 - DNA, 20 bp, synthetic construct
  misc_feature 1..20: note = CRISPR gRNA sequence
  source 1..20: mol_type = other DNA
gctctgttaccaaggctgga

SEQ ID NO: 65236 - DNA, 20 bp, synthetic construct
  misc_feature 1..20: note = CRISPR gRNA sequence
  source 1..20: mol_type = other DNA
ctctgttaccaaggctggag

SEQ ID NO: 65237 - DNA, 20 bp, synthetic construct
  misc_feature 1..20: note = CRISPR gRNA sequence
  source 1..20: mol_type = other DNA
tgttaccaaggctggagtac

SEQ ID NO: 65238 - DNA, 20 bp, synthetic construct
  misc_feature 1..20: note = CRISPR gRNA sequence
  source 1..20: mol_type = other DNA
ttaccaaggctggagtacag

SEQ ID NO: 65239 - DNA, 20 bp, synthetic construct
  misc_feature 1..20: note = CRISPR gRNA sequence
  source 1..20: mol_type = other DNA
ccaaggctggagtacagtga

SEQ ID NO: 65240 - DNA, 20 bp, synthetic construct
  misc_feature 1..20: note = CRISPR gRNA sequence
  source 1..20: mol_type = other DNA
gagtacagtgacacaatcac

SEQ ID NO: 65241 - DNA, 20 bp, synthetic construct
  misc_feature 1..20: note = CRISPR gRNA sequence
  source 1..20: mol_type = other DNA
actgtaacctccaaatcctg

SEQ ID NO: 65242 - DNA, 20 bp, synthetic construct
  misc_feature 1..20: note = CRISPR gRNA sequence
  source 1..20: mol_type = other DNA
taacctccaaatcctgggct

SEQ ID NO: 65243 - DNA, 20 bp, synthetic construct
  misc_feature 1..20: note = CRISPR gRNA sequence
  source 1..20: mol_type = other DNA
caaatcctgggctcagcaat

SEQ ID NO: 65244 - DNA, 20 bp, synthetic construct
  misc_feature 1..20: note = CRISPR gRNA sequence
  source 1..20: mol_type = other DNA
ggctcagcaatccatctctc

SEQ ID NO: 65245 - DNA, 20 bp, synthetic construct
  misc_feature 1..20: note = CRISPR gRNA sequence
  source 1..20: mol_type = other DNA
agcaatccatctctcttagt

SEQ ID NO: 65246 - DNA, 20 bp, synthetic construct
  misc_feature 1..20: note = CRISPR gRNA sequence
  source 1..20: mol_type = other DNA
tcttagtctcccaaagtgct

SEQ ID NO: 65247 - DNA, 20 bp, synthetic construct
  misc_feature 1..20: note = CRISPR gRNA sequence
  source 1..20: mol_type = other DNA
ttagtctcccaaagtgctgg

SEQ ID NO: 65248 - DNA, 20 bp, synthetic construct
  misc_feature 1..20: note = CRISPR gRNA sequence
  source 1..20: mol_type = other DNA
agtctcccaaagtgctggga

SEQ ID NO: 65249 - DNA, 20 bp, synthetic construct
  misc_feature 1..20: note = CRISPR gRNA sequence
  source 1..20: mol_type = other DNA
gtctcccaaagtgctgggat

SEQ ID NO: 65250 - DNA, 20 bp, synthetic construct
  misc_feature 1..20: note = CRISPR gRNA sequence
  source 1..20: mol_type = other DNA
ccaaagtgctgggattacag

SEQ ID NO: 65251 - DNA, 20 bp, synthetic construct
  misc_feature 1..20: note = CRISPR gRNA sequence
  source 1..20: mol_type = other DNA
ggattacagtcatgagtcac

SEQ ID NO: 65252 - DNA, 20 bp, synthetic construct
  misc_feature 1..20: note = CRISPR gRNA sequence
  source 1..20: mol_type = other DNA
cagtcatgagtcactatgcc

SEQ ID NO: 65253 - DNA, 20 bp, synthetic construct
  misc_feature 1..20: note = CRISPR gRNA sequence
  source 1..20: mol_type = other DNA
tgcctggcaattttttttat

SEQ ID NO: 65254 - DNA, 20 bp, synthetic construct
  misc_feature 1..20: note = CRISPR gRNA sequence
  source 1..20: mol_type = other DNA
gcaattttttttatttttag

SEQ ID NO: 65255 - DNA, 20 bp, synthetic construct
  misc_feature 1..20: note = CRISPR gRNA sequence
  source 1..20: mol_type = other DNA
tttttatttttagtagagag

SEQ ID NO: 65256 - DNA, 20 bp, synthetic construct
  misc_feature 1..20: note = CRISPR gRNA sequence
  source 1..20: mol_type = other DNA
ttttatttttagtagagaga

SEQ ID NO: 65257 - DNA, 20 bp, synthetic construct
  misc_feature 1..20: note = CRISPR gRNA sequence
  source 1..20: mol_type = other DNA
tttatttttagtagagagag

SEQ ID NO: 65258 - DNA, 20 bp, synthetic construct
  misc_feature 1..20: note = CRISPR gRNA sequence
  source 1..20: mol_type = other DNA
ttatttttagtagagagagg

SEQ ID NO: 65259 - DNA, 20 bp, synthetic construct
  misc_feature 1..20: note = CRISPR gRNA sequence
  source 1..20: mol_type = other DNA
tatttttagtagagagaggg

SEQ ID NO: 65260 - DNA, 20 bp, synthetic construct
  misc_feature 1..20: note = CRISPR gRNA sequence
  source 1..20: mol_type = other DNA
atttttagtagagagagggt

SEQ ID NO: 65261 - DNA, 20 bp, synthetic construct
  misc_feature 1..20: note = CRISPR gRNA sequence
  source 1..20: mol_type = other DNA
tttttagtagagagagggtc

SEQ ID NO: 65262 - DNA, 20 bp, synthetic construct
  misc_feature 1..20: note = CRISPR gRNA sequence
  source 1..20: mol_type = other DNA
ttagtagagagagggtcttg

SEQ ID NO: 65263 - DNA, 20 bp, synthetic construct
  misc_feature 1..20: note = CRISPR gRNA sequence
  source 1..20: mol_type = other DNA
tagtagagagagggtcttgc

SEQ ID NO: 65264 - DNA, 20 bp, synthetic construct
  misc_feature 1..20: note = CRISPR gRNA sequence
  source 1..20: mol_type = other DNA
agtagagagagggtcttgct

SEQ ID NO: 65265 - DNA, 20 bp, synthetic construct
  misc_feature 1..20: note = CRISPR gRNA sequence
  source 1..20: mol_type = other DNA
gtagagagagggtcttgcta

SEQ ID NO: 65266 - DNA, 20 bp, synthetic construct
  misc_feature 1..20: note = CRISPR gRNA sequence
  source 1..20: mol_type = other DNA
gctatattgaccaggctgtt

SEQ ID NO: 65267 - DNA, 20 bp, synthetic construct
  misc_feature 1..20: note = CRISPR gRNA sequence
  source 1..20: mol_type = other DNA
ctatattgaccaggctgttc

SEQ ID NO: 65268 - DNA, 20 bp, synthetic construct
  misc_feature 1..20: note = CRISPR gRNA sequence
  source 1..20: mol_type = other DNA
tattgaccaggctgttctca

SEQ ID NO: 65269 - DNA, 20 bp, synthetic construct
  misc_feature 1..20: note = CRISPR gRNA sequence
  source 1..20: mol_type = other DNA
accaggctgttctcaaactc

SEQ ID NO: 65270 - DNA, 20 bp, synthetic construct
  misc_feature 1..20: note = CRISPR gRNA sequence
  source 1..20: mol_type = other DNA
ttctcaaactcccgagctca

SEQ ID NO: 65271 - DNA, 20 bp, synthetic construct
  misc_feature 1..20: note = CRISPR gRNA sequence
  source 1..20: mol_type = other DNA
tcaaactcccgagctcatgt

SEQ ID NO: 65272 - DNA, 20 bp, synthetic construct
  misc_feature 1..20: note = CRISPR gRNA sequence
  source 1..20: mol_type = other DNA
aaactcccgagctcatgtga

SEQ ID NO: 65273 - DNA, 20 bp, synthetic construct
  misc_feature 1..20: note = CRISPR gRNA sequence
  source 1..20: mol_type = other DNA
ccgagctcatgtgatcctcc

SEQ ID NO: 65274 - DNA, 20 bp, synthetic construct
  misc_feature 1..20: note = CRISPR gRNA sequence
  source 1..20: mol_type = other DNA
atgtgatcctcctgccctgg

SEQ ID NO: 65275 - DNA, 20 bp, synthetic construct
  misc_feature 1..20: note = CRISPR gRNA sequence
  source 1..20: mol_type = other DNA
ctgccctggcctcccaaaga

SEQ ID NO: 65276 - DNA, 20 bp, synthetic construct
  misc_feature 1..20: note = CRISPR gRNA sequence
  source 1..20: mol_type = other DNA
ccctggcctcccaaagagca

SEQ ID NO: 65277 - DNA, 20 bp, synthetic construct
  misc_feature 1..20: note = CRISPR gRNA sequence
  source 1..20: mol_type = other DNA
gcctcccaaagagcaaggat

SEQ ID NO: 65278 - DNA, 20 bp, synthetic construct
  misc_feature 1..20: note = CRISPR gRNA sequence
  source 1..20: mol_type = other DNA
ccaaagagcaaggattatag

SEQ ID NO: 65279 - DNA, 20 bp, synthetic construct
  misc_feature 1..20: note = CRISPR gRNA sequence
  source 1..20: mol_type = other DNA
taggtatgaaccactgcacc

SEQ ID NO: 65280 - DNA, 20 bp, synthetic construct
  misc_feature 1..20: note = CRISPR gRNA sequence
  source 1..20: mol_type = other DNA
caccaggccaaacataaaaa

SEQ ID NO: 65281 - DNA, 20 bp, synthetic construct
  misc_feature 1..20: note = CRISPR gRNA sequence
  source 1..20: mol_type = other DNA
taactcattatcttaaaaga

SEQ ID NO: 65282 - DNA, 20 bp, synthetic construct
  misc_feature 1..20: note = CRISPR gRNA sequence
  source 1..20: mol_type = other DNA
aactcattatcttaaaagat

SEQ ID NO: 65283 - DNA, 20 bp, synthetic construct
  misc_feature 1..20: note = CRISPR gRNA sequence
  source 1..20: mol_type = other DNA
actcattatcttaaaagatt

SEQ ID NO: 65284 - DNA, 20 bp, synthetic construct
  misc_feature 1..20: note = CRISPR gRNA sequence
  source 1..20: mol_type = other DNA
attatcttaaaagattataa

SEQ ID NO: 65285 - DNA, 20 bp, synthetic construct
  misc_feature 1..20: note = CRISPR gRNA sequence
  source 1..20: mol_type = other DNA
tcttaaaagattataaaaga

SEQ ID NO: 65286 - DNA, 20 bp, synthetic construct
  misc_feature 1..20: note = CRISPR gRNA sequence
  source 1..20: mol_type = other DNA
aaaagattataaaagattat

SEQ ID NO: 65287 - DNA, 20 bp, synthetic construct
  misc_feature 1..20: note = CRISPR gRNA sequence
  source 1..20: mol_type = other DNA
aaagattataaaagattata

SEQ ID NO: 65288 - DNA, 20 bp, synthetic construct
  misc_feature 1..20: note = CRISPR gRNA sequence
  source 1..20: mol_type = other DNA
taaaagattataataaagct

SEQ ID NO: 65289 - DNA, 20 bp, synthetic construct
  misc_feature 1..20: note = CRISPR gRNA sequence
  source 1..20: mol_type = other DNA
taataaagcttttcaagata

SEQ ID NO: 65290 - DNA, 20 bp, synthetic construct
  misc_feature 1..20: note = CRISPR gRNA sequence
  source 1..20: mol_type = other DNA
ttcaagatatgcaatggcag

SEQ ID NO: 65291 - DNA, 20 bp, synthetic construct
  misc_feature 1..20: note = CRISPR gRNA sequence
  source 1..20: mol_type = other DNA
tcaagatatgcaatggcaga

SEQ ID NO: 65292 - DNA, 20 bp, synthetic construct
  misc_feature 1..20: note = CRISPR gRNA sequence
  source 1..20: mol_type = other DNA
caagatatgcaatggcagaa

SEQ ID NO: 65293 - DNA, 20 bp, synthetic construct
  misc_feature 1..20: note = CRISPR gRNA sequence
  source 1..20: mol_type = other DNA
aagatatgcaatggcagaaa

SEQ ID NO: 65294 - DNA, 20 bp, synthetic construct
  misc_feature 1..20: note = CRISPR gRNA sequence
  source 1..20: mol_type = other DNA
ggccaggtgctgtggctcat

SEQ ID NO: 65295 - DNA, 20 bp, synthetic construct
  misc_feature 1..20: note = CRISPR gRNA sequence
  source 1..20: mol_type = other DNA
tggctcatgctgtaaaccca

SEQ ID NO: 65296 - DNA, 20 bp, synthetic construct
  misc_feature 1..20: note = CRISPR gRNA sequence
  source 1..20: mol_type = other DNA
atgctgtaaacccagcactt

SEQ ID NO: 65297 - DNA, 20 bp, synthetic construct
  misc_feature 1..20: note = CRISPR gRNA sequence
  source 1..20: mol_type = other DNA
taaacccagcactttgggag

SEQ ID NO: 65298 - DNA, 20 bp, synthetic construct
  misc_feature 1..20: note = CRISPR gRNA sequence
  source 1..20: mol_type = other DNA
tgggaggctgaggcaggggg

SEQ ID NO: 65299 - DNA, 20 bp, synthetic construct
  misc_feature 1..20: note = CRISPR gRNA sequence
  source 1..20: mol_type = other DNA
gggaggctgaggcaggggga

SEQ ID NO: 65300 - DNA, 20 bp, synthetic construct
  misc_feature 1..20: note = CRISPR gRNA sequence
  source 1..20: mol_type = other DNA
ggaggctgaggcagggggat

SEQ ID NO: 65301 - DNA, 20 bp, synthetic construct
  misc_feature 1..20: note = CRISPR gRNA sequence
  source 1..20: mol_type = other DNA
aggcagggggatcacctgag

SEQ ID NO: 65302 - DNA, 20 bp, synthetic construct
  misc_feature 1..20: note = CRISPR gRNA sequence
  source 1..20: mol_type = other DNA
aggtcaggagttcaagacca

SEQ ID NO: 65303 - DNA, 20 bp, synthetic construct
  misc_feature 1..20: note = CRISPR gRNA sequence
  source 1..20: mol_type = other DNA
aagaccagcctggccaatag

SEQ ID NO: 65304 - DNA, 20 bp, synthetic construct
  misc_feature 1..20: note = CRISPR gRNA sequence
  source 1..20: mol_type = other DNA
gccaataggatgaaaccccg

SEQ ID NO: 65305 - DNA, 20 bp, synthetic construct
  misc_feature 1..20: note = CRISPR gRNA sequence
  source 1..20: mol_type = other DNA
tactaaaaatacaaaaacta

SEQ ID NO: 65306 - DNA, 20 bp, synthetic construct
  misc_feature 1..20: note = CRISPR gRNA sequence
  source 1..20: mol_type = other DNA
ctaaaaatacaaaaactagc

SEQ ID NO: 65307 - DNA, 20 bp, synthetic construct
  misc_feature 1..20: note = CRISPR gRNA sequence
  source 1..20: mol_type = other DNA
aaaatacaaaaactagctgg

SEQ ID NO: 65308 - DNA, 20 bp, synthetic construct
  misc_feature 1..20: note = CRISPR gRNA sequence
  source 1..20: mol_type = other DNA
gctgggcatggtggcgtgca

SEQ ID NO: 65309 - DNA, 20 bp, synthetic construct
  misc_feature 1..20: note = CRISPR gRNA sequence
  source 1..20: mol_type = other DNA
ggcatggtggcgtgcacctg

SEQ ID NO: 65310 - DNA, 20 bp, synthetic construct
  misc_feature 1..20: note = CRISPR gRNA sequence
  source 1..20: mol_type = other DNA
taattccagctactcaggag

SEQ ID NO: 65311 - DNA, 20 bp, synthetic construct
  misc_feature 1..20: note = CRISPR gRNA sequence
  source 1..20: mol_type = other DNA
cagctactcaggaggctgag

SEQ ID NO: 65312 - DNA, 20 bp, synthetic construct
  misc_feature 1..20: note = CRISPR gRNA sequence
  source 1..20: mol_type = other DNA
ctcaggaggctgaggcagga

SEQ ID NO: 65313 - DNA, 20 bp, synthetic construct
  misc_feature 1..20: note = CRISPR gRNA sequence
  source 1..20: mol_type = other DNA
aggaggctgaggcaggagaa

SEQ ID NO: 65314 - DNA, 20 bp, synthetic construct
  misc_feature 1..20: note = CRISPR gRNA sequence
  source 1..20: mol_type = other DNA
aggcaggagaatcgctggaa

SEQ ID NO: 65315 - DNA, 20 bp, synthetic construct
  misc_feature 1..20: note = CRISPR gRNA sequence
  source 1..20: mol_type = other DNA
gaacctgggaggcggaggtt

SEQ ID NO: 65316 - DNA, 20 bp, synthetic construct
  misc_feature 1..20: note = CRISPR gRNA sequence
  source 1..20: mol_type = other DNA
ggaggcggaggttgcagtga

SEQ ID NO: 65317 - DNA, 20 bp, synthetic construct
  misc_feature 1..20: note = CRISPR gRNA sequence
  source 1..20: mol_type = other DNA
cagtgagccgagatcatgcc

SEQ ID NO: 65318 - DNA, 20 bp, synthetic construct
  misc_feature 1..20: note = CRISPR gRNA sequence
  source 1..20: mol_type = other DNA
cactccagcctgggagacag

SEQ ID NO: 65319 - DNA, 20 bp, synthetic construct
  misc_feature 1..20: note = CRISPR gRNA sequence
  source 1..20: mol_type = other DNA
cagcctgggagacagagcaa

SEQ ID NO: 65320 - DNA, 20 bp, synthetic construct
  misc_feature 1..20: note = CRISPR gRNA sequence
  source 1..20: mol_type = other DNA
ggagacagagcaagactctg

SEQ ID NO: 65321 - DNA, 20 bp, synthetic construct
  misc_feature 1..20: note = CRISPR gRNA sequence
  source 1..20: mol_type = other DNA
tgtctcaaattaaaaaaaaa

SEQ ID NO: 65322 - DNA, 20 bp, synthetic construct
  misc_feature 1..20: note = CRISPR gRNA sequence
  source 1..20: mol_type = other DNA
tctcaaattaaaaaaaaaaa

SEQ ID NO: 65323 - DNA, 20 bp, synthetic construct
  misc_feature 1..20: note = CRISPR gRNA sequence
  source 1..20: mol_type = other DNA
aaattaaaaaaaaaaaaaaa

SEQ ID NO: 65324 - DNA, 20 bp, synthetic construct
  misc_feature 1..20: note = CRISPR gRNA sequence
  source 1..20: mol_type = other DNA
aaaaaaaaaaaaaaaaaaga

SEQ ID NO: 65325 - DNA, 20 bp, synthetic construct
  misc_feature 1..20: note = CRISPR gRNA sequence
  source 1..20: mol_type = other DNA
ttcccatcaataatgatcaa

SEQ ID NO: 65326 - DNA, 20 bp, synthetic construct
  misc_feature 1..20: note = CRISPR gRNA sequence
  source 1..20: mol_type = other DNA
ccatcaataatgatcaagta

SEQ ID NO: 65327 - DNA, 20 bp, synthetic construct
  misc_feature 1..20: note = CRISPR gRNA sequence
  source 1..20: mol_type = other DNA
ataattatttgtcatccctg

SEQ ID NO: 65328 - DNA, 20 bp, synthetic construct
  misc_feature 1..20: note = CRISPR gRNA sequence
  source 1..20: mol_type = other DNA
tttgtcatccctgcttctag

SEQ ID NO: 65329 - DNA, 20 bp, synthetic construct
  misc_feature 1..20: note = CRISPR gRNA sequence
  source 1..20: mol_type = other DNA
gtcatccctgcttctagccc

SEQ ID NO: 65330 - DNA, 20 bp, synthetic construct
  misc_feature 1..20: note = CRISPR gRNA sequence
  source 1..20: mol_type = other DNA
tcatccctgcttctagccct

SEQ ID NO: 65331 - DNA, 20 bp, synthetic construct
  misc_feature 1..20: note = CRISPR gRNA sequence
  source 1..20: mol_type = other DNA
cttctagcccttaaaaaact

SEQ ID NO: 65332 - DNA, 20 bp, synthetic construct
  misc_feature 1..20: note = CRISPR gRNA sequence
  source 1..20: mol_type = other DNA
ctagcccttaaaaaactaat

SEQ ID NO: 65333 - DNA, 20 bp, synthetic construct
  misc_feature 1..20: note = CRISPR gRNA sequence
  source 1..20: mol_type = other DNA
tagcccttaaaaaactaatg

SEQ ID NO: 65334 - DNA, 20 bp, synthetic construct
  misc_feature 1..20: note = CRISPR gRNA sequence
  source 1..20: mol_type = other DNA
gcccttaaaaaactaatgtt

SEQ ID NO: 65335 - DNA, 20 bp, synthetic construct
  misc_feature 1..20: note = CRISPR gRNA sequence
  source 1..20: mol_type = other DNA
aaaaaactaatgtttaaaaa

SEQ ID NO: 65336 - DNA, 20 bp, synthetic construct
  misc_feature 1..20: note = CRISPR gRNA sequence
  source 1..20: mol_type = other DNA
aaaaactaatgtttaaaaag

SEQ ID NO: 65337 - DNA, 20 bp, synthetic construct
  misc_feature 1..20: note = CRISPR gRNA sequence
  source 1..20: mol_type = other DNA
atgtttaaaaagagaatcta

SEQ ID NO: 65338 - DNA, 20 bp, synthetic construct
  misc_feature 1..20: note = CRISPR gRNA sequence
  source 1..20: mol_type = other DNA
aaaaagagaatctatagttt

SEQ ID NO: 65339 - DNA, 20 bp, synthetic construct
  misc_feature 1..20: note = CRISPR gRNA sequence
  source 1..20: mol_type = other DNA
aaaagagaatctatagttta

SEQ ID NO: 65340 - DNA, 20 bp, synthetic construct
  misc_feature 1..20: note = CRISPR gRNA sequence
  source 1..20: mol_type = other DNA
tagtttaatcccatgtttgt

SEQ ID NO: 65341 - DNA, 20 bp, synthetic construct
  misc_feature 1..20: note = CRISPR gRNA sequence
  source 1..20: mol_type = other DNA
aatcccatgtttgtaaaaca

SEQ ID NO: 65342 - DNA, 20 bp, synthetic construct
  misc_feature 1..20: note = CRISPR gRNA sequence
  source 1..20: mol_type = other DNA
atcccatgtttgtaaaacaa

SEQ ID NO: 65343 - DNA, 20 bp, synthetic construct
  misc_feature 1..20: note = CRISPR gRNA sequence
  source 1..20: mol_type = other DNA
gtaaaacaaaaattattgca

SEQ ID NO: 65344 - DNA, 20 bp, synthetic construct
  misc_feature 1..20: note = CRISPR gRNA sequence
  source 1..20: mol_type = other DNA
taaaacaaaaattattgcac

SEQ ID NO: 65345 - DNA, 20 bp, synthetic construct
  misc_feature 1..20: note = CRISPR gRNA sequence
  source 1..20: mol_type = other DNA
ttgcactagaaaatggaagg

SEQ ID NO: 65346 - DNA, 20 bp, synthetic construct
  misc_feature 1..20: note = CRISPR gRNA sequence
  source 1..20: mol_type = other DNA
cactagaaaatggaaggttt

SEQ ID NO: 65347 - DNA, 20 bp, synthetic construct
  misc_feature 1..20: note = CRISPR gRNA sequence
  source 1..20: mol_type = other DNA
gaaaatggaaggtttgaagg

SEQ ID NO: 65348 - DNA, 20 bp, synthetic construct
  misc_feature 1..20: note = CRISPR gRNA sequence
  source 1..20: mol_type = other DNA
gaaggactcactccaaaggt

SEQ ID NO: 65349 - DNA, 20 bp, synthetic construct
  misc_feature 1..20: note = CRISPR gRNA sequence
  source 1..20: mol_type = other DNA
aaggactcactccaaaggtt

SEQ ID NO: 65350 - DNA, 20 bp, synthetic construct
  misc_feature 1..20: note = CRISPR gRNA sequence
  source 1..20: mol_type = other DNA
actccaaaggttaccagggg

SEQ ID NO: 65351 - DNA, 20 bp, synthetic construct
  misc_feature 1..20: note = CRISPR gRNA sequence
  source 1..20: mol_type = other DNA
caaaggttaccaggggtaat

SEQ ID NO: 65352 - DNA, 20 bp, synthetic construct
  misc_feature 1..20: note = CRISPR gRNA sequence
  source 1..20: mol_type = other DNA
ccaggggtaatccacacata

SEQ ID NO: 65353 - DNA, 20 bp, synthetic construct
  misc_feature 1..20: note = CRISPR gRNA sequence
  source 1..20: mol_type = other DNA
tgagcacagacagaacactg

SEQ ID NO: 65354 - DNA, 20 bp, synthetic construct
  misc_feature 1..20: note = CRISPR gRNA sequence
  source 1..20: mol_type = other DNA
gagcacagacagaacactga

SEQ ID NO: 65355 - DNA, 20 bp, synthetic construct
  misc_feature 1..20: note = CRISPR gRNA sequence
  source 1..20: mol_type = other DNA
agcacagacagaacactgac

SEQ ID NO: 65356 - DNA, 20 bp, synthetic construct
  misc_feature 1..20: note = CRISPR gRNA sequence
  source 1..20: mol_type = other DNA
actagcagagagaggggttt

SEQ ID NO: 65357 - DNA, 20 bp, synthetic construct
  misc_feature 1..20: note = CRISPR gRNA sequence
  source 1..20: mol_type = other DNA
gcagagagaggggtttcagt

SEQ ID NO: 65358 - DNA, 20 bp, synthetic construct
  misc_feature 1..20: note = CRISPR gRNA sequence
  source 1..20: mol_type = other DNA
cagtctggggctaaaagaga

SEQ ID NO: 65359 - DNA, 20 bp, synthetic construct
  misc_feature 1..20: note = CRISPR gRNA sequence
  source 1..20: mol_type = other DNA
agtctggggctaaaagagag

SEQ ID NO: 65360 - DNA, 20 bp, synthetic construct
  misc_feature 1..20: note = CRISPR gRNA sequence
  source 1..20: mol_type = other DNA
gggctaaaagagagaacaca

SEQ ID NO: 65361 - DNA, 20 bp, synthetic construct
  misc_feature 1..20: note = CRISPR gRNA sequence
  source 1..20: mol_type = other DNA
aaagagagaacacagaattt

SEQ ID NO: 65362 - DNA, 20 bp, synthetic construct
  misc_feature 1..20: note = CRISPR gRNA sequence
  source 1..20: mol_type = other DNA
gttttcttttaagacttgcc

SEQ ID NO: 65363 - DNA, 20 bp, synthetic construct
  misc_feature 1..20: note = CRISPR gRNA sequence
  source 1..20: mol_type = other DNA
ttttcttttaagacttgcca

SEQ ID NO: 65364 - DNA, 20 bp, synthetic construct
  misc_feature 1..20: note = CRISPR gRNA sequence
  source 1..20: mol_type = other DNA
tcttttaagacttgccagga

SEQ ID NO: 65365 - DNA, 20 bp, synthetic construct
  misc_feature 1..20: note = CRISPR gRNA sequence
  source 1..20: mol_type = other DNA
cttttaagacttgccaggaa

SEQ ID NO: 65366 - DNA, 20 bp, synthetic construct
  misc_feature 1..20: note = CRISPR gRNA sequence
  source 1..20: mol_type = other DNA
ttttaagacttgccaggaaa

SEQ ID NO: 65367 - DNA, 20 bp, synthetic construct
  misc_feature 1..20: note = CRISPR gRNA sequence
  source 1..20: mol_type = other DNA
ttaagacttgccaggaaatg

SEQ ID NO: 65368 - DNA, 20 bp, synthetic construct
  misc_feature 1..20: note = CRISPR gRNA sequence
  source 1..20: mol_type = other DNA
taagacttgccaggaaatgg

SEQ ID NO: 65369 - DNA, 20 bp, synthetic construct
  misc_feature 1..20: note = CRISPR gRNA sequence
  source 1..20: mol_type = other DNA
aagacttgccaggaaatggg

SEQ ID NO: 65370 - DNA, 20 bp, synthetic construct
  misc_feature 1..20: note = CRISPR gRNA sequence
  source 1..20: mol_type = other DNA
agacttgccaggaaatgggg

SEQ ID NO: 65371 - DNA, 20 bp, synthetic construct
  misc_feature 1..20: note = CRISPR gRNA sequence
  source 1..20: mol_type = other DNA
gccaggaaatggggcttact

SEQ ID NO: 65372 - DNA, 20 bp, synthetic construct
  misc_feature 1..20: note = CRISPR gRNA sequence
  source 1..20: mol_type = other DNA
ccaggaaatggggcttactt

SEQ ID NO: 65373 - DNA, 20 bp, synthetic construct
  misc_feature 1..20: note = CRISPR gRNA sequence
  source 1..20: mol_type = other DNA
acttaggcaatagatacatt

SEQ ID NO: 65374 - DNA, 20 bp, synthetic construct
  misc_feature 1..20: note = CRISPR gRNA sequence
  source 1..20: mol_type = other DNA
cttaggcaatagatacattt

SEQ ID NO: 65375 - DNA, 20 bp, synthetic construct
  misc_feature 1..20: note = CRISPR gRNA sequence
  source 1..20: mol_type = other DNA
aggcaatagatacatttgtg

SEQ ID NO: 65376 - DNA, 20 bp, synthetic construct
  misc_feature 1..20: note = CRISPR gRNA sequence
  source 1..20: mol_type = other DNA
ggcaatagatacatttgtga

SEQ ID NO: 65377 - DNA, 20 bp, synthetic construct
  misc_feature 1..20: note = CRISPR gRNA sequence
  source 1..20: mol_type = other DNA
gtgaaatatctgtggtagaa

SEQ ID NO: 65378 - DNA, 20 bp, synthetic construct
  misc_feature 1..20: note = CRISPR gRNA sequence
  source 1..20: mol_type = other DNA
tgaaatatctgtggtagaaa

SEQ ID NO: 65379 - DNA, 20 bp, synthetic construct
  misc_feature 1..20: note = CRISPR gRNA sequence
  source 1..20: mol_type = other DNA
tggtagaaagatttcagccc

SEQ ID NO: 65380 - DNA, 20 bp, synthetic construct
  misc_feature 1..20: note = CRISPR gRNA sequence
  source 1..20: mol_type = other DNA
cagccctccaaaagctcaga

SEQ ID NO: 65381 - DNA, 20 bp, synthetic construct
  misc_feature 1..20: note = CRISPR gRNA sequence
  source 1..20: mol_type = other DNA
agccctccaaaagctcagag

SEQ ID NO: 65382 - DNA, 20 bp, synthetic construct
  misc_feature 1..20: note = CRISPR gRNA sequence
  source 1..20: mol_type = other DNA
caaaagctcagaggaagtca

SEQ ID NO: 65383 - DNA, 20 bp, synthetic construct
  misc_feature 1..20: note = CRISPR gRNA sequence
  source 1..20: mol_type = other DNA
agaggaagtcagaggggagt

SEQ ID NO: 65384 - DNA, 20 bp, synthetic construct
  misc_feature 1..20: note = CRISPR gRNA sequence
  source 1..20: mol_type = other DNA
cagctggaggcagggggatg

SEQ ID NO: 65385 - DNA, 20 bp, synthetic construct
  misc_feature 1..20: note = CRISPR gRNA sequence
  source 1..20: mol_type = other DNA
gaggcagggggatggaactt

SEQ ID NO: 65386 - DNA, 20 bp, synthetic construct
  misc_feature 1..20: note = CRISPR gRNA sequence
  source 1..20: mol_type = other DNA
gagaggtcctcccgggccag

SEQ ID NO: 65387 - DNA, 20 bp, synthetic construct
  misc_feature 1..20: note = CRISPR gRNA sequence
  source 1..20: mol_type = other DNA
agaggtcctcccgggccagg

SEQ ID NO: 65388 - DNA, 20 bp, synthetic construct
  misc_feature 1..20: note = CRISPR gRNA sequence
  source 1..20: mol_type = other DNA
ccgggccaggggtaaaaagt

SEQ ID NO: 65389 - DNA, 20 bp, synthetic construct
  misc_feature 1..20: note = CRISPR gRNA sequence
  source 1..20: mol_type = other DNA
acacctatcatcccagcact

SEQ ID NO: 65390 - DNA, 20 bp, synthetic construct
  misc_feature 1..20: note = CRISPR gRNA sequence
  source 1..20: mol_type = other DNA
tcatcccagcactttgggaa

SEQ ID NO: 65391 - DNA, 20 bp, synthetic construct
  misc_feature 1..20: note = CRISPR gRNA sequence
  source 1..20: mol_type = other DNA
tgggaagcaaaggtgggagg

SEQ ID NO: 65392 - DNA, 20 bp, synthetic construct
  misc_feature 1..20: note = CRISPR gRNA sequence
  source 1..20: mol_type = other DNA
gggaagcaaaggtgggagga

SEQ ID NO: 65393 - DNA, 20 bp, synthetic construct
  misc_feature 1..20: note = CRISPR gRNA sequence
  source 1..20: mol_type = other DNA
ggaagcaaaggtgggaggat

SEQ ID NO: 65394 - DNA, 20 bp, synthetic construct
  misc_feature 1..20: note = CRISPR gRNA sequence
  source 1..20: mol_type = other DNA
agcccagaagttcgagacca

SEQ ID NO: 65395 - DNA, 20 bp, synthetic construct
  misc_feature 1..20: note = CRISPR gRNA sequence
  source 1..20: mol_type = other DNA
gagaccagagtagacaacat

SEQ ID NO: 65396 - DNA, 20 bp, synthetic construct
  misc_feature 1..20: note = CRISPR gRNA sequence
  source 1..20: mol_type = other DNA
tctctacatacttttttttt

SEQ ID NO: 65397 - DNA, 20 bp, synthetic construct
  misc_feature 1..20: note = CRISPR gRNA sequence
  source 1..20: mol_type = other DNA
tacatacttttttttttaat

SEQ ID NO: 65398 - DNA, 20 bp, synthetic construct
  misc_feature 1..20: note = CRISPR gRNA sequence
  source 1..20: mol_type = other DNA
catacttttttttttaatta

SEQ ID NO: 65399 - DNA, 20 bp, synthetic construct
  misc_feature 1..20: note = CRISPR gRNA sequence
  source 1..20: mol_type = other DNA
ttttttttaattagctgggc

SEQ ID NO: 65400 - DNA, 20 bp, synthetic construct
  misc_feature 1..20: note = CRISPR gRNA sequence
  source 1..20: mol_type = other DNA
tttttttaattagctgggcc

SEQ ID NO: 65401 - DNA, 20 bp, synthetic construct
  misc_feature 1..20: note = CRISPR gRNA sequence
  source 1..20: mol_type = other DNA
ttttttaattagctgggcct

SEQ ID NO: 65402 - DNA, 20 bp, synthetic construct
  misc_feature 1..20: note = CRISPR gRNA sequence
  source 1..20: mol_type = other DNA
tttttaattagctgggcctg

SEQ ID NO: 65403 - DNA, 20 bp, synthetic construct
  misc_feature 1..20: note = CRISPR gRNA sequence
  source 1..20: mol_type = other DNA
ttttaattagctgggcctga

SEQ ID NO: 65404 - DNA, 20 bp, synthetic construct
  misc_feature 1..20: note = CRISPR gRNA sequence
  source 1..20: mol_type = other DNA
tttaattagctgggcctgat

SEQ ID NO: 65405 - DNA, 20 bp, synthetic construct
  misc_feature 1..20: note = CRISPR gRNA sequence
  source 1..20: mol_type = other DNA
ttaattagctgggcctgatg

SEQ ID NO: 65406 - DNA, 20 bp, synthetic construct
  misc_feature 1..20: note = CRISPR gRNA sequence
  source 1..20: mol_type = other DNA
taattagctgggcctgatgg

SEQ ID NO: 65407 - DNA, 20 bp, synthetic construct
  misc_feature 1..20: note = CRISPR gRNA sequence
  source 1..20: mol_type = other DNA
aattagctgggcctgatggc

SEQ ID NO: 65408 - DNA, 20 bp, synthetic construct
  misc_feature 1..20: note = CRISPR gRNA sequence
  source 1..20: mol_type = other DNA
attagctgggcctgatggca

SEQ ID NO: 65409 - DNA, 20 bp, synthetic construct
  misc_feature 1..20: note = CRISPR gRNA sequence
  source 1..20: mol_type = other DNA
gctgggcctgatggcacaag

SEQ ID NO: 65410 - DNA, 20 bp, synthetic construct
  misc_feature 1..20: note = CRISPR gRNA sequence
  source 1..20: mol_type = other DNA
ggcctgatggcacaagcctg

SEQ ID NO: 65411 - DNA, 20 bp, synthetic construct
  misc_feature 1..20: note = CRISPR gRNA sequence
  source 1..20: mol_type = other DNA
atggcacaagcctgtaatcc

SEQ ID NO: 65412 - DNA, 20 bp, synthetic construct
  misc_feature 1..20: note = CRISPR gRNA sequence
  source 1..20: mol_type = other DNA
taatcccagctactcaggag

SEQ ID NO: 65413 - DNA, 20 bp, synthetic construct
  misc_feature 1..20: note = CRISPR gRNA sequence
  source 1..20: mol_type = other DNA
ctcaggaggctgaagtggga

SEQ ID NO: 65414 - DNA, 20 bp, synthetic construct
  misc_feature 1..20: note = CRISPR gRNA sequence
  source 1..20: mol_type = other DNA
aggaggctgaagtgggagga

SEQ ID NO: 65415 - DNA, 20 bp, synthetic construct
  misc_feature 1..20: note = CRISPR gRNA sequence
  source 1..20: mol_type = other DNA
aagtgggaggattgcttgag

SEQ ID NO: 65416 - DNA, 20 bp, synthetic construct
  misc_feature 1..20: note = CRISPR gRNA sequence
  source 1..20: mol_type = other DNA
cttgagcccaggaggtggag

SEQ ID NO: 65417 - DNA, 20 bp, synthetic construct
  misc_feature 1..20: note = CRISPR gRNA sequence
  source 1..20: mol_type = other DNA
gagcccaggaggtggaggct

SEQ ID NO: 65418 - DNA, 20 bp, synthetic construct
  misc_feature 1..20: note = CRISPR gRNA sequence
  source 1..20: mol_type = other DNA
agcccaggaggtggaggctt

SEQ ID NO: 65419 - DNA, 20 bp, synthetic construct
  misc_feature 1..20: note = CRISPR gRNA sequence
  source 1..20: mol_type = other DNA
cagtgagccatgattgcacc

SEQ ID NO: 65420 - DNA, 20 bp, synthetic construct
  misc_feature 1..20: note = CRISPR gRNA sequence
  source 1..20: mol_type = other DNA
agtgagccatgattgcacca

SEQ ID NO: 65421 - DNA, 20 bp, synthetic construct
  misc_feature 1..20: note = CRISPR gRNA sequence
  source 1..20: mol_type = other DNA
caccactgcacaccagcttg

SEQ ID NO: 65422 - DNA, 20 bp, synthetic construct
  misc_feature 1..20: note = CRISPR gRNA sequence
  source 1..20: mol_type = other DNA
cacaccagcttgggcaacag

SEQ ID NO: 65423 - DNA, 20 bp, synthetic construct
  misc_feature 1..20: note = CRISPR gRNA sequence
  source 1..20: mol_type = other DNA
gggcaacagactgagacctt

SEQ ID NO: 65424 - DNA, 20 bp, synthetic construct
  misc_feature 1..20: note = CRISPR gRNA sequence
  source 1..20: mol_type = other DNA
ggcaacagactgagaccttc

SEQ ID NO: 65425 - DNA, 20 bp, synthetic construct
  misc_feature 1..20: note = CRISPR gRNA sequence
  source 1..20: mol_type = other DNA
agaccttctctcaaaaagaa

SEQ ID NO: 65426 - DNA, 20 bp, synthetic construct
  misc_feature 1..20: note = CRISPR gRNA sequence
  source 1..20: mol_type = other DNA
ctctcaaaaagaaatagtaa

SEQ ID NO: 65427 - DNA, 20 bp, synthetic construct
  misc_feature 1..20: note = CRISPR gRNA sequence
  source 1..20: mol_type = other DNA
tctcaaaaagaaatagtaac

SEQ ID NO: 65428 - DNA, 20 bp, synthetic construct
  misc_feature 1..20: note = CRISPR gRNA sequence
  source 1..20: mol_type = other DNA
tcaaaaagaaatagtaacag

SEQ ID NO: 65429 - DNA, 20 bp, synthetic construct
  misc_feature 1..20: note = CRISPR gRNA sequence
  source 1..20: mol_type = other DNA
aaaaagaaatagtaacaggg

SEQ ID NO: 65430 - DNA, 20 bp, synthetic construct
  misc_feature 1..20: note = CRISPR gRNA sequence
  source 1..20: mol_type = other DNA
tcgcttcctcacccctcttt

SEQ ID NO: 65431 - DNA, 20 bp, synthetic construct
  misc_feature 1..20: note = CRISPR gRNA sequence
  source 1..20: mol_type = other DNA
gcttcctcacccctcttttg

SEQ ID NO: 65432 - DNA, 20 bp, synthetic construct
  misc_feature 1..20: note = CRISPR gRNA sequence
  source 1..20: mol_type = other DNA
cctcacccctcttttgtctt

SEQ ID NO: 65433 - DNA, 20 bp, synthetic construct
  misc_feature 1..20: note = CRISPR gRNA sequence
  source 1..20: mol_type = other DNA
ctcacccctcttttgtcttc

SEQ ID NO: 65434 - DNA, 20 bp, synthetic construct
  misc_feature 1..20: note = CRISPR gRNA sequence
  source 1..20: mol_type = other DNA
acccctcttttgtcttcaca

SEQ ID NO: 65435 - DNA, 20 bp, synthetic construct
  misc_feature 1..20: note = CRISPR gRNA sequence
  source 1..20: mol_type = other DNA
ttttgtcttcacagcctgca

SEQ ID NO: 65436 - DNA, 20 bp, synthetic construct
  misc_feature 1..20: note = CRISPR gRNA sequence
  source 1..20: mol_type = other DNA
ttgtcttcacagcctgcagc

SEQ ID NO: 65437 - DNA, 20 bp, synthetic construct
  misc_feature 1..20: note = CRISPR gRNA sequence
  source 1..20: mol_type = other DNA
tgtcttcacagcctgcagca

SEQ ID NO: 65438 - DNA, 20 bp, synthetic construct
  misc_feature 1..20: note = CRISPR gRNA sequence
  source 1..20: mol_type = other DNA
gtcttcacagcctgcagcac

SEQ ID NO: 65439 - DNA, 20 bp, synthetic construct
  misc_feature 1..20: note = CRISPR gRNA sequence
  source 1..20: mol_type = other DNA
tcttcacagcctgcagcaca

SEQ ID NO: 65440 - DNA, 20 bp, synthetic construct
  misc_feature 1..20: note = CRISPR gRNA sequence
  source 1..20: mol_type = other DNA
cacagcctgcagcacaaaac

SEQ ID NO: 65441 - DNA, 20 bp, synthetic construct
  misc_feature 1..20: note = CRISPR gRNA sequence
  source 1..20: mol_type = other DNA
acagcctgcagcacaaaact

SEQ ID NO: 65442 - DNA, 20 bp, synthetic construct
  misc_feature 1..20: note = CRISPR gRNA sequence
  source 1..20: mol_type = other DNA
cagcacaaaactgtgatctt

SEQ ID NO: 65443 - DNA, 20 bp, synthetic construct
  misc_feature 1..20: note = CRISPR gRNA sequence
  source 1..20: mol_type = other DNA
tgatcttcatgtttgcccag

SEQ ID NO: 65444 - DNA, 20 bp, synthetic construct
  misc_feature 1..20: note = CRISPR gRNA sequence
  source 1..20: mol_type = other DNA
catgtttgcccaggagccag

SEQ ID NO: 65445 - DNA, 20 bp, synthetic construct
  misc_feature 1..20: note = CRISPR gRNA sequence
  source 1..20: mol_type = other DNA
atgtttgcccaggagccaga

SEQ ID NO: 65446 - DNA, 20 bp, synthetic construct
  misc_feature 1..20: note = CRISPR gRNA sequence
  source 1..20: mol_type = other DNA
gcccaggagccagaggagca

SEQ ID NO: 65447 - DNA, 20 bp, synthetic construct
  misc_feature 1..20: note = CRISPR gRNA sequence
  source 1..20: mol_type = other DNA
cccaggagccagaggagcag

SEQ ID NO: 65448 - DNA, 20 bp, synthetic construct
  misc_feature 1..20: note = CRISPR gRNA sequence
  source 1..20: mol_type = other DNA
caccccaactccatgctcag

SEQ ID NO: 65449 - DNA, 20 bp, synthetic construct
  misc_feature 1..20: note = CRISPR gRNA sequence
  source 1..20: mol_type = other DNA
accccaactccatgctcagt

SEQ ID NO: 65450 - DNA, 20 bp, synthetic construct
  misc_feature 1..20: note = CRISPR gRNA sequence
  source 1..20: mol_type = other DNA
catgctcagtcagggacatt

SEQ ID NO: 65451 - DNA, 20 bp, synthetic construct
  misc_feature 1..20: note = CRISPR gRNA sequence
  source 1..20: mol_type = other DNA
agtcagggacattcccctct

SEQ ID NO: 65452 - DNA, 20 bp, synthetic construct
  misc_feature 1..20: note = CRISPR gRNA sequence
  source 1..20: mol_type = other DNA
ccctctctaccctccacagc

SEQ ID NO: 65453 - DNA, 20 bp, synthetic construct
  misc_feature 1..20: note = CRISPR gRNA sequence
  source 1..20: mol_type = other DNA
tctaccctccacagctgggc

SEQ ID NO: 65454 - DNA, 20 bp, synthetic construct
  misc_feature 1..20: note = CRISPR gRNA sequence
  source 1..20: mol_type = other DNA
taccctccacagctgggcag

SEQ ID NO: 65455 - DNA, 20 bp, synthetic construct
  misc_feature 1..20: note = CRISPR gRNA sequence
  source 1..20: mol_type = other DNA
ccctccacagctgggcagtg

SEQ ID NO: 65456 - DNA, 20 bp, synthetic construct
  misc_feature 1..20: note = CRISPR gRNA sequence
  source 1..20: mol_type = other DNA
cacagctgggcagtgccagt

SEQ ID NO: 65457 - DNA, 20 bp, synthetic construct
  misc_feature 1..20: note = CRISPR gRNA sequence
  source 1..20: mol_type = other DNA
ggcagtgccagtcagtcaac

SEQ ID NO: 65458 - DNA, 20 bp, synthetic construct
  misc_feature 1..20: note = CRISPR gRNA sequence
  source 1..20: mol_type = other DNA
ccagggtgacctggacaaat

SEQ ID NO: 65459 - DNA, 20 bp, synthetic construct
  misc_feature 1..20: note = CRISPR gRNA sequence
  source 1..20: mol_type = other DNA
gacaaattcacggaagagcg

SEQ ID NO: 65460 - DNA, 20 bp, synthetic construct
  misc_feature 1..20: note = CRISPR gRNA sequence
  source 1..20: mol_type = other DNA
acggaagagcgggaagtgag

SEQ ID NO: 65461 - DNA, 20 bp, synthetic construct
  misc_feature 1..20: note = CRISPR gRNA sequence
  source 1..20: mol_type = other DNA
ggcaaaggatgcagccccaa

SEQ ID NO: 65462 - DNA, 20 bp, synthetic construct
  misc_feature 1..20: note = CRISPR gRNA sequence
  source 1..20: mol_type = other DNA
gcaaaggatgcagccccaaa

SEQ ID NO: 65463 - DNA, 20 bp, synthetic construct
  misc_feature 1..20: note = CRISPR gRNA sequence
  source 1..20: mol_type = other DNA
cgcctctcatggtgcctgaa

SEQ ID NO: 65464 - DNA, 20 bp, synthetic construct
  misc_feature 1..20: note = CRISPR gRNA sequence
  source 1..20: mol_type = other DNA
tcatggtgcctgaaaggagc

SEQ ID NO: 65465 - DNA, 20 bp, synthetic construct
  misc_feature 1..20: note = CRISPR gRNA sequence
  source 1..20: mol_type = other DNA
atggtgcctgaaaggagccc

SEQ ID NO: 65466 - DNA, 20 bp, synthetic construct
  misc_feature 1..20: note = CRISPR gRNA sequence
  source 1..20: mol_type = other DNA
aaaggagccccagtgtgtag

SEQ ID NO: 65467 - DNA, 20 bp, synthetic construct
  misc_feature 1..20: note = CRISPR gRNA sequence
  source 1..20: mol_type = other DNA
ggtagccagagggggattcc

SEQ ID NO: 65468 - DNA, 20 bp, synthetic construct
  misc_feature 1..20: note = CRISPR gRNA sequence
  source 1..20: mol_type = other DNA
cgggagactagagccctcca

SEQ ID NO: 65469 - DNA, 20 bp, synthetic construct
  misc_feature 1..20: note = CRISPR gRNA sequence
  source 1..20: mol_type = other DNA
gagccctccagcttaaaccc

SEQ ID NO: 65470 - DNA, 20 bp, synthetic construct
  misc_feature 1..20: note = CRISPR gRNA sequence
  source 1..20: mol_type = other DNA
cagcttaaacccaggggatt

SEQ ID NO: 65471 - DNA, 20 bp, synthetic construct
  misc_feature 1..20: note = CRISPR gRNA sequence
  source 1..20: mol_type = other DNA
aaacccaggggattgcctgg

SEQ ID NO: 65472 - DNA, 20 bp, synthetic construct
  misc_feature 1..20: note = CRISPR gRNA sequence
  source 1..20: mol_type = other DNA
aacccaggggattgcctggc

SEQ ID NO: 65473 - DNA, 20 bp, synthetic construct
  misc_feature 1..20: note = CRISPR gRNA sequence
  source 1..20: mol_type = other DNA
cctggcctgtagctctggtc

SEQ ID NO: 65474 - DNA, 20 bp, synthetic construct
  misc_feature 1..20: note = CRISPR gRNA sequence
  source 1..20: mol_type = other DNA
gcctgtagctctggtcctgg

SEQ ID NO: 65475 - DNA, 20 bp, synthetic construct
  misc_feature 1..20: note = CRISPR gRNA sequence
  source 1..20: mol_type = other DNA
tagctctggtcctggtcgga

SEQ ID NO: 65476 - DNA, 20 bp, synthetic construct
  misc_feature 1..20: note = CRISPR gRNA sequence
  source 1..20: mol_type = other DNA
tggtcctggtcggaacttct

SEQ ID NO: 65477 - DNA, 20 bp, synthetic construct
  misc_feature 1..20: note = CRISPR gRNA sequence
  source 1..20: mol_type = other DNA
gtcctggtcggaacttctgt

SEQ ID NO: 65478 - DNA, 20 bp, synthetic construct
  misc_feature 1..20: note = CRISPR gRNA sequence
  source 1..20: mol_type = other DNA
gtcggaacttctgtatccct

SEQ ID NO: 65479 - DNA, 20 bp, synthetic construct
  misc_feature 1..20: note = CRISPR gRNA sequence
  source 1..20: mol_type = other DNA
ctgtatccctttcacacaag

SEQ ID NO: 65480 - DNA, 20 bp, synthetic construct
  misc_feature 1..20: note = CRISPR gRNA sequence
  source 1..20: mol_type = other DNA
tgtatccctttcacacaagg

SEQ ID NO: 65481 - DNA, 20 bp, synthetic construct
  misc_feature 1..20: note = CRISPR gRNA sequence
  source 1..20: mol_type = other DNA
tatccctttcacacaaggac

SEQ ID NO: 65482 - DNA, 20 bp, synthetic construct
  misc_feature 1..20: note = CRISPR gRNA sequence
  source 1..20: mol_type = other DNA
tcacacaaggacccattagg

SEQ ID NO: 65483 - DNA, 20 bp, synthetic construct
  misc_feature 1..20: note = CRISPR gRNA sequence
  source 1..20: mol_type = other DNA
cacacaaggacccattaggg

SEQ ID NO: 65484 - DNA, 20 bp, synthetic construct
  misc_feature 1..20: note = CRISPR gRNA sequence
  source 1..20: mol_type = other DNA
acacaaggacccattagggt

SEQ ID NO: 65485 - DNA, 20 bp, synthetic construct
  misc_feature 1..20: note = CRISPR gRNA sequence
  source 1..20: mol_type = other DNA
gggtcctggattgccccagc

SEQ ID NO: 65486 - DNA, 20 bp, synthetic construct
  misc_feature 1..20: note = CRISPR gRNA sequence
  source 1..20: mol_type = other DNA
gattgccccagcctagcgca

SEQ ID NO: 65487 - DNA, 20 bp, synthetic construct
  misc_feature 1..20: note = CRISPR gRNA sequence
  source 1..20: mol_type = other DNA
ccccagcctagcgcatgggt

SEQ ID NO: 65488 - DNA, 20 bp, synthetic construct
  misc_feature 1..20: note = CRISPR gRNA sequence
  source 1..20: mol_type = other DNA
gcgcatgggtagagactcag

SEQ ID NO: 65489 - DNA, 20 bp, synthetic construct
  misc_feature 1..20: note = CRISPR gRNA sequence
  source 1..20: mol_type = other DNA
agctctttgctcccggagcc

SEQ ID NO: 65490 - DNA, 20 bp, synthetic construct
  misc_feature 1..20: note = CRISPR gRNA sequence
  source 1..20: mol_type = other DNA
tttgctcccggagcccaccc

SEQ ID NO: 65491 - DNA, 20 bp, synthetic construct
  misc_feature 1..20: note = CRISPR gRNA sequence
  source 1..20: mol_type = other DNA
tgctcccggagcccacccac

SEQ ID NO: 65492 - DNA, 20 bp, synthetic construct
  misc_feature 1..20: note = CRISPR gRNA sequence
  source 1..20: mol_type = other DNA
gctcccggagcccacccaca

SEQ ID NO: 65493 - DNA, 20 bp, synthetic construct
  misc_feature 1..20: note = CRISPR gRNA sequence
  source 1..20: mol_type = other DNA
ctcccggagcccacccacaa

SEQ ID NO: 65494 - DNA, 20 bp, synthetic construct
  misc_feature 1..20: note = CRISPR gRNA sequence
  source 1..20: mol_type = other DNA
ccggagcccacccacaatct

SEQ ID NO: 65495 - DNA, 20 bp, synthetic construct
  misc_feature 1..20: note = CRISPR gRNA sequence
  source 1..20: mol_type = other DNA
ttctgtagagtctggactac

SEQ ID NO: 65496 - DNA, 20 bp, synthetic construct
  misc_feature 1..20: note = CRISPR gRNA sequence
  source 1..20: mol_type = other DNA
ctgtagagtctggactactg

SEQ ID NO: 65497 - DNA, 20 bp, synthetic construct
  misc_feature 1..20: note = CRISPR gRNA sequence
  source 1..20: mol_type = other DNA
tgtagagtctggactactga

SEQ ID NO: 65498 - DNA, 20 bp, synthetic construct
  misc_feature 1..20: note = CRISPR gRNA sequence
  source 1..20: mol_type = other DNA
tagagtctggactactgaag

SEQ ID NO: 65499 - DNA, 20 bp, synthetic construct
  misc_feature 1..20: note = CRISPR gRNA sequence
  source 1..20: mol_type = other DNA
gactactgaaggctcgattc

SEQ ID NO: 65500 - DNA, 20 bp, synthetic construct
  misc_feature 1..20: note = CRISPR gRNA sequence
  source 1..20: mol_type = other DNA
ctgaaggctcgattccagct

SEQ ID NO: 65501 - DNA, 20 bp, synthetic construct
  misc_feature 1..20: note = CRISPR gRNA sequence
  source 1..20: mol_type = other DNA
aaggctcgattccagctggg

SEQ ID NO: 65502 - DNA, 20 bp, synthetic construct
  misc_feature 1..20: note = CRISPR gRNA sequence
  source 1..20: mol_type = other DNA
gattccagctggggctgaca

SEQ ID NO: 65503 - DNA, 20 bp, synthetic construct
  misc_feature 1..20: note = CRISPR gRNA sequence
  source 1..20: mol_type = other DNA
cagctggggctgacatctct

SEQ ID NO: 65504 - DNA, 20 bp, synthetic construct
  misc_feature 1..20: note = CRISPR gRNA sequence
  source 1..20: mol_type = other DNA
gggctgacatctctgaagca

SEQ ID NO: 65505 - DNA, 20 bp, synthetic construct
  misc_feature 1..20: note = CRISPR gRNA sequence
  source 1..20: mol_type = other DNA
acatctctgaagcacagatg

SEQ ID NO: 65506 - DNA, 20 bp, synthetic construct
  misc_feature 1..20: note = CRISPR gRNA sequence
  source 1..20: mol_type = other DNA
tgaagcacagatgaggagga

SEQ ID NO: 65507 - DNA, 20 bp, synthetic construct
  misc_feature 1..20: note = CRISPR gRNA sequence
  source 1..20: mol_type = other DNA
aagcacagatgaggaggagg

SEQ ID NO: 65508 - DNA, 20 bp, synthetic construct
  misc_feature 1..20: note = CRISPR gRNA sequence
  source 1..20: mol_type = other DNA
atgataatagcagtcaaggt

SEQ ID NO: 65509 - DNA, 20 bp, synthetic construct
  misc_feature 1..20: note = CRISPR gRNA sequence
  source 1..20: mol_type = other DNA
agtacttgccatgtatgcac

SEQ ID NO: 65510 - DNA, 20 bp, synthetic construct
  misc_feature 1..20: note = CRISPR gRNA sequence
  source 1..20: mol_type = other DNA
gccatgtatgcaccaagcac

SEQ ID NO: 65511 - DNA, 20 bp, synthetic construct
  misc_feature 1..20: note = CRISPR gRNA sequence
  source 1..20: mol_type = other DNA
ccatgtatgcaccaagcacc

SEQ ID NO: 65512 - DNA, 20 bp, synthetic construct
  misc_feature 1..20: note = CRISPR gRNA sequence
  source 1..20: mol_type = other DNA
aggcagttcacatacagtct

SEQ ID NO: 65513 - DNA, 20 bp, synthetic construct
  misc_feature 1..20: note = CRISPR gRNA sequence
  source 1..20: mol_type = other DNA
acatacagtctcccattgag

SEQ ID NO: 65514 - DNA, 20 bp, synthetic construct
  misc_feature 1..20: note = CRISPR gRNA sequence
  source 1..20: mol_type = other DNA
ccattgagaggctgtgattt

SEQ ID NO: 65515 - DNA, 20 bp, synthetic construct
  misc_feature 1..20: note = CRISPR gRNA sequence
  source 1..20: mol_type = other DNA
agaggctgtgatttgtccag

SEQ ID NO: 65516 - DNA, 20 bp, synthetic construct
  misc_feature 1..20: note = CRISPR gRNA sequence
  source 1..20: mol_type = other DNA
tgatttgtccagggtcacac

SEQ ID NO: 65517 - DNA, 20 bp, synthetic construct
  misc_feature 1..20: note = CRISPR gRNA sequence
  source 1..20: mol_type = other DNA
gtccagggtcacacaaccag

SEQ ID NO: 65518 - DNA, 20 bp, synthetic construct
  misc_feature 1..20: note = CRISPR gRNA sequence
  source 1..20: mol_type = other DNA
tccagggtcacacaaccagg

SEQ ID NO: 65519 - DNA, 20 bp, synthetic construct
  misc_feature 1..20: note = CRISPR gRNA sequence
  source 1..20: mol_type = other DNA
gcaccaaggtctgattgact

SEQ ID NO: 65520 - DNA, 20 bp, synthetic construct
  misc_feature 1..20: note = CRISPR gRNA sequence
  source 1..20: mol_type = other DNA
attgactctaggtggaggat

SEQ ID NO: 65521 - DNA, 20 bp, synthetic construct
  misc_feature 1..20: note = CRISPR gRNA sequence
  source 1..20: mol_type = other DNA
actctaggtggaggataggg

SEQ ID NO: 65522 - DNA, 20 bp, synthetic construct
  misc_feature 1..20: note = CRISPR gRNA sequence
  source 1..20: mol_type = other DNA
taggtggaggatagggctcg

SEQ ID NO: 65523 - DNA, 20 bp, synthetic construct
  misc_feature 1..20: note = CRISPR gRNA sequence
  source 1..20: mol_type = other DNA
ggtggaggatagggctcgat

SEQ ID NO: 65524 - DNA, 20 bp, synthetic construct
  misc_feature 1..20: note = CRISPR gRNA sequence
  source 1..20: mol_type = other DNA
gatggtggaaggccaggctg

SEQ ID NO: 65525 - DNA, 20 bp, synthetic construct
  misc_feature 1..20: note = CRISPR gRNA sequence
  source 1..20: mol_type = other DNA
aggatggattctggagatgg

SEQ ID NO: 65526 - DNA, 20 bp, synthetic construct
  misc_feature 1..20: note = CRISPR gRNA sequence
  source 1..20: mol_type = other DNA
tggagatggcggacatggcc

SEQ ID NO: 65527 - DNA, 20 bp, synthetic construct
  misc_feature 1..20: note = CRISPR gRNA sequence
  source 1..20: mol_type = other DNA
gagatggcggacatggcctt

SEQ ID NO: 65528 - DNA, 20 bp, synthetic construct
  misc_feature 1..20: note = CRISPR gRNA sequence
  source 1..20: mol_type = other DNA
tgctcagcctggccttggtg

SEQ ID NO: 65529 - DNA, 20 bp, synthetic construct
  misc_feature 1..20: note = CRISPR gRNA sequence
  source 1..20: mol_type = other DNA
gctcagcctggccttggtga

SEQ ID NO: 65530 - DNA, 20 bp, synthetic construct
  misc_feature 1..20: note = CRISPR gRNA sequence
  source 1..20: mol_type = other DNA
ctcagcctggccttggtgat

SEQ ID NO: 65531 - DNA, 20 bp, synthetic construct
  misc_feature 1..20: note = CRISPR gRNA sequence
  source 1..20: mol_type = other DNA
agcctggccttggtgatgtc

SEQ ID NO: 65532 - DNA, 20 bp, synthetic construct
  misc_feature 1..20: note = CRISPR gRNA sequence
  source 1..20: mol_type = other DNA
gccttggtgatgtccctcca

SEQ ID NO: 65533 - DNA, 20 bp, synthetic construct
  misc_feature 1..20: note = CRISPR gRNA sequence
  source 1..20: mol_type = other DNA
ggtgatgtccctccagggct

SEQ ID NO: 65534 - DNA, 20 bp, synthetic construct
  misc_feature 1..20: note = CRISPR gRNA sequence
  source 1..20: mol_type = other DNA
gtgatgtccctccagggctg

SEQ ID NO: 65535 - DNA, 20 bp, synthetic construct
  misc_feature 1..20: note = CRISPR gRNA sequence
  source 1..20: mol_type = other DNA
cagggctgcatttcttgaca

SEQ ID NO: 65536 - DNA, 20 bp, synthetic construct
  misc_feature 1..20: note = CRISPR gRNA sequence
  source 1..20: mol_type = other DNA
catttcttgacagcctcatg

SEQ ID NO: 65537 - DNA, 20 bp, synthetic construct
  misc_feature 1..20: note = CRISPR gRNA sequence
  source 1..20: mol_type = other DNA
cttgacagcctcatgctcca

SEQ ID NO: 65538 - DNA, 20 bp, synthetic construct
  misc_feature 1..20: note = CRISPR gRNA sequence
  source 1..20: mol_type = other DNA
ttgacagcctcatgctccag

SEQ ID NO: 65539 - DNA, 20 bp, synthetic construct
  misc_feature 1..20: note = CRISPR gRNA sequence
  source 1..20: mol_type = other DNA
gacagcctcatgctccagat

SEQ ID NO: 65540 - DNA, 20 bp, synthetic construct
  misc_feature 1..20: note = CRISPR gRNA sequence
  source 1..20: mol_type = other DNA
acagcctcatgctccagatg

SEQ ID NO: 65541 - DNA, 20 bp, synthetic construct
  misc_feature 1..20: note = CRISPR gRNA sequence
  source 1..20: mol_type = other DNA
atgctccagatgccctctga

SEQ ID NO: 65542 - DNA, 20 bp, synthetic construct
  misc_feature 1..20: note = CRISPR gRNA sequence
  source 1..20: mol_type = other DNA
cagatgccctctgagctgcc

SEQ ID NO: 65543 - DNA, 20 bp, synthetic construct
  misc_feature 1..20: note = CRISPR gRNA sequence
  source 1..20: mol_type = other DNA
tgagctgcctctgagctccc

SEQ ID NO: 65544 - DNA, 20 bp, synthetic construct
  misc_feature 1..20: note = CRISPR gRNA sequence
  source 1..20: mol_type = other DNA
agctgcctctgagctcccga

SEQ ID NO: 65545 - DNA, 20 bp, synthetic construct
  misc_feature 1..20: note = CRISPR gRNA sequence
  source 1..20: mol_type = other DNA
cctctgagctcccgaaggat

SEQ ID NO: 65546 - DNA, 20 bp, synthetic construct
  misc_feature 1..20: note = CRISPR gRNA sequence
  source 1..20: mol_type = other DNA
tgagctcccgaaggatgagg

SEQ ID NO: 65547 - DNA, 20 bp, synthetic construct
  misc_feature 1..20: note = CRISPR gRNA sequence
  source 1..20: mol_type = other DNA
agctcccgaaggatgaggta

SEQ ID NO: 65548 - DNA, 20 bp, synthetic construct
  misc_feature 1..20: note = CRISPR gRNA sequence
  source 1..20: mol_type = other DNA
ccgaaggatgaggtacagtg

SEQ ID NO: 65549 - DNA, 20 bp, synthetic construct
  misc_feature 1..20: note = CRISPR gRNA sequence
  source 1..20: mol_type = other DNA
cagccctgtgtgtgattcca

SEQ ID NO: 65550 - DNA, 20 bp, synthetic construct
  misc_feature 1..20: note = CRISPR gRNA sequence
  source 1..20: mol_type = other DNA
tgtgtgattccagccccctc

SEQ ID NO: 65551 - DNA, 20 bp, synthetic construct
  misc_feature 1..20: note = CRISPR gRNA sequence
  source 1..20: mol_type = other DNA
cagccccctcccttcccctg

SEQ ID NO: 65552 - DNA, 20 bp, synthetic construct
  misc_feature 1..20: note = CRISPR gRNA sequence
  source 1..20: mol_type = other DNA
ccttcccctgctcagagcct

SEQ ID NO: 65553 - DNA, 20 bp, synthetic construct
  misc_feature 1..20: note = CRISPR gRNA sequence
  source 1..20: mol_type = other DNA
cccctgctcagagcctgctc

SEQ ID NO: 65554 - DNA, 20 bp, synthetic construct
  misc_feature 1..20: note = CRISPR gRNA sequence
  source 1..20: mol_type = other DNA
ccctgctcagagcctgctcc

SEQ ID NO: 65555 - DNA, 20 bp, synthetic construct
  misc_feature 1..20: note = CRISPR gRNA sequence
  source 1..20: mol_type = other DNA
ctcagagcctgctcccaaac

SEQ ID NO: 65556 - DNA, 20 bp, synthetic construct
  misc_feature 1..20: note = CRISPR gRNA sequence
  source 1..20: mol_type = other DNA
agagcctgctcccaaacctg

SEQ ID NO: 65557 - DNA, 20 bp, synthetic construct
  misc_feature 1..20: note = CRISPR gRNA sequence
  source 1..20: mol_type = other DNA
ctcccaaacctgtgcccagg

SEQ ID NO: 65558 - DNA, 20 bp, synthetic construct
  misc_feature 1..20: note = CRISPR gRNA sequence
  source 1..20: mol_type = other DNA
ccaaacctgtgcccaggccc

SEQ ID NO: 65559 - DNA, 20 bp, synthetic construct
  misc_feature 1..20: note = CRISPR gRNA sequence
  source 1..20: mol_type = other DNA
tgcccaggccccacatgctc

SEQ ID NO: 65560 - DNA, 20 bp, synthetic construct
  misc_feature 1..20: note = CRISPR gRNA sequence
  source 1..20: mol_type = other DNA
cctgaaggacacctgacctg

SEQ ID NO: 65561 - DNA, 20 bp, synthetic construct
  misc_feature 1..20: note = CRISPR gRNA sequence
  source 1..20: mol_type = other DNA
aaggacacctgacctgctgt

SEQ ID NO: 65562 - DNA, 20 bp, synthetic construct
  misc_feature 1..20: note = CRISPR gRNA sequence
  source 1..20: mol_type = other DNA
acctgctgtgtccaggggtc

SEQ ID NO: 65563 - DNA, 20 bp, synthetic construct
  misc_feature 1..20: note = CRISPR gRNA sequence
  source 1..20: mol_type = other DNA
ctgtgtccaggggtcatggc

SEQ ID NO: 65564 - DNA, 20 bp, synthetic construct
  misc_feature 1..20: note = CRISPR gRNA sequence
  source 1..20: mol_type = other DNA
tgtccaggggtcatggcctg

SEQ ID NO: 65565 - DNA, 20 bp, synthetic construct
  misc_feature 1..20: note = CRISPR gRNA sequence
  source 1..20: mol_type = other DNA
gcttccctacctcctacctc

SEQ ID NO: 65566 - DNA, 20 bp, synthetic construct
  misc_feature 1..20: note = CRISPR gRNA sequence
  source 1..20: mol_type = other DNA
ccctacctcctacctcccct

SEQ ID NO: 65567 - DNA, 20 bp, synthetic construct
  misc_feature 1..20: note = CRISPR gRNA sequence
  source 1..20: mol_type = other DNA
cctacctcctacctcccctg

SEQ ID NO: 65568 - DNA, 20 bp, synthetic construct
  misc_feature 1..20: note = CRISPR gRNA sequence
  source 1..20: mol_type = other DNA
cctcctacctcccctgccca

SEQ ID NO: 65569 - DNA, 20 bp, synthetic construct
  misc_feature 1..20: note = CRISPR gRNA sequence
  source 1..20: mol_type = other DNA
ctacctcccctgcccagccc

SEQ ID NO: 65570 - DNA, 20 bp, synthetic construct
  misc_feature 1..20: note = CRISPR gRNA sequence
  source 1..20: mol_type = other DNA
cctcccctgcccagcccacc

SEQ ID NO: 65571 - DNA, 20 bp, synthetic construct
  misc_feature 1..20: note = CRISPR gRNA sequence
  source 1..20: mol_type = other DNA
ccctgcccagcccaccccag

SEQ ID NO: 65572 - DNA, 20 bp, synthetic construct
  misc_feature 1..20: note = CRISPR gRNA sequence
  source 1..20: mol_type = other DNA
cccagcccaccccagacagg

SEQ ID NO: 65573 - DNA, 20 bp, synthetic construct
  misc_feature 1..20: note = CRISPR gRNA sequence
  source 1..20: mol_type = other DNA
acaaggcagccccgtcaacc

SEQ ID NO: 65574 - DNA, 20 bp, synthetic construct
  misc_feature 1..20: note = CRISPR gRNA sequence
  source 1..20: mol_type = other DNA
cccaagcccaggagacccca

SEQ ID NO: 65575 - DNA, 20 bp, synthetic construct
  misc_feature 1..20: note = CRISPR gRNA sequence
  source 1..20: mol_type = other DNA
ccaagcccaggagaccccac

SEQ ID NO: 65576 - DNA, 20 bp, synthetic construct
  misc_feature 1..20: note = CRISPR gRNA sequence
  source 1..20: mol_type = other DNA
cccttagctccctgaccccc

SEQ ID NO: 65577 - DNA, 20 bp, synthetic construct
  misc_feature 1..20: note = CRISPR gRNA sequence
  source 1..20: mol_type = other DNA
agctccctgacccccagcag

SEQ ID NO: 65578 - DNA, 20 bp, synthetic construct
  misc_feature 1..20: note = CRISPR gRNA sequence
  source 1..20: mol_type = other DNA
gctccctgacccccagcagc

SEQ ID NO: 65579 - DNA, 20 bp, synthetic construct
  misc_feature 1..20: note = CRISPR gRNA sequence
  source 1..20: mol_type = other DNA
cctgacccccagcagctgag

SEQ ID NO: 65580 - DNA, 20 bp, synthetic construct
  misc_feature 1..20: note = CRISPR gRNA sequence
  source 1..20: mol_type = other DNA
acccccagcagctgaggggt

SEQ ID NO: 65581 - DNA, 20 bp, synthetic construct
  misc_feature 1..20: note = CRISPR gRNA sequence
  source 1..20: mol_type = other DNA
aggggttgtggagactctga

SEQ ID NO: 65582 - DNA, 20 bp, synthetic construct
  misc_feature 1..20: note = CRISPR gRNA sequence
  source 1..20: mol_type = other DNA
tggagactctgaaaagaggt

SEQ ID NO: 65583 - DNA, 20 bp, synthetic construct
  misc_feature 1..20: note = CRISPR gRNA sequence
  source 1..20: mol_type = other DNA
tgaaaagaggtgaaggggag

SEQ ID NO: 65584 - DNA, 20 bp, synthetic construct
  misc_feature 1..20: note = CRISPR gRNA sequence
  source 1..20: mol_type = other DNA
aaaagaggtgaaggggagca

SEQ ID NO: 65585 - DNA, 20 bp, synthetic construct
  misc_feature 1..20: note = CRISPR gRNA sequence
  source 1..20: mol_type = other DNA
ggctccttctgtcatgatcc

SEQ ID NO: 65586 - DNA, 20 bp, synthetic construct
  misc_feature 1..20: note = CRISPR gRNA sequence
  source 1..20: mol_type = other DNA
cttctgtcatgatcctggtg

SEQ ID NO: 65587 - DNA, 20 bp, synthetic construct
  misc_feature 1..20: note = CRISPR gRNA sequence
  source 1..20: mol_type = other DNA
ctgtcatgatcctggtgcct

SEQ ID NO: 65588 - DNA, 20 bp, synthetic construct
  misc_feature 1..20: note = CRISPR gRNA sequence
  source 1..20: mol_type = other DNA
tgtcatgatcctggtgcctg

SEQ ID NO: 65589 - DNA, 20 bp, synthetic construct
  misc_feature 1..20: note = CRISPR gRNA sequence
  source 1..20: mol_type = other DNA
tcatgatcctggtgcctggg

SEQ ID NO: 65590 - DNA, 20 bp, synthetic construct
  misc_feature 1..20: note = CRISPR gRNA sequence
  source 1..20: mol_type = other DNA
gtgcctgggcctgggggctc

SEQ ID NO: 65591 - DNA, 20 bp, synthetic construct
  misc_feature 1..20: note = CRISPR gRNA sequence
  source 1..20: mol_type = other DNA
ggcctgggggctcccatcag

SEQ ID NO: 65592 - DNA, 20 bp, synthetic construct
  misc_feature 1..20: note = CRISPR gRNA sequence
  source 1..20: mol_type = other DNA
ggggctcccatcagcactct

SEQ ID NO: 65593 - DNA, 20 bp, synthetic construct
  misc_feature 1..20: note = CRISPR gRNA sequence
  source 1..20: mol_type = other DNA
ccatcagcactcttcccccc

SEQ ID NO: 65594 - DNA, 20 bp, synthetic construct
  misc_feature 1..20: note = CRISPR gRNA sequence
  source 1..20: mol_type = other DNA
ttccccccttctctcttggt

SEQ ID NO: 65595 - DNA, 20 bp, synthetic construct
  misc_feature 1..20: note = CRISPR gRNA sequence
  source 1..20: mol_type = other DNA
ccccccttctctcttggtct

SEQ ID NO: 65596 - DNA, 20 bp, synthetic construct
  misc_feature 1..20: note = CRISPR gRNA sequence
  source 1..20: mol_type = other DNA
cccccttctctcttggtctt

SEQ ID NO: 65597 - DNA, 20 bp, synthetic construct
  misc_feature 1..20: note = CRISPR gRNA sequence
  source 1..20: mol_type = other DNA
ctctcttggtctttgtctgt

SEQ ID NO: 65598 - DNA, 20 bp, synthetic construct
  misc_feature 1..20: note = CRISPR gRNA sequence
  source 1..20: mol_type = other DNA
tctcttggtctttgtctgtc

SEQ ID NO: 65599 - DNA, 20 bp, synthetic construct
  misc_feature 1..20: note = CRISPR gRNA sequence
  source 1..20: mol_type = other DNA
tcttggtctttgtctgtcct

SEQ ID NO: 65600 - DNA, 20 bp, synthetic construct
  misc_feature 1..20: note = CRISPR gRNA sequence
  source 1..20: mol_type = other DNA
ttggtctttgtctgtcctaa

SEQ ID NO: 65601 - DNA, 20 bp, synthetic construct
  misc_feature 1..20: note = CRISPR gRNA sequence
  source 1..20: mol_type = other DNA
ggtctttgtctgtcctaatc

SEQ ID NO: 65602 - DNA, 20 bp, synthetic construct
  misc_feature 1..20: note = CRISPR gRNA sequence
  source 1..20: mol_type = other DNA
gtctttgtctgtcctaatct

SEQ ID NO: 65603 - DNA, 20 bp, synthetic construct
  misc_feature 1..20: note = CRISPR gRNA sequence
  source 1..20: mol_type = other DNA
tgtctgtcctaatctccctc

SEQ ID NO: 65604 - DNA, 20 bp, synthetic construct
  misc_feature 1..20: note = CRISPR gRNA sequence
  source 1..20: mol_type = other DNA
gtctgtcctaatctccctct

SEQ ID NO: 65605 - DNA, 20 bp, synthetic construct
  misc_feature 1..20: note = CRISPR gRNA sequence
  source 1..20: mol_type = other DNA
tctgtcctaatctccctctg

SEQ ID NO: 65606 - DNA, 20 bp, synthetic construct
  misc_feature 1..20: note = CRISPR gRNA sequence
  source 1..20: mol_type = other DNA
tcctaatctccctctgtccc

SEQ ID NO: 65607 - DNA, 20 bp, synthetic construct
  misc_feature 1..20: note = CRISPR gRNA sequence
  source 1..20: mol_type = other DNA
atctccctctgtccctctgc

SEQ ID NO: 65608 - DNA, 20 bp, synthetic construct
  misc_feature 1..20: note = CRISPR gRNA sequence
  source 1..20: mol_type = other DNA
cctctgtccctctgcctgtt

SEQ ID NO: 65609 - DNA, 20 bp, synthetic construct
  misc_feature 1..20: note = CRISPR gRNA sequence
  source 1..20: mol_type = other DNA
tgtccctctgcctgtttctc

SEQ ID NO: 65610 - DNA, 20 bp, synthetic construct
  misc_feature 1..20: note = CRISPR gRNA sequence
  source 1..20: mol_type = other DNA
tccctctgcctgtttctctc

SEQ ID NO: 65611 - DNA, 20 bp, synthetic construct
  misc_feature 1..20: note = CRISPR gRNA sequence
  source 1..20: mol_type = other DNA
tgcctgtttctctcatttct

SEQ ID NO: 65612 - DNA, 20 bp, synthetic construct
  misc_feature 1..20: note = CRISPR gRNA sequence
  source 1..20: mol_type = other DNA
cctgtttctctcatttcttc

SEQ ID NO: 65613 - DNA, 20 bp, synthetic construct
  misc_feature 1..20: note = CRISPR gRNA sequence
  source 1..20: mol_type = other DNA
tttctctcatttcttccctc

SEQ ID NO: 65614 - DNA, 20 bp, synthetic construct
  misc_feature 1..20: note = CRISPR gRNA sequence
  source 1..20: mol_type = other DNA
ctctcatttcttccctctct

SEQ ID NO: 65615 - DNA, 20 bp, synthetic construct
  misc_feature 1..20: note = CRISPR gRNA sequence
  source 1..20: mol_type = other DNA
tctcatttcttccctctctc

SEQ ID NO: 65616 - DNA, 20 bp, synthetic construct
  misc_feature 1..20: note = CRISPR gRNA sequence
  source 1..20: mol_type = other DNA
tcatttcttccctctctcat

SEQ ID NO: 65617 - DNA, 20 bp, synthetic construct
  misc_feature 1..20: note = CRISPR gRNA sequence
  source 1..20: mol_type = other DNA
atttcttccctctctcatcg

SEQ ID NO: 65618 - DNA, 20 bp, synthetic construct
  misc_feature 1..20: note = CRISPR gRNA sequence
  source 1..20: mol_type = other DNA
cttccctctctcatcgtgta

SEQ ID NO: 65619 - DNA, 20 bp, synthetic construct
  misc_feature 1..20: note = CRISPR gRNA sequence
  source 1..20: mol_type = other DNA
ttccctctctcatcgtgtat

SEQ ID NO: 65620 - DNA, 20 bp, synthetic construct
  misc_feature 1..20: note = CRISPR gRNA sequence
  source 1..20: mol_type = other DNA
ccctctctcatcgtgtattt

SEQ ID NO: 65621 - DNA, 20 bp, synthetic construct
  misc_feature 1..20: note = CRISPR gRNA sequence
  source 1..20: mol_type = other DNA
cctctctcatcgtgtatttc

SEQ ID NO: 65622 - DNA, 20 bp, synthetic construct
  misc_feature 1..20: note = CRISPR gRNA sequence
  source 1..20: mol_type = other DNA
tctcatcgtgtatttctgtt

SEQ ID NO: 65623 - DNA, 20 bp, synthetic construct
  misc_feature 1..20: note = CRISPR gRNA sequence
  source 1..20: mol_type = other DNA
tcatcgtgtatttctgtttt

SEQ ID NO: 65624 - DNA, 20 bp, synthetic construct
  misc_feature 1..20: note = CRISPR gRNA sequence
  source 1..20: mol_type = other DNA
atcgtgtatttctgttttat

SEQ ID NO: 65625 - DNA, 20 bp, synthetic construct
  misc_feature 1..20: note = CRISPR gRNA sequence
  source 1..20: mol_type = other DNA
ctgttttatcagtttattta

SEQ ID NO: 65626 - DNA, 20 bp, synthetic construct
  misc_feature 1..20: note = CRISPR gRNA sequence
  source 1..20: mol_type = other DNA
tgttttatcagtttatttaa

SEQ ID NO: 65627 - DNA, 20 bp, synthetic construct
  misc_feature 1..20: note = CRISPR gRNA sequence
  source 1..20: mol_type = other DNA
ttttatcagtttatttaact

SEQ ID NO: 65628 - DNA, 20 bp, synthetic construct
  misc_feature 1..20: note = CRISPR gRNA sequence
  source 1..20: mol_type = other DNA
tatcagtttatttaactgtt

SEQ ID NO: 65629 - DNA, 20 bp, synthetic construct
  misc_feature 1..20: note = CRISPR gRNA sequence
  source 1..20: mol_type = other DNA
atcagtttatttaactgtta

SEQ ID NO: 65630 - DNA, 20 bp, synthetic construct
  misc_feature 1..20: note = CRISPR gRNA sequence
  source 1..20: mol_type = other DNA
tcagtttatttaactgttat

SEQ ID NO: 65631 - DNA, 20 bp, synthetic construct
  misc_feature 1..20: note = CRISPR gRNA sequence
  source 1..20: mol_type = other DNA
atttaactgttatttcagtc

SEQ ID NO: 65632 - DNA, 20 bp, synthetic construct
  misc_feature 1..20: note = CRISPR gRNA sequence
  source 1..20: mol_type = other DNA
tttaactgttatttcagtct

SEQ ID NO: 65633 - DNA, 20 bp, synthetic construct
  misc_feature 1..20: note = CRISPR gRNA sequence
  source 1..20: mol_type = other DNA
aactgttatttcagtcttat

SEQ ID NO: 65634 - DNA, 20 bp, synthetic construct
  misc_feature 1..20: note = CRISPR gRNA sequence
  source 1..20: mol_type = other DNA
actgttatttcagtcttatc

SEQ ID NO: 65635 - DNA, 20 bp, synthetic construct
  misc_feature 1..20: note = CRISPR gRNA sequence
  source 1..20: mol_type = other DNA
ttatttcagtcttatctgtc

SEQ ID NO: 65636 - DNA, 20 bp, synthetic construct
  misc_feature 1..20: note = CRISPR gRNA sequence
  source 1..20: mol_type = other DNA
tttcagtcttatctgtcttc

SEQ ID NO: 65637 - DNA, 20 bp, synthetic construct
  misc_feature 1..20: note = CRISPR gRNA sequence
  source 1..20: mol_type = other DNA
cagtcttatctgtcttcctc

SEQ ID NO: 65638 - DNA, 20 bp, synthetic construct
  misc_feature 1..20: note = CRISPR gRNA sequence
  source 1..20: mol_type = other DNA
agtcttatctgtcttcctct

SEQ ID NO: 65639 - DNA, 20 bp, synthetic construct
  misc_feature 1..20: note = CRISPR gRNA sequence
  source 1..20: mol_type = other DNA
atctgtcttcctctgatctg

SEQ ID NO: 65640 - DNA, 20 bp, synthetic construct
  misc_feature 1..20: note = CRISPR gRNA sequence
  source 1..20: mol_type = other DNA
tctgtcttcctctgatctgc

SEQ ID NO: 65641 - DNA, 20 bp, synthetic construct
  misc_feature 1..20: note = CRISPR gRNA sequence
  source 1..20: mol_type = other DNA
tcttcctctgatctgctctc

SEQ ID NO: 65642 - DNA, 20 bp, synthetic construct
  misc_feature 1..20: note = CRISPR gRNA sequence
  source 1..20: mol_type = other DNA
cctctgatctgctctctctc

SEQ ID NO: 65643 - DNA, 20 bp, synthetic construct
  misc_feature 1..20: note = CRISPR gRNA sequence
  source 1..20: mol_type = other DNA
ctctgatctgctctctctct

SEQ ID NO: 65644 - DNA, 20 bp, synthetic construct
  misc_feature 1..20: note = CRISPR gRNA sequence
  source 1..20: mol_type = other DNA
tgatctgctctctctctctg

SEQ ID NO: 65645 - DNA, 20 bp, synthetic construct
  misc_feature 1..20: note = CRISPR gRNA sequence
  source 1..20: mol_type = other DNA
atctgctctctctctctgag

SEQ ID NO: 65646 - DNA, 20 bp, synthetic construct
  misc_feature 1..20: note = CRISPR gRNA sequence
  source 1..20: mol_type = other DNA
ctctctctctctgaggtctc

SEQ ID NO: 65647 - DNA, 20 bp, synthetic construct
  misc_feature 1..20: note = CRISPR gRNA sequence
  source 1..20: mol_type = other DNA
tctctctctgaggtctctgt

SEQ ID NO: 65648 - DNA, 20 bp, synthetic construct
  misc_feature 1..20: note = CRISPR gRNA sequence
  source 1..20: mol_type = other DNA
tctctctgaggtctctgtgc

SEQ ID NO: 65649 - DNA, 20 bp, synthetic construct
  misc_feature 1..20: note = CRISPR gRNA sequence
  source 1..20: mol_type = other DNA
tctctgaggtctctgtgcct

SEQ ID NO: 65650 - DNA, 20 bp, synthetic construct
  misc_feature 1..20: note = CRISPR gRNA sequence
  source 1..20: mol_type = other DNA
tctgaggtctctgtgccttg

SEQ ID NO: 65651 - DNA, 20 bp, synthetic construct
  misc_feature 1..20: note = CRISPR gRNA sequence
  source 1..20: mol_type = other DNA
tgaggtctctgtgccttggt

SEQ ID NO: 65652 - DNA, 20 bp, synthetic construct
  misc_feature 1..20: note = CRISPR gRNA sequence
  source 1..20: mol_type = other DNA
aggtctctgtgccttggttt

SEQ ID NO: 65653 - DNA, 20 bp, synthetic construct
  misc_feature 1..20: note = CRISPR gRNA sequence
  source 1..20: mol_type = other DNA
tgtgccttggtttccttcca

SEQ ID NO: 65654 - DNA, 20 bp, synthetic construct
  misc_feature 1..20: note = CRISPR gRNA sequence
  source 1..20: mol_type = other DNA
tgccttggtttccttccatc

SEQ ID NO: 65655 - DNA, 20 bp, synthetic construct
  misc_feature 1..20: note = CRISPR gRNA sequence
  source 1..20: mol_type = other DNA
ggtttccttccatctgtgtc

SEQ ID NO: 65656 - DNA, 20 bp, synthetic construct
  misc_feature 1..20: note = CRISPR gRNA sequence
  source 1..20: mol_type = other DNA
gtttccttccatctgtgtct

SEQ ID NO: 65657 - DNA, 20 bp, synthetic construct
  misc_feature 1..20: note = CRISPR gRNA sequence
  source 1..20: mol_type = other DNA
ccttccatctgtgtctctgc

SEQ ID NO: 65658 - DNA, 20 bp, synthetic construct
  misc_feature 1..20: note = CRISPR gRNA sequence
  source 1..20: mol_type = other DNA
cttccatctgtgtctctgcc

SEQ ID NO: 65659 - DNA, 20 bp, synthetic construct
  misc_feature 1..20: note = CRISPR gRNA sequence
  source 1..20: mol_type = other DNA
ccatctgtgtctctgcccac

SEQ ID NO: 65660 - DNA, 20 bp, synthetic construct
  misc_feature 1..20: note = CRISPR gRNA sequence
  source 1..20: mol_type = other DNA
catctgtgtctctgcccacc

SEQ ID NO: 65661 - DNA, 20 bp, synthetic construct
  misc_feature 1..20: note = CRISPR gRNA sequence
  source 1..20: mol_type = other DNA
tgtctctgcccaccctctgc

SEQ ID NO: 65662 - DNA, 20 bp, synthetic construct
  misc_feature 1..20: note = CRISPR gRNA sequence
  source 1..20: mol_type = other DNA
tgcccaccctctgcctatat

SEQ ID NO: 65663 - DNA, 20 bp, synthetic construct
  misc_feature 1..20: note = CRISPR gRNA sequence
  source 1..20: mol_type = other DNA
cccaccctctgcctatatgt

SEQ ID NO: 65664 - DNA, 20 bp, synthetic construct
  misc_feature 1..20: note = CRISPR gRNA sequence
  source 1..20: mol_type = other DNA
tgcctatatgtgacatcctg

SEQ ID NO: 65665 - DNA, 20 bp, synthetic construct
  misc_feature 1..20: note = CRISPR gRNA sequence
  source 1..20: mol_type = other DNA
cctatatgtgacatcctgtg

SEQ ID NO: 65666 - DNA, 20 bp, synthetic construct
  misc_feature 1..20: note = CRISPR gRNA sequence
  source 1..20: mol_type = other DNA
tatgtgacatcctgtgggtg

SEQ ID NO: 65667 - DNA, 20 bp, synthetic construct
  misc_feature 1..20: note = CRISPR gRNA sequence
  source 1..20: mol_type = other DNA
tgggtgtcgtgtgtgttggt

SEQ ID NO: 65668 - DNA, 20 bp, synthetic construct
  misc_feature 1..20: note = CRISPR gRNA sequence
  source 1..20: mol_type = other DNA
gtccctctttgtccgtctgt

SEQ ID NO: 65669 - DNA, 20 bp, synthetic construct
  misc_feature 1..20: note = CRISPR gRNA sequence
  source 1..20: mol_type = other DNA
tttgtccgtctgtctaggtg

SEQ ID NO: 65670 - DNA, 20 bp, synthetic construct
  misc_feature 1..20: note = CRISPR gRNA sequence
  source 1..20: mol_type = other DNA
tgtccgtctgtctaggtgcc

SEQ ID NO: 65671 - DNA, 20 bp, synthetic construct
  misc_feature 1..20: note = CRISPR gRNA sequence
  source 1..20: mol_type = other DNA
gtccgtctgtctaggtgcca

SEQ ID NO: 65672 - DNA, 20 bp, synthetic construct
  misc_feature 1..20: note = CRISPR gRNA sequence
  source 1..20: mol_type = other DNA
tccgtctgtctaggtgccag

SEQ ID NO: 65673 - DNA, 20 bp, synthetic construct
  misc_feature 1..20: note = CRISPR gRNA sequence
  source 1..20: mol_type = other DNA
tctaggtgccagatacatcc

SEQ ID NO: 65674 - DNA, 20 bp, synthetic construct
  misc_feature 1..20: note = CRISPR gRNA sequence
  source 1..20: mol_type = other DNA
ggtgccagatacatcccagt

SEQ ID NO: 65675 - DNA, 20 bp, synthetic construct
  misc_feature 1..20: note = CRISPR gRNA sequence
  source 1..20: mol_type = other DNA
ctctcctgcaagcctcattc

SEQ ID NO: 65676 - DNA, 20 bp, synthetic construct
  misc_feature 1..20: note = CRISPR gRNA sequence
  source 1..20: mol_type = other DNA
tcctgcaagcctcattctct

SEQ ID NO: 65677 - DNA, 20 bp, synthetic construct
  misc_feature 1..20: note = CRISPR gRNA sequence
  source 1..20: mol_type = other DNA
ctgcaagcctcattctctgc

SEQ ID NO: 65678 - DNA, 20 bp, synthetic construct
  misc_feature 1..20: note = CRISPR gRNA sequence
  source 1..20: mol_type = other DNA
caagcctcattctctgcctc

SEQ ID NO: 65679 - DNA, 20 bp, synthetic construct
  misc_feature 1..20: note = CRISPR gRNA sequence
  source 1..20: mol_type = other DNA
attctctgcctctgtgtctg

SEQ ID NO: 65680 - DNA, 20 bp, synthetic construct
  misc_feature 1..20: note = CRISPR gRNA sequence
  source 1..20: mol_type = other DNA
tctgcctctgtgtctggggg

SEQ ID NO: 65681 - DNA, 20 bp, synthetic construct
  misc_feature 1..20: note = CRISPR gRNA sequence
  source 1..20: mol_type = other DNA
tgcctctgtgtctggggggt

SEQ ID NO: 65682 - DNA, 20 bp, synthetic construct
  misc_feature 1..20: note = CRISPR gRNA sequence
  source 1..20: mol_type = other DNA
cctctgtgtctggggggtgg

SEQ ID NO: 65683 - DNA, 20 bp, synthetic construct
  misc_feature 1..20: note = CRISPR gRNA sequence
  source 1..20: mol_type = other DNA
tgtgtctggggggtgggaaa

SEQ ID NO: 65684 - DNA, 20 bp, synthetic construct
  misc_feature 1..20: note = CRISPR gRNA sequence
  source 1..20: mol_type = other DNA
tgtctggggggtgggaaagc

SEQ ID NO: 65685 - DNA, 20 bp, synthetic construct
  misc_feature 1..20: note = CRISPR gRNA sequence
  source 1..20: mol_type = other DNA
gggggtgggaaagcggctcc

SEQ ID NO: 65686 - DNA, 20 bp, synthetic construct
  misc_feature 1..20: note = CRISPR gRNA sequence
  source 1..20: mol_type = other DNA
cttcccgcctctgttcagtg

SEQ ID NO: 65687 - DNA, 20 bp, synthetic construct
  misc_feature 1..20: note = CRISPR gRNA sequence
  source 1..20: mol_type = other DNA
cccgcctctgttcagtgggg

SEQ ID NO: 65688 - DNA, 20 bp, synthetic construct
  misc_feature 1..20: note = CRISPR gRNA sequence
  source 1..20: mol_type = other DNA
ccgcctctgttcagtggggc

SEQ ID NO: 65689 - DNA, 20 bp, synthetic construct
  misc_feature 1..20: note = CRISPR gRNA sequence
  source 1..20: mol_type = other DNA
tgttcagtggggcatgcagc

SEQ ID NO: 65690 - DNA, 20 bp, synthetic construct
  misc_feature 1..20: note = CRISPR gRNA sequence
  source 1..20: mol_type = other DNA
ttcagtggggcatgcagcac

SEQ ID NO: 65691 - DNA, 20 bp, synthetic construct
  misc_feature 1..20: note = CRISPR gRNA sequence
  source 1..20: mol_type = other DNA
agtggggcatgcagcactgt

SEQ ID NO: 65692 - DNA, 20 bp, synthetic construct
  misc_feature 1..20: note = CRISPR gRNA sequence
  source 1..20: mol_type = other DNA
tgtttttgtccctgggcagg

SEQ ID NO: 65693 - DNA, 20 bp, synthetic construct
  misc_feature 1..20: note = CRISPR gRNA sequence
  source 1..20: mol_type = other DNA
ttgtccctgggcaggctgac

SEQ ID NO: 65694 - DNA, 20 bp, synthetic construct
  misc_feature 1..20: note = CRISPR gRNA sequence
  source 1..20: mol_type = other DNA
tgtccctgggcaggctgaca

SEQ ID NO: 65695 - DNA, 20 bp, synthetic construct
  misc_feature 1..20: note = CRISPR gRNA sequence
  source 1..20: mol_type = other DNA
gtccctgggcaggctgacac

SEQ ID NO: 65696 - DNA, 20 bp, synthetic construct
  misc_feature 1..20: note = CRISPR gRNA sequence
  source 1..20: mol_type = other DNA
tccctgggcaggctgacaca

SEQ ID NO: 65697 - DNA, 20 bp, synthetic construct
  misc_feature 1..20: note = CRISPR gRNA sequence
  source 1..20: mol_type = other DNA
ggcaggctgacacattgtgg

SEQ ID NO: 65698 - DNA, 20 bp, synthetic construct
  misc_feature 1..20: note = CRISPR gRNA sequence
  source 1..20: mol_type = other DNA
acacattgtggcctccaaga

SEQ ID NO: 65699 - DNA, 20 bp, synthetic construct
  misc_feature 1..20: note = CRISPR gRNA sequence
  source 1..20: mol_type = other DNA
tggcctccaagaaaagcacc

SEQ ID NO: 65700 - DNA, 20 bp, synthetic construct
  misc_feature 1..20: note = CRISPR gRNA sequence
  source 1..20: mol_type = other DNA
caagaaaagcacctagagca

SEQ ID NO: 65701 - DNA, 20 bp, synthetic construct
  misc_feature 1..20: note = CRISPR gRNA sequence
  source 1..20: mol_type = other DNA
gagcagctctgcaaggctct

SEQ ID NO: 65702 - DNA, 20 bp, synthetic construct
  misc_feature 1..20: note = CRISPR gRNA sequence
  source 1..20: mol_type = other DNA
tgcaaggctctgggaggaag

SEQ ID NO: 65703 - DNA, 20 bp, synthetic construct
  misc_feature 1..20: note = CRISPR gRNA sequence
  source 1..20: mol_type = other DNA
caaggctctgggaggaagct

SEQ ID NO: 65704 - DNA, 20 bp, synthetic construct
  misc_feature 1..20: note = CRISPR gRNA sequence
  source 1..20: mol_type = other DNA
tgggaggaagctgccacctc

SEQ ID NO: 65705 - DNA, 20 bp, synthetic construct
  misc_feature 1..20: note = CRISPR gRNA sequence
  source 1..20: mol_type = other DNA
ggaggaagctgccacctcgg

SEQ ID NO: 65706 - DNA, 20 bp, synthetic construct
  misc_feature 1..20: note = CRISPR gRNA sequence
  source 1..20: mol_type = other DNA
ccacctcggtcacctccacc

SEQ ID NO: 65707 - DNA, 20 bp, synthetic construct
  misc_feature 1..20: note = CRISPR gRNA sequence
  source 1..20: mol_type = other DNA
ggtcacctccacctcgagtg

SEQ ID NO: 65708 - DNA, 20 bp, synthetic construct
  misc_feature 1..20: note = CRISPR gRNA sequence
  source 1..20: mol_type = other DNA
cacctcgagtgagtggtttg

SEQ ID NO: 65709 - DNA, 20 bp, synthetic construct
  misc_feature 1..20: note = CRISPR gRNA sequence
  source 1..20: mol_type = other DNA
gagtgagtggtttgtgtgtt

SEQ ID NO: 65710 - DNA, 20 bp, synthetic construct
  misc_feature 1..20: note = CRISPR gRNA sequence
  source 1..20: mol_type = other DNA
gtgtgttggaaggtgggtgg

SEQ ID NO: 65711 - DNA, 20 bp, synthetic construct
  misc_feature 1..20: note = CRISPR gRNA sequence
  source 1..20: mol_type = other DNA
tgtgttggaaggtgggtggg

SEQ ID NO: 65712 - DNA, 20 bp, synthetic construct
  misc_feature 1..20: note = CRISPR gRNA sequence
  source 1..20: mol_type = other DNA
gaaggtgggtgggtggggcc

SEQ ID NO: 65713 - DNA, 20 bp, synthetic construct
  misc_feature 1..20: note = CRISPR gRNA sequence
  source 1..20: mol_type = other DNA
cagtgagttagtgttggtgt

SEQ ID NO: 65714 - DNA, 20 bp, synthetic construct
  misc_feature 1..20: note = CRISPR gRNA sequence
  source 1..20: mol_type = other DNA
gtgttggtgtttgggtttgg

SEQ ID NO: 65715 - DNA, 20 bp, synthetic construct
  misc_feature 1..20: note = CRISPR gRNA sequence
  source 1..20: mol_type = other DNA
gtgtttgggtttggttttta

SEQ ID NO: 65716 - DNA, 20 bp, synthetic construct
  misc_feature 1..20: note = CRISPR gRNA sequence
  source 1..20: mol_type = other DNA
gggtttggtttttaagattt

SEQ ID NO: 65717 - DNA, 20 bp, synthetic construct
  misc_feature 1..20: note = CRISPR gRNA sequence
  source 1..20: mol_type = other DNA
ggtttggtttttaagattta

SEQ ID NO: 65718 - DNA, 20 bp, synthetic construct
  misc_feature 1..20: note = CRISPR gRNA sequence
  source 1..20: mol_type = other DNA
ggtttttaagatttagatca

SEQ ID NO: 65719 - DNA, 20 bp, synthetic construct
  misc_feature 1..20: note = CRISPR gRNA sequence
  source 1..20: mol_type = other DNA
gtttttaagatttagatcaa

SEQ ID NO: 65720 - DNA, 20 bp, synthetic construct
  misc_feature 1..20: note = CRISPR gRNA sequence
  source 1..20: mol_type = other DNA
ttaagatttagatcaactgt

SEQ ID NO: 65721 - DNA, 20 bp, synthetic construct
  misc_feature 1..20: note = CRISPR gRNA sequence
  source 1..20: mol_type = other DNA
taagatttagatcaactgtt

SEQ ID NO: 65722 - DNA, 20 bp, synthetic construct
  misc_feature 1..20: note = CRISPR gRNA sequence
  source 1..20: mol_type = other DNA
aagatttagatcaactgttc

SEQ ID NO: 65723 - DNA, 20 bp, synthetic construct
  misc_feature 1..20: note = CRISPR gRNA sequence
  source 1..20: mol_type = other DNA
agatttagatcaactgttct

SEQ ID NO: 65724 - DNA, 20 bp, synthetic construct
  misc_feature 1..20: note = CRISPR gRNA sequence
  source 1..20: mol_type = other DNA
agatcaactgttctttccct

SEQ ID NO: 65725 - DNA, 20 bp, synthetic construct
  misc_feature 1..20: note = CRISPR gRNA sequence
  source 1..20: mol_type = other DNA
gatcaactgttctttccctg

SEQ ID NO: 65726 - DNA, 20 bp, synthetic construct
  misc_feature 1..20: note = CRISPR gRNA sequence
  source 1..20: mol_type = other DNA
ttctttccctgctgaagtca

SEQ ID NO: 65727 - DNA, 20 bp, synthetic construct
  misc_feature 1..20: note = CRISPR gRNA sequence
  source 1..20: mol_type = other DNA
tttccctgctgaagtcagaa

SEQ ID NO: 65728 - DNA, 20 bp, synthetic construct
  misc_feature 1..20: note = CRISPR gRNA sequence
  source 1..20: mol_type = other DNA
tccctgctgaagtcagaaac

SEQ ID NO: 65729 - DNA, 20 bp, synthetic construct
  misc_feature 1..20: note = CRISPR gRNA sequence
  source 1..20: mol_type = other DNA
ccctgctgaagtcagaaacc

SEQ ID NO: 65730 - DNA, 20 bp, synthetic construct
  misc_feature 1..20: note = CRISPR gRNA sequence
  source 1..20: mol_type = other DNA
cctgctgaagtcagaaaccc

SEQ ID NO: 65731 - DNA, 20 bp, synthetic construct
  misc_feature 1..20: note = CRISPR gRNA sequence
  source 1..20: mol_type = other DNA
ctgaagtcagaaaccccttg

SEQ ID NO: 65732 - DNA, 20 bp, synthetic construct
  misc_feature 1..20: note = CRISPR gRNA sequence
  source 1..20: mol_type = other DNA
aagtcagaaaccccttggag

SEQ ID NO: 65733 - DNA, 20 bp, synthetic construct
  misc_feature 1..20: note = CRISPR gRNA sequence
  source 1..20: mol_type = other DNA
ggagaatctggtgaaagttg

SEQ ID NO: 65734 - DNA, 20 bp, synthetic construct
  misc_feature 1..20: note = CRISPR gRNA sequence
  source 1..20: mol_type = other DNA
gagaatctggtgaaagttgt

SEQ ID NO: 65735 - DNA, 20 bp, synthetic construct
  misc_feature 1..20: note = CRISPR gRNA sequence
  source 1..20: mol_type = other DNA
gtgaaagttgtgactcttcc

SEQ ID NO: 65736 - DNA, 20 bp, synthetic construct
  misc_feature 1..20: note = CRISPR gRNA sequence
  source 1..20: mol_type = other DNA
tgactcttcctcccaagata

SEQ ID NO: 65737 - DNA, 20 bp, synthetic construct
  misc_feature 1..20: note = CRISPR gRNA sequence
  source 1..20: mol_type = other DNA
ttcctcccaagatacagatc

SEQ ID NO: 65738 - DNA, 20 bp, synthetic construct
  misc_feature 1..20: note = CRISPR gRNA sequence
  source 1..20: mol_type = other DNA
cctcccaagatacagatccc

SEQ ID NO: 65739 - DNA, 20 bp, synthetic construct
  misc_feature 1..20: note = CRISPR gRNA sequence
  source 1..20: mol_type = other DNA
ctcccaagatacagatcccc

SEQ ID NO: 65740 - DNA, 20 bp, synthetic construct
  misc_feature 1..20: note = CRISPR gRNA sequence
  source 1..20: mol_type = other DNA
ccaagatacagatcccccat

SEQ ID NO: 65741 - DNA, 20 bp, synthetic construct
  misc_feature 1..20: note = CRISPR gRNA sequence
  source 1..20: mol_type = other DNA
acacgctcggaggctcaccc

SEQ ID NO: 65742 - DNA, 20 bp, synthetic construct
  misc_feature 1..20: note = CRISPR gRNA sequence
  source 1..20: mol_type = other DNA
ggaggctcacccctggtccc

SEQ ID NO: 65743 - DNA, 20 bp, synthetic construct
  misc_feature 1..20: note = CRISPR gRNA sequence
  source 1..20: mol_type = other DNA
acccctggtccctcagaggt

SEQ ID NO: 65744 - DNA, 20 bp, synthetic construct
  misc_feature 1..20: note = CRISPR gRNA sequence
  source 1..20: mol_type = other DNA
gtccctcagaggtccacgaa

SEQ ID NO: 65745 - DNA, 20 bp, synthetic construct
  misc_feature 1..20: note = CRISPR gRNA sequence
  source 1..20: mol_type = other DNA
agaggtccacgaacctcaga

SEQ ID NO: 65746 - DNA, 20 bp, synthetic construct
  misc_feature 1..20: note = CRISPR gRNA sequence
  source 1..20: mol_type = other DNA
agaataagaacctgggggag

SEQ ID NO: 65747 - DNA, 20 bp, synthetic construct
  misc_feature 1..20: note = CRISPR gRNA sequence
  source 1..20: mol_type = other DNA
ggggagaccccagctgcccg

SEQ ID NO: 65748 - DNA, 20 bp, synthetic construct
  misc_feature 1..20: note = CRISPR gRNA sequence
  source 1..20: mol_type = other DNA
cccgtgccagatctgctgag

SEQ ID NO: 65749 - DNA, 20 bp, synthetic construct
  misc_feature 1..20: note = CRISPR gRNA sequence
  source 1..20: mol_type = other DNA
ctgagatctggcctggcagc

SEQ ID NO: 65750 - DNA, 20 bp, synthetic construct
  misc_feature 1..20: note = CRISPR gRNA sequence
  source 1..20: mol_type = other DNA
agatctggcctggcagccca

SEQ ID NO: 65751 - DNA, 20 bp, synthetic construct
  misc_feature 1..20: note = CRISPR gRNA sequence
  source 1..20: mol_type = other DNA
gcctggcagcccagggctgt

SEQ ID NO: 65752 - DNA, 20 bp, synthetic construct
  misc_feature 1..20: note = CRISPR gRNA sequence
  source 1..20: mol_type = other DNA
gcagcccagggctgtgtcca

SEQ ID NO: 65753 - DNA, 20 bp, synthetic construct
  misc_feature 1..20: note = CRISPR gRNA sequence
  source 1..20: mol_type = other DNA
tgtccagtttcaggaagttg

SEQ ID NO: 65754 - DNA, 20 bp, synthetic construct
  misc_feature 1..20: note = CRISPR gRNA sequence
  source 1..20: mol_type = other DNA
caggaagttgagtaactgga

SEQ ID NO: 65755 - DNA, 20 bp, synthetic construct
  misc_feature 1..20: note = CRISPR gRNA sequence
  source 1..20: mol_type = other DNA
aggaagttgagtaactggaa

SEQ ID NO: 65756 - DNA, 20 bp, synthetic construct
  misc_feature 1..20: note = CRISPR gRNA sequence
  source 1..20: mol_type = other DNA
agtaactggaatgcagggac

SEQ ID NO: 65757 - DNA, 20 bp, synthetic construct
  misc_feature 1..20: note = CRISPR gRNA sequence
  source 1..20: mol_type = other DNA
gaatgcagggaccatgctgc

SEQ ID NO: 65758 - DNA, 20 bp, synthetic construct
  misc_feature 1..20: note = CRISPR gRNA sequence
  source 1..20: mol_type = other DNA
ccagcaacccactccccacc

SEQ ID NO: 65759 - DNA, 20 bp, synthetic construct
  misc_feature 1..20: note = CRISPR gRNA sequence
  source 1..20: mol_type = other DNA
cccacctgctaatgttctcc

SEQ ID NO: 65760 - DNA, 20 bp, synthetic construct
  misc_feature 1..20: note = CRISPR gRNA sequence
  source 1..20: mol_type = other DNA
ctaatgttctcccctccctt

SEQ ID NO: 65761 - DNA, 20 bp, synthetic construct
  misc_feature 1..20: note = CRISPR gRNA sequence
  source 1..20: mol_type = other DNA
atgttctcccctcccttctc

SEQ ID NO: 65762 - DNA, 20 bp, synthetic construct
  misc_feature 1..20: note = CRISPR gRNA sequence
  source 1..20: mol_type = other DNA
tcccctcccttctccccacc

SEQ ID NO: 65763 - DNA, 20 bp, synthetic construct
  misc_feature 1..20: note = CRISPR gRNA sequence
  source 1..20: mol_type = other DNA
ccctcccttctccccacccc

SEQ ID NO: 65764 - DNA, 20 bp, synthetic construct
  misc_feature 1..20: note = CRISPR gRNA sequence
  source 1..20: mol_type = other DNA
ccttctccccacccccagct

SEQ ID NO: 65765 - DNA, 20 bp, synthetic construct
  misc_feature 1..20: note = CRISPR gRNA sequence
  source 1..20: mol_type = other DNA
ctccccacccccagcttctc

SEQ ID NO: 65766 - DNA, 20 bp, synthetic construct
  misc_feature 1..20: note = CRISPR gRNA sequence
  source 1..20: mol_type = other DNA
tccccacccccagcttctca

SEQ ID NO: 65767 - DNA, 20 bp, synthetic construct
  misc_feature 1..20: note = CRISPR gRNA sequence
  source 1..20: mol_type = other DNA
cccacccccagcttctcagg

SEQ ID NO: 65768 - DNA, 20 bp, synthetic construct
  misc_feature 1..20: note = CRISPR gRNA sequence
  source 1..20: mol_type = other DNA
ctcaggcaatgctctggggg

SEQ ID NO: 65769 - DNA, 20 bp, synthetic construct
  misc_feature 1..20: note = CRISPR gRNA sequence
  source 1..20: mol_type = other DNA
tcaggcaatgctctggggga

SEQ ID NO: 65770 - DNA, 20 bp, synthetic construct
  misc_feature 1..20: note = CRISPR gRNA sequence
  source 1..20: mol_type = other DNA
aggcaatgctctgggggatg

SEQ ID NO: 65771 - DNA, 20 bp, synthetic construct
  misc_feature 1..20: note = CRISPR gRNA sequence
  source 1..20: mol_type = other DNA
tgggggatgaaggtgcagcc

SEQ ID NO: 65772 - DNA, 20 bp, synthetic construct
  misc_feature 1..20: note = CRISPR gRNA sequence
  source 1..20: mol_type = other DNA
ggggatgaaggtgcagcccg

SEQ ID NO: 65773 - DNA, 20 bp, synthetic construct
  misc_feature 1..20: note = CRISPR gRNA sequence
  source 1..20: mol_type = other DNA
gctcagctgctcccagggct

SEQ ID NO: 65774 - DNA, 20 bp, synthetic construct
  misc_feature 1..20: note = CRISPR gRNA sequence
  source 1..20: mol_type = other DNA
agctgctcccagggctggga

SEQ ID NO: 65775 - DNA, 20 bp, synthetic construct
  misc_feature 1..20: note = CRISPR gRNA sequence
  source 1..20: mol_type = other DNA
ctcccagggctgggagctct

SEQ ID NO: 65776 - DNA, 20 bp, synthetic construct
  misc_feature 1..20: note = CRISPR gRNA sequence
  source 1..20: mol_type = other DNA
ccagggctgggagctctgca

SEQ ID NO: 65777 - DNA, 20 bp, synthetic construct
  misc_feature 1..20: note = CRISPR gRNA sequence
  source 1..20: mol_type = other DNA
ggagctctgcagtccttgaa

SEQ ID NO: 65778 - DNA, 20 bp, synthetic construct
  misc_feature 1..20: note = CRISPR gRNA sequence
  source 1..20: mol_type = other DNA
tgcagtccttgaagtgagta

SEQ ID NO: 65779 - DNA, 20 bp, synthetic construct
  misc_feature 1..20: note = CRISPR gRNA sequence
  source 1..20: mol_type = other DNA
cagtccttgaagtgagtagc

SEQ ID NO: 65780 - DNA, 20 bp, synthetic construct
  misc_feature 1..20: note = CRISPR gRNA sequence
  source 1..20: mol_type = other DNA
gaagtgagtagcccgctagg

SEQ ID NO: 65781 - DNA, 20 bp, synthetic construct
  misc_feature 1..20: note = CRISPR gRNA sequence
  source 1..20: mol_type = other DNA
aagtgagtagcccgctaggc

SEQ ID NO: 65782 - DNA, 20 bp, synthetic construct
  misc_feature 1..20: note = CRISPR gRNA sequence
  source 1..20: mol_type = other DNA
ggcagagcctctgaggctgg

SEQ ID NO: 65783 - DNA, 20 bp, synthetic construct
  misc_feature 1..20: note = CRISPR gRNA sequence
  source 1..20: mol_type = other DNA
tgaggctggggcaggggggg

SEQ ID NO: 65784 - DNA, 20 bp, synthetic construct
  misc_feature 1..20: note = CRISPR gRNA sequence
  source 1..20: mol_type = other DNA
aggctggggcagggggggag

SEQ ID NO: 65785 - DNA, 20 bp, synthetic construct
  misc_feature 1..20: note = CRISPR gRNA sequence
  source 1..20: mol_type = other DNA
gggcagggggggagcattct

SEQ ID NO: 65786 - DNA, 20 bp, synthetic construct
  misc_feature 1..20: note = CRISPR gRNA sequence
  source 1..20: mol_type = other DNA
tctgtcccatccccctcttt

SEQ ID NO: 65787 - DNA, 20 bp, synthetic construct
  misc_feature 1..20: note = CRISPR gRNA sequence
  source 1..20: mol_type = other DNA
tgtcccatccccctctttcc

SEQ ID NO: 65788 - DNA, 20 bp, synthetic construct
  misc_feature 1..20: note = CRISPR gRNA sequence
  source 1..20: mol_type = other DNA
tcccatccccctctttcctg

SEQ ID NO: 65789 - DNA, 20 bp, synthetic construct
  misc_feature 1..20: note = CRISPR gRNA sequence
  source 1..20: mol_type = other DNA
tttcctggggttattgtaaa

SEQ ID NO: 65790 - DNA, 20 bp, synthetic construct
  misc_feature 1..20: note = CRISPR gRNA sequence
  source 1..20: mol_type = other DNA
tcctggggttattgtaaaga

SEQ ID NO: 65791 - DNA, 20 bp, synthetic construct
  misc_feature 1..20: note = CRISPR gRNA sequence
  source 1..20: mol_type = other DNA
cctggggttattgtaaagat

SEQ ID NO: 65792 - DNA, 20 bp, synthetic construct
  misc_feature 1..20: note = CRISPR gRNA sequence
  source 1..20: mol_type = other DNA
ctggggttattgtaaagatt

SEQ ID NO: 65793 - DNA, 20 bp, synthetic construct
  misc_feature 1..20: note = CRISPR gRNA sequence
  source 1..20: mol_type = other DNA
gggttattgtaaagattaaa

SEQ ID NO: 65794 - DNA, 20 bp, synthetic construct
  misc_feature 1..20: note = CRISPR gRNA sequence
  source 1..20: mol_type = other DNA
ttgtaaagattaaatcggaa

SEQ ID NO: 65795 - DNA, 20 bp, synthetic construct
  misc_feature 1..20: note = CRISPR gRNA sequence
  source 1..20: mol_type = other DNA
taaagattaaatcggaaaat

SEQ ID NO: 65796 - DNA, 20 bp, synthetic construct
  misc_feature 1..20: note = CRISPR gRNA sequence
  source 1..20: mol_type = other DNA
aatcggaaaatgcatgaaaa

SEQ ID NO: 65797 - DNA, 20 bp, synthetic construct
  misc_feature 1..20: note = CRISPR gRNA sequence
  source 1..20: mol_type = other DNA
cccctaatacaatgtaagtt

SEQ ID NO: 65798 - DNA, 20 bp, synthetic construct
  misc_feature 1..20: note = CRISPR gRNA sequence
  source 1..20: mol_type = other DNA
atacaatgtaagttctcggt

SEQ ID NO: 65799 - DNA, 20 bp, synthetic construct
  misc_feature 1..20: note = CRISPR gRNA sequence
  source 1..20: mol_type = other DNA
tcggtgaaggctagctaata

SEQ ID NO: 65800 - DNA, 20 bp, synthetic construct
  misc_feature 1..20: note = CRISPR gRNA sequence
  source 1..20: mol_type = other DNA
ggtgaaggctagctaataga

SEQ ID NO: 65801 - DNA, 20 bp, synthetic construct
  misc_feature 1..20: note = CRISPR gRNA sequence
  source 1..20: mol_type = other DNA
gctaatagatgattcttact

SEQ ID NO: 65802 - DNA, 20 bp, synthetic construct
  misc_feature 1..20: note = CRISPR gRNA sequence
  source 1..20: mol_type = other DNA
atagatgattcttactcaga

SEQ ID NO: 65803 - DNA, 20 bp, synthetic construct
  misc_feature 1..20: note = CRISPR gRNA sequence
  source 1..20: mol_type = other DNA
ttactcagagagtctgtgac

SEQ ID NO: 65804 - DNA, 20 bp, synthetic construct
  misc_feature 1..20: note = CRISPR gRNA sequence
  source 1..20: mol_type = other DNA
actcagagagtctgtgactc

SEQ ID NO: 65805 - DNA, 20 bp, synthetic construct
  misc_feature 1..20: note = CRISPR gRNA sequence
  source 1..20: mol_type = other DNA
ctcagagagtctgtgactca

SEQ ID NO: 65806 - DNA, 20 bp, synthetic construct
  misc_feature 1..20: note = CRISPR gRNA sequence
  source 1..20: mol_type = other DNA
agagagtctgtgactcaata

SEQ ID NO: 65807 - DNA, 20 bp, synthetic construct
  misc_feature 1..20: note = CRISPR gRNA sequence
  source 1..20: mol_type = other DNA
tgactcaataatcccacttc

SEQ ID NO: 65808 - DNA, 20 bp, synthetic construct
  misc_feature 1..20: note = CRISPR gRNA sequence
  source 1..20: mol_type = other DNA
aataatcccacttctgattc

SEQ ID NO: 65809 - DNA, 20 bp, synthetic construct
  misc_feature 1..20: note = CRISPR gRNA sequence
  source 1..20: mol_type = other DNA
ctgattcaaggtttcacttc

SEQ ID NO: 65810 - DNA, 20 bp, synthetic construct
  misc_feature 1..20: note = CRISPR gRNA sequence
  source 1..20: mol_type = other DNA
tgattcaaggtttcacttct

SEQ ID NO: 65811 - DNA, 20 bp, synthetic construct
  misc_feature 1..20: note = CRISPR gRNA sequence
  source 1..20: mol_type = other DNA
attcaaggtttcacttctgg

SEQ ID NO: 65812 - DNA, 20 bp, synthetic construct
  misc_feature 1..20: note = CRISPR gRNA sequence
  source 1..20: mol_type = other DNA
aaggtttcacttctggaacc

SEQ ID NO: 65813 - DNA, 20 bp, synthetic construct
  misc_feature 1..20: note = CRISPR gRNA sequence
  source 1..20: mol_type = other DNA
cacttctggaacctgtctcc

SEQ ID NO: 65814 - DNA, 20 bp, synthetic construct
  misc_feature 1..20: note = CRISPR gRNA sequence
  source 1..20: mol_type = other DNA
acttctggaacctgtctccg

SEQ ID NO: 65815 - DNA, 20 bp, synthetic construct
  misc_feature 1..20: note = CRISPR gRNA sequence
  source 1..20: mol_type = other DNA
ctggaacctgtctccgcatc

SEQ ID NO: 65816 - DNA, 20 bp, synthetic construct
  misc_feature 1..20: note = CRISPR gRNA sequence
  source 1..20: mol_type = other DNA
tggaacctgtctccgcatct

SEQ ID NO: 65817 - DNA, 20 bp, synthetic construct
  misc_feature 1..20: note = CRISPR gRNA sequence
  source 1..20: mol_type = other DNA
gaacctgtctccgcatctct

SEQ ID NO: 65818 - DNA, 20 bp, synthetic construct
  misc_feature 1..20: note = CRISPR gRNA sequence
  source 1..20: mol_type = other DNA
tctccgcatctctgaacagg

SEQ ID NO: 65819 - DNA, 20 bp, synthetic construct
  misc_feature 1..20: note = CRISPR gRNA sequence
  source 1..20: mol_type = other DNA
cgcatctctgaacaggcttc

SEQ ID NO: 65820 - DNA, 20 bp, synthetic construct
  misc_feature 1..20: note = CRISPR gRNA sequence
  source 1..20: mol_type = other DNA
tgaacaggcttctgaggcca

SEQ ID NO: 65821 - DNA, 20 bp, synthetic construct
  misc_feature 1..20: note = CRISPR gRNA sequence
  source 1..20: mol_type = other DNA
aacaggcttctgaggccacc

SEQ ID NO: 65822 - DNA, 20 bp, synthetic construct
  misc_feature 1..20: note = CRISPR gRNA sequence
  source 1..20: mol_type = other DNA
ctgaggccaccctggggagg

SEQ ID NO: 65823 - DNA, 20 bp, synthetic construct
  misc_feature 1..20: note = CRISPR gRNA sequence
  source 1..20: mol_type = other DNA
tgaggccaccctggggaggg

SEQ ID NO: 65824 - DNA, 20 bp, synthetic construct
  misc_feature 1..20: note = CRISPR gRNA sequence
  source 1..20: mol_type = other DNA
aggccaccctggggagggca

SEQ ID NO: 65825 - DNA, 20 bp, synthetic construct
  misc_feature 1..20: note = CRISPR gRNA sequence
  source 1..20: mol_type = other DNA
gggagggcaggtgtgggtgc

SEQ ID NO: 65826 - DNA, 20 bp, synthetic construct
  misc_feature 1..20: note = CRISPR gRNA sequence
  source 1..20: mol_type = other DNA
acggctggcagttgttattc

SEQ ID NO: 65827 - DNA, 20 bp, synthetic construct
  misc_feature 1..20: note = CRISPR gRNA sequence
  source 1..20: mol_type = other DNA
gcagttgttattctggccct

SEQ ID NO: 65828 - DNA, 20 bp, synthetic construct
  misc_feature 1..20: note = CRISPR gRNA sequence
  source 1..20: mol_type = other DNA
ttattctggccctggggtgc

SEQ ID NO: 65829 - DNA, 20 bp, synthetic construct
  misc_feature 1..20: note = CRISPR gRNA sequence
  source 1..20: mol_type = other DNA
ttctggccctggggtgccgg

SEQ ID NO: 65830 - DNA, 20 bp, synthetic construct
  misc_feature 1..20: note = CRISPR gRNA sequence
  source 1..20: mol_type = other DNA
tggccctggggtgccgggag

SEQ ID NO: 65831 - DNA, 20 bp, synthetic construct
  misc_feature 1..20: note = CRISPR gRNA sequence
  source 1..20: mol_type = other DNA
gccctggggtgccgggaggg

SEQ ID NO: 65832 - DNA, 20 bp, synthetic construct
  misc_feature 1..20: note = CRISPR gRNA sequence
  source 1..20: mol_type = other DNA
gggtgccgggaggggctggg

SEQ ID NO: 65833 - DNA, 20 bp, synthetic construct
  misc_feature 1..20: note = CRISPR gRNA sequence
  source 1..20: mol_type = other DNA
gggctgttagctggggtatg

SEQ ID NO: 65834 - DNA, 20 bp, synthetic construct
  misc_feature 1..20: note = CRISPR gRNA sequence
  source 1..20: mol_type = other DNA
ttagctggggtatggtcagg

SEQ ID NO: 65835 - DNA, 20 bp, synthetic construct
  misc_feature 1..20: note = CRISPR gRNA sequence
  source 1..20: mol_type = other DNA
gctggggtatggtcagggta

SEQ ID NO: 65836 - DNA, 20 bp, synthetic construct
  misc_feature 1..20: note = CRISPR gRNA sequence
  source 1..20: mol_type = other DNA
gggtatggtcagggtagaca

SEQ ID NO: 65837 - DNA, 20 bp, synthetic construct
  misc_feature 1..20: note = CRISPR gRNA sequence
  source 1..20: mol_type = other DNA
gtaccagagaggacactcaa

SEQ ID NO: 65838 - DNA, 20 bp, synthetic construct
  misc_feature 1..20: note = CRISPR gRNA sequence
  source 1..20: mol_type = other DNA
taccagagaggacactcaag

SEQ ID NO: 65839 - DNA, 20 bp, synthetic construct
  misc_feature 1..20: note = CRISPR gRNA sequence
  source 1..20: mol_type = other DNA
aagcagggtgcccagggctg

SEQ ID NO: 65840 - DNA, 20 bp, synthetic construct
  misc_feature 1..20: note = CRISPR gRNA sequence
  source 1..20: mol_type = other DNA
ccaaggatccctgagtacct

SEQ ID NO: 65841 - DNA, 20 bp, synthetic construct
  misc_feature 1..20: note = CRISPR gRNA sequence
  source 1..20: mol_type = other DNA
agtacctggcagagagtgtg

SEQ ID NO: 65842 - DNA, 20 bp, synthetic construct
  misc_feature 1..20: note = CRISPR gRNA sequence
  source 1..20: mol_type = other DNA
gcagagagtgtgtaggagga

SEQ ID NO: 65843 - DNA, 20 bp, synthetic construct
  misc_feature 1..20: note = CRISPR gRNA sequence
  source 1..20: mol_type = other DNA
gcctgcaatggaccagagtt

SEQ ID NO: 65844 - DNA, 20 bp, synthetic construct
  misc_feature 1..20: note = CRISPR gRNA sequence
  source 1..20: mol_type = other DNA
cctgcaatggaccagagttc

SEQ ID NO: 65845 - DNA, 20 bp, synthetic construct
  misc_feature 1..20: note = CRISPR gRNA sequence
  source 1..20: mol_type = other DNA
caatggaccagagttcttga

SEQ ID NO: 65846 - DNA, 20 bp, synthetic construct
  misc_feature 1..20: note = CRISPR gRNA sequence
  source 1..20: mol_type = other DNA
ttgatccctaaatgcccttg

SEQ ID NO: 65847 - DNA, 20 bp, synthetic construct
  misc_feature 1..20: note = CRISPR gRNA sequence
  source 1..20: mol_type = other DNA
gatccctaaatgcccttggt

SEQ ID NO: 65848 - DNA, 20 bp, synthetic construct
  misc_feature 1..20: note = CRISPR gRNA sequence
  source 1..20: mol_type = other DNA
atccctaaatgcccttggtg

SEQ ID NO: 65849 - DNA, 20 bp, synthetic construct
  misc_feature 1..20: note = CRISPR gRNA sequence
  source 1..20: mol_type = other DNA
aatgcccttggtgcttttgg

SEQ ID NO: 65850 - DNA, 20 bp, synthetic construct
  misc_feature 1..20: note = CRISPR gRNA sequence
  source 1..20: mol_type = other DNA
ggtgcttttggctcacaaag

SEQ ID NO: 65851 - DNA, 20 bp, synthetic construct
  misc_feature 1..20: note = CRISPR gRNA sequence
  source 1..20: mol_type = other DNA
gtgcttttggctcacaaagc

SEQ ID NO: 65852 - DNA, 20 bp, synthetic construct
  misc_feature 1..20: note = CRISPR gRNA sequence
  source 1..20: mol_type = other DNA
ttggctcacaaagcaccccc

SEQ ID NO: 65853 - DNA, 20 bp, synthetic construct
  misc_feature 1..20: note = CRISPR gRNA sequence
  source 1..20: mol_type = other DNA
tggctcacaaagcaccccct

SEQ ID NO: 65854 - DNA, 20 bp, synthetic construct
  misc_feature 1..20: note = CRISPR gRNA sequence
  source 1..20: mol_type = other DNA
ggctcacaaagcaccccctc

SEQ ID NO: 65855 - DNA, 20 bp, synthetic construct
  misc_feature 1..20: note = CRISPR gRNA sequence
  source 1..20: mol_type = other DNA
gctcacaaagcaccccctcc

SEQ ID NO: 65856 - DNA, 20 bp, synthetic construct
  misc_feature 1..20: note = CRISPR gRNA sequence
  source 1..20: mol_type = other DNA
acaaagcaccccctcctccc

SEQ ID NO: 65857 - DNA, 20 bp, synthetic construct
  misc_feature 1..20: note = CRISPR gRNA sequence
  source 1..20: mol_type = other DNA
ctcccaggcacttctgggcc

SEQ ID NO: 65858 - DNA, 20 bp, synthetic construct
  misc_feature 1..20: note = CRISPR gRNA sequence
  source 1..20: mol_type = other DNA
ccaggcacttctgggccaaa

SEQ ID NO: 65859 - DNA, 20 bp, synthetic construct
  misc_feature 1..20: note = CRISPR gRNA sequence
  source 1..20: mol_type = other DNA
ctgggccaaagccagaggag

SEQ ID NO: 65860 - DNA, 20 bp, synthetic construct
  misc_feature 1..20: note = CRISPR gRNA sequence
  source 1..20: mol_type = other DNA
tgggccaaagccagaggagc

SEQ ID NO: 65861 - DNA, 20 bp, synthetic construct
  misc_feature 1..20: note = CRISPR gRNA sequence
  source 1..20: mol_type = other DNA
ggccaaagccagaggagccc

SEQ ID NO: 65862 - DNA, 20 bp, synthetic construct
  misc_feature 1..20: note = CRISPR gRNA sequence
  source 1..20: mol_type = other DNA
tattccaggctgtctctgtg

SEQ ID NO: 65863 - DNA, 20 bp, synthetic construct
  misc_feature 1..20: note = CRISPR gRNA sequence
  source 1..20: mol_type = other DNA
caggctgtctctgtgaacac

SEQ ID NO: 65864 - DNA, 20 bp, synthetic construct
  misc_feature 1..20: note = CRISPR gRNA sequence
  source 1..20: mol_type = other DNA
tctctgtgaacacgctttgc

SEQ ID NO: 65865 - DNA, 20 bp, synthetic construct
  misc_feature 1..20: note = CRISPR gRNA sequence
  source 1..20: mol_type = other DNA
tgtgaacacgctttgctgtg

SEQ ID NO: 65866 - DNA, 20 bp, synthetic construct
  misc_feature 1..20: note = CRISPR gRNA sequence
  source 1..20: mol_type = other DNA
tgaacacgctttgctgtgtg

SEQ ID NO: 65867 - DNA, 20 bp, synthetic construct
  misc_feature 1..20: note = CRISPR gRNA sequence
  source 1..20: mol_type = other DNA
tgctgtgtgattctgggcaa

SEQ ID NO: 65868 - DNA, 20 bp, synthetic construct
  misc_feature 1..20: note = CRISPR gRNA sequence
  source 1..20: mol_type = other DNA
gctgtgtgattctgggcaag

SEQ ID NO: 65869 - DNA, 20 bp, synthetic construct
  misc_feature 1..20: note = CRISPR gRNA sequence
  source 1..20: mol_type = other DNA
ctgtgtgattctgggcaagt

SEQ ID NO: 65870 - DNA, 20 bp, synthetic construct
  misc_feature 1..20: note = CRISPR gRNA sequence
  source 1..20: mol_type = other DNA
tgtgattctgggcaagttac

SEQ ID NO: 65871 - DNA, 20 bp, synthetic construct
  misc_feature 1..20: note = CRISPR gRNA sequence
  source 1..20: mol_type = other DNA
tgggcaagttacatcccctc

SEQ ID NO: 65872 - DNA, 20 bp, synthetic construct
  misc_feature 1..20: note = CRISPR gRNA sequence
  source 1..20: mol_type = other DNA
ggcaagttacatcccctctc

SEQ ID NO: 65873 - DNA, 20 bp, synthetic construct
  misc_feature 1..20: note = CRISPR gRNA sequence
  source 1..20: mol_type = other DNA
catcccctctccgagtccct

SEQ ID NO: 65874 - DNA, 20 bp, synthetic construct
  misc_feature 1..20: note = CRISPR gRNA sequence
  source 1..20: mol_type = other DNA
tccgagtccctggttcccag

SEQ ID NO: 65875 - DNA, 20 bp, synthetic construct
  misc_feature 1..20: note = CRISPR gRNA sequence
  source 1..20: mol_type = other DNA
cgagtccctggttcccagtc

SEQ ID NO: 65876 - DNA, 20 bp, synthetic construct
  misc_feature 1..20: note = CRISPR gRNA sequence
  source 1..20: mol_type = other DNA
gttcccagtcggtaaataca

SEQ ID NO: 65877 - DNA, 20 bp, synthetic construct
  misc_feature 1..20: note = CRISPR gRNA sequence
  source 1..20: mol_type = other DNA
ccagtcggtaaatacataaa

SEQ ID NO: 65878 - DNA, 20 bp, synthetic construct
  misc_feature 1..20: note = CRISPR gRNA sequence
  source 1..20: mol_type = other DNA
caggcgtggcctctgttggt

SEQ ID NO: 65879 - DNA, 20 bp, synthetic construct
  misc_feature 1..20: note = CRISPR gRNA sequence
  source 1..20: mol_type = other DNA
tgttggtggctacgatctct

SEQ ID NO: 65880 - DNA, 20 bp, synthetic construct
  misc_feature 1..20: note = CRISPR gRNA sequence
  source 1..20: mol_type = other DNA
ttggtggctacgatctctga

SEQ ID NO: 65881 - DNA, 20 bp, synthetic construct
  misc_feature 1..20: note = CRISPR gRNA sequence
  source 1..20: mol_type = other DNA
gtggctacgatctctgaaat

SEQ ID NO: 65882 - DNA, 20 bp, synthetic construct
  misc_feature 1..20: note = CRISPR gRNA sequence
  source 1..20: mol_type = other DNA
cgatctctgaaatgagtgct

SEQ ID NO: 65883 - DNA, 20 bp, synthetic construct
  misc_feature 1..20: note = CRISPR gRNA sequence
  source 1..20: mol_type = other DNA
tgaaatgagtgctggggcct

SEQ ID NO: 65884 - DNA, 20 bp, synthetic construct
  misc_feature 1..20: note = CRISPR gRNA sequence
  source 1..20: mol_type = other DNA
aaatgagtgctggggcctaa

SEQ ID NO: 65885 - DNA, 20 bp, synthetic construct
  misc_feature 1..20: note = CRISPR gRNA sequence
  source 1..20: mol_type = other DNA
gggcctaaggaccccctgct

SEQ ID NO: 65886 - DNA, 20 bp, synthetic construct
  misc_feature 1..20: note = CRISPR gRNA sequence
  source 1..20: mol_type = other DNA
aggaccccctgctcacaccc

SEQ ID NO: 65887 - DNA, 20 bp, synthetic construct
  misc_feature 1..20: note = CRISPR gRNA sequence
  source 1..20: mol_type = other DNA
ctcacaccctgtttttgtgc

SEQ ID NO: 65888 - DNA, 20 bp, synthetic construct
  misc_feature 1..20: note = CRISPR gRNA sequence
  source 1..20: mol_type = other DNA
acaccctgtttttgtgcaat

SEQ ID NO: 65889 - DNA, 20 bp, synthetic construct
  misc_feature 1..20: note = CRISPR gRNA sequence
  source 1..20: mol_type = other DNA
tttttgtgcaatgctgggaa

SEQ ID NO: 65890 - DNA, 20 bp, synthetic construct
  misc_feature 1..20: note = CRISPR gRNA sequence
  source 1..20: mol_type = other DNA
ttgtgcaatgctgggaagga

SEQ ID NO: 65891 - DNA, 20 bp, synthetic construct
  misc_feature 1..20: note = CRISPR gRNA sequence
  source 1..20: mol_type = other DNA
tgtgcaatgctgggaaggaa

SEQ ID NO: 65892 - DNA, 20 bp, synthetic construct
  misc_feature 1..20: note = CRISPR gRNA sequence
  source 1..20: mol_type = other DNA
gtgcaatgctgggaaggaag

SEQ ID NO: 65893 - DNA, 20 bp, synthetic construct
  misc_feature 1..20: note = CRISPR gRNA sequence
  source 1..20: mol_type = other DNA
tgcaatgctgggaaggaagg

SEQ ID NO: 65894 - DNA, 20 bp, synthetic construct
  misc_feature 1..20: note = CRISPR gRNA sequence
  source 1..20: mol_type = other DNA
ggaaggaagggagttgcctt

SEQ ID NO: 65895 - DNA, 20 bp, synthetic construct
  misc_feature 1..20: note = CRISPR gRNA sequence
  source 1..20: mol_type = other DNA
ccttggttcctgttcagggc

SEQ ID NO: 65896 - DNA, 20 bp, synthetic construct
  misc_feature 1..20: note = CRISPR gRNA sequence
  source 1..20: mol_type = other DNA
ggttcctgttcagggcctgc

SEQ ID NO: 65897 - DNA, 20 bp, synthetic construct
  misc_feature 1..20: note = CRISPR gRNA sequence
  source 1..20: mol_type = other DNA
gttcctgttcagggcctgca

SEQ ID NO: 65898 - DNA, 20 bp, synthetic construct
  misc_feature 1..20: note = CRISPR gRNA sequence
  source 1..20: mol_type = other DNA
ctgttcagggcctgcacctg

SEQ ID NO: 65899 - DNA, 20 bp, synthetic construct
  misc_feature 1..20: note = CRISPR gRNA sequence
  source 1..20: mol_type = other DNA
ttcagggcctgcacctggga

SEQ ID NO: 65900 - DNA, 20 bp, synthetic construct
  misc_feature 1..20: note = CRISPR gRNA sequence
  source 1..20: mol_type = other DNA
agggcctgcacctgggaagg

SEQ ID NO: 65901 - DNA, 20 bp, synthetic construct
  misc_feature 1..20: note = CRISPR gRNA sequence
  source 1..20: mol_type = other DNA
cacctgggaaggaaggaagg

SEQ ID NO: 65902 - DNA, 20 bp, synthetic construct
  misc_feature 1..20: note = CRISPR gRNA sequence
  source 1..20: mol_type = other DNA
ggaaggaaggaaggtctaac

SEQ ID NO: 65903 - DNA, 20 bp, synthetic construct
  misc_feature 1..20: note = CRISPR gRNA sequence
  source 1..20: mol_type = other DNA
accattgcaggcaaattaca

SEQ ID NO: 65904 - DNA, 20 bp, synthetic construct
  misc_feature 1..20: note = CRISPR gRNA sequence
  source 1..20: mol_type = other DNA
caggcaaattacatgaagac

SEQ ID NO: 65905 - DNA, 20 bp, synthetic construct
  misc_feature 1..20: note = CRISPR gRNA sequence
  source 1..20: mol_type = other DNA
catgaagactggaggtttta

SEQ ID NO: 65906 - DNA, 20 bp, synthetic construct
  misc_feature 1..20: note = CRISPR gRNA sequence
  source 1..20: mol_type = other DNA
gaggttttagtatgtcctca

SEQ ID NO: 65907 - DNA, 20 bp, synthetic construct
  misc_feature 1..20: note = CRISPR gRNA sequence
  source 1..20: mol_type = other DNA
tagtatgtcctcatgtgacc

SEQ ID NO: 65908 - DNA, 20 bp, synthetic construct
  misc_feature 1..20: note = CRISPR gRNA sequence
  source 1..20: mol_type = other DNA
agtatgtcctcatgtgacct

SEQ ID NO: 65909 - DNA, 20 bp, synthetic construct
  misc_feature 1..20: note = CRISPR gRNA sequence
  source 1..20: mol_type = other DNA
gtatgtcctcatgtgacctt

SEQ ID NO: 65910 - DNA, 20 bp, synthetic construct
  misc_feature 1..20: note = CRISPR gRNA sequence
  source 1..20: mol_type = other DNA
atgtgaccttcttattagtg

SEQ ID NO: 65911 - DNA, 20 bp, synthetic construct
  misc_feature 1..20: note = CRISPR gRNA sequence
  source 1..20: mol_type = other DNA
cttattagtgtggactcgtg

SEQ ID NO: 65912 - DNA, 20 bp, synthetic construct
  misc_feature 1..20: note = CRISPR gRNA sequence
  source 1..20: mol_type = other DNA
ttattagtgtggactcgtga

SEQ ID NO: 65913 - DNA, 20 bp, synthetic construct
  misc_feature 1..20: note = CRISPR gRNA sequence
  source 1..20: mol_type = other DNA
attagtgtggactcgtgacc

SEQ ID NO: 65914 - DNA, 20 bp, synthetic construct
  misc_feature 1..20: note = CRISPR gRNA sequence
  source 1..20: mol_type = other DNA
ttagtgtggactcgtgacct

SEQ ID NO: 65915 - DNA, 20 bp, synthetic construct
  misc_feature 1..20: note = CRISPR gRNA sequence
  source 1..20: mol_type = other DNA
gtgtggactcgtgacctggt

SEQ ID NO: 65916 - DNA, 20 bp, synthetic construct
  misc_feature 1..20: note = CRISPR gRNA sequence
  source 1..20: mol_type = other DNA
gtgacctggtgctgtgaggg

SEQ ID NO: 65917 - DNA, 20 bp, synthetic construct
  misc_feature 1..20: note = CRISPR gRNA sequence
  source 1..20: mol_type = other DNA
gtgctgtgagggtccacact

SEQ ID NO: 65918 - DNA, 20 bp, synthetic construct
  misc_feature 1..20: note = CRISPR gRNA sequence
  source 1..20: mol_type = other DNA
tgagggtccacactcgccct

SEQ ID NO: 65919 - DNA, 20 bp, synthetic construct
  misc_feature 1..20: note = CRISPR gRNA sequence
  source 1..20: mol_type = other DNA
gccctaccagtgtccccgtg

SEQ ID NO: 65920 - DNA, 20 bp, synthetic construct
  misc_feature 1..20: note = CRISPR gRNA sequence
  source 1..20: mol_type = other DNA
ccagtgtccccgtgggaggg

SEQ ID NO: 65921 - DNA, 20 bp, synthetic construct
  misc_feature 1..20: note = CRISPR gRNA sequence
  source 1..20: mol_type = other DNA
aatagtaaatagaaaacaat

SEQ ID NO: 65922 - DNA, 20 bp, synthetic construct
  misc_feature 1..20: note = CRISPR gRNA sequence
  source 1..20: mol_type = other DNA
acaggagaccctgaaagaaa

SEQ ID NO: 65923 - DNA, 20 bp, synthetic construct
  misc_feature 1..20: note = CRISPR gRNA sequence
  source 1..20: mol_type = other DNA
aaagaaaggagacactttgt

SEQ ID NO: 65924 - DNA, 20 bp, synthetic construct
  misc_feature 1..20: note = CRISPR gRNA sequence
  source 1..20: mol_type = other DNA
tgttcctgctttctgcacaa

SEQ ID NO: 65925 - DNA, 20 bp, synthetic construct
  misc_feature 1..20: note = CRISPR gRNA sequence
  source 1..20: mol_type = other DNA
gttcctgctttctgcacaag

SEQ ID NO: 65926 - DNA, 20 bp, synthetic construct
  misc_feature 1..20: note = CRISPR gRNA sequence
  source 1..20: mol_type = other DNA
ttcctgctttctgcacaaga

SEQ ID NO: 65927 - DNA, 20 bp, synthetic construct
  misc_feature 1..20: note = CRISPR gRNA sequence
  source 1..20: mol_type = other DNA
ctgctttctgcacaagagac

SEQ ID NO: 65928 - DNA, 20 bp, synthetic construct
  misc_feature 1..20: note = CRISPR gRNA sequence
  source 1..20: mol_type = other DNA
ctttctgcacaagagaccct

SEQ ID NO: 65929 - DNA, 20 bp, synthetic construct
  misc_feature 1..20: note = CRISPR gRNA sequence
  source 1..20: mol_type = other DNA
tctgcacaagagaccctgca

SEQ ID NO: 65930 - DNA, 20 bp, synthetic construct
  misc_feature 1..20: note = CRISPR gRNA sequence
  source 1..20: mol_type = other DNA
ctgcacaagagaccctgcat

SEQ ID NO: 65931 - DNA, 20 bp, synthetic construct
  misc_feature 1..20: note = CRISPR gRNA sequence
  source 1..20: mol_type = other DNA
tgcacaagagaccctgcatt

SEQ ID NO: 65932 - DNA, 20 bp, synthetic construct
  misc_feature 1..20: note = CRISPR gRNA sequence
  source 1..20: mol_type = other DNA
cacaagagaccctgcatttt

SEQ ID NO: 65933 - DNA, 20 bp, synthetic construct
  misc_feature 1..20: note = CRISPR gRNA sequence
  source 1..20: mol_type = other DNA
cattttcattttgtcctggg

SEQ ID NO: 65934 - DNA, 20 bp, synthetic construct
  misc_feature 1..20: note = CRISPR gRNA sequence
  source 1..20: mol_type = other DNA
tcattttgtcctgggtacca

SEQ ID NO: 65935 - DNA, 20 bp, synthetic construct
  misc_feature 1..20: note = CRISPR gRNA sequence
  source 1..20: mol_type = other DNA
cattttgtcctgggtaccac

SEQ ID NO: 65936 - DNA, 20 bp, synthetic construct
  misc_feature 1..20: note = CRISPR gRNA sequence
  source 1..20: mol_type = other DNA
attttgtcctgggtaccacc

SEQ ID NO: 65937 - DNA, 20 bp, synthetic construct
  misc_feature 1..20: note = CRISPR gRNA sequence
  source 1..20: mol_type = other DNA
tgtcctgggtaccacccctc

SEQ ID NO: 65938 - DNA, 20 bp, synthetic construct
  misc_feature 1..20: note = CRISPR gRNA sequence
  source 1..20: mol_type = other DNA
gtcctgggtaccacccctcc

SEQ ID NO: 65939 - DNA, 20 bp, synthetic construct
  misc_feature 1..20: note = CRISPR gRNA sequence
  source 1..20: mol_type = other DNA
tcctgggtaccacccctccc

SEQ ID NO: 65940 - DNA, 20 bp, synthetic construct
  misc_feature 1..20: note = CRISPR gRNA sequence
  source 1..20: mol_type = other DNA
ggtaccacccctcccttatc

SEQ ID NO: 65941 - DNA, 20 bp, synthetic construct
  misc_feature 1..20: note = CRISPR gRNA sequence
  source 1..20: mol_type = other DNA
ccttatcaggtggagaaaag

SEQ ID NO: 65942 - DNA, 20 bp, synthetic construct
  misc_feature 1..20: note = CRISPR gRNA sequence
  source 1..20: mol_type = other DNA
atcaggtggagaaaaggagg

SEQ ID NO: 65943 - DNA, 20 bp, synthetic construct
  misc_feature 1..20: note = CRISPR gRNA sequence
  source 1..20: mol_type = other DNA
tcaggtggagaaaaggaggc

SEQ ID NO: 65944 - DNA, 20 bp, synthetic construct
  misc_feature 1..20: note = CRISPR gRNA sequence
  source 1..20: mol_type = other DNA
cagccagaaagcactcctca

SEQ ID NO: 65945 - DNA, 20 bp, synthetic construct
  misc_feature 1..20: note = CRISPR gRNA sequence
  source 1..20: mol_type = other DNA
ctcagatccatcacagaccg

SEQ ID NO: 65946 - DNA, 20 bp, synthetic construct
  misc_feature 1..20: note = CRISPR gRNA sequence
  source 1..20: mol_type = other DNA
agatccatcacagaccgagg

SEQ ID NO: 65947 - DNA, 20 bp, synthetic construct
  misc_feature 1..20: note = CRISPR gRNA sequence
  source 1..20: mol_type = other DNA
ggtgcccatctcagctctgt

SEQ ID NO: 65948 - DNA, 20 bp, synthetic construct
  misc_feature 1..20: note = CRISPR gRNA sequence
  source 1..20: mol_type = other DNA
agctctgtcaccaacatgtc

SEQ ID NO: 65949 - DNA, 20 bp, synthetic construct
  misc_feature 1..20: note = CRISPR gRNA sequence
  source 1..20: mol_type = other DNA
tgtcaccaacatgtctcata

SEQ ID NO: 65950 - DNA, 20 bp, synthetic construct
  misc_feature 1..20: note = CRISPR gRNA sequence
  source 1..20: mol_type = other DNA
tcaccaacatgtctcataac

SEQ ID NO: 65951 - DNA, 20 bp, synthetic construct
  misc_feature 1..20: note = CRISPR gRNA sequence
  source 1..20: mol_type = other DNA
ataaccttgggctagacctt

SEQ ID NO: 65952 - DNA, 20 bp, synthetic construct
  misc_feature 1..20: note = CRISPR gRNA sequence
  source 1..20: mol_type = other DNA
gggctagaccttgattctct

SEQ ID NO: 65953 - DNA, 20 bp, synthetic construct
  misc_feature 1..20: note = CRISPR gRNA sequence
  source 1..20: mol_type = other DNA
ggctagaccttgattctctc

SEQ ID NO: 65954 - DNA, 20 bp, synthetic construct
  misc_feature 1..20: note = CRISPR gRNA sequence
  source 1..20: mol_type = other DNA
gaccttgattctctctagga

SEQ ID NO: 65955 - DNA, 20 bp, synthetic construct
  misc_feature 1..20: note = CRISPR gRNA sequence
  source 1..20: mol_type = other DNA
gattctctctaggactctgt

SEQ ID NO: 65956 - DNA, 20 bp, synthetic construct
  misc_feature 1..20: note = CRISPR gRNA sequence
  source 1..20: mol_type = other DNA
attctctctaggactctgtt

SEQ ID NO: 65957 - DNA, 20 bp, synthetic construct
  misc_feature 1..20: note = CRISPR gRNA sequence
  source 1..20: mol_type = other DNA
tctctaggactctgtttccc

SEQ ID NO: 65958 - DNA, 20 bp, synthetic construct
  misc_feature 1..20: note = CRISPR gRNA sequence
  source 1..20: mol_type = other DNA
tctaggactctgtttcccca

SEQ ID NO: 65959 - DNA, 20 bp, synthetic construct
  misc_feature 1..20: note = CRISPR gRNA sequence
  source 1..20: mol_type = other DNA
taggactctgtttccccatc

SEQ ID NO: 65960 - DNA, 20 bp, synthetic construct
  misc_feature 1..20: note = CRISPR gRNA sequence
  source 1..20: mol_type = other DNA
ggactctgtttccccatctc

SEQ ID NO: 65961 - DNA, 20 bp, synthetic construct
  misc_feature 1..20: note = CRISPR gRNA sequence
  source 1..20: mol_type = other DNA
tgtttccccatctccaccat

SEQ ID NO: 65962 - DNA, 20 bp, synthetic construct
  misc_feature 1..20: note = CRISPR gRNA sequence
  source 1..20: mol_type = other DNA
tttccccatctccaccatga

SEQ ID NO: 65963 - DNA, 20 bp, synthetic construct
  misc_feature 1..20: note = CRISPR gRNA sequence
  source 1..20: mol_type = other DNA
ccccatctccaccatgagga

SEQ ID NO: 65964 - DNA, 20 bp, synthetic construct
  misc_feature 1..20: note = CRISPR gRNA sequence
  source 1..20: mol_type = other DNA
cccatctccaccatgaggac

SEQ ID NO: 65965 - DNA, 20 bp, synthetic construct
  misc_feature 1..20: note = CRISPR gRNA sequence
  source 1..20: mol_type = other DNA
caccatgaggacttgcaagg

SEQ ID NO: 65966 - DNA, 20 bp, synthetic construct
  misc_feature 1..20: note = CRISPR gRNA sequence
  source 1..20: mol_type = other DNA
gcaaggggtgctctctgacc

SEQ ID NO: 65967 - DNA, 20 bp, synthetic construct
  misc_feature 1..20: note = CRISPR gRNA sequence
  source 1..20: mol_type = other DNA
caaggggtgctctctgacca

SEQ ID NO: 65968 - DNA, 20 bp, synthetic construct
  misc_feature 1..20: note = CRISPR gRNA sequence
  source 1..20: mol_type = other DNA
tctgaccatcttgggttcag

SEQ ID NO: 65969 - DNA, 20 bp, synthetic construct
  misc_feature 1..20: note = CRISPR gRNA sequence
  source 1..20: mol_type = other DNA
tgaccatcttgggttcagtg

SEQ ID NO: 65970 - DNA, 20 bp, synthetic construct
  misc_feature 1..20: note = CRISPR gRNA sequence
  source 1..20: mol_type = other DNA
accatcttgggttcagtggg

SEQ ID NO: 65971 - DNA, 20 bp, synthetic construct
  misc_feature 1..20: note = CRISPR gRNA sequence
  source 1..20: mol_type = other DNA
gggttcagtgggttccgtca

SEQ ID NO: 65972 - DNA, 20 bp, synthetic construct
  misc_feature 1..20: note = CRISPR gRNA sequence
  source 1..20: mol_type = other DNA
ggttcagtgggttccgtcat

SEQ ID NO: 65973 - DNA, 20 bp, synthetic construct
  misc_feature 1..20: note = CRISPR gRNA sequence
  source 1..20: mol_type = other DNA
agtgggttccgtcatctgga

SEQ ID NO: 65974 - DNA, 20 bp, synthetic construct
  misc_feature 1..20: note = CRISPR gRNA sequence
  source 1..20: mol_type = other DNA
cgtcatctggaaccagggat

SEQ ID NO: 65975 - DNA, 20 bp, synthetic construct
  misc_feature 1..20: note = CRISPR gRNA sequence
  source 1..20: mol_type = other DNA
gaaccagggatccctccccc

SEQ ID NO: 65976 - DNA, 20 bp, synthetic construct
  misc_feature 1..20: note = CRISPR gRNA sequence
  source 1..20: mol_type = other DNA
ccccgccctgtgccctgacc

SEQ ID NO: 65977 - DNA, 20 bp, synthetic construct
  misc_feature 1..20: note = CRISPR gRNA sequence
  source 1..20: mol_type = other DNA
tgccctgaccacaaagagga

SEQ ID NO: 65978 - DNA, 20 bp, synthetic construct
  misc_feature 1..20: note = CRISPR gRNA sequence
  source 1..20: mol_type = other DNA
accacaaagaggatgtgttt

SEQ ID NO: 65979 - DNA, 20 bp, synthetic construct
  misc_feature 1..20: note = CRISPR gRNA sequence
  source 1..20: mol_type = other DNA
gggtcctgagtgacctccat

SEQ ID NO: 65980 - DNA, 20 bp, synthetic construct
  misc_feature 1..20: note = CRISPR gRNA sequence
  source 1..20: mol_type = other DNA
ggtcctgagtgacctccatt

SEQ ID NO: 65981 - DNA, 20 bp, synthetic construct
  misc_feature 1..20: note = CRISPR gRNA sequence
  source 1..20: mol_type = other DNA
agtgacctccattgtgccac

SEQ ID NO: 65982 - DNA, 20 bp, synthetic construct
  misc_feature 1..20: note = CRISPR gRNA sequence
  source 1..20: mol_type = other DNA
cattgtgccacccctgtgat

SEQ ID NO: 65983 - DNA, 20 bp, synthetic construct
  misc_feature 1..20: note = CRISPR gRNA sequence
  source 1..20: mol_type = other DNA
tgccacccctgtgatctcca

SEQ ID NO: 65984 - DNA, 20 bp, synthetic construct
  misc_feature 1..20: note = CRISPR gRNA sequence
  source 1..20: mol_type = other DNA
tgatctccagcctcagtgag

SEQ ID NO: 65985 - DNA, 20 bp, synthetic construct
  misc_feature 1..20: note = CRISPR gRNA sequence
  source 1..20: mol_type = other DNA
cagcctcagtgagaacggtt

SEQ ID NO: 65986 - DNA, 20 bp, synthetic construct
  misc_feature 1..20: note = CRISPR gRNA sequence
  source 1..20: mol_type = other DNA
agtgagaacggtttgtccct

SEQ ID NO: 65987 - DNA, 20 bp, synthetic construct
  misc_feature 1..20: note = CRISPR gRNA sequence
  source 1..20: mol_type = other DNA
gtccctggatgccgtgttgg

SEQ ID NO: 65988 - DNA, 20 bp, synthetic construct
  misc_feature 1..20: note = CRISPR gRNA sequence
  source 1..20: mol_type = other DNA
tccctggatgccgtgttggg

SEQ ID NO: 65989 - DNA, 20 bp, synthetic construct
  misc_feature 1..20: note = CRISPR gRNA sequence
  source 1..20: mol_type = other DNA
gatgccgtgttgggtttggt

SEQ ID NO: 65990 - DNA, 20 bp, synthetic construct
  misc_feature 1..20: note = CRISPR gRNA sequence
  source 1..20: mol_type = other DNA
ggtttggttcggtgcttctc

SEQ ID NO: 65991 - DNA, 20 bp, synthetic construct
  misc_feature 1..20: note = CRISPR gRNA sequence
  source 1..20: mol_type = other DNA
ggttcggtgcttctccactc

SEQ ID NO: 65992 - DNA, 20 bp, synthetic construct
  misc_feature 1..20: note = CRISPR gRNA sequence
  source 1..20: mol_type = other DNA
gttcggtgcttctccactct

SEQ ID NO: 65993 - DNA, 20 bp, synthetic construct
  misc_feature 1..20: note = CRISPR gRNA sequence
  source 1..20: mol_type = other DNA
ggtgcttctccactctgcag

SEQ ID NO: 65994 - DNA, 20 bp, synthetic construct
  misc_feature 1..20: note = CRISPR gRNA sequence
  source 1..20: mol_type = other DNA
ctccactctgcagtggctct

SEQ ID NO: 65995 - DNA, 20 bp, synthetic construct
  misc_feature 1..20: note = CRISPR gRNA sequence
  source 1..20: mol_type = other DNA
tccactctgcagtggctctt

SEQ ID NO: 65996 - DNA, 20 bp, synthetic construct
  misc_feature 1..20: note = CRISPR gRNA sequence
  source 1..20: mol_type = other DNA
cactctgcagtggctcttcc

SEQ ID NO: 65997 - DNA, 20 bp, synthetic construct
  misc_feature 1..20: note = CRISPR gRNA sequence
  source 1..20: mol_type = other DNA
tgcagtggctcttccgcttg

SEQ ID NO: 65998 - DNA, 20 bp, synthetic construct
  misc_feature 1..20: note = CRISPR gRNA sequence
  source 1..20: mol_type = other DNA
cagtggctcttccgcttgga

SEQ ID NO: 65999 - DNA, 20 bp, synthetic construct
  misc_feature 1..20: note = CRISPR gRNA sequence
  source 1..20: mol_type = other DNA
ttccgcttggacatcaggtg

SEQ ID NO: 66000 - DNA, 20 bp, synthetic construct
  misc_feature 1..20: note = CRISPR gRNA sequence
  source 1..20: mol_type = other DNA
ccgcttggacatcaggtgag

SEQ ID NO: 66001 - DNA, 20 bp, synthetic construct
  misc_feature 1..20: note = CRISPR gRNA sequence
  source 1..20: mol_type = other DNA
cgcttggacatcaggtgagc

SEQ ID NO: 66002 - DNA, 20 bp, synthetic construct
  misc_feature 1..20: note = CRISPR gRNA sequence
  source 1..20: mol_type = other DNA
ggacatcaggtgagcgtgcc

SEQ ID NO: 66003 - DNA, 20 bp, synthetic construct
  misc_feature 1..20: note = CRISPR gRNA sequence
  source 1..20: mol_type = other DNA
gacatcaggtgagcgtgcct

SEQ ID NO: 66004 - DNA, 20 bp, synthetic construct
  misc_feature 1..20: note = CRISPR gRNA sequence
  source 1..20: mol_type = other DNA
tccgcccccagccctgcccc

SEQ ID NO: 66005 - DNA, 20 bp, synthetic construct
  misc_feature 1..20: note = CRISPR gRNA sequence
  source 1..20: mol_type = other DNA
cgcccccagccctgcccctg

SEQ ID NO: 66006 - DNA, 20 bp, synthetic construct
  misc_feature 1..20: note = CRISPR gRNA sequence
  source 1..20: mol_type = other DNA
cccctgtcccccatcccaca

SEQ ID NO: 66007 - DNA, 20 bp, synthetic construct
  misc_feature 1..20: note = CRISPR gRNA sequence
  source 1..20: mol_type = other DNA
tcccccatcccacaggtcat

SEQ ID NO: 66008 - DNA, 20 bp, synthetic construct
  misc_feature 1..20: note = CRISPR gRNA sequence
  source 1..20: mol_type = other DNA
ctcccacgtgggccccttgt

SEQ ID NO: 66009 - DNA, 20 bp, synthetic construct
  misc_feature 1..20: note = CRISPR gRNA sequence
  source 1..20: mol_type = other DNA
ccacgtgggccccttgtcca

SEQ ID NO: 66010 - DNA, 20 bp, synthetic construct
  misc_feature 1..20: note = CRISPR gRNA sequence
  source 1..20: mol_type = other DNA
gtccaccagtttcatgccaa

SEQ ID NO: 66011 - DNA, 20 bp, synthetic construct
  misc_feature 1..20: note = CRISPR gRNA sequence
  source 1..20: mol_type = other DNA
tccaccagtttcatgccaac

SEQ ID NO: 66012 - DNA, 20 bp, synthetic construct
  misc_feature 1..20: note = CRISPR gRNA sequence
  source 1..20: mol_type = other DNA
catgccaacctgtcatcctc

SEQ ID NO: 66013 - DNA, 20 bp, synthetic construct
  misc_feature 1..20: note = CRISPR gRNA sequence
  source 1..20: mol_type = other DNA
atgccaacctgtcatcctca

SEQ ID NO: 66014 - DNA, 20 bp, synthetic construct
  misc_feature 1..20: note = CRISPR gRNA sequence
  source 1..20: mol_type = other DNA
tcatcctcagcaccttgggc

SEQ ID NO: 66015 - DNA, 20 bp, synthetic construct
  misc_feature 1..20: note = CRISPR gRNA sequence
  source 1..20: mol_type = other DNA
agcaccttgggcagtaccag

SEQ ID NO: 66016 - DNA, 20 bp, synthetic construct
  misc_feature 1..20: note = CRISPR gRNA sequence
  source 1..20: mol_type = other DNA
gggcagtaccagatctgcag

SEQ ID NO: 66017 - DNA, 20 bp, synthetic construct
  misc_feature 1..20: note = CRISPR gRNA sequence
  source 1..20: mol_type = other DNA
ggcagtaccagatctgcaga

SEQ ID NO: 66018 - DNA, 20 bp, synthetic construct
  misc_feature 1..20: note = CRISPR gRNA sequence
  source 1..20: mol_type = other DNA
cagagcatgtgatgggcgtc

SEQ ID NO: 66019 - DNA, 20 bp, synthetic construct
  misc_feature 1..20: note = CRISPR gRNA sequence
  source 1..20: mol_type = other DNA
aatgaatgaatgatcaaatg

SEQ ID NO: 66020 - DNA, 20 bp, synthetic construct
  misc_feature 1..20: note = CRISPR gRNA sequence
  source 1..20: mol_type = other DNA
acggatgctcaaatttctcc

SEQ ID NO: 66021 - DNA, 20 bp, synthetic construct
  misc_feature 1..20: note = CRISPR gRNA sequence
  source 1..20: mol_type = other DNA
aaatttctccaaattcacca

SEQ ID NO: 66022 - DNA, 20 bp, synthetic construct
  misc_feature 1..20: note = CRISPR gRNA sequence
  source 1..20: mol_type = other DNA
ctccaaattcaccattagag

SEQ ID NO: 66023 - DNA, 20 bp, synthetic construct
  misc_feature 1..20: note = CRISPR gRNA sequence
  source 1..20: mol_type = other DNA
tccaaattcaccattagaga

SEQ ID NO: 66024 - DNA, 20 bp, synthetic construct
  misc_feature 1..20: note = CRISPR gRNA sequence
  source 1..20: mol_type = other DNA
caaattcaccattagagagt

SEQ ID NO: 66025 - DNA, 20 bp, synthetic construct
  misc_feature 1..20: note = CRISPR gRNA sequence
  source 1..20: mol_type = other DNA
accattagagagttcattga

SEQ ID NO: 66026 - DNA, 20 bp, synthetic construct
  misc_feature 1..20: note = CRISPR gRNA sequence
  source 1..20: mol_type = other DNA
gagagttcattgactctgcc

SEQ ID NO: 66027 - DNA, 20 bp, synthetic construct
  misc_feature 1..20: note = CRISPR gRNA sequence
  source 1..20: mol_type = other DNA
attgactctgcctcactcgt

SEQ ID NO: 66028 - DNA, 20 bp, synthetic construct
  misc_feature 1..20: note = CRISPR gRNA sequence
  source 1..20: mol_type = other DNA
actctgcctcactcgttctt

SEQ ID NO: 66029 - DNA, 20 bp, synthetic construct
  misc_feature 1..20: note = CRISPR gRNA sequence
  source 1..20: mol_type = other DNA
tgcctcactcgttctttgga

SEQ ID NO: 66030 - DNA, 20 bp, synthetic construct
  misc_feature 1..20: note = CRISPR gRNA sequence
  source 1..20: mol_type = other DNA
cctcactcgttctttggata

SEQ ID NO: 66031 - DNA, 20 bp, synthetic construct
  misc_feature 1..20: note = CRISPR gRNA sequence
  source 1..20: mol_type = other DNA
actcgttctttggatagtcc

SEQ ID NO: 66032 - DNA, 20 bp, synthetic construct
  misc_feature 1..20: note = CRISPR gRNA sequence
  source 1..20: mol_type = other DNA
gttctttggatagtccttag

SEQ ID NO: 66033 - DNA, 20 bp, synthetic construct
  misc_feature 1..20: note = CRISPR gRNA sequence
  source 1..20: mol_type = other DNA
tttggatagtccttagagat

SEQ ID NO: 66034 - DNA, 20 bp, synthetic construct
  misc_feature 1..20: note = CRISPR gRNA sequence
  source 1..20: mol_type = other DNA
tggatagtccttagagattt

SEQ ID NO: 66035 - DNA, 20 bp, synthetic construct
  misc_feature 1..20: note = CRISPR gRNA sequence
  source 1..20: mol_type = other DNA
ggatagtccttagagatttt

SEQ ID NO: 66036 - DNA, 20 bp, synthetic construct
  misc_feature 1..20: note = CRISPR gRNA sequence
  source 1..20: mol_type = other DNA
gatagtccttagagattttt

SEQ ID NO: 66037 - DNA, 20 bp, synthetic construct
  misc_feature 1..20: note = CRISPR gRNA sequence
  source 1..20: mol_type = other DNA
agagatttttttttttagga

SEQ ID NO: 66038 - DNA, 20 bp, synthetic construct
  misc_feature 1..20: note = CRISPR gRNA sequence
  source 1..20: mol_type = other DNA
gagatttttttttttaggat

SEQ ID NO: 66039 - DNA, 20 bp, synthetic construct
  misc_feature 1..20: note = CRISPR gRNA sequence
  source 1..20: mol_type = other DNA
ttttttttaggatttttttt

SEQ ID NO: 66040 - DNA, 20 bp, synthetic construct
  misc_feature 1..20: note = CRISPR gRNA sequence
  source 1..20: mol_type = other DNA
tttttttaggattttttttt

SEQ ID NO: 66041 - DNA, 20 bp, synthetic construct
  misc_feature 1..20: note = CRISPR gRNA sequence
  source 1..20: mol_type = other DNA
ttttttaggatttttttttt

SEQ ID NO: 66042 - DNA, 20 bp, synthetic construct
  misc_feature 1..20: note = CRISPR gRNA sequence
  source 1..20: mol_type = other DNA
tttttaggatttttttttta

SEQ ID NO: 66043 - DNA, 20 bp, synthetic construct
  misc_feature 1..20: note = CRISPR gRNA sequence
  source 1..20: mol_type = other DNA
ttttaggattttttttttaa

SEQ ID NO: 66044 - DNA, 20 bp, synthetic construct
  misc_feature 1..20: note = CRISPR gRNA sequence
  source 1..20: mol_type = other DNA
tttaggattttttttttaat

SEQ ID NO: 66045 - DNA, 20 bp, synthetic construct
  misc_feature 1..20: note = CRISPR gRNA sequence
  source 1..20: mol_type = other DNA
ttaggattttttttttaatt

SEQ ID NO: 66046 - DNA, 20 bp, synthetic construct
  misc_feature 1..20: note = CRISPR gRNA sequence
  source 1..20: mol_type = other DNA
taggattttttttttaatta

SEQ ID NO: 66047 - DNA, 20 bp, synthetic construct
  misc_feature 1..20: note = CRISPR gRNA sequence
  source 1..20: mol_type = other DNA
aggattttttttttaattat

SEQ ID NO: 66048 - DNA, 20 bp, synthetic construct
  misc_feature 1..20: note = CRISPR gRNA sequence
  source 1..20: mol_type = other DNA
ggattttttttttaattatt

SEQ ID NO: 66049 - DNA, 20 bp, synthetic construct
  misc_feature 1..20: note = CRISPR gRNA sequence
  source 1..20: mol_type = other DNA
tttttttaattattatactt

SEQ ID NO: 66050 - DNA, 20 bp, synthetic construct
  misc_feature 1..20: note = CRISPR gRNA sequence
  source 1..20: mol_type = other DNA
ttttttaattattatacttt

SEQ ID NO: 66051 - DNA, 20 bp, synthetic construct
  misc_feature 1..20: note = CRISPR gRNA sequence
  source 1..20: mol_type = other DNA
tttttaattattatacttta

SEQ ID NO: 66052 - DNA, 20 bp, synthetic construct
  misc_feature 1..20: note = CRISPR gRNA sequence
  source 1..20: mol_type = other DNA
ttttaattattatactttaa

SEQ ID NO: 66053 - DNA, 20 bp, synthetic construct
  misc_feature 1..20: note = CRISPR gRNA sequence
  source 1..20: mol_type = other DNA
tttaattattatactttaag

SEQ ID NO: 66054 - DNA, 20 bp, synthetic construct
  misc_feature 1..20: note = CRISPR gRNA sequence
  source 1..20: mol_type = other DNA
ttaattattatactttaagt

SEQ ID NO: 66055 - DNA, 20 bp, synthetic construct
  misc_feature 1..20: note = CRISPR gRNA sequence
  source 1..20: mol_type = other DNA
taattattatactttaagtt

SEQ ID NO: 66056 - DNA, 20 bp, synthetic construct
  misc_feature 1..20: note = CRISPR gRNA sequence
  source 1..20: mol_type = other DNA
aattattatactttaagttc

SEQ ID NO: 66057 - DNA, 20 bp, synthetic construct
  misc_feature 1..20: note = CRISPR gRNA sequence
  source 1..20: mol_type = other DNA
attattatactttaagttct

SEQ ID NO: 66058 - DNA, 20 bp, synthetic construct
  misc_feature 1..20: note = CRISPR gRNA sequence
  source 1..20: mol_type = other DNA
ttatactttaagttctaggg

SEQ ID NO: 66059 - DNA, 20 bp, synthetic construct
  misc_feature 1..20: note = CRISPR gRNA sequence
  source 1..20: mol_type = other DNA
tactttaagttctagggtac

SEQ ID NO: 66060 - DNA, 20 bp, synthetic construct
  misc_feature 1..20: note = CRISPR gRNA sequence
  source 1..20: mol_type = other DNA
taagttctagggtacatgtg

SEQ ID NO: 66061 - DNA, 20 bp, synthetic construct
  misc_feature 1..20: note = CRISPR gRNA sequence
  source 1..20: mol_type = other DNA
aagttctagggtacatgtgc

SEQ ID NO: 66062 - DNA, 20 bp, synthetic construct
  misc_feature 1..20: note = CRISPR gRNA sequence
  source 1..20: mol_type = other DNA
agttctagggtacatgtgca

SEQ ID NO: 66063 - DNA, 20 bp, synthetic construct
  misc_feature 1..20: note = CRISPR gRNA sequence
  source 1..20: mol_type = other DNA
tagggtacatgtgcacaaca

SEQ ID NO: 66064 - DNA, 20 bp, synthetic construct
  misc_feature 1..20: note = CRISPR gRNA sequence
  source 1..20: mol_type = other DNA
gggtacatgtgcacaacata

SEQ ID NO: 66065 - DNA, 20 bp, synthetic construct
  misc_feature 1..20: note = CRISPR gRNA sequence
  source 1..20: mol_type = other DNA
gttacatatgtatacatgtg

SEQ ID NO: 66066 - DNA, 20 bp, synthetic construct
  misc_feature 1..20: note = CRISPR gRNA sequence
  source 1..20: mol_type = other DNA
ttacatatgtatacatgtgc

SEQ ID NO: 66067 - DNA, 20 bp, synthetic construct
  misc_feature 1..20: note = CRISPR gRNA sequence
  source 1..20: mol_type = other DNA
catatgtatacatgtgccat

SEQ ID NO: 66068 - DNA, 20 bp, synthetic construct
  misc_feature 1..20: note = CRISPR gRNA sequence
  source 1..20: mol_type = other DNA
gtatgctgcagagactttta

SEQ ID NO: 66069 - DNA, 20 bp, synthetic construct
  misc_feature 1..20: note = CRISPR gRNA sequence
  source 1..20: mol_type = other DNA
cagagacttttaagaaaact

SEQ ID NO: 66070 - DNA, 20 bp, synthetic construct
  misc_feature 1..20: note = CRISPR gRNA sequence
  source 1..20: mol_type = other DNA
ttaagaaaactgggggccag

SEQ ID NO: 66071 - DNA, 20 bp, synthetic construct
  misc_feature 1..20: note = CRISPR gRNA sequence
  source 1..20: mol_type = other DNA
taagaaaactgggggccagg

SEQ ID NO: 66072 - DNA, 20 bp, synthetic construct
  misc_feature 1..20: note = CRISPR gRNA sequence
  source 1..20: mol_type = other DNA
aagaaaactgggggccaggc

SEQ ID NO: 66073 - DNA, 20 bp, synthetic construct
  misc_feature 1..20: note = CRISPR gRNA sequence
  source 1..20: mol_type = other DNA
agaaaactgggggccaggcg

SEQ ID NO: 66074 - DNA, 20 bp, synthetic construct
  misc_feature 1..20: note = CRISPR gRNA sequence
  source 1..20: mol_type = other DNA
ggggccaggcgcggtggctc

SEQ ID NO: 66075 - DNA, 20 bp, synthetic construct
  misc_feature 1..20: note = CRISPR gRNA sequence
  source 1..20: mol_type = other DNA
acgcctgtaatcccagcatt

SEQ ID NO: 66076 - DNA, 20 bp, synthetic construct
  misc_feature 1..20: note = CRISPR gRNA sequence
  source 1..20: mol_type = other DNA
taatcccagcattttgggag

SEQ ID NO: 66077 - DNA, 20 bp, synthetic construct
  misc_feature 1..20: note = CRISPR gRNA sequence
  source 1..20: mol_type = other DNA
tgggaggccaaggtgggcgg

SEQ ID NO: 66078 - DNA, 20 bp, synthetic construct
  misc_feature 1..20: note = CRISPR gRNA sequence
  source 1..20: mol_type = other DNA
gggaggccaaggtgggcgga

SEQ ID NO: 66079 - DNA, 20 bp, synthetic construct
  misc_feature 1..20: note = CRISPR gRNA sequence
  source 1..20: mol_type = other DNA
ggaggccaaggtgggcggat

SEQ ID NO: 66080 - DNA, 20 bp, synthetic construct
  misc_feature 1..20: note = CRISPR gRNA sequence
  source 1..20: mol_type = other DNA
gagaacagcctggccaacag

SEQ ID NO: 66081 - DNA, 20 bp, synthetic construct
  misc_feature 1..20: note = CRISPR gRNA sequence
  source 1..20: mol_type = other DNA
agaacagcctggccaacagg

SEQ ID NO: 66082 - DNA, 20 bp, synthetic construct
  misc_feature 1..20: note = CRISPR gRNA sequence
  source 1..20: mol_type = other DNA
gccaacagggtgaaaccctg

SEQ ID NO: 66083 - DNA, 20 bp, synthetic construct
  misc_feature 1..20: note = CRISPR gRNA sequence
  source 1..20: mol_type = other DNA
tctctgctaaaaataccaaa

SEQ ID NO: 66084 - DNA, 20 bp, synthetic construct
  misc_feature 1..20: note = CRISPR gRNA sequence
  source 1..20: mol_type = other DNA
tgctaaaaataccaaaaaaa

SEQ ID NO: 66085 - DNA, 20 bp, synthetic construct
  misc_feature 1..20: note = CRISPR gRNA sequence
  source 1..20: mol_type = other DNA
ctaaaaataccaaaaaaaaa

SEQ ID NO: 66086 - DNA, 20 bp, synthetic construct
  misc_feature 1..20: note = CRISPR gRNA sequence
  source 1..20: mol_type = other DNA
aaaataccaaaaaaaaaaaa

SEQ ID NO: 66087 - DNA, 20 bp, synthetic construct
  misc_feature 1..20: note = CRISPR gRNA sequence
  source 1..20: mol_type = other DNA
ggcgtggttgtgagcccttg

SEQ ID NO: 66088 - DNA, 20 bp, synthetic construct
  misc_feature 1..20: note = CRISPR gRNA sequence
  source 1..20: mol_type = other DNA
tgagcccttgtagtgccagc

SEQ ID NO: 66089 - DNA, 20 bp, synthetic construct
  misc_feature 1..20: note = CRISPR gRNA sequence
  source 1..20: mol_type = other DNA
gtagtgccagccgctcagga

SEQ ID NO: 66090 - DNA, 20 bp, synthetic construct
  misc_feature 1..20: note = CRISPR gRNA sequence
  source 1..20: mol_type = other DNA
tagtgccagccgctcaggag

SEQ ID NO: 66091 - DNA, 20 bp, synthetic construct
  misc_feature 1..20: note = CRISPR gRNA sequence
  source 1..20: mol_type = other DNA
aggagtcaggagaatcactt

SEQ ID NO: 66092 - DNA, 20 bp, synthetic construct
  misc_feature 1..20: note = CRISPR gRNA sequence
  source 1..20: mol_type = other DNA
gaacccaggaggcgaaggtt

SEQ ID NO: 66093 - DNA, 20 bp, synthetic construct
  misc_feature 1..20: note = CRISPR gRNA sequence
  source 1..20: mol_type = other DNA
aacccaggaggcgaaggttg

SEQ ID NO: 66094 - DNA, 20 bp, synthetic construct
  misc_feature 1..20: note = CRISPR gRNA sequence
  source 1..20: mol_type = other DNA
cagtgagctgagatcgtgcc

SEQ ID NO: 66095 - DNA, 20 bp, synthetic construct
  misc_feature 1..20: note = CRISPR gRNA sequence
  source 1..20: mol_type = other DNA
agatcgtgccactgcactcc

SEQ ID NO: 66096 - DNA, 20 bp, synthetic construct
  misc_feature 1..20: note = CRISPR gRNA sequence
  source 1..20: mol_type = other DNA
cactccagcctgggcgacag

SEQ ID NO: 66097 - DNA, 20 bp, synthetic construct
  misc_feature 1..20: note = CRISPR gRNA sequence
  source 1..20: mol_type = other DNA
cagcctgggcgacagagtga

SEQ ID NO: 66098 - DNA, 20 bp, synthetic construct
  misc_feature 1..20: note = CRISPR gRNA sequence
  source 1..20: mol_type = other DNA
ggcgacagagtgagactcca

SEQ ID NO: 66099 - DNA, 20 bp, synthetic construct
  misc_feature 1..20: note = CRISPR gRNA sequence
  source 1..20: mol_type = other DNA
catctcaaaaaaaaaaagaa

SEQ ID NO: 66100 - DNA, 20 bp, synthetic construct
  misc_feature 1..20: note = CRISPR gRNA sequence
  source 1..20: mol_type = other DNA
aaaaaaaaaaagaaaagaaa

SEQ ID NO: 66101 - DNA, 20 bp, synthetic construct
  misc_feature 1..20: note = CRISPR gRNA sequence
  source 1..20: mol_type = other DNA
ggagcttcctagttgccact

SEQ ID NO: 66102 - DNA, 20 bp, synthetic construct
  misc_feature 1..20: note = CRISPR gRNA sequence
  source 1..20: mol_type = other DNA
cctagttgccactggggact

SEQ ID NO: 66103 - DNA, 20 bp, synthetic construct
  misc_feature 1..20: note = CRISPR gRNA sequence
  source 1..20: mol_type = other DNA
ctagttgccactggggactc

SEQ ID NO: 66104 - DNA, 20 bp, synthetic construct
  misc_feature 1..20: note = CRISPR gRNA sequence
  source 1..20: mol_type = other DNA
gttgccactggggactcagg

SEQ ID NO: 66105 - DNA, 20 bp, synthetic construct
  misc_feature 1..20: note = CRISPR gRNA sequence
  source 1..20: mol_type = other DNA
ccactggggactcagggacc

SEQ ID NO: 66106 - DNA, 20 bp, synthetic construct
  misc_feature 1..20: note = CRISPR gRNA sequence
  source 1..20: mol_type = other DNA
gggactcagggacctgtctt

SEQ ID NO: 66107 - DNA, 20 bp, synthetic construct
  misc_feature 1..20: note = CRISPR gRNA sequence
  source 1..20: mol_type = other DNA
agggacctgtcttaattgtg

SEQ ID NO: 66108 - DNA, 20 bp, synthetic construct
  misc_feature 1..20: note = CRISPR gRNA sequence
  source 1..20: mol_type = other DNA
tcttaattgtgggagctgat

SEQ ID NO: 66109 - DNA, 20 bp, synthetic construct
  misc_feature 1..20: note = CRISPR gRNA sequence
  source 1..20: mol_type = other DNA
aattgtgggagctgatgaga

SEQ ID NO: 66110 - DNA, 20 bp, synthetic construct
  misc_feature 1..20: note = CRISPR gRNA sequence
  source 1..20: mol_type = other DNA
attgtgggagctgatgagaa

SEQ ID NO: 66111 - DNA, 20 bp, synthetic construct
  misc_feature 1..20: note = CRISPR gRNA sequence
  source 1..20: mol_type = other DNA
tgggagctgatgagaatata

SEQ ID NO: 66112 - DNA, 20 bp, synthetic construct
  misc_feature 1..20: note = CRISPR gRNA sequence
  source 1..20: mol_type = other DNA
atgagaatataaaaggggag

SEQ ID NO: 66113 - DNA, 20 bp, synthetic construct
  misc_feature 1..20: note = CRISPR gRNA sequence
  source 1..20: mol_type = other DNA
agggcaccgcatccatgatt

SEQ ID NO: 66114 - DNA, 20 bp, synthetic construct
  misc_feature 1..20: note = CRISPR gRNA sequence
  source 1..20: mol_type = other DNA
tcaggggaggtctgcttccc

SEQ ID NO: 66115 - DNA, 20 bp, synthetic construct
  misc_feature 1..20: note = CRISPR gRNA sequence
  source 1..20: mol_type = other DNA
caggggaggtctgcttccct

SEQ ID NO: 66116 - DNA, 20 bp, synthetic construct
  misc_feature 1..20: note = CRISPR gRNA sequence
  source 1..20: mol_type = other DNA
aggggaggtctgcttccctt

SEQ ID NO: 66117 - DNA, 20 bp, synthetic construct
  misc_feature 1..20: note = CRISPR gRNA sequence
  source 1..20: mol_type = other DNA
cttccctttcccttccctaa

SEQ ID NO: 66118 - DNA, 20 bp, synthetic construct
  misc_feature 1..20: note = CRISPR gRNA sequence
  source 1..20: mol_type = other DNA
ccctttcccttccctaagga

SEQ ID NO: 66119 - DNA, 20 bp, synthetic construct
  misc_feature 1..20: note = CRISPR gRNA sequence
  source 1..20: mol_type = other DNA
cctttcccttccctaaggac

SEQ ID NO: 66120 - DNA, 20 bp, synthetic construct
  misc_feature 1..20: note = CRISPR gRNA sequence
  source 1..20: mol_type = other DNA
tcccttccctaaggaccccc

SEQ ID NO: 66121 - DNA, 20 bp, synthetic construct
  misc_feature 1..20: note = CRISPR gRNA sequence
  source 1..20: mol_type = other DNA
cccttccctaaggaccccca

SEQ ID NO: 66122 - DNA, 20 bp, synthetic construct
  misc_feature 1..20: note = CRISPR gRNA sequence
  source 1..20: mol_type = other DNA
ccttccctaaggacccccaa

SEQ ID NO: 66123 - DNA, 20 bp, synthetic construct
  misc_feature 1..20: note = CRISPR gRNA sequence
  source 1..20: mol_type = other DNA
ccctaaggacccccaagaat

SEQ ID NO: 66124 - DNA, 20 bp, synthetic construct
  misc_feature 1..20: note = CRISPR gRNA sequence
  source 1..20: mol_type = other DNA
cctaaggacccccaagaatg

SEQ ID NO: 66125 - DNA, 20 bp, synthetic construct
  misc_feature 1..20: note = CRISPR gRNA sequence
  source 1..20: mol_type = other DNA
aggacccccaagaatgggag

SEQ ID NO: 66126 - DNA, 20 bp, synthetic construct
  misc_feature 1..20: note = CRISPR gRNA sequence
  source 1..20: mol_type = other DNA
agttacttaactgctgcgag

SEQ ID NO: 66127 - DNA, 20 bp, synthetic construct
  misc_feature 1..20: note = CRISPR gRNA sequence
  source 1..20: mol_type = other DNA
cttaactgctgcgagctcag

SEQ ID NO: 66128 - DNA, 20 bp, synthetic construct
  misc_feature 1..20: note = CRISPR gRNA sequence
  source 1..20: mol_type = other DNA
aactgctgcgagctcagagc

SEQ ID NO: 66129 - DNA, 20 bp, synthetic construct
  misc_feature 1..20: note = CRISPR gRNA sequence
  source 1..20: mol_type = other DNA
actgctgcgagctcagagca

SEQ ID NO: 66130 - DNA, 20 bp, synthetic construct
  misc_feature 1..20: note = CRISPR gRNA sequence
  source 1..20: mol_type = other DNA
ctgcgagctcagagcaggtc

SEQ ID NO: 66131 - DNA, 20 bp, synthetic construct
  misc_feature 1..20: note = CRISPR gRNA sequence
  source 1..20: mol_type = other DNA
cgagctcagagcaggtccca

SEQ ID NO: 66132 - DNA, 20 bp, synthetic construct
  misc_feature 1..20: note = CRISPR gRNA sequence
  source 1..20: mol_type = other DNA
agagcaggtcccagagcctc

SEQ ID NO: 66133 - DNA, 20 bp, synthetic construct
  misc_feature 1..20: note = CRISPR gRNA sequence
  source 1..20: mol_type = other DNA
tccaggcctcagtttcctca

SEQ ID NO: 66134 - DNA, 20 bp, synthetic construct
  misc_feature 1..20: note = CRISPR gRNA sequence
  source 1..20: mol_type = other DNA
caggcctcagtttcctcatc

SEQ ID NO: 66135 - DNA, 20 bp, synthetic construct
  misc_feature 1..20: note = CRISPR gRNA sequence
  source 1..20: mol_type = other DNA
agtttcctcatctgtaaaat

SEQ ID NO: 66136 - DNA, 20 bp, synthetic construct
  misc_feature 1..20: note = CRISPR gRNA sequence
  source 1..20: mol_type = other DNA
cctcatctgtaaaatggaga

SEQ ID NO: 66137 - DNA, 20 bp, synthetic construct
  misc_feature 1..20: note = CRISPR gRNA sequence
  source 1..20: mol_type = other DNA
ctcatctgtaaaatggagat

SEQ ID NO: 66138 - DNA, 20 bp, synthetic construct
  misc_feature 1..20: note = CRISPR gRNA sequence
  source 1..20: mol_type = other DNA
atctgtaaaatggagataag

SEQ ID NO: 66139 - DNA, 20 bp, synthetic construct
  misc_feature 1..20: note = CRISPR gRNA sequence
  source 1..20: mol_type = other DNA
taaaatggagataagaataa

SEQ ID NO: 66140 - DNA, 20 bp, synthetic construct
  misc_feature 1..20: note = CRISPR gRNA sequence
  source 1..20: mol_type = other DNA
ctggcctggcacagtggctc

SEQ ID NO: 66141 - DNA, 20 bp, synthetic construct
  misc_feature 1..20: note = CRISPR gRNA sequence
  source 1..20: mol_type = other DNA
gcctggcacagtggctcaag

SEQ ID NO: 66142 - DNA, 20 bp, synthetic construct
  misc_feature 1..20: note = CRISPR gRNA sequence
  source 1..20: mol_type = other DNA
gcacagtggctcaagcctgt

SEQ ID NO: 66143 - DNA, 20 bp, synthetic construct
  misc_feature 1..20: note = CRISPR gRNA sequence
  source 1..20: mol_type = other DNA
aagcctgtaatcccagcact

SEQ ID NO: 66144 - DNA, 20 bp, synthetic construct
  misc_feature 1..20: note = CRISPR gRNA sequence
  source 1..20: mol_type = other DNA
taatcccagcactttgggag

SEQ ID NO: 66145 - DNA, 20 bp, synthetic construct
  misc_feature 1..20: note = CRISPR gRNA sequence
  source 1..20: mol_type = other DNA
tgggaggccaagacaggagg

SEQ ID NO: 66146 - DNA, 20 bp, synthetic construct
  misc_feature 1..20: note = CRISPR gRNA sequence
  source 1..20: mol_type = other DNA
gggaggccaagacaggagga

SEQ ID NO: 66147 - DNA, 20 bp, synthetic construct
  misc_feature 1..20: note = CRISPR gRNA sequence
  source 1..20: mol_type = other DNA
ggaggccaagacaggaggag

SEQ ID NO: 66148 - DNA, 20 bp, synthetic construct
  misc_feature 1..20: note = CRISPR gRNA sequence
  source 1..20: mol_type = other DNA
agcctaggagtttgagacca

SEQ ID NO: 66149 - DNA, 20 bp, synthetic construct
  misc_feature 1..20: note = CRISPR gRNA sequence
  source 1..20: mol_type = other DNA
ggagtttgagaccagcctgg

SEQ ID NO: 66150 - DNA, 20 bp, synthetic construct
  misc_feature 1..20: note = CRISPR gRNA sequence
  source 1..20: mol_type = other DNA
gagaccagcctggacaacat

SEQ ID NO: 66151 - DNA, 20 bp, synthetic construct
  misc_feature 1..20: note = CRISPR gRNA sequence
  source 1..20: mol_type = other DNA
agaccagcctggacaacatg

SEQ ID NO: 66152 - DNA, 20 bp, synthetic construct
  misc_feature 1..20: note = CRISPR gRNA sequence
  source 1..20: mol_type = other DNA
gacaacatggtgagaccccc

SEQ ID NO: 66153 - DNA, 20 bp, synthetic construct
  misc_feature 1..20: note = CRISPR gRNA sequence
  source 1..20: mol_type = other DNA
tacagaaactttaaaaatta

SEQ ID NO: 66154 - DNA, 20 bp, synthetic construct
  misc_feature 1..20: note = CRISPR gRNA sequence
  source 1..20: mol_type = other DNA
cagaaactttaaaaattagc

SEQ ID NO: 66155 - DNA, 20 bp, synthetic construct
  misc_feature 1..20: note = CRISPR gRNA sequence
  source 1..20: mol_type = other DNA
taaaaattagccaagcgtga

SEQ ID NO: 66156 - DNA, 20 bp, synthetic construct
  misc_feature 1..20: note = CRISPR gRNA sequence
  source 1..20: mol_type = other DNA
aaaaattagccaagcgtgat

SEQ ID NO: 66157 - DNA, 20 bp, synthetic construct
  misc_feature 1..20: note = CRISPR gRNA sequence
  source 1..20: mol_type = other DNA
aaaattagccaagcgtgatg

SEQ ID NO: 66158 - DNA, 20 bp, synthetic construct
  misc_feature 1..20: note = CRISPR gRNA sequence
  source 1..20: mol_type = other DNA
gccaagcgtgatggcatgca

SEQ ID NO: 66159 - DNA, 20 bp, synthetic construct
  misc_feature 1..20: note = CRISPR gRNA sequence
  source 1..20: mol_type = other DNA
cttgggaggctgaggtggga

SEQ ID NO: 66160 - DNA, 20 bp, synthetic construct
  misc_feature 1..20: note = CRISPR gRNA sequence
  source 1..20: mol_type = other DNA
gggaggctgaggtgggagga

SEQ ID NO: 66161 - DNA, 20 bp, synthetic construct
  misc_feature 1..20: note = CRISPR gRNA sequence
  source 1..20: mol_type = other DNA
ggaggctgaggtgggaggat

SEQ ID NO: 66162 - DNA, 20 bp, synthetic construct
  misc_feature 1..20: note = CRISPR gRNA sequence
  source 1..20: mol_type = other DNA
aggtgggaggattgcttaga

SEQ ID NO: 66163 - DNA, 20 bp, synthetic construct
  misc_feature 1..20: note = CRISPR gRNA sequence
  source 1..20: mol_type = other DNA
cttagactcaggagatcgag

SEQ ID NO: 66164 - DNA, 20 bp, synthetic construct
  misc_feature 1..20: note = CRISPR gRNA sequence
  source 1..20: mol_type = other DNA
agactcaggagatcgaggct

SEQ ID NO: 66165 - DNA, 20 bp, synthetic construct
  misc_feature 1..20: note = CRISPR gRNA sequence
  source 1..20: mol_type = other DNA
gactcaggagatcgaggcta

SEQ ID NO: 66166 - DNA, 20 bp, synthetic construct
  misc_feature 1..20: note = CRISPR gRNA sequence
  source 1..20: mol_type = other DNA
aggagatcgaggctacagtg

SEQ ID NO: 66167 - DNA, 20 bp, synthetic construct
  misc_feature 1..20: note = CRISPR gRNA sequence
  source 1..20: mol_type = other DNA
cagtgagttgtgatcacacc

SEQ ID NO: 66168 - DNA, 20 bp, synthetic construct
  misc_feature 1..20: note = CRISPR gRNA sequence
  source 1..20: mol_type = other DNA
tgatcacaccattgcactcc

SEQ ID NO: 66169 - DNA, 20 bp, synthetic construct
  misc_feature 1..20: note = CRISPR gRNA sequence
  source 1..20: mol_type = other DNA
cactccagcctgggcaacag

SEQ ID NO: 66170 - DNA, 20 bp, synthetic construct
  misc_feature 1..20: note = CRISPR gRNA sequence
  source 1..20: mol_type = other DNA
cagcctgggcaacagagcaa

SEQ ID NO: 66171 - DNA, 20 bp, synthetic construct
  misc_feature 1..20: note = CRISPR gRNA sequence
  source 1..20: mol_type = other DNA
ggcaacagagcaagactctg

SEQ ID NO: 66172 - DNA, 20 bp, synthetic construct
  misc_feature 1..20: note = CRISPR gRNA sequence
  source 1..20: mol_type = other DNA
tgtctcaaagaaaaaaaaat

SEQ ID NO: 66173 - DNA, 20 bp, synthetic construct
  misc_feature 1..20: note = CRISPR gRNA sequence
  source 1..20: mol_type = other DNA
tctcaaagaaaaaaaaatgt

SEQ ID NO: 66174 - DNA, 20 bp, synthetic construct
  misc_feature 1..20: note = CRISPR gRNA sequence
  source 1..20: mol_type = other DNA
aaagaaaaaaaaatgtcagg

SEQ ID NO: 66175 - DNA, 20 bp, synthetic construct
  misc_feature 1..20: note = CRISPR gRNA sequence
  source 1..20: mol_type = other DNA
acatctgtaattccagcact

SEQ ID NO: 66176 - DNA, 20 bp, synthetic construct
  misc_feature 1..20: note = CRISPR gRNA sequence
  source 1..20: mol_type = other DNA
taattccagcactttgggag

SEQ ID NO: 66177 - DNA, 20 bp, synthetic construct
  misc_feature 1..20: note = CRISPR gRNA sequence
  source 1..20: mol_type = other DNA
cagcactttgggaggctaag

SEQ ID NO: 66178 - DNA, 20 bp, synthetic construct
  misc_feature 1..20: note = CRISPR gRNA sequence
  source 1..20: mol_type = other DNA
tgggaggctaaggcaggagg

SEQ ID NO: 66179 - DNA, 20 bp, synthetic construct
  misc_feature 1..20: note = CRISPR gRNA sequence
  source 1..20: mol_type = other DNA
gggaggctaaggcaggagga

SEQ ID NO: 66180 - DNA, 20 bp, synthetic construct
  misc_feature 1..20: note = CRISPR gRNA sequence
  source 1..20: mol_type = other DNA
ggaggctaaggcaggaggat

SEQ ID NO: 66181 - DNA, 20 bp, synthetic construct
  misc_feature 1..20: note = CRISPR gRNA sequence
  source 1..20: mol_type = other DNA
aggcaggaggatcgtttgag

SEQ ID NO: 66182 - DNA, 20 bp, synthetic construct
  misc_feature 1..20: note = CRISPR gRNA sequence
  source 1..20: mol_type = other DNA
gagccatggagtttgagacc

SEQ ID NO: 66183 - DNA, 20 bp, synthetic construct
  misc_feature 1..20: note = CRISPR gRNA sequence
  source 1..20: mol_type = other DNA
agccatggagtttgagacca

SEQ ID NO: 66184 - DNA, 20 bp, synthetic construct
  misc_feature 1..20: note = CRISPR gRNA sequence
  source 1..20: mol_type = other DNA
gagaccagcctgctcaacat

SEQ ID NO: 66185 - DNA, 20 bp, synthetic construct
  misc_feature 1..20: note = CRISPR gRNA sequence
  source 1..20: mol_type = other DNA
agaccagcctgctcaacatg

SEQ ID NO: 66186 - DNA, 20 bp, synthetic construct
  misc_feature 1..20: note = CRISPR gRNA sequence
  source 1..20: mol_type = other DNA
ctcaacatggcaaaacccca

SEQ ID NO: 66187 - DNA, 20 bp, synthetic construct
  misc_feature 1..20: note = CRISPR gRNA sequence
  source 1..20: mol_type = other DNA
aacatggcaaaaccccatct

SEQ ID NO: 66188 - DNA, 20 bp, synthetic construct
  misc_feature 1..20: note = CRISPR gRNA sequence
  source 1..20: mol_type = other DNA
tacaaaaaatacaaaaatta

SEQ ID NO: 66189 - DNA, 20 bp, synthetic construct
  misc_feature 1..20: note = CRISPR gRNA sequence
  source 1..20: mol_type = other DNA
caaaaaatacaaaaattaga

SEQ ID NO: 66190 - DNA, 20 bp, synthetic construct
  misc_feature 1..20: note = CRISPR gRNA sequence
  source 1..20: mol_type = other DNA
gacagtcatggtggggcgtt

SEQ ID NO: 66191 - DNA, 20 bp, synthetic construct
  misc_feature 1..20: note = CRISPR gRNA sequence
  source 1..20: mol_type = other DNA
ctgtagtcccagctacttgg

SEQ ID NO: 66192 - DNA, 20 bp, synthetic construct
  misc_feature 1..20: note = CRISPR gRNA sequence
  source 1..20: mol_type = other DNA
tagtcccagctacttgggag

SEQ ID NO: 66193 - DNA, 20 bp, synthetic construct
  misc_feature 1..20: note = CRISPR gRNA sequence
  source 1..20: mol_type = other DNA
cttgggaggctgaggcagta

SEQ ID NO: 66194 - DNA, 20 bp, synthetic construct
  misc_feature 1..20: note = CRISPR gRNA sequence
  source 1..20: mol_type = other DNA
gggaggctgaggcagtagga

SEQ ID NO: 66195 - DNA, 20 bp, synthetic construct
  misc_feature 1..20: note = CRISPR gRNA sequence
  source 1..20: mol_type = other DNA
ggaggctgaggcagtaggat

SEQ ID NO: 66196 - DNA, 20 bp, synthetic construct
  misc_feature 1..20: note = CRISPR gRNA sequence
  source 1..20: mol_type = other DNA
aggcagtaggatcagttgag

SEQ ID NO: 66197 - DNA, 20 bp, synthetic construct
  misc_feature 1..20: note = CRISPR gRNA sequence
  source 1..20: mol_type = other DNA
agcccggggaaggttgaggc

SEQ ID NO: 66198 - DNA, 20 bp, synthetic construct
  misc_feature 1..20: note = CRISPR gRNA sequence
  source 1..20: mol_type = other DNA
aggctgcagtgagccatgac

SEQ ID NO: 66199 - DNA, 20 bp, synthetic construct
  misc_feature 1..20: note = CRISPR gRNA sequence
  source 1..20: mol_type = other DNA
cagtgagccatgactgcacc

SEQ ID NO: 66200 - DNA, 20 bp, synthetic construct
  misc_feature 1..20: note = CRISPR gRNA sequence
  source 1..20: mol_type = other DNA
caccactgcacaccagcctg

SEQ ID NO: 66201 - DNA, 20 bp, synthetic construct
  misc_feature 1..20: note = CRISPR gRNA sequence
  source 1..20: mol_type = other DNA
cacaccagcctgggcgacag

SEQ ID NO: 66202 - DNA, 20 bp, synthetic construct
  misc_feature 1..20: note = CRISPR gRNA sequence
  source 1..20: mol_type = other DNA
ggcgacagagcaagaccctt

SEQ ID NO: 66203 - DNA, 20 bp, synthetic construct
  misc_feature 1..20: note = CRISPR gRNA sequence
  source 1..20: mol_type = other DNA
tcttcgaaacaacaacaaag

SEQ ID NO: 66204 - DNA, 20 bp, synthetic construct
  misc_feature 1..20: note = CRISPR gRNA sequence
  source 1..20: mol_type = other DNA
cttcgaaacaacaacaaaga

SEQ ID NO: 66205 - DNA, 20 bp, synthetic construct
  misc_feature 1..20: note = CRISPR gRNA sequence
  source 1..20: mol_type = other DNA
ttcgaaacaacaacaaagaa

SEQ ID NO: 66206 - DNA, 20 bp, synthetic construct
  misc_feature 1..20: note = CRISPR gRNA sequence
  source 1..20: mol_type = other DNA
cgaaacaacaacaaagaaga

SEQ ID NO: 66207 - DNA, 20 bp, synthetic construct
  misc_feature 1..20: note = CRISPR gRNA sequence
  source 1..20: mol_type = other DNA
gaaacaacaacaaagaagaa

SEQ ID NO: 66208 - DNA, 20 bp, synthetic construct
  misc_feature 1..20: note = CRISPR gRNA sequence
  source 1..20: mol_type = other DNA
cttacctcattgtttattgt

SEQ ID NO: 66209 - DNA, 20 bp, synthetic construct
  misc_feature 1..20: note = CRISPR gRNA sequence
  source 1..20: mol_type = other DNA
ttacctcattgtttattgtg

SEQ ID NO: 66210 - DNA, 20 bp, synthetic construct
  misc_feature 1..20: note = CRISPR gRNA sequence
  source 1..20: mol_type = other DNA
acctcattgtttattgtgag

SEQ ID NO: 66211 - DNA, 20 bp, synthetic construct
  misc_feature 1..20: note = CRISPR gRNA sequence
  source 1..20: mol_type = other DNA
cctcattgtttattgtgaga

SEQ ID NO: 66212 - DNA, 20 bp, synthetic construct
  misc_feature 1..20: note = CRISPR gRNA sequence
  source 1..20: mol_type = other DNA
attgtttattgtgagaatca

SEQ ID NO: 66213 - DNA, 20 bp, synthetic construct
  misc_feature 1..20: note = CRISPR gRNA sequence
  source 1..20: mol_type = other DNA
tttattgtgagaatcaaatg

SEQ ID NO: 66214 - DNA, 20 bp, synthetic construct
  misc_feature 1..20: note = CRISPR gRNA sequence
  source 1..20: mol_type = other DNA
attgtgagaatcaaatgaga

SEQ ID NO: 66215 - DNA, 20 bp, synthetic construct
  misc_feature 1..20: note = CRISPR gRNA sequence
  source 1..20: mol_type = other DNA
ttgtgagaatcaaatgagaa

SEQ ID NO: 66216 - DNA, 20 bp, synthetic construct
  misc_feature 1..20: note = CRISPR gRNA sequence
  source 1..20: mol_type = other DNA
tgagaatcaaatgagaaatg

SEQ ID NO: 66217 - DNA, 20 bp, synthetic construct
  misc_feature 1..20: note = CRISPR gRNA sequence
  source 1..20: mol_type = other DNA
tgcatgtgacttgatacatg

SEQ ID NO: 66218 - DNA, 20 bp, synthetic construct
  misc_feature 1..20: note = CRISPR gRNA sequence
  source 1..20: mol_type = other DNA
gcatgtgacttgatacatgt

SEQ ID NO: 66219 - DNA, 20 bp, synthetic construct
  misc_feature 1..20: note = CRISPR gRNA sequence
  source 1..20: mol_type = other DNA
catgtgacttgatacatgta

SEQ ID NO: 66220 - DNA, 20 bp, synthetic construct
  misc_feature 1..20: note = CRISPR gRNA sequence
  source 1..20: mol_type = other DNA
gatacatgtaattgttgctt

SEQ ID NO: 66221 - DNA, 20 bp, synthetic construct
  misc_feature 1..20: note = CRISPR gRNA sequence
  source 1..20: mol_type = other DNA
atacatgtaattgttgctta

SEQ ID NO: 66222 - DNA, 20 bp, synthetic construct
  misc_feature 1..20: note = CRISPR gRNA sequence
  source 1..20: mol_type = other DNA
ttgcttaatctattccttgt

SEQ ID NO: 66223 - DNA, 20 bp, synthetic construct
  misc_feature 1..20: note = CRISPR gRNA sequence
  source 1..20: mol_type = other DNA
cttaatctattccttgtttg

SEQ ID NO: 66224 - DNA, 20 bp, synthetic construct
  misc_feature 1..20: note = CRISPR gRNA sequence
  source 1..20: mol_type = other DNA
aatctattccttgtttgcta

SEQ ID NO: 66225 - DNA, 20 bp, synthetic construct
  misc_feature 1..20: note = CRISPR gRNA sequence
  source 1..20: mol_type = other DNA
atctattccttgtttgctaa

SEQ ID NO: 66226 - DNA, 20 bp, synthetic construct
  misc_feature 1..20: note = CRISPR gRNA sequence
  source 1..20: mol_type = other DNA
ttccttgtttgctaagaaag

SEQ ID NO: 66227 - DNA, 20 bp, synthetic construct
  misc_feature 1..20: note = CRISPR gRNA sequence
  source 1..20: mol_type = other DNA
cttgtttgctaagaaagcag

SEQ ID NO: 66228 - DNA, 20 bp, synthetic construct
  misc_feature 1..20: note = CRISPR gRNA sequence
  source 1..20: mol_type = other DNA
gtttgctaagaaagcaggcc

SEQ ID NO: 66229 - DNA, 20 bp, synthetic construct
  misc_feature 1..20: note = CRISPR gRNA sequence
  source 1..20: mol_type = other DNA
tttgctaagaaagcaggcca

SEQ ID NO: 66230 - DNA, 20 bp, synthetic construct
  misc_feature 1..20: note = CRISPR gRNA sequence
  source 1..20: mol_type = other DNA
gctaagaaagcaggccaccc

SEQ ID NO: 66231 - DNA, 20 bp, synthetic construct
  misc_feature 1..20: note = CRISPR gRNA sequence
  source 1..20: mol_type = other DNA
ctaagaaagcaggccacccc

SEQ ID NO: 66232 - DNA, 20 bp, synthetic construct
  misc_feature 1..20: note = CRISPR gRNA sequence
  source 1..20: mol_type = other DNA
agaaagcaggccaccccagg

SEQ ID NO: 66233 - DNA, 20 bp, synthetic construct
  misc_feature 1..20: note = CRISPR gRNA sequence
  source 1..20: mol_type = other DNA
cttgccctgaccagtctggg

SEQ ID NO: 66234 - DNA, 20 bp, synthetic construct
  misc_feature 1..20: note = CRISPR gRNA sequence
  source 1..20: mol_type = other DNA
gccctgaccagtctgggttc

SEQ ID NO: 66235 - DNA, 20 bp, synthetic construct
  misc_feature 1..20: note = CRISPR gRNA sequence
  source 1..20: mol_type = other DNA
ccctgaccagtctgggttct

SEQ ID NO: 66236 - DNA, 20 bp, synthetic construct
  misc_feature 1..20: note = CRISPR gRNA sequence
  source 1..20: mol_type = other DNA
accagtctgggttcttgcca

SEQ ID NO: 66237 - DNA, 20 bp, synthetic construct
  misc_feature 1..20: note = CRISPR gRNA sequence
  source 1..20: mol_type = other DNA
ggttcttgccactgccaggg

SEQ ID NO: 66238 - DNA, 20 bp, synthetic construct
  misc_feature 1..20: note = CRISPR gRNA sequence
  source 1..20: mol_type = other DNA
ttgccactgccagggaagtt

SEQ ID NO: 66239 - DNA, 20 bp, synthetic construct
  misc_feature 1..20: note = CRISPR gRNA sequence
  source 1..20: mol_type = other DNA
gccactgccagggaagttgg

SEQ ID NO: 66240 - DNA, 20 bp, synthetic construct
  misc_feature 1..20: note = CRISPR gRNA sequence
  source 1..20: mol_type = other DNA
ccactgccagggaagttggt

SEQ ID NO: 66241 - DNA, 20 bp, synthetic construct
  misc_feature 1..20: note = CRISPR gRNA sequence
  source 1..20: mol_type = other DNA
ccagggaagttggtctttga

SEQ ID NO: 66242 - DNA, 20 bp, synthetic construct
  misc_feature 1..20: note = CRISPR gRNA sequence
  source 1..20: mol_type = other DNA
gtctttgaccattttcaaac

SEQ ID NO: 66243 - DNA, 20 bp, synthetic construct
  misc_feature 1..20: note = CRISPR gRNA sequence
  source 1..20: mol_type = other DNA
tgaccattttcaaactgctg

SEQ ID NO: 66244 - DNA, 20 bp, synthetic construct
  misc_feature 1..20: note = CRISPR gRNA sequence
  source 1..20: mol_type = other DNA
gaccattttcaaactgctgc

SEQ ID NO: 66245 - DNA, 20 bp, synthetic construct
  misc_feature 1..20: note = CRISPR gRNA sequence
  source 1..20: mol_type = other DNA
accattttcaaactgctgct

SEQ ID NO: 66246 - DNA, 20 bp, synthetic construct
  misc_feature 1..20: note = CRISPR gRNA sequence
  source 1..20: mol_type = other DNA
tcaaactgctgcttcctctc

SEQ ID NO: 66247 - DNA, 20 bp, synthetic construct
  misc_feature 1..20: note = CRISPR gRNA sequence
  source 1..20: mol_type = other DNA
caaactgctgcttcctctct

SEQ ID NO: 66248 - DNA, 20 bp, synthetic construct
  misc_feature 1..20: note = CRISPR gRNA sequence
  source 1..20: mol_type = other DNA
aaactgctgcttcctctctg

SEQ ID NO: 66249 - DNA, 20 bp, synthetic construct
  misc_feature 1..20: note = CRISPR gRNA sequence
  source 1..20: mol_type = other DNA
ctgcttcctctctgcttcca

SEQ ID NO: 66250 - DNA, 20 bp, synthetic construct
  misc_feature 1..20: note = CRISPR gRNA sequence
  source 1..20: mol_type = other DNA
cttcctctctgcttccagct

SEQ ID NO: 66251 - DNA, 20 bp, synthetic construct
  misc_feature 1..20: note = CRISPR gRNA sequence
  source 1..20: mol_type = other DNA
cctctctgcttccagctttg

SEQ ID NO: 66252 - DNA, 20 bp, synthetic construct
  misc_feature 1..20: note = CRISPR gRNA sequence
  source 1..20: mol_type = other DNA
ctctctgcttccagctttga

SEQ ID NO: 66253 - DNA, 20 bp, synthetic construct
  misc_feature 1..20: note = CRISPR gRNA sequence
  source 1..20: mol_type = other DNA
tctgcttccagctttgaaag

SEQ ID NO: 66254 - DNA, 20 bp, synthetic construct
  misc_feature 1..20: note = CRISPR gRNA sequence
  source 1..20: mol_type = other DNA
tgcttccagctttgaaagcc

SEQ ID NO: 66255 - DNA, 20 bp, synthetic construct
  misc_feature 1..20: note = CRISPR gRNA sequence
  source 1..20: mol_type = other DNA
cttccagctttgaaagccaa

SEQ ID NO: 66256 - DNA, 20 bp, synthetic construct
  misc_feature 1..20: note = CRISPR gRNA sequence
  source 1..20: mol_type = other DNA
ccagctttgaaagccaacac

SEQ ID NO: 66257 - DNA, 20 bp, synthetic construct
  misc_feature 1..20: note = CRISPR gRNA sequence
  source 1..20: mol_type = other DNA
cagctttgaaagccaacaca

SEQ ID NO: 66258 - DNA, 20 bp, synthetic construct
  misc_feature 1..20: note = CRISPR gRNA sequence
  source 1..20: mol_type = other DNA
tgaaagccaacacatcctcc

SEQ ID NO: 66259 - DNA, 20 bp, synthetic construct
  misc_feature 1..20: note = CRISPR gRNA sequence
  source 1..20: mol_type = other DNA
gaaagccaacacatcctcct

SEQ ID NO: 66260 - DNA, 20 bp, synthetic construct
  misc_feature 1..20: note = CRISPR gRNA sequence
  source 1..20: mol_type = other DNA
aaagccaacacatcctcctg

SEQ ID NO: 66261 - DNA, 20 bp, synthetic construct
  misc_feature 1..20: note = CRISPR gRNA sequence
  source 1..20: mol_type = other DNA
ctgagaggggacaagacaag

SEQ ID NO: 66262 - DNA, 20 bp, synthetic construct
  misc_feature 1..20: note = CRISPR gRNA sequence
  source 1..20: mol_type = other DNA
agaggggacaagacaagcag

SEQ ID NO: 66263 - DNA, 20 bp, synthetic construct
  misc_feature 1..20: note = CRISPR gRNA sequence
  source 1..20: mol_type = other DNA
ggggtgggggagtcccctcc

SEQ ID NO: 66264 - DNA, 20 bp, synthetic construct
  misc_feature 1..20: note = CRISPR gRNA sequence
  source 1..20: mol_type = other DNA
ccgctctggtccccgtctgt

SEQ ID NO: 66265 - DNA, 20 bp, synthetic construct
  misc_feature 1..20: note = CRISPR gRNA sequence
  source 1..20: mol_type = other DNA
tggtccccgtctgttggagg

SEQ ID NO: 66266 - DNA, 20 bp, synthetic construct
  misc_feature 1..20: note = CRISPR gRNA sequence
  source 1..20: mol_type = other DNA
gtccccgtctgttggaggtc

SEQ ID NO: 66267 - DNA, 20 bp, synthetic construct
  misc_feature 1..20: note = CRISPR gRNA sequence
  source 1..20: mol_type = other DNA
ttggaggtccccccaccccc

SEQ ID NO: 66268 - DNA, 20 bp, synthetic construct
  misc_feature 1..20: note = CRISPR gRNA sequence
  source 1..20: mol_type = other DNA
gaggtccccccacccccaga

SEQ ID NO: 66269 - DNA, 20 bp, synthetic construct
  misc_feature 1..20: note = CRISPR gRNA sequence
  source 1..20: mol_type = other DNA
accactcagctctcagttaa

SEQ ID NO: 66270 - DNA, 20 bp, synthetic construct
  misc_feature 1..20: note = CRISPR gRNA sequence
  source 1..20: mol_type = other DNA
agctctcagttaaaccaccc

SEQ ID NO: 66271 - DNA, 20 bp, synthetic construct
  misc_feature 1..20: note = CRISPR gRNA sequence
  source 1..20: mol_type = other DNA
tcagttaaaccacccaagtc

SEQ ID NO: 66272 - DNA, 20 bp, synthetic construct
  misc_feature 1..20: note = CRISPR gRNA sequence
  source 1..20: mol_type = other DNA
agttaaaccacccaagtccg

SEQ ID NO: 66273 - DNA, 20 bp, synthetic construct
  misc_feature 1..20: note = CRISPR gRNA sequence
  source 1..20: mol_type = other DNA
aaccacccaagtccggcaca

SEQ ID NO: 66274 - DNA, 20 bp, synthetic construct
  misc_feature 1..20: note = CRISPR gRNA sequence
  source 1..20: mol_type = other DNA
ggtttaatcaccacttcagt

SEQ ID NO: 66275 - DNA, 20 bp, synthetic construct
  misc_feature 1..20: note = CRISPR gRNA sequence
  source 1..20: mol_type = other DNA
aatcaccacttcagtaacca

SEQ ID NO: 66276 - DNA, 20 bp, synthetic construct
  misc_feature 1..20: note = CRISPR gRNA sequence
  source 1..20: mol_type = other DNA
atcaccacttcagtaaccac

SEQ ID NO: 66277 - DNA, 20 bp, synthetic construct
  misc_feature 1..20: note = CRISPR gRNA sequence
  source 1..20: mol_type = other DNA
cagtaaccaccgcccccccc

SEQ ID NO: 66278 - DNA, 20 bp, synthetic construct
  misc_feature 1..20: note = CRISPR gRNA sequence
  source 1..20: mol_type = other DNA
agtaaccaccgcccccccca

SEQ ID NO: 66279 - DNA, 20 bp, synthetic construct
  misc_feature 1..20: note = CRISPR gRNA sequence
  source 1..20: mol_type = other DNA
tcagtaatcaactgccctgt

SEQ ID NO: 66280 - DNA, 20 bp, synthetic construct
  misc_feature 1..20: note = CRISPR gRNA sequence
  source 1..20: mol_type = other DNA
ccctgttttccccttggaag

SEQ ID NO: 66281 - DNA, 20 bp, synthetic construct
  misc_feature 1..20: note = CRISPR gRNA sequence
  source 1..20: mol_type = other DNA
ttttccccttggaaggaggc

SEQ ID NO: 66282 - DNA, 20 bp, synthetic construct
  misc_feature 1..20: note = CRISPR gRNA sequence
  source 1..20: mol_type = other DNA
tccccttggaaggaggcaat

SEQ ID NO: 66283 - DNA, 20 bp, synthetic construct
  misc_feature 1..20: note = CRISPR gRNA sequence
  source 1..20: mol_type = other DNA
ccccttggaaggaggcaatg

SEQ ID NO: 66284 - DNA, 20 bp, synthetic construct
  misc_feature 1..20: note = CRISPR gRNA sequence
  source 1..20: mol_type = other DNA
cccttggaaggaggcaatgc

SEQ ID NO: 66285 - DNA, 20 bp, synthetic construct
  misc_feature 1..20: note = CRISPR gRNA sequence
  source 1..20: mol_type = other DNA
ggaaggaggcaatgcagatg

SEQ ID NO: 66286 - DNA, 20 bp, synthetic construct
  misc_feature 1..20: note = CRISPR gRNA sequence
  source 1..20: mol_type = other DNA
gaaggaggcaatgcagatgg

SEQ ID NO: 66287 - DNA, 20 bp, synthetic construct
  misc_feature 1..20: note = CRISPR gRNA sequence
  source 1..20: mol_type = other DNA
ggagaggtcccagagcaggg

SEQ ID NO: 66288 - DNA, 20 bp, synthetic construct
  misc_feature 1..20: note = CRISPR gRNA sequence
  source 1..20: mol_type = other DNA
ctgctgtgtgggaggagaca

SEQ ID NO: 66289 - DNA, 20 bp, synthetic construct
  misc_feature 1..20: note = CRISPR gRNA sequence
  source 1..20: mol_type = other DNA
ctgtgtgggaggagacagga

SEQ ID NO: 66290 - DNA, 20 bp, synthetic construct
  misc_feature 1..20: note = CRISPR gRNA sequence
  source 1..20: mol_type = other DNA
tgtgggaggagacaggagaa

SEQ ID NO: 66291 - DNA, 20 bp, synthetic construct
  misc_feature 1..20: note = CRISPR gRNA sequence
  source 1..20: mol_type = other DNA
gtgcttctgcgtttcgggga

SEQ ID NO: 66292 - DNA, 20 bp, synthetic construct
  misc_feature 1..20: note = CRISPR gRNA sequence
  source 1..20: mol_type = other DNA
tgcttctgcgtttcggggaa

SEQ ID NO: 66293 - DNA, 20 bp, synthetic construct
  misc_feature 1..20: note = CRISPR gRNA sequence
  source 1..20: mol_type = other DNA
ctgcgtttcggggaattttg

SEQ ID NO: 66294 - DNA, 20 bp, synthetic construct
  misc_feature 1..20: note = CRISPR gRNA sequence
  source 1..20: mol_type = other DNA
tgcgtttcggggaattttgt

SEQ ID NO: 66295 - DNA, 20 bp, synthetic construct
  misc_feature 1..20: note = CRISPR gRNA sequence
  source 1..20: mol_type = other DNA
cgtttcggggaattttgtag

SEQ ID NO: 66296 - DNA, 20 bp, synthetic construct
  misc_feature 1..20: note = CRISPR gRNA sequence
  source 1..20: mol_type = other DNA
cggggaattttgtagaccca

SEQ ID NO: 66297 - DNA, 20 bp, synthetic construct
  misc_feature 1..20: note = CRISPR gRNA sequence
  source 1..20: mol_type = other DNA
ggggaattttgtagacccac

SEQ ID NO: 66298 - DNA, 20 bp, synthetic construct
  misc_feature 1..20: note = CRISPR gRNA sequence
  source 1..20: mol_type = other DNA
tgtagacccaccgctccata

SEQ ID NO: 66299 - DNA, 20 bp, synthetic construct
  misc_feature 1..20: note = CRISPR gRNA sequence
  source 1..20: mol_type = other DNA
gtagacccaccgctccatac

SEQ ID NO: 66300 - DNA, 20 bp, synthetic construct
  misc_feature 1..20: note = CRISPR gRNA sequence
  source 1..20: mol_type = other DNA
tagacccaccgctccataca

SEQ ID NO: 66301 - DNA, 20 bp, synthetic construct
  misc_feature 1..20: note = CRISPR gRNA sequence
  source 1..20: mol_type = other DNA
catacatgtcactgcccttt

SEQ ID NO: 66302 - DNA, 20 bp, synthetic construct
  misc_feature 1..20: note = CRISPR gRNA sequence
  source 1..20: mol_type = other DNA
ccctttcacgctctgaaggc

SEQ ID NO: 66303 - DNA, 20 bp, synthetic construct
  misc_feature 1..20: note = CRISPR gRNA sequence
  source 1..20: mol_type = other DNA
tcacgctctgaaggcagggg

SEQ ID NO: 66304 - DNA, 20 bp, synthetic construct
  misc_feature 1..20: note = CRISPR gRNA sequence
  source 1..20: mol_type = other DNA
cacgctctgaaggcaggggc

SEQ ID NO: 66305 - DNA, 20 bp, synthetic construct
  misc_feature 1..20: note = CRISPR gRNA sequence
  source 1..20: mol_type = other DNA
acgctctgaaggcaggggcc

SEQ ID NO: 66306 - DNA, 20 bp, synthetic construct
  misc_feature 1..20: note = CRISPR gRNA sequence
  source 1..20: mol_type = other DNA
tgaaggcaggggccgtgggt

SEQ ID NO: 66307 - DNA, 20 bp, synthetic construct
  misc_feature 1..20: note = CRISPR gRNA sequence
  source 1..20: mol_type = other DNA
aaggcaggggccgtgggtgc

SEQ ID NO: 66308 - DNA, 20 bp, synthetic construct
  misc_feature 1..20: note = CRISPR gRNA sequence
  source 1..20: mol_type = other DNA
tgaaaaaacattttccccgt

SEQ ID NO: 66309 - DNA, 20 bp, synthetic construct
  misc_feature 1..20: note = CRISPR gRNA sequence
  source 1..20: mol_type = other DNA
aaaaaacattttccccgtct

SEQ ID NO: 66310 - DNA, 20 bp, synthetic construct
  misc_feature 1..20: note = CRISPR gRNA sequence
  source 1..20: mol_type = other DNA
tccccgtcttcgcagtaaac

SEQ ID NO: 66311 - DNA, 20 bp, synthetic construct
  misc_feature 1..20: note = CRISPR gRNA sequence
  source 1..20: mol_type = other DNA
ccccgtcttcgcagtaaaca

SEQ ID NO: 66312 - DNA, 20 bp, synthetic construct
  misc_feature 1..20: note = CRISPR gRNA sequence
  source 1..20: mol_type = other DNA
cccgtcttcgcagtaaacaa

SEQ ID NO: 66313 - DNA, 20 bp, synthetic construct
  misc_feature 1..20: note = CRISPR gRNA sequence
  source 1..20: mol_type = other DNA
cgcagtaaacaaccaatact

SEQ ID NO: 66314 - DNA, 20 bp, synthetic construct
  misc_feature 1..20: note = CRISPR gRNA sequence
  source 1..20: mol_type = other DNA
gcagtaaacaaccaatacta

SEQ ID NO: 66315 - DNA, 20 bp, synthetic construct
  misc_feature 1..20: note = CRISPR gRNA sequence
  source 1..20: mol_type = other DNA
gtttagctcttcatgatgtt

SEQ ID NO: 66316 - DNA, 20 bp, synthetic construct
  misc_feature 1..20: note = CRISPR gRNA sequence
  source 1..20: mol_type = other DNA
agctcttcatgatgttcccg

SEQ ID NO: 66317 - DNA, 20 bp, synthetic construct
  misc_feature 1..20: note = CRISPR gRNA sequence
  source 1..20: mol_type = other DNA
gctcttcatgatgttcccgg

SEQ ID NO: 66318 - DNA, 20 bp, synthetic construct
  misc_feature 1..20: note = CRISPR gRNA sequence
  source 1..20: mol_type = other DNA
ttcatgatgttcccggctgc

SEQ ID NO: 66319 - DNA, 20 bp, synthetic construct
  misc_feature 1..20: note = CRISPR gRNA sequence
  source 1..20: mol_type = other DNA
catgatgttcccggctgccc

SEQ ID NO: 66320 - DNA, 20 bp, synthetic construct
  misc_feature 1..20: note = CRISPR gRNA sequence
  source 1..20: mol_type = other DNA
atgatgttcccggctgccct

SEQ ID NO: 66321 - DNA, 20 bp, synthetic construct
  misc_feature 1..20: note = CRISPR gRNA sequence
  source 1..20: mol_type = other DNA
ccggctgccctctagtggga

SEQ ID NO: 66322 - DNA, 20 bp, synthetic construct
  misc_feature 1..20: note = CRISPR gRNA sequence
  source 1..20: mol_type = other DNA
ccctctagtgggaccaggcc

SEQ ID NO: 66323 - DNA, 20 bp, synthetic construct
  misc_feature 1..20: note = CRISPR gRNA sequence
  source 1..20: mol_type = other DNA
tagtgggaccaggcctcttg

SEQ ID NO: 66324 - DNA, 20 bp, synthetic construct
  misc_feature 1..20: note = CRISPR gRNA sequence
  source 1..20: mol_type = other DNA
gtgggaccaggcctcttggc

SEQ ID NO: 66325 - DNA, 20 bp, synthetic construct
  misc_feature 1..20: note = CRISPR gRNA sequence
  source 1..20: mol_type = other DNA
ttggcctcacttgggagcag

SEQ ID NO: 66326 - DNA, 20 bp, synthetic construct
  misc_feature 1..20: note = CRISPR gRNA sequence
  source 1..20: mol_type = other DNA
ggcctcacttgggagcagtg

SEQ ID NO: 66327 - DNA, 20 bp, synthetic construct
  misc_feature 1..20: note = CRISPR gRNA sequence
  source 1..20: mol_type = other DNA
gcctcacttgggagcagtgg

SEQ ID NO: 66328 - DNA, 20 bp, synthetic construct
  misc_feature 1..20: note = CRISPR gRNA sequence
  source 1..20: mol_type = other DNA
acttgggagcagtggcagcg

SEQ ID NO: 66329 - DNA, 20 bp, synthetic construct
  misc_feature 1..20: note = CRISPR gRNA sequence
  source 1..20: mol_type = other DNA
gggagcagtggcagcggaca

SEQ ID NO: 66330 - DNA, 20 bp, synthetic construct
  misc_feature 1..20: note = CRISPR gRNA sequence
  source 1..20: mol_type = other DNA
ggagcagtggcagcggacag

SEQ ID NO: 66331 - DNA, 20 bp, synthetic construct
  misc_feature 1..20: note = CRISPR gRNA sequence
  source 1..20: mol_type = other DNA
gctgggtggagagagtcaca

SEQ ID NO: 66332 - DNA, 20 bp, synthetic construct
  misc_feature 1..20: note = CRISPR gRNA sequence
  source 1..20: mol_type = other DNA
ggtggagagagtcacagcta

SEQ ID NO: 66333 - DNA, 20 bp, synthetic construct
  misc_feature 1..20: note = CRISPR gRNA sequence
  source 1..20: mol_type = other DNA
gtgtgtcaagaaaaggcact

SEQ ID NO: 66334 - DNA, 20 bp, synthetic construct
  misc_feature 1..20: note = CRISPR gRNA sequence
  source 1..20: mol_type = other DNA
ccgtacagatgggctgtcag

SEQ ID NO: 66335 - DNA, 20 bp, synthetic construct
  misc_feature 1..20: note = CRISPR gRNA sequence
  source 1..20: mol_type = other DNA
tcaggagtcaggggtggctc

SEQ ID NO: 66336 - DNA, 20 bp, synthetic construct
  misc_feature 1..20: note = CRISPR gRNA sequence
  source 1..20: mol_type = other DNA
aagcctgggtggtcttgctt

SEQ ID NO: 66337 - DNA, 20 bp, synthetic construct
  misc_feature 1..20: note = CRISPR gRNA sequence
  source 1..20: mol_type = other DNA
ggtggtcttgcttcccagga

SEQ ID NO: 66338 - DNA, 20 bp, synthetic construct
  misc_feature 1..20: note = CRISPR gRNA sequence
  source 1..20: mol_type = other DNA
gcttcccaggataggatctc

SEQ ID NO: 66339 - DNA, 20 bp, synthetic construct
  misc_feature 1..20: note = CRISPR gRNA sequence
  source 1..20: mol_type = other DNA
cttcccaggataggatctct

SEQ ID NO: 66340 - DNA, 20 bp, synthetic construct
  misc_feature 1..20: note = CRISPR gRNA sequence
  source 1..20: mol_type = other DNA
cccaggataggatctctgtt

SEQ ID NO: 66341 - DNA, 20 bp, synthetic construct
  misc_feature 1..20: note = CRISPR gRNA sequence
  source 1..20: mol_type = other DNA
ccaggataggatctctgttt

SEQ ID NO: 66342 - DNA, 20 bp, synthetic construct
  misc_feature 1..20: note = CRISPR gRNA sequence
  source 1..20: mol_type = other DNA
tgtttctggggaacccccgg

SEQ ID NO: 66343 - DNA, 20 bp, synthetic construct
  misc_feature 1..20: note = CRISPR gRNA sequence
  source 1..20: mol_type = other DNA
tttctggggaacccccgggt

SEQ ID NO: 66344 - DNA, 20 bp, synthetic construct
  misc_feature 1..20: note = CRISPR gRNA sequence
  source 1..20: mol_type = other DNA
ctggggaacccccgggttct

SEQ ID NO: 66345 - DNA, 20 bp, synthetic construct
  misc_feature 1..20: note = CRISPR gRNA sequence
  source 1..20: mol_type = other DNA
tggggaacccccgggttctt

SEQ ID NO: 66346 - DNA, 20 bp, synthetic construct
  misc_feature 1..20: note = CRISPR gRNA sequence
  source 1..20: mol_type = other DNA
gggaacccccgggttcttga

SEQ ID NO: 66347 - DNA, 20 bp, synthetic construct
  misc_feature 1..20: note = CRISPR gRNA sequence
  source 1..20: mol_type = other DNA
ttgaggcccaaagaactgac

SEQ ID NO: 66348 - DNA, 20 bp, synthetic construct
  misc_feature 1..20: note = CRISPR gRNA sequence
  source 1..20: mol_type = other DNA
gaggcccaaagaactgacgt

SEQ ID NO: 66349 - DNA, 20 bp, synthetic construct
  misc_feature 1..20: note = CRISPR gRNA sequence
  source 1..20: mol_type = other DNA
aggcccaaagaactgacgta

SEQ ID NO: 66350 - DNA, 20 bp, synthetic construct
  misc_feature 1..20: note = CRISPR gRNA sequence
  source 1..20: mol_type = other DNA
acgtacagggaggcagaagt

SEQ ID NO: 66351 - DNA, 20 bp, synthetic construct
  misc_feature 1..20: note = CRISPR gRNA sequence
  source 1..20: mol_type = other DNA
tgtcttgggtcctcctgcct

SEQ ID NO: 66352 - DNA, 20 bp, synthetic construct
  misc_feature 1..20: note = CRISPR gRNA sequence
  source 1..20: mol_type = other DNA
tcttgggtcctcctgcctgc

SEQ ID NO: 66353 - DNA, 20 bp, synthetic construct
  misc_feature 1..20: note = CRISPR gRNA sequence
  source 1..20: mol_type = other DNA
gggtcctcctgcctgctcac

SEQ ID NO: 66354 - DNA, 20 bp, synthetic construct
  misc_feature 1..20: note = CRISPR gRNA sequence
  source 1..20: mol_type = other DNA
ggtcctcctgcctgctcacc

SEQ ID NO: 66355 - DNA, 20 bp, synthetic construct
  misc_feature 1..20: note = CRISPR gRNA sequence
  source 1..20: mol_type = other DNA
ctgcctgctcacctggacag

SEQ ID NO: 66356 - DNA, 20 bp, synthetic construct
  misc_feature 1..20: note = CRISPR gRNA sequence
  source 1..20: mol_type = other DNA
cctgctcacctggacaggaa

SEQ ID NO: 66357 - DNA, 20 bp, synthetic construct
  misc_feature 1..20: note = CRISPR gRNA sequence
  source 1..20: mol_type = other DNA
ctcacctggacaggaacaag

SEQ ID NO: 66358 - DNA, 20 bp, synthetic construct
  misc_feature 1..20: note = CRISPR gRNA sequence
  source 1..20: mol_type = other DNA
acctggacaggaacaagctg

SEQ ID NO: 66359 - DNA, 20 bp, synthetic construct
  misc_feature 1..20: note = CRISPR gRNA sequence
  source 1..20: mol_type = other DNA
gacaggaacaagctgctggc

SEQ ID NO: 66360 - DNA, 20 bp, synthetic construct
  misc_feature 1..20: note = CRISPR gRNA sequence
  source 1..20: mol_type = other DNA
ctggcttttctaactcaggc

SEQ ID NO: 66361 - DNA, 20 bp, synthetic construct
  misc_feature 1..20: note = CRISPR gRNA sequence
  source 1..20: mol_type = other DNA
gcttttctaactcaggcttc

SEQ ID NO: 66362 - DNA, 20 bp, synthetic construct
  misc_feature 1..20: note = CRISPR gRNA sequence
  source 1..20: mol_type = other DNA
ttctaactcaggcttccctt

SEQ ID NO: 66363 - DNA, 20 bp, synthetic construct
  misc_feature 1..20: note = CRISPR gRNA sequence
  source 1..20: mol_type = other DNA
tctaactcaggcttcccttc

SEQ ID NO: 66364 - DNA, 20 bp, synthetic construct
  misc_feature 1..20: note = CRISPR gRNA sequence
  source 1..20: mol_type = other DNA
ctaactcaggcttcccttcc

SEQ ID NO: 66365 - DNA, 20 bp, synthetic construct
  misc_feature 1..20: note = CRISPR gRNA sequence
  source 1..20: mol_type = other DNA
taactcaggcttcccttccc

SEQ ID NO: 66366 - DNA, 20 bp, synthetic construct
  misc_feature 1..20: note = CRISPR gRNA sequence
  source 1..20: mol_type = other DNA
actcaggcttcccttccctg

SEQ ID NO: 66367 - DNA, 20 bp, synthetic construct
  misc_feature 1..20: note = CRISPR gRNA sequence
  source 1..20: mol_type = other DNA
aggcttcccttccctgagcc

SEQ ID NO: 66368 - DNA, 20 bp, synthetic construct
  misc_feature 1..20: note = CRISPR gRNA sequence
  source 1..20: mol_type = other DNA
cccttccctgagcctcagtt

SEQ ID NO: 66369 - DNA, 20 bp, synthetic construct
  misc_feature 1..20: note = CRISPR gRNA sequence
  source 1..20: mol_type = other DNA
ccttccctgagcctcagttt

SEQ ID NO: 66370 - DNA, 20 bp, synthetic construct
  misc_feature 1..20: note = CRISPR gRNA sequence
  source 1..20: mol_type = other DNA
ccctgagcctcagtttcccc

SEQ ID NO: 66371 - DNA, 20 bp, synthetic construct
  misc_feature 1..20: note = CRISPR gRNA sequence
  source 1..20: mol_type = other DNA
cctgagcctcagtttcccca

SEQ ID NO: 66372 - DNA, 20 bp, synthetic construct
  misc_feature 1..20: note = CRISPR gRNA sequence
  source 1..20: mol_type = other DNA
agcctcagtttccccatctg

SEQ ID NO: 66373 - DNA, 20 bp, synthetic construct
  misc_feature 1..20: note = CRISPR gRNA sequence
  source 1..20: mol_type = other DNA
agtttccccatctgaacaat

SEQ ID NO: 66374 - DNA, 20 bp, synthetic construct
  misc_feature 1..20: note = CRISPR gRNA sequence
  source 1..20: mol_type = other DNA
ccccatctgaacaatgaggg

SEQ ID NO: 66375 - DNA, 20 bp, synthetic construct
  misc_feature 1..20: note = CRISPR gRNA sequence
  source 1..20: mol_type = other DNA
cccatctgaacaatgaggga

SEQ ID NO: 66376 - DNA, 20 bp, synthetic construct
  misc_feature 1..20: note = CRISPR gRNA sequence
  source 1..20: mol_type = other DNA
aacaatgagggactgagcta

SEQ ID NO: 66377 - DNA, 20 bp, synthetic construct
  misc_feature 1..20: note = CRISPR gRNA sequence
  source 1..20: mol_type = other DNA
agctaggatctagtgactgc

SEQ ID NO: 66378 - DNA, 20 bp, synthetic construct
  misc_feature 1..20: note = CRISPR gRNA sequence
  source 1..20: mol_type = other DNA
ggatctagtgactgcattgt

SEQ ID NO: 66379 - DNA, 20 bp, synthetic construct
  misc_feature 1..20: note = CRISPR gRNA sequence
  source 1..20: mol_type = other DNA
gtgactgcattgtctctgag

SEQ ID NO: 66380 - DNA, 20 bp, synthetic construct
  misc_feature 1..20: note = CRISPR gRNA sequence
  source 1..20: mol_type = other DNA
cattgtctctgagatgcctt

SEQ ID NO: 66381 - DNA, 20 bp, synthetic construct
  misc_feature 1..20: note = CRISPR gRNA sequence
  source 1..20: mol_type = other DNA
tctctgagatgccttccagc

SEQ ID NO: 66382 - DNA, 20 bp, synthetic construct
  misc_feature 1..20: note = CRISPR gRNA sequence
  source 1..20: mol_type = other DNA
tgagatgccttccagccctg

SEQ ID NO: 66383 - DNA, 20 bp, synthetic construct
  misc_feature 1..20: note = CRISPR gRNA sequence
  source 1..20: mol_type = other DNA
agatgccttccagccctgac

SEQ ID NO: 66384 - DNA, 20 bp, synthetic construct
  misc_feature 1..20: note = CRISPR gRNA sequence
  source 1..20: mol_type = other DNA
ccagccctgactttccaagt

SEQ ID NO: 66385 - DNA, 20 bp, synthetic construct
  misc_feature 1..20: note = CRISPR gRNA sequence
  source 1..20: mol_type = other DNA
cagccctgactttccaagtc

SEQ ID NO: 66386 - DNA, 20 bp, synthetic construct
  misc_feature 1..20: note = CRISPR gRNA sequence
  source 1..20: mol_type = other DNA
actttccaagtctgggagtc

SEQ ID NO: 66387 - DNA, 20 bp, synthetic construct
  misc_feature 1..20: note = CRISPR gRNA sequence
  source 1..20: mol_type = other DNA
tccaagtctgggagtccaat

SEQ ID NO: 66388 - DNA, 20 bp, synthetic construct
  misc_feature 1..20: note = CRISPR gRNA sequence
  source 1..20: mol_type = other DNA
ccaagtctgggagtccaatg

SEQ ID NO: 66389 - DNA, 20 bp, synthetic construct
  misc_feature 1..20: note = CRISPR gRNA sequence
  source 1..20: mol_type = other DNA
caagtctgggagtccaatgt

SEQ ID NO: 66390 - DNA, 20 bp, synthetic construct
  misc_feature 1..20: note = CRISPR gRNA sequence
  source 1..20: mol_type = other DNA
ggagtccaatgtgggtgatc

SEQ ID NO: 66391 - DNA, 20 bp, synthetic construct
  misc_feature 1..20: note = CRISPR gRNA sequence
  source 1..20: mol_type = other DNA
aactttcctttctaaacgat

SEQ ID NO: 66392 - DNA, 20 bp, synthetic construct
  misc_feature 1..20: note = CRISPR gRNA sequence
  source 1..20: mol_type = other DNA
tcctttctaaacgatccccc

SEQ ID NO: 66393 - DNA, 20 bp, synthetic construct
  misc_feature 1..20: note = CRISPR gRNA sequence
  source 1..20: mol_type = other DNA
cctttctaaacgatccccct

SEQ ID NO: 66394 - DNA, 20 bp, synthetic construct
  misc_feature 1..20: note = CRISPR gRNA sequence
  source 1..20: mol_type = other DNA
ctttctaaacgatccccctc

SEQ ID NO: 66395 - DNA, 20 bp, synthetic construct
  misc_feature 1..20: note = CRISPR gRNA sequence
  source 1..20: mol_type = other DNA
tctaaacgatccccctccta

SEQ ID NO: 66396 - DNA, 20 bp, synthetic construct
  misc_feature 1..20: note = CRISPR gRNA sequence
  source 1..20: mol_type = other DNA
ctaaacgatccccctcctag

SEQ ID NO: 66397 - DNA, 20 bp, synthetic construct
  misc_feature 1..20: note = CRISPR gRNA sequence
  source 1..20: mol_type = other DNA
taaacgatccccctcctagg

SEQ ID NO: 66398 - DNA, 20 bp, synthetic construct
  misc_feature 1..20: note = CRISPR gRNA sequence
  source 1..20: mol_type = other DNA
aacgatccccctcctagggg

SEQ ID NO: 66399 - DNA, 20 bp, synthetic construct
  misc_feature 1..20: note = CRISPR gRNA sequence
  source 1..20: mol_type = other DNA
ctaggggtatatgggctggg

SEQ ID NO: 66400 - DNA, 20 bp, synthetic construct
  misc_feature 1..20: note = CRISPR gRNA sequence
  source 1..20: mol_type = other DNA
ggggtatatgggctgggctg

SEQ ID NO: 66401 - DNA, 20 bp, synthetic construct
  misc_feature 1..20: note = CRISPR gRNA sequence
  source 1..20: mol_type = other DNA
ggctgggagtccgagggggt

SEQ ID NO: 66402 - DNA, 20 bp, synthetic construct
  misc_feature 1..20: note = CRISPR gRNA sequence
  source 1..20: mol_type = other DNA
ggagtccgagggggtgatct

SEQ ID NO: 66403 - DNA, 20 bp, synthetic construct
  misc_feature 1..20: note = CRISPR gRNA sequence
  source 1..20: mol_type = other DNA
aactttcctttctaaatgat

SEQ ID NO: 66404 - DNA, 20 bp, synthetic construct
  misc_feature 1..20: note = CRISPR gRNA sequence
  source 1..20: mol_type = other DNA
tcctttctaaatgatccccc

SEQ ID NO: 66405 - DNA, 20 bp, synthetic construct
  misc_feature 1..20: note = CRISPR gRNA sequence
  source 1..20: mol_type = other DNA
cctttctaaatgatccccct

SEQ ID NO: 66406 - DNA, 20 bp, synthetic construct
  misc_feature 1..20: note = CRISPR gRNA sequence
  source 1..20: mol_type = other DNA
ctttctaaatgatccccctc

SEQ ID NO: 66407 - DNA, 20 bp, synthetic construct
  misc_feature 1..20: note = CRISPR gRNA sequence
  source 1..20: mol_type = other DNA
tctaaatgatccccctccta

SEQ ID NO: 66408 - DNA, 20 bp, synthetic construct
  misc_feature 1..20: note = CRISPR gRNA sequence
  source 1..20: mol_type = other DNA
ctaaatgatccccctcctag

SEQ ID NO: 66409 - DNA, 20 bp, synthetic construct
  misc_feature 1..20: note = CRISPR gRNA sequence
  source 1..20: mol_type = other DNA
taaatgatccccctcctagg

SEQ ID NO: 66410 - DNA, 20 bp, synthetic construct
  misc_feature 1..20: note = CRISPR gRNA sequence
  source 1..20: mol_type = other DNA
aatgatccccctcctaggga

SEQ ID NO: 66411 - DNA, 20 bp, synthetic construct
  misc_feature 1..20: note = CRISPR gRNA sequence
  source 1..20: mol_type = other DNA
ctagggatatgtgggccact

SEQ ID NO: 66412 - DNA, 20 bp, synthetic construct
  misc_feature 1..20: note = CRISPR gRNA sequence
  source 1..20: mol_type = other DNA
gggatatgtgggccactgga

SEQ ID NO: 66413 - DNA, 20 bp, synthetic construct
  misc_feature 1..20: note = CRISPR gRNA sequence
  source 1..20: mol_type = other DNA
gatctttgccagacttccca

SEQ ID NO: 66414 - DNA, 20 bp, synthetic construct
  misc_feature 1..20: note = CRISPR gRNA sequence
  source 1..20: mol_type = other DNA
tgccagacttcccagctgca

SEQ ID NO: 66415 - DNA, 20 bp, synthetic construct
  misc_feature 1..20: note = CRISPR gRNA sequence
  source 1..20: mol_type = other DNA
gccagacttcccagctgcag

SEQ ID NO: 66416 - DNA, 20 bp, synthetic construct
  misc_feature 1..20: note = CRISPR gRNA sequence
  source 1..20: mol_type = other DNA
ccagacttcccagctgcagc

SEQ ID NO: 66417 - DNA, 20 bp, synthetic construct
  misc_feature 1..20: note = CRISPR gRNA sequence
  source 1..20: mol_type = other DNA
cccagctgcagccaagttct

SEQ ID NO: 66418 - DNA, 20 bp, synthetic construct
  misc_feature 1..20: note = CRISPR gRNA sequence
  source 1..20: mol_type = other DNA
ccagctgcagccaagttctt

SEQ ID NO: 66419 - DNA, 20 bp, synthetic construct
  misc_feature 1..20: note = CRISPR gRNA sequence
  source 1..20: mol_type = other DNA
cagccaagttcttagggttc

SEQ ID NO: 66420 - DNA, 20 bp, synthetic construct
  misc_feature 1..20: note = CRISPR gRNA sequence
  source 1..20: mol_type = other DNA
ttagggttccgtcagcgctg

SEQ ID NO: 66421 - DNA, 20 bp, synthetic construct
  misc_feature 1..20: note = CRISPR gRNA sequence
  source 1..20: mol_type = other DNA
agggttccgtcagcgctgca

SEQ ID NO: 66422 - DNA, 20 bp, synthetic construct
  misc_feature 1..20: note = CRISPR gRNA sequence
  source 1..20: mol_type = other DNA
gggttccgtcagcgctgcat

SEQ ID NO: 66423 - DNA, 20 bp, synthetic construct
  misc_feature 1..20: note = CRISPR gRNA sequence
  source 1..20: mol_type = other DNA
cgtcagcgctgcatccccag

SEQ ID NO: 66424 - DNA, 20 bp, synthetic construct
  misc_feature 1..20: note = CRISPR gRNA sequence
  source 1..20: mol_type = other DNA
catccccaggagcctctggt

SEQ ID NO: 66425 - DNA, 20 bp, synthetic construct
  misc_feature 1..20: note = CRISPR gRNA sequence
  source 1..20: mol_type = other DNA
tggtactgtcccagcccttc

SEQ ID NO: 66426 - DNA, 20 bp, synthetic construct
  misc_feature 1..20: note = CRISPR gRNA sequence
  source 1..20: mol_type = other DNA
gtactgtcccagcccttctt

SEQ ID NO: 66427 - DNA, 20 bp, synthetic construct
  misc_feature 1..20: note = CRISPR gRNA sequence
  source 1..20: mol_type = other DNA
tcccagcccttcttgtttgg

SEQ ID NO: 66428 - DNA, 20 bp, synthetic construct
  misc_feature 1..20: note = CRISPR gRNA sequence
  source 1..20: mol_type = other DNA
cttgtttgggggtaaccata

SEQ ID NO: 66429 - DNA, 20 bp, synthetic construct
  misc_feature 1..20: note = CRISPR gRNA sequence
  source 1..20: mol_type = other DNA
ttgtttgggggtaaccataa

SEQ ID NO: 66430 - DNA, 20 bp, synthetic construct
  misc_feature 1..20: note = CRISPR gRNA sequence
  source 1..20: mol_type = other DNA
gtttgggggtaaccataata

SEQ ID NO: 66431 - DNA, 20 bp, synthetic construct
  misc_feature 1..20: note = CRISPR gRNA sequence
  source 1..20: mol_type = other DNA
tttgggggtaaccataatag

SEQ ID NO: 66432 - DNA, 20 bp, synthetic construct
  misc_feature 1..20: note = CRISPR gRNA sequence
  source 1..20: mol_type = other DNA
gggggtaaccataataggga

SEQ ID NO: 66433 - DNA, 20 bp, synthetic construct
  misc_feature 1..20: note = CRISPR gRNA sequence
  source 1..20: mol_type = other DNA
ggggtaaccataatagggat

SEQ ID NO: 66434 - DNA, 20 bp, synthetic construct
  misc_feature 1..20: note = CRISPR gRNA sequence
  source 1..20: mol_type = other DNA
gcagggggctagggctgggg

SEQ ID NO: 66435 - DNA, 20 bp, synthetic construct
  misc_feature 1..20: note = CRISPR gRNA sequence
  source 1..20: mol_type = other DNA
gggctggggattgggataga

SEQ ID NO: 66436 - DNA, 20 bp, synthetic construct
  misc_feature 1..20: note = CRISPR gRNA sequence
  source 1..20: mol_type = other DNA
gggattgggatagagggaag

SEQ ID NO: 66437 - DNA, 20 bp, synthetic construct
  misc_feature 1..20: note = CRISPR gRNA sequence
  source 1..20: mol_type = other DNA
ggatagagggaagagaggga

SEQ ID NO: 66438 - DNA, 20 bp, synthetic construct
  misc_feature 1..20: note = CRISPR gRNA sequence
  source 1..20: mol_type = other DNA
aagagaaaaggaaaagaaag

SEQ ID NO: 66439 - DNA, 20 bp, synthetic construct
  misc_feature 1..20: note = CRISPR gRNA sequence
  source 1..20: mol_type = other DNA
agagaaaaggaaaagaaaga

SEQ ID NO: 66440 - DNA, 20 bp, synthetic construct
  misc_feature 1..20: note = CRISPR gRNA sequence
  source 1..20: mol_type = other DNA
ggagttggggagctctggcc

SEQ ID NO: 66441 - DNA, 20 bp, synthetic construct
  misc_feature 1..20: note = CRISPR gRNA sequence
  source 1..20: mol_type = other DNA
gggagctctggcccctgacg

SEQ ID NO: 66442 - DNA, 20 bp, synthetic construct
  misc_feature 1..20: note = CRISPR gRNA sequence
  source 1..20: mol_type = other DNA
tggcccctgacgggcagctc

SEQ ID NO: 66443 - DNA, 20 bp, synthetic construct
  misc_feature 1..20: note = CRISPR gRNA sequence
  source 1..20: mol_type = other DNA
gcccctgacgggcagctcag

SEQ ID NO: 66444 - DNA, 20 bp, synthetic construct
  misc_feature 1..20: note = CRISPR gRNA sequence
  source 1..20: mol_type = other DNA
acgggcagctcagctggccc

SEQ ID NO: 66445 - DNA, 20 bp, synthetic construct
  misc_feature 1..20: note = CRISPR gRNA sequence
  source 1..20: mol_type = other DNA
agctggcccatgccccgcat

SEQ ID NO: 66446 - DNA, 20 bp, synthetic construct
  misc_feature 1..20: note = CRISPR gRNA sequence
  source 1..20: mol_type = other DNA
gcccatgccccgcattctcc

SEQ ID NO: 66447 - DNA, 20 bp, synthetic construct
  misc_feature 1..20: note = CRISPR gRNA sequence
  source 1..20: mol_type = other DNA
tccttggagagaagattcca

SEQ ID NO: 66448 - DNA, 20 bp, synthetic construct
  misc_feature 1..20: note = CRISPR gRNA sequence
  source 1..20: mol_type = other DNA
cttggagagaagattccaca

SEQ ID NO: 66449 - DNA, 20 bp, synthetic construct
  misc_feature 1..20: note = CRISPR gRNA sequence
  source 1..20: mol_type = other DNA
ggagagaagattccacattt

SEQ ID NO: 66450 - DNA, 20 bp, synthetic construct
  misc_feature 1..20: note = CRISPR gRNA sequence
  source 1..20: mol_type = other DNA
gagagaagattccacatttc

SEQ ID NO: 66451 - DNA, 20 bp, synthetic construct
  misc_feature 1..20: note = CRISPR gRNA sequence
  source 1..20: mol_type = other DNA
cacatttctgtgaagcaaac

SEQ ID NO: 66452 - DNA, 20 bp, synthetic construct
  misc_feature 1..20: note = CRISPR gRNA sequence
  source 1..20: mol_type = other DNA
ctgtgaagcaaacagagcag

SEQ ID NO: 66453 - DNA, 20 bp, synthetic construct
  misc_feature 1..20: note = CRISPR gRNA sequence
  source 1..20: mol_type = other DNA
tgtgaagcaaacagagcagc

SEQ ID NO: 66454 - DNA, 20 bp, synthetic construct
  misc_feature 1..20: note = CRISPR gRNA sequence
  source 1..20: mol_type = other DNA
tgaagcaaacagagcagctc

SEQ ID NO: 66455 - DNA, 20 bp, synthetic construct
  misc_feature 1..20: note = CRISPR gRNA sequence
  source 1..20: mol_type = other DNA
agccactccctgcctggggt

SEQ ID NO: 66456 - DNA, 20 bp, synthetic construct
  misc_feature 1..20: note = CRISPR gRNA sequence
  source 1..20: mol_type = other DNA
cctgcctggggtctccatct

SEQ ID NO: 66457 - DNA, 20 bp, synthetic construct
  misc_feature 1..20: note = CRISPR gRNA sequence
  source 1..20: mol_type = other DNA
cctggggtctccatctgctc

SEQ ID NO: 66458 - DNA, 20 bp, synthetic construct
  misc_feature 1..20: note = CRISPR gRNA sequence
  source 1..20: mol_type = other DNA
gggtctccatctgctctggg

SEQ ID NO: 66459 - DNA, 20 bp, synthetic construct
  misc_feature 1..20: note = CRISPR gRNA sequence
  source 1..20: mol_type = other DNA
catctgctctgggggacacc

SEQ ID NO: 66460 - DNA, 20 bp, synthetic construct
  misc_feature 1..20: note = CRISPR gRNA sequence
  source 1..20: mol_type = other DNA
ctctgggggacacccacttt

SEQ ID NO: 66461 - DNA, 20 bp, synthetic construct
  misc_feature 1..20: note = CRISPR gRNA sequence
  source 1..20: mol_type = other DNA
tgggggacacccactttcca

SEQ ID NO: 66462 - DNA, 20 bp, synthetic construct
  misc_feature 1..20: note = CRISPR gRNA sequence
  source 1..20: mol_type = other DNA
ggggacacccactttccaga

SEQ ID NO: 66463 - DNA, 20 bp, synthetic construct
  misc_feature 1..20: note = CRISPR gRNA sequence
  source 1..20: mol_type = other DNA
tccagaaagaaaggggttgg

SEQ ID NO: 66464 - DNA, 20 bp, synthetic construct
  misc_feature 1..20: note = CRISPR gRNA sequence
  source 1..20: mol_type = other DNA
ccagaaagaaaggggttggc

SEQ ID NO: 66465 - DNA, 20 bp, synthetic construct
  misc_feature 1..20: note = CRISPR gRNA sequence
  source 1..20: mol_type = other DNA
cagaaagaaaggggttggcc

SEQ ID NO: 66466 - DNA, 20 bp, synthetic construct
  misc_feature 1..20: note = CRISPR gRNA sequence
  source 1..20: mol_type = other DNA
gcctgtctccccactaatac

SEQ ID NO: 66467 - DNA, 20 bp, synthetic construct
  misc_feature 1..20: note = CRISPR gRNA sequence
  source 1..20: mol_type = other DNA
tctccccactaatacactcc

SEQ ID NO: 66468 - DNA, 20 bp, synthetic construct
  misc_feature 1..20: note = CRISPR gRNA sequence
  source 1..20: mol_type = other DNA
cccactaatacactccccat

SEQ ID NO: 66469 - DNA, 20 bp, synthetic construct
  misc_feature 1..20: note = CRISPR gRNA sequence
  source 1..20: mol_type = other DNA
atacactccccatctgcaag

SEQ ID NO: 66470 - DNA, 20 bp, synthetic construct
  misc_feature 1..20: note = CRISPR gRNA sequence
  source 1..20: mol_type = other DNA
cccatctgcaagctctgcca

SEQ ID NO: 66471 - DNA, 20 bp, synthetic construct
  misc_feature 1..20: note = CRISPR gRNA sequence
  source 1..20: mol_type = other DNA
caagctctgccatgagaggc

SEQ ID NO: 66472 - DNA, 20 bp, synthetic construct
  misc_feature 1..20: note = CRISPR gRNA sequence
  source 1..20: mol_type = other DNA
tgccatgagaggctgtgaga

SEQ ID NO: 66473 - DNA, 20 bp, synthetic construct
  misc_feature 1..20: note = CRISPR gRNA sequence
  source 1..20: mol_type = other DNA
ccatgagaggctgtgagacc

SEQ ID NO: 66474 - DNA, 20 bp, synthetic construct
  misc_feature 1..20: note = CRISPR gRNA sequence
  source 1..20: mol_type = other DNA
tgagaccctgacttggcccc

SEQ ID NO: 66475 - DNA, 20 bp, synthetic construct
  misc_feature 1..20: note = CRISPR gRNA sequence
  source 1..20: mol_type = other DNA
acttggccccacctctctct

SEQ ID NO: 66476 - DNA, 20 bp, synthetic construct
  misc_feature 1..20: note = CRISPR gRNA sequence
  source 1..20: mol_type = other DNA
ggccccacctctctctaggc

SEQ ID NO: 66477 - DNA, 20 bp, synthetic construct
  misc_feature 1..20: note = CRISPR gRNA sequence
  source 1..20: mol_type = other DNA
gccccacctctctctaggcc

SEQ ID NO: 66478 - DNA, 20 bp, synthetic construct
  misc_feature 1..20: note = CRISPR gRNA sequence
  source 1..20: mol_type = other DNA
tctctaggcctccagggaag

SEQ ID NO: 66479 - DNA, 20 bp, synthetic construct
  misc_feature 1..20: note = CRISPR gRNA sequence
  source 1..20: mol_type = other DNA
tctaggcctccagggaagtg

SEQ ID NO: 66480 - DNA, 20 bp, synthetic construct
  misc_feature 1..20: note = CRISPR gRNA sequence
  source 1..20: mol_type = other DNA
taggcctccagggaagtgga

SEQ ID NO: 66481 - DNA, 20 bp, synthetic construct
  misc_feature 1..20: note = CRISPR gRNA sequence
  source 1..20: mol_type = other DNA
ggcctccagggaagtggagg

SEQ ID NO: 66482 - DNA, 20 bp, synthetic construct
  misc_feature 1..20: note = CRISPR gRNA sequence
  source 1..20: mol_type = other DNA
cagggaagtggaggcaagtg

SEQ ID NO: 66483 - DNA, 20 bp, synthetic construct
  misc_feature 1..20: note = CRISPR gRNA sequence
  source 1..20: mol_type = other DNA
ggaaggacatttcaatttca

SEQ ID NO: 66484 - DNA, 20 bp, synthetic construct
  misc_feature 1..20: note = CRISPR gRNA sequence
  source 1..20: mol_type = other DNA
caatttcactgttagcccca

SEQ ID NO: 66485 - DNA, 20 bp, synthetic construct
  misc_feature 1..20: note = CRISPR gRNA sequence
  source 1..20: mol_type = other DNA
aatttcactgttagccccag

SEQ ID NO: 66486 - DNA, 20 bp, synthetic construct
  misc_feature 1..20: note = CRISPR gRNA sequence
  source 1..20: mol_type = other DNA
cactgttagccccagggcaa

SEQ ID NO: 66487 - DNA, 20 bp, synthetic construct
  misc_feature 1..20: note = CRISPR gRNA sequence
  source 1..20: mol_type = other DNA
actgttagccccagggcaat

SEQ ID NO: 66488 - DNA, 20 bp, synthetic construct
  misc_feature 1..20: note = CRISPR gRNA sequence
  source 1..20: mol_type = other DNA
ttagccccagggcaatgggg

SEQ ID NO: 66489 - DNA, 20 bp, synthetic construct
  misc_feature 1..20: note = CRISPR gRNA sequence
  source 1..20: mol_type = other DNA
gccccagggcaatggggagc

SEQ ID NO: 66490 - DNA, 20 bp, synthetic construct
  misc_feature 1..20: note = CRISPR gRNA sequence
  source 1..20: mol_type = other DNA
gtcagatgtgcagtgttaaa

SEQ ID NO: 66491 - DNA, 20 bp, synthetic construct
  misc_feature 1..20: note = CRISPR gRNA sequence
  source 1..20: mol_type = other DNA
aaatgtgagacacttgtggg

SEQ ID NO: 66492 - DNA, 20 bp, synthetic construct
  misc_feature 1..20: note = CRISPR gRNA sequence
  source 1..20: mol_type = other DNA
gtggggcagagagggattaa

SEQ ID NO: 66493 - DNA, 20 bp, synthetic construct
  misc_feature 1..20: note = CRISPR gRNA sequence
  source 1..20: mol_type = other DNA
tggggcagagagggattaaa

SEQ ID NO: 66494 - DNA, 20 bp, synthetic construct
  misc_feature 1..20: note = CRISPR gRNA sequence
  source 1..20: mol_type = other DNA
aagggaggcaagagtggaag

SEQ ID NO: 66495 - DNA, 20 bp, synthetic construct
  misc_feature 1..20: note = CRISPR gRNA sequence
  source 1..20: mol_type = other DNA
aatggtcaaggtgagtgagg

SEQ ID NO: 66496 - DNA, 20 bp, synthetic construct
  misc_feature 1..20: note = CRISPR gRNA sequence
  source 1..20: mol_type = other DNA
ggctctggagggggcggtgg

SEQ ID NO: 66497 - DNA, 20 bp, synthetic construct
  misc_feature 1..20: note = CRISPR gRNA sequence
  source 1..20: mol_type = other DNA
tggagggggcggtggggagg

SEQ ID NO: 66498 - DNA, 20 bp, synthetic construct
  misc_feature 1..20: note = CRISPR gRNA sequence
  source 1..20: mol_type = other DNA
gagggggcggtggggaggac

SEQ ID NO: 66499 - DNA, 20 bp, synthetic construct
  misc_feature 1..20: note = CRISPR gRNA sequence
  source 1..20: mol_type = other DNA
ggagagtcactgacaagggc

SEQ ID NO: 66500 - DNA, 20 bp, synthetic construct
  misc_feature 1..20: note = CRISPR gRNA sequence
  source 1..20: mol_type = other DNA
gagagtcactgacaagggca

SEQ ID NO: 66501 - DNA, 20 bp, synthetic construct
  misc_feature 1..20: note = CRISPR gRNA sequence
  source 1..20: mol_type = other DNA
acaagggcagctgggaactc

SEQ ID NO: 66502 - DNA, 20 bp, synthetic construct
  misc_feature 1..20: note = CRISPR gRNA sequence
  source 1..20: mol_type = other DNA
ggaactcagggtcctgcact

SEQ ID NO: 66503 - DNA, 20 bp, synthetic construct
  misc_feature 1..20: note = CRISPR gRNA sequence
  source 1..20: mol_type = other DNA
agggtcctgcactgtcactg

SEQ ID NO: 66504 - DNA, 20 bp, synthetic construct
  misc_feature 1..20: note = CRISPR gRNA sequence
  source 1..20: mol_type = other DNA
cactgtcactgtcagggcag

SEQ ID NO: 66505 - DNA, 20 bp, synthetic construct
  misc_feature 1..20: note = CRISPR gRNA sequence
  source 1..20: mol_type = other DNA
tcactgtcagggcaggagga

SEQ ID NO: 66506 - DNA, 20 bp, synthetic construct
  misc_feature 1..20: note = CRISPR gRNA sequence
  source 1..20: mol_type = other DNA
tcagggcaggaggattgggg

SEQ ID NO: 66507 - DNA, 20 bp, synthetic construct
  misc_feature 1..20: note = CRISPR gRNA sequence
  source 1..20: mol_type = other DNA
ggggctgcaggggagactcg

SEQ ID NO: 66508 - DNA, 20 bp, synthetic construct
  misc_feature 1..20: note = CRISPR gRNA sequence
  source 1..20: mol_type = other DNA
caggggagactcgagaggga

SEQ ID NO: 66509 - DNA, 20 bp, synthetic construct
  misc_feature 1..20: note = CRISPR gRNA sequence
  source 1..20: mol_type = other DNA
gagagggaagcgagtgcccc

SEQ ID NO: 66510 - DNA, 20 bp, synthetic construct
  misc_feature 1..20: note = CRISPR gRNA sequence
  source 1..20: mol_type = other DNA
tggcctcccacttagagtga

SEQ ID NO: 66511 - DNA, 20 bp, synthetic construct
  misc_feature 1..20: note = CRISPR gRNA sequence
  source 1..20: mol_type = other DNA
ccacttagagtgagggatgc

SEQ ID NO: 66512 - DNA, 20 bp, synthetic construct
  misc_feature 1..20: note = CRISPR gRNA sequence
  source 1..20: mol_type = other DNA
agagtgagggatgctgggag

SEQ ID NO: 66513 - DNA, 20 bp, synthetic construct
  misc_feature 1..20: note = CRISPR gRNA sequence
  source 1..20: mol_type = other DNA
gagtgagggatgctgggaga

SEQ ID NO: 66514 - DNA, 20 bp, synthetic construct
  misc_feature 1..20: note = CRISPR gRNA sequence
  source 1..20: mol_type = other DNA
ggagaaggatagagcccctg

SEQ ID NO: 66515 - DNA, 20 bp, synthetic construct
  misc_feature 1..20: note = CRISPR gRNA sequence
  source 1..20: mol_type = other DNA
gggctagccagggaccctgg

SEQ ID NO: 66516 - DNA, 20 bp, synthetic construct
  misc_feature 1..20: note = CRISPR gRNA sequence
  source 1..20: mol_type = other DNA
gccagggaccctgggctttc

SEQ ID NO: 66517 - DNA, 20 bp, synthetic construct
  misc_feature 1..20: note = CRISPR gRNA sequence
  source 1..20: mol_type = other DNA
ggctttctctgattccctgc

SEQ ID NO: 66518 - DNA, 20 bp, synthetic construct
  misc_feature 1..20: note = CRISPR gRNA sequence
  source 1..20: mol_type = other DNA
tctctgattccctgccctgc

SEQ ID NO: 66519 - DNA, 20 bp, synthetic construct
  misc_feature 1..20: note = CRISPR gRNA sequence
  source 1..20: mol_type = other DNA
ctctgattccctgccctgcc

SEQ ID NO: 66520 - DNA, 20 bp, synthetic construct
  misc_feature 1..20: note = CRISPR gRNA sequence
  source 1..20: mol_type = other DNA
tctgattccctgccctgccc

SEQ ID NO: 66521 - DNA, 20 bp, synthetic construct
  misc_feature 1..20: note = CRISPR gRNA sequence
  source 1..20: mol_type = other DNA
tgattccctgccctgcccat

SEQ ID NO: 66522 - DNA, 20 bp, synthetic construct
  misc_feature 1..20: note = CRISPR gRNA sequence
  source 1..20: mol_type = other DNA
attccctgccctgcccattg

SEQ ID NO: 66523 - DNA, 20 bp, synthetic construct
  misc_feature 1..20: note = CRISPR gRNA sequence
  source 1..20: mol_type = other DNA
cctgccctgcccattgcccc

SEQ ID NO: 66524 - DNA, 20 bp, synthetic construct
  misc_feature 1..20: note = CRISPR gRNA sequence
  source 1..20: mol_type = other DNA
ccctgcccattgcccctttg

SEQ ID NO: 66525 - DNA, 20 bp, synthetic construct
  misc_feature 1..20: note = CRISPR gRNA sequence
  source 1..20: mol_type = other DNA
cccattgcccctttgcagcc

SEQ ID NO: 66526 - DNA, 20 bp, synthetic construct
  misc_feature 1..20: note = CRISPR gRNA sequence
  source 1..20: mol_type = other DNA
cccctttgcagcctcagtga

SEQ ID NO: 66527 - DNA, 20 bp, synthetic construct
  misc_feature 1..20: note = CRISPR gRNA sequence
  source 1..20: mol_type = other DNA
tgcagcctcagtgagtgtcc

SEQ ID NO: 66528 - DNA, 20 bp, synthetic construct
  misc_feature 1..20: note = CRISPR gRNA sequence
  source 1..20: mol_type = other DNA
gcagcctcagtgagtgtcct

SEQ ID NO: 66529 - DNA, 20 bp, synthetic construct
  misc_feature 1..20: note = CRISPR gRNA sequence
  source 1..20: mol_type = other DNA
cagcctcagtgagtgtcctc

SEQ ID NO: 66530 - DNA, 20 bp, synthetic construct
  misc_feature 1..20: note = CRISPR gRNA sequence
  source 1..20: mol_type = other DNA
agtgagtgtcctctggagcc

SEQ ID NO: 66531 - DNA, 20 bp, synthetic construct
  misc_feature 1..20: note = CRISPR gRNA sequence
  source 1..20: mol_type = other DNA
tggagcccccaagcctcacc

SEQ ID NO: 66532 - DNA, 20 bp, synthetic construct
  misc_feature 1..20: note = CRISPR gRNA sequence
  source 1..20: mol_type = other DNA
gagcccccaagcctcacccg

SEQ ID NO: 66533 - DNA, 20 bp, synthetic construct
  misc_feature 1..20: note = CRISPR gRNA sequence
  source 1..20: mol_type = other DNA
acccgcctctgtgccactct

SEQ ID NO: 66534 - DNA, 20 bp, synthetic construct
  misc_feature 1..20: note = CRISPR gRNA sequence
  source 1..20: mol_type = other DNA
tgtgccactctgaaggactg

SEQ ID NO: 66535 - DNA, 20 bp, synthetic construct
  misc_feature 1..20: note = CRISPR gRNA sequence
  source 1..20: mol_type = other DNA
tgccactctgaaggactgcc

SEQ ID NO: 66536 - DNA, 20 bp, synthetic construct
  misc_feature 1..20: note = CRISPR gRNA sequence
  source 1..20: mol_type = other DNA
tgaaggactgcccgggaccc

SEQ ID NO: 66537 - DNA, 20 bp, synthetic construct
  misc_feature 1..20: note = CRISPR gRNA sequence
  source 1..20: mol_type = other DNA
aaggactgcccgggacccct

SEQ ID NO: 66538 - DNA, 20 bp, synthetic construct
  misc_feature 1..20: note = CRISPR gRNA sequence
  source 1..20: mol_type = other DNA
cccgggacccctggaactgc

SEQ ID NO: 66539 - DNA, 20 bp, synthetic construct
  misc_feature 1..20: note = CRISPR gRNA sequence
  source 1..20: mol_type = other DNA
gaactgcagtaagtaacgag

SEQ ID NO: 66540 - DNA, 20 bp, synthetic construct
  misc_feature 1..20: note = CRISPR gRNA sequence
  source 1..20: mol_type = other DNA
cagtaagtaacgaggacaca

SEQ ID NO: 66541 - DNA, 20 bp, synthetic construct
  misc_feature 1..20: note = CRISPR gRNA sequence
  source 1..20: mol_type = other DNA
cccagtgacctgggaggggg

SEQ ID NO: 66542 - DNA, 20 bp, synthetic construct
  misc_feature 1..20: note = CRISPR gRNA sequence
  source 1..20: mol_type = other DNA
ggagggggcttcttggttag

SEQ ID NO: 66543 - DNA, 20 bp, synthetic construct
  misc_feature 1..20: note = CRISPR gRNA sequence
  source 1..20: mol_type = other DNA
cttggttagaagacaggtga

SEQ ID NO: 66544 - DNA, 20 bp, synthetic construct
  misc_feature 1..20: note = CRISPR gRNA sequence
  source 1..20: mol_type = other DNA
ttggttagaagacaggtgag

SEQ ID NO: 66545 - DNA, 20 bp, synthetic construct
  misc_feature 1..20: note = CRISPR gRNA sequence
  source 1..20: mol_type = other DNA
ggttagaagacaggtgagtc

SEQ ID NO: 66546 - DNA, 20 bp, synthetic construct
  misc_feature 1..20: note = CRISPR gRNA sequence
  source 1..20: mol_type = other DNA
gttagaagacaggtgagtct

SEQ ID NO: 66547 - DNA, 20 bp, synthetic construct
  misc_feature 1..20: note = CRISPR gRNA sequence
  source 1..20: mol_type = other DNA
gaagacaggtgagtctttct

SEQ ID NO: 66548 - DNA, 20 bp, synthetic construct
  misc_feature 1..20: note = CRISPR gRNA sequence
  source 1..20: mol_type = other DNA
tctcgatttcttcccaccag

SEQ ID NO: 66549 - DNA, 20 bp, synthetic construct
  misc_feature 1..20: note = CRISPR gRNA sequence
  source 1..20: mol_type = other DNA
ctcgatttcttcccaccagc

SEQ ID NO: 66550 - DNA, 20 bp, synthetic construct
  misc_feature 1..20: note = CRISPR gRNA sequence
  source 1..20: mol_type = other DNA
tcgatttcttcccaccagcc

SEQ ID NO: 66551 - DNA, 20 bp, synthetic construct
  misc_feature 1..20: note = CRISPR gRNA sequence
  source 1..20: mol_type = other DNA
gatttcttcccaccagccct

SEQ ID NO: 66552 - DNA, 20 bp, synthetic construct
  misc_feature 1..20: note = CRISPR gRNA sequence
  source 1..20: mol_type = other DNA
cttcccaccagccctgcccc

SEQ ID NO: 66553 - DNA, 20 bp, synthetic construct
  misc_feature 1..20: note = CRISPR gRNA sequence
  source 1..20: mol_type = other DNA
ttcccaccagccctgcccca

SEQ ID NO: 66554 - DNA, 20 bp, synthetic construct
  misc_feature 1..20: note = CRISPR gRNA sequence
  source 1..20: mol_type = other DNA
cccaccagccctgccccatg

SEQ ID NO: 66555 - DNA, 20 bp, synthetic construct
  misc_feature 1..20: note = CRISPR gRNA sequence
  source 1..20: mol_type = other DNA
ccaccagccctgccccatga

SEQ ID NO: 66556 - DNA, 20 bp, synthetic construct
  misc_feature 1..20: note = CRISPR gRNA sequence
  source 1..20: mol_type = other DNA
ccccatgagagtcccctggc

SEQ ID NO: 66557 - DNA, 20 bp, synthetic construct
  misc_feature 1..20: note = CRISPR gRNA sequence
  source 1..20: mol_type = other DNA
gcctttggtagaaacttggc

SEQ ID NO: 66558 - DNA, 20 bp, synthetic construct
  misc_feature 1..20: note = CRISPR gRNA sequence
  source 1..20: mol_type = other DNA
tggtagaaacttggctgtct

SEQ ID NO: 66559 - DNA, 20 bp, synthetic construct
  misc_feature 1..20: note = CRISPR gRNA sequence
  source 1..20: mol_type = other DNA
ggtagaaacttggctgtctc

SEQ ID NO: 66560 - DNA, 20 bp, synthetic construct
  misc_feature 1..20: note = CRISPR gRNA sequence
  source 1..20: mol_type = other DNA
gtagaaacttggctgtctct

SEQ ID NO: 66561 - DNA, 20 bp, synthetic construct
  misc_feature 1..20: note = CRISPR gRNA sequence
  source 1..20: mol_type = other DNA
ggctgtctctcggcagcccc

SEQ ID NO: 66562 - DNA, 20 bp, synthetic construct
  misc_feature 1..20: note = CRISPR gRNA sequence
  source 1..20: mol_type = other DNA
gctgtctctcggcagccccc

SEQ ID NO: 66563 - DNA, 20 bp, synthetic construct
  misc_feature 1..20: note = CRISPR gRNA sequence
  source 1..20: mol_type = other DNA
tctctcggcagcccccagcc

SEQ ID NO: 66564 - DNA, 20 bp, synthetic construct
  misc_feature 1..20: note = CRISPR gRNA sequence
  source 1..20: mol_type = other DNA
tcggcagcccccagccttag

SEQ ID NO: 66565 - DNA, 20 bp, synthetic construct
  misc_feature 1..20: note = CRISPR gRNA sequence
  source 1..20: mol_type = other DNA
ggcagcccccagccttaggc

SEQ ID NO: 66566 - DNA, 20 bp, synthetic construct
  misc_feature 1..20: note = CRISPR gRNA sequence
  source 1..20: mol_type = other DNA
aggcagcgcatgtctcccac

SEQ ID NO: 66567 - DNA, 20 bp, synthetic construct
  misc_feature 1..20: note = CRISPR gRNA sequence
  source 1..20: mol_type = other DNA
ggcagcgcatgtctcccact

SEQ ID NO: 66568 - DNA, 20 bp, synthetic construct
  misc_feature 1..20: note = CRISPR gRNA sequence
  source 1..20: mol_type = other DNA
ccactgggagatgctgtgct

SEQ ID NO: 66569 - DNA, 20 bp, synthetic construct
  misc_feature 1..20: note = CRISPR gRNA sequence
  source 1..20: mol_type = other DNA
ggagatgctgtgctggactg

SEQ ID NO: 66570 - DNA, 20 bp, synthetic construct
  misc_feature 1..20: note = CRISPR gRNA sequence
  source 1..20: mol_type = other DNA
tgctggactggggaagcctt

SEQ ID NO: 66571 - DNA, 20 bp, synthetic construct
  misc_feature 1..20: note = CRISPR gRNA sequence
  source 1..20: mol_type = other DNA
gactggggaagccttcacct

SEQ ID NO: 66572 - DNA, 20 bp, synthetic construct
  misc_feature 1..20: note = CRISPR gRNA sequence
  source 1..20: mol_type = other DNA
gggaagccttcacctgcacc

SEQ ID NO: 66573 - DNA, 20 bp, synthetic construct
  misc_feature 1..20: note = CRISPR gRNA sequence
  source 1..20: mol_type = other DNA
cacctgcaccatccactcaa

SEQ ID NO: 66574 - DNA, 20 bp, synthetic construct
  misc_feature 1..20: note = CRISPR gRNA sequence
  source 1..20: mol_type = other DNA
acctgcaccatccactcaac

SEQ ID NO: 66575 - DNA, 20 bp, synthetic construct
  misc_feature 1..20: note = CRISPR gRNA sequence
  source 1..20: mol_type = other DNA
caccatccactcaactcagg

SEQ ID NO: 66576 - DNA, 20 bp, synthetic construct
  misc_feature 1..20: note = CRISPR gRNA sequence
  source 1..20: mol_type = other DNA
aactcagggcacctgggagc

SEQ ID NO: 66577 - DNA, 20 bp, synthetic construct
  misc_feature 1..20: note = CRISPR gRNA sequence
  source 1..20: mol_type = other DNA
agggcacctgggagccctgt

SEQ ID NO: 66578 - DNA, 20 bp, synthetic construct
  misc_feature 1..20: note = CRISPR gRNA sequence
  source 1..20: mol_type = other DNA
ggagccctgtccacctccaa

SEQ ID NO: 66579 - DNA, 20 bp, synthetic construct
  misc_feature 1..20: note = CRISPR gRNA sequence
  source 1..20: mol_type = other DNA
tccacctccaaccccacccc

SEQ ID NO: 66580 - DNA, 20 bp, synthetic construct
  misc_feature 1..20: note = CRISPR gRNA sequence
  source 1..20: mol_type = other DNA
caaccccacccctggagcct

SEQ ID NO: 66581 - DNA, 20 bp, synthetic construct
  misc_feature 1..20: note = CRISPR gRNA sequence
  source 1..20: mol_type = other DNA
gagcctcaccagggcaccca

SEQ ID NO: 66582 - DNA, 20 bp, synthetic construct
  misc_feature 1..20: note = CRISPR gRNA sequence
  source 1..20: mol_type = other DNA
accagggcacccacttgaac

SEQ ID NO: 66583 - DNA, 20 bp, synthetic construct
  misc_feature 1..20: note = CRISPR gRNA sequence
  source 1..20: mol_type = other DNA
gaacctgcctgcatggctgg

SEQ ID NO: 66584 - DNA, 20 bp, synthetic construct
  misc_feature 1..20: note = CRISPR gRNA sequence
  source 1..20: mol_type = other DNA
aacctgcctgcatggctgga

SEQ ID NO: 66585 - DNA, 20 bp, synthetic construct
  misc_feature 1..20: note = CRISPR gRNA sequence
  source 1..20: mol_type = other DNA
cctgcatggctggagcgtag

SEQ ID NO: 66586 - DNA, 20 bp, synthetic construct
  misc_feature 1..20: note = CRISPR gRNA sequence
  source 1..20: mol_type = other DNA
catggctggagcgtagcact

SEQ ID NO: 66587 - DNA, 20 bp, synthetic construct
  misc_feature 1..20: note = CRISPR gRNA sequence
  source 1..20: mol_type = other DNA
gagcgtagcacttctgaaag

SEQ ID NO: 66588 - DNA, 20 bp, synthetic construct
  misc_feature 1..20: note = CRISPR gRNA sequence
  source 1..20: mol_type = other DNA
ctgaaagcccttcctcaagg

SEQ ID NO: 66589 - DNA, 20 bp, synthetic construct
  misc_feature 1..20: note = CRISPR gRNA sequence
  source 1..20: mol_type = other DNA
tgaaagcccttcctcaaggc

SEQ ID NO: 66590 - DNA, 20 bp, synthetic construct
  misc_feature 1..20: note = CRISPR gRNA sequence
  source 1..20: mol_type = other DNA
aaagcccttcctcaaggcac

SEQ ID NO: 66591 - DNA, 20 bp, synthetic construct
  misc_feature 1..20: note = CRISPR gRNA sequence
  source 1..20: mol_type = other DNA
cctcaaggcacccccactct

SEQ ID NO: 66592 - DNA, 20 bp, synthetic construct
  misc_feature 1..20: note = CRISPR gRNA sequence
  source 1..20: mol_type = other DNA
ctcaaggcacccccactctc

SEQ ID NO: 66593 - DNA, 20 bp, synthetic construct
  misc_feature 1..20: note = CRISPR gRNA sequence
  source 1..20: mol_type = other DNA
aaggcacccccactctcctt

SEQ ID NO: 66594 - DNA, 20 bp, synthetic construct
  misc_feature 1..20: note = CRISPR gRNA sequence
  source 1..20: mol_type = other DNA
tccttggggttaccacctca

SEQ ID NO: 66595 - DNA, 20 bp, synthetic construct
  misc_feature 1..20: note = CRISPR gRNA sequence
  source 1..20: mol_type = other DNA
cttggggttaccacctcact

SEQ ID NO: 66596 - DNA, 20 bp, synthetic construct
  misc_feature 1..20: note = CRISPR gRNA sequence
  source 1..20: mol_type = other DNA
ggggttaccacctcactcgc

SEQ ID NO: 66597 - DNA, 20 bp, synthetic construct
  misc_feature 1..20: note = CRISPR gRNA sequence
  source 1..20: mol_type = other DNA
gggttaccacctcactcgcc

SEQ ID NO: 66598 - DNA, 20 bp, synthetic construct
  misc_feature 1..20: note = CRISPR gRNA sequence
  source 1..20: mol_type = other DNA
ccacctcactcgccccagaa

SEQ ID NO: 66599 - DNA, 20 bp, synthetic construct
  misc_feature 1..20: note = CRISPR gRNA sequence
  source 1..20: mol_type = other DNA
actcgccccagaacatctgg

SEQ ID NO: 66600 - DNA, 20 bp, synthetic construct
  misc_feature 1..20: note = CRISPR gRNA sequence
  source 1..20: mol_type = other DNA
gccccagaacatctgggtct

SEQ ID NO: 66601 - DNA, 20 bp, synthetic construct
  misc_feature 1..20: note = CRISPR gRNA sequence
  source 1..20: mol_type = other DNA
ggtctgtaaccagagactgg

SEQ ID NO: 66602 - DNA, 20 bp, synthetic construct
  misc_feature 1..20: note = CRISPR gRNA sequence
  source 1..20: mol_type = other DNA
taaccagagactggacctgg

SEQ ID NO: 66603 - DNA, 20 bp, synthetic construct
  misc_feature 1..20: note = CRISPR gRNA sequence
  source 1..20: mol_type = other DNA
gacctggaatcaggactctt

SEQ ID NO: 66604 - DNA, 20 bp, synthetic construct
  misc_feature 1..20: note = CRISPR gRNA sequence
  source 1..20: mol_type = other DNA
gaatcaggactcttggctca

SEQ ID NO: 66605 - DNA, 20 bp, synthetic construct
  misc_feature 1..20: note = CRISPR gRNA sequence
  source 1..20: mol_type = other DNA
ttggctcaaaagggatttaa

SEQ ID NO: 66606 - DNA, 20 bp, synthetic construct
  misc_feature 1..20: note = CRISPR gRNA sequence
  source 1..20: mol_type = other DNA
ggctcaaaagggatttaact

SEQ ID NO: 66607 - DNA, 20 bp, synthetic construct
  misc_feature 1..20: note = CRISPR gRNA sequence
  source 1..20: mol_type = other DNA
gctcaaaagggatttaactc

SEQ ID NO: 66608 - DNA, 20 bp, synthetic construct
  misc_feature 1..20: note = CRISPR gRNA sequence
  source 1..20: mol_type = other DNA
aaaagggatttaactccccg

SEQ ID NO: 66609 - DNA, 20 bp, synthetic construct
  misc_feature 1..20: note = CRISPR gRNA sequence
  source 1..20: mol_type = other DNA
aactccccgggcctcagctt

SEQ ID NO: 66610 - DNA, 20 bp, synthetic construct
  misc_feature 1..20: note = CRISPR gRNA sequence
  source 1..20: mol_type = other DNA
actccccgggcctcagcttc

SEQ ID NO: 66611 - DNA, 20 bp, synthetic construct
  misc_feature 1..20: note = CRISPR gRNA sequence
  source 1..20: mol_type = other DNA
cccgggcctcagcttcttca

SEQ ID NO: 66612 - DNA, 20 bp, synthetic construct
  misc_feature 1..20: note = CRISPR gRNA sequence
  source 1..20: mol_type = other DNA
agcttcttcatctgcacagt

SEQ ID NO: 66613 - DNA, 20 bp, synthetic construct
  misc_feature 1..20: note = CRISPR gRNA sequence
  source 1..20: mol_type = other DNA
cttcatctgcacagtggatg

SEQ ID NO: 66614 - DNA, 20 bp, synthetic construct
  misc_feature 1..20: note = CRISPR gRNA sequence
  source 1..20: mol_type = other DNA
ttcatctgcacagtggatgg

SEQ ID NO: 66615 - DNA, 20 bp, synthetic construct
  misc_feature 1..20: note = CRISPR gRNA sequence
  source 1..20: mol_type = other DNA
catctgcacagtggatggtc

SEQ ID NO: 66616 - DNA, 20 bp, synthetic construct
  misc_feature 1..20: note = CRISPR gRNA sequence
  source 1..20: mol_type = other DNA
atctgcacagtggatggtca

SEQ ID NO: 66617 - DNA, 20 bp, synthetic construct
  misc_feature 1..20: note = CRISPR gRNA sequence
  source 1..20: mol_type = other DNA
cacagtggatggtcagcctt

SEQ ID NO: 66618 - DNA, 20 bp, synthetic construct
  misc_feature 1..20: note = CRISPR gRNA sequence
  source 1..20: mol_type = other DNA
tccttttattgtcattgtgg

SEQ ID NO: 66619 - DNA, 20 bp, synthetic construct
  misc_feature 1..20: note = CRISPR gRNA sequence
  source 1..20: mol_type = other DNA
ccttttattgtcattgtggt

SEQ ID NO: 66620 - DNA, 20 bp, synthetic construct
  misc_feature 1..20: note = CRISPR gRNA sequence
  source 1..20: mol_type = other DNA
cttttattgtcattgtggtg

SEQ ID NO: 66621 - DNA, 20 bp, synthetic construct
  misc_feature 1..20: note = CRISPR gRNA sequence
  source 1..20: mol_type = other DNA
ttattgtcattgtggtgatt

SEQ ID NO: 66622 - DNA, 20 bp, synthetic construct
  misc_feature 1..20: note = CRISPR gRNA sequence
  source 1..20: mol_type = other DNA
tattgtcattgtggtgattc

SEQ ID NO: 66623 - DNA, 20 bp, synthetic construct
  misc_feature 1..20: note = CRISPR gRNA sequence
  source 1..20: mol_type = other DNA
attgtcattgtggtgattct

SEQ ID NO: 66624 - DNA, 20 bp, synthetic construct
  misc_feature 1..20: note = CRISPR gRNA sequence
  source 1..20: mol_type = other DNA
ttgtcattgtggtgattcta

SEQ ID NO: 66625 - DNA, 20 bp, synthetic construct
  misc_feature 1..20: note = CRISPR gRNA sequence
  source 1..20: mol_type = other DNA
tcattgtggtgattctatta

SEQ ID NO: 66626 - DNA, 20 bp, synthetic construct
  misc_feature 1..20: note = CRISPR gRNA sequence
  source 1..20: mol_type = other DNA
tggtgattctattatagtaa

SEQ ID NO: 66627 - DNA, 20 bp, synthetic construct
  misc_feature 1..20: note = CRISPR gRNA sequence
  source 1..20: mol_type = other DNA
tattatagtaattaccttaa

SEQ ID NO: 66628 - DNA, 20 bp, synthetic construct
  misc_feature 1..20: note = CRISPR gRNA sequence
  source 1..20: mol_type = other DNA
ttatagtaattaccttaaaa

SEQ ID NO: 66629 - DNA, 20 bp, synthetic construct
  misc_feature 1..20: note = CRISPR gRNA sequence
  source 1..20: mol_type = other DNA
tagtaattaccttaaaataa

SEQ ID NO: 66630 - DNA, 20 bp, synthetic construct
  misc_feature 1..20: note = CRISPR gRNA sequence
  source 1..20: mol_type = other DNA
ccttaaaataaagaaatcca

SEQ ID NO: 66631 - DNA, 20 bp, synthetic construct
  misc_feature 1..20: note = CRISPR gRNA sequence
  source 1..20: mol_type = other DNA
aaaataaagaaatccaagac

SEQ ID NO: 66632 - DNA, 20 bp, synthetic construct
  misc_feature 1..20: note = CRISPR gRNA sequence
  source 1..20: mol_type = other DNA
aaataaagaaatccaagaca

SEQ ID NO: 66633 - DNA, 20 bp, synthetic construct
  misc_feature 1..20: note = CRISPR gRNA sequence
  source 1..20: mol_type = other DNA
cctcacctaaacaacctctt

SEQ ID NO: 66634 - DNA, 20 bp, synthetic construct
  misc_feature 1..20: note = CRISPR gRNA sequence
  source 1..20: mol_type = other DNA
acctaaacaacctcttctct

SEQ ID NO: 66635 - DNA, 20 bp, synthetic construct
  misc_feature 1..20: note = CRISPR gRNA sequence
  source 1..20: mol_type = other DNA
aacaacctcttctctcatca

SEQ ID NO: 66636 - DNA, 20 bp, synthetic construct
  misc_feature 1..20: note = CRISPR gRNA sequence
  source 1..20: mol_type = other DNA
ttctctcatcaaatccatgt

SEQ ID NO: 66637 - DNA, 20 bp, synthetic construct
  misc_feature 1..20: note = CRISPR gRNA sequence
  source 1..20: mol_type = other DNA
ctctcatcaaatccatgttg

SEQ ID NO: 66638 - DNA, 20 bp, synthetic construct
  misc_feature 1..20: note = CRISPR gRNA sequence
  source 1..20: mol_type = other DNA
tctcatcaaatccatgttgt

SEQ ID NO: 66639 - DNA, 20 bp, synthetic construct
  misc_feature 1..20: note = CRISPR gRNA sequence
  source 1..20: mol_type = other DNA
tcatcaaatccatgttgtca

SEQ ID NO: 66640 - DNA, 20 bp, synthetic construct
  misc_feature 1..20: note = CRISPR gRNA sequence
  source 1..20: mol_type = other DNA
atcaaatccatgttgtcatg

SEQ ID NO: 66641 - DNA, 20 bp, synthetic construct
  misc_feature 1..20: note = CRISPR gRNA sequence
  source 1..20: mol_type = other DNA
tcatgtgtccacaggactgt

SEQ ID NO: 66642 - DNA, 20 bp, synthetic construct
  misc_feature 1..20: note = CRISPR gRNA sequence
  source 1..20: mol_type = other DNA
tctactccttgcctatttgc

SEQ ID NO: 66643 - DNA, 20 bp, synthetic construct
  misc_feature 1..20: note = CRISPR gRNA sequence
  source 1..20: mol_type = other DNA
ctccttgcctatttgcatat

SEQ ID NO: 66644 - DNA, 20 bp, synthetic construct
  misc_feature 1..20: note = CRISPR gRNA sequence
  source 1..20: mol_type = other DNA
cttgcctatttgcatattca

SEQ ID NO: 66645 - DNA, 20 bp, synthetic construct
  misc_feature 1..20: note = CRISPR gRNA sequence
  source 1..20: mol_type = other DNA
gcctatttgcatattcagtt

SEQ ID NO: 66646 - DNA, 20 bp, synthetic construct
  misc_feature 1..20: note = CRISPR gRNA sequence
  source 1..20: mol_type = other DNA
cctatttgcatattcagttt

SEQ ID NO: 66647 - DNA, 20 bp, synthetic construct
  misc_feature 1..20: note = CRISPR gRNA sequence
  source 1..20: mol_type = other DNA
tttgcatattcagtttctac

SEQ ID NO: 66648 - DNA, 20 bp, synthetic construct
  misc_feature 1..20: note = CRISPR gRNA sequence
  source 1..20: mol_type = other DNA
gcatattcagtttctacctg

SEQ ID NO: 66649 - DNA, 20 bp, synthetic construct
  misc_feature 1..20: note = CRISPR gRNA sequence
  source 1..20: mol_type = other DNA
catattcagtttctacctgt

SEQ ID NO: 66650 - DNA, 20 bp, synthetic construct
  misc_feature 1..20: note = CRISPR gRNA sequence
  source 1..20: mol_type = other DNA
agtttctacctgtttgcagt

SEQ ID NO: 66651 - DNA, 20 bp, synthetic construct
  misc_feature 1..20: note = CRISPR gRNA sequence
  source 1..20: mol_type = other DNA
ctacctgtttgcagtcataa

SEQ ID NO: 66652 - DNA, 20 bp, synthetic construct
  misc_feature 1..20: note = CRISPR gRNA sequence
  source 1..20: mol_type = other DNA
tacctgtttgcagtcataaa

SEQ ID NO: 66653 - DNA, 20 bp, synthetic construct
  misc_feature 1..20: note = CRISPR gRNA sequence
  source 1..20: mol_type = other DNA
cctgtttgcagtcataaact

SEQ ID NO: 66654 - DNA, 20 bp, synthetic construct
  misc_feature 1..20: note = CRISPR gRNA sequence
  source 1..20: mol_type = other DNA
tttgcagtcataaactagtt

SEQ ID NO: 66655 - DNA, 20 bp, synthetic construct
  misc_feature 1..20: note = CRISPR gRNA sequence
  source 1..20: mol_type = other DNA
gcagtcataaactagtttca

SEQ ID NO: 66656 - DNA, 20 bp, synthetic construct
  misc_feature 1..20: note = CRISPR gRNA sequence
  source 1..20: mol_type = other DNA
cagtcataaactagtttcat

SEQ ID NO: 66657 - DNA, 20 bp, synthetic construct
  misc_feature 1..20: note = CRISPR gRNA sequence
  source 1..20: mol_type = other DNA
gtttcatgcactgtgttttc

SEQ ID NO: 66658 - DNA, 20 bp, synthetic construct
  misc_feature 1..20: note = CRISPR gRNA sequence
  source 1..20: mol_type = other DNA
catgcactgtgttttcatag

SEQ ID NO: 66659 - DNA, 20 bp, synthetic construct
  misc_feature 1..20: note = CRISPR gRNA sequence
  source 1..20: mol_type = other DNA
atgcactgtgttttcatagc

SEQ ID NO: 66660 - DNA, 20 bp, synthetic construct
  misc_feature 1..20: note = CRISPR gRNA sequence
  source 1..20: mol_type = other DNA
tgttttcatagcatctgtgt

SEQ ID NO: 66661 - DNA, 20 bp, synthetic construct
  misc_feature 1..20: note = CRISPR gRNA sequence
  source 1..20: mol_type = other DNA
tcatagcatctgtgttttcc

SEQ ID NO: 66662 - DNA, 20 bp, synthetic construct
  misc_feature 1..20: note = CRISPR gRNA sequence
  source 1..20: mol_type = other DNA
catagcatctgtgttttcca

SEQ ID NO: 66663 - DNA, 20 bp, synthetic construct
  misc_feature 1..20: note = CRISPR gRNA sequence
  source 1..20: mol_type = other DNA
atagcatctgtgttttccat

SEQ ID NO: 66664 - DNA, 20 bp, synthetic construct
  misc_feature 1..20: note = CRISPR gRNA sequence
  source 1..20: mol_type = other DNA
tgttttccattttgcttcag

SEQ ID NO: 66665 - DNA, 20 bp, synthetic construct
  misc_feature 1..20: note = CRISPR gRNA sequence
  source 1..20: mol_type = other DNA
tccattttgcttcagtcttt

SEQ ID NO: 66666 - DNA, 20 bp, synthetic construct
  misc_feature 1..20: note = CRISPR gRNA sequence
  source 1..20: mol_type = other DNA
ccattttgcttcagtctttt

SEQ ID NO: 66667 - DNA, 20 bp, synthetic construct
  misc_feature 1..20: note = CRISPR gRNA sequence
  source 1..20: mol_type = other DNA
cattttgcttcagtcttttt

SEQ ID NO: 66668 - DNA, 20 bp, synthetic construct
  misc_feature 1..20: note = CRISPR gRNA sequence
  source 1..20: mol_type = other DNA
tgcttcagtcttttttcttg

SEQ ID NO: 66669 - DNA, 20 bp, synthetic construct
  misc_feature 1..20: note = CRISPR gRNA sequence
  source 1..20: mol_type = other DNA
gcttcagtcttttttcttgc

SEQ ID NO: 66670 - DNA, 20 bp, synthetic construct
  misc_feature 1..20: note = CRISPR gRNA sequence
  source 1..20: mol_type = other DNA
cttcagtcttttttcttgct

SEQ ID NO: 66671 - DNA, 20 bp, synthetic construct
  misc_feature 1..20: note = CRISPR gRNA sequence
  source 1..20: mol_type = other DNA
cagtcttttttcttgctttc

SEQ ID NO: 66672 - DNA, 20 bp, synthetic construct
  misc_feature 1..20: note = CRISPR gRNA sequence
  source 1..20: mol_type = other DNA
agtcttttttcttgctttct

SEQ ID NO: 66673 - DNA, 20 bp, synthetic construct
  misc_feature 1..20: note = CRISPR gRNA sequence
  source 1..20: mol_type = other DNA
ttttcttgctttctagcccc

SEQ ID NO: 66674 - DNA, 20 bp, synthetic construct
  misc_feature 1..20: note = CRISPR gRNA sequence
  source 1..20: mol_type = other DNA
tttcttgctttctagccccc

SEQ ID NO: 66675 - DNA, 20 bp, synthetic construct
  misc_feature 1..20: note = CRISPR gRNA sequence
  source 1..20: mol_type = other DNA
ttcttgctttctagccccca

SEQ ID NO: 66676 - DNA, 20 bp, synthetic construct
  misc_feature 1..20: note = CRISPR gRNA sequence
  source 1..20: mol_type = other DNA
tcttgctttctagcccccat

SEQ ID NO: 66677 - DNA, 20 bp, synthetic construct
  misc_feature 1..20: note = CRISPR gRNA sequence
  source 1..20: mol_type = other DNA
cttgctttctagcccccatc

SEQ ID NO: 66678 - DNA, 20 bp, synthetic construct
  misc_feature 1..20: note = CRISPR gRNA sequence
  source 1..20: mol_type = other DNA
ttgctttctagcccccatct

SEQ ID NO: 66679 - DNA, 20 bp, synthetic construct
  misc_feature 1..20: note = CRISPR gRNA sequence
  source 1..20: mol_type = other DNA
gctttctagcccccatctca

SEQ ID NO: 66680 - DNA, 20 bp, synthetic construct
  misc_feature 1..20: note = CRISPR gRNA sequence
  source 1..20: mol_type = other DNA
ctttctagcccccatctcaa

SEQ ID NO: 66681 - DNA, 20 bp, synthetic construct
  misc_feature 1..20: note = CRISPR gRNA sequence
  source 1..20: mol_type = other DNA
tctagcccccatctcaaatg

SEQ ID NO: 66682 - DNA, 20 bp, synthetic construct
  misc_feature 1..20: note = CRISPR gRNA sequence
  source 1..20: mol_type = other DNA
ctagcccccatctcaaatgc

SEQ ID NO: 66683 - DNA, 20 bp, synthetic construct
  misc_feature 1..20: note = CRISPR gRNA sequence
  source 1..20: mol_type = other DNA
tagcccccatctcaaatgcc

SEQ ID NO: 66684 - DNA, 20 bp, synthetic construct
  misc_feature 1..20: note = CRISPR gRNA sequence
  source 1..20: mol_type = other DNA
gcccccatctcaaatgccct

SEQ ID NO: 66685 - DNA, 20 bp, synthetic construct
  misc_feature 1..20: note = CRISPR gRNA sequence
  source 1..20: mol_type = other DNA
aaatgcccttccagcccttc

SEQ ID NO: 66686 - DNA, 20 bp, synthetic construct
  misc_feature 1..20: note = CRISPR gRNA sequence
  source 1..20: mol_type = other DNA
ccagcccttccaaccagata

SEQ ID NO: 66687 - DNA, 20 bp, synthetic construct
  misc_feature 1..20: note = CRISPR gRNA sequence
  source 1..20: mol_type = other DNA
cagcccttccaaccagataa

SEQ ID NO: 66688 - DNA, 20 bp, synthetic construct
  misc_feature 1..20: note = CRISPR gRNA sequence
  source 1..20: mol_type = other DNA
ccaaccagataatccggttt

SEQ ID NO: 66689 - DNA, 20 bp, synthetic construct
  misc_feature 1..20: note = CRISPR gRNA sequence
  source 1..20: mol_type = other DNA
caaccagataatccggtttg

SEQ ID NO: 66690 - DNA, 20 bp, synthetic construct
  misc_feature 1..20: note = CRISPR gRNA sequence
  source 1..20: mol_type = other DNA
gaccccctggagtgtggcct

SEQ ID NO: 66691 - DNA, 20 bp, synthetic construct
  misc_feature 1..20: note = CRISPR gRNA sequence
  source 1..20: mol_type = other DNA
accccctggagtgtggcctt

SEQ ID NO: 66692 - DNA, 20 bp, synthetic construct
  misc_feature 1..20: note = CRISPR gRNA sequence
  source 1..20: mol_type = other DNA
gagtgtggccttcccatgtc

SEQ ID NO: 66693 - DNA, 20 bp, synthetic construct
  misc_feature 1..20: note = CRISPR gRNA sequence
  source 1..20: mol_type = other DNA
cccatgtccttctccaggtt

SEQ ID NO: 66694 - DNA, 20 bp, synthetic construct
  misc_feature 1..20: note = CRISPR gRNA sequence
  source 1..20: mol_type = other DNA
ccatgtccttctccaggttc

SEQ ID NO: 66695 - DNA, 20 bp, synthetic construct
  misc_feature 1..20: note = CRISPR gRNA sequence
  source 1..20: mol_type = other DNA
ctccaggttcaaacatataa

SEQ ID NO: 66696 - DNA, 20 bp, synthetic construct
  misc_feature 1..20: note = CRISPR gRNA sequence
  source 1..20: mol_type = other DNA
tccaggttcaaacatataac

SEQ ID NO: 66697 - DNA, 20 bp, synthetic construct
  misc_feature 1..20: note = CRISPR gRNA sequence
  source 1..20: mol_type = other DNA
caggttcaaacatataacca

SEQ ID NO: 66698 - DNA, 20 bp, synthetic construct
  misc_feature 1..20: note = CRISPR gRNA sequence
  source 1..20: mol_type = other DNA
aaacatataaccacaaaacc

SEQ ID NO: 66699 - DNA, 20 bp, synthetic construct
  misc_feature 1..20: note = CRISPR gRNA sequence
  source 1..20: mol_type = other DNA
tcagacctacactatttttt

SEQ ID NO: 66700 - DNA, 20 bp, synthetic construct
  misc_feature 1..20: note = CRISPR gRNA sequence
  source 1..20: mol_type = other DNA
cactattttttttttctgag

SEQ ID NO: 66701 - DNA, 20 bp, synthetic construct
  misc_feature 1..20: note = CRISPR gRNA sequence
  source 1..20: mol_type = other DNA
ttttttttttctgagacaga

SEQ ID NO: 66702 - DNA, 20 bp, synthetic construct
  misc_feature 1..20: note = CRISPR gRNA sequence
  source 1..20: mol_type = other DNA
tttttttctgagacagagtt

SEQ ID NO: 66703 - DNA, 20 bp, synthetic construct
  misc_feature 1..20: note = CRISPR gRNA sequence
  source 1..20: mol_type = other DNA
ttttttctgagacagagttt

SEQ ID NO: 66704 - DNA, 20 bp, synthetic construct
  misc_feature 1..20: note = CRISPR gRNA sequence
  source 1..20: mol_type = other DNA
tttttctgagacagagtttt

SEQ ID NO: 66705 - DNA, 20 bp, synthetic construct
  misc_feature 1..20: note = CRISPR gRNA sequence
  source 1..20: mol_type = other DNA
ttttctgagacagagttttg

SEQ ID NO: 66706 - DNA, 20 bp, synthetic construct
  misc_feature 1..20: note = CRISPR gRNA sequence
  source 1..20: mol_type = other DNA
tttctgagacagagttttgc

SEQ ID NO: 66707 - DNA, 20 bp, synthetic construct
  misc_feature 1..20: note = CRISPR gRNA sequence
  source 1..20: mol_type = other DNA
ttctgagacagagttttgct

SEQ ID NO: 66708 - DNA, 20 bp, synthetic construct
  misc_feature 1..20: note = CRISPR gRNA sequence
  source 1..20: mol_type = other DNA
tctgagacagagttttgctc

SEQ ID NO: 66709 - DNA, 20 bp, synthetic construct
  misc_feature 1..20: note = CRISPR gRNA sequence
  source 1..20: mol_type = other DNA
ctgagacagagttttgctct

SEQ ID NO: 66710 - DNA, 20 bp, synthetic construct
  misc_feature 1..20: note = CRISPR gRNA sequence
  source 1..20: mol_type = other DNA
tgagacagagttttgctctt

SEQ ID NO: 66711 - DNA, 20 bp, synthetic construct
  misc_feature 1..20: note = CRISPR gRNA sequence
  source 1..20: mol_type = other DNA
agacagagttttgctcttgt

SEQ ID NO: 66712 - DNA, 20 bp, synthetic construct
  misc_feature 1..20: note = CRISPR gRNA sequence
  source 1..20: mol_type = other DNA
tgctcttgttgcccaggctg

SEQ ID NO: 66713 - DNA, 20 bp, synthetic construct
  misc_feature 1..20: note = CRISPR gRNA sequence
  source 1..20: mol_type = other DNA
gctcttgttgcccaggctgg

SEQ ID NO: 66714 - DNA, 20 bp, synthetic construct
  misc_feature 1..20: note = CRISPR gRNA sequence
  source 1..20: mol_type = other DNA
ctcttgttgcccaggctgga

SEQ ID NO: 66715 - DNA, 20 bp, synthetic construct
  misc_feature 1..20: note = CRISPR gRNA sequence
  source 1..20: mol_type = other DNA
ttgttgcccaggctggagtg

SEQ ID NO: 66716 - DNA, 20 bp, synthetic construct
  misc_feature 1..20: note = CRISPR gRNA sequence
  source 1..20: mol_type = other DNA
gttgcccaggctggagtgca

SEQ ID NO: 66717 - DNA, 20 bp, synthetic construct
  misc_feature 1..20: note = CRISPR gRNA sequence
  source 1..20: mol_type = other DNA
ttgcccaggctggagtgcaa

SEQ ID NO: 66718 - DNA, 20 bp, synthetic construct
  misc_feature 1..20: note = CRISPR gRNA sequence
  source 1..20: mol_type = other DNA
cccaggctggagtgcaatgg

SEQ ID NO: 66719 - DNA, 20 bp, synthetic construct
  misc_feature 1..20: note = CRISPR gRNA sequence
  source 1..20: mol_type = other DNA
gagtgcaatggcgtgatctc

SEQ ID NO: 66720 - DNA, 20 bp, synthetic construct
  misc_feature 1..20: note = CRISPR gRNA sequence
  source 1..20: mol_type = other DNA
ggcttgctgccacctctgcc

SEQ ID NO: 66721 - DNA, 20 bp, synthetic construct
  misc_feature 1..20: note = CRISPR gRNA sequence
  source 1..20: mol_type = other DNA
gctgccacctctgcctcctg

SEQ ID NO: 66722 - DNA, 20 bp, synthetic construct
  misc_feature 1..20: note = CRISPR gRNA sequence
  source 1..20: mol_type = other DNA
ctgccacctctgcctcctgg

SEQ ID NO: 66723 - DNA, 20 bp, synthetic construct
  misc_feature 1..20: note = CRISPR gRNA sequence
  source 1..20: mol_type = other DNA
ccacctctgcctcctgggtt

SEQ ID NO: 66724 - DNA, 20 bp, synthetic construct
  misc_feature 1..20: note = CRISPR gRNA sequence
  source 1..20: mol_type = other DNA
tgcctcctgggttcaagcaa

SEQ ID NO: 66725 - DNA, 20 bp, synthetic construct
  misc_feature 1..20: note = CRISPR gRNA sequence
  source 1..20: mol_type = other DNA
cctcctgggttcaagcaatt

SEQ ID NO: 66726 - DNA, 20 bp, synthetic construct
  misc_feature 1..20: note = CRISPR gRNA sequence
  source 1..20: mol_type = other DNA
ctgggttcaagcaattctcc

SEQ ID NO: 66727 - DNA, 20 bp, synthetic construct
  misc_feature 1..20: note = CRISPR gRNA sequence
  source 1..20: mol_type = other DNA
ggttcaagcaattctcctgc

SEQ ID NO: 66728 - DNA, 20 bp, synthetic construct
  misc_feature 1..20: note = CRISPR gRNA sequence
  source 1..20: mol_type = other DNA
aagcaattctcctgcctcag

SEQ ID NO: 66729 - DNA, 20 bp, synthetic construct
  misc_feature 1..20: note = CRISPR gRNA sequence
  source 1..20: mol_type = other DNA
tcctgcctcagcctcctgag

SEQ ID NO: 66730 - DNA, 20 bp, synthetic construct
  misc_feature 1..20: note = CRISPR gRNA sequence
  source 1..20: mol_type = other DNA
ctgcctcagcctcctgagta

SEQ ID NO: 66731 - DNA, 20 bp, synthetic construct
  misc_feature 1..20: note = CRISPR gRNA sequence
  source 1..20: mol_type = other DNA
cctcagcctcctgagtagct

SEQ ID NO: 66732 - DNA, 20 bp, synthetic construct
  misc_feature 1..20: note = CRISPR gRNA sequence
  source 1..20: mol_type = other DNA
agcctcctgagtagctggga

SEQ ID NO: 66733 - DNA, 20 bp, synthetic construct
  misc_feature 1..20: note = CRISPR gRNA sequence
  source 1..20: mol_type = other DNA
ctgagtagctgggattacag

SEQ ID NO: 66734 - DNA, 20 bp, synthetic construct
  misc_feature 1..20: note = CRISPR gRNA sequence
  source 1..20: mol_type = other DNA
agtagctgggattacaggcg

SEQ ID NO: 66735 - DNA, 20 bp, synthetic construct
  misc_feature 1..20: note = CRISPR gRNA sequence
  source 1..20: mol_type = other DNA
ggattacaggcgcccgccat

SEQ ID NO: 66736 - DNA, 20 bp, synthetic construct
  misc_feature 1..20: note = CRISPR gRNA sequence
  source 1..20: mol_type = other DNA
caggcgcccgccatcatgcc

SEQ ID NO: 66737 - DNA, 20 bp, synthetic construct
  misc_feature 1..20: note = CRISPR gRNA sequence
  source 1..20: mol_type = other DNA
gctaatttttgtatttttag

SEQ ID NO: 66738 - DNA, 20 bp, synthetic construct
  misc_feature 1..20: note = CRISPR gRNA sequence
  source 1..20: mol_type = other DNA
atttttgtatttttagtaga

SEQ ID NO: 66739 - DNA, 20 bp, synthetic construct
  misc_feature 1..20: note = CRISPR gRNA sequence
  source 1..20: mol_type = other DNA
ttgtatttttagtagaggca

SEQ ID NO: 66740 - DNA, 20 bp, synthetic construct
  misc_feature 1..20: note = CRISPR gRNA sequence
  source 1..20: mol_type = other DNA
tgtatttttagtagaggcag

SEQ ID NO: 66741 - DNA, 20 bp, synthetic construct
  misc_feature 1..20: note = CRISPR gRNA sequence
  source 1..20: mol_type = other DNA
gtatttttagtagaggcagg

SEQ ID NO: 66742 - DNA, 20 bp, synthetic construct
  misc_feature 1..20: note = CRISPR gRNA sequence
  source 1..20: mol_type = other DNA
tatttttagtagaggcaggg

SEQ ID NO: 66743 - DNA, 20 bp, synthetic construct
  misc_feature 1..20: note = CRISPR gRNA sequence
  source 1..20: mol_type = other DNA
ttagtagaggcagggtttca

SEQ ID NO: 66744 - DNA, 20 bp, synthetic construct
  misc_feature 1..20: note = CRISPR gRNA sequence
  source 1..20: mol_type = other DNA
tagtagaggcagggtttcac

SEQ ID NO: 66745 - DNA, 20 bp, synthetic construct
  misc_feature 1..20: note = CRISPR gRNA sequence
  source 1..20: mol_type = other DNA
agtagaggcagggtttcacc

SEQ ID NO: 66746 - DNA, 20 bp, synthetic construct
  misc_feature 1..20: note = CRISPR gRNA sequence
  source 1..20: mol_type = other DNA
gtagaggcagggtttcacca

SEQ ID NO: 66747 - DNA, 20 bp, synthetic construct
  misc_feature 1..20: note = CRISPR gRNA sequence
  source 1..20: mol_type = other DNA
caccatgttggccaggctgg

SEQ ID NO: 66748 - DNA, 20 bp, synthetic construct
  misc_feature 1..20: note = CRISPR gRNA sequence
  source 1..20: mol_type = other DNA
accatgttggccaggctggt

SEQ ID NO: 66749 - DNA, 20 bp, synthetic construct
  misc_feature 1..20: note = CRISPR gRNA sequence
  source 1..20: mol_type = other DNA
gccaggctggtctcgaactc

SEQ ID NO: 66750 - DNA, 20 bp, synthetic construct
  misc_feature 1..20: note = CRISPR gRNA sequence
  source 1..20: mol_type = other DNA
gtctcgaactcctgacctca

SEQ ID NO: 66751 - DNA, 20 bp, synthetic construct
  misc_feature 1..20: note = CRISPR gRNA sequence
  source 1..20: mol_type = other DNA
gaactcctgacctcaagtga

SEQ ID NO: 66752 - DNA, 20 bp, synthetic construct
  misc_feature 1..20: note = CRISPR gRNA sequence
  source 1..20: mol_type = other DNA
ctgacctcaagtgatccacc

SEQ ID NO: 66753 - DNA, 20 bp, synthetic construct
  misc_feature 1..20: note = CRISPR gRNA sequence
  source 1..20: mol_type = other DNA
acctcaagtgatccaccttc

SEQ ID NO: 66754 - DNA, 20 bp, synthetic construct
  misc_feature 1..20: note = CRISPR gRNA sequence
  source 1..20: mol_type = other DNA
aagtgatccaccttcctcag

SEQ ID NO: 66755 - DNA, 20 bp, synthetic construct
  misc_feature 1..20: note = CRISPR gRNA sequence
  source 1..20: mol_type = other DNA
cctcagcctcccaaagtgtt

SEQ ID NO: 66756 - DNA, 20 bp, synthetic construct
  misc_feature 1..20: note = CRISPR gRNA sequence
  source 1..20: mol_type = other DNA
ctcagcctcccaaagtgttg

SEQ ID NO: 66757 - DNA, 20 bp, synthetic construct
  misc_feature 1..20: note = CRISPR gRNA sequence
  source 1..20: mol_type = other DNA
agcctcccaaagtgttggga

SEQ ID NO: 66758 - DNA, 20 bp, synthetic construct
  misc_feature 1..20: note = CRISPR gRNA sequence
  source 1..20: mol_type = other DNA
ccaaagtgttgggattacag

SEQ ID NO: 66759 - DNA, 20 bp, synthetic construct
  misc_feature 1..20: note = CRISPR gRNA sequence
  source 1..20: mol_type = other DNA
ggattacaggcttgagccac

SEQ ID NO: 66760 - DNA, 20 bp, synthetic construct
  misc_feature 1..20: note = CRISPR gRNA sequence
  source 1..20: mol_type = other DNA
caggcttgagccactgcacc

SEQ ID NO: 66761 - DNA, 20 bp, synthetic construct
  misc_feature 1..20: note = CRISPR gRNA sequence
  source 1..20: mol_type = other DNA
gagccactgcacctggccca

SEQ ID NO: 66762 - DNA, 20 bp, synthetic construct
  misc_feature 1..20: note = CRISPR gRNA sequence
  source 1..20: mol_type = other DNA
agccactgcacctggcccag

SEQ ID NO: 66763 - DNA, 20 bp, synthetic construct
  misc_feature 1..20: note = CRISPR gRNA sequence
  source 1..20: mol_type = other DNA
cacctggcccagacctaccc

SEQ ID NO: 66764 - DNA, 20 bp, synthetic construct
  misc_feature 1..20: note = CRISPR gRNA sequence
  source 1..20: mol_type = other DNA
gcccagacctaccctattaa

SEQ ID NO: 66765 - DNA, 20 bp, synthetic construct
  misc_feature 1..20: note = CRISPR gRNA sequence
  source 1..20: mol_type = other DNA
ccctattaatggcaattcct

SEQ ID NO: 66766 - DNA, 20 bp, synthetic construct
  misc_feature 1..20: note = CRISPR gRNA sequence
  source 1..20: mol_type = other DNA
ttaatggcaattccttaaag

SEQ ID NO: 66767 - DNA, 20 bp, synthetic construct
  misc_feature 1..20: note = CRISPR gRNA sequence
  source 1..20: mol_type = other DNA
atggcaattccttaaagtca

SEQ ID NO: 66768 - DNA, 20 bp, synthetic construct
  misc_feature 1..20: note = CRISPR gRNA sequence
  source 1..20: mol_type = other DNA
cttaaagtcaaccaatggtc

SEQ ID NO: 66769 - DNA, 20 bp, synthetic construct
  misc_feature 1..20: note = CRISPR gRNA sequence
  source 1..20: mol_type = other DNA
aaagtcaaccaatggtcagt

SEQ ID NO: 66770 - DNA, 20 bp, synthetic construct
  misc_feature 1..20: note = CRISPR gRNA sequence
  source 1..20: mol_type = other DNA
aagtcaaccaatggtcagtg

SEQ ID NO: 66771 - DNA, 20 bp, synthetic construct
  misc_feature 1..20: note = CRISPR gRNA sequence
  source 1..20: mol_type = other DNA
attgtctcttacctgttttc

SEQ ID NO: 66772 - DNA, 20 bp, synthetic construct
  misc_feature 1..20: note = CRISPR gRNA sequence
  source 1..20: mol_type = other DNA
tctcttacctgttttcacag

SEQ ID NO: 66773 - DNA, 20 bp, synthetic construct
  misc_feature 1..20: note = CRISPR gRNA sequence
  source 1..20: mol_type = other DNA
ttacctgttttcacagagta

SEQ ID NO: 66774 - DNA, 20 bp, synthetic construct
  misc_feature 1..20: note = CRISPR gRNA sequence
  source 1..20: mol_type = other DNA
acctgttttcacagagtata

SEQ ID NO: 66775 - DNA, 20 bp, synthetic construct
  misc_feature 1..20: note = CRISPR gRNA sequence
  source 1..20: mol_type = other DNA
cctgttttcacagagtatat

SEQ ID NO: 66776 - DNA, 20 bp, synthetic construct
  misc_feature 1..20: note = CRISPR gRNA sequence
  source 1..20: mol_type = other DNA
ttttcacagagtatatactg

SEQ ID NO: 66777 - DNA, 20 bp, synthetic construct
  misc_feature 1..20: note = CRISPR gRNA sequence
  source 1..20: mol_type = other DNA
tcacagagtatatactgatg

SEQ ID NO: 66778 - DNA, 20 bp, synthetic construct
  misc_feature 1..20: note = CRISPR gRNA sequence
  source 1..20: mol_type = other DNA
cacagagtatatactgatgc

SEQ ID NO: 66779 - DNA, 20 bp, synthetic construct
  misc_feature 1..20: note = CRISPR gRNA sequence
  source 1..20: mol_type = other DNA
acagagtatatactgatgcc

SEQ ID NO: 66780 - DNA, 20 bp, synthetic construct
  misc_feature 1..20: note = CRISPR gRNA sequence
  source 1..20: mol_type = other DNA
atgccttttaatactaaatt

SEQ ID NO: 66781 - DNA, 20 bp, synthetic construct
  misc_feature 1..20: note = CRISPR gRNA sequence
  source 1..20: mol_type = other DNA
ttaatactaaattgccacag

SEQ ID NO: 66782 - DNA, 20 bp, synthetic construct
  misc_feature 1..20: note = CRISPR gRNA sequence
  source 1..20: mol_type = other DNA
taatactaaattgccacagt

SEQ ID NO: 66783 - DNA, 20 bp, synthetic construct
  misc_feature 1..20: note = CRISPR gRNA sequence
  source 1..20: mol_type = other DNA
aatactaaattgccacagta

SEQ ID NO: 66784 - DNA, 20 bp, synthetic construct
  misc_feature 1..20: note = CRISPR gRNA sequence
  source 1..20: mol_type = other DNA
atactaaattgccacagtac

SEQ ID NO: 66785 - DNA, 20 bp, synthetic construct
  misc_feature 1..20: note = CRISPR gRNA sequence
  source 1..20: mol_type = other DNA
aattgccacagtacgggacg

SEQ ID NO: 66786 - DNA, 20 bp, synthetic construct
  misc_feature 1..20: note = CRISPR gRNA sequence
  source 1..20: mol_type = other DNA
ccacagtacgggacgagctg

SEQ ID NO: 66787 - DNA, 20 bp, synthetic construct
  misc_feature 1..20: note = CRISPR gRNA sequence
  source 1..20: mol_type = other DNA
caagttactccaccacaccc

SEQ ID NO: 66788 - DNA, 20 bp, synthetic construct
  misc_feature 1..20: note = CRISPR gRNA sequence
  source 1..20: mol_type = other DNA
ctccaccacacccttctaga

SEQ ID NO: 66789 - DNA, 20 bp, synthetic construct
  misc_feature 1..20: note = CRISPR gRNA sequence
  source 1..20: mol_type = other DNA
caccacacccttctagagtc

SEQ ID NO: 66790 - DNA, 20 bp, synthetic construct
  misc_feature 1..20: note = CRISPR gRNA sequence
  source 1..20: mol_type = other DNA
ctagagtctagatcaagggt

SEQ ID NO: 66791 - DNA, 20 bp, synthetic construct
  misc_feature 1..20: note = CRISPR gRNA sequence
  source 1..20: mol_type = other DNA
tagagtctagatcaagggtg

SEQ ID NO: 66792 - DNA, 20 bp, synthetic construct
  misc_feature 1..20: note = CRISPR gRNA sequence
  source 1..20: mol_type = other DNA
gagtctagatcaagggtgtc

SEQ ID NO: 66793 - DNA, 20 bp, synthetic construct
  misc_feature 1..20: note = CRISPR gRNA sequence
  source 1..20: mol_type = other DNA
gatcaagggtgtccaatctt

SEQ ID NO: 66794 - DNA, 20 bp, synthetic construct
  misc_feature 1..20: note = CRISPR gRNA sequence
  source 1..20: mol_type = other DNA
ttggcttccctgggccacat

SEQ ID NO: 66795 - DNA, 20 bp, synthetic construct
  misc_feature 1..20: note = CRISPR gRNA sequence
  source 1..20: mol_type = other DNA
tggcttccctgggccacatt

SEQ ID NO: 66796 - DNA, 20 bp, synthetic construct
  misc_feature 1..20: note = CRISPR gRNA sequence
  source 1..20: mol_type = other DNA
ggcttccctgggccacattg

SEQ ID NO: 66797 - DNA, 20 bp, synthetic construct
  misc_feature 1..20: note = CRISPR gRNA sequence
  source 1..20: mol_type = other DNA
gcttccctgggccacattgg

SEQ ID NO: 66798 - DNA, 20 bp, synthetic construct
  misc_feature 1..20: note = CRISPR gRNA sequence
  source 1..20: mol_type = other DNA
ccctgggccacattggaaga

SEQ ID NO: 66799 - DNA, 20 bp, synthetic construct
  misc_feature 1..20: note = CRISPR gRNA sequence
  source 1..20: mol_type = other DNA
cctgggccacattggaagaa

SEQ ID NO: 66800 - DNA, 20 bp, synthetic construct
  misc_feature 1..20: note = CRISPR gRNA sequence
  source 1..20: mol_type = other DNA
ggccacattggaagaagaaa

SEQ ID NO: 66801 - DNA, 20 bp, synthetic construct
  misc_feature 1..20: note = CRISPR gRNA sequence
  source 1..20: mol_type = other DNA
gaagaagaaaaagaattgtc

SEQ ID NO: 66802 - DNA, 20 bp, synthetic construct
  misc_feature 1..20: note = CRISPR gRNA sequence
  source 1..20: mol_type = other DNA
tcttgggccacacataaaat

SEQ ID NO: 66803 - DNA, 20 bp, synthetic construct
  misc_feature 1..20: note = CRISPR gRNA sequence
  source 1..20: mol_type = other DNA
gggccacacataaaatacac

SEQ ID NO: 66804 - DNA, 20 bp, synthetic construct
  misc_feature 1..20: note = CRISPR gRNA sequence
  source 1..20: mol_type = other DNA
ggccacacataaaatacact

SEQ ID NO: 66805 - DNA, 20 bp, synthetic construct
  misc_feature 1..20: note = CRISPR gRNA sequence
  source 1..20: mol_type = other DNA
acactagcgatagctgatgt

SEQ ID NO: 66806 - DNA, 20 bp, synthetic construct
  misc_feature 1..20: note = CRISPR gRNA sequence
  source 1..20: mol_type = other DNA
gcgatagctgatgtgctaaa

SEQ ID NO: 66807 - DNA, 20 bp, synthetic construct
  misc_feature 1..20: note = CRISPR gRNA sequence
  source 1..20: mol_type = other DNA
atgtgctaaaaaaaaaaaac

SEQ ID NO: 66808 - DNA, 20 bp, synthetic construct
  misc_feature 1..20: note = CRISPR gRNA sequence
  source 1..20: mol_type = other DNA
aaaaaaaaaaacaaaactcc

SEQ ID NO: 66809 - DNA, 20 bp, synthetic construct
  misc_feature 1..20: note = CRISPR gRNA sequence
  source 1..20: mol_type = other DNA
caaagaaaaatctcatagtg

SEQ ID NO: 66810 - DNA, 20 bp, synthetic construct
  misc_feature 1..20: note = CRISPR gRNA sequence
  source 1..20: mol_type = other DNA
atagtgttttaagaaagttt

SEQ ID NO: 66811 - DNA, 20 bp, synthetic construct
  misc_feature 1..20: note = CRISPR gRNA sequence
  source 1..20: mol_type = other DNA
taagaaagtttacgaatttt

SEQ ID NO: 66812 - DNA, 20 bp, synthetic construct
  misc_feature 1..20: note = CRISPR gRNA sequence
  source 1..20: mol_type = other DNA
aagaaagtttacgaattttt

SEQ ID NO: 66813 - DNA, 20 bp, synthetic construct
  misc_feature 1..20: note = CRISPR gRNA sequence
  source 1..20: mol_type = other DNA
agaaagtttacgaatttttg

SEQ ID NO: 66814 - DNA, 20 bp, synthetic construct
  misc_feature 1..20: note = CRISPR gRNA sequence
  source 1..20: mol_type = other DNA
acgaatttttgttaggccgt

SEQ ID NO: 66815 - DNA, 20 bp, synthetic construct
  misc_feature 1..20: note = CRISPR gRNA sequence
  source 1..20: mol_type = other DNA
cgaatttttgttaggccgta

SEQ ID NO: 66816 - DNA, 20 bp, synthetic construct
  misc_feature 1..20: note = CRISPR gRNA sequence
  source 1..20: mol_type = other DNA
ttgttaggccgtattcaaag

SEQ ID NO: 66817 - DNA, 20 bp, synthetic construct
  misc_feature 1..20: note = CRISPR gRNA sequence
  source 1..20: mol_type = other DNA
tgttaggccgtattcaaagc

SEQ ID NO: 66818 - DNA, 20 bp, synthetic construct
  misc_feature 1..20: note = CRISPR gRNA sequence
  source 1..20: mol_type = other DNA
gttaggccgtattcaaagcc

SEQ ID NO: 66819 - DNA, 20 bp, synthetic construct
  misc_feature 1..20: note = CRISPR gRNA sequence
  source 1..20: mol_type = other DNA
ttaggccgtattcaaagcca

SEQ ID NO: 66820 - DNA, 20 bp, synthetic construct
  misc_feature 1..20: note = CRISPR gRNA sequence
  source 1..20: mol_type = other DNA
ggccgtattcaaagccatcc

SEQ ID NO: 66821 - DNA, 20 bp, synthetic construct
  misc_feature 1..20: note = CRISPR gRNA sequence
  source 1..20: mol_type = other DNA
aaagccatcctaggctgcat

SEQ ID NO: 66822 - DNA, 20 bp, synthetic construct
  misc_feature 1..20: note = CRISPR gRNA sequence
  source 1..20: mol_type = other DNA
ggctgcatgcagcaggccat

SEQ ID NO: 66823 - DNA, 20 bp, synthetic construct
  misc_feature 1..20: note = CRISPR gRNA sequence
  source 1..20: mol_type = other DNA
catgcagcaggccatgtggc

SEQ ID NO: 66824 - DNA, 20 bp, synthetic construct
  misc_feature 1..20: note = CRISPR gRNA sequence
  source 1..20: mol_type = other DNA
ggacaacttggtctagattg

SEQ ID NO: 66825 - DNA, 20 bp, synthetic construct
  misc_feature 1..20: note = CRISPR gRNA sequence
  source 1..20: mol_type = other DNA
gacaacttggtctagattga

SEQ ID NO: 66826 - DNA, 20 bp, synthetic construct
  misc_feature 1..20: note = CRISPR gRNA sequence
  source 1..20: mol_type = other DNA
ggtctagattgaaatccaaa

SEQ ID NO: 66827 - DNA, 20 bp, synthetic construct
  misc_feature 1..20: note = CRISPR gRNA sequence
  source 1..20: mol_type = other DNA
gtctagattgaaatccaaac

SEQ ID NO: 66828 - DNA, 20 bp, synthetic construct
  misc_feature 1..20: note = CRISPR gRNA sequence
  source 1..20: mol_type = other DNA
gattgaaatccaaactgctt

SEQ ID NO: 66829 - DNA, 20 bp, synthetic construct
  misc_feature 1..20: note = CRISPR gRNA sequence
  source 1..20: mol_type = other DNA
aaatccaaactgcttctagg

SEQ ID NO: 66830 - DNA, 20 bp, synthetic construct
  misc_feature 1..20: note = CRISPR gRNA sequence
  source 1..20: mol_type = other DNA
cttctaggtgttgtgttttg

SEQ ID NO: 66831 - DNA, 20 bp, synthetic construct
  misc_feature 1..20: note = CRISPR gRNA sequence
  source 1..20: mol_type = other DNA
ctaggtgttgtgttttgttt

SEQ ID NO: 66832 - DNA, 20 bp, synthetic construct
  misc_feature 1..20: note = CRISPR gRNA sequence
  source 1..20: mol_type = other DNA
taggtgttgtgttttgtttt

SEQ ID NO: 66833 - DNA, 20 bp, synthetic construct
  misc_feature 1..20: note = CRISPR gRNA sequence
  source 1..20: mol_type = other DNA
ggtgttgtgttttgttttgt

SEQ ID NO: 66834 - DNA, 20 bp, synthetic construct
  misc_feature 1..20: note = CRISPR gRNA sequence
  source 1..20: mol_type = other DNA
tgttttgttttgtgtagcac

SEQ ID NO: 66835 - DNA, 20 bp, synthetic construct
  misc_feature 1..20: note = CRISPR gRNA sequence
  source 1..20: mol_type = other DNA
tgttttgtgtagcactgcag

SEQ ID NO: 66836 - DNA, 20 bp, synthetic construct
  misc_feature 1..20: note = CRISPR gRNA sequence
  source 1..20: mol_type = other DNA
gttttgtgtagcactgcagt

SEQ ID NO: 66837 - DNA, 20 bp, synthetic construct
  misc_feature 1..20: note = CRISPR gRNA sequence
  source 1..20: mol_type = other DNA
ttttgtgtagcactgcagtc

SEQ ID NO: 66838 - DNA, 20 bp, synthetic construct
  misc_feature 1..20: note = CRISPR gRNA sequence
  source 1..20: mol_type = other DNA
tgtgtagcactgcagtcagt

SEQ ID NO: 66839 - DNA, 20 bp, synthetic construct
  misc_feature 1..20: note = CRISPR gRNA sequence
  source 1..20: mol_type = other DNA
gtgtagcactgcagtcagtg

SEQ ID NO: 66840 - DNA, 20 bp, synthetic construct
  misc_feature 1..20: note = CRISPR gRNA sequence
  source 1..20: mol_type = other DNA
tgtagcactgcagtcagtgc

SEQ ID NO: 66841 - DNA, 20 bp, synthetic construct
  misc_feature 1..20: note = CRISPR gRNA sequence
  source 1..20: mol_type = other DNA
cagtcagtgctacaaaaagc

SEQ ID NO: 66842 - DNA, 20 bp, synthetic construct
  misc_feature 1..20: note = CRISPR gRNA sequence
  source 1..20: mol_type = other DNA
caaaaagcactcttacgtga

SEQ ID NO: 66843 - DNA, 20 bp, synthetic construct
  misc_feature 1..20: note = CRISPR gRNA sequence
  source 1..20: mol_type = other DNA
ttacgtgatttgactgttaa

SEQ ID NO: 66844 - DNA, 20 bp, synthetic construct
  misc_feature 1..20: note = CRISPR gRNA sequence
  source 1..20: mol_type = other DNA
acgtgatttgactgttaagt

SEQ ID NO: 66845 - DNA, 20 bp, synthetic construct
  misc_feature 1..20: note = CRISPR gRNA sequence
  source 1..20: mol_type = other DNA
cgtgatttgactgttaagta

SEQ ID NO: 66846 - DNA, 20 bp, synthetic construct
  misc_feature 1..20: note = CRISPR gRNA sequence
  source 1..20: mol_type = other DNA
gactgttaagtacctattgt

SEQ ID NO: 66847 - DNA, 20 bp, synthetic construct
  misc_feature 1..20: note = CRISPR gRNA sequence
  source 1..20: mol_type = other DNA
actgttaagtacctattgta

SEQ ID NO: 66848 - DNA, 20 bp, synthetic construct
  misc_feature 1..20: note = CRISPR gRNA sequence
  source 1..20: mol_type = other DNA
ttaagtacctattgtatacc

SEQ ID NO: 66849 - DNA, 20 bp, synthetic construct
  misc_feature 1..20: note = CRISPR gRNA sequence
  source 1..20: mol_type = other DNA
agtacctattgtataccatg

SEQ ID NO: 66850 - DNA, 20 bp, synthetic construct
  misc_feature 1..20: note = CRISPR gRNA sequence
  source 1..20: mol_type = other DNA
ttgtataccatgcactgggc

SEQ ID NO: 66851 - DNA, 20 bp, synthetic construct
  misc_feature 1..20: note = CRISPR gRNA sequence
  source 1..20: mol_type = other DNA
tataccatgcactgggccag

SEQ ID NO: 66852 - DNA, 20 bp, synthetic construct
  misc_feature 1..20: note = CRISPR gRNA sequence
  source 1..20: mol_type = other DNA
ggccagatcctgggaacaca

SEQ ID NO: 66853 - DNA, 20 bp, synthetic construct
  misc_feature 1..20: note = CRISPR gRNA sequence
  source 1..20: mol_type = other DNA
ggaacacaaggagactggga

SEQ ID NO: 66854 - DNA, 20 bp, synthetic construct
  misc_feature 1..20: note = CRISPR gRNA sequence
  source 1..20: mol_type = other DNA
ggatgcgggctctgctggcc

SEQ ID NO: 66855 - DNA, 20 bp, synthetic construct
  misc_feature 1..20: note = CRISPR gRNA sequence
  source 1..20: mol_type = other DNA
tgctggccaaggcaaatcat

SEQ ID NO: 66856 - DNA, 20 bp, synthetic construct
  misc_feature 1..20: note = CRISPR gRNA sequence
  source 1..20: mol_type = other DNA
ctggccaaggcaaatcatct

SEQ ID NO: 66857 - DNA, 20 bp, synthetic construct
  misc_feature 1..20: note = CRISPR gRNA sequence
  source 1..20: mol_type = other DNA
gccaaggcaaatcatctgca

SEQ ID NO: 66858 - DNA, 20 bp, synthetic construct
  misc_feature 1..20: note = CRISPR gRNA sequence
  source 1..20: mol_type = other DNA
cagaggaagcttaatataaa

SEQ ID NO: 66859 - DNA, 20 bp, synthetic construct
  misc_feature 1..20: note = CRISPR gRNA sequence
  source 1..20: mol_type = other DNA
aatataaaaagcccactggc

SEQ ID NO: 66860 - DNA, 20 bp, synthetic construct
  misc_feature 1..20: note = CRISPR gRNA sequence
  source 1..20: mol_type = other DNA
atataaaaagcccactggcg

SEQ ID NO: 66861 - DNA, 20 bp, synthetic construct
  misc_feature 1..20: note = CRISPR gRNA sequence
  source 1..20: mol_type = other DNA
gcggcccggcacggtgactc

SEQ ID NO: 66862 - DNA, 20 bp, synthetic construct
  misc_feature 1..20: note = CRISPR gRNA sequence
  source 1..20: mol_type = other DNA
acgcctataatcccagcact

SEQ ID NO: 66863 - DNA, 20 bp, synthetic construct
  misc_feature 1..20: note = CRISPR gRNA sequence
  source 1..20: mol_type = other DNA
taatcccagcactttgggag

SEQ ID NO: 66864 - DNA, 20 bp, synthetic construct
  misc_feature 1..20: note = CRISPR gRNA sequence
  source 1..20: mol_type = other DNA
tgggaggccgaggtggctgg

SEQ ID NO: 66865 - DNA, 20 bp, synthetic construct
  misc_feature 1..20: note = CRISPR gRNA sequence
  source 1..20: mol_type = other DNA
gggaggccgaggtggctgga

SEQ ID NO: 66866 - DNA, 20 bp, synthetic construct
  misc_feature 1..20: note = CRISPR gRNA sequence
  source 1..20: mol_type = other DNA
ggaggccgaggtggctggat

SEQ ID NO: 66867 - DNA, 20 bp, synthetic construct
  misc_feature 1..20: note = CRISPR gRNA sequence
  source 1..20: mol_type = other DNA
gatcatgaggtcaggagttc

SEQ ID NO: 66868 - DNA, 20 bp, synthetic construct
  misc_feature 1..20: note = CRISPR gRNA sequence
  source 1..20: mol_type = other DNA
gagactagcctggccaacat

SEQ ID NO: 66869 - DNA, 20 bp, synthetic construct
  misc_feature 1..20: note = CRISPR gRNA sequence
  source 1..20: mol_type = other DNA
gcctggccaacatagtgaaa

SEQ ID NO: 66870 - DNA, 20 bp, synthetic construct
  misc_feature 1..20: note = CRISPR gRNA sequence
  source 1..20: mol_type = other DNA
gccaacatagtgaaacccca

SEQ ID NO: 66871 - DNA, 20 bp, synthetic construct
  misc_feature 1..20: note = CRISPR gRNA sequence
  source 1..20: mol_type = other DNA
tactaaaaatacaaaaatta

SEQ ID NO: 66872 - DNA, 20 bp, synthetic construct
  misc_feature 1..20: note = CRISPR gRNA sequence
  source 1..20: mol_type = other DNA
ctaaaaatacaaaaattagc

SEQ ID NO: 66873 - DNA, 20 bp, synthetic construct
  misc_feature 1..20: note = CRISPR gRNA sequence
  source 1..20: mol_type = other DNA
aaaatacaaaaattagccag

SEQ ID NO: 66874 - DNA, 20 bp, synthetic construct
  misc_feature 1..20: note = CRISPR gRNA sequence
  source 1..20: mol_type = other DNA
gccaggcatggtggtgcacc

SEQ ID NO: 66875 - DNA, 20 bp, synthetic construct
  misc_feature 1..20: note = CRISPR gRNA sequence
  source 1..20: mol_type = other DNA
taatcccagctactctggag

SEQ ID NO: 66876 - DNA, 20 bp, synthetic construct
  misc_feature 1..20: note = CRISPR gRNA sequence
  source 1..20: mol_type = other DNA
ctctggaggcaggcaggaga

SEQ ID NO: 66877 - DNA, 20 bp, synthetic construct
  misc_feature 1..20: note = CRISPR gRNA sequence
  source 1..20: mol_type = other DNA
tggaggcaggcaggagactt

SEQ ID NO: 66878 - DNA, 20 bp, synthetic construct
  misc_feature 1..20: note = CRISPR gRNA sequence
  source 1..20: mol_type = other DNA
gaggcaggcaggagacttgc

SEQ ID NO: 66879 - DNA, 20 bp, synthetic construct
  misc_feature 1..20: note = CRISPR gRNA sequence
  source 1..20: mol_type = other DNA
gcttgaacccgggaggcaga

SEQ ID NO: 66880 - DNA, 20 bp, synthetic construct
  misc_feature 1..20: note = CRISPR gRNA sequence
  source 1..20: mol_type = other DNA
cttgaacccgggaggcagag

SEQ ID NO: 66881 - DNA, 20 bp, synthetic construct
  misc_feature 1..20: note = CRISPR gRNA sequence
  source 1..20: mol_type = other DNA
gaacccgggaggcagagatt

SEQ ID NO: 66882 - DNA, 20 bp, synthetic construct
  misc_feature 1..20: note = CRISPR gRNA sequence
  source 1..20: mol_type = other DNA
aacccgggaggcagagattg

SEQ ID NO: 66883 - DNA, 20 bp, synthetic construct
  misc_feature 1..20: note = CRISPR gRNA sequence
  source 1..20: mol_type = other DNA
tggtgagccaagactgcgcc

SEQ ID NO: 66884 - DNA, 20 bp, synthetic construct
  misc_feature 1..20: note = CRISPR gRNA sequence
  source 1..20: mol_type = other DNA
cgccactgtcctccagcctg

SEQ ID NO: 66885 - DNA, 20 bp, synthetic construct
  misc_feature 1..20: note = CRISPR gRNA sequence
  source 1..20: mol_type = other DNA
tcctccagcctgggcaacag

SEQ ID NO: 66886 - DNA, 20 bp, synthetic construct
  misc_feature 1..20: note = CRISPR gRNA sequence
  source 1..20: mol_type = other DNA
cagcctgggcaacagagcaa

SEQ ID NO: 66887 - DNA, 20 bp, synthetic construct
  misc_feature 1..20: note = CRISPR gRNA sequence
  source 1..20: mol_type = other DNA
ggcaacagagcaagactctg

SEQ ID NO: 66888 - DNA, 20 bp, synthetic construct
  misc_feature 1..20: note = CRISPR gRNA sequence
  source 1..20: mol_type = other DNA
tgtctcaaataaataaataa

SEQ ID NO: 66889 - DNA, 20 bp, synthetic construct
  misc_feature 1..20: note = CRISPR gRNA sequence
  source 1..20: mol_type = other DNA
tctcaaataaataaataaat

SEQ ID NO: 66890 - DNA, 20 bp, synthetic construct
  misc_feature 1..20: note = CRISPR gRNA sequence
  source 1..20: mol_type = other DNA
aaataaataaataaataaat

SEQ ID NO: 66891 - DNA, 20 bp, synthetic construct
  misc_feature 1..20: note = CRISPR gRNA sequence
  source 1..20: mol_type = other DNA
gcagcactgggcggtctgag

SEQ ID NO: 66892 - DNA, 20 bp, synthetic construct
  misc_feature 1..20: note = CRISPR gRNA sequence
  source 1..20: mol_type = other DNA
ggcggtctgagcacaggtgg

SEQ ID NO: 66893 - DNA, 20 bp, synthetic construct
  misc_feature 1..20: note = CRISPR gRNA sequence
  source 1..20: mol_type = other DNA
agcacaggtgggagtttcag

SEQ ID NO: 66894 - DNA, 20 bp, synthetic construct
  misc_feature 1..20: note = CRISPR gRNA sequence
  source 1..20: mol_type = other DNA
caggtccccctccattacct

SEQ ID NO: 66895 - DNA, 20 bp, synthetic construct
  misc_feature 1..20: note = CRISPR gRNA sequence
  source 1..20: mol_type = other DNA
aggtccccctccattacctg

SEQ ID NO: 66896 - DNA, 20 bp, synthetic construct
  misc_feature 1..20: note = CRISPR gRNA sequence
  source 1..20: mol_type = other DNA
cattacctgtggttggggaa

SEQ ID NO: 66897 - DNA, 20 bp, synthetic construct
  misc_feature 1..20: note = CRISPR gRNA sequence
  source 1..20: mol_type = other DNA
cctgtggttggggaaagtgc

SEQ ID NO: 66898 - DNA, 20 bp, synthetic construct
  misc_feature 1..20: note = CRISPR gRNA sequence
  source 1..20: mol_type = other DNA
tggttggggaaagtgcaata

SEQ ID NO: 66899 - DNA, 20 bp, synthetic construct
  misc_feature 1..20: note = CRISPR gRNA sequence
  source 1..20: mol_type = other DNA
gggaaagtgcaatagtgaat

SEQ ID NO: 66900 - DNA, 20 bp, synthetic construct
  misc_feature 1..20: note = CRISPR gRNA sequence
  source 1..20: mol_type = other DNA
tgtcaactgtagagtactgt

SEQ ID NO: 66901 - DNA, 20 bp, synthetic construct
  misc_feature 1..20: note = CRISPR gRNA sequence
  source 1..20: mol_type = other DNA
gtcaactgtagagtactgtg

SEQ ID NO: 66902 - DNA, 20 bp, synthetic construct
  misc_feature 1..20: note = CRISPR gRNA sequence
  source 1..20: mol_type = other DNA
tcaactgtagagtactgtga

SEQ ID NO: 66903 - DNA, 20 bp, synthetic construct
  misc_feature 1..20: note = CRISPR gRNA sequence
  source 1..20: mol_type = other DNA
tagagtactgtgatcacttg

SEQ ID NO: 66904 - DNA, 20 bp, synthetic construct
  misc_feature 1..20: note = CRISPR gRNA sequence
  source 1..20: mol_type = other DNA
tgatcacttgcaggattatt

SEQ ID NO: 66905 - DNA, 20 bp, synthetic construct
  misc_feature 1..20: note = CRISPR gRNA sequence
  source 1..20: mol_type = other DNA
gcaggattattgctataaat

SEQ ID NO: 66906 - DNA, 20 bp, synthetic construct
  misc_feature 1..20: note = CRISPR gRNA sequence
  source 1..20: mol_type = other DNA
caggattattgctataaata

SEQ ID NO: 66907 - DNA, 20 bp, synthetic construct
  misc_feature 1..20: note = CRISPR gRNA sequence
  source 1..20: mol_type = other DNA
ttgctataaatagtcatcaa

SEQ ID NO: 66908 - DNA, 20 bp, synthetic construct
  misc_feature 1..20: note = CRISPR gRNA sequence
  source 1..20: mol_type = other DNA
ctataaatagtcatcaaggt

SEQ ID NO: 66909 - DNA, 20 bp, synthetic construct
  misc_feature 1..20: note = CRISPR gRNA sequence
  source 1..20: mol_type = other DNA
taaatagtcatcaaggtact

SEQ ID NO: 66910 - DNA, 20 bp, synthetic construct
  misc_feature 1..20: note = CRISPR gRNA sequence
  source 1..20: mol_type = other DNA
aatgctgaagtccagtgatt

SEQ ID NO: 66911 - DNA, 20 bp, synthetic construct
  misc_feature 1..20: note = CRISPR gRNA sequence
  source 1..20: mol_type = other DNA
aagtccagtgattccccggg

SEQ ID NO: 66912 - DNA, 20 bp, synthetic construct
  misc_feature 1..20: note = CRISPR gRNA sequence
  source 1..20: mol_type = other DNA
cccggggttccaccggggaa

SEQ ID NO: 66913 - DNA, 20 bp, synthetic construct
  misc_feature 1..20: note = CRISPR gRNA sequence
  source 1..20: mol_type = other DNA
caccggggaagccagggaag

SEQ ID NO: 66914 - DNA, 20 bp, synthetic construct
  misc_feature 1..20: note = CRISPR gRNA sequence
  source 1..20: mol_type = other DNA
tggggctccatcccccctcc

SEQ ID NO: 66915 - DNA, 20 bp, synthetic construct
  misc_feature 1..20: note = CRISPR gRNA sequence
  source 1..20: mol_type = other DNA
catcccccctccctgaattc

SEQ ID NO: 66916 - DNA, 20 bp, synthetic construct
  misc_feature 1..20: note = CRISPR gRNA sequence
  source 1..20: mol_type = other DNA
cctgaattcaagcactgcag

SEQ ID NO: 66917 - DNA, 20 bp, synthetic construct
  misc_feature 1..20: note = CRISPR gRNA sequence
  source 1..20: mol_type = other DNA
aattcaagcactgcaggtct

SEQ ID NO: 66918 - DNA, 20 bp, synthetic construct
  misc_feature 1..20: note = CRISPR gRNA sequence
  source 1..20: mol_type = other DNA
aagcactgcaggtctacttt

SEQ ID NO: 66919 - DNA, 20 bp, synthetic construct
  misc_feature 1..20: note = CRISPR gRNA sequence
  source 1..20: mol_type = other DNA
caggtctactttgcctgtgt

SEQ ID NO: 66920 - DNA, 20 bp, synthetic construct
  misc_feature 1..20: note = CRISPR gRNA sequence
  source 1..20: mol_type = other DNA
ctttgcctgtgtacacatgg

SEQ ID NO: 66921 - DNA, 20 bp, synthetic construct
  misc_feature 1..20: note = CRISPR gRNA sequence
  source 1..20: mol_type = other DNA
tgcctgtgtacacatgggca

SEQ ID NO: 66922 - DNA, 20 bp, synthetic construct
  misc_feature 1..20: note = CRISPR gRNA sequence
  source 1..20: mol_type = other DNA
gcctgtgtacacatgggcat

SEQ ID NO: 66923 - DNA, 20 bp, synthetic construct
  misc_feature 1..20: note = CRISPR gRNA sequence
  source 1..20: mol_type = other DNA
cctgtgtacacatgggcata

SEQ ID NO: 66924 - DNA, 20 bp, synthetic construct
  misc_feature 1..20: note = CRISPR gRNA sequence
  source 1..20: mol_type = other DNA
tgtacacatgggcataccat

SEQ ID NO: 66925 - DNA, 20 bp, synthetic construct
  misc_feature 1..20: note = CRISPR gRNA sequence
  source 1..20: mol_type = other DNA
cattgctttaaaaaaaaaaa

SEQ ID NO: 66926 - DNA, 20 bp, synthetic construct
  misc_feature 1..20: note = CRISPR gRNA sequence
  source 1..20: mol_type = other DNA
ctttaaaaaaaaaaaaaagg

SEQ ID NO: 66927 - DNA, 20 bp, synthetic construct
  misc_feature 1..20: note = CRISPR gRNA sequence
  source 1..20: mol_type = other DNA
taaaaaaaaaaaaaaggagg

SEQ ID NO: 66928 - DNA, 20 bp, synthetic construct
  misc_feature 1..20: note = CRISPR gRNA sequence
  source 1..20: mol_type = other DNA
aaaaaaaaaaaaaaggaggg

SEQ ID NO: 66929 - DNA, 20 bp, synthetic construct
  misc_feature 1..20: note = CRISPR gRNA sequence
  source 1..20: mol_type = other DNA
aaaaaaaaaaaaaggagggt

SEQ ID NO: 66930 - DNA, 20 bp, synthetic construct
  misc_feature 1..20: note = CRISPR gRNA sequence
  source 1..20: mol_type = other DNA
ctttgccaaccagagcccat

SEQ ID NO: 66931 - DNA, 20 bp, synthetic construct
  misc_feature 1..20: note = CRISPR gRNA sequence
  source 1..20: mol_type = other DNA
tgccaaccagagcccatggt

SEQ ID NO: 66932 - DNA, 20 bp, synthetic construct
  misc_feature 1..20: note = CRISPR gRNA sequence
  source 1..20: mol_type = other DNA
gccaaccagagcccatggtg

SEQ ID NO: 66933 - DNA, 20 bp, synthetic construct
  misc_feature 1..20: note = CRISPR gRNA sequence
  source 1..20: mol_type = other DNA
ccaaccagagcccatggtgt

SEQ ID NO: 66934 - DNA, 20 bp, synthetic construct
  misc_feature 1..20: note = CRISPR gRNA sequence
  source 1..20: mol_type = other DNA
gggggtctggtgggacacca

SEQ ID NO: 66935 - DNA, 20 bp, synthetic construct
  misc_feature 1..20: note = CRISPR gRNA sequence
  source 1..20: mol_type = other DNA
ggggtctggtgggacaccat

SEQ ID NO: 66936 - DNA, 20 bp, synthetic construct
  misc_feature 1..20: note = CRISPR gRNA sequence
  source 1..20: mol_type = other DNA
gtgggacaccatacgggatg

SEQ ID NO: 66937 - DNA, 20 bp, synthetic construct
  misc_feature 1..20: note = CRISPR gRNA sequence
  source 1..20: mol_type = other DNA
ctggaaagaccaccctcaat

SEQ ID NO: 66938 - DNA, 20 bp, synthetic construct
  misc_feature 1..20: note = CRISPR gRNA sequence
  source 1..20: mol_type = other DNA
tggaaagaccaccctcaata

SEQ ID NO: 66939 - DNA, 20 bp, synthetic construct
  misc_feature 1..20: note = CRISPR gRNA sequence
  source 1..20: mol_type = other DNA
gaaagaccaccctcaataaa

SEQ ID NO: 66940 - DNA, 20 bp, synthetic construct
  misc_feature 1..20: note = CRISPR gRNA sequence
  source 1..20: mol_type = other DNA
aataaaggccccagtcctga

SEQ ID NO: 66941 - DNA, 20 bp, synthetic construct
  misc_feature 1..20: note = CRISPR gRNA sequence
  source 1..20: mol_type = other DNA
actgtgcctcaggggcccat

SEQ ID NO: 66942 - DNA, 20 bp, synthetic construct
  misc_feature 1..20: note = CRISPR gRNA sequence
  source 1..20: mol_type = other DNA
tgcctcaggggcccatgccc

SEQ ID NO: 66943 - DNA, 20 bp, synthetic construct
  misc_feature 1..20: note = CRISPR gRNA sequence
  source 1..20: mol_type = other DNA
aggggcccatgcccagtccc

SEQ ID NO: 66944 - DNA, 20 bp, synthetic construct
  misc_feature 1..20: note = CRISPR gRNA sequence
  source 1..20: mol_type = other DNA
gggcagaaagggtagagttg

SEQ ID NO: 66945 - DNA, 20 bp, synthetic construct
  misc_feature 1..20: note = CRISPR gRNA sequence
  source 1..20: mol_type = other DNA
ggcctccagcctgggccctg

SEQ ID NO: 66946 - DNA, 20 bp, synthetic construct
  misc_feature 1..20: note = CRISPR gRNA sequence
  source 1..20: mol_type = other DNA
cagcctgggccctggcagag

SEQ ID NO: 66947 - DNA, 20 bp, synthetic construct
  misc_feature 1..20: note = CRISPR gRNA sequence
  source 1..20: mol_type = other DNA
ggccctggcagaggctccaa

SEQ ID NO: 66948 - DNA, 20 bp, synthetic construct
  misc_feature 1..20: note = CRISPR gRNA sequence
  source 1..20: mol_type = other DNA
gcagaggctccaacatgagg

SEQ ID NO: 66949 - DNA, 20 bp, synthetic construct
  misc_feature 1..20: note = CRISPR gRNA sequence
  source 1..20: mol_type = other DNA
caacatgaggctgctcctcc

SEQ ID NO: 66950 - DNA, 20 bp, synthetic construct
  misc_feature 1..20: note = CRISPR gRNA sequence
  source 1..20: mol_type = other DNA
ctcctcccgccctaccctgc

SEQ ID NO: 66951 - DNA, 20 bp, synthetic construct
  misc_feature 1..20: note = CRISPR gRNA sequence
  source 1..20: mol_type = other DNA
ctcccgccctaccctgcccc

SEQ ID NO: 66952 - DNA, 20 bp, synthetic construct
  misc_feature 1..20: note = CRISPR gRNA sequence
  source 1..20: mol_type = other DNA
ccgccctaccctgcccccca

SEQ ID NO: 66953 - DNA, 20 bp, synthetic construct
  misc_feature 1..20: note = CRISPR gRNA sequence
  source 1..20: mol_type = other DNA
ccctgccccccagctcactg

SEQ ID NO: 66954 - DNA, 20 bp, synthetic construct
  misc_feature 1..20: note = CRISPR gRNA sequence
  source 1..20: mol_type = other DNA
ccccccagctcactgagcca

SEQ ID NO: 66955 - DNA, 20 bp, synthetic construct
  misc_feature 1..20: note = CRISPR gRNA sequence
  source 1..20: mol_type = other DNA
actgagccagttgatgtagg

SEQ ID NO: 66956 - DNA, 20 bp, synthetic construct
  misc_feature 1..20: note = CRISPR gRNA sequence
  source 1..20: mol_type = other DNA
agccagttgatgtagggccc

SEQ ID NO: 66957 - DNA, 20 bp, synthetic construct
  misc_feature 1..20: note = CRISPR gRNA sequence
  source 1..20: mol_type = other DNA
atgtagggcccctgtactcc

SEQ ID NO: 66958 - DNA, 20 bp, synthetic construct
  misc_feature 1..20: note = CRISPR gRNA sequence
  source 1..20: mol_type = other DNA
tactccatgcctcccctcca

SEQ ID NO: 66959 - DNA, 20 bp, synthetic construct
  misc_feature 1..20: note = CRISPR gRNA sequence
  source 1..20: mol_type = other DNA
catgcctcccctccaaacag

SEQ ID NO: 66960 - DNA, 20 bp, synthetic construct
  misc_feature 1..20: note = CRISPR gRNA sequence
  source 1..20: mol_type = other DNA
ccctccaaacagccagagga

SEQ ID NO: 66961 - DNA, 20 bp, synthetic construct
  misc_feature 1..20: note = CRISPR gRNA sequence
  source 1..20: mol_type = other DNA
caaacagccagaggagaaag

SEQ ID NO: 66962 - DNA, 20 bp, synthetic construct
  misc_feature 1..20: note = CRISPR gRNA sequence
  source 1..20: mol_type = other DNA
ggaggccccggagaggggag

SEQ ID NO: 66963 - DNA, 20 bp, synthetic construct
  misc_feature 1..20: note = CRISPR gRNA sequence
  source 1..20: mol_type = other DNA
gaggccccggagaggggaga

SEQ ID NO: 66964 - DNA, 20 bp, synthetic construct
  misc_feature 1..20: note = CRISPR gRNA sequence
  source 1..20: mol_type = other DNA
cagaggatgaaggaacagaa

SEQ ID NO: 66965 - DNA, 20 bp, synthetic construct
  misc_feature 1..20: note = CRISPR gRNA sequence
  source 1..20: mol_type = other DNA
cgggggttgggaagtggctc

SEQ ID NO: 66966 - DNA, 20 bp, synthetic construct
  misc_feature 1..20: note = CRISPR gRNA sequence
  source 1..20: mol_type = other DNA
ggaagtggctccaggccccc

SEQ ID NO: 66967 - DNA, 20 bp, synthetic construct
  misc_feature 1..20: note = CRISPR gRNA sequence
  source 1..20: mol_type = other DNA
caggccccccaggaaggggc

SEQ ID NO: 66968 - DNA, 20 bp, synthetic construct
  misc_feature 1..20: note = CRISPR gRNA sequence
  source 1..20: mol_type = other DNA
taggtaaaccccagggaact

SEQ ID NO: 66969 - DNA, 20 bp, synthetic construct
  misc_feature 1..20: note = CRISPR gRNA sequence
  source 1..20: mol_type = other DNA
agtgtcttgagttgtcctgg

SEQ ID NO: 66970 - DNA, 20 bp, synthetic construct
  misc_feature 1..20: note = CRISPR gRNA sequence
  source 1..20: mol_type = other DNA
gagttgtcctggtcctccat

SEQ ID NO: 66971 - DNA, 20 bp, synthetic construct
  misc_feature 1..20: note = CRISPR gRNA sequence
  source 1..20: mol_type = other DNA
agttgtcctggtcctccatc

SEQ ID NO: 66972 - DNA, 20 bp, synthetic construct
  misc_feature 1..20: note = CRISPR gRNA sequence
  source 1..20: mol_type = other DNA
tcctggtcctccatctagag

SEQ ID NO: 66973 - DNA, 20 bp, synthetic construct
  misc_feature 1..20: note = CRISPR gRNA sequence
  source 1..20: mol_type = other DNA
gtcctccatctagagcagag

SEQ ID NO: 66974 - DNA, 20 bp, synthetic construct
  misc_feature 1..20: note = CRISPR gRNA sequence
  source 1..20: mol_type = other DNA
catctagagcagagacagca

SEQ ID NO: 66975 - DNA, 20 bp, synthetic construct
  misc_feature 1..20: note = CRISPR gRNA sequence
  source 1..20: mol_type = other DNA
gagcagagacagcaaggcag

SEQ ID NO: 66976 - DNA, 20 bp, synthetic construct
  misc_feature 1..20: note = CRISPR gRNA sequence
  source 1..20: mol_type = other DNA
gagtttctcctaaatgcact

SEQ ID NO: 66977 - DNA, 20 bp, synthetic construct
  misc_feature 1..20: note = CRISPR gRNA sequence
  source 1..20: mol_type = other DNA
ctcctaaatgcactgggttc

SEQ ID NO: 66978 - DNA, 20 bp, synthetic construct
  misc_feature 1..20: note = CRISPR gRNA sequence
  source 1..20: mol_type = other DNA
tcctaaatgcactgggttct

SEQ ID NO: 66979 - DNA, 20 bp, synthetic construct
  misc_feature 1..20: note = CRISPR gRNA sequence
  source 1..20: mol_type = other DNA
ctaaatgcactgggttctga

SEQ ID NO: 66980 - DNA, 20 bp, synthetic construct
  misc_feature 1..20: note = CRISPR gRNA sequence
  source 1..20: mol_type = other DNA
aatgcactgggttctgacga

SEQ ID NO: 66981 - DNA, 20 bp, synthetic construct
  misc_feature 1..20: note = CRISPR gRNA sequence
  source 1..20: mol_type = other DNA
ggttctgacgaattatctga

SEQ ID NO: 66982 - DNA, 20 bp, synthetic construct
  misc_feature 1..20: note = CRISPR gRNA sequence
  source 1..20: mol_type = other DNA
tgacgaattatctgaacaat

SEQ ID NO: 66983 - DNA, 20 bp, synthetic construct
  misc_feature 1..20: note = CRISPR gRNA sequence
  source 1..20: mol_type = other DNA
acgaattatctgaacaatga

SEQ ID NO: 66984 - DNA, 20 bp, synthetic construct
  misc_feature 1..20: note = CRISPR gRNA sequence
  source 1..20: mol_type = other DNA
tctgaacaatgatgagctgg

SEQ ID NO: 66985 - DNA, 20 bp, synthetic construct
  misc_feature 1..20: note = CRISPR gRNA sequence
  source 1..20: mol_type = other DNA
aacaatgatgagctggttgg

SEQ ID NO: 66986 - DNA, 20 bp, synthetic construct
  misc_feature 1..20: note = CRISPR gRNA sequence
  source 1..20: mol_type = other DNA
gttggtctggtgttaatggg

SEQ ID NO: 66987 - DNA, 20 bp, synthetic construct
  misc_feature 1..20: note = CRISPR gRNA sequence
  source 1..20: mol_type = other DNA
gtctggtgttaatgggcaac

SEQ ID NO: 66988 - DNA, 20 bp, synthetic construct
  misc_feature 1..20: note = CRISPR gRNA sequence
  source 1..20: mol_type = other DNA
gtgttaatgggcaactagag

SEQ ID NO: 66989 - DNA, 20 bp, synthetic construct
  misc_feature 1..20: note = CRISPR gRNA sequence
  source 1..20: mol_type = other DNA
atgggcaactagagacccaa

SEQ ID NO: 66990 - DNA, 20 bp, synthetic construct
  misc_feature 1..20: note = CRISPR gRNA sequence
  source 1..20: mol_type = other DNA
gagacccaagccagtccctg

SEQ ID NO: 66991 - DNA, 20 bp, synthetic construct
  misc_feature 1..20: note = CRISPR gRNA sequence
  source 1..20: mol_type = other DNA
tctccttcgctgacctgttg

SEQ ID NO: 66992 - DNA, 20 bp, synthetic construct
  misc_feature 1..20: note = CRISPR gRNA sequence
  source 1..20: mol_type = other DNA
cttcgctgacctgttgtatg

SEQ ID NO: 66993 - DNA, 20 bp, synthetic construct
  misc_feature 1..20: note = CRISPR gRNA sequence
  source 1..20: mol_type = other DNA
cgctgacctgttgtatgctg

SEQ ID NO: 66994 - DNA, 20 bp, synthetic construct
  misc_feature 1..20: note = CRISPR gRNA sequence
  source 1..20: mol_type = other DNA
gctgacctgttgtatgctga

SEQ ID NO: 66995 - DNA, 20 bp, synthetic construct
  misc_feature 1..20: note = CRISPR gRNA sequence
  source 1..20: mol_type = other DNA
acctgttgtatgctgaattt

SEQ ID NO: 66996 - DNA, 20 bp, synthetic construct
  misc_feature 1..20: note = CRISPR gRNA sequence
  source 1..20: mol_type = other DNA
ttgtatgctgaatttccact

SEQ ID NO: 66997 - DNA, 20 bp, synthetic construct
  misc_feature 1..20: note = CRISPR gRNA sequence
  source 1..20: mol_type = other DNA
tatgctgaatttccactgtc

SEQ ID NO: 66998 - DNA, 20 bp, synthetic construct
  misc_feature 1..20: note = CRISPR gRNA sequence
  source 1..20: mol_type = other DNA
aatttccactgtcatatcca

SEQ ID NO: 66999 - DNA, 20 bp, synthetic construct
  misc_feature 1..20: note = CRISPR gRNA sequence
  source 1..20: mol_type = other DNA
ccactgtcatatccactcct

SEQ ID NO: 67000 - DNA, 20 bp, synthetic construct
  misc_feature 1..20: note = CRISPR gRNA sequence
  source 1..20: mol_type = other DNA
cactgtcatatccactcctc

SEQ ID NO: 67001 - DNA, 20 bp, synthetic construct
  misc_feature 1..20: note = CRISPR gRNA sequence
  source 1..20: mol_type = other DNA
tcatatccactcctctgggt

SEQ ID NO: 67002 - DNA, 20 bp, synthetic construct
  misc_feature 1..20: note = CRISPR gRNA sequence
  source 1..20: mol_type = other DNA
ctctgggttaaggcagcatt

SEQ ID NO: 67003 - DNA, 20 bp, synthetic construct
  misc_feature 1..20: note = CRISPR gRNA sequence
  source 1..20: mol_type = other DNA
tgggttaaggcagcattgtt

SEQ ID NO: 67004 - DNA, 20 bp, synthetic construct
  misc_feature 1..20: note = CRISPR gRNA sequence
  source 1..20: mol_type = other DNA
ggttaaggcagcattgtttt

SEQ ID NO: 67005 - DNA, 20 bp, synthetic construct
  misc_feature 1..20: note = CRISPR gRNA sequence
  source 1..20: mol_type = other DNA
aggcagcattgttttctttt

SEQ ID NO: 67006 - DNA, 20 bp, synthetic construct
  misc_feature 1..20: note = CRISPR gRNA sequence
  source 1..20: mol_type = other DNA
ttttcttttcttttttattt

SEQ ID NO: 67007 - DNA, 20 bp, synthetic construct
  misc_feature 1..20: note = CRISPR gRNA sequence
  source 1..20: mol_type = other DNA
tcttttcttttttatttttt

SEQ ID NO: 67008 - DNA, 20 bp, synthetic construct
  misc_feature 1..20: note = CRISPR gRNA sequence
  source 1..20: mol_type = other DNA
cttttcttttttattttttt

SEQ ID NO: 67009 - DNA, 20 bp, synthetic construct
  misc_feature 1..20: note = CRISPR gRNA sequence
  source 1..20: mol_type = other DNA
ttttcttttttatttttttg

SEQ ID NO: 67010 - DNA, 20 bp, synthetic construct
  misc_feature 1..20: note = CRISPR gRNA sequence
  source 1..20: mol_type = other DNA
ttcttttttatttttttgag

SEQ ID NO: 67011 - DNA, 20 bp, synthetic construct
  misc_feature 1..20: note = CRISPR gRNA sequence
  source 1..20: mol_type = other DNA
tcttttttatttttttgaga

SEQ ID NO: 67012 - DNA, 20 bp, synthetic construct
  misc_feature 1..20: note = CRISPR gRNA sequence
  source 1..20: mol_type = other DNA
cttttttatttttttgagat

SEQ ID NO: 67013 - DNA, 20 bp, synthetic construct
  misc_feature 1..20: note = CRISPR gRNA sequence
  source 1..20: mol_type = other DNA
ttttttatttttttgagata

SEQ ID NO: 67014 - DNA, 20 bp, synthetic construct
  misc_feature 1..20: note = CRISPR gRNA sequence
  source 1..20: mol_type = other DNA
ttttatttttttgagataga

SEQ ID NO: 67015 - DNA, 20 bp, synthetic construct
  misc_feature 1..20: note = CRISPR gRNA sequence
  source 1..20: mol_type = other DNA
tttatttttttgagatagag

SEQ ID NO: 67016 - DNA, 20 bp, synthetic construct
  misc_feature 1..20: note = CRISPR gRNA sequence
  source 1..20: mol_type = other DNA
ttatttttttgagatagaga

SEQ ID NO: 67017 - DNA, 20 bp, synthetic construct
  misc_feature 1..20: note = CRISPR gRNA sequence
  source 1..20: mol_type = other DNA
tatttttttgagatagagac

SEQ ID NO: 67018 - DNA, 20 bp, synthetic construct
  misc_feature 1..20: note = CRISPR gRNA sequence
  source 1..20: mol_type = other DNA
atttttttgagatagagact

SEQ ID NO: 67019 - DNA, 20 bp, synthetic construct
  misc_feature 1..20: note = CRISPR gRNA sequence
  source 1..20: mol_type = other DNA
tttttttgagatagagactc

SEQ ID NO: 67020 - DNA, 20 bp, synthetic construct
  misc_feature 1..20: note = CRISPR gRNA sequence
  source 1..20: mol_type = other DNA
ttttgagatagagactcgct

SEQ ID NO: 67021 - DNA, 20 bp, synthetic construct
  misc_feature 1..20: note = CRISPR gRNA sequence
  source 1..20: mol_type = other DNA
tttgagatagagactcgctc

SEQ ID NO: 67022 - DNA, 20 bp, synthetic construct
  misc_feature 1..20: note = CRISPR gRNA sequence
  source 1..20: mol_type = other DNA
ttgagatagagactcgctct

SEQ ID NO: 67023 - DNA, 20 bp, synthetic construct
  misc_feature 1..20: note = CRISPR gRNA sequence
  source 1..20: mol_type = other DNA
tgagatagagactcgctctg

SEQ ID NO: 67024 - DNA, 20 bp, synthetic construct
  misc_feature 1..20: note = CRISPR gRNA sequence
  source 1..20: mol_type = other DNA
gagatagagactcgctctgt

SEQ ID NO: 67025 - DNA, 20 bp, synthetic construct
  misc_feature 1..20: note = CRISPR gRNA sequence
  source 1..20: mol_type = other DNA
agatagagactcgctctgtc

SEQ ID NO: 67026 - DNA, 20 bp, synthetic construct
  misc_feature 1..20: note = CRISPR gRNA sequence
  source 1..20: mol_type = other DNA
gctctgtcacccaggctgga

SEQ ID NO: 67027 - DNA, 20 bp, synthetic construct
  misc_feature 1..20: note = CRISPR gRNA sequence
  source 1..20: mol_type = other DNA
tgtcacccaggctggagtgc

SEQ ID NO: 67028 - DNA, 20 bp, synthetic construct
  misc_feature 1..20: note = CRISPR gRNA sequence
  source 1..20: mol_type = other DNA
tcacccaggctggagtgcag

SEQ ID NO: 67029 - DNA, 20 bp, synthetic construct
  misc_feature 1..20: note = CRISPR gRNA sequence
  source 1..20: mol_type = other DNA
gagtgcagtggtacgatctt

SEQ ID NO: 67030 - DNA, 20 bp, synthetic construct
  misc_feature 1..20: note = CRISPR gRNA sequence
  source 1..20: mol_type = other DNA
ggctcactgcaacctctgcc

SEQ ID NO: 67031 - DNA, 20 bp, synthetic construct
  misc_feature 1..20: note = CRISPR gRNA sequence
  source 1..20: mol_type = other DNA
gctcactgcaacctctgcct

SEQ ID NO: 67032 - DNA, 20 bp, synthetic construct
  misc_feature 1..20: note = CRISPR gRNA sequence
  source 1..20: mol_type = other DNA
actgcaacctctgcctccca

SEQ ID NO: 67033 - DNA, 20 bp, synthetic construct
  misc_feature 1..20: note = CRISPR gRNA sequence
  source 1..20: mol_type = other DNA
caacctctgcctcccaggtt

SEQ ID NO: 67034 - DNA, 20 bp, synthetic construct
  misc_feature 1..20: note = CRISPR gRNA sequence
  source 1..20: mol_type = other DNA
tgcctcccaggttcaagtga

SEQ ID NO: 67035 - DNA, 20 bp, synthetic construct
  misc_feature 1..20: note = CRISPR gRNA sequence
  source 1..20: mol_type = other DNA
cctcccaggttcaagtgatt

SEQ ID NO: 67036 - DNA, 20 bp, synthetic construct
  misc_feature 1..20: note = CRISPR gRNA sequence
  source 1..20: mol_type = other DNA
ccaggttcaagtgattccca

SEQ ID NO: 67037 - DNA, 20 bp, synthetic construct
  misc_feature 1..20: note = CRISPR gRNA sequence
  source 1..20: mol_type = other DNA
aagtgattcccatgcctcag

SEQ ID NO: 67038 - DNA, 20 bp, synthetic construct
  misc_feature 1..20: note = CRISPR gRNA sequence
  source 1..20: mol_type = other DNA
ccatgcctcagcctcctgag

SEQ ID NO: 67039 - DNA, 20 bp, synthetic construct
  misc_feature 1..20: note = CRISPR gRNA sequence
  source 1..20: mol_type = other DNA
agcctcctgagtagctatta

SEQ ID NO: 67040 - DNA, 20 bp, synthetic construct
  misc_feature 1..20: note = CRISPR gRNA sequence
  source 1..20: mol_type = other DNA
ctgagtagctattactacag

SEQ ID NO: 67041 - DNA, 20 bp, synthetic construct
  misc_feature 1..20: note = CRISPR gRNA sequence
  source 1..20: mol_type = other DNA
agtagctattactacaggtg

SEQ ID NO: 67042 - DNA, 20 bp, synthetic construct
  misc_feature 1..20: note = CRISPR gRNA sequence
  source 1..20: mol_type = other DNA
ttactacaggtgtgcaccac

SEQ ID NO: 67043 - DNA, 20 bp, synthetic construct
  misc_feature 1..20: note = CRISPR gRNA sequence
  source 1..20: mol_type = other DNA
ctacaggtgtgcaccaccac

SEQ ID NO: 67044 - DNA, 20 bp, synthetic construct
  misc_feature 1..20: note = CRISPR gRNA sequence
  source 1..20: mol_type = other DNA
caggtgtgcaccaccacgcc

SEQ ID NO: 67045 - DNA, 20 bp, synthetic construct
  misc_feature 1..20: note = CRISPR gRNA sequence
  source 1..20: mol_type = other DNA
gctaatttttttttcgtttt

SEQ ID NO: 67046 - DNA, 20 bp, synthetic construct
  misc_feature 1..20: note = CRISPR gRNA sequence
  source 1..20: mol_type = other DNA
atttttttttcgttttttgt

SEQ ID NO: 67047 - DNA, 20 bp, synthetic construct
  misc_feature 1..20: note = CRISPR gRNA sequence
  source 1..20: mol_type = other DNA
ttttttcgttttttgtagta

SEQ ID NO: 67048 - DNA, 20 bp, synthetic construct
  misc_feature 1..20: note = CRISPR gRNA sequence
  source 1..20: mol_type = other DNA
tttttcgttttttgtagtag

SEQ ID NO: 67049 - DNA, 20 bp, synthetic construct
  misc_feature 1..20: note = CRISPR gRNA sequence
  source 1..20: mol_type = other DNA
ttttcgttttttgtagtaga

SEQ ID NO: 67050 - DNA, 20 bp, synthetic construct
  misc_feature 1..20: note = CRISPR gRNA sequence
  source 1..20: mol_type = other DNA
tttcgttttttgtagtagag

SEQ ID NO: 67051 - DNA, 20 bp, synthetic construct
  misc_feature 1..20: note = CRISPR gRNA sequence
  source 1..20: mol_type = other DNA
ttcgttttttgtagtagagg

SEQ ID NO: 67052 - DNA, 20 bp, synthetic construct
  misc_feature 1..20: note = CRISPR gRNA sequence
  source 1..20: mol_type = other DNA
tcgttttttgtagtagaggt

SEQ ID NO: 67053 - DNA, 20 bp, synthetic construct
  misc_feature 1..20: note = CRISPR gRNA sequence
  source 1..20: mol_type = other DNA
cgttttttgtagtagaggtg

SEQ ID NO: 67054 - DNA, 20 bp, synthetic construct
  misc_feature 1..20: note = CRISPR gRNA sequence
  source 1..20: mol_type = other DNA
gttttttgtagtagaggtgg

SEQ ID NO: 67055 - DNA, 20 bp, synthetic construct
  misc_feature 1..20: note = CRISPR gRNA sequence
  source 1..20: mol_type = other DNA
tttgtagtagaggtggaatt

SEQ ID NO: 67056 - DNA, 20 bp, synthetic construct
  misc_feature 1..20: note = CRISPR gRNA sequence
  source 1..20: mol_type = other DNA
ttgtagtagaggtggaattt

SEQ ID NO: 67057 - DNA, 20 bp, synthetic construct
  misc_feature 1..20: note = CRISPR gRNA sequence
  source 1..20: mol_type = other DNA
tgtagtagaggtggaatttc

SEQ ID NO: 67058 - DNA, 20 bp, synthetic construct
  misc_feature 1..20: note = CRISPR gRNA sequence
  source 1..20: mol_type = other DNA
gtagtagaggtggaatttca

SEQ ID NO: 67059 - DNA, 20 bp, synthetic construct
  misc_feature 1..20: note = CRISPR gRNA sequence
  source 1..20: mol_type = other DNA
tagtagaggtggaatttcac

SEQ ID NO: 67060 - DNA, 20 bp, synthetic construct
  misc_feature 1..20: note = CRISPR gRNA sequence
  source 1..20: mol_type = other DNA
caccatgttgcccaggctgg

SEQ ID NO: 67061 - DNA, 20 bp, synthetic construct
  misc_feature 1..20: note = CRISPR gRNA sequence
  source 1..20: mol_type = other DNA
accatgttgcccaggctggt

SEQ ID NO: 67062 - DNA, 20 bp, synthetic construct
  misc_feature 1..20: note = CRISPR gRNA sequence
  source 1..20: mol_type = other DNA
cccaggctggtcccagactc

SEQ ID NO: 67063 - DNA, 20 bp, synthetic construct
  misc_feature 1..20: note = CRISPR gRNA sequence
  source 1..20: mol_type = other DNA
gtcccagactcctgacctca

SEQ ID NO: 67064 - DNA, 20 bp, synthetic construct
  misc_feature 1..20: note = CRISPR gRNA sequence
  source 1..20: mol_type = other DNA
ctgacctcagatgatccacc

SEQ ID NO: 67065 - DNA, 20 bp, synthetic construct
  misc_feature 1..20: note = CRISPR gRNA sequence
  source 1..20: mol_type = other DNA
acctcagatgatccacccac

SEQ ID NO: 67066 - DNA, 20 bp, synthetic construct
  misc_feature 1..20: note = CRISPR gRNA sequence
  source 1..20: mol_type = other DNA
agatgatccacccacctcag

SEQ ID NO: 67067 - DNA, 20 bp, synthetic construct
  misc_feature 1..20: note = CRISPR gRNA sequence
  source 1..20: mol_type = other DNA
agcctcccaaagtgctgcga

SEQ ID NO: 67068 - DNA, 20 bp, synthetic construct
  misc_feature 1..20: note = CRISPR gRNA sequence
  source 1..20: mol_type = other DNA
ccaaagtgctgcgattacag

SEQ ID NO: 67069 - DNA, 20 bp, synthetic construct
  misc_feature 1..20: note = CRISPR gRNA sequence
  source 1..20: mol_type = other DNA
cgattacaggcatgagccac

SEQ ID NO: 67070 - DNA, 20 bp, synthetic construct
  misc_feature 1..20: note = CRISPR gRNA sequence
  source 1..20: mol_type = other DNA
caggcatgagccaccatgcc

SEQ ID NO: 67071 - DNA, 20 bp, synthetic construct
  misc_feature 1..20: note = CRISPR gRNA sequence
  source 1..20: mol_type = other DNA
cattcttttcttaacaaaca

SEQ ID NO: 67072 - DNA, 20 bp, synthetic construct
  misc_feature 1..20: note = CRISPR gRNA sequence
  source 1..20: mol_type = other DNA
ttttcttaacaaacatgttt

SEQ ID NO: 67073 - DNA, 20 bp, synthetic construct
  misc_feature 1..20: note = CRISPR gRNA sequence
  source 1..20: mol_type = other DNA
ttcttaacaaacatgttttg

SEQ ID NO: 67074 - DNA, 20 bp, synthetic construct
  misc_feature 1..20: note = CRISPR gRNA sequence
  source 1..20: mol_type = other DNA
tcttaacaaacatgttttgc

SEQ ID NO: 67075 - DNA, 20 bp, synthetic construct
  misc_feature 1..20: note = CRISPR gRNA sequence
  source 1..20: mol_type = other DNA
cttaacaaacatgttttgcg

SEQ ID NO: 67076 - DNA, 20 bp, synthetic construct
  misc_feature 1..20: note = CRISPR gRNA sequence
  source 1..20: mol_type = other DNA
ttaacaaacatgttttgcgg

SEQ ID NO: 67077 - DNA, 20 bp, synthetic construct
  misc_feature 1..20: note = CRISPR gRNA sequence
  source 1..20: mol_type = other DNA
aacaaacatgttttgcggaa

SEQ ID NO: 67078 - DNA, 20 bp, synthetic construct
  misc_feature 1..20: note = CRISPR gRNA sequence
  source 1..20: mol_type = other DNA
acaaacatgttttgcggaac

SEQ ID NO: 67079 - DNA, 20 bp, synthetic construct
  misc_feature 1..20: note = CRISPR gRNA sequence
  source 1..20: mol_type = other DNA
tgcggaacactaaccttcat

SEQ ID NO: 67080 - DNA, 20 bp, synthetic construct
  misc_feature 1..20: note = CRISPR gRNA sequence
  source 1..20: mol_type = other DNA
gcggaacactaaccttcatg

SEQ ID NO: 67081 - DNA, 20 bp, synthetic construct
  misc_feature 1..20: note = CRISPR gRNA sequence
  source 1..20: mol_type = other DNA
cggaacactaaccttcatgg

SEQ ID NO: 67082 - DNA, 20 bp, synthetic construct
  misc_feature 1..20: note = CRISPR gRNA sequence
  source 1..20: mol_type = other DNA
accttcatggcccttaaaaa

SEQ ID NO: 67083 - DNA, 20 bp, synthetic construct
  misc_feature 1..20: note = CRISPR gRNA sequence
  source 1..20: mol_type = other DNA
catggcccttaaaaattaat

SEQ ID NO: 67084 - DNA, 20 bp, synthetic construct
  misc_feature 1..20: note = CRISPR gRNA sequence
  source 1..20: mol_type = other DNA
atggcccttaaaaattaatt

SEQ ID NO: 67085 - DNA, 20 bp, synthetic construct
  misc_feature 1..20: note = CRISPR gRNA sequence
  source 1..20: mol_type = other DNA
aaaaattaattctgctagtc

SEQ ID NO: 67086 - DNA, 20 bp, synthetic construct
  misc_feature 1..20: note = CRISPR gRNA sequence
  source 1..20: mol_type = other DNA
aaaattaattctgctagtcc

SEQ ID NO: 67087 - DNA, 20 bp, synthetic construct
  misc_feature 1..20: note = CRISPR gRNA sequence
  source 1..20: mol_type = other DNA
attctgctagtccatttagt

SEQ ID NO: 67088 - DNA, 20 bp, synthetic construct
  misc_feature 1..20: note = CRISPR gRNA sequence
  source 1..20: mol_type = other DNA
tgctagtccatttagtttgg

SEQ ID NO: 67089 - DNA, 20 bp, synthetic construct
  misc_feature 1..20: note = CRISPR gRNA sequence
  source 1..20: mol_type = other DNA
ctagtccatttagtttgggg

SEQ ID NO: 67090 - DNA, 20 bp, synthetic construct
  misc_feature 1..20: note = CRISPR gRNA sequence
  source 1..20: mol_type = other DNA
gtccatttagtttggggaaa

SEQ ID NO: 67091 - DNA, 20 bp, synthetic construct
  misc_feature 1..20: note = CRISPR gRNA sequence
  source 1..20: mol_type = other DNA
agtttggggaaaagtctgct

SEQ ID NO: 67092 - DNA, 20 bp, synthetic construct
  misc_feature 1..20: note = CRISPR gRNA sequence
  source 1..20: mol_type = other DNA
gtttggggaaaagtctgctg

SEQ ID NO: 67093 - DNA, 20 bp, synthetic construct
  misc_feature 1..20: note = CRISPR gRNA sequence
  source 1..20: mol_type = other DNA
ggggaaaagtctgctgtagc

SEQ ID NO: 67094 - DNA, 20 bp, synthetic construct
  misc_feature 1..20: note = CRISPR gRNA sequence
  source 1..20: mol_type = other DNA
gggaaaagtctgctgtagct

SEQ ID NO: 67095 - DNA, 20 bp, synthetic construct
  misc_feature 1..20: note = CRISPR gRNA sequence
  source 1..20: mol_type = other DNA
ctgtagctccttggaaattc

SEQ ID NO: 67096 - DNA, 20 bp, synthetic construct
  misc_feature 1..20: note = CRISPR gRNA sequence
  source 1..20: mol_type = other DNA
tagctccttggaaattcata

SEQ ID NO: 67097 - DNA, 20 bp, synthetic construct
  misc_feature 1..20: note = CRISPR gRNA sequence
  source 1..20: mol_type = other DNA
cttggaaattcataatgcac

SEQ ID NO: 67098 - DNA, 20 bp, synthetic construct
  misc_feature 1..20: note = CRISPR gRNA sequence
  source 1..20: mol_type = other DNA
ggaaattcataatgcacagc

SEQ ID NO: 67099 - DNA, 20 bp, synthetic construct
  misc_feature 1..20: note = CRISPR gRNA sequence
  source 1..20: mol_type = other DNA
gaaattcataatgcacagca

SEQ ID NO: 67100 - DNA, 20 bp, synthetic construct
  misc_feature 1..20: note = CRISPR gRNA sequence
  source 1..20: mol_type = other DNA
ataatgcacagcagcctatc

SEQ ID NO: 67101 - DNA, 20 bp, synthetic construct
  misc_feature 1..20: note = CRISPR gRNA sequence
  source 1..20: mol_type = other DNA
tcgcagcctcagagaagccc

SEQ ID NO: 67102 - DNA, 20 bp, synthetic construct
  misc_feature 1..20: note = CRISPR gRNA sequence
  source 1..20: mol_type = other DNA
agagaagccctgcagcaaac

SEQ ID NO: 67103 - DNA, 20 bp, synthetic construct
  misc_feature 1..20: note = CRISPR gRNA sequence
  source 1..20: mol_type = other DNA
cagcaaacaaaaccatttaa

SEQ ID NO: 67104 - DNA, 20 bp, synthetic construct
  misc_feature 1..20: note = CRISPR gRNA sequence
  source 1..20: mol_type = other DNA
aatttggcttaaccccgtat

SEQ ID NO: 67105 - DNA, 20 bp, synthetic construct
  misc_feature 1..20: note = CRISPR gRNA sequence
  source 1..20: mol_type = other DNA
atttggcttaaccccgtatt

SEQ ID NO: 67106 - DNA, 20 bp, synthetic construct
  misc_feature 1..20: note = CRISPR gRNA sequence
  source 1..20: mol_type = other DNA
ggcttaaccccgtatttccc

SEQ ID NO: 67107 - DNA, 20 bp, synthetic construct
  misc_feature 1..20: note = CRISPR gRNA sequence
  source 1..20: mol_type = other DNA
gcttaaccccgtatttccca

SEQ ID NO: 67108 - DNA, 20 bp, synthetic construct
  misc_feature 1..20: note = CRISPR gRNA sequence
  source 1..20: mol_type = other DNA
aaccccgtatttcccaaact

SEQ ID NO: 67109 - DNA, 20 bp, synthetic construct
  misc_feature 1..20: note = CRISPR gRNA sequence
  source 1..20: mol_type = other DNA
accccgtatttcccaaactt

SEQ ID NO: 67110 - DNA, 20 bp, synthetic construct
  misc_feature 1..20: note = CRISPR gRNA sequence
  source 1..20: mol_type = other DNA
cccaaacttaaaagaccttc

SEQ ID NO: 67111 - DNA, 20 bp, synthetic construct
  misc_feature 1..20: note = CRISPR gRNA sequence
  source 1..20: mol_type = other DNA
ccaaacttaaaagaccttcc

SEQ ID NO: 67112 - DNA, 20 bp, synthetic construct
  misc_feature 1..20: note = CRISPR gRNA sequence
  source 1..20: mol_type = other DNA
aaaagaccttcctcttcttc

SEQ ID NO: 67113 - DNA, 20 bp, synthetic construct
  misc_feature 1..20: note = CRISPR gRNA sequence
  source 1..20: mol_type = other DNA
aaagaccttcctcttcttcc

SEQ ID NO: 67114 - DNA, 20 bp, synthetic construct
  misc_feature 1..20: note = CRISPR gRNA sequence
  source 1..20: mol_type = other DNA
cctcttcttccagcctcacg

SEQ ID NO: 67115 - DNA, 20 bp, synthetic construct
  misc_feature 1..20: note = CRISPR gRNA sequence
  source 1..20: mol_type = other DNA
ctcttcttccagcctcacgg

SEQ ID NO: 67116 - DNA, 20 bp, synthetic construct
  misc_feature 1..20: note = CRISPR gRNA sequence
  source 1..20: mol_type = other DNA
ttcttccagcctcacggata

SEQ ID NO: 67117 - DNA, 20 bp, synthetic construct
  misc_feature 1..20: note = CRISPR gRNA sequence
  source 1..20: mol_type = other DNA
cttccagcctcacggataac

SEQ ID NO: 67118 - DNA, 20 bp, synthetic construct
  misc_feature 1..20: note = CRISPR gRNA sequence
  source 1..20: mol_type = other DNA
ttccagcctcacggataacc

SEQ ID NO: 67119 - DNA, 20 bp, synthetic construct
  misc_feature 1..20: note = CRISPR gRNA sequence
  source 1..20: mol_type = other DNA
ccagcctcacggataaccca

SEQ ID NO: 67120 - DNA, 20 bp, synthetic construct
  misc_feature 1..20: note = CRISPR gRNA sequence
  source 1..20: mol_type = other DNA
cagcctcacggataacccat

SEQ ID NO: 67121 - DNA, 20 bp, synthetic construct
  misc_feature 1..20: note = CRISPR gRNA sequence
  source 1..20: mol_type = other DNA
acggataacccatggaccca

SEQ ID NO: 67122 - DNA, 20 bp, synthetic construct
  misc_feature 1..20: note = CRISPR gRNA sequence
  source 1..20: mol_type = other DNA
ggagggaatgtttcaggtga

SEQ ID NO: 67123 - DNA, 20 bp, synthetic construct
  misc_feature 1..20: note = CRISPR gRNA sequence
  source 1..20: mol_type = other DNA
caggtgaccctggttaggtc

SEQ ID NO: 67124 - DNA, 20 bp, synthetic construct
  misc_feature 1..20: note = CRISPR gRNA sequence
  source 1..20: mol_type = other DNA
aggtgaccctggttaggtcc

SEQ ID NO: 67125 - DNA, 20 bp, synthetic construct
  misc_feature 1..20: note = CRISPR gRNA sequence
  source 1..20: mol_type = other DNA
gttaggtcccatctccagaa

SEQ ID NO: 67126 - DNA, 20 bp, synthetic construct
  misc_feature 1..20: note = CRISPR gRNA sequence
  source 1..20: mol_type = other DNA
ggtcccatctccagaaggct

SEQ ID NO: 67127 - DNA, 20 bp, synthetic construct
  misc_feature 1..20: note = CRISPR gRNA sequence
  source 1..20: mol_type = other DNA
cagaaggctctggctatgag

SEQ ID NO: 67128 - DNA, 20 bp, synthetic construct
  misc_feature 1..20: note = CRISPR gRNA sequence
  source 1..20: mol_type = other DNA
tggctatgaggccgtgctcc

SEQ ID NO: 67129 - DNA, 20 bp, synthetic construct
  misc_feature 1..20: note = CRISPR gRNA sequence
  source 1..20: mol_type = other DNA
gctatgaggccgtgctccct

SEQ ID NO: 67130 - DNA, 20 bp, synthetic construct
  misc_feature 1..20: note = CRISPR gRNA sequence
  source 1..20: mol_type = other DNA
tgaggccgtgctccctgctt

SEQ ID NO: 67131 - DNA, 20 bp, synthetic construct
  misc_feature 1..20: note = CRISPR gRNA sequence
  source 1..20: mol_type = other DNA
cctgctttcctggaaggttt

SEQ ID NO: 67132 - DNA, 20 bp, synthetic construct
  misc_feature 1..20: note = CRISPR gRNA sequence
  source 1..20: mol_type = other DNA
ctttcctggaaggtttcccc

SEQ ID NO: 67133 - DNA, 20 bp, synthetic construct
  misc_feature 1..20: note = CRISPR gRNA sequence
  source 1..20: mol_type = other DNA
tcctggaaggtttcccccac

SEQ ID NO: 67134 - DNA, 20 bp, synthetic construct
  misc_feature 1..20: note = CRISPR gRNA sequence
  source 1..20: mol_type = other DNA
cctggaaggtttcccccacc

SEQ ID NO: 67135 - DNA, 20 bp, synthetic construct
  misc_feature 1..20: note = CRISPR gRNA sequence
  source 1..20: mol_type = other DNA
ctggaaggtttcccccacct

SEQ ID NO: 67136 - DNA, 20 bp, synthetic construct
  misc_feature 1..20: note = CRISPR gRNA sequence
  source 1..20: mol_type = other DNA
gaaggtttcccccacctcat

SEQ ID NO: 67137 - DNA, 20 bp, synthetic construct
  misc_feature 1..20: note = CRISPR gRNA sequence
  source 1..20: mol_type = other DNA
cccccacctcatccacctgc

SEQ ID NO: 67138 - DNA, 20 bp, synthetic construct
  misc_feature 1..20: note = CRISPR gRNA sequence
  source 1..20: mol_type = other DNA
ccccacctcatccacctgct

SEQ ID NO: 67139 - DNA, 20 bp, synthetic construct
  misc_feature 1..20: note = CRISPR gRNA sequence
  source 1..20: mol_type = other DNA
atccacctgctttgtttcac

SEQ ID NO: 67140 - DNA, 20 bp, synthetic construct
  misc_feature 1..20: note = CRISPR gRNA sequence
  source 1..20: mol_type = other DNA
ctttgtttcacagattgtcc

SEQ ID NO: 67141 - DNA, 20 bp, synthetic construct
  misc_feature 1..20: note = CRISPR gRNA sequence
  source 1..20: mol_type = other DNA
tgtttcacagattgtcctgt

SEQ ID NO: 67142 - DNA, 20 bp, synthetic construct
  misc_feature 1..20: note = CRISPR gRNA sequence
  source 1..20: mol_type = other DNA
gtttcacagattgtcctgtg

SEQ ID NO: 67143 - DNA, 20 bp, synthetic construct
  misc_feature 1..20: note = CRISPR gRNA sequence
  source 1..20: mol_type = other DNA
tttcacagattgtcctgtga

SEQ ID NO: 67144 - DNA, 20 bp, synthetic construct
  misc_feature 1..20: note = CRISPR gRNA sequence
  source 1..20: mol_type = other DNA
cacagattgtcctgtgagtt

SEQ ID NO: 67145 - DNA, 20 bp, synthetic construct
  misc_feature 1..20: note = CRISPR gRNA sequence
  source 1..20: mol_type = other DNA
acagattgtcctgtgagttc

SEQ ID NO: 67146 - DNA, 20 bp, synthetic construct
  misc_feature 1..20: note = CRISPR gRNA sequence
  source 1..20: mol_type = other DNA
tcctgtgagttcctgagtga

SEQ ID NO: 67147 - DNA, 20 bp, synthetic construct
  misc_feature 1..20: note = CRISPR gRNA sequence
  source 1..20: mol_type = other DNA
tgagttcctgagtgaccaga

SEQ ID NO: 67148 - DNA, 20 bp, synthetic construct
  misc_feature 1..20: note = CRISPR gRNA sequence
  source 1..20: mol_type = other DNA
ctgagtgaccagagcctgga

SEQ ID NO: 67149 - DNA, 20 bp, synthetic construct
  misc_feature 1..20: note = CRISPR gRNA sequence
  source 1..20: mol_type = other DNA
agtgaccagagcctggagac

SEQ ID NO: 67150 - DNA, 20 bp, synthetic construct
  misc_feature 1..20: note = CRISPR gRNA sequence
  source 1..20: mol_type = other DNA
gagactctactggactgctt

SEQ ID NO: 67151 - DNA, 20 bp, synthetic construct
  misc_feature 1..20: note = CRISPR gRNA sequence
  source 1..20: mol_type = other DNA
tactggactgcttacctcaa

SEQ ID NO: 67152 - DNA, 20 bp, synthetic construct
  misc_feature 1..20: note = CRISPR gRNA sequence
  source 1..20: mol_type = other DNA
ctggactgcttacctcaact

SEQ ID NO: 67153 - DNA, 20 bp, synthetic construct
  misc_feature 1..20: note = CRISPR gRNA sequence
  source 1..20: mol_type = other DNA
gactgcttacctcaactccc

SEQ ID NO: 67154 - DNA, 20 bp, synthetic construct
  misc_feature 1..20: note = CRISPR gRNA sequence
  source 1..20: mol_type = other DNA
cttacctcaactccctcagc

SEQ ID NO: 67155 - DNA, 20 bp, synthetic construct
  misc_feature 1..20: note = CRISPR gRNA sequence
  source 1..20: mol_type = other DNA
acctcaactccctcagctga

SEQ ID NO: 67156 - DNA, 20 bp, synthetic construct
  misc_feature 1..20: note = CRISPR gRNA sequence
  source 1..20: mol_type = other DNA
cctcaactccctcagctgag

SEQ ID NO: 67157 - DNA, 20 bp, synthetic construct
  misc_feature 1..20: note = CRISPR gRNA sequence
  source 1..20: mol_type = other DNA
aactccctcagctgagcctg

SEQ ID NO: 67158 - DNA, 20 bp, synthetic construct
  misc_feature 1..20: note = CRISPR gRNA sequence
  source 1..20: mol_type = other DNA
cctcagctgagcctgctgca

SEQ ID NO: 67159 - DNA, 20 bp, synthetic construct
  misc_feature 1..20: note = CRISPR gRNA sequence
  source 1..20: mol_type = other DNA
agctgagcctgctgcagtaa

SEQ ID NO: 67160 - DNA, 20 bp, synthetic construct
  misc_feature 1..20: note = CRISPR gRNA sequence
  source 1..20: mol_type = other DNA
agcctgctgcagtaagacga

SEQ ID NO: 67161 - DNA, 20 bp, synthetic construct
  misc_feature 1..20: note = CRISPR gRNA sequence
  source 1..20: mol_type = other DNA
ctgcagtaagacgagagttt

SEQ ID NO: 67162 - DNA, 20 bp, synthetic construct
  misc_feature 1..20: note = CRISPR gRNA sequence
  source 1..20: mol_type = other DNA
cagtaagacgagagtttttc

SEQ ID NO: 67163 - DNA, 20 bp, synthetic construct
  misc_feature 1..20: note = CRISPR gRNA sequence
  source 1..20: mol_type = other DNA
ttcctatttcccggttcctt

SEQ ID NO: 67164 - DNA, 20 bp, synthetic construct
  misc_feature 1..20: note = CRISPR gRNA sequence
  source 1..20: mol_type = other DNA
tcctatttcccggttccttg

SEQ ID NO: 67165 - DNA, 20 bp, synthetic construct
  misc_feature 1..20: note = CRISPR gRNA sequence
  source 1..20: mol_type = other DNA
cctatttcccggttccttgt

SEQ ID NO: 67166 - DNA, 20 bp, synthetic construct
  misc_feature 1..20: note = CRISPR gRNA sequence
  source 1..20: mol_type = other DNA
ctatttcccggttccttgtg

SEQ ID NO: 67167 - DNA, 20 bp, synthetic construct
  misc_feature 1..20: note = CRISPR gRNA sequence
  source 1..20: mol_type = other DNA
tttcccggttccttgtgctc

SEQ ID NO: 67168 - DNA, 20 bp, synthetic construct
  misc_feature 1..20: note = CRISPR gRNA sequence
  source 1..20: mol_type = other DNA
cccggttccttgtgctcgtg

SEQ ID NO: 67169 - DNA, 20 bp, synthetic construct
  misc_feature 1..20: note = CRISPR gRNA sequence
  source 1..20: mol_type = other DNA
ccggttccttgtgctcgtgt

SEQ ID NO: 67170 - DNA, 20 bp, synthetic construct
  misc_feature 1..20: note = CRISPR gRNA sequence
  source 1..20: mol_type = other DNA
cttgtgctcgtgtttctaag

SEQ ID NO: 67171 - DNA, 20 bp, synthetic construct
  misc_feature 1..20: note = CRISPR gRNA sequence
  source 1..20: mol_type = other DNA
gtgctcgtgtttctaaggct

SEQ ID NO: 67172 - DNA, 20 bp, synthetic construct
  misc_feature 1..20: note = CRISPR gRNA sequence
  source 1..20: mol_type = other DNA
tgctcgtgtttctaaggctc

SEQ ID NO: 67173 - DNA, 20 bp, synthetic construct
  misc_feature 1..20: note = CRISPR gRNA sequence
  source 1..20: mol_type = other DNA
gtgtttctaaggctcctcca

SEQ ID NO: 67174 - DNA, 20 bp, synthetic construct
  misc_feature 1..20: note = CRISPR gRNA sequence
  source 1..20: mol_type = other DNA
ctaaggctcctccatggcaa

SEQ ID NO: 67175 - DNA, 20 bp, synthetic construct
  misc_feature 1..20: note = CRISPR gRNA sequence
  source 1..20: mol_type = other DNA
taaggctcctccatggcaaa

SEQ ID NO: 67176 - DNA, 20 bp, synthetic construct
  misc_feature 1..20: note = CRISPR gRNA sequence
  source 1..20: mol_type = other DNA
aggctcctccatggcaaagc

SEQ ID NO: 67177 - DNA, 20 bp, synthetic construct
  misc_feature 1..20: note = CRISPR gRNA sequence
  source 1..20: mol_type = other DNA
ctccatggcaaagctgtacc

SEQ ID NO: 67178 - DNA, 20 bp, synthetic construct
  misc_feature 1..20: note = CRISPR gRNA sequence
  source 1..20: mol_type = other DNA
catggcaaagctgtacctgc

SEQ ID NO: 67179 - DNA, 20 bp, synthetic construct
  misc_feature 1..20: note = CRISPR gRNA sequence
  source 1..20: mol_type = other DNA
tacctgccctctaacccctc

SEQ ID NO: 67180 - DNA, 20 bp, synthetic construct
  misc_feature 1..20: note = CRISPR gRNA sequence
  source 1..20: mol_type = other DNA
ccctctaacccctcaacccc

SEQ ID NO: 67181 - DNA, 20 bp, synthetic construct
  misc_feature 1..20: note = CRISPR gRNA sequence
  source 1..20: mol_type = other DNA
taacccctcaaccccccgcc

SEQ ID NO: 67182 - DNA, 20 bp, synthetic construct
  misc_feature 1..20: note = CRISPR gRNA sequence
  source 1..20: mol_type = other DNA
acccctcaaccccccgcctt

SEQ ID NO: 67183 - DNA, 20 bp, synthetic construct
  misc_feature 1..20: note = CRISPR gRNA sequence
  source 1..20: mol_type = other DNA
aaccccccgcctttaccccc

SEQ ID NO: 67184 - DNA, 20 bp, synthetic construct
  misc_feature 1..20: note = CRISPR gRNA sequence
  source 1..20: mol_type = other DNA
taccccctccaaccccctct

SEQ ID NO: 67185 - DNA, 20 bp, synthetic construct
  misc_feature 1..20: note = CRISPR gRNA sequence
  source 1..20: mol_type = other DNA
accccctccaaccccctcta

SEQ ID NO: 67186 - DNA, 20 bp, synthetic construct
  misc_feature 1..20: note = CRISPR gRNA sequence
  source 1..20: mol_type = other DNA
ccccctccaaccccctctac

SEQ ID NO: 67187 - DNA, 20 bp, synthetic construct
  misc_feature 1..20: note = CRISPR gRNA sequence
  source 1..20: mol_type = other DNA
caaccccctctacccgctcc

SEQ ID NO: 67188 - DNA, 20 bp, synthetic construct
  misc_feature 1..20: note = CRISPR gRNA sequence
  source 1..20: mol_type = other DNA
tacccgctccattctttcct

SEQ ID NO: 67189 - DNA, 20 bp, synthetic construct
  misc_feature 1..20: note = CRISPR gRNA sequence
  source 1..20: mol_type = other DNA
cccgctccattctttcctta

SEQ ID NO: 67190 - DNA, 20 bp, synthetic construct
  misc_feature 1..20: note = CRISPR gRNA sequence
  source 1..20: mol_type = other DNA
cattctttccttaggttgtt

SEQ ID NO: 67191 - DNA, 20 bp, synthetic construct
  misc_feature 1..20: note = CRISPR gRNA sequence
  source 1..20: mol_type = other DNA
tttccttaggttgttttatc

SEQ ID NO: 67192 - DNA, 20 bp, synthetic construct
  misc_feature 1..20: note = CRISPR gRNA sequence
  source 1..20: mol_type = other DNA
tccttaggttgttttatcat

SEQ ID NO: 67193 - DNA, 20 bp, synthetic construct
  misc_feature 1..20: note = CRISPR gRNA sequence
  source 1..20: mol_type = other DNA
ccttaggttgttttatcatt

SEQ ID NO: 67194 - DNA, 20 bp, synthetic construct
  misc_feature 1..20: note = CRISPR gRNA sequence
  source 1..20: mol_type = other DNA
cttaggttgttttatcattt

SEQ ID NO: 67195 - DNA, 20 bp, synthetic construct
  misc_feature 1..20: note = CRISPR gRNA sequence
  source 1..20: mol_type = other DNA
aggttgttttatcattttac

SEQ ID NO: 67196 - DNA, 20 bp, synthetic construct
  misc_feature 1..20: note = CRISPR gRNA sequence
  source 1..20: mol_type = other DNA
ggttgttttatcattttacc

SEQ ID NO: 67197 - DNA, 20 bp, synthetic construct
  misc_feature 1..20: note = CRISPR gRNA sequence
  source 1..20: mol_type = other DNA
ttttatcattttacctggca

SEQ ID NO: 67198 - DNA, 20 bp, synthetic construct
  misc_feature 1..20: note = CRISPR gRNA sequence
  source 1..20: mol_type = other DNA
tatcattttacctggcacaa

SEQ ID NO: 67199 - DNA, 20 bp, synthetic construct
  misc_feature 1..20: note = CRISPR gRNA sequence
  source 1..20: mol_type = other DNA
atcattttacctggcacaac

SEQ ID NO: 67200 - DNA, 20 bp, synthetic construct
  misc_feature 1..20: note = CRISPR gRNA sequence
  source 1..20: mol_type = other DNA
tcattttacctggcacaact

SEQ ID NO: 67201 - DNA, 20 bp, synthetic construct
  misc_feature 1..20: note = CRISPR gRNA sequence
  source 1..20: mol_type = other DNA
tacctggcacaactggggac

SEQ ID NO: 67202 - DNA, 20 bp, synthetic construct
  misc_feature 1..20: note = CRISPR gRNA sequence
  source 1..20: mol_type = other DNA
acctggcacaactggggact

SEQ ID NO: 67203 - DNA, 20 bp, synthetic construct
  misc_feature 1..20: note = CRISPR gRNA sequence
  source 1..20: mol_type = other DNA
cctggcacaactggggactc

SEQ ID NO: 67204 - DNA, 20 bp, synthetic construct
  misc_feature 1..20: note = CRISPR gRNA sequence
  source 1..20: mol_type = other DNA
gcacaactggggactccaat

SEQ ID NO: 67205 - DNA, 20 bp, synthetic construct
  misc_feature 1..20: note = CRISPR gRNA sequence
  source 1..20: mol_type = other DNA
gggactccaatctgcttcca

SEQ ID NO: 67206 - DNA, 20 bp, synthetic construct
  misc_feature 1..20: note = CRISPR gRNA sequence
  source 1..20: mol_type = other DNA
caatctgcttccagctccac

SEQ ID NO: 67207 - DNA, 20 bp, synthetic construct
  misc_feature 1..20: note = CRISPR gRNA sequence
  source 1..20: mol_type = other DNA
cttccagctccaccctaata

SEQ ID NO: 67208 - DNA, 20 bp, synthetic construct
  misc_feature 1..20: note = CRISPR gRNA sequence
  source 1..20: mol_type = other DNA
ccagctccaccctaatactt

SEQ ID NO: 67209 - DNA, 20 bp, synthetic construct
  misc_feature 1..20: note = CRISPR gRNA sequence
  source 1..20: mol_type = other DNA
cagctccaccctaatacttt

SEQ ID NO: 67210 - DNA, 20 bp, synthetic construct
  misc_feature 1..20: note = CRISPR gRNA sequence
  source 1..20: mol_type = other DNA
caccctaatactttgtcaac

SEQ ID NO: 67211 - DNA, 20 bp, synthetic construct
  misc_feature 1..20: note = CRISPR gRNA sequence
  source 1..20: mol_type = other DNA
atactttgtcaacctcaggg

SEQ ID NO: 67212 - DNA, 20 bp, synthetic construct
  misc_feature 1..20: note = CRISPR gRNA sequence
  source 1..20: mol_type = other DNA
tgtcaacctcagggggcgtc

SEQ ID NO: 67213 - DNA, 20 bp, synthetic construct
  misc_feature 1..20: note = CRISPR gRNA sequence
  source 1..20: mol_type = other DNA
gtcaacctcagggggcgtcg

SEQ ID NO: 67214 - DNA, 20 bp, synthetic construct
  misc_feature 1..20: note = CRISPR gRNA sequence
  source 1..20: mol_type = other DNA
tcaacctcagggggcgtcgt

SEQ ID NO: 67215 - DNA, 20 bp, synthetic construct
  misc_feature 1..20: note = CRISPR gRNA sequence
  source 1..20: mol_type = other DNA
agggggcgtcgtttgcctcc

SEQ ID NO: 67216 - DNA, 20 bp, synthetic construct
  misc_feature 1..20: note = CRISPR gRNA sequence
  source 1..20: mol_type = other DNA
gcctcctctgcgtctcagtt

SEQ ID NO: 67217 - DNA, 20 bp, synthetic construct
  misc_feature 1..20: note = CRISPR gRNA sequence
  source 1..20: mol_type = other DNA
cctcctctgcgtctcagttt

SEQ ID NO: 67218 - DNA, 20 bp, synthetic construct
  misc_feature 1..20: note = CRISPR gRNA sequence
  source 1..20: mol_type = other DNA
ctctgcgtctcagtttcctc

SEQ ID NO: 67219 - DNA, 20 bp, synthetic construct
  misc_feature 1..20: note = CRISPR gRNA sequence
  source 1..20: mol_type = other DNA
tgcgtctcagtttcctcatc

SEQ ID NO: 67220 - DNA, 20 bp, synthetic construct
  misc_feature 1..20: note = CRISPR gRNA sequence
  source 1..20: mol_type = other DNA
cgtctcagtttcctcatctg

SEQ ID NO: 67221 - DNA, 20 bp, synthetic construct
  misc_feature 1..20: note = CRISPR gRNA sequence
  source 1..20: mol_type = other DNA
agtttcctcatctgacaaat

SEQ ID NO: 67222 - DNA, 20 bp, synthetic construct
  misc_feature 1..20: note = CRISPR gRNA sequence
  source 1..20: mol_type = other DNA
cctcatctgacaaatgggat

SEQ ID NO: 67223 - DNA, 20 bp, synthetic construct
  misc_feature 1..20: note = CRISPR gRNA sequence
  source 1..20: mol_type = other DNA
ctcatctgacaaatgggatt

SEQ ID NO: 67224 - DNA, 20 bp, synthetic construct
  misc_feature 1..20: note = CRISPR gRNA sequence
  source 1..20: mol_type = other DNA
atctgacaaatgggattaat

SEQ ID NO: 67225 - DNA, 20 bp, synthetic construct
  misc_feature 1..20: note = CRISPR gRNA sequence
  source 1..20: mol_type = other DNA
acaaatgggattaatattcc

SEQ ID NO: 67226 - DNA, 20 bp, synthetic construct
  misc_feature 1..20: note = CRISPR gRNA sequence
  source 1..20: mol_type = other DNA
atattccccgcccattcccc

SEQ ID NO: 67227 - DNA, 20 bp, synthetic construct
  misc_feature 1..20: note = CRISPR gRNA sequence
  source 1..20: mol_type = other DNA
cccgcccattcccccagagt

SEQ ID NO: 67228 - DNA, 20 bp, synthetic construct
  misc_feature 1..20: note = CRISPR gRNA sequence
  source 1..20: mol_type = other DNA
ccccagagttgggactcaaa

SEQ ID NO: 67229 - DNA, 20 bp, synthetic construct
  misc_feature 1..20: note = CRISPR gRNA sequence
  source 1..20: mol_type = other DNA
ggactcaaataagttattct

SEQ ID NO: 67230 - DNA, 20 bp, synthetic construct
  misc_feature 1..20: note = CRISPR gRNA sequence
  source 1..20: mol_type = other DNA
aaataagttattctaaaatc

SEQ ID NO: 67231 - DNA, 20 bp, synthetic construct
  misc_feature 1..20: note = CRISPR gRNA sequence
  source 1..20: mol_type = other DNA
ttctaaaatcaccttaagaa

SEQ ID NO: 67232 - DNA, 20 bp, synthetic construct
  misc_feature 1..20: note = CRISPR gRNA sequence
  source 1..20: mol_type = other DNA
taaaatcaccttaagaaatg

SEQ ID NO: 67233 - DNA, 20 bp, synthetic construct
  misc_feature 1..20: note = CRISPR gRNA sequence
  source 1..20: mol_type = other DNA
aaatcaccttaagaaatgga

SEQ ID NO: 67234 - DNA, 20 bp, synthetic construct
  misc_feature 1..20: note = CRISPR gRNA sequence
  source 1..20: mol_type = other DNA
aagaaatggaagatctgtga

SEQ ID NO: 67235 - DNA, 20 bp, synthetic construct
  misc_feature 1..20: note = CRISPR gRNA sequence
  source 1..20: mol_type = other DNA
agaaatggaagatctgtgac

SEQ ID NO: 67236 - DNA, 20 bp, synthetic construct
  misc_feature 1..20: note = CRISPR gRNA sequence
  source 1..20: mol_type = other DNA
tgacaaatgagctgtccaac

SEQ ID NO: 67237 - DNA, 20 bp, synthetic construct
  misc_feature 1..20: note = CRISPR gRNA sequence
  source 1..20: mol_type = other DNA
tccaacttctccccacccac

SEQ ID NO: 67238 - DNA, 20 bp, synthetic construct
  misc_feature 1..20: note = CRISPR gRNA sequence
  source 1..20: mol_type = other DNA
ctccccacccacggagggtc

SEQ ID NO: 67239 - DNA, 20 bp, synthetic construct
  misc_feature 1..20: note = CRISPR gRNA sequence
  source 1..20: mol_type = other DNA
tccccacccacggagggtca

SEQ ID NO: 67240 - DNA, 20 bp, synthetic construct
  misc_feature 1..20: note = CRISPR gRNA sequence
  source 1..20: mol_type = other DNA
cccacccacggagggtcacc

SEQ ID NO: 67241 - DNA, 20 bp, synthetic construct
  misc_feature 1..20: note = CRISPR gRNA sequence
  source 1..20: mol_type = other DNA
gtagaaaggggctgtacaga

SEQ ID NO: 67242 - DNA, 20 bp, synthetic construct
  misc_feature 1..20: note = CRISPR gRNA sequence
  source 1..20: mol_type = other DNA
tacagatgtaggtcctgtac

SEQ ID NO: 67243 - DNA, 20 bp, synthetic construct
  misc_feature 1..20: note = CRISPR gRNA sequence
  source 1..20: mol_type = other DNA
tacttatcacatgctgcttt

SEQ ID NO: 67244 - DNA, 20 bp, synthetic construct
  misc_feature 1..20: note = CRISPR gRNA sequence
  source 1..20: mol_type = other DNA
atcacatgctgctttttaaa

SEQ ID NO: 67245 - DNA, 20 bp, synthetic construct
  misc_feature 1..20: note = CRISPR gRNA sequence
  source 1..20: mol_type = other DNA
tcacatgctgctttttaaag

SEQ ID NO: 67246 - DNA, 20 bp, synthetic construct
  misc_feature 1..20: note = CRISPR gRNA sequence
  source 1..20: mol_type = other DNA
ctttttaaaggtcaccgtca

SEQ ID NO: 67247 - DNA, 20 bp, synthetic construct
  misc_feature 1..20: note = CRISPR gRNA sequence
  source 1..20: mol_type = other DNA
tttaaaggtcaccgtcaaac

SEQ ID NO: 67248 - DNA, 20 bp, synthetic construct
  misc_feature 1..20: note = CRISPR gRNA sequence
  source 1..20: mol_type = other DNA
ttaaaggtcaccgtcaaact

SEQ ID NO: 67249 - DNA, 20 bp, synthetic construct
  misc_feature 1..20: note = CRISPR gRNA sequence
  source 1..20: mol_type = other DNA
taaaggtcaccgtcaaactc

SEQ ID NO: 67250 - DNA, 20 bp, synthetic construct
  misc_feature 1..20: note = CRISPR gRNA sequence
  source 1..20: mol_type = other DNA
aaaggtcaccgtcaaactcg

SEQ ID NO: 67251 - DNA, 20 bp, synthetic construct
  misc_feature 1..20: note = CRISPR gRNA sequence
  source 1..20: mol_type = other DNA
aaggtcaccgtcaaactcgc

SEQ ID NO: 67252 - DNA, 20 bp, synthetic construct
  misc_feature 1..20: note = CRISPR gRNA sequence
  source 1..20: mol_type = other DNA
gcaaaaagggaatttaagca

SEQ ID NO: 67253 - DNA, 20 bp, synthetic construct
  misc_feature 1..20: note = CRISPR gRNA sequence
  source 1..20: mol_type = other DNA
aagcagaattcccccaaagt

SEQ ID NO: 67254 - DNA, 20 bp, synthetic construct
  misc_feature 1..20: note = CRISPR gRNA sequence
  source 1..20: mol_type = other DNA
agcagaattcccccaaagta

SEQ ID NO: 67255 - DNA, 20 bp, synthetic construct
  misc_feature 1..20: note = CRISPR gRNA sequence
  source 1..20: mol_type = other DNA
ccccaaagtattaaaactat

SEQ ID NO: 67256 - DNA, 20 bp, synthetic construct
  misc_feature 1..20: note = CRISPR gRNA sequence
  source 1..20: mol_type = other DNA
aaactattttctaatttcag

SEQ ID NO: 67257 - DNA, 20 bp, synthetic construct
  misc_feature 1..20: note = CRISPR gRNA sequence
  source 1..20: mol_type = other DNA
ttttctaatttcagctcaga

SEQ ID NO: 67258 - DNA, 20 bp, synthetic construct
  misc_feature 1..20: note = CRISPR gRNA sequence
  source 1..20: mol_type = other DNA
tctaatttcagctcagactg

SEQ ID NO: 67259 - DNA, 20 bp, synthetic construct
  misc_feature 1..20: note = CRISPR gRNA sequence
  source 1..20: mol_type = other DNA
ctaatttcagctcagactgg

SEQ ID NO: 67260 - DNA, 20 bp, synthetic construct
  misc_feature 1..20: note = CRISPR gRNA sequence
  source 1..20: mol_type = other DNA
taatttcagctcagactggt

SEQ ID NO: 67261 - DNA, 20 bp, synthetic construct
  misc_feature 1..20: note = CRISPR gRNA sequence
  source 1..20: mol_type = other DNA
atttcagctcagactggtta

SEQ ID NO: 67262 - DNA, 20 bp, synthetic construct
  misc_feature 1..20: note = CRISPR gRNA sequence
  source 1..20: mol_type = other DNA
cagctcagactggttagaat

SEQ ID NO: 67263 - DNA, 20 bp, synthetic construct
  misc_feature 1..20: note = CRISPR gRNA sequence
  source 1..20: mol_type = other DNA
agctcagactggttagaatt

SEQ ID NO: 67264 - DNA, 20 bp, synthetic construct
  misc_feature 1..20: note = CRISPR gRNA sequence
  source 1..20: mol_type = other DNA
agactggttagaattttaaa

SEQ ID NO: 67265 - DNA, 20 bp, synthetic construct
  misc_feature 1..20: note = CRISPR gRNA sequence
  source 1..20: mol_type = other DNA
gttagaattttaaaagtatt

SEQ ID NO: 67266 - DNA, 20 bp, synthetic construct
  misc_feature 1..20: note = CRISPR gRNA sequence
  source 1..20: mol_type = other DNA
gaattttaaaagtatttagg

SEQ ID NO: 67267 - DNA, 20 bp, synthetic construct
  misc_feature 1..20: note = CRISPR gRNA sequence
  source 1..20: mol_type = other DNA
taaaagtatttaggccatgt

SEQ ID NO: 67268 - DNA, 20 bp, synthetic construct
  misc_feature 1..20: note = CRISPR gRNA sequence
  source 1..20: mol_type = other DNA
aaaagtatttaggccatgtg

SEQ ID NO: 67269 - DNA, 20 bp, synthetic construct
  misc_feature 1..20: note = CRISPR gRNA sequence
  source 1..20: mol_type = other DNA
aaagtatttaggccatgtgt

SEQ ID NO: 67270 - DNA, 20 bp, synthetic construct
  misc_feature 1..20: note = CRISPR gRNA sequence
  source 1..20: mol_type = other DNA
aggccatgtgtggtggctca

SEQ ID NO: 67271 - DNA, 20 bp, synthetic construct
  misc_feature 1..20: note = CRISPR gRNA sequence
  source 1..20: mol_type = other DNA
ggccatgtgtggtggctcat

SEQ ID NO: 67272 - DNA, 20 bp, synthetic construct
  misc_feature 1..20: note = CRISPR gRNA sequence
  source 1..20: mol_type = other DNA
atgcctgtaatcccggcact

SEQ ID NO: 67273 - DNA, 20 bp, synthetic construct
  misc_feature 1..20: note = CRISPR gRNA sequence
  source 1..20: mol_type = other DNA
taatcccggcactttgggag

SEQ ID NO: 67274 - DNA, 20 bp, synthetic construct
  misc_feature 1..20: note = CRISPR gRNA sequence
  source 1..20: mol_type = other DNA
tgggaggccgaggcgggcag

SEQ ID NO: 67275 - DNA, 20 bp, synthetic construct
  misc_feature 1..20: note = CRISPR gRNA sequence
  source 1..20: mol_type = other DNA
gggaggccgaggcgggcaga

SEQ ID NO: 67276 - DNA, 20 bp, synthetic construct
  misc_feature 1..20: note = CRISPR gRNA sequence
  source 1..20: mol_type = other DNA
ggaggccgaggcgggcagat

SEQ ID NO: 67277 - DNA, 20 bp, synthetic construct
  misc_feature 1..20: note = CRISPR gRNA sequence
  source 1..20: mol_type = other DNA
aggtcaggagtttgagacca

SEQ ID NO: 67278 - DNA, 20 bp, synthetic construct
  misc_feature 1..20: note = CRISPR gRNA sequence
  source 1..20: mol_type = other DNA
gagaccagcctggccaatgt

SEQ ID NO: 67279 - DNA, 20 bp, synthetic construct
  misc_feature 1..20: note = CRISPR gRNA sequence
  source 1..20: mol_type = other DNA
agaccagcctggccaatgtg

SEQ ID NO: 67280 - DNA, 20 bp, synthetic construct
  misc_feature 1..20: note = CRISPR gRNA sequence
  source 1..20: mol_type = other DNA
gccaatgtggtgaaaccccg

SEQ ID NO: 67281 - DNA, 20 bp, synthetic construct
  misc_feature 1..20: note = CRISPR gRNA sequence
  source 1..20: mol_type = other DNA
tactaaaaatacaaaaatta

SEQ ID NO: 67282 - DNA, 20 bp, synthetic construct
  misc_feature 1..20: note = CRISPR gRNA sequence
  source 1..20: mol_type = other DNA
ctaaaaatacaaaaattagc

SEQ ID NO: 67283 - DNA, 20 bp, synthetic construct
  misc_feature 1..20: note = CRISPR gRNA sequence
  source 1..20: mol_type = other DNA
aaaatacaaaaattagcccg

SEQ ID NO: 67284 - DNA, 20 bp, synthetic construct
  misc_feature 1..20: note = CRISPR gRNA sequence
  source 1..20: mol_type = other DNA
gcccggtgtggtggtgggtg

SEQ ID NO: 67285 - DNA, 20 bp, synthetic construct
  misc_feature 1..20: note = CRISPR gRNA sequence
  source 1..20: mol_type = other DNA
taattccagctacttgggag

SEQ ID NO: 67286 - DNA, 20 bp, synthetic construct
  misc_feature 1..20: note = CRISPR gRNA sequence
  source 1..20: mol_type = other DNA
cagctacttgggaggctgag

SEQ ID NO: 67287 - DNA, 20 bp, synthetic construct
  misc_feature 1..20: note = CRISPR gRNA sequence
  source 1..20: mol_type = other DNA
cttgggaggctgaggcagga

SEQ ID NO: 67288 - DNA, 20 bp, synthetic construct
  misc_feature 1..20: note = CRISPR gRNA sequence
  source 1..20: mol_type = other DNA
gggaggctgaggcaggagaa

SEQ ID NO: 67289 - DNA, 20 bp, synthetic construct
  misc_feature 1..20: note = CRISPR gRNA sequence
  source 1..20: mol_type = other DNA
ggaggctgaggcaggagaat

SEQ ID NO: 67290 - DNA, 20 bp, synthetic construct
  misc_feature 1..20: note = CRISPR gRNA sequence
  source 1..20: mol_type = other DNA
aggcaggagaattgcttgaa

SEQ ID NO: 67291 - DNA, 20 bp, synthetic construct
  misc_feature 1..20: note = CRISPR gRNA sequence
  source 1..20: mol_type = other DNA
cttgaacttgggaggcggag

SEQ ID NO: 67292 - DNA, 20 bp, synthetic construct
  misc_feature 1..20: note = CRISPR gRNA sequence
  source 1..20: mol_type = other DNA
gaacttgggaggcggaggtt

SEQ ID NO: 67293 - DNA, 20 bp, synthetic construct
  misc_feature 1..20: note = CRISPR gRNA sequence
  source 1..20: mol_type = other DNA
aacttgggaggcggaggttg

SEQ ID NO: 67294 - DNA, 20 bp, synthetic construct
  misc_feature 1..20: note = CRISPR gRNA sequence
  source 1..20: mol_type = other DNA
gggaggcggaggttgcagtg

SEQ ID NO: 67295 - DNA, 20 bp, synthetic construct
  misc_feature 1..20: note = CRISPR gRNA sequence
  source 1..20: mol_type = other DNA
ggaggcggaggttgcagtga

SEQ ID NO: 67296 - DNA, 20 bp, synthetic construct
  misc_feature 1..20: note = CRISPR gRNA sequence
  source 1..20: mol_type = other DNA
cagtgagccgagatcgcgcc

SEQ ID NO: 67297 - DNA, 20 bp, synthetic construct
  misc_feature 1..20: note = CRISPR gRNA sequence
  source 1..20: mol_type = other DNA
cactccagcttgggcgacaa

SEQ ID NO: 67298 - DNA, 20 bp, synthetic construct
  misc_feature 1..20: note = CRISPR gRNA sequence
  source 1..20: mol_type = other DNA
cagcttgggcgacaagagtg

SEQ ID NO: 67299 - DNA, 20 bp, synthetic construct
  misc_feature 1..20: note = CRISPR gRNA sequence
  source 1..20: mol_type = other DNA
gggcgacaagagtgaaactc

SEQ ID NO: 67300 - DNA, 20 bp, synthetic construct
  misc_feature 1..20: note = CRISPR gRNA sequence
  source 1..20: mol_type = other DNA
ggcgacaagagtgaaactcc

SEQ ID NO: 67301 - DNA, 20 bp, synthetic construct
  misc_feature 1..20: note = CRISPR gRNA sequence
  source 1..20: mol_type = other DNA
catctcagaaaaaaaaaaag

SEQ ID NO: 67302 - DNA, 20 bp, synthetic construct
  misc_feature 1..20: note = CRISPR gRNA sequence
  source 1..20: mol_type = other DNA
agaaaaaaaaaaagaaaaaa

SEQ ID NO: 67303 - DNA, 20 bp, synthetic construct
  misc_feature 1..20: note = CRISPR gRNA sequence
  source 1..20: mol_type = other DNA
tagaaggatttactttaaac

SEQ ID NO: 67304 - DNA, 20 bp, synthetic construct
  misc_feature 1..20: note = CRISPR gRNA sequence
  source 1..20: mol_type = other DNA
agaaggatttactttaaaca

SEQ ID NO: 67305 - DNA, 20 bp, synthetic construct
  misc_feature 1..20: note = CRISPR gRNA sequence
  source 1..20: mol_type = other DNA
gaaggatttactttaaacag

SEQ ID NO: 67306 - DNA, 20 bp, synthetic construct
  misc_feature 1..20: note = CRISPR gRNA sequence
  source 1..20: mol_type = other DNA
actttaaacagtcttctagt

SEQ ID NO: 67307 - DNA, 20 bp, synthetic construct
  misc_feature 1..20: note = CRISPR gRNA sequence
  source 1..20: mol_type = other DNA
ctttaaacagtcttctagtg

SEQ ID NO: 67308 - DNA, 20 bp, synthetic construct
  misc_feature 1..20: note = CRISPR gRNA sequence
  source 1..20: mol_type = other DNA
taaacagtcttctagtggtg

SEQ ID NO: 67309 - DNA, 20 bp, synthetic construct
  misc_feature 1..20: note = CRISPR gRNA sequence
  source 1..20: mol_type = other DNA
aaacagtcttctagtggtgg

SEQ ID NO: 67310 - DNA, 20 bp, synthetic construct
  misc_feature 1..20: note = CRISPR gRNA sequence
  source 1..20: mol_type = other DNA
aacagtcttctagtggtggg

SEQ ID NO: 67311 - DNA, 20 bp, synthetic construct
  misc_feature 1..20: note = CRISPR gRNA sequence
  source 1..20: mol_type = other DNA
ctagtggtgggaggcggggt

SEQ ID NO: 67312 - DNA, 20 bp, synthetic construct
  misc_feature 1..20: note = CRISPR gRNA sequence
  source 1..20: mol_type = other DNA
tagtggtgggaggcggggtg

SEQ ID NO: 67313 - DNA, 20 bp, synthetic construct
  misc_feature 1..20: note = CRISPR gRNA sequence
  source 1..20: mol_type = other DNA
gtggtgggaggcggggtggg

SEQ ID NO: 67314 - DNA, 20 bp, synthetic construct
  misc_feature 1..20: note = CRISPR gRNA sequence
  source 1..20: mol_type = other DNA
cagctaagatgaaaaaatac

SEQ ID NO: 67315 - DNA, 20 bp, synthetic construct
  misc_feature 1..20: note = CRISPR gRNA sequence
  source 1..20: mol_type = other DNA
agatgaaaaaatacagcagg

SEQ ID NO: 67316 - DNA, 20 bp, synthetic construct
  misc_feature 1..20: note = CRISPR gRNA sequence
  source 1..20: mol_type = other DNA
ataacatcggtgcaaaggct

SEQ ID NO: 67317 - DNA, 20 bp, synthetic construct
  misc_feature 1..20: note = CRISPR gRNA sequence
  source 1..20: mol_type = other DNA
gggctctctgggatgtctaa

SEQ ID NO: 67318 - DNA, 20 bp, synthetic construct
  misc_feature 1..20: note = CRISPR gRNA sequence
  source 1..20: mol_type = other DNA
tctgggatgtctaagatggc

SEQ ID NO: 67319 - DNA, 20 bp, synthetic construct
  misc_feature 1..20: note = CRISPR gRNA sequence
  source 1..20: mol_type = other DNA
tgggatgtctaagatggctc

SEQ ID NO: 67320 - DNA, 20 bp, synthetic construct
  misc_feature 1..20: note = CRISPR gRNA sequence
  source 1..20: mol_type = other DNA
ggatgtctaagatggctcgc

SEQ ID NO: 67321 - DNA, 20 bp, synthetic construct
  misc_feature 1..20: note = CRISPR gRNA sequence
  source 1..20: mol_type = other DNA
agatggctcgcatcacctcc

SEQ ID NO: 67322 - DNA, 20 bp, synthetic construct
  misc_feature 1..20: note = CRISPR gRNA sequence
  source 1..20: mol_type = other DNA
gcatcacctccaggatctcg

SEQ ID NO: 67323 - DNA, 20 bp, synthetic construct
  misc_feature 1..20: note = CRISPR gRNA sequence
  source 1..20: mol_type = other DNA
caggatctcgcttatgcttg

SEQ ID NO: 67324 - DNA, 20 bp, synthetic construct
  misc_feature 1..20: note = CRISPR gRNA sequence
  source 1..20: mol_type = other DNA
gcttatgcttgggttttatc

SEQ ID NO: 67325 - DNA, 20 bp, synthetic construct
  misc_feature 1..20: note = CRISPR gRNA sequence
  source 1..20: mol_type = other DNA
atgcttgggttttatctggg

SEQ ID NO: 67326 - DNA, 20 bp, synthetic construct
  misc_feature 1..20: note = CRISPR gRNA sequence
  source 1..20: mol_type = other DNA
tgcttgggttttatctggga

SEQ ID NO: 67327 - DNA, 20 bp, synthetic construct
  misc_feature 1..20: note = CRISPR gRNA sequence
  source 1..20: mol_type = other DNA
gggttttatctgggagggag

SEQ ID NO: 67328 - DNA, 20 bp, synthetic construct
  misc_feature 1..20: note = CRISPR gRNA sequence
  source 1..20: mol_type = other DNA
ggttttatctgggagggagg

SEQ ID NO: 67329 - DNA, 20 bp, synthetic construct
  misc_feature 1..20: note = CRISPR gRNA sequence
  source 1..20: mol_type = other DNA
tatctgggagggagggagga

SEQ ID NO: 67330 - DNA, 20 bp, synthetic construct
  misc_feature 1..20: note = CRISPR gRNA sequence
  source 1..20: mol_type = other DNA
atctgggagggagggaggag

SEQ ID NO: 67331 - DNA, 20 bp, synthetic construct
  misc_feature 1..20: note = CRISPR gRNA sequence
  source 1..20: mol_type = other DNA
tctgggagggagggaggaga

SEQ ID NO: 67332 - DNA, 20 bp, synthetic construct
  misc_feature 1..20: note = CRISPR gRNA sequence
  source 1..20: mol_type = other DNA
ggagggagggaggagacgtg

SEQ ID NO: 67333 - DNA, 20 bp, synthetic construct
  misc_feature 1..20: note = CRISPR gRNA sequence
  source 1..20: mol_type = other DNA
caggggcaagtacagcccag

SEQ ID NO: 67334 - DNA, 20 bp, synthetic construct
  misc_feature 1..20: note = CRISPR gRNA sequence
  source 1..20: mol_type = other DNA
acagcaccccatggcaccct

SEQ ID NO: 67335 - DNA, 20 bp, synthetic construct
  misc_feature 1..20: note = CRISPR gRNA sequence
  source 1..20: mol_type = other DNA
taatagtcccaccctgcccg

SEQ ID NO: 67336 - DNA, 20 bp, synthetic construct
  misc_feature 1..20: note = CRISPR gRNA sequence
  source 1..20: mol_type = other DNA
cccggagataatgagtcaga

SEQ ID NO: 67337 - DNA, 20 bp, synthetic construct
  misc_feature 1..20: note = CRISPR gRNA sequence
  source 1..20: mol_type = other DNA
ctttggacataaaaggtggc

SEQ ID NO: 67338 - DNA, 20 bp, synthetic construct
  misc_feature 1..20: note = CRISPR gRNA sequence
  source 1..20: mol_type = other DNA
tggacataaaaggtggcagg

SEQ ID NO: 67339 - DNA, 20 bp, synthetic construct
  misc_feature 1..20: note = CRISPR gRNA sequence
  source 1..20: mol_type = other DNA
ggacataaaaggtggcaggt

SEQ ID NO: 67340 - DNA, 20 bp, synthetic construct
  misc_feature 1..20: note = CRISPR gRNA sequence
  source 1..20: mol_type = other DNA
gacataaaaggtggcaggtt

SEQ ID NO: 67341 - DNA, 20 bp, synthetic construct
  misc_feature 1..20: note = CRISPR gRNA sequence
  source 1..20: mol_type = other DNA
aaattgaacaggttggaaac

SEQ ID NO: 67342 - DNA, 20 bp, synthetic construct
  misc_feature 1..20: note = CRISPR gRNA sequence
  source 1..20: mol_type = other DNA
aacaggttggaaacctcaga

SEQ ID NO: 67343 - DNA, 20 bp, synthetic construct
  misc_feature 1..20: note = CRISPR gRNA sequence
  source 1..20: mol_type = other DNA
gaaacctcagaccggagagg

SEQ ID NO: 67344 - DNA, 20 bp, synthetic construct
  misc_feature 1..20: note = CRISPR gRNA sequence
  source 1..20: mol_type = other DNA
agaccggagaggaacttctc

SEQ ID NO: 67345 - DNA, 20 bp, synthetic construct
  misc_feature 1..20: note = CRISPR gRNA sequence
  source 1..20: mol_type = other DNA
ctctttgcctaaatcacaca

SEQ ID NO: 67346 - DNA, 20 bp, synthetic construct
  misc_feature 1..20: note = CRISPR gRNA sequence
  source 1..20: mol_type = other DNA
tctttgcctaaatcacacag

SEQ ID NO: 67347 - DNA, 20 bp, synthetic construct
  misc_feature 1..20: note = CRISPR gRNA sequence
  source 1..20: mol_type = other DNA
tttgcctaaatcacacagct

SEQ ID NO: 67348 - DNA, 20 bp, synthetic construct
  misc_feature 1..20: note = CRISPR gRNA sequence
  source 1..20: mol_type = other DNA
tgcctaaatcacacagcttc

SEQ ID NO: 67349 - DNA, 20 bp, synthetic construct
  misc_feature 1..20: note = CRISPR gRNA sequence
  source 1..20: mol_type = other DNA
gcctaaatcacacagcttca

SEQ ID NO: 67350 - DNA, 20 bp, synthetic construct
  misc_feature 1..20: note = CRISPR gRNA sequence
  source 1..20: mol_type = other DNA
cctaaatcacacagcttcac

SEQ ID NO: 67351 - DNA, 20 bp, synthetic construct
  misc_feature 1..20: note = CRISPR gRNA sequence
  source 1..20: mol_type = other DNA
aatcacacagcttcacccct

SEQ ID NO: 67352 - DNA, 20 bp, synthetic construct
  misc_feature 1..20: note = CRISPR gRNA sequence
  source 1..20: mol_type = other DNA
cacccctgactcctcgtccg

SEQ ID NO: 67353 - DNA, 20 bp, synthetic construct
  misc_feature 1..20: note = CRISPR gRNA sequence
  source 1..20: mol_type = other DNA
acccctgactcctcgtccgc

SEQ ID NO: 67354 - DNA, 20 bp, synthetic construct
  misc_feature 1..20: note = CRISPR gRNA sequence
  source 1..20: mol_type = other DNA
actcctcgtccgcctttgga

SEQ ID NO: 67355 - DNA, 20 bp, synthetic construct
  misc_feature 1..20: note = CRISPR gRNA sequence
  source 1..20: mol_type = other DNA
ctcgtccgcctttggagtgg

SEQ ID NO: 67356 - DNA, 20 bp, synthetic construct
  misc_feature 1..20: note = CRISPR gRNA sequence
  source 1..20: mol_type = other DNA
gtccgcctttggagtggcgt

SEQ ID NO: 67357 - DNA, 20 bp, synthetic construct
  misc_feature 1..20: note = CRISPR gRNA sequence
  source 1..20: mol_type = other DNA
tggagtggcgtggccagcct

SEQ ID NO: 67358 - DNA, 20 bp, synthetic construct
  misc_feature 1..20: note = CRISPR gRNA sequence
  source 1..20: mol_type = other DNA
ggagtggcgtggccagcctg

SEQ ID NO: 67359 - DNA, 20 bp, synthetic construct
  misc_feature 1..20: note = CRISPR gRNA sequence
  source 1..20: mol_type = other DNA
gagtggcgtggccagcctga

SEQ ID NO: 67360 - DNA, 20 bp, synthetic construct
  misc_feature 1..20: note = CRISPR gRNA sequence
  source 1..20: mol_type = other DNA
accccttgccagggtttaaa

SEQ ID NO: 67361 - DNA, 20 bp, synthetic construct
  misc_feature 1..20: note = CRISPR gRNA sequence
  source 1..20: mol_type = other DNA
gccagggtttaaactttgta

SEQ ID NO: 67362 - DNA, 20 bp, synthetic construct
  misc_feature 1..20: note = CRISPR gRNA sequence
  source 1..20: mol_type = other DNA
ccagggtttaaactttgtag

SEQ ID NO: 67363 - DNA, 20 bp, synthetic construct
  misc_feature 1..20: note = CRISPR gRNA sequence
  source 1..20: mol_type = other DNA
aaactttgtagtactcaacg

SEQ ID NO: 67364 - DNA, 20 bp, synthetic construct
  misc_feature 1..20: note = CRISPR gRNA sequence
  source 1..20: mol_type = other DNA
aactttgtagtactcaacgt

SEQ ID NO: 67365 - DNA, 20 bp, synthetic construct
  misc_feature 1..20: note = CRISPR gRNA sequence
  source 1..20: mol_type = other DNA
tgtagtactcaacgtgtagt

SEQ ID NO: 67366 - DNA, 20 bp, synthetic construct
  misc_feature 1..20: note = CRISPR gRNA sequence
  source 1..20: mol_type = other DNA
gtagtactcaacgtgtagtg

SEQ ID NO: 67367 - DNA, 20 bp, synthetic construct
  misc_feature 1..20: note = CRISPR gRNA sequence
  source 1..20: mol_type = other DNA
tagtactcaacgtgtagtgc

SEQ ID NO: 67368 - DNA, 20 bp, synthetic construct
  misc_feature 1..20: note = CRISPR gRNA sequence
  source 1..20: mol_type = other DNA
aacgtgtagtgcttgtggcc

SEQ ID NO: 67369 - DNA, 20 bp, synthetic construct
  misc_feature 1..20: note = CRISPR gRNA sequence
  source 1..20: mol_type = other DNA
gtggccctactgtgggccag

SEQ ID NO: 67370 - DNA, 20 bp, synthetic construct
  misc_feature 1..20: note = CRISPR gRNA sequence
  source 1..20: mol_type = other DNA
tggccctactgtgggccagg

SEQ ID NO: 67371 - DNA, 20 bp, synthetic construct
  misc_feature 1..20: note = CRISPR gRNA sequence
  source 1..20: mol_type = other DNA
ctgtgggccaggcattgtgt

SEQ ID NO: 67372 - DNA, 20 bp, synthetic construct
  misc_feature 1..20: note = CRISPR gRNA sequence
  source 1..20: mol_type = other DNA
tgggccaggcattgtgtgac

SEQ ID NO: 67373 - DNA, 20 bp, synthetic construct
  misc_feature 1..20: note = CRISPR gRNA sequence
  source 1..20: mol_type = other DNA
tgtgacgacacagcagaaaa

SEQ ID NO: 67374 - DNA, 20 bp, synthetic construct
  misc_feature 1..20: note = CRISPR gRNA sequence
  source 1..20: mol_type = other DNA
accatgtccttatcttcttg

SEQ ID NO: 67375 - DNA, 20 bp, synthetic construct
  misc_feature 1..20: note = CRISPR gRNA sequence
  source 1..20: mol_type = other DNA
atcttcttggagctcctctt

SEQ ID NO: 67376 - DNA, 20 bp, synthetic construct
  misc_feature 1..20: note = CRISPR gRNA sequence
  source 1..20: mol_type = other DNA
tcttcttggagctcctctta

SEQ ID NO: 67377 - DNA, 20 bp, synthetic construct
  misc_feature 1..20: note = CRISPR gRNA sequence
  source 1..20: mol_type = other DNA
cttggagctcctcttacaat

SEQ ID NO: 67378 - DNA, 20 bp, synthetic construct
  misc_feature 1..20: note = CRISPR gRNA sequence
  source 1..20: mol_type = other DNA
ttggagctcctcttacaata

SEQ ID NO: 67379 - DNA, 20 bp, synthetic construct
  misc_feature 1..20: note = CRISPR gRNA sequence
  source 1..20: mol_type = other DNA
ggagctcctcttacaatagt

SEQ ID NO: 67380 - DNA, 20 bp, synthetic construct
  misc_feature 1..20: note = CRISPR gRNA sequence
  source 1..20: mol_type = other DNA
gagctcctcttacaatagtg

SEQ ID NO: 67381 - DNA, 20 bp, synthetic construct
  misc_feature 1..20: note = CRISPR gRNA sequence
  source 1..20: mol_type = other DNA
ctcttacaatagtgggagct

SEQ ID NO: 67382 - DNA, 20 bp, synthetic construct
  misc_feature 1..20: note = CRISPR gRNA sequence
  source 1..20: mol_type = other DNA
ttacaatagtgggagctgaa

SEQ ID NO: 67383 - DNA, 20 bp, synthetic construct
  misc_feature 1..20: note = CRISPR gRNA sequence
  source 1..20: mol_type = other DNA
acaatagtgggagctgaaaa

SEQ ID NO: 67384 - DNA, 20 bp, synthetic construct
  misc_feature 1..20: note = CRISPR gRNA sequence
  source 1..20: mol_type = other DNA
caatagtgggagctgaaaaa

SEQ ID NO: 67385 - DNA, 20 bp, synthetic construct
  misc_feature 1..20: note = CRISPR gRNA sequence
  source 1..20: mol_type = other DNA
aaaaataagtaaagtaaaat

SEQ ID NO: 67386 - DNA, 20 bp, synthetic construct
  misc_feature 1..20: note = CRISPR gRNA sequence
  source 1..20: mol_type = other DNA
agccagtgataagagaattt

SEQ ID NO: 67387 - DNA, 20 bp, synthetic construct
  misc_feature 1..20: note = CRISPR gRNA sequence
  source 1..20: mol_type = other DNA
gccagtgataagagaatttt

SEQ ID NO: 67388 - DNA, 20 bp, synthetic construct
  misc_feature 1..20: note = CRISPR gRNA sequence
  source 1..20: mol_type = other DNA
tctcgggatgtggtgaagag

SEQ ID NO: 67389 - DNA, 20 bp, synthetic construct
  misc_feature 1..20: note = CRISPR gRNA sequence
  source 1..20: mol_type = other DNA
ctcgggatgtggtgaagagt

SEQ ID NO: 67390 - DNA, 20 bp, synthetic construct
  misc_feature 1..20: note = CRISPR gRNA sequence
  source 1..20: mol_type = other DNA
tcgggatgtggtgaagagtg

SEQ ID NO: 67391 - DNA, 20 bp, synthetic construct
  misc_feature 1..20: note = CRISPR gRNA sequence
  source 1..20: mol_type = other DNA
gggatgtggtgaagagtggc

SEQ ID NO: 67392 - DNA, 20 bp, synthetic construct
  misc_feature 1..20: note = CRISPR gRNA sequence
  source 1..20: mol_type = other DNA
gagaggtgatttagatgtgg

SEQ ID NO: 67393 - DNA, 20 bp, synthetic construct
  misc_feature 1..20: note = CRISPR gRNA sequence
  source 1..20: mol_type = other DNA
agatgtggcagaagccatca

SEQ ID NO: 67394 - DNA, 20 bp, synthetic construct
  misc_feature 1..20: note = CRISPR gRNA sequence
  source 1..20: mol_type = other DNA
gatgtggcagaagccatcag

SEQ ID NO: 67395 - DNA, 20 bp, synthetic construct
  misc_feature 1..20: note = CRISPR gRNA sequence
  source 1..20: mol_type = other DNA
tgaggagggatgctgagctg

SEQ ID NO: 67396 - DNA, 20 bp, synthetic construct
  misc_feature 1..20: note = CRISPR gRNA sequence
  source 1..20: mol_type = other DNA
aggagggatgctgagctggg

SEQ ID NO: 67397 - DNA, 20 bp, synthetic construct
  misc_feature 1..20: note = CRISPR gRNA sequence
  source 1..20: mol_type = other DNA
agctgggacctaaaggaaga

SEQ ID NO: 67398 - DNA, 20 bp, synthetic construct
  misc_feature 1..20: note = CRISPR gRNA sequence
  source 1..20: mol_type = other DNA
ggacctaaaggaagagagag

SEQ ID NO: 67399 - DNA, 20 bp, synthetic construct
  misc_feature 1..20: note = CRISPR gRNA sequence
  source 1..20: mol_type = other DNA
aaggaagagagagagctcgc

SEQ ID NO: 67400 - DNA, 20 bp, synthetic construct
  misc_feature 1..20: note = CRISPR gRNA sequence
  source 1..20: mol_type = other DNA
gccttgtgaagagcagggaa

SEQ ID NO: 67401 - DNA, 20 bp, synthetic construct
  misc_feature 1..20: note = CRISPR gRNA sequence
  source 1..20: mol_type = other DNA
gtgaagagcagggaactgca

SEQ ID NO: 67402 - DNA, 20 bp, synthetic construct
  misc_feature 1..20: note = CRISPR gRNA sequence
  source 1..20: mol_type = other DNA
tgaagagcagggaactgcat

SEQ ID NO: 67403 - DNA, 20 bp, synthetic construct
  misc_feature 1..20: note = CRISPR gRNA sequence
  source 1..20: mol_type = other DNA
cattccaggcagagggaacg

SEQ ID NO: 67404 - DNA, 20 bp, synthetic construct
  misc_feature 1..20: note = CRISPR gRNA sequence
  source 1..20: mol_type = other DNA
caggcagagggaacggcatg

SEQ ID NO: 67405 - DNA, 20 bp, synthetic construct
  misc_feature 1..20: note = CRISPR gRNA sequence
  source 1..20: mol_type = other DNA
aggcatgattaagcttggtg

SEQ ID NO: 67406 - DNA, 20 bp, synthetic construct
  misc_feature 1..20: note = CRISPR gRNA sequence
  source 1..20: mol_type = other DNA
agcttggtgggctccaggaa

SEQ ID NO: 67407 - DNA, 20 bp, synthetic construct
  misc_feature 1..20: note = CRISPR gRNA sequence
  source 1..20: mol_type = other DNA
ggtgggctccaggaacagcg

SEQ ID NO: 67408 - DNA, 20 bp, synthetic construct
  misc_feature 1..20: note = CRISPR gRNA sequence
  source 1..20: mol_type = other DNA
gtgggctccaggaacagcgc

SEQ ID NO: 67409 - DNA, 20 bp, synthetic construct
  misc_feature 1..20: note = CRISPR gRNA sequence
  source 1..20: mol_type = other DNA
caggaacagcgcggaaccga

SEQ ID NO: 67410 - DNA, 20 bp, synthetic construct
  misc_feature 1..20: note = CRISPR gRNA sequence
  source 1..20: mol_type = other DNA
gcagggacagtcctaggaga

SEQ ID NO: 67411 - DNA, 20 bp, synthetic construct
  misc_feature 1..20: note = CRISPR gRNA sequence
  source 1..20: mol_type = other DNA
ggagaggaggaagagagaga

SEQ ID NO: 67412 - DNA, 20 bp, synthetic construct
  misc_feature 1..20: note = CRISPR gRNA sequence
  source 1..20: mol_type = other DNA
gggttgggttgcatggggcc

SEQ ID NO: 67413 - DNA, 20 bp, synthetic construct
  misc_feature 1..20: note = CRISPR gRNA sequence
  source 1..20: mol_type = other DNA
ggttgcatggggcctggcac

SEQ ID NO: 67414 - DNA, 20 bp, synthetic construct
  misc_feature 1..20: note = CRISPR gRNA sequence
  source 1..20: mol_type = other DNA
catggggcctggcacccatg

SEQ ID NO: 67415 - DNA, 20 bp, synthetic construct
  misc_feature 1..20: note = CRISPR gRNA sequence
  source 1..20: mol_type = other DNA
gcacccatggggagagttta

SEQ ID NO: 67416 - DNA, 20 bp, synthetic construct
  misc_feature 1..20: note = CRISPR gRNA sequence
  source 1..20: mol_type = other DNA
agacttttgttcctgggaac

SEQ ID NO: 67417 - DNA, 20 bp, synthetic construct
  misc_feature 1..20: note = CRISPR gRNA sequence
  source 1..20: mol_type = other DNA
gacttttgttcctgggaaca

SEQ ID NO: 67418 - DNA, 20 bp, synthetic construct
  misc_feature 1..20: note = CRISPR gRNA sequence
  source 1..20: mol_type = other DNA
ttgttcctgggaacatgaaa

SEQ ID NO: 67419 - DNA, 20 bp, synthetic construct
  misc_feature 1..20: note = CRISPR gRNA sequence
  source 1..20: mol_type = other DNA
tgttcctgggaacatgaaag

SEQ ID NO: 67420 - DNA, 20 bp, synthetic construct
  misc_feature 1..20: note = CRISPR gRNA sequence
  source 1..20: mol_type = other DNA
gttcctgggaacatgaaagg

SEQ ID NO: 67421 - DNA, 20 bp, synthetic construct
  misc_feature 1..20: note = CRISPR gRNA sequence
  source 1..20: mol_type = other DNA
ttcctgggaacatgaaaggg

SEQ ID NO: 67422 - DNA, 20 bp, synthetic construct
  misc_feature 1..20: note = CRISPR gRNA sequence
  source 1..20: mol_type = other DNA
ctgggaacatgaaagggaga

SEQ ID NO: 67423 - DNA, 20 bp, synthetic construct
  misc_feature 1..20: note = CRISPR gRNA sequence
  source 1..20: mol_type = other DNA
ggaacatgaaagggagagga

SEQ ID NO: 67424 - DNA, 20 bp, synthetic construct
  misc_feature 1..20: note = CRISPR gRNA sequence
  source 1..20: mol_type = other DNA
gggttttctttctttctttt

SEQ ID NO: 67425 - DNA, 20 bp, synthetic construct
  misc_feature 1..20: note = CRISPR gRNA sequence
  source 1..20: mol_type = other DNA
ggttttctttctttcttttt

SEQ ID NO: 67426 - DNA, 20 bp, synthetic construct
  misc_feature 1..20: note = CRISPR gRNA sequence
  source 1..20: mol_type = other DNA
tctttctttcttttttgtgg

SEQ ID NO: 67427 - DNA, 20 bp, synthetic construct
  misc_feature 1..20: note = CRISPR gRNA sequence
  source 1..20: mol_type = other DNA
ctttctttcttttttgtggg

SEQ ID NO: 67428 - DNA, 20 bp, synthetic construct
  misc_feature 1..20: note = CRISPR gRNA sequence
  source 1..20: mol_type = other DNA
tttctttcttttttgtgggg

SEQ ID NO: 67429 - DNA, 20 bp, synthetic construct
  misc_feature 1..20: note = CRISPR gRNA sequence
  source 1..20: mol_type = other DNA
tctttcttttttgtggggga

SEQ ID NO: 67430 - DNA, 20 bp, synthetic construct
  misc_feature 1..20: note = CRISPR gRNA sequence
  source 1..20: mol_type = other DNA
ctttcttttttgtgggggag

SEQ ID NO: 67431 - DNA, 20 bp, synthetic construct
  misc_feature 1..20: note = CRISPR gRNA sequence
  source 1..20: mol_type = other DNA
tttcttttttgtgggggagg

SEQ ID NO: 67432 - DNA, 20 bp, synthetic construct
  misc_feature 1..20: note = CRISPR gRNA sequence
  source 1..20: mol_type = other DNA
tcttttttgtgggggagggt

SEQ ID NO: 67433 - DNA, 20 bp, synthetic construct
  misc_feature 1..20: note = CRISPR gRNA sequence
  source 1..20: mol_type = other DNA
cttttttgtgggggagggtc

SEQ ID NO: 67434 - DNA, 20 bp, synthetic construct
  misc_feature 1..20: note = CRISPR gRNA sequence
  source 1..20: mol_type = other DNA
ttttttgtgggggagggtct

SEQ ID NO: 67435 - DNA, 20 bp, synthetic construct
  misc_feature 1..20: note = CRISPR gRNA sequence
  source 1..20: mol_type = other DNA
ttttgtgggggagggtctcg

SEQ ID NO: 67436 - DNA, 20 bp, synthetic construct
  misc_feature 1..20: note = CRISPR gRNA sequence
  source 1..20: mol_type = other DNA
tttgtgggggagggtctcgc

SEQ ID NO: 67437 - DNA, 20 bp, synthetic construct
  misc_feature 1..20: note = CRISPR gRNA sequence
  source 1..20: mol_type = other DNA
ttgtgggggagggtctcgct

SEQ ID NO: 67438 - DNA, 20 bp, synthetic construct
  misc_feature 1..20: note = CRISPR gRNA sequence
  source 1..20: mol_type = other DNA
tgtgggggagggtctcgctc

SEQ ID NO: 67439 - DNA, 20 bp, synthetic construct
  misc_feature 1..20: note = CRISPR gRNA sequence
  source 1..20: mol_type = other DNA
gtgggggagggtctcgctct

SEQ ID NO: 67440 - DNA, 20 bp, synthetic construct
  misc_feature 1..20: note = CRISPR gRNA sequence
  source 1..20: mol_type = other DNA
tgggggagggtctcgctctg

SEQ ID NO: 67441 - DNA, 20 bp, synthetic construct
  misc_feature 1..20: note = CRISPR gRNA sequence
  source 1..20: mol_type = other DNA
gctctgtcacacaggctgga

SEQ ID NO: 67442 - DNA, 20 bp, synthetic construct
  misc_feature 1..20: note = CRISPR gRNA sequence
  source 1..20: mol_type = other DNA
tgtcacacaggctggagtgc

SEQ ID NO: 67443 - DNA, 20 bp, synthetic construct
  misc_feature 1..20: note = CRISPR gRNA sequence
  source 1..20: mol_type = other DNA
tcacacaggctggagtgcaa

SEQ ID NO: 67444 - DNA, 20 bp, synthetic construct
  misc_feature 1..20: note = CRISPR gRNA sequence
  source 1..20: mol_type = other DNA
gagtgcaatggcgcaatctc

SEQ ID NO: 67445 - DNA, 20 bp, synthetic construct
  misc_feature 1..20: note = CRISPR gRNA sequence
  source 1..20: mol_type = other DNA
ggctcactgcaacctccgcc

SEQ ID NO: 67446 - DNA, 20 bp, synthetic construct
  misc_feature 1..20: note = CRISPR gRNA sequence
  source 1..20: mol_type = other DNA
actgcaacctccgcctccca

SEQ ID NO: 67447 - DNA, 20 bp, synthetic construct
  misc_feature 1..20: note = CRISPR gRNA sequence
  source 1..20: mol_type = other DNA
caacctccgcctcccaggtt

SEQ ID NO: 67448 - DNA, 20 bp, synthetic construct
  misc_feature 1..20: note = CRISPR gRNA sequence
  source 1..20: mol_type = other DNA
cgcctcccaggttcaggcaa

SEQ ID NO: 67449 - DNA, 20 bp, synthetic construct
  misc_feature 1..20: note = CRISPR gRNA sequence
  source 1..20: mol_type = other DNA
ccaggttcaggcaattcttg

SEQ ID NO: 67450 - DNA, 20 bp, synthetic construct
  misc_feature 1..20: note = CRISPR gRNA sequence
  source 1..20: mol_type = other DNA
aggcaattcttgtgcctcag

SEQ ID NO: 67451 - DNA, 20 bp, synthetic construct
  misc_feature 1..20: note = CRISPR gRNA sequence
  source 1..20: mol_type = other DNA
ttgtgcctcagcctcccaag

SEQ ID NO: 67452 - DNA, 20 bp, synthetic construct
  misc_feature 1..20: note = CRISPR gRNA sequence
  source 1..20: mol_type = other DNA
gtgcctcagcctcccaagta

SEQ ID NO: 67453 - DNA, 20 bp, synthetic construct
  misc_feature 1..20: note = CRISPR gRNA sequence
  source 1..20: mol_type = other DNA
tgcctcagcctcccaagtag

SEQ ID NO: 67454 - DNA, 20 bp, synthetic construct
  misc_feature 1..20: note = CRISPR gRNA sequence
  source 1..20: mol_type = other DNA
agcctcccaagtagctggga

SEQ ID NO: 67455 - DNA, 20 bp, synthetic construct
  misc_feature 1..20: note = CRISPR gRNA sequence
  source 1..20: mol_type = other DNA
ccaagtagctgggattacag

SEQ ID NO: 67456 - DNA, 20 bp, synthetic construct
  misc_feature 1..20: note = CRISPR gRNA sequence
  source 1..20: mol_type = other DNA
ggattacaggcgtgcaccat

SEQ ID NO: 67457 - DNA, 20 bp, synthetic construct
  misc_feature 1..20: note = CRISPR gRNA sequence
  source 1..20: mol_type = other DNA
caggcgtgcaccatcatgcc

SEQ ID NO: 67458 - DNA, 20 bp, synthetic construct
  misc_feature 1..20: note = CRISPR gRNA sequence
  source 1..20: mol_type = other DNA
atttttgtatttttagtaga

SEQ ID NO: 67459 - DNA, 20 bp, synthetic construct
  misc_feature 1..20: note = CRISPR gRNA sequence
  source 1..20: mol_type = other DNA
ttgtatttttagtagagaca

SEQ ID NO: 67460 - DNA, 20 bp, synthetic construct
  misc_feature 1..20: note = CRISPR gRNA sequence
  source 1..20: mol_type = other DNA
tgtatttttagtagagacag

SEQ ID NO: 67461 - DNA, 20 bp, synthetic construct
  misc_feature 1..20: note = CRISPR gRNA sequence
  source 1..20: mol_type = other DNA
gtatttttagtagagacaga

SEQ ID NO: 67462 - DNA, 20 bp, synthetic construct
  misc_feature 1..20: note = CRISPR gRNA sequence
  source 1..20: mol_type = other DNA
tatttttagtagagacagag

SEQ ID NO: 67463 - DNA, 20 bp, synthetic construct
  misc_feature 1..20: note = CRISPR gRNA sequence
  source 1..20: mol_type = other DNA
ttagtagagacagagtttaa

SEQ ID NO: 67464 - DNA, 20 bp, synthetic construct
  misc_feature 1..20: note = CRISPR gRNA sequence
  source 1..20: mol_type = other DNA
tagtagagacagagtttaac

SEQ ID NO: 67465 - DNA, 20 bp, synthetic construct
  misc_feature 1..20: note = CRISPR gRNA sequence
  source 1..20: mol_type = other DNA
agtagagacagagtttaacc

SEQ ID NO: 67466 - DNA, 20 bp, synthetic construct
  misc_feature 1..20: note = CRISPR gRNA sequence
  source 1..20: mol_type = other DNA
gtagagacagagtttaacca

SEQ ID NO: 67467 - DNA, 20 bp, synthetic construct
  misc_feature 1..20: note = CRISPR gRNA sequence
  source 1..20: mol_type = other DNA
aaccatgttgaccatgctgg

SEQ ID NO: 67468 - DNA, 20 bp, synthetic construct
  misc_feature 1..20: note = CRISPR gRNA sequence
  source 1..20: mol_type = other DNA
accatgttgaccatgctggt

SEQ ID NO: 67469 - DNA, 20 bp, synthetic construct
  misc_feature 1..20: note = CRISPR gRNA sequence
  source 1..20: mol_type = other DNA
accatgctggtctcaaactc

SEQ ID NO: 67470 - DNA, 20 bp, synthetic construct
  misc_feature 1..20: note = CRISPR gRNA sequence
  source 1..20: mol_type = other DNA
gtctcaaactcccgacctca

SEQ ID NO: 67471 - DNA, 20 bp, synthetic construct
  misc_feature 1..20: note = CRISPR gRNA sequence
  source 1..20: mol_type = other DNA
aaactcccgacctcaagtga

SEQ ID NO: 67472 - DNA, 20 bp, synthetic construct
  misc_feature 1..20: note = CRISPR gRNA sequence
  source 1..20: mol_type = other DNA
ccgacctcaagtgatccgcc

SEQ ID NO: 67473 - DNA, 20 bp, synthetic construct
  misc_feature 1..20: note = CRISPR gRNA sequence
  source 1..20: mol_type = other DNA
aagtgatccgcccgcctcgg

SEQ ID NO: 67474 - DNA, 20 bp, synthetic construct
  misc_feature 1..20: note = CRISPR gRNA sequence
  source 1..20: mol_type = other DNA
ggcttcccaaagtactgaga

SEQ ID NO: 67475 - DNA, 20 bp, synthetic construct
  misc_feature 1..20: note = CRISPR gRNA sequence
  source 1..20: mol_type = other DNA
cccaaagtactgagattaca

SEQ ID NO: 67476 - DNA, 20 bp, synthetic construct
  misc_feature 1..20: note = CRISPR gRNA sequence
  source 1..20: mol_type = other DNA
ccaaagtactgagattacag

SEQ ID NO: 67477 - DNA, 20 bp, synthetic construct
  misc_feature 1..20: note = CRISPR gRNA sequence
  source 1..20: mol_type = other DNA
agattacaggcaggagccac

SEQ ID NO: 67478 - DNA, 20 bp, synthetic construct
  misc_feature 1..20: note = CRISPR gRNA sequence
  source 1..20: mol_type = other DNA
caggcaggagccactgcacc

SEQ ID NO: 67479 - DNA, 20 bp, synthetic construct
  misc_feature 1..20: note = CRISPR gRNA sequence
  source 1..20: mol_type = other DNA
cacccgttcctcatttgggt

SEQ ID NO: 67480 - DNA, 20 bp, synthetic construct
  misc_feature 1..20: note = CRISPR gRNA sequence
  source 1..20: mol_type = other DNA
ctcatttgggttttcaaaag

SEQ ID NO: 67481 - DNA, 20 bp, synthetic construct
  misc_feature 1..20: note = CRISPR gRNA sequence
  source 1..20: mol_type = other DNA
atttgggttttcaaaagttc

SEQ ID NO: 67482 - DNA, 20 bp, synthetic construct
  misc_feature 1..20: note = CRISPR gRNA sequence
  source 1..20: mol_type = other DNA
gggttttcaaaagttcagac

SEQ ID NO: 67483 - DNA, 20 bp, synthetic construct
  misc_feature 1..20: note = CRISPR gRNA sequence
  source 1..20: mol_type = other DNA
ggttttcaaaagttcagact

SEQ ID NO: 67484 - DNA, 20 bp, synthetic construct
  misc_feature 1..20: note = CRISPR gRNA sequence
  source 1..20: mol_type = other DNA
tcaaaagttcagactgagtg

SEQ ID NO: 67485 - DNA, 20 bp, synthetic construct
  misc_feature 1..20: note = CRISPR gRNA sequence
  source 1..20: mol_type = other DNA
caaaagttcagactgagtgc

SEQ ID NO: 67486 - DNA, 20 bp, synthetic construct
  misc_feature 1..20: note = CRISPR gRNA sequence
  source 1..20: mol_type = other DNA
aaaagttcagactgagtgct

SEQ ID NO: 67487 - DNA, 20 bp, synthetic construct
  misc_feature 1..20: note = CRISPR gRNA sequence
  source 1..20: mol_type = other DNA
agactgagtgctgggtagag

SEQ ID NO: 67488 - DNA, 20 bp, synthetic construct
  misc_feature 1..20: note = CRISPR gRNA sequence
  source 1..20: mol_type = other DNA
agtgctgggtagagaatgga

SEQ ID NO: 67489 - DNA, 20 bp, synthetic construct
  misc_feature 1..20: note = CRISPR gRNA sequence
  source 1..20: mol_type = other DNA
ggtagagaatggattgggag

SEQ ID NO: 67490 - DNA, 20 bp, synthetic construct
  misc_feature 1..20: note = CRISPR gRNA sequence
  source 1..20: mol_type = other DNA
ggagatacgagtggaaatga

SEQ ID NO: 67491 - DNA, 20 bp, synthetic construct
  misc_feature 1..20: note = CRISPR gRNA sequence
  source 1..20: mol_type = other DNA
ggggctgatcactgctgggg

SEQ ID NO: 67492 - DNA, 20 bp, synthetic construct
  misc_feature 1..20: note = CRISPR gRNA sequence
  source 1..20: mol_type = other DNA
atcactgctggggtgggata

SEQ ID NO: 67493 - DNA, 20 bp, synthetic construct
  misc_feature 1..20: note = CRISPR gRNA sequence
  source 1..20: mol_type = other DNA
ctggggtgggatagaagttg

SEQ ID NO: 67494 - DNA, 20 bp, synthetic construct
  misc_feature 1..20: note = CRISPR gRNA sequence
  source 1..20: mol_type = other DNA
gggtgggatagaagttggta

SEQ ID NO: 67495 - DNA, 20 bp, synthetic construct
  misc_feature 1..20: note = CRISPR gRNA sequence
  source 1..20: mol_type = other DNA
gtagactcagggtggatctt

SEQ ID NO: 67496 - DNA, 20 bp, synthetic construct
  misc_feature 1..20: note = CRISPR gRNA sequence
  source 1..20: mol_type = other DNA
agggtggatcttgagagtgg

SEQ ID NO: 67497 - DNA, 20 bp, synthetic construct
  misc_feature 1..20: note = CRISPR gRNA sequence
  source 1..20: mol_type = other DNA
gagagtggaatttacagaca

SEQ ID NO: 67498 - DNA, 20 bp, synthetic construct
  misc_feature 1..20: note = CRISPR gRNA sequence
  source 1..20: mol_type = other DNA
agagtggaatttacagacaa

SEQ ID NO: 67499 - DNA, 20 bp, synthetic construct
  misc_feature 1..20: note = CRISPR gRNA sequence
  source 1..20: mol_type = other DNA
acagacaagctgataggggg

SEQ ID NO: 67500 - DNA, 20 bp, synthetic construct
  misc_feature 1..20: note = CRISPR gRNA sequence
  source 1..20: mol_type = other DNA
cagacaagctgataggggga

SEQ ID NO: 67501 - DNA, 20 bp, synthetic construct
  misc_feature 1..20: note = CRISPR gRNA sequence
  source 1..20: mol_type = other DNA
atagggggattactggatga

SEQ ID NO: 67502 - DNA, 20 bp, synthetic construct
  misc_feature 1..20: note = CRISPR gRNA sequence
  source 1..20: mol_type = other DNA
ctggatgaggcaaatggagg

SEQ ID NO: 67503 - DNA, 20 bp, synthetic construct
  misc_feature 1..20: note = CRISPR gRNA sequence
  source 1..20: mol_type = other DNA
gatgaggcaaatggaggtgc

SEQ ID NO: 67504 - DNA, 20 bp, synthetic construct
  misc_feature 1..20: note = CRISPR gRNA sequence
  source 1..20: mol_type = other DNA
aggctgcctctgagggcaga

SEQ ID NO: 67505 - DNA, 20 bp, synthetic construct
  misc_feature 1..20: note = CRISPR gRNA sequence
  source 1..20: mol_type = other DNA
cctctgagggcagagtggac

SEQ ID NO: 67506 - DNA, 20 bp, synthetic construct
  misc_feature 1..20: note = CRISPR gRNA sequence
  source 1..20: mol_type = other DNA
tgagggcagagtggacccat

SEQ ID NO: 67507 - DNA, 20 bp, synthetic construct
  misc_feature 1..20: note = CRISPR gRNA sequence
  source 1..20: mol_type = other DNA
agggcagagtggacccatct

SEQ ID NO: 67508 - DNA, 20 bp, synthetic construct
  misc_feature 1..20: note = CRISPR gRNA sequence
  source 1..20: mol_type = other DNA
actttctctaaggcagtggt

SEQ ID NO: 67509 - DNA, 20 bp, synthetic construct
  misc_feature 1..20: note = CRISPR gRNA sequence
  source 1..20: mol_type = other DNA
tctctaaggcagtggtttcc

SEQ ID NO: 67510 - DNA, 20 bp, synthetic construct
  misc_feature 1..20: note = CRISPR gRNA sequence
  source 1..20: mol_type = other DNA
ctctaaggcagtggtttcca

SEQ ID NO: 67511 - DNA, 20 bp, synthetic construct
  misc_feature 1..20: note = CRISPR gRNA sequence
  source 1..20: mol_type = other DNA
tctaaggcagtggtttccaa

SEQ ID NO: 67512 - DNA, 20 bp, synthetic construct
  misc_feature 1..20: note = CRISPR gRNA sequence
  source 1..20: mol_type = other DNA
taaggcagtggtttccaact

SEQ ID NO: 67513 - DNA, 20 bp, synthetic construct
  misc_feature 1..20: note = CRISPR gRNA sequence
  source 1..20: mol_type = other DNA
aggcagtggtttccaactgg

SEQ ID NO: 67514 - DNA, 20 bp, synthetic construct
  misc_feature 1..20: note = CRISPR gRNA sequence
  source 1..20: mol_type = other DNA
ccaactgggggtgattttca

SEQ ID NO: 67515 - DNA, 20 bp, synthetic construct
  misc_feature 1..20: note = CRISPR gRNA sequence
  source 1..20: mol_type = other DNA
caactgggggtgattttcac

SEQ ID NO: 67516 - DNA, 20 bp, synthetic construct
  misc_feature 1..20: note = CRISPR gRNA sequence
  source 1..20: mol_type = other DNA
ggggtgattttcacccttgg

SEQ ID NO: 67517 - DNA, 20 bp, synthetic construct
  misc_feature 1..20: note = CRISPR gRNA sequence
  source 1..20: mol_type = other DNA
tcacccttgggagtcatttg

SEQ ID NO: 67518 - DNA, 20 bp, synthetic construct
  misc_feature 1..20: note = CRISPR gRNA sequence
  source 1..20: mol_type = other DNA
cacccttgggagtcatttgg

SEQ ID NO: 67519 - DNA, 20 bp, synthetic construct
  misc_feature 1..20: note = CRISPR gRNA sequence
  source 1..20: mol_type = other DNA
acccttgggagtcatttgga

SEQ ID NO: 67520 - DNA, 20 bp, synthetic construct
  misc_feature 1..20: note = CRISPR gRNA sequence
  source 1..20: mol_type = other DNA
gggagtcatttggaaatatc

SEQ ID NO: 67521 - DNA, 20 bp, synthetic construct
  misc_feature 1..20: note = CRISPR gRNA sequence
  source 1..20: mol_type = other DNA
ggagtcatttggaaatatct

SEQ ID NO: 67522 - DNA, 20 bp, synthetic construct
  misc_feature 1..20: note = CRISPR gRNA sequence
  source 1..20: mol_type = other DNA
ggaaatatctggagatattt

SEQ ID NO: 67523 - DNA, 20 bp, synthetic construct
  misc_feature 1..20: note = CRISPR gRNA sequence
  source 1..20: mol_type = other DNA
gaaatatctggagatatttt

SEQ ID NO: 67524 - DNA, 20 bp, synthetic construct
  misc_feature 1..20: note = CRISPR gRNA sequence
  source 1..20: mol_type = other DNA
gagatatttttggtggtcat

SEQ ID NO: 67525 - DNA, 20 bp, synthetic construct
  misc_feature 1..20: note = CRISPR gRNA sequence
  source 1..20: mol_type = other DNA
ttggtggtcatgactgcggg

SEQ ID NO: 67526 - DNA, 20 bp, synthetic construct
  misc_feature 1..20: note = CRISPR gRNA sequence
  source 1..20: mol_type = other DNA
tggtggtcatgactgcgggt

SEQ ID NO: 67527 - DNA, 20 bp, synthetic construct
  misc_feature 1..20: note = CRISPR gRNA sequence
  source 1..20: mol_type = other DNA
ggtggtcatgactgcgggtg

SEQ ID NO: 67528 - DNA, 20 bp, synthetic construct
  misc_feature 1..20: note = CRISPR gRNA sequence
  source 1..20: mol_type = other DNA
gtggtcatgactgcgggtga

SEQ ID NO: 67529 - DNA, 20 bp, synthetic construct
  misc_feature 1..20: note = CRISPR gRNA sequence
  source 1..20: mol_type = other DNA
cgggtgaggggtgctgctac

SEQ ID NO: 67530 - DNA, 20 bp, synthetic construct
  misc_feature 1..20: note = CRISPR gRNA sequence
  source 1..20: mol_type = other DNA
ctactggcatcgaatgaata

SEQ ID NO: 67531 - DNA, 20 bp, synthetic construct
  misc_feature 1..20: note = CRISPR gRNA sequence
  source 1..20: mol_type = other DNA
ctggcatcgaatgaatagag

SEQ ID NO: 67532 - DNA, 20 bp, synthetic construct
  misc_feature 1..20: note = CRISPR gRNA sequence
  source 1..20: mol_type = other DNA
gcatcgaatgaatagagatc

SEQ ID NO: 67533 - DNA, 20 bp, synthetic construct
  misc_feature 1..20: note = CRISPR gRNA sequence
  source 1..20: mol_type = other DNA
ggatgctgctgaacatccta

SEQ ID NO: 67534 - DNA, 20 bp, synthetic construct
  misc_feature 1..20: note = CRISPR gRNA sequence
  source 1..20: mol_type = other DNA
ctgaacatcctatagggcac

SEQ ID NO: 67535 - DNA, 20 bp, synthetic construct
  misc_feature 1..20: note = CRISPR gRNA sequence
  source 1..20: mol_type = other DNA
aacatcctatagggcacagg

SEQ ID NO: 67536 - DNA, 20 bp, synthetic construct
  misc_feature 1..20: note = CRISPR gRNA sequence
  source 1..20: mol_type = other DNA
tagggcacaggagagcccac

SEQ ID NO: 67537 - DNA, 20 bp, synthetic construct
  misc_feature 1..20: note = CRISPR gRNA sequence
  source 1..20: mol_type = other DNA
ttggacctcacatctcaata

SEQ ID NO: 67538 - DNA, 20 bp, synthetic construct
  misc_feature 1..20: note = CRISPR gRNA sequence
  source 1..20: mol_type = other DNA
gacctcacatctcaatagtg

SEQ ID NO: 67539 - DNA, 20 bp, synthetic construct
  misc_feature 1..20: note = CRISPR gRNA sequence
  source 1..20: mol_type = other DNA
acatctcaatagtgctaagg

SEQ ID NO: 67540 - DNA, 20 bp, synthetic construct
  misc_feature 1..20: note = CRISPR gRNA sequence
  source 1..20: mol_type = other DNA
aatagtgctaaggtttaaaa

SEQ ID NO: 67541 - DNA, 20 bp, synthetic construct
  misc_feature 1..20: note = CRISPR gRNA sequence
  source 1..20: mol_type = other DNA
aggtttaaaaactgtgtctg

SEQ ID NO: 67542 - DNA, 20 bp, synthetic construct
  misc_feature 1..20: note = CRISPR gRNA sequence
  source 1..20: mol_type = other DNA
aaaaactgtgtctgaagggc

SEQ ID NO: 67543 - DNA, 20 bp, synthetic construct
  misc_feature 1..20: note = CRISPR gRNA sequence
  source 1..20: mol_type = other DNA
aaaactgtgtctgaagggcc

SEQ ID NO: 67544 - DNA, 20 bp, synthetic construct
  misc_feature 1..20: note = CRISPR gRNA sequence
  source 1..20: mol_type = other DNA
tgtctgaagggcctgaagct

SEQ ID NO: 67545 - DNA, 20 bp, synthetic construct
  misc_feature 1..20: note = CRISPR gRNA sequence
  source 1..20: mol_type = other DNA
aagggcctgaagcttcccac

SEQ ID NO: 67546 - DNA, 20 bp, synthetic construct
  misc_feature 1..20: note = CRISPR gRNA sequence
  source 1..20: mol_type = other DNA
aagcttcccactctctgtga

SEQ ID NO: 67547 - DNA, 20 bp, synthetic construct
  misc_feature 1..20: note = CRISPR gRNA sequence
  source 1..20: mol_type = other DNA
cccactctctgtgagcaagg

SEQ ID NO: 67548 - DNA, 20 bp, synthetic construct
  misc_feature 1..20: note = CRISPR gRNA sequence
  source 1..20: mol_type = other DNA
ccactctctgtgagcaagga

SEQ ID NO: 67549 - DNA, 20 bp, synthetic construct
  misc_feature 1..20: note = CRISPR gRNA sequence
  source 1..20: mol_type = other DNA
tctgtgagcaaggactcgcc

SEQ ID NO: 67550 - DNA, 20 bp, synthetic construct
  misc_feature 1..20: note = CRISPR gRNA sequence
  source 1..20: mol_type = other DNA
tgtgagcaaggactcgcctg

SEQ ID NO: 67551 - DNA, 20 bp, synthetic construct
  misc_feature 1..20: note = CRISPR gRNA sequence
  source 1..20: mol_type = other DNA
tgagcaaggactcgcctgtg

SEQ ID NO: 67552 - DNA, 20 bp, synthetic construct
  misc_feature 1..20: note = CRISPR gRNA sequence
  source 1..20: mol_type = other DNA
gcctgtgaaatctgtgcttg

SEQ ID NO: 67553 - DNA, 20 bp, synthetic construct
  misc_feature 1..20: note = CRISPR gRNA sequence
  source 1..20: mol_type = other DNA
tgaaatctgtgcttgcaggt

SEQ ID NO: 67554 - DNA, 20 bp, synthetic construct
  misc_feature 1..20: note = CRISPR gRNA sequence
  source 1..20: mol_type = other DNA
tgcttgcaggtaaaaacaat

SEQ ID NO: 67555 - DNA, 20 bp, synthetic construct
  misc_feature 1..20: note = CRISPR gRNA sequence
  source 1..20: mol_type = other DNA
gcaggtaaaaacaatagtaa

SEQ ID NO: 67556 - DNA, 20 bp, synthetic construct
  misc_feature 1..20: note = CRISPR gRNA sequence
  source 1..20: mol_type = other DNA
caggtaaaaacaatagtaat

SEQ ID NO: 67557 - DNA, 20 bp, synthetic construct
  misc_feature 1..20: note = CRISPR gRNA sequence
  source 1..20: mol_type = other DNA
catgatgtaattaaatcctc

SEQ ID NO: 67558 - DNA, 20 bp, synthetic construct
  misc_feature 1..20: note = CRISPR gRNA sequence
  source 1..20: mol_type = other DNA
aatcctcatatacctcgaga

SEQ ID NO: 67559 - DNA, 20 bp, synthetic construct
  misc_feature 1..20: note = CRISPR gRNA sequence
  source 1..20: mol_type = other DNA
atatacctcgagagtcatac

SEQ ID NO: 67560 - DNA, 20 bp, synthetic construct
  misc_feature 1..20: note = CRISPR gRNA sequence
  source 1..20: mol_type = other DNA
gagagtcatacatgacgagt

SEQ ID NO: 67561 - DNA, 20 bp, synthetic construct
  misc_feature 1..20: note = CRISPR gRNA sequence
  source 1..20: mol_type = other DNA
gatttccagataaggaaact

SEQ ID NO: 67562 - DNA, 20 bp, synthetic construct
  misc_feature 1..20: note = CRISPR gRNA sequence
  source 1..20: mol_type = other DNA
atttccagataaggaaactg

SEQ ID NO: 67563 - DNA, 20 bp, synthetic construct
  misc_feature 1..20: note = CRISPR gRNA sequence
  source 1..20: mol_type = other DNA
ccagataaggaaactgaagc

SEQ ID NO: 67564 - DNA, 20 bp, synthetic construct
  misc_feature 1..20: note = CRISPR gRNA sequence
  source 1..20: mol_type = other DNA
cagataaggaaactgaagct

SEQ ID NO: 67565 - DNA, 20 bp, synthetic construct
  misc_feature 1..20: note = CRISPR gRNA sequence
  source 1..20: mol_type = other DNA
aagctcagagaggtgaagtc

SEQ ID NO: 67566 - DNA, 20 bp, synthetic construct
  misc_feature 1..20: note = CRISPR gRNA sequence
  source 1..20: mol_type = other DNA
agagaggtgaagtcacttct

SEQ ID NO: 67567 - DNA, 20 bp, synthetic construct
  misc_feature 1..20: note = CRISPR gRNA sequence
  source 1..20: mol_type = other DNA
ctccaaggtcacacagccaa

SEQ ID NO: 67568 - DNA, 20 bp, synthetic construct
  misc_feature 1..20: note = CRISPR gRNA sequence
  source 1..20: mol_type = other DNA
tccaaggtcacacagccaat

SEQ ID NO: 67569 - DNA, 20 bp, synthetic construct
  misc_feature 1..20: note = CRISPR gRNA sequence
  source 1..20: mol_type = other DNA
caaggtcacacagccaataa

SEQ ID NO: 67570 - DNA, 20 bp, synthetic construct
  misc_feature 1..20: note = CRISPR gRNA sequence
  source 1..20: mol_type = other DNA
ggactcaaatccaaatctgc

SEQ ID NO: 67571 - DNA, 20 bp, synthetic construct
  misc_feature 1..20: note = CRISPR gRNA sequence
  source 1..20: mol_type = other DNA
aaatccaaatctgcctgtcc

SEQ ID NO: 67572 - DNA, 20 bp, synthetic construct
  misc_feature 1..20: note = CRISPR gRNA sequence
  source 1..20: mol_type = other DNA
cctgtccctcagccctattt

SEQ ID NO: 67573 - DNA, 20 bp, synthetic construct
  misc_feature 1..20: note = CRISPR gRNA sequence
  source 1..20: mol_type = other DNA
tccctcagccctatttgtgc

SEQ ID NO: 67574 - DNA, 20 bp, synthetic construct
  misc_feature 1..20: note = CRISPR gRNA sequence
  source 1..20: mol_type = other DNA
agccctatttgtgcctcttg

SEQ ID NO: 67575 - DNA, 20 bp, synthetic construct
  misc_feature 1..20: note = CRISPR gRNA sequence
  source 1..20: mol_type = other DNA
tttgtgcctcttgatcccct

SEQ ID NO: 67576 - DNA, 20 bp, synthetic construct
  misc_feature 1..20: note = CRISPR gRNA sequence
  source 1..20: mol_type = other DNA
gtgcctcttgatcccctgcc

SEQ ID NO: 67577 - DNA, 20 bp, synthetic construct
  misc_feature 1..20: note = CRISPR gRNA sequence
  source 1..20: mol_type = other DNA
tgcctcttgatcccctgcct

SEQ ID NO: 67578 - DNA, 20 bp, synthetic construct
  misc_feature 1..20: note = CRISPR gRNA sequence
  source 1..20: mol_type = other DNA
ttgatcccctgcctgcttcc

SEQ ID NO: 67579 - DNA, 20 bp, synthetic construct
  misc_feature 1..20: note = CRISPR gRNA sequence
  source 1..20: mol_type = other DNA
gatcccctgcctgcttccct

SEQ ID NO: 67580 - DNA, 20 bp, synthetic construct
  misc_feature 1..20: note = CRISPR gRNA sequence
  source 1..20: mol_type = other DNA
atcccctgcctgcttcccta

SEQ ID NO: 67581 - DNA, 20 bp, synthetic construct
  misc_feature 1..20: note = CRISPR gRNA sequence
  source 1..20: mol_type = other DNA
cctgcttccctattgccttg

SEQ ID NO: 67582 - DNA, 20 bp, synthetic construct
  misc_feature 1..20: note = CRISPR gRNA sequence
  source 1..20: mol_type = other DNA
cttccctattgccttgctga

SEQ ID NO: 67583 - DNA, 20 bp, synthetic construct
  misc_feature 1..20: note = CRISPR gRNA sequence
  source 1..20: mol_type = other DNA
ccctattgccttgctgagct

SEQ ID NO: 67584 - DNA, 20 bp, synthetic construct
  misc_feature 1..20: note = CRISPR gRNA sequence
  source 1..20: mol_type = other DNA
cctattgccttgctgagctg

SEQ ID NO: 67585 - DNA, 20 bp, synthetic construct
  misc_feature 1..20: note = CRISPR gRNA sequence
  source 1..20: mol_type = other DNA
ttgccttgctgagctgctag

SEQ ID NO: 67586 - DNA, 20 bp, synthetic construct
  misc_feature 1..20: note = CRISPR gRNA sequence
  source 1..20: mol_type = other DNA
ccttgctgagctgctagccc

SEQ ID NO: 67587 - DNA, 20 bp, synthetic construct
  misc_feature 1..20: note = CRISPR gRNA sequence
  source 1..20: mol_type = other DNA
gctgagctgctagccctccc

SEQ ID NO: 67588 - DNA, 20 bp, synthetic construct
  misc_feature 1..20: note = CRISPR gRNA sequence
  source 1..20: mol_type = other DNA
ctgagctgctagccctcccc

SEQ ID NO: 67589 - DNA, 20 bp, synthetic construct
  misc_feature 1..20: note = CRISPR gRNA sequence
  source 1..20: mol_type = other DNA
agctgctagccctccccacc

SEQ ID NO: 67590 - DNA, 20 bp, synthetic construct
  misc_feature 1..20: note = CRISPR gRNA sequence
  source 1..20: mol_type = other DNA
ctagccctccccaccctccc

SEQ ID NO: 67591 - DNA, 20 bp, synthetic construct
  misc_feature 1..20: note = CRISPR gRNA sequence
  source 1..20: mol_type = other DNA
gccctccccaccctcccttt

SEQ ID NO: 67592 - DNA, 20 bp, synthetic construct
  misc_feature 1..20: note = CRISPR gRNA sequence
  source 1..20: mol_type = other DNA
cccaccctccctttccttac

SEQ ID NO: 67593 - DNA, 20 bp, synthetic construct
  misc_feature 1..20: note = CRISPR gRNA sequence
  source 1..20: mol_type = other DNA
cctttccttaccctccaggc

SEQ ID NO: 67594 - DNA, 20 bp, synthetic construct
  misc_feature 1..20: note = CRISPR gRNA sequence
  source 1..20: mol_type = other DNA
tccttaccctccaggctagc

SEQ ID NO: 67595 - DNA, 20 bp, synthetic construct
  misc_feature 1..20: note = CRISPR gRNA sequence
  source 1..20: mol_type = other DNA
ccttaccctccaggctagcc

SEQ ID NO: 67596 - DNA, 20 bp, synthetic construct
  misc_feature 1..20: note = CRISPR gRNA sequence
  source 1..20: mol_type = other DNA
cttaccctccaggctagcca

SEQ ID NO: 67597 - DNA, 20 bp, synthetic construct
  misc_feature 1..20: note = CRISPR gRNA sequence
  source 1..20: mol_type = other DNA
accctccaggctagccaggt

SEQ ID NO: 67598 - DNA, 20 bp, synthetic construct
  misc_feature 1..20: note = CRISPR gRNA sequence
  source 1..20: mol_type = other DNA
ccctccaggctagccaggtt

SEQ ID NO: 67599 - DNA, 20 bp, synthetic construct
  misc_feature 1..20: note = CRISPR gRNA sequence
  source 1..20: mol_type = other DNA
caggctagccaggttccttg

SEQ ID NO: 67600 - DNA, 20 bp, synthetic construct
  misc_feature 1..20: note = CRISPR gRNA sequence
  source 1..20: mol_type = other DNA
gccaggttccttgtccactc

SEQ ID NO: 67601 - DNA, 20 bp, synthetic construct
  misc_feature 1..20: note = CRISPR gRNA sequence
  source 1..20: mol_type = other DNA
cttgtccactcatcttgccg

SEQ ID NO: 67602 - DNA, 20 bp, synthetic construct
  misc_feature 1..20: note = CRISPR gRNA sequence
  source 1..20: mol_type = other DNA
gtccactcatcttgccggat

SEQ ID NO: 67603 - DNA, 20 bp, synthetic construct
  misc_feature 1..20: note = CRISPR gRNA sequence
  source 1..20: mol_type = other DNA
tccactcatcttgccggatc

SEQ ID NO: 67604 - DNA, 20 bp, synthetic construct
  misc_feature 1..20: note = CRISPR gRNA sequence
  source 1..20: mol_type = other DNA
atcttgccggatctaccccc

SEQ ID NO: 67605 - DNA, 20 bp, synthetic construct
  misc_feature 1..20: note = CRISPR gRNA sequence
  source 1..20: mol_type = other DNA
gccggatctaccccctttcc

SEQ ID NO: 67606 - DNA, 20 bp, synthetic construct
  misc_feature 1..20: note = CRISPR gRNA sequence
  source 1..20: mol_type = other DNA
ccggatctaccccctttcct

SEQ ID NO: 67607 - DNA, 20 bp, synthetic construct
  misc_feature 1..20: note = CRISPR gRNA sequence
  source 1..20: mol_type = other DNA
ccccctttccttttcaggct

SEQ ID NO: 67608 - DNA, 20 bp, synthetic construct
  misc_feature 1..20: note = CRISPR gRNA sequence
  source 1..20: mol_type = other DNA
tccttttcaggctgagccag

SEQ ID NO: 67609 - DNA, 20 bp, synthetic construct
  misc_feature 1..20: note = CRISPR gRNA sequence
  source 1..20: mol_type = other DNA
ccttttcaggctgagccaga

SEQ ID NO: 67610 - DNA, 20 bp, synthetic construct
  misc_feature 1..20: note = CRISPR gRNA sequence
  source 1..20: mol_type = other DNA
cttttcaggctgagccagac

SEQ ID NO: 67611 - DNA, 20 bp, synthetic construct
  misc_feature 1..20: note = CRISPR gRNA sequence
  source 1..20: mol_type = other DNA
ttcaggctgagccagacggg

SEQ ID NO: 67612 - DNA, 20 bp, synthetic construct
  misc_feature 1..20: note = CRISPR gRNA sequence
  source 1..20: mol_type = other DNA
tcaggctgagccagacggga

SEQ ID NO: 67613 - DNA, 20 bp, synthetic construct
  misc_feature 1..20: note = CRISPR gRNA sequence
  source 1..20: mol_type = other DNA
caggctgagccagacgggac

SEQ ID NO: 67614 - DNA, 20 bp, synthetic construct
  misc_feature 1..20: note = CRISPR gRNA sequence
  source 1..20: mol_type = other DNA
aggctgagccagacgggact

SEQ ID NO: 67615 - DNA, 20 bp, synthetic construct
  misc_feature 1..20: note = CRISPR gRNA sequence
  source 1..20: mol_type = other DNA
agccagacgggactgtcccc

SEQ ID NO: 67616 - DNA, 20 bp, synthetic construct
  misc_feature 1..20: note = CRISPR gRNA sequence
  source 1..20: mol_type = other DNA
tccccgaaaagccccttcct

SEQ ID NO: 67617 - DNA, 20 bp, synthetic construct
  misc_feature 1..20: note = CRISPR gRNA sequence
  source 1..20: mol_type = other DNA
cctgctggccaacaccttaa

SEQ ID NO: 67618 - DNA, 20 bp, synthetic construct
  misc_feature 1..20: note = CRISPR gRNA sequence
  source 1..20: mol_type = other DNA
ctgctggccaacaccttaag

SEQ ID NO: 67619 - DNA, 20 bp, synthetic construct
  misc_feature 1..20: note = CRISPR gRNA sequence
  source 1..20: mol_type = other DNA
ctggccaacaccttaagcct

SEQ ID NO: 67620 - DNA, 20 bp, synthetic construct
  misc_feature 1..20: note = CRISPR gRNA sequence
  source 1..20: mol_type = other DNA
gccaacaccttaagcctgtg

SEQ ID NO: 67621 - DNA, 20 bp, synthetic construct
  misc_feature 1..20: note = CRISPR gRNA sequence
  source 1..20: mol_type = other DNA
aagcctgtgtccacgggtta

SEQ ID NO: 67622 - DNA, 20 bp, synthetic construct
  misc_feature 1..20: note = CRISPR gRNA sequence
  source 1..20: mol_type = other DNA
agcctgtgtccacgggttaa

SEQ ID NO: 67623 - DNA, 20 bp, synthetic construct
  misc_feature 1..20: note = CRISPR gRNA sequence
  source 1..20: mol_type = other DNA
tgtccacgggttaaaaaggt

SEQ ID NO: 67624 - DNA, 20 bp, synthetic construct
  misc_feature 1..20: note = CRISPR gRNA sequence
  source 1..20: mol_type = other DNA
aaaaggtggatctcaggtgg

SEQ ID NO: 67625 - DNA, 20 bp, synthetic construct
  misc_feature 1..20: note = CRISPR gRNA sequence
  source 1..20: mol_type = other DNA
aggtgggcattcccctggga

SEQ ID NO: 67626 - DNA, 20 bp, synthetic construct
  misc_feature 1..20: note = CRISPR gRNA sequence
  source 1..20: mol_type = other DNA
ccctgggacagccaggactc

SEQ ID NO: 67627 - DNA, 20 bp, synthetic construct
  misc_feature 1..20: note = CRISPR gRNA sequence
  source 1..20: mol_type = other DNA
ggacagccaggactcgtcct

SEQ ID NO: 67628 - DNA, 20 bp, synthetic construct
  misc_feature 1..20: note = CRISPR gRNA sequence
  source 1..20: mol_type = other DNA
gtcctgaagggttgtgcctg

SEQ ID NO: 67629 - DNA, 20 bp, synthetic construct
  misc_feature 1..20: note = CRISPR gRNA sequence
  source 1..20: mol_type = other DNA
aagggttgtgcctggagtct

SEQ ID NO: 67630 - DNA, 20 bp, synthetic construct
  misc_feature 1..20: note = CRISPR gRNA sequence
  source 1..20: mol_type = other DNA
tgcctggagtctggtgggta

SEQ ID NO: 67631 - DNA, 20 bp, synthetic construct
  misc_feature 1..20: note = CRISPR gRNA sequence
  source 1..20: mol_type = other DNA
gagtctggtgggtatgaggg

SEQ ID NO: 67632 - DNA, 20 bp, synthetic construct
  misc_feature 1..20: note = CRISPR gRNA sequence
  source 1..20: mol_type = other DNA
gtgggtatgagggggtagga

SEQ ID NO: 67633 - DNA, 20 bp, synthetic construct
  misc_feature 1..20: note = CRISPR gRNA sequence
  source 1..20: mol_type = other DNA
gaggctgggcttccggagga

SEQ ID NO: 67634 - DNA, 20 bp, synthetic construct
  misc_feature 1..20: note = CRISPR gRNA sequence
  source 1..20: mol_type = other DNA
ggcttccggaggaggggtgc

SEQ ID NO: 67635 - DNA, 20 bp, synthetic construct
  misc_feature 1..20: note = CRISPR gRNA sequence
  source 1..20: mol_type = other DNA
ccggaggaggggtgctggcc

SEQ ID NO: 67636 - DNA, 20 bp, synthetic construct
  misc_feature 1..20: note = CRISPR gRNA sequence
  source 1..20: mol_type = other DNA
cggaggaggggtgctggccc

SEQ ID NO: 67637 - DNA, 20 bp, synthetic construct
  misc_feature 1..20: note = CRISPR gRNA sequence
  source 1..20: mol_type = other DNA
gccccgtgggggcatcctga

SEQ ID NO: 67638 - DNA, 20 bp, synthetic construct
  misc_feature 1..20: note = CRISPR gRNA sequence
  source 1..20: mol_type = other DNA
aggctgtggccacagctgtc

SEQ ID NO: 67639 - DNA, 20 bp, synthetic construct
  misc_feature 1..20: note = CRISPR gRNA sequence
  source 1..20: mol_type = other DNA
tggccacagctgtctgaccc

SEQ ID NO: 67640 - DNA, 20 bp, synthetic construct
  misc_feature 1..20: note = CRISPR gRNA sequence
  source 1..20: mol_type = other DNA
tctgacccaggtcctgtctg

SEQ ID NO: 67641 - DNA, 20 bp, synthetic construct
  misc_feature 1..20: note = CRISPR gRNA sequence
  source 1..20: mol_type = other DNA
acccaggtcctgtctgatcc

SEQ ID NO: 67642 - DNA, 20 bp, synthetic construct
  misc_feature 1..20: note = CRISPR gRNA sequence
  source 1..20: mol_type = other DNA
tctgatccaggtccctgcac

SEQ ID NO: 67643 - DNA, 20 bp, synthetic construct
  misc_feature 1..20: note = CRISPR gRNA sequence
  source 1..20: mol_type = other DNA
atccaggtccctgcaccatg

SEQ ID NO: 67644 - DNA, 20 bp, synthetic construct
  misc_feature 1..20: note = CRISPR gRNA sequence
  source 1..20: mol_type = other DNA
caccatgcaactttgcactt

SEQ ID NO: 67645 - DNA, 20 bp, synthetic construct
  misc_feature 1..20: note = CRISPR gRNA sequence
  source 1..20: mol_type = other DNA
tgcacttcagatccaacgag

SEQ ID NO: 67646 - DNA, 20 bp, synthetic construct
  misc_feature 1..20: note = CRISPR gRNA sequence
  source 1..20: mol_type = other DNA
gcacttcagatccaacgagg

SEQ ID NO: 67647 - DNA, 20 bp, synthetic construct
  misc_feature 1..20: note = CRISPR gRNA sequence
  source 1..20: mol_type = other DNA
cacttcagatccaacgagga

SEQ ID NO: 67648 - DNA, 20 bp, synthetic construct
  misc_feature 1..20: note = CRISPR gRNA sequence
  source 1..20: mol_type = other DNA
cagatccaacgaggaggagg

SEQ ID NO: 67649 - DNA, 20 bp, synthetic construct
  misc_feature 1..20: note = CRISPR gRNA sequence
  source 1..20: mol_type = other DNA
agatccaacgaggaggagga

SEQ ID NO: 67650 - DNA, 20 bp, synthetic construct
  misc_feature 1..20: note = CRISPR gRNA sequence
  source 1..20: mol_type = other DNA
tgggtaagcccccttgaacc

SEQ ID NO: 67651 - DNA, 20 bp, synthetic construct
  misc_feature 1..20: note = CRISPR gRNA sequence
  source 1..20: mol_type = other DNA
gaaccatgcctaggcagcta

SEQ ID NO: 67652 - DNA, 20 bp, synthetic construct
  misc_feature 1..20: note = CRISPR gRNA sequence
  source 1..20: mol_type = other DNA
aaccatgcctaggcagctag

SEQ ID NO: 67653 - DNA, 20 bp, synthetic construct
  misc_feature 1..20: note = CRISPR gRNA sequence
  source 1..20: mol_type = other DNA
ggcagctagttgatgttggg

SEQ ID NO: 67654 - DNA, 20 bp, synthetic construct
  misc_feature 1..20: note = CRISPR gRNA sequence
  source 1..20: mol_type = other DNA
gttgatgttggggaccagta

SEQ ID NO: 67655 - DNA, 20 bp, synthetic construct
  misc_feature 1..20: note = CRISPR gRNA sequence
  source 1..20: mol_type = other DNA
atgttggggaccagtagatc

SEQ ID NO: 67656 - DNA, 20 bp, synthetic construct
  misc_feature 1..20: note = CRISPR gRNA sequence
  source 1..20: mol_type = other DNA
gggaccagtagatctgcctc

SEQ ID NO: 67657 - DNA, 20 bp, synthetic construct
  misc_feature 1..20: note = CRISPR gRNA sequence
  source 1..20: mol_type = other DNA
cctcctgggtggccagagca

SEQ ID NO: 67658 - DNA, 20 bp, synthetic construct
  misc_feature 1..20: note = CRISPR gRNA sequence
  source 1..20: mol_type = other DNA
ctgggtggccagagcagtat

SEQ ID NO: 67659 - DNA, 20 bp, synthetic construct
  misc_feature 1..20: note = CRISPR gRNA sequence
  source 1..20: mol_type = other DNA
ggtggccagagcagtatgca

SEQ ID NO: 67660 - DNA, 20 bp, synthetic construct
  misc_feature 1..20: note = CRISPR gRNA sequence
  source 1..20: mol_type = other DNA
cctaccacaaaacattcccc

SEQ ID NO: 67661 - DNA, 20 bp, synthetic construct
  misc_feature 1..20: note = CRISPR gRNA sequence
  source 1..20: mol_type = other DNA
ccacaaaacattcccctgga

SEQ ID NO: 67662 - DNA, 20 bp, synthetic construct
  misc_feature 1..20: note = CRISPR gRNA sequence
  source 1..20: mol_type = other DNA
ccctggaacaaccctgcaga

SEQ ID NO: 67663 - DNA, 20 bp, synthetic construct
  misc_feature 1..20: note = CRISPR gRNA sequence
  source 1..20: mol_type = other DNA
gaacaaccctgcagagggac

SEQ ID NO: 67664 - DNA, 20 bp, synthetic construct
  misc_feature 1..20: note = CRISPR gRNA sequence
  source 1..20: mol_type = other DNA
cagagggacttgtttcaccc

SEQ ID NO: 67665 - DNA, 20 bp, synthetic construct
  misc_feature 1..20: note = CRISPR gRNA sequence
  source 1..20: mol_type = other DNA
gtttcacccagcatgaagaa

SEQ ID NO: 67666 - DNA, 20 bp, synthetic construct
  misc_feature 1..20: note = CRISPR gRNA sequence
  source 1..20: mol_type = other DNA
tttcacccagcatgaagaaa

SEQ ID NO: 67667 - DNA, 20 bp, synthetic construct
  misc_feature 1..20: note = CRISPR gRNA sequence
  source 1..20: mol_type = other DNA
cacccagcatgaagaaacac

SEQ ID NO: 67668 - DNA, 20 bp, synthetic construct
  misc_feature 1..20: note = CRISPR gRNA sequence
  source 1..20: mol_type = other DNA
acccagcatgaagaaacaca

SEQ ID NO: 67669 - DNA, 20 bp, synthetic construct
  misc_feature 1..20: note = CRISPR gRNA sequence
  source 1..20: mol_type = other DNA
ctgtgggggtgggagcagtg

SEQ ID NO: 67670 - DNA, 20 bp, synthetic construct
  misc_feature 1..20: note = CRISPR gRNA sequence
  source 1..20: mol_type = other DNA
tgggggtgggagcagtggat

SEQ ID NO: 67671 - DNA, 20 bp, synthetic construct
  misc_feature 1..20: note = CRISPR gRNA sequence
  source 1..20: mol_type = other DNA
tggacacttccagagggtcc

SEQ ID NO: 67672 - DNA, 20 bp, synthetic construct
  misc_feature 1..20: note = CRISPR gRNA sequence
  source 1..20: mol_type = other DNA
gacacttccagagggtccaa

SEQ ID NO: 67673 - DNA, 20 bp, synthetic construct
  misc_feature 1..20: note = CRISPR gRNA sequence
  source 1..20: mol_type = other DNA
ccagagggtccaagcttgag

SEQ ID NO: 67674 - DNA, 20 bp, synthetic construct
  misc_feature 1..20: note = CRISPR gRNA sequence
  source 1..20: mol_type = other DNA
cagagggtccaagcttgagt

SEQ ID NO: 67675 - DNA, 20 bp, synthetic construct
  misc_feature 1..20: note = CRISPR gRNA sequence
  source 1..20: mol_type = other DNA
gagtggagacccacctggag

SEQ ID NO: 67676 - DNA, 20 bp, synthetic construct
  misc_feature 1..20: note = CRISPR gRNA sequence
  source 1..20: mol_type = other DNA
agtggagacccacctggagc

SEQ ID NO: 67677 - DNA, 20 bp, synthetic construct
  misc_feature 1..20: note = CRISPR gRNA sequence
  source 1..20: mol_type = other DNA
gagcccagaggctgtgccct

SEQ ID NO: 67678 - DNA, 20 bp, synthetic construct
  misc_feature 1..20: note = CRISPR gRNA sequence
  source 1..20: mol_type = other DNA
tgccctgggctagccaggcc

SEQ ID NO: 67679 - DNA, 20 bp, synthetic construct
  misc_feature 1..20: note = CRISPR gRNA sequence
  source 1..20: mol_type = other DNA
ggctagccaggccggagggg

SEQ ID NO: 67680 - DNA, 20 bp, synthetic construct
  misc_feature 1..20: note = CRISPR gRNA sequence
  source 1..20: mol_type = other DNA
gccaggccggagggggtctc

SEQ ID NO: 67681 - DNA, 20 bp, synthetic construct
  misc_feature 1..20: note = CRISPR gRNA sequence
  source 1..20: mol_type = other DNA
agtggccaaacgccccatcc

SEQ ID NO: 67682 - DNA, 20 bp, synthetic construct
  misc_feature 1..20: note = CRISPR gRNA sequence
  source 1..20: mol_type = other DNA
cttgtcccctttacctccgt

SEQ ID NO: 67683 - DNA, 20 bp, synthetic construct
  misc_feature 1..20: note = CRISPR gRNA sequence
  source 1..20: mol_type = other DNA
gtcccctttacctccgtcca

SEQ ID NO: 67684 - DNA, 20 bp, synthetic construct
  misc_feature 1..20: note = CRISPR gRNA sequence
  source 1..20: mol_type = other DNA
tcccctttacctccgtccag

SEQ ID NO: 67685 - DNA, 20 bp, synthetic construct
  misc_feature 1..20: note = CRISPR gRNA sequence
  source 1..20: mol_type = other DNA
tacctccgtccagcaggttc

SEQ ID NO: 67686 - DNA, 20 bp, synthetic construct
  misc_feature 1..20: note = CRISPR gRNA sequence
  source 1..20: mol_type = other DNA
acctccgtccagcaggttca

SEQ ID NO: 67687 - DNA, 20 bp, synthetic construct
  misc_feature 1..20: note = CRISPR gRNA sequence
  source 1..20: mol_type = other DNA
cctccgtccagcaggttcac

SEQ ID NO: 67688 - DNA, 20 bp, synthetic construct
  misc_feature 1..20: note = CRISPR gRNA sequence
  source 1..20: mol_type = other DNA
cgtccagcaggttcacaggc

SEQ ID NO: 67689 - DNA, 20 bp, synthetic construct
  misc_feature 1..20: note = CRISPR gRNA sequence
  source 1..20: mol_type = other DNA
acaggctgcagcctcagcca

SEQ ID NO: 67690 - DNA, 20 bp, synthetic construct
  misc_feature 1..20: note = CRISPR gRNA sequence
  source 1..20: mol_type = other DNA
cagcctcagccaggagcacg

SEQ ID NO: 67691 - DNA, 20 bp, synthetic construct
  misc_feature 1..20: note = CRISPR gRNA sequence
  source 1..20: mol_type = other DNA
agccaggagcacgtagagtc

SEQ ID NO: 67692 - DNA, 20 bp, synthetic construct
  misc_feature 1..20: note = CRISPR gRNA sequence
  source 1..20: mol_type = other DNA
tgctggttgctgagcaagtg

SEQ ID NO: 67693 - DNA, 20 bp, synthetic construct
  misc_feature 1..20: note = CRISPR gRNA sequence
  source 1..20: mol_type = other DNA
ctggttgctgagcaagtgta

SEQ ID NO: 67694 - DNA, 20 bp, synthetic construct
  misc_feature 1..20: note = CRISPR gRNA sequence
  source 1..20: mol_type = other DNA
gttgctgagcaagtgtaaag

SEQ ID NO: 67695 - DNA, 20 bp, synthetic construct
  misc_feature 1..20: note = CRISPR gRNA sequence
  source 1..20: mol_type = other DNA
ctgagcaagtgtaaagacct

SEQ ID NO: 67696 - DNA, 20 bp, synthetic construct
  misc_feature 1..20: note = CRISPR gRNA sequence
  source 1..20: mol_type = other DNA
agcaagtgtaaagacctcag

SEQ ID NO: 67697 - DNA, 20 bp, synthetic construct
  misc_feature 1..20: note = CRISPR gRNA sequence
  source 1..20: mol_type = other DNA
agccaggtggagtaagttga

SEQ ID NO: 67698 - DNA, 20 bp, synthetic construct
  misc_feature 1..20: note = CRISPR gRNA sequence
  source 1..20: mol_type = other DNA
agggaggaggaggaaggaga

SEQ ID NO: 67699 - DNA, 20 bp, synthetic construct
  misc_feature 1..20: note = CRISPR gRNA sequence
  source 1..20: mol_type = other DNA
aggggcactgaagggggtat

SEQ ID NO: 67700 - DNA, 20 bp, synthetic construct
  misc_feature 1..20: note = CRISPR gRNA sequence
  source 1..20: mol_type = other DNA
aagggggtatgagggtccgt

SEQ ID NO: 67701 - DNA, 20 bp, synthetic construct
  misc_feature 1..20: note = CRISPR gRNA sequence
  source 1..20: mol_type = other DNA
atgtgtgcctgcctacacct

SEQ ID NO: 67702 - DNA, 20 bp, synthetic construct
  misc_feature 1..20: note = CRISPR gRNA sequence
  source 1..20: mol_type = other DNA
cctacacctctcaggaccag

SEQ ID NO: 67703 - DNA, 20 bp, synthetic construct
  misc_feature 1..20: note = CRISPR gRNA sequence
  source 1..20: mol_type = other DNA
cacctctcaggaccagctgt

SEQ ID NO: 67704 - DNA, 20 bp, synthetic construct
  misc_feature 1..20: note = CRISPR gRNA sequence
  source 1..20: mol_type = other DNA
tcaggaccagctgtcaggga

SEQ ID NO: 67705 - DNA, 20 bp, synthetic construct
  misc_feature 1..20: note = CRISPR gRNA sequence
  source 1..20: mol_type = other DNA
aggaccagctgtcagggatg

SEQ ID NO: 67706 - DNA, 20 bp, synthetic construct
  misc_feature 1..20: note = CRISPR gRNA sequence
  source 1..20: mol_type = other DNA
tcagggatgcctgggtcaca

SEQ ID NO: 67707 - DNA, 20 bp, synthetic construct
  misc_feature 1..20: note = CRISPR gRNA sequence
  source 1..20: mol_type = other DNA
ggtcacatacccaaagcttc

SEQ ID NO: 67708 - DNA, 20 bp, synthetic construct
  misc_feature 1..20: note = CRISPR gRNA sequence
  source 1..20: mol_type = other DNA
ccctgaatcaattttctctc

SEQ ID NO: 67709 - DNA, 20 bp, synthetic construct
  misc_feature 1..20: note = CRISPR gRNA sequence
  source 1..20: mol_type = other DNA
cctgaatcaattttctctct

SEQ ID NO: 67710 - DNA, 20 bp, synthetic construct
  misc_feature 1..20: note = CRISPR gRNA sequence
  source 1..20: mol_type = other DNA
aatcaattttctctctcccg

SEQ ID NO: 67711 - DNA, 20 bp, synthetic construct
  misc_feature 1..20: note = CRISPR gRNA sequence
  source 1..20: mol_type = other DNA
tctctctcccgcccccactc

SEQ ID NO: 67712 - DNA, 20 bp, synthetic construct
  misc_feature 1..20: note = CRISPR gRNA sequence
  source 1..20: mol_type = other DNA
ctctctcccgcccccactct

SEQ ID NO: 67713 - DNA, 20 bp, synthetic construct
  misc_feature 1..20: note = CRISPR gRNA sequence
  source 1..20: mol_type = other DNA
tctctcccgcccccactctc

SEQ ID NO: 67714 - DNA, 20 bp, synthetic construct
  misc_feature 1..20: note = CRISPR gRNA sequence
  source 1..20: mol_type = other DNA
tctcccgcccccactctcgc

SEQ ID NO: 67715 - DNA, 20 bp, synthetic construct
  misc_feature 1..20: note = CRISPR gRNA sequence
  source 1..20: mol_type = other DNA
tcccgcccccactctcgcca

SEQ ID NO: 67716 - DNA, 20 bp, synthetic construct
  misc_feature 1..20: note = CRISPR gRNA sequence
  source 1..20: mol_type = other DNA
ccgcccccactctcgccatg

SEQ ID NO: 67717 - DNA, 20 bp, synthetic construct
  misc_feature 1..20: note = CRISPR gRNA sequence
  source 1..20: mol_type = other DNA
tcgccatggtggagctagtt

SEQ ID NO: 67718 - DNA, 20 bp, synthetic construct
  misc_feature 1..20: note = CRISPR gRNA sequence
  source 1..20: mol_type = other DNA
gccatggtggagctagttcc

SEQ ID NO: 67719 - DNA, 20 bp, synthetic construct
  misc_feature 1..20: note = CRISPR gRNA sequence
  source 1..20: mol_type = other DNA
gttccatggtgtgccctctg

SEQ ID NO: 67720 - DNA, 20 bp, synthetic construct
  misc_feature 1..20: note = CRISPR gRNA sequence
  source 1..20: mol_type = other DNA
catggtgtgccctctgactt

SEQ ID NO: 67721 - DNA, 20 bp, synthetic construct
  misc_feature 1..20: note = CRISPR gRNA sequence
  source 1..20: mol_type = other DNA
tgacttgggcagccctcagc

SEQ ID NO: 67722 - DNA, 20 bp, synthetic construct
  misc_feature 1..20: note = CRISPR gRNA sequence
  source 1..20: mol_type = other DNA
acttgggcagccctcagcct

SEQ ID NO: 67723 - DNA, 20 bp, synthetic construct
  misc_feature 1..20: note = CRISPR gRNA sequence
  source 1..20: mol_type = other DNA
gggcagccctcagcctcaag

SEQ ID NO: 67724 - DNA, 20 bp, synthetic construct
  misc_feature 1..20: note = CRISPR gRNA sequence
  source 1..20: mol_type = other DNA
ggcagccctcagcctcaagt

SEQ ID NO: 67725 - DNA, 20 bp, synthetic construct
  misc_feature 1..20: note = CRISPR gRNA sequence
  source 1..20: mol_type = other DNA
agcctcaagtatgtgcaagc

SEQ ID NO: 67726 - DNA, 20 bp, synthetic construct
  misc_feature 1..20: note = CRISPR gRNA sequence
  source 1..20: mol_type = other DNA
aagtatgtgcaagctctgct

SEQ ID NO: 67727 - DNA, 20 bp, synthetic construct
  misc_feature 1..20: note = CRISPR gRNA sequence
  source 1..20: mol_type = other DNA
tgctggcagatgggggctaa

SEQ ID NO: 67728 - DNA, 20 bp, synthetic construct
  misc_feature 1..20: note = CRISPR gRNA sequence
  source 1..20: mol_type = other DNA
ctggcagatgggggctaaaa

SEQ ID NO: 67729 - DNA, 20 bp, synthetic construct
  misc_feature 1..20: note = CRISPR gRNA sequence
  source 1..20: mol_type = other DNA
gcagatgggggctaaaacgc

SEQ ID NO: 67730 - DNA, 20 bp, synthetic construct
  misc_feature 1..20: note = CRISPR gRNA sequence
  source 1..20: mol_type = other DNA
aaacgcaggattcattgttg

SEQ ID NO: 67731 - DNA, 20 bp, synthetic construct
  misc_feature 1..20: note = CRISPR gRNA sequence
  source 1..20: mol_type = other DNA
attgttggcccagcaggtgg

SEQ ID NO: 67732 - DNA, 20 bp, synthetic construct
  misc_feature 1..20: note = CRISPR gRNA sequence
  source 1..20: mol_type = other DNA
ttggcccagcaggtggttaa

SEQ ID NO: 67733 - DNA, 20 bp, synthetic construct
  misc_feature 1..20: note = CRISPR gRNA sequence
  source 1..20: mol_type = other DNA
gcccagcaggtggttaaaag

SEQ ID NO: 67734 - DNA, 20 bp, synthetic construct
  misc_feature 1..20: note = CRISPR gRNA sequence
  source 1..20: mol_type = other DNA
aaagtaccggatgactctgc

SEQ ID NO: 67735 - DNA, 20 bp, synthetic construct
  misc_feature 1..20: note = CRISPR gRNA sequence
  source 1..20: mol_type = other DNA
tgcctgaggagggacgcaga

SEQ ID NO: 67736 - DNA, 20 bp, synthetic construct
  misc_feature 1..20: note = CRISPR gRNA sequence
  source 1..20: mol_type = other DNA
cctgaggagggacgcagagc

SEQ ID NO: 67737 - DNA, 20 bp, synthetic construct
  misc_feature 1..20: note = CRISPR gRNA sequence
  source 1..20: mol_type = other DNA
aggagggacgcagagccagc

SEQ ID NO: 67738 - DNA, 20 bp, synthetic construct
  misc_feature 1..20: note = CRISPR gRNA sequence
  source 1..20: mol_type = other DNA
gcagtctcttgtattgttga

SEQ ID NO: 67739 - DNA, 20 bp, synthetic construct
  misc_feature 1..20: note = CRISPR gRNA sequence
  source 1..20: mol_type = other DNA
cagtctcttgtattgttgag

SEQ ID NO: 67740 - DNA, 20 bp, synthetic construct
  misc_feature 1..20: note = CRISPR gRNA sequence
  source 1..20: mol_type = other DNA
ttgtattgttgagatgtggt

SEQ ID NO: 67741 - DNA, 20 bp, synthetic construct
  misc_feature 1..20: note = CRISPR gRNA sequence
  source 1..20: mol_type = other DNA
gtattgttgagatgtggtat

SEQ ID NO: 67742 - DNA, 20 bp, synthetic construct
  misc_feature 1..20: note = CRISPR gRNA sequence
  source 1..20: mol_type = other DNA
tattgttgagatgtggtatc

SEQ ID NO: 67743 - DNA, 20 bp, synthetic construct
  misc_feature 1..20: note = CRISPR gRNA sequence
  source 1..20: mol_type = other DNA
ttgagatgtggtatctgcgt

SEQ ID NO: 67744 - DNA, 20 bp, synthetic construct
  misc_feature 1..20: note = CRISPR gRNA sequence
  source 1..20: mol_type = other DNA
agatgtggtatctgcgtggc

SEQ ID NO: 67745 - DNA, 20 bp, synthetic construct
  misc_feature 1..20: note = CRISPR gRNA sequence
  source 1..20: mol_type = other DNA
cgtggcctgtcttggatatt

SEQ ID NO: 67746 - DNA, 20 bp, synthetic construct
  misc_feature 1..20: note = CRISPR gRNA sequence
  source 1..20: mol_type = other DNA
tcttggatattcaaatagtc

SEQ ID NO: 67747 - DNA, 20 bp, synthetic construct
  misc_feature 1..20: note = CRISPR gRNA sequence
  source 1..20: mol_type = other DNA
ggatattcaaatagtcagcc

SEQ ID NO: 67748 - DNA, 20 bp, synthetic construct
  misc_feature 1..20: note = CRISPR gRNA sequence
  source 1..20: mol_type = other DNA
gatattcaaatagtcagccc

SEQ ID NO: 67749 - DNA, 20 bp, synthetic construct
  misc_feature 1..20: note = CRISPR gRNA sequence
  source 1..20: mol_type = other DNA
aaatagtcagcccctgcatg

SEQ ID NO: 67750 - DNA, 20 bp, synthetic construct
  misc_feature 1..20: note = CRISPR gRNA sequence
  source 1..20: mol_type = other DNA
catgggtggaataataatag

SEQ ID NO: 67751 - DNA, 20 bp, synthetic construct
  misc_feature 1..20: note = CRISPR gRNA sequence
  source 1..20: mol_type = other DNA
acagctactgagcactttct

SEQ ID NO: 67752 - DNA, 20 bp, synthetic construct
  misc_feature 1..20: note = CRISPR gRNA sequence
  source 1..20: mol_type = other DNA
ctgagcactttctccactgt

SEQ ID NO: 67753 - DNA, 20 bp, synthetic construct
  misc_feature 1..20: note = CRISPR gRNA sequence
  source 1..20: mol_type = other DNA
agcactttctccactgttct

SEQ ID NO: 67754 - DNA, 20 bp, synthetic construct
  misc_feature 1..20: note = CRISPR gRNA sequence
  source 1..20: mol_type = other DNA
tctccactgttctaagtgct

SEQ ID NO: 67755 - DNA, 20 bp, synthetic construct
  misc_feature 1..20: note = CRISPR gRNA sequence
  source 1..20: mol_type = other DNA
ctccactgttctaagtgctt

SEQ ID NO: 67756 - DNA, 20 bp, synthetic construct
  misc_feature 1..20: note = CRISPR gRNA sequence
  source 1..20: mol_type = other DNA
tccactgttctaagtgcttg

SEQ ID NO: 67757 - DNA, 20 bp, synthetic construct
  misc_feature 1..20: note = CRISPR gRNA sequence
  source 1..20: mol_type = other DNA
cactgttctaagtgcttgac

SEQ ID NO: 67758 - DNA, 20 bp, synthetic construct
  misc_feature 1..20: note = CRISPR gRNA sequence
  source 1..20: mol_type = other DNA
ttctaagtgcttgacatgtt

SEQ ID NO: 67759 - DNA, 20 bp, synthetic construct
  misc_feature 1..20: note = CRISPR gRNA sequence
  source 1..20: mol_type = other DNA
taagtgcttgacatgttctt

SEQ ID NO: 67760 - DNA, 20 bp, synthetic construct
  misc_feature 1..20: note = CRISPR gRNA sequence
  source 1..20: mol_type = other DNA
agtgcttgacatgttctttt

SEQ ID NO: 67761 - DNA, 20 bp, synthetic construct
  misc_feature 1..20: note = CRISPR gRNA sequence
  source 1..20: mol_type = other DNA
gacatgttctttttatgttt

SEQ ID NO: 67762 - DNA, 20 bp, synthetic construct
  misc_feature 1..20: note = CRISPR gRNA sequence
  source 1..20: mol_type = other DNA
acatgttctttttatgtttc

SEQ ID NO: 67763 - DNA, 20 bp, synthetic construct
  misc_feature 1..20: note = CRISPR gRNA sequence
  source 1..20: mol_type = other DNA
tttttatgtttcccatatcc

SEQ ID NO: 67764 - DNA, 20 bp, synthetic construct
  misc_feature 1..20: note = CRISPR gRNA sequence
  source 1..20: mol_type = other DNA
tttatgtttcccatatccct

SEQ ID NO: 67765 - DNA, 20 bp, synthetic construct
  misc_feature 1..20: note = CRISPR gRNA sequence
  source 1..20: mol_type = other DNA
ttatgtttcccatatccctg

SEQ ID NO: 67766 - DNA, 20 bp, synthetic construct
  misc_feature 1..20: note = CRISPR gRNA sequence
  source 1..20: mol_type = other DNA
tatgtttcccatatccctgg

SEQ ID NO: 67767 - DNA, 20 bp, synthetic construct
  misc_feature 1..20: note = CRISPR gRNA sequence
  source 1..20: mol_type = other DNA
atgtttcccatatccctgga

SEQ ID NO: 67768 - DNA, 20 bp, synthetic construct
  misc_feature 1..20: note = CRISPR gRNA sequence
  source 1..20: mol_type = other DNA
tgtttcccatatccctggat

SEQ ID NO: 67769 - DNA, 20 bp, synthetic construct
  misc_feature 1..20: note = CRISPR gRNA sequence
  source 1..20: mol_type = other DNA
cccatatccctggatactag

SEQ ID NO: 67770 - DNA, 20 bp, synthetic construct
  misc_feature 1..20: note = CRISPR gRNA sequence
  source 1..20: mol_type = other DNA
ccatatccctggatactagt

SEQ ID NO: 67771 - DNA, 20 bp, synthetic construct
  misc_feature 1..20: note = CRISPR gRNA sequence
  source 1..20: mol_type = other DNA
gatactagtattgttctcat

SEQ ID NO: 67772 - DNA, 20 bp, synthetic construct
  misc_feature 1..20: note = CRISPR gRNA sequence
  source 1..20: mol_type = other DNA
gtattgttctcattttacag

SEQ ID NO: 67773 - DNA, 20 bp, synthetic construct
  misc_feature 1..20: note = CRISPR gRNA sequence
  source 1..20: mol_type = other DNA
ttctcattttacagatgagg

SEQ ID NO: 67774 - DNA, 20 bp, synthetic construct
  misc_feature 1..20: note = CRISPR gRNA sequence
  source 1..20: mol_type = other DNA
tcattttacagatgagggaa

SEQ ID NO: 67775 - DNA, 20 bp, synthetic construct
  misc_feature 1..20: note = CRISPR gRNA sequence
  source 1..20: mol_type = other DNA
attttacagatgagggaact

SEQ ID NO: 67776 - DNA, 20 bp, synthetic construct
  misc_feature 1..20: note = CRISPR gRNA sequence
  source 1..20: mol_type = other DNA
tacagatgagggaactgaga

SEQ ID NO: 67777 - DNA, 20 bp, synthetic construct
  misc_feature 1..20: note = CRISPR gRNA sequence
  source 1..20: mol_type = other DNA
acagatgagggaactgagac

SEQ ID NO: 67778 - DNA, 20 bp, synthetic construct
  misc_feature 1..20: note = CRISPR gRNA sequence
  source 1..20: mol_type = other DNA
cagatgagggaactgagaca

SEQ ID NO: 67779 - DNA, 20 bp, synthetic construct
  misc_feature 1..20: note = CRISPR gRNA sequence
  source 1..20: mol_type = other DNA
agacacagagggtgtaagaa

SEQ ID NO: 67780 - DNA, 20 bp, synthetic construct
  misc_feature 1..20: note = CRISPR gRNA sequence
  source 1..20: mol_type = other DNA
gcccaaggtcacacagctag

SEQ ID NO: 67781 - DNA, 20 bp, synthetic construct
  misc_feature 1..20: note = CRISPR gRNA sequence
  source 1..20: mol_type = other DNA
cccaaggtcacacagctagt

SEQ ID NO: 67782 - DNA, 20 bp, synthetic construct
  misc_feature 1..20: note = CRISPR gRNA sequence
  source 1..20: mol_type = other DNA
gtaaaatgcagagtccctgc

SEQ ID NO: 67783 - DNA, 20 bp, synthetic construct
  misc_feature 1..20: note = CRISPR gRNA sequence
  source 1..20: mol_type = other DNA
ctcagacgcattgggaatcc

SEQ ID NO: 67784 - DNA, 20 bp, synthetic construct
  misc_feature 1..20: note = CRISPR gRNA sequence
  source 1..20: mol_type = other DNA
agacgcattgggaatccagc

SEQ ID NO: 67785 - DNA, 20 bp, synthetic construct
  misc_feature 1..20: note = CRISPR gRNA sequence
  source 1..20: mol_type = other DNA
ggaatccagcctaggaccag

SEQ ID NO: 67786 - DNA, 20 bp, synthetic construct
  misc_feature 1..20: note = CRISPR gRNA sequence
  source 1..20: mol_type = other DNA
ggaccagtgggaaatagaga

SEQ ID NO: 67787 - DNA, 20 bp, synthetic construct
  misc_feature 1..20: note = CRISPR gRNA sequence
  source 1..20: mol_type = other DNA
tcatttctgttgtgatgtgg

SEQ ID NO: 67788 - DNA, 20 bp, synthetic construct
  misc_feature 1..20: note = CRISPR gRNA sequence
  source 1..20: mol_type = other DNA
catttctgttgtgatgtggc

SEQ ID NO: 67789 - DNA, 20 bp, synthetic construct
  misc_feature 1..20: note = CRISPR gRNA sequence
  source 1..20: mol_type = other DNA
atttctgttgtgatgtggca

SEQ ID NO: 67790 - DNA, 20 bp, synthetic construct
  misc_feature 1..20: note = CRISPR gRNA sequence
  source 1..20: mol_type = other DNA
ctgttgtgatgtggcagaga

SEQ ID NO: 67791 - DNA, 20 bp, synthetic construct
  misc_feature 1..20: note = CRISPR gRNA sequence
  source 1..20: mol_type = other DNA
tgttgtgatgtggcagagaa

SEQ ID NO: 67792 - DNA, 20 bp, synthetic construct
  misc_feature 1..20: note = CRISPR gRNA sequence
  source 1..20: mol_type = other DNA
ttgtgatgtggcagagaaga

SEQ ID NO: 67793 - DNA, 20 bp, synthetic construct
  misc_feature 1..20: note = CRISPR gRNA sequence
  source 1..20: mol_type = other DNA
tgatgtggcagagaagaaaa

SEQ ID NO: 67794 - DNA, 20 bp, synthetic construct
  misc_feature 1..20: note = CRISPR gRNA sequence
  source 1..20: mol_type = other DNA
ataaaatcatggatttcttt

SEQ ID NO: 67795 - DNA, 20 bp, synthetic construct
  misc_feature 1..20: note = CRISPR gRNA sequence
  source 1..20: mol_type = other DNA
cttttttttttaagacctgg

SEQ ID NO: 67796 - DNA, 20 bp, synthetic construct
  misc_feature 1..20: note = CRISPR gRNA sequence
  source 1..20: mol_type = other DNA
ttttttttttaagacctggg

SEQ ID NO: 67797 - DNA, 20 bp, synthetic construct
  misc_feature 1..20: note = CRISPR gRNA sequence
  source 1..20: mol_type = other DNA
ttttttttaagacctggggt

SEQ ID NO: 67798 - DNA, 20 bp, synthetic construct
  misc_feature 1..20: note = CRISPR gRNA sequence
  source 1..20: mol_type = other DNA
tttttttaagacctggggtc

SEQ ID NO: 67799 - DNA, 20 bp, synthetic construct
  misc_feature 1..20: note = CRISPR gRNA sequence
  source 1..20: mol_type = other DNA
ttttttaagacctggggtct

SEQ ID NO: 67800 - DNA, 20 bp, synthetic construct
  misc_feature 1..20: note = CRISPR gRNA sequence
  source 1..20: mol_type = other DNA
tttttaagacctggggtctc

SEQ ID NO: 67801 - DNA, 20 bp, synthetic construct
  misc_feature 1..20: note = CRISPR gRNA sequence
  source 1..20: mol_type = other DNA
ttttaagacctggggtctca

SEQ ID NO: 67802 - DNA, 20 bp, synthetic construct
  misc_feature 1..20: note = CRISPR gRNA sequence
  source 1..20: mol_type = other DNA
tttaagacctggggtctcac

SEQ ID NO: 67803 - DNA, 20 bp, synthetic construct
  misc_feature 1..20: note = CRISPR gRNA sequence
  source 1..20: mol_type = other DNA
ttaagacctggggtctcact

SEQ ID NO: 67804 - DNA, 20 bp, synthetic construct
  misc_feature 1..20: note = CRISPR gRNA sequence
  source 1..20: mol_type = other DNA
taagacctggggtctcactc

SEQ ID NO: 67805 - DNA, 20 bp, synthetic construct
  misc_feature 1..20: note = CRISPR gRNA sequence
  source 1..20: mol_type = other DNA
aagacctggggtctcactct

SEQ ID NO: 67806 - DNA, 20 bp, synthetic construct
  misc_feature 1..20: note = CRISPR gRNA sequence
  source 1..20: mol_type = other DNA
agacctggggtctcactctg

SEQ ID NO: 67807 - DNA, 20 bp, synthetic construct
  misc_feature 1..20: note = CRISPR gRNA sequence
  source 1..20: mol_type = other DNA
gggtctcactctgttgccca

SEQ ID NO: 67808 - DNA, 20 bp, synthetic construct
  misc_feature 1..20: note = CRISPR gRNA sequence
  source 1..20: mol_type = other DNA
actctgttgcccaggctgga

SEQ ID NO: 67809 - DNA, 20 bp, synthetic construct
  misc_feature 1..20: note = CRISPR gRNA sequence
  source 1..20: mol_type = other DNA
tgttgcccaggctggagtgc

SEQ ID NO: 67810 - DNA, 20 bp, synthetic construct
  misc_feature 1..20: note = CRISPR gRNA sequence
  source 1..20: mol_type = other DNA
ttgcccaggctggagtgcag

SEQ ID NO: 67811 - DNA, 20 bp, synthetic construct
  misc_feature 1..20: note = CRISPR gRNA sequence
  source 1..20: mol_type = other DNA
cccaggctggagtgcagtgg

SEQ ID NO: 67812 - DNA, 20 bp, synthetic construct
  misc_feature 1..20: note = CRISPR gRNA sequence
  source 1..20: mol_type = other DNA
gagtgcagtggtgcaatgat

SEQ ID NO: 67813 - DNA, 20 bp, synthetic construct
  misc_feature 1..20: note = CRISPR gRNA sequence
  source 1..20: mol_type = other DNA
cagcctccaactcctgggct

SEQ ID NO: 67814 - DNA, 20 bp, synthetic construct
  misc_feature 1..20: note = CRISPR gRNA sequence
  source 1..20: mol_type = other DNA
caactcctgggctcaagcga

SEQ ID NO: 67815 - DNA, 20 bp, synthetic construct
  misc_feature 1..20: note = CRISPR gRNA sequence
  source 1..20: mol_type = other DNA
ctgggctcaagcgatcctcc

SEQ ID NO: 67816 - DNA, 20 bp, synthetic construct
  misc_feature 1..20: note = CRISPR gRNA sequence
  source 1..20: mol_type = other DNA
ggctcaagcgatcctcccac

SEQ ID NO: 67817 - DNA, 20 bp, synthetic construct
  misc_feature 1..20: note = CRISPR gRNA sequence
  source 1..20: mol_type = other DNA
aagcgatcctcccacctcag

SEQ ID NO: 67818 - DNA, 20 bp, synthetic construct
  misc_feature 1..20: note = CRISPR gRNA sequence
  source 1..20: mol_type = other DNA
ccacctcagcctctggagta

SEQ ID NO: 67819 - DNA, 20 bp, synthetic construct
  misc_feature 1..20: note = CRISPR gRNA sequence
  source 1..20: mol_type = other DNA
agcctctggagtagctggga

SEQ ID NO: 67820 - DNA, 20 bp, synthetic construct
  misc_feature 1..20: note = CRISPR gRNA sequence
  source 1..20: mol_type = other DNA
tggagtagctgggactacag

SEQ ID NO: 67821 - DNA, 20 bp, synthetic construct
  misc_feature 1..20: note = CRISPR gRNA sequence
  source 1..20: mol_type = other DNA
gagtagctgggactacaggc

SEQ ID NO: 67822 - DNA, 20 bp, synthetic construct
  misc_feature 1..20: note = CRISPR gRNA sequence
  source 1..20: mol_type = other DNA
ggactacaggcacacaccaa

SEQ ID NO: 67823 - DNA, 20 bp, synthetic construct
  misc_feature 1..20: note = CRISPR gRNA sequence
  source 1..20: mol_type = other DNA
caggcacacaccaacatgcc

SEQ ID NO: 67824 - DNA, 20 bp, synthetic construct
  misc_feature 1..20: note = CRISPR gRNA sequence
  source 1..20: mol_type = other DNA
gctaatagtttagttttgta

SEQ ID NO: 67825 - DNA, 20 bp, synthetic construct
  misc_feature 1..20: note = CRISPR gRNA sequence
  source 1..20: mol_type = other DNA
atagtttagttttgtaagag

SEQ ID NO: 67826 - DNA, 20 bp, synthetic construct
  misc_feature 1..20: note = CRISPR gRNA sequence
  source 1..20: mol_type = other DNA
agttttgtaagagatgaagt

SEQ ID NO: 67827 - DNA, 20 bp, synthetic construct
  misc_feature 1..20: note = CRISPR gRNA sequence
  source 1..20: mol_type = other DNA
gttttgtaagagatgaagtc

SEQ ID NO: 67828 - DNA, 20 bp, synthetic construct
  misc_feature 1..20: note = CRISPR gRNA sequence
  source 1..20: mol_type = other DNA
tgtaagagatgaagtctcac

SEQ ID NO: 67829 - DNA, 20 bp, synthetic construct
  misc_feature 1..20: note = CRISPR gRNA sequence
  source 1..20: mol_type = other DNA
gtaagagatgaagtctcacc

SEQ ID NO: 67830 - DNA, 20 bp, synthetic construct
  misc_feature 1..20: note = CRISPR gRNA sequence
  source 1..20: mol_type = other DNA
taagagatgaagtctcacca

SEQ ID NO: 67831 - DNA, 20 bp, synthetic construct
  misc_feature 1..20: note = CRISPR gRNA sequence
  source 1..20: mol_type = other DNA
accatgttccccaggttggt

SEQ ID NO: 67832 - DNA, 20 bp, synthetic construct
  misc_feature 1..20: note = CRISPR gRNA sequence
  source 1..20: mol_type = other DNA
cccaggttggtctcaaactt

SEQ ID NO: 67833 - DNA, 20 bp, synthetic construct
  misc_feature 1..20: note = CRISPR gRNA sequence
  source 1..20: mol_type = other DNA
gtctcaaacttctgagctca

SEQ ID NO: 67834 - DNA, 20 bp, synthetic construct
  misc_feature 1..20: note = CRISPR gRNA sequence
  source 1..20: mol_type = other DNA
aaacttctgagctcaggtga

SEQ ID NO: 67835 - DNA, 20 bp, synthetic construct
  misc_feature 1..20: note = CRISPR gRNA sequence
  source 1..20: mol_type = other DNA
ctgagctcaggtgatcctca

SEQ ID NO: 67836 - DNA, 20 bp, synthetic construct
  misc_feature 1..20: note = CRISPR gRNA sequence
  source 1..20: mol_type = other DNA
tgagctcaggtgatcctcag

SEQ ID NO: 67837 - DNA, 20 bp, synthetic construct
  misc_feature 1..20: note = CRISPR gRNA sequence
  source 1..20: mol_type = other DNA
agctcaggtgatcctcagcc

SEQ ID NO: 67838 - DNA, 20 bp, synthetic construct
  misc_feature 1..20: note = CRISPR gRNA sequence
  source 1..20: mol_type = other DNA
aggtgatcctcagcctccca

SEQ ID NO: 67839 - DNA, 20 bp, synthetic construct
  misc_feature 1..20: note = CRISPR gRNA sequence
  source 1..20: mol_type = other DNA
agcctcccaggttgctgaga

SEQ ID NO: 67840 - DNA, 20 bp, synthetic construct
  misc_feature 1..20: note = CRISPR gRNA sequence
  source 1..20: mol_type = other DNA
ccaggttgctgagattacag

SEQ ID NO: 67841 - DNA, 20 bp, synthetic construct
  misc_feature 1..20: note = CRISPR gRNA sequence
  source 1..20: mol_type = other DNA
ctgagattacaggcatgagc

SEQ ID NO: 67842 - DNA, 20 bp, synthetic construct
  misc_feature 1..20: note = CRISPR gRNA sequence
  source 1..20: mol_type = other DNA
agattacaggcatgagccgc

SEQ ID NO: 67843 - DNA, 20 bp, synthetic construct
  misc_feature 1..20: note = CRISPR gRNA sequence
  source 1..20: mol_type = other DNA
caggcatgagccgctgtgct

SEQ ID NO: 67844 - DNA, 20 bp, synthetic construct
  misc_feature 1..20: note = CRISPR gRNA sequence
  source 1..20: mol_type = other DNA
tgcttggaatgtattttaaa

SEQ ID NO: 67845 - DNA, 20 bp, synthetic construct
  misc_feature 1..20: note = CRISPR gRNA sequence
  source 1..20: mol_type = other DNA
ggaatgtattttaaacagat

SEQ ID NO: 67846 - DNA, 20 bp, synthetic construct
  misc_feature 1..20: note = CRISPR gRNA sequence
  source 1..20: mol_type = other DNA
gaatgtattttaaacagata

SEQ ID NO: 67847 - DNA, 20 bp, synthetic construct
  misc_feature 1..20: note = CRISPR gRNA sequence
  source 1..20: mol_type = other DNA
taaacagatatgaataagaa

SEQ ID NO: 67848 - DNA, 20 bp, synthetic construct
  misc_feature 1..20: note = CRISPR gRNA sequence
  source 1..20: mol_type = other DNA
aaacagatatgaataagaaa

SEQ ID NO: 67849 - DNA, 20 bp, synthetic construct
  misc_feature 1..20: note = CRISPR gRNA sequence
  source 1..20: mol_type = other DNA
aacagatatgaataagaaat

SEQ ID NO: 67850 - DNA, 20 bp, synthetic construct
  misc_feature 1..20: note = CRISPR gRNA sequence
  source 1..20: mol_type = other DNA
tgagttttttgtttttcatt

SEQ ID NO: 67851 - DNA, 20 bp, synthetic construct
  misc_feature 1..20: note = CRISPR gRNA sequence
  source 1..20: mol_type = other DNA
gagttttttgtttttcatta

SEQ ID NO: 67852 - DNA, 20 bp, synthetic construct
  misc_feature 1..20: note = CRISPR gRNA sequence
  source 1..20: mol_type = other DNA
agttttttgtttttcattat

SEQ ID NO: 67853 - DNA, 20 bp, synthetic construct
  misc_feature 1..20: note = CRISPR gRNA sequence
  source 1..20: mol_type = other DNA
tttgtttttcattatagagg

SEQ ID NO: 67854 - DNA, 20 bp, synthetic construct
  misc_feature 1..20: note = CRISPR gRNA sequence
  source 1..20: mol_type = other DNA
ttgtttttcattatagaggg

SEQ ID NO: 67855 - DNA, 20 bp, synthetic construct
  misc_feature 1..20: note = CRISPR gRNA sequence
  source 1..20: mol_type = other DNA
tgtttttcattatagaggga

SEQ ID NO: 67856 - DNA, 20 bp, synthetic construct
  misc_feature 1..20: note = CRISPR gRNA sequence
  source 1..20: mol_type = other DNA
gtttttcattatagagggaa

SEQ ID NO: 67857 - DNA, 20 bp, synthetic construct
  misc_feature 1..20: note = CRISPR gRNA sequence
  source 1..20: mol_type = other DNA
tttttcattatagagggaaa

SEQ ID NO: 67858 - DNA, 20 bp, synthetic construct
  misc_feature 1..20: note = CRISPR gRNA sequence
  source 1..20: mol_type = other DNA
ttcattatagagggaaattt

SEQ ID NO: 67859 - DNA, 20 bp, synthetic construct
  misc_feature 1..20: note = CRISPR gRNA sequence
  source 1..20: mol_type = other DNA
tcattatagagggaaatttt

SEQ ID NO: 67860 - DNA, 20 bp, synthetic construct
  misc_feature 1..20: note = CRISPR gRNA sequence
  source 1..20: mol_type = other DNA
cattatagagggaaattttt

SEQ ID NO: 67861 - DNA, 20 bp, synthetic construct
  misc_feature 1..20: note = CRISPR gRNA sequence
  source 1..20: mol_type = other DNA
attatagagggaaatttttc

SEQ ID NO: 67862 - DNA, 20 bp, synthetic construct
  misc_feature 1..20: note = CRISPR gRNA sequence
  source 1..20: mol_type = other DNA
tagagggaaatttttctttt

SEQ ID NO: 67863 - DNA, 20 bp, synthetic construct
  misc_feature 1..20: note = CRISPR gRNA sequence
  source 1..20: mol_type = other DNA
ttcttttctttctttctttt

SEQ ID NO: 67864 - DNA, 20 bp, synthetic construct
  misc_feature 1..20: note = CRISPR gRNA sequence
  source 1..20: mol_type = other DNA
tcttttctttctttcttttt

SEQ ID NO: 67865 - DNA, 20 bp, synthetic construct
  misc_feature 1..20: note = CRISPR gRNA sequence
  source 1..20: mol_type = other DNA
cttttctttctttctttttt

SEQ ID NO: 67866 - DNA, 20 bp, synthetic construct
  misc_feature 1..20: note = CRISPR gRNA sequence
  source 1..20: mol_type = other DNA
ttttctttctttcttttttt

SEQ ID NO: 67867 - DNA, 20 bp, synthetic construct
  misc_feature 1..20: note = CRISPR gRNA sequence
  source 1..20: mol_type = other DNA
ttctttctttcttttttttt

SEQ ID NO: 67868 - DNA, 20 bp, synthetic construct
  misc_feature 1..20: note = CRISPR gRNA sequence
  source 1..20: mol_type = other DNA
tctttctttcttttttttta

SEQ ID NO: 67869 - DNA, 20 bp, synthetic construct
  misc_feature 1..20: note = CRISPR gRNA sequence
  source 1..20: mol_type = other DNA
ctttctttctttttttttag

SEQ ID NO: 67870 - DNA, 20 bp, synthetic construct
  misc_feature 1..20: note = CRISPR gRNA sequence
  source 1..20: mol_type = other DNA
tttctttctttttttttaga

SEQ ID NO: 67871 - DNA, 20 bp, synthetic construct
  misc_feature 1..20: note = CRISPR gRNA sequence
  source 1..20: mol_type = other DNA
tctttctttttttttagatg

SEQ ID NO: 67872 - DNA, 20 bp, synthetic construct
  misc_feature 1..20: note = CRISPR gRNA sequence
  source 1..20: mol_type = other DNA
ctttctttttttttagatgg

SEQ ID NO: 67873 - DNA, 20 bp, synthetic construct
  misc_feature 1..20: note = CRISPR gRNA sequence
  source 1..20: mol_type = other DNA
tttctttttttttagatgga

SEQ ID NO: 67874 - DNA, 20 bp, synthetic construct
  misc_feature 1..20: note = CRISPR gRNA sequence
  source 1..20: mol_type = other DNA
tctttttttttagatggagt

SEQ ID NO: 67875 - DNA, 20 bp, synthetic construct
  misc_feature 1..20: note = CRISPR gRNA sequence
  source 1..20: mol_type = other DNA
ctttttttttagatggagtc

SEQ ID NO: 67876 - DNA, 20 bp, synthetic construct
  misc_feature 1..20: note = CRISPR gRNA sequence
  source 1..20: mol_type = other DNA
tttttttttagatggagtct

SEQ ID NO: 67877 - DNA, 20 bp, synthetic construct
  misc_feature 1..20: note = CRISPR gRNA sequence
  source 1..20: mol_type = other DNA
tttttttagatggagtcttt

SEQ ID NO: 67878 - DNA, 20 bp, synthetic construct
  misc_feature 1..20: note = CRISPR gRNA sequence
  source 1..20: mol_type = other DNA
ttttttagatggagtctttc

SEQ ID NO: 67879 - DNA, 20 bp, synthetic construct
  misc_feature 1..20: note = CRISPR gRNA sequence
  source 1..20: mol_type = other DNA
tttttagatggagtctttct

SEQ ID NO: 67880 - DNA, 20 bp, synthetic construct
  misc_feature 1..20: note = CRISPR gRNA sequence
  source 1..20: mol_type = other DNA
ttttagatggagtctttctc

SEQ ID NO: 67881 - DNA, 20 bp, synthetic construct
  misc_feature 1..20: note = CRISPR gRNA sequence
  source 1..20: mol_type = other DNA
tttagatggagtctttctct

SEQ ID NO: 67882 - DNA, 20 bp, synthetic construct
  misc_feature 1..20: note = CRISPR gRNA sequence
  source 1..20: mol_type = other DNA
ttagatggagtctttctctg

SEQ ID NO: 67883 - DNA, 20 bp, synthetic construct
  misc_feature 1..20: note = CRISPR gRNA sequence
  source 1..20: mol_type = other DNA
tagatggagtctttctctgc

SEQ ID NO: 67884 - DNA, 20 bp, synthetic construct
  misc_feature 1..20: note = CRISPR gRNA sequence
  source 1..20: mol_type = other DNA
agatggagtctttctctgct

SEQ ID NO: 67885 - DNA, 20 bp, synthetic construct
  misc_feature 1..20: note = CRISPR gRNA sequence
  source 1..20: mol_type = other DNA
gatggagtctttctctgctg

SEQ ID NO: 67886 - DNA, 20 bp, synthetic construct
  misc_feature 1..20: note = CRISPR gRNA sequence
  source 1..20: mol_type = other DNA
tctctgctgcccaggctgga

SEQ ID NO: 67887 - DNA, 20 bp, synthetic construct
  misc_feature 1..20: note = CRISPR gRNA sequence
  source 1..20: mol_type = other DNA
ctctgctgcccaggctggaa

SEQ ID NO: 67888 - DNA, 20 bp, synthetic construct
  misc_feature 1..20: note = CRISPR gRNA sequence
  source 1..20: mol_type = other DNA
tctgctgcccaggctggaat

SEQ ID NO: 67889 - DNA, 20 bp, synthetic construct
  misc_feature 1..20: note = CRISPR gRNA sequence
  source 1..20: mol_type = other DNA
tgctgcccaggctggaatgc

SEQ ID NO: 67890 - DNA, 20 bp, synthetic construct
  misc_feature 1..20: note = CRISPR gRNA sequence
  source 1..20: mol_type = other DNA
ctgcccaggctggaatgcag

SEQ ID NO: 67891 - DNA, 20 bp, synthetic construct
  misc_feature 1..20: note = CRISPR gRNA sequence
  source 1..20: mol_type = other DNA
cccaggctggaatgcagtgg

SEQ ID NO: 67892 - DNA, 20 bp, synthetic construct
  misc_feature 1..20: note = CRISPR gRNA sequence
  source 1..20: mol_type = other DNA
gaatgcagtggcgcaatttc

SEQ ID NO: 67893 - DNA, 20 bp, synthetic construct
  misc_feature 1..20: note = CRISPR gRNA sequence
  source 1..20: mol_type = other DNA
cggctcactgcaacttccgc

SEQ ID NO: 67894 - DNA, 20 bp, synthetic construct
  misc_feature 1..20: note = CRISPR gRNA sequence
  source 1..20: mol_type = other DNA
ggctcactgcaacttccgcc

SEQ ID NO: 67895 - DNA, 20 bp, synthetic construct
  misc_feature 1..20: note = CRISPR gRNA sequence
  source 1..20: mol_type = other DNA
actgcaacttccgcctccca

SEQ ID NO: 67896 - DNA, 20 bp, synthetic construct
  misc_feature 1..20: note = CRISPR gRNA sequence
  source 1..20: mol_type = other DNA
caacttccgcctcccaggtt

SEQ ID NO: 67897 - DNA, 20 bp, synthetic construct
  misc_feature 1..20: note = CRISPR gRNA sequence
  source 1..20: mol_type = other DNA
ccgcctcccaggttcaagca

SEQ ID NO: 67898 - DNA, 20 bp, synthetic construct
  misc_feature 1..20: note = CRISPR gRNA sequence
  source 1..20: mol_type = other DNA
cgcctcccaggttcaagcaa

SEQ ID NO: 67899 - DNA, 20 bp, synthetic construct
  misc_feature 1..20: note = CRISPR gRNA sequence
  source 1..20: mol_type = other DNA
ccaggttcaagcaattctcc

SEQ ID NO: 67900 - DNA, 20 bp, synthetic construct
  misc_feature 1..20: note = CRISPR gRNA sequence
  source 1..20: mol_type = other DNA
aagcaattctcctgcctcag

SEQ ID NO: 67901 - DNA, 20 bp, synthetic construct
  misc_feature 1..20: note = CRISPR gRNA sequence
  source 1..20: mol_type = other DNA
tcctgcctcagcctcccaag

SEQ ID NO: 67902 - DNA, 20 bp, synthetic construct
  misc_feature 1..20: note = CRISPR gRNA sequence
  source 1..20: mol_type = other DNA
ctgcctcagcctcccaagga

SEQ ID NO: 67903 - DNA, 20 bp, synthetic construct
  misc_feature 1..20: note = CRISPR gRNA sequence
  source 1..20: mol_type = other DNA
cctcagcctcccaaggagct

SEQ ID NO: 67904 - DNA, 20 bp, synthetic construct
  misc_feature 1..20: note = CRISPR gRNA sequence
  source 1..20: mol_type = other DNA
agcctcccaaggagctgaga

SEQ ID NO: 67905 - DNA, 20 bp, synthetic construct
  misc_feature 1..20: note = CRISPR gRNA sequence
  source 1..20: mol_type = other DNA
ccaaggagctgagattacag

SEQ ID NO: 67906 - DNA, 20 bp, synthetic construct
  misc_feature 1..20: note = CRISPR gRNA sequence
  source 1..20: mol_type = other DNA
agattacaggcatgagccac

SEQ ID NO: 67907 - DNA, 20 bp, synthetic construct
  misc_feature 1..20: note = CRISPR gRNA sequence
  source 1..20: mol_type = other DNA
caggcatgagccaccatgcc

SEQ ID NO: 67908 - DNA, 20 bp, synthetic construct
  misc_feature 1..20: note = CRISPR gRNA sequence
  source 1..20: mol_type = other DNA
gctaattttggtatttttag

SEQ ID NO: 67909 - DNA, 20 bp, synthetic construct
  misc_feature 1..20: note = CRISPR gRNA sequence
  source 1..20: mol_type = other DNA
attttggtatttttagtaga

SEQ ID NO: 67910 - DNA, 20 bp, synthetic construct
  misc_feature 1..20: note = CRISPR gRNA sequence
  source 1..20: mol_type = other DNA
tggtatttttagtagagacg

SEQ ID NO: 67911 - DNA, 20 bp, synthetic construct
  misc_feature 1..20: note = CRISPR gRNA sequence
  source 1..20: mol_type = other DNA
ggtatttttagtagagacgg

SEQ ID NO: 67912 - DNA, 20 bp, synthetic construct
  misc_feature 1..20: note = CRISPR gRNA sequence
  source 1..20: mol_type = other DNA
gtatttttagtagagacggg

SEQ ID NO: 67913 - DNA, 20 bp, synthetic construct
  misc_feature 1..20: note = CRISPR gRNA sequence
  source 1..20: mol_type = other DNA
ttagtagagacggggtttca

SEQ ID NO: 67914 - DNA, 20 bp, synthetic construct
  misc_feature 1..20: note = CRISPR gRNA sequence
  source 1..20: mol_type = other DNA
tagtagagacggggtttcac

SEQ ID NO: 67915 - DNA, 20 bp, synthetic construct
  misc_feature 1..20: note = CRISPR gRNA sequence
  source 1..20: mol_type = other DNA
agtagagacggggtttcacc

SEQ ID NO: 67916 - DNA, 20 bp, synthetic construct
  misc_feature 1..20: note = CRISPR gRNA sequence
  source 1..20: mol_type = other DNA
gtagagacggggtttcacca

SEQ ID NO: 67917 - DNA, 20 bp, synthetic construct
  misc_feature 1..20: note = CRISPR gRNA sequence
  source 1..20: mol_type = other DNA
caccatgttggccaggctgg

SEQ ID NO: 67918 - DNA, 20 bp, synthetic construct
  misc_feature 1..20: note = CRISPR gRNA sequence
  source 1..20: mol_type = other DNA
accatgttggccaggctggt

SEQ ID NO: 67919 - DNA, 20 bp, synthetic construct
  misc_feature 1..20: note = CRISPR gRNA sequence
  source 1..20: mol_type = other DNA
gccaggctggtcttgaactc

SEQ ID NO: 67920 - DNA, 20 bp, synthetic construct
  misc_feature 1..20: note = CRISPR gRNA sequence
  source 1..20: mol_type = other DNA
gtcttgaactcctgacctca

SEQ ID NO: 67921 - DNA, 20 bp, synthetic construct
  misc_feature 1..20: note = CRISPR gRNA sequence
  source 1..20: mol_type = other DNA
gaactcctgacctcaggcga

SEQ ID NO: 67922 - DNA, 20 bp, synthetic construct
  misc_feature 1..20: note = CRISPR gRNA sequence
  source 1..20: mol_type = other DNA
aactcctgacctcaggcgat

SEQ ID NO: 67923 - DNA, 20 bp, synthetic construct
  misc_feature 1..20: note = CRISPR gRNA sequence
  source 1..20: mol_type = other DNA
ctgacctcaggcgatccgcc

SEQ ID NO: 67924 - DNA, 20 bp, synthetic construct
  misc_feature 1..20: note = CRISPR gRNA sequence
  source 1..20: mol_type = other DNA
acctcaggcgatccgcctgc

SEQ ID NO: 67925 - DNA, 20 bp, synthetic construct
  misc_feature 1..20: note = CRISPR gRNA sequence
  source 1..20: mol_type = other DNA
aggcgatccgcctgcctcgc

SEQ ID NO: 67926 - DNA, 20 bp, synthetic construct
  misc_feature 1..20: note = CRISPR gRNA sequence
  source 1..20: mol_type = other DNA
cctcgccctcccaaagtgct

SEQ ID NO: 67927 - DNA, 20 bp, synthetic construct
  misc_feature 1..20: note = CRISPR gRNA sequence
  source 1..20: mol_type = other DNA
gccctcccaaagtgctggga

SEQ ID NO: 67928 - DNA, 20 bp, synthetic construct
  misc_feature 1..20: note = CRISPR gRNA sequence
  source 1..20: mol_type = other DNA
ccaaagtgctgggattacag

SEQ ID NO: 67929 - DNA, 20 bp, synthetic construct
  misc_feature 1..20: note = CRISPR gRNA sequence
  source 1..20: mol_type = other DNA
ggattacagccttgagccac

SEQ ID NO: 67930 - DNA, 20 bp, synthetic construct
  misc_feature 1..20: note = CRISPR gRNA sequence
  source 1..20: mol_type = other DNA
cagccttgagccaccgcacc

SEQ ID NO: 67931 - DNA, 20 bp, synthetic construct
  misc_feature 1..20: note = CRISPR gRNA sequence
  source 1..20: mol_type = other DNA
gagccaccgcacccagccaa

SEQ ID NO: 67932 - DNA, 20 bp, synthetic construct
  misc_feature 1..20: note = CRISPR gRNA sequence
  source 1..20: mol_type = other DNA
agccaccgcacccagccaat

SEQ ID NO: 67933 - DNA, 20 bp, synthetic construct
  misc_feature 1..20: note = CRISPR gRNA sequence
  source 1..20: mol_type = other DNA
ttcttattttaaagactatt

SEQ ID NO: 67934 - DNA, 20 bp, synthetic construct
  misc_feature 1..20: note = CRISPR gRNA sequence
  source 1..20: mol_type = other DNA
tcttattttaaagactattt

SEQ ID NO: 67935 - DNA, 20 bp, synthetic construct
  misc_feature 1..20: note = CRISPR gRNA sequence
  source 1..20: mol_type = other DNA
cttattttaaagactatttt

SEQ ID NO: 67936 - DNA, 20 bp, synthetic construct
  misc_feature 1..20: note = CRISPR gRNA sequence
  source 1..20: mol_type = other DNA
ttattttaaagactatttta

SEQ ID NO: 67937 - DNA, 20 bp, synthetic construct
  misc_feature 1..20: note = CRISPR gRNA sequence
  source 1..20: mol_type = other DNA
attttaaagactattttatt

SEQ ID NO: 67938 - DNA, 20 bp, synthetic construct
  misc_feature 1..20: note = CRISPR gRNA sequence
  source 1..20: mol_type = other DNA
ttttaaagactattttatta

SEQ ID NO: 67939 - DNA, 20 bp, synthetic construct
  misc_feature 1..20: note = CRISPR gRNA sequence
  source 1..20: mol_type = other DNA
taaagactattttattaagt

SEQ ID NO: 67940 - DNA, 20 bp, synthetic construct
  misc_feature 1..20: note = CRISPR gRNA sequence
  source 1..20: mol_type = other DNA
aaagactattttattaagtg

SEQ ID NO: 67941 - DNA, 20 bp, synthetic construct
  misc_feature 1..20: note = CRISPR gRNA sequence
  source 1..20: mol_type = other DNA
aagactattttattaagtgg

SEQ ID NO: 67942 - DNA, 20 bp, synthetic construct
  misc_feature 1..20: note = CRISPR gRNA sequence
  source 1..20: mol_type = other DNA
ttttattaagtggcttcata

SEQ ID NO: 67943 - DNA, 20 bp, synthetic construct
  misc_feature 1..20: note = CRISPR gRNA sequence
  source 1..20: mol_type = other DNA
tattaagtggcttcataaga

SEQ ID NO: 67944 - DNA, 20 bp, synthetic construct
  misc_feature 1..20: note = CRISPR gRNA sequence
  source 1..20: mol_type = other DNA
attaagtggcttcataagac

SEQ ID NO: 67945 - DNA, 20 bp, synthetic construct
  misc_feature 1..20: note = CRISPR gRNA sequence
  source 1..20: mol_type = other DNA
ttaagtggcttcataagaca

SEQ ID NO: 67946 - DNA, 20 bp, synthetic construct
  misc_feature 1..20: note = CRISPR gRNA sequence
  source 1..20: mol_type = other DNA
agtggcttcataagacagac

SEQ ID NO: 67947 - DNA, 20 bp, synthetic construct
  misc_feature 1..20: note = CRISPR gRNA sequence
  source 1..20: mol_type = other DNA
cataagacagaccaattttt

SEQ ID NO: 67948 - DNA, 20 bp, synthetic construct
  misc_feature 1..20: note = CRISPR gRNA sequence
  source 1..20: mol_type = other DNA
ataagacagaccaattttta

SEQ ID NO: 67949 - DNA, 20 bp, synthetic construct
  misc_feature 1..20: note = CRISPR gRNA sequence
  source 1..20: mol_type = other DNA
ttaaatgacgtttctcagga

SEQ ID NO: 67950 - DNA, 20 bp, synthetic construct
  misc_feature 1..20: note = CRISPR gRNA sequence
  source 1..20: mol_type = other DNA
taaatgacgtttctcaggaa

SEQ ID NO: 67951 - DNA, 20 bp, synthetic construct
  misc_feature 1..20: note = CRISPR gRNA sequence
  source 1..20: mol_type = other DNA
aaatgacgtttctcaggaaa

SEQ ID NO: 67952 - DNA, 20 bp, synthetic construct
  misc_feature 1..20: note = CRISPR gRNA sequence
  source 1..20: mol_type = other DNA
aatgacgtttctcaggaaaa

SEQ ID NO: 67953 - DNA, 20 bp, synthetic construct
  misc_feature 1..20: note = CRISPR gRNA sequence
  source 1..20: mol_type = other DNA
ctcaggaaaagatgaaatta

SEQ ID NO: 67954 - DNA, 20 bp, synthetic construct
  misc_feature 1..20: note = CRISPR gRNA sequence
  source 1..20: mol_type = other DNA
tcaggaaaagatgaaattaa

SEQ ID NO: 67955 - DNA, 20 bp, synthetic construct
  misc_feature 1..20: note = CRISPR gRNA sequence
  source 1..20: mol_type = other DNA
aggaaaagatgaaattaaca

SEQ ID NO: 67956 - DNA, 20 bp, synthetic construct
  misc_feature 1..20: note = CRISPR gRNA sequence
  source 1..20: mol_type = other DNA
acaaacatcaaaaatgtcac

SEQ ID NO: 67957 - DNA, 20 bp, synthetic construct
  misc_feature 1..20: note = CRISPR gRNA sequence
  source 1..20: mol_type = other DNA
ggaggaaaatcagatgttcc

SEQ ID NO: 67958 - DNA, 20 bp, synthetic construct
  misc_feature 1..20: note = CRISPR gRNA sequence
  source 1..20: mol_type = other DNA
cgggacacactggttatatt

SEQ ID NO: 67959 - DNA, 20 bp, synthetic construct
  misc_feature 1..20: note = CRISPR gRNA sequence
  source 1..20: mol_type = other DNA
gttatattatttctgaaact

SEQ ID NO: 67960 - DNA, 20 bp, synthetic construct
  misc_feature 1..20: note = CRISPR gRNA sequence
  source 1..20: mol_type = other DNA
tattatttctgaaactgtag

SEQ ID NO: 67961 - DNA, 20 bp, synthetic construct
  misc_feature 1..20: note = CRISPR gRNA sequence
  source 1..20: mol_type = other DNA
tttctgaaactgtagttaaa

SEQ ID NO: 67962 - DNA, 20 bp, synthetic construct
  misc_feature 1..20: note = CRISPR gRNA sequence
  source 1..20: mol_type = other DNA
ctgaaactgtagttaaaact

SEQ ID NO: 67963 - DNA, 20 bp, synthetic construct
  misc_feature 1..20: note = CRISPR gRNA sequence
  source 1..20: mol_type = other DNA
tgaaactgtagttaaaacta

SEQ ID NO: 67964 - DNA, 20 bp, synthetic construct
  misc_feature 1..20: note = CRISPR gRNA sequence
  source 1..20: mol_type = other DNA
aaactgtagttaaaactagc

SEQ ID NO: 67965 - DNA, 20 bp, synthetic construct
  misc_feature 1..20: note = CRISPR gRNA sequence
  source 1..20: mol_type = other DNA
tagttaaaactagctgggcg

SEQ ID NO: 67966 - DNA, 20 bp, synthetic construct
  misc_feature 1..20: note = CRISPR gRNA sequence
  source 1..20: mol_type = other DNA
aaactagctgggcgtggtgg

SEQ ID NO: 67967 - DNA, 20 bp, synthetic construct
  misc_feature 1..20: note = CRISPR gRNA sequence
  source 1..20: mol_type = other DNA
gctgggcgtggtggctcacg

SEQ ID NO: 67968 - DNA, 20 bp, synthetic construct
  misc_feature 1..20: note = CRISPR gRNA sequence
  source 1..20: mol_type = other DNA
ggcgtggtggctcacgcctg

SEQ ID NO: 67969 - DNA, 20 bp, synthetic construct
  misc_feature 1..20: note = CRISPR gRNA sequence
  source 1..20: mol_type = other DNA
acgcctgtaatcccagcact

SEQ ID NO: 67970 - DNA, 20 bp, synthetic construct
  misc_feature 1..20: note = CRISPR gRNA sequence
  source 1..20: mol_type = other DNA
taatcccagcactttgggag

SEQ ID NO: 67971 - DNA, 20 bp, synthetic construct
  misc_feature 1..20: note = CRISPR gRNA sequence
  source 1..20: mol_type = other DNA
tgggaggccaaagcgggtgg

SEQ ID NO: 67972 - DNA, 20 bp, synthetic construct
  misc_feature 1..20: note = CRISPR gRNA sequence
  source 1..20: mol_type = other DNA
gggaggccaaagcgggtgga

SEQ ID NO: 67973 - DNA, 20 bp, synthetic construct
  misc_feature 1..20: note = CRISPR gRNA sequence
  source 1..20: mol_type = other DNA
ggaggccaaagcgggtggat

SEQ ID NO: 67974 - DNA, 20 bp, synthetic construct
  misc_feature 1..20: note = CRISPR gRNA sequence
  source 1..20: mol_type = other DNA
aggtcaggagtttgagacca

SEQ ID NO: 67975 - DNA, 20 bp, synthetic construct
  misc_feature 1..20: note = CRISPR gRNA sequence
  source 1..20: mol_type = other DNA
gagaccagcctgatcaacat

SEQ ID NO: 67976 - DNA, 20 bp, synthetic construct
  misc_feature 1..20: note = CRISPR gRNA sequence
  source 1..20: mol_type = other DNA
agaccagcctgatcaacatg

SEQ ID NO: 67977 - DNA, 20 bp, synthetic construct
  misc_feature 1..20: note = CRISPR gRNA sequence
  source 1..20: mol_type = other DNA
atcaacatggtgaaaacccg

SEQ ID NO: 67978 - DNA, 20 bp, synthetic construct
  misc_feature 1..20: note = CRISPR gRNA sequence
  source 1..20: mol_type = other DNA
tactaaaaatacaaaaataa

SEQ ID NO: 67979 - DNA, 20 bp, synthetic construct
  misc_feature 1..20: note = CRISPR gRNA sequence
  source 1..20: mol_type = other DNA
ctaaaaatacaaaaataatt

SEQ ID NO: 67980 - DNA, 20 bp, synthetic construct
  misc_feature 1..20: note = CRISPR gRNA sequence
  source 1..20: mol_type = other DNA
aaaatacaaaaataattagc

SEQ ID NO: 67981 - DNA, 20 bp, synthetic construct
  misc_feature 1..20: note = CRISPR gRNA sequence
  source 1..20: mol_type = other DNA
gccaggcatagtggcacatg

SEQ ID NO: 67982 - DNA, 20 bp, synthetic construct
  misc_feature 1..20: note = CRISPR gRNA sequence
  source 1..20: mol_type = other DNA
taatcccagctacttgggag

SEQ ID NO: 67983 - DNA, 20 bp, synthetic construct
  misc_feature 1..20: note = CRISPR gRNA sequence
  source 1..20: mol_type = other DNA
cttgggaggctgaggcagga

SEQ ID NO: 67984 - DNA, 20 bp, synthetic construct
  misc_feature 1..20: note = CRISPR gRNA sequence
  source 1..20: mol_type = other DNA
gggaggctgaggcaggagaa

SEQ ID NO: 67985 - DNA, 20 bp, synthetic construct
  misc_feature 1..20: note = CRISPR gRNA sequence
  source 1..20: mol_type = other DNA
ggaggctgaggcaggagaat

SEQ ID NO: 67986 - DNA, 20 bp, synthetic construct
  misc_feature 1..20: note = CRISPR gRNA sequence
  source 1..20: mol_type = other DNA
aggcaggagaatctcttgaa

SEQ ID NO: 67987 - DNA, 20 bp, synthetic construct
  misc_feature 1..20: note = CRISPR gRNA sequence
  source 1..20: mol_type = other DNA
ttgaacctgggagacagagg

SEQ ID NO: 67988 - DNA, 20 bp, synthetic construct
  misc_feature 1..20: note = CRISPR gRNA sequence
  source 1..20: mol_type = other DNA
gaacctgggagacagaggtc

SEQ ID NO: 67989 - DNA, 20 bp, synthetic construct
  misc_feature 1..20: note = CRISPR gRNA sequence
  source 1..20: mol_type = other DNA
aacctgggagacagaggtcg

SEQ ID NO: 67990 - DNA, 20 bp, synthetic construct
  misc_feature 1..20: note = CRISPR gRNA sequence
  source 1..20: mol_type = other DNA
ggagacagaggtcgcagtga

SEQ ID NO: 67991 - DNA, 20 bp, synthetic construct
  misc_feature 1..20: note = CRISPR gRNA sequence
  source 1..20: mol_type = other DNA
cactccagcctgggcaacag

SEQ ID NO: 67992 - DNA, 20 bp, synthetic construct
  misc_feature 1..20: note = CRISPR gRNA sequence
  source 1..20: mol_type = other DNA
cagcctgggcaacagagcaa

SEQ ID NO: 67993 - DNA, 20 bp, synthetic construct
  misc_feature 1..20: note = CRISPR gRNA sequence
  source 1..20: mol_type = other DNA
ggcaacagagcaagactcca

SEQ ID NO: 67994 - DNA, 20 bp, synthetic construct
  misc_feature 1..20: note = CRISPR gRNA sequence
  source 1..20: mol_type = other DNA
catctcaaaataaataaata

SEQ ID NO: 67995 - DNA, 20 bp, synthetic construct
  misc_feature 1..20: note = CRISPR gRNA sequence
  source 1..20: mol_type = other DNA
aaaataaataaataaataaa

SEQ ID NO: 67996 - DNA, 20 bp, synthetic construct
  misc_feature 1..20: note = CRISPR gRNA sequence
  source 1..20: mol_type = other DNA
caatgaagggaagtaagaaa

SEQ ID NO: 67997 - DNA, 20 bp, synthetic construct
  misc_feature 1..20: note = CRISPR gRNA sequence
  source 1..20: mol_type = other DNA
caggtgaggtttccaatatt

SEQ ID NO: 67998 - DNA, 20 bp, synthetic construct
  misc_feature 1..20: note = CRISPR gRNA sequence
  source 1..20: mol_type = other DNA
aggtgaggtttccaatattg

SEQ ID NO: 67999 - DNA, 20 bp, synthetic construct
  misc_feature 1..20: note = CRISPR gRNA sequence
  source 1..20: mol_type = other DNA
ccaatattgatattgcattc

SEQ ID NO: 68000 - DNA, 20 bp, synthetic construct
  misc_feature 1..20: note = CRISPR gRNA sequence
  source 1..20: mol_type = other DNA
caatattgatattgcattcc

SEQ ID NO: 68001 - DNA, 20 bp, synthetic construct
  misc_feature 1..20: note = CRISPR gRNA sequence
  source 1..20: mol_type = other DNA
atattgcattcccagattaa

SEQ ID NO: 68002 - DNA, 20 bp, synthetic construct
  misc_feature 1..20: note = CRISPR gRNA sequence
  source 1..20: mol_type = other DNA
cattcccagattaaaagaag

SEQ ID NO: 68003 - DNA, 20 bp, synthetic construct
  misc_feature 1..20: note = CRISPR gRNA sequence
  source 1..20: mol_type = other DNA
ccagattaaaagaagaaatc

SEQ ID NO: 68004 - DNA, 20 bp, synthetic construct
  misc_feature 1..20: note = CRISPR gRNA sequence
  source 1..20: mol_type = other DNA
aaagaagaaatctatgggtt

SEQ ID NO: 68005 - DNA, 20 bp, synthetic construct
  misc_feature 1..20: note = CRISPR gRNA sequence
  source 1..20: mol_type = other DNA
tgggtttaatgcatcctgca

SEQ ID NO: 68006 - DNA, 20 bp, synthetic construct
  misc_feature 1..20: note = CRISPR gRNA sequence
  source 1..20: mol_type = other DNA
aatgcatcctgcaaacattt

SEQ ID NO: 68007 - DNA, 20 bp, synthetic construct
  misc_feature 1..20: note = CRISPR gRNA sequence
  source 1..20: mol_type = other DNA
atgcatcctgcaaacatttt

SEQ ID NO: 68008 - DNA, 20 bp, synthetic construct
  misc_feature 1..20: note = CRISPR gRNA sequence
  source 1..20: mol_type = other DNA
caaacatttttttttcctga

SEQ ID NO: 68009 - DNA, 20 bp, synthetic construct
  misc_feature 1..20: note = CRISPR gRNA sequence
  source 1..20: mol_type = other DNA
ttttttcctgaatttcctct

SEQ ID NO: 68010 - DNA, 20 bp, synthetic construct
  misc_feature 1..20: note = CRISPR gRNA sequence
  source 1..20: mol_type = other DNA
tttttcctgaatttcctctc

SEQ ID NO: 68011 - DNA, 20 bp, synthetic construct
  misc_feature 1..20: note = CRISPR gRNA sequence
  source 1..20: mol_type = other DNA
ttttcctgaatttcctctca

SEQ ID NO: 68012 - DNA, 20 bp, synthetic construct
  misc_feature 1..20: note = CRISPR gRNA sequence
  source 1..20: mol_type = other DNA
tttcctgaatttcctctcat

SEQ ID NO: 68013 - DNA, 20 bp, synthetic construct
  misc_feature 1..20: note = CRISPR gRNA sequence
  source 1..20: mol_type = other DNA
ttcctgaatttcctctcatt

SEQ ID NO: 68014 - DNA, 20 bp, synthetic construct
  misc_feature 1..20: note = CRISPR gRNA sequence
  source 1..20: mol_type = other DNA
tcctgaatttcctctcattc

SEQ ID NO: 68015 - DNA, 20 bp, synthetic construct
  misc_feature 1..20: note = CRISPR gRNA sequence
  source 1..20: mol_type = other DNA
cctgaatttcctctcattca

SEQ ID NO: 68016 - DNA, 20 bp, synthetic construct
  misc_feature 1..20: note = CRISPR gRNA sequence
  source 1..20: mol_type = other DNA
ctgaatttcctctcattcaa

SEQ ID NO: 68017 - DNA, 20 bp, synthetic construct
  misc_feature 1..20: note = CRISPR gRNA sequence
  source 1..20: mol_type = other DNA
aatttcctctcattcaaaaa

SEQ ID NO: 68018 - DNA, 20 bp, synthetic construct
  misc_feature 1..20: note = CRISPR gRNA sequence
  source 1..20: mol_type = other DNA
cctctcattcaaaaactgtg

SEQ ID NO: 68019 - DNA, 20 bp, synthetic construct
  misc_feature 1..20: note = CRISPR gRNA sequence
  source 1..20: mol_type = other DNA
ctctcattcaaaaactgtgg

SEQ ID NO: 68020 - DNA, 20 bp, synthetic construct
  misc_feature 1..20: note = CRISPR gRNA sequence
  source 1..20: mol_type = other DNA
tcattcaaaaactgtggatc

SEQ ID NO: 68021 - DNA, 20 bp, synthetic construct
  misc_feature 1..20: note = CRISPR gRNA sequence
  source 1..20: mol_type = other DNA
attcaaaaactgtggatccc

SEQ ID NO: 68022 - DNA, 20 bp, synthetic construct
  misc_feature 1..20: note = CRISPR gRNA sequence
  source 1..20: mol_type = other DNA
aaaaactgtggatcccaaat

SEQ ID NO: 68023 - DNA, 20 bp, synthetic construct
  misc_feature 1..20: note = CRISPR gRNA sequence
  source 1..20: mol_type = other DNA
tggatcccaaatgatgccgg

SEQ ID NO: 68024 - DNA, 20 bp, synthetic construct
  misc_feature 1..20: note = CRISPR gRNA sequence
  source 1..20: mol_type = other DNA
gtttttctttaacccttgaa

SEQ ID NO: 68025 - DNA, 20 bp, synthetic construct
  misc_feature 1..20: note = CRISPR gRNA sequence
  source 1..20: mol_type = other DNA
ttctttaacccttgaaagcc

SEQ ID NO: 68026 - DNA, 20 bp, synthetic construct
  misc_feature 1..20: note = CRISPR gRNA sequence
  source 1..20: mol_type = other DNA
tctttaacccttgaaagcct

SEQ ID NO: 68027 - DNA, 20 bp, synthetic construct
  misc_feature 1..20: note = CRISPR gRNA sequence
  source 1..20: mol_type = other DNA
ctttaacccttgaaagcctg

SEQ ID NO: 68028 - DNA, 20 bp, synthetic construct
  misc_feature 1..20: note = CRISPR gRNA sequence
  source 1..20: mol_type = other DNA
tttaacccttgaaagcctgc

SEQ ID NO: 68029 - DNA, 20 bp, synthetic construct
  misc_feature 1..20: note = CRISPR gRNA sequence
  source 1..20: mol_type = other DNA
taacccttgaaagcctgctg

SEQ ID NO: 68030 - DNA, 20 bp, synthetic construct
  misc_feature 1..20: note = CRISPR gRNA sequence
  source 1..20: mol_type = other DNA
aacccttgaaagcctgctgg

SEQ ID NO: 68031 - DNA, 20 bp, synthetic construct
  misc_feature 1..20: note = CRISPR gRNA sequence
  source 1..20: mol_type = other DNA
acccttgaaagcctgctgga

SEQ ID NO: 68032 - DNA, 20 bp, synthetic construct
  misc_feature 1..20: note = CRISPR gRNA sequence
  source 1..20: mol_type = other DNA
gaaagcctgctggaggcacc

SEQ ID NO: 68033 - DNA, 20 bp, synthetic construct
  misc_feature 1..20: note = CRISPR gRNA sequence
  source 1..20: mol_type = other DNA
aaagcctgctggaggcacct

SEQ ID NO: 68034 - DNA, 20 bp, synthetic construct
  misc_feature 1..20: note = CRISPR gRNA sequence
  source 1..20: mol_type = other DNA
ctggaggcacctgagctatg

SEQ ID NO: 68035 - DNA, 20 bp, synthetic construct
  misc_feature 1..20: note = CRISPR gRNA sequence
  source 1..20: mol_type = other DNA
gaggcacctgagctatgagt

SEQ ID NO: 68036 - DNA, 20 bp, synthetic construct
  misc_feature 1..20: note = CRISPR gRNA sequence
  source 1..20: mol_type = other DNA
agctatgagtggtcacccga

SEQ ID NO: 68037 - DNA, 20 bp, synthetic construct
  misc_feature 1..20: note = CRISPR gRNA sequence
  source 1..20: mol_type = other DNA
tgagtggtcacccgatatgg

SEQ ID NO: 68038 - DNA, 20 bp, synthetic construct
  misc_feature 1..20: note = CRISPR gRNA sequence
  source 1..20: mol_type = other DNA
actgtggtgctggggagggg

SEQ ID NO: 68039 - DNA, 20 bp, synthetic construct
  misc_feature 1..20: note = CRISPR gRNA sequence
  source 1..20: mol_type = other DNA
ctgtggtgctggggagggga

SEQ ID NO: 68040 - DNA, 20 bp, synthetic construct
  misc_feature 1..20: note = CRISPR gRNA sequence
  source 1..20: mol_type = other DNA
tggtgctggggaggggatag

SEQ ID NO: 68041 - DNA, 20 bp, synthetic construct
  misc_feature 1..20: note = CRISPR gRNA sequence
  source 1..20: mol_type = other DNA
gggaggggatagtagcagag

SEQ ID NO: 68042 - DNA, 20 bp, synthetic construct
  misc_feature 1..20: note = CRISPR gRNA sequence
  source 1..20: mol_type = other DNA
ctggtcattctagtggtgat

SEQ ID NO: 68043 - DNA, 20 bp, synthetic construct
  misc_feature 1..20: note = CRISPR gRNA sequence
  source 1..20: mol_type = other DNA
gtcattctagtggtgatgga

SEQ ID NO: 68044 - DNA, 20 bp, synthetic construct
  misc_feature 1..20: note = CRISPR gRNA sequence
  source 1..20: mol_type = other DNA
tagtggtgatggaagggatg

SEQ ID NO: 68045 - DNA, 20 bp, synthetic construct
  misc_feature 1..20: note = CRISPR gRNA sequence
  source 1..20: mol_type = other DNA
gtggtgatggaagggatggt

SEQ ID NO: 68046 - DNA, 20 bp, synthetic construct
  misc_feature 1..20: note = CRISPR gRNA sequence
  source 1..20: mol_type = other DNA
ggcttggtggtgtagaattg

SEQ ID NO: 68047 - DNA, 20 bp, synthetic construct
  misc_feature 1..20: note = CRISPR gRNA sequence
  source 1..20: mol_type = other DNA
ggtggtgtagaattgtggtg

SEQ ID NO: 68048 - DNA, 20 bp, synthetic construct
  misc_feature 1..20: note = CRISPR gRNA sequence
  source 1..20: mol_type = other DNA
gtggtgtagaattgtggtga

SEQ ID NO: 68049 - DNA, 20 bp, synthetic construct
  misc_feature 1..20: note = CRISPR gRNA sequence
  source 1..20: mol_type = other DNA
tggtgataatgaaagtggtg

SEQ ID NO: 68050 - DNA, 20 bp, synthetic construct
  misc_feature 1..20: note = CRISPR gRNA sequence
  source 1..20: mol_type = other DNA
gtggtggtgacattggtggt

SEQ ID NO: 68051 - DNA, 20 bp, synthetic construct
  misc_feature 1..20: note = CRISPR gRNA sequence
  source 1..20: mol_type = other DNA
gtggtggtggtgatggtggt

SEQ ID NO: 68052 - DNA, 20 bp, synthetic construct
  misc_feature 1..20: note = CRISPR gRNA sequence
  source 1..20: mol_type = other DNA
gtgatggtggtgatggtggt

SEQ ID NO: 68053 - DNA, 20 bp, synthetic construct
  misc_feature 1..20: note = CRISPR gRNA sequence
  source 1..20: mol_type = other DNA
gtgaccctgacatggggtcc

SEQ ID NO: 68054 - DNA, 20 bp, synthetic construct
  misc_feature 1..20: note = CRISPR gRNA sequence
  source 1..20: mol_type = other DNA
acatggggtccagtagcagt

SEQ ID NO: 68055 - DNA, 20 bp, synthetic construct
  misc_feature 1..20: note = CRISPR gRNA sequence
  source 1..20: mol_type = other DNA
ctggtgactgaggagcatct

SEQ ID NO: 68056 - DNA, 20 bp, synthetic construct
  misc_feature 1..20: note = CRISPR gRNA sequence
  source 1..20: mol_type = other DNA
gtgactgaggagcatctcag

SEQ ID NO: 68057 - DNA, 20 bp, synthetic construct
  misc_feature 1..20: note = CRISPR gRNA sequence
  source 1..20: mol_type = other DNA
aggagcatctcaggctgagg

SEQ ID NO: 68058 - DNA, 20 bp, synthetic construct
  misc_feature 1..20: note = CRISPR gRNA sequence
  source 1..20: mol_type = other DNA
aggctgaggaggcacctctg

SEQ ID NO: 68059 - DNA, 20 bp, synthetic construct
  misc_feature 1..20: note = CRISPR gRNA sequence
  source 1..20: mol_type = other DNA
aggaggcacctctgatcccc

SEQ ID NO: 68060 - DNA, 20 bp, synthetic construct
  misc_feature 1..20: note = CRISPR gRNA sequence
  source 1..20: mol_type = other DNA
tgatccccgccactgctcct

SEQ ID NO: 68061 - DNA, 20 bp, synthetic construct
  misc_feature 1..20: note = CRISPR gRNA sequence
  source 1..20: mol_type = other DNA
atccccgccactgctcctta

SEQ ID NO: 68062 - DNA, 20 bp, synthetic construct
  misc_feature 1..20: note = CRISPR gRNA sequence
  source 1..20: mol_type = other DNA
ctccttaccccctacagtct

SEQ ID NO: 68063 - DNA, 20 bp, synthetic construct
  misc_feature 1..20: note = CRISPR gRNA sequence
  source 1..20: mol_type = other DNA
cttaccccctacagtctctc

SEQ ID NO: 68064 - DNA, 20 bp, synthetic construct
  misc_feature 1..20: note = CRISPR gRNA sequence
  source 1..20: mol_type = other DNA
accccctacagtctctcagc

SEQ ID NO: 68065 - DNA, 20 bp, synthetic construct
  misc_feature 1..20: note = CRISPR gRNA sequence
  source 1..20: mol_type = other DNA
ccccctacagtctctcagca

SEQ ID NO: 68066 - DNA, 20 bp, synthetic construct
  misc_feature 1..20: note = CRISPR gRNA sequence
  source 1..20: mol_type = other DNA
cagtctctcagcaaacctgc

SEQ ID NO: 68067 - DNA, 20 bp, synthetic construct
  misc_feature 1..20: note = CRISPR gRNA sequence
  source 1..20: mol_type = other DNA
tcagcaaacctgctgggcga

SEQ ID NO: 68068 - DNA, 20 bp, synthetic construct
  misc_feature 1..20: note = CRISPR gRNA sequence
  source 1..20: mol_type = other DNA
agcaaacctgctgggcgaca

SEQ ID NO: 68069 - DNA, 20 bp, synthetic construct
  misc_feature 1..20: note = CRISPR gRNA sequence
  source 1..20: mol_type = other DNA
ctgggcgacagcggactcag

SEQ ID NO: 68070 - DNA, 20 bp, synthetic construct
  misc_feature 1..20: note = CRISPR gRNA sequence
  source 1..20: mol_type = other DNA
ggcgacagcggactcagatg

SEQ ID NO: 68071 - DNA, 20 bp, synthetic construct
  misc_feature 1..20: note = CRISPR gRNA sequence
  source 1..20: mol_type = other DNA
agatgccttctggaatgtct

SEQ ID NO: 68072 - DNA, 20 bp, synthetic construct
  misc_feature 1..20: note = CRISPR gRNA sequence
  source 1..20: mol_type = other DNA
ctggaatgtctgccgcaggt

SEQ ID NO: 68073 - DNA, 20 bp, synthetic construct
  misc_feature 1..20: note = CRISPR gRNA sequence
  source 1..20: mol_type = other DNA
tggaatgtctgccgcaggtg

SEQ ID NO: 68074 - DNA, 20 bp, synthetic construct
  misc_feature 1..20: note = CRISPR gRNA sequence
  source 1..20: mol_type = other DNA
gaatgtctgccgcaggtgcc

SEQ ID NO: 68075 - DNA, 20 bp, synthetic construct
  misc_feature 1..20: note = CRISPR gRNA sequence
  source 1..20: mol_type = other DNA
ccgcaggtgcccatctccgg

SEQ ID NO: 68076 - DNA, 20 bp, synthetic construct
  misc_feature 1..20: note = CRISPR gRNA sequence
  source 1..20: mol_type = other DNA
cggtttgcttgagtaagtgg

SEQ ID NO: 68077 - DNA, 20 bp, synthetic construct
  misc_feature 1..20: note = CRISPR gRNA sequence
  source 1..20: mol_type = other DNA
gcttgagtaagtggaaagca

SEQ ID NO: 68078 - DNA, 20 bp, synthetic construct
  misc_feature 1..20: note = CRISPR gRNA sequence
  source 1..20: mol_type = other DNA
cttgagtaagtggaaagcag

SEQ ID NO: 68079 - DNA, 20 bp, synthetic construct
  misc_feature 1..20: note = CRISPR gRNA sequence
  source 1..20: mol_type = other DNA
gagtaagtggaaagcagcat

SEQ ID NO: 68080 - DNA, 20 bp, synthetic construct
  misc_feature 1..20: note = CRISPR gRNA sequence
  source 1..20: mol_type = other DNA
agtaagtggaaagcagcata

SEQ ID NO: 68081 - DNA, 20 bp, synthetic construct
  misc_feature 1..20: note = CRISPR gRNA sequence
  source 1..20: mol_type = other DNA
ccctaggccaaaagcatgat

SEQ ID NO: 68082 - DNA, 20 bp, synthetic construct
  misc_feature 1..20: note = CRISPR gRNA sequence
  source 1..20: mol_type = other DNA
ggccaaaagcatgatggggg

SEQ ID NO: 68083 - DNA, 20 bp, synthetic construct
  misc_feature 1..20: note = CRISPR gRNA sequence
  source 1..20: mol_type = other DNA
cttctgagggcatcccccag

SEQ ID NO: 68084 - DNA, 20 bp, synthetic construct
  misc_feature 1..20: note = CRISPR gRNA sequence
  source 1..20: mol_type = other DNA
ctgagggcatcccccagagc

SEQ ID NO: 68085 - DNA, 20 bp, synthetic construct
  misc_feature 1..20: note = CRISPR gRNA sequence
  source 1..20: mol_type = other DNA
tgagggcatcccccagagca

SEQ ID NO: 68086 - DNA, 20 bp, synthetic construct
  misc_feature 1..20: note = CRISPR gRNA sequence
  source 1..20: mol_type = other DNA
agggcatcccccagagcacc

SEQ ID NO: 68087 - DNA, 20 bp, synthetic construct
  misc_feature 1..20: note = CRISPR gRNA sequence
  source 1..20: mol_type = other DNA
tggagggcaaggggcaattc

SEQ ID NO: 68088 - DNA, 20 bp, synthetic construct
  misc_feature 1..20: note = CRISPR gRNA sequence
  source 1..20: mol_type = other DNA
ttcccttgccttcactcccc

SEQ ID NO: 68089 - DNA, 20 bp, synthetic construct
  misc_feature 1..20: note = CRISPR gRNA sequence
  source 1..20: mol_type = other DNA
cccttgccttcactcccctg

SEQ ID NO: 68090 - DNA, 20 bp, synthetic construct
  misc_feature 1..20: note = CRISPR gRNA sequence
  source 1..20: mol_type = other DNA
ccttgccttcactcccctgg

SEQ ID NO: 68091 - DNA, 20 bp, synthetic construct
  misc_feature 1..20: note = CRISPR gRNA sequence
  source 1..20: mol_type = other DNA
gccttcactcccctggcctt

SEQ ID NO: 68092 - DNA, 20 bp, synthetic construct
  misc_feature 1..20: note = CRISPR gRNA sequence
  source 1..20: mol_type = other DNA
ccttcactcccctggccttg

SEQ ID NO: 68093 - DNA, 20 bp, synthetic construct
  misc_feature 1..20: note = CRISPR gRNA sequence
  source 1..20: mol_type = other DNA
cactcccctggccttgggtc

SEQ ID NO: 68094 - DNA, 20 bp, synthetic construct
  misc_feature 1..20: note = CRISPR gRNA sequence
  source 1..20: mol_type = other DNA
actcccctggccttgggtcc

SEQ ID NO: 68095 - DNA, 20 bp, synthetic construct
  misc_feature 1..20: note = CRISPR gRNA sequence
  source 1..20: mol_type = other DNA
ccctggccttgggtcctttc

SEQ ID NO: 68096 - DNA, 20 bp, synthetic construct
  misc_feature 1..20: note = CRISPR gRNA sequence
  source 1..20: mol_type = other DNA
gccttgggtcctttcctctg

SEQ ID NO: 68097 - DNA, 20 bp, synthetic construct
  misc_feature 1..20: note = CRISPR gRNA sequence
  source 1..20: mol_type = other DNA
gggtcctttcctctgtccct

SEQ ID NO: 68098 - DNA, 20 bp, synthetic construct
  misc_feature 1..20: note = CRISPR gRNA sequence
  source 1..20: mol_type = other DNA
ggtcctttcctctgtccctc

SEQ ID NO: 68099 - DNA, 20 bp, synthetic construct
  misc_feature 1..20: note = CRISPR gRNA sequence
  source 1..20: mol_type = other DNA
tcctctgtccctcacaccca

SEQ ID NO: 68100 - DNA, 20 bp, synthetic construct
  misc_feature 1..20: note = CRISPR gRNA sequence
  source 1..20: mol_type = other DNA
cctctgtccctcacacccac

SEQ ID NO: 68101 - DNA, 20 bp, synthetic construct
  misc_feature 1..20: note = CRISPR gRNA sequence
  source 1..20: mol_type = other DNA
ctctgtccctcacacccacc

SEQ ID NO: 68102 - DNA, 20 bp, synthetic construct
  misc_feature 1..20: note = CRISPR gRNA sequence
  source 1..20: mol_type = other DNA
tgtccctcacacccaccatg

SEQ ID NO: 68103 - DNA, 20 bp, synthetic construct
  misc_feature 1..20: note = CRISPR gRNA sequence
  source 1..20: mol_type = other DNA
tccctcacacccaccatggg

SEQ ID NO: 68104 - DNA, 20 bp, synthetic construct
  misc_feature 1..20: note = CRISPR gRNA sequence
  source 1..20: mol_type = other DNA
acacccaccatgggcagatc

SEQ ID NO: 68105 - DNA, 20 bp, synthetic construct
  misc_feature 1..20: note = CRISPR gRNA sequence
  source 1..20: mol_type = other DNA
caccaaacacccaagagagg

SEQ ID NO: 68106 - DNA, 20 bp, synthetic construct
  misc_feature 1..20: note = CRISPR gRNA sequence
  source 1..20: mol_type = other DNA
tgattcgtggcagggtgaca

SEQ ID NO: 68107 - DNA, 20 bp, synthetic construct
  misc_feature 1..20: note = CRISPR gRNA sequence
  source 1..20: mol_type = other DNA
gtggcagggtgacacacccc

SEQ ID NO: 68108 - DNA, 20 bp, synthetic construct
  misc_feature 1..20: note = CRISPR gRNA sequence
  source 1..20: mol_type = other DNA
cagccaaactgacctgggga

SEQ ID NO: 68109 - DNA, 20 bp, synthetic construct
  misc_feature 1..20: note = CRISPR gRNA sequence
  source 1..20: mol_type = other DNA
acctggggacagggaagcaa

SEQ ID NO: 68110 - DNA, 20 bp, synthetic construct
  misc_feature 1..20: note = CRISPR gRNA sequence
  source 1..20: mol_type = other DNA
gggacagggaagcaacattc

SEQ ID NO: 68111 - DNA, 20 bp, synthetic construct
  misc_feature 1..20: note = CRISPR gRNA sequence
  source 1..20: mol_type = other DNA
catccccaaccagctgatgc

SEQ ID NO: 68112 - DNA, 20 bp, synthetic construct
  misc_feature 1..20: note = CRISPR gRNA sequence
  source 1..20: mol_type = other DNA
atgcgggattgcagctgcct

SEQ ID NO: 68113 - DNA, 20 bp, synthetic construct
  misc_feature 1..20: note = CRISPR gRNA sequence
  source 1..20: mol_type = other DNA
cagctgcctggctcctggtc

SEQ ID NO: 68114 - DNA, 20 bp, synthetic construct
  misc_feature 1..20: note = CRISPR gRNA sequence
  source 1..20: mol_type = other DNA
cctggctcctggtccatccc

SEQ ID NO: 68115 - DNA, 20 bp, synthetic construct
  misc_feature 1..20: note = CRISPR gRNA sequence
  source 1..20: mol_type = other DNA
gctcctggtccatcccgtcc

SEQ ID NO: 68116 - DNA, 20 bp, synthetic construct
  misc_feature 1..20: note = CRISPR gRNA sequence
  source 1..20: mol_type = other DNA
ctggtccatcccgtccctga

SEQ ID NO: 68117 - DNA, 20 bp, synthetic construct
  misc_feature 1..20: note = CRISPR gRNA sequence
  source 1..20: mol_type = other DNA
gtccatcccgtccctgaaat

SEQ ID NO: 68118 - DNA, 20 bp, synthetic construct
  misc_feature 1..20: note = CRISPR gRNA sequence
  source 1..20: mol_type = other DNA
aaattcttctgacccaatct

SEQ ID NO: 68119 - DNA, 20 bp, synthetic construct
  misc_feature 1..20: note = CRISPR gRNA sequence
  source 1..20: mol_type = other DNA
ttctgacccaatctgtggaa

SEQ ID NO: 68120 - DNA, 20 bp, synthetic construct
  misc_feature 1..20: note = CRISPR gRNA sequence
  source 1..20: mol_type = other DNA
ctgacccaatctgtggaaca

SEQ ID NO: 68121 - DNA, 20 bp, synthetic construct
  misc_feature 1..20: note = CRISPR gRNA sequence
  source 1..20: mol_type = other DNA
tgacccaatctgtggaacat

SEQ ID NO: 68122 - DNA, 20 bp, synthetic construct
  misc_feature 1..20: note = CRISPR gRNA sequence
  source 1..20: mol_type = other DNA
acccaatctgtggaacataa

SEQ ID NO: 68123 - DNA, 20 bp, synthetic construct
  misc_feature 1..20: note = CRISPR gRNA sequence
  source 1..20: mol_type = other DNA
tggaacataaatgtggagat

SEQ ID NO: 68124 - DNA, 20 bp, synthetic construct
  misc_feature 1..20: note = CRISPR gRNA sequence
  source 1..20: mol_type = other DNA
tggcaggcaaggggccttag

SEQ ID NO: 68125 - DNA, 20 bp, synthetic construct
  misc_feature 1..20: note = CRISPR gRNA sequence
  source 1..20: mol_type = other DNA
aggaagtcatccacatggtt

SEQ ID NO: 68126 - DNA, 20 bp, synthetic construct
  misc_feature 1..20: note = CRISPR gRNA sequence
  source 1..20: mol_type = other DNA
ggaagtcatccacatggttg

SEQ ID NO: 68127 - DNA, 20 bp, synthetic construct
  misc_feature 1..20: note = CRISPR gRNA sequence
  source 1..20: mol_type = other DNA
ccccatctctcccgtgacct

SEQ ID NO: 68128 - DNA, 20 bp, synthetic construct
  misc_feature 1..20: note = CRISPR gRNA sequence
  source 1..20: mol_type = other DNA
tcccgtgacctgctggagtg

SEQ ID NO: 68129 - DNA, 20 bp, synthetic construct
  misc_feature 1..20: note = CRISPR gRNA sequence
  source 1..20: mol_type = other DNA
ccgtgacctgctggagtgac

SEQ ID NO: 68130 - DNA, 20 bp, synthetic construct
  misc_feature 1..20: note = CRISPR gRNA sequence
  source 1..20: mol_type = other DNA
ctggagtgacagccagctcc

SEQ ID NO: 68131 - DNA, 20 bp, synthetic construct
  misc_feature 1..20: note = CRISPR gRNA sequence
  source 1..20: mol_type = other DNA
gagtgacagccagctccagg

SEQ ID NO: 68132 - DNA, 20 bp, synthetic construct
  misc_feature 1..20: note = CRISPR gRNA sequence
  source 1..20: mol_type = other DNA
caggacaccacttgttgcta

SEQ ID NO: 68133 - DNA, 20 bp, synthetic construct
  misc_feature 1..20: note = CRISPR gRNA sequence
  source 1..20: mol_type = other DNA
gttgctaggcaactgagctt

SEQ ID NO: 68134 - DNA, 20 bp, synthetic construct
  misc_feature 1..20: note = CRISPR gRNA sequence
  source 1..20: mol_type = other DNA
ttgctaggcaactgagcttc

SEQ ID NO: 68135 - DNA, 20 bp, synthetic construct
  misc_feature 1..20: note = CRISPR gRNA sequence
  source 1..20: mol_type = other DNA
ctaggcaactgagcttcgtg

SEQ ID NO: 68136 - DNA, 20 bp, synthetic construct
  misc_feature 1..20: note = CRISPR gRNA sequence
  source 1..20: mol_type = other DNA
ggcaactgagcttcgtgctc

SEQ ID NO: 68137 - DNA, 20 bp, synthetic construct
  misc_feature 1..20: note = CRISPR gRNA sequence
  source 1..20: mol_type = other DNA
agcttcgtgctcgggagtcc

SEQ ID NO: 68138 - DNA, 20 bp, synthetic construct
  misc_feature 1..20: note = CRISPR gRNA sequence
  source 1..20: mol_type = other DNA
cgtgctcgggagtccttgac

SEQ ID NO: 68139 - DNA, 20 bp, synthetic construct
  misc_feature 1..20: note = CRISPR gRNA sequence
  source 1..20: mol_type = other DNA
gtgctcgggagtccttgacc

SEQ ID NO: 68140 - DNA, 20 bp, synthetic construct
  misc_feature 1..20: note = CRISPR gRNA sequence
  source 1..20: mol_type = other DNA
gggagtccttgacccatgcg

SEQ ID NO: 68141 - DNA, 20 bp, synthetic construct
  misc_feature 1..20: note = CRISPR gRNA sequence
  source 1..20: mol_type = other DNA
gacccatgcggggctagagc

SEQ ID NO: 68142 - DNA, 20 bp, synthetic construct
  misc_feature 1..20: note = CRISPR gRNA sequence
  source 1..20: mol_type = other DNA
acccatgcggggctagagct

SEQ ID NO: 68143 - DNA, 20 bp, synthetic construct
  misc_feature 1..20: note = CRISPR gRNA sequence
  source 1..20: mol_type = other DNA
gagctgccagcctggccttg

SEQ ID NO: 68144 - DNA, 20 bp, synthetic construct
  misc_feature 1..20: note = CRISPR gRNA sequence
  source 1..20: mol_type = other DNA
ccagcctggccttgccagtg

SEQ ID NO: 68145 - DNA, 20 bp, synthetic construct
  misc_feature 1..20: note = CRISPR gRNA sequence
  source 1..20: mol_type = other DNA
gccttgccagtgcccagacc

SEQ ID NO: 68146 - DNA, 20 bp, synthetic construct
  misc_feature 1..20: note = CRISPR gRNA sequence
  source 1..20: mol_type = other DNA
gccagtgcccagaccccaga

SEQ ID NO: 68147 - DNA, 20 bp, synthetic construct
  misc_feature 1..20: note = CRISPR gRNA sequence
  source 1..20: mol_type = other DNA
ccagtgcccagaccccagac

SEQ ID NO: 68148 - DNA, 20 bp, synthetic construct
  misc_feature 1..20: note = CRISPR gRNA sequence
  source 1..20: mol_type = other DNA
aaggactcagggtctggtgc

SEQ ID NO: 68149 - DNA, 20 bp, synthetic construct
  misc_feature 1..20: note = CRISPR gRNA sequence
  source 1..20: mol_type = other DNA
agggtctggtgccagttctg

SEQ ID NO: 68150 - DNA, 20 bp, synthetic construct
  misc_feature 1..20: note = CRISPR gRNA sequence
  source 1..20: mol_type = other DNA
gtgccagttctgcctgtgtg

SEQ ID NO: 68151 - DNA, 20 bp, synthetic construct
  misc_feature 1..20: note = CRISPR gRNA sequence
  source 1..20: mol_type = other DNA
tgcctgtgtggggatggtat

SEQ ID NO: 68152 - DNA, 20 bp, synthetic construct
  misc_feature 1..20: note = CRISPR gRNA sequence
  source 1..20: mol_type = other DNA
cctgtgtggggatggtatcc

SEQ ID NO: 68153 - DNA, 20 bp, synthetic construct
  misc_feature 1..20: note = CRISPR gRNA sequence
  source 1..20: mol_type = other DNA
tgtggggatggtatccttct

SEQ ID NO: 68154 - DNA, 20 bp, synthetic construct
  misc_feature 1..20: note = CRISPR gRNA sequence
  source 1..20: mol_type = other DNA
ctgggcctcagtgtgtccat

SEQ ID NO: 68155 - DNA, 20 bp, synthetic construct
  misc_feature 1..20: note = CRISPR gRNA sequence
  source 1..20: mol_type = other DNA
tgggcctcagtgtgtccatc

SEQ ID NO: 68156 - DNA, 20 bp, synthetic construct
  misc_feature 1..20: note = CRISPR gRNA sequence
  source 1..20: mol_type = other DNA
ggcctcagtgtgtccatctg

SEQ ID NO: 68157 - DNA, 20 bp, synthetic construct
  misc_feature 1..20: note = CRISPR gRNA sequence
  source 1..20: mol_type = other DNA
agtgtgtccatctggagaat

SEQ ID NO: 68158 - DNA, 20 bp, synthetic construct
  misc_feature 1..20: note = CRISPR gRNA sequence
  source 1..20: mol_type = other DNA
gagaatagatgcttagacat

SEQ ID NO: 68159 - DNA, 20 bp, synthetic construct
  misc_feature 1..20: note = CRISPR gRNA sequence
  source 1..20: mol_type = other DNA
agacatggaggcttctcttc

SEQ ID NO: 68160 - DNA, 20 bp, synthetic construct
  misc_feature 1..20: note = CRISPR gRNA sequence
  source 1..20: mol_type = other DNA
gacatggaggcttctcttct

SEQ ID NO: 68161 - DNA, 20 bp, synthetic construct
  misc_feature 1..20: note = CRISPR gRNA sequence
  source 1..20: mol_type = other DNA
ctcttcttggaaatgacagc

SEQ ID NO: 68162 - DNA, 20 bp, synthetic construct
  misc_feature 1..20: note = CRISPR gRNA sequence
  source 1..20: mol_type = other DNA
tcttcttggaaatgacagct

SEQ ID NO: 68163 - DNA, 20 bp, synthetic construct
  misc_feature 1..20: note = CRISPR gRNA sequence
  source 1..20: mol_type = other DNA
ttcttggaaatgacagctgg

SEQ ID NO: 68164 - DNA, 20 bp, synthetic construct
  misc_feature 1..20: note = CRISPR gRNA sequence
  source 1..20: mol_type = other DNA
cttggaaatgacagctggaa

SEQ ID NO: 68165 - DNA, 20 bp, synthetic construct
  misc_feature 1..20: note = CRISPR gRNA sequence
  source 1..20: mol_type = other DNA
ttggaaatgacagctggaag

SEQ ID NO: 68166 - DNA, 20 bp, synthetic construct
  misc_feature 1..20: note = CRISPR gRNA sequence
  source 1..20: mol_type = other DNA
ggaaatgacagctggaaggg

SEQ ID NO: 68167 - DNA, 20 bp, synthetic construct
  misc_feature 1..20: note = CRISPR gRNA sequence
  source 1..20: mol_type = other DNA
gaaatgacagctggaaggga

SEQ ID NO: 68168 - DNA, 20 bp, synthetic construct
  misc_feature 1..20: note = CRISPR gRNA sequence
  source 1..20: mol_type = other DNA
gaagggagatggagggggct

SEQ ID NO: 68169 - DNA, 20 bp, synthetic construct
  misc_feature 1..20: note = CRISPR gRNA sequence
  source 1..20: mol_type = other DNA
ggcagggctccaaggaggtc

SEQ ID NO: 68170 - DNA, 20 bp, synthetic construct
  misc_feature 1..20: note = CRISPR gRNA sequence
  source 1..20: mol_type = other DNA
caaggaggtcctgccctcac

SEQ ID NO: 68171 - DNA, 20 bp, synthetic construct
  misc_feature 1..20: note = CRISPR gRNA sequence
  source 1..20: mol_type = other DNA
ccctcactcccattctcatc

SEQ ID NO: 68172 - DNA, 20 bp, synthetic construct
  misc_feature 1..20: note = CRISPR gRNA sequence
  source 1..20: mol_type = other DNA
actcccattctcatctccat

SEQ ID NO: 68173 - DNA, 20 bp, synthetic construct
  misc_feature 1..20: note = CRISPR gRNA sequence
  source 1..20: mol_type = other DNA
ccattctcatctccatttcc

SEQ ID NO: 68174 - DNA, 20 bp, synthetic construct
  misc_feature 1..20: note = CRISPR gRNA sequence
  source 1..20: mol_type = other DNA
tcatctccatttcccttcta

SEQ ID NO: 68175 - DNA, 20 bp, synthetic construct
  misc_feature 1..20: note = CRISPR gRNA sequence
  source 1..20: mol_type = other DNA
atctccatttcccttctagt

SEQ ID NO: 68176 - DNA, 20 bp, synthetic construct
  misc_feature 1..20: note = CRISPR gRNA sequence
  source 1..20: mol_type = other DNA
catttcccttctagtctgag

SEQ ID NO: 68177 - DNA, 20 bp, synthetic construct
  misc_feature 1..20: note = CRISPR gRNA sequence
  source 1..20: mol_type = other DNA
cccttctagtctgagtcaca

SEQ ID NO: 68178 - DNA, 20 bp, synthetic construct
  misc_feature 1..20: note = CRISPR gRNA sequence
  source 1..20: mol_type = other DNA
ccttctagtctgagtcacaa

SEQ ID NO: 68179 - DNA, 20 bp, synthetic construct
  misc_feature 1..20: note = CRISPR gRNA sequence
  source 1..20: mol_type = other DNA
ctagtctgagtcacaacagc

SEQ ID NO: 68180 - DNA, 20 bp, synthetic construct
  misc_feature 1..20: note = CRISPR gRNA sequence
  source 1..20: mol_type = other DNA
tagtctgagtcacaacagca

SEQ ID NO: 68181 - DNA, 20 bp, synthetic construct
  misc_feature 1..20: note = CRISPR gRNA sequence
  source 1..20: mol_type = other DNA
gtctgagtcacaacagcatt

SEQ ID NO: 68182 - DNA, 20 bp, synthetic construct
  misc_feature 1..20: note = CRISPR gRNA sequence
  source 1..20: mol_type = other DNA
agtcacaacagcatttctca

SEQ ID NO: 68183 - DNA, 20 bp, synthetic construct
  misc_feature 1..20: note = CRISPR gRNA sequence
  source 1..20: mol_type = other DNA
ctcaggaaagtgccctgtac

SEQ ID NO: 68184 - DNA, 20 bp, synthetic construct
  misc_feature 1..20: note = CRISPR gRNA sequence
  source 1..20: mol_type = other DNA
tcaggaaagtgccctgtacc

SEQ ID NO: 68185 - DNA, 20 bp, synthetic construct
  misc_feature 1..20: note = CRISPR gRNA sequence
  source 1..20: mol_type = other DNA
aggaaagtgccctgtacctg

SEQ ID NO: 68186 - DNA, 20 bp, synthetic construct
  misc_feature 1..20: note = CRISPR gRNA sequence
  source 1..20: mol_type = other DNA
tacctgctggagacactgcc

SEQ ID NO: 68187 - DNA, 20 bp, synthetic construct
  misc_feature 1..20: note = CRISPR gRNA sequence
  source 1..20: mol_type = other DNA
ctggagacactgccctcctg

SEQ ID NO: 68188 - DNA, 20 bp, synthetic construct
  misc_feature 1..20: note = CRISPR gRNA sequence
  source 1..20: mol_type = other DNA
gagacactgccctcctgccc

SEQ ID NO: 68189 - DNA, 20 bp, synthetic construct
  misc_feature 1..20: note = CRISPR gRNA sequence
  source 1..20: mol_type = other DNA
ccctcctgcccacgtgtccg

SEQ ID NO: 68190 - DNA, 20 bp, synthetic construct
  misc_feature 1..20: note = CRISPR gRNA sequence
  source 1..20: mol_type = other DNA
ctgcccacgtgtccgggagg

SEQ ID NO: 68191 - DNA, 20 bp, synthetic construct
  misc_feature 1..20: note = CRISPR gRNA sequence
  source 1..20: mol_type = other DNA
cccacgtgtccgggaggcct

SEQ ID NO: 68192 - DNA, 20 bp, synthetic construct
  misc_feature 1..20: note = CRISPR gRNA sequence
  source 1..20: mol_type = other DNA
agtgaagtaaggggatgttg

SEQ ID NO: 68193 - DNA, 20 bp, synthetic construct
  misc_feature 1..20: note = CRISPR gRNA sequence
  source 1..20: mol_type = other DNA
gtccccgaaaagcccctttc

SEQ ID NO: 68194 - DNA, 20 bp, synthetic construct
  misc_feature 1..20: note = CRISPR gRNA sequence
  source 1..20: mol_type = other DNA
tctgctggccaacaggtgcc

SEQ ID NO: 68195 - DNA, 20 bp, synthetic construct
  misc_feature 1..20: note = CRISPR gRNA sequence
  source 1..20: mol_type = other DNA
ctgctggccaacaggtgccc

SEQ ID NO: 68196 - DNA, 20 bp, synthetic construct
  misc_feature 1..20: note = CRISPR gRNA sequence
  source 1..20: mol_type = other DNA
tgctggccaacaggtgcccc

SEQ ID NO: 68197 - DNA, 20 bp, synthetic construct
  misc_feature 1..20: note = CRISPR gRNA sequence
  source 1..20: mol_type = other DNA
ctggccaacaggtgcccctg

SEQ ID NO: 68198 - DNA, 20 bp, synthetic construct
  misc_feature 1..20: note = CRISPR gRNA sequence
  source 1..20: mol_type = other DNA
gccaacaggtgcccctggct

SEQ ID NO: 68199 - DNA, 20 bp, synthetic construct
  misc_feature 1..20: note = CRISPR gRNA sequence
  source 1..20: mol_type = other DNA
gctgatgatgggagaagcaa

SEQ ID NO: 68200 - DNA, 20 bp, synthetic construct
  misc_feature 1..20: note = CRISPR gRNA sequence
  source 1..20: mol_type = other DNA
atgatgggagaagcaaggca

SEQ ID NO: 68201 - DNA, 20 bp, synthetic construct
  misc_feature 1..20: note = CRISPR gRNA sequence
  source 1..20: mol_type = other DNA
tgtggccttccatctgggtg

SEQ ID NO: 68202 - DNA, 20 bp, synthetic construct
  misc_feature 1..20: note = CRISPR gRNA sequence
  source 1..20: mol_type = other DNA
gtggccttccatctgggtgg

SEQ ID NO: 68203 - DNA, 20 bp, synthetic construct
  misc_feature 1..20: note = CRISPR gRNA sequence
  source 1..20: mol_type = other DNA
tggccttccatctgggtggc

SEQ ID NO: 68204 - DNA, 20 bp, synthetic construct
  misc_feature 1..20: note = CRISPR gRNA sequence
  source 1..20: mol_type = other DNA
ccatctgggtggcttggagc

SEQ ID NO: 68205 - DNA, 20 bp, synthetic construct
  misc_feature 1..20: note = CRISPR gRNA sequence
  source 1..20: mol_type = other DNA
catctgggtggcttggagca

SEQ ID NO: 68206 - DNA, 20 bp, synthetic construct
  misc_feature 1..20: note = CRISPR gRNA sequence
  source 1..20: mol_type = other DNA
ggtggcttggagcaacctct

SEQ ID NO: 68207 - DNA, 20 bp, synthetic construct
  misc_feature 1..20: note = CRISPR gRNA sequence
  source 1..20: mol_type = other DNA
ggagcaacctctgcctttct

SEQ ID NO: 68208 - DNA, 20 bp, synthetic construct
  misc_feature 1..20: note = CRISPR gRNA sequence
  source 1..20: mol_type = other DNA
gagcaacctctgcctttctc

SEQ ID NO: 68209 - DNA, 20 bp, synthetic construct
  misc_feature 1..20: note = CRISPR gRNA sequence
  source 1..20: mol_type = other DNA
tgcctttctctgaatctcag

SEQ ID NO: 68210 - DNA, 20 bp, synthetic construct
  misc_feature 1..20: note = CRISPR gRNA sequence
  source 1..20: mol_type = other DNA
cctttctctgaatctcaggg

SEQ ID NO: 68211 - DNA, 20 bp, synthetic construct
  misc_feature 1..20: note = CRISPR gRNA sequence
  source 1..20: mol_type = other DNA
tctctgaatctcagggtttc

SEQ ID NO: 68212 - DNA, 20 bp, synthetic construct
  misc_feature 1..20: note = CRISPR gRNA sequence
  source 1..20: mol_type = other DNA
ctctgaatctcagggtttcc

SEQ ID NO: 68213 - DNA, 20 bp, synthetic construct
  misc_feature 1..20: note = CRISPR gRNA sequence
  source 1..20: mol_type = other DNA
tctgaatctcagggtttcct

SEQ ID NO: 68214 - DNA, 20 bp, synthetic construct
  misc_feature 1..20: note = CRISPR gRNA sequence
  source 1..20: mol_type = other DNA
tgaatctcagggtttcctgg

SEQ ID NO: 68215 - DNA, 20 bp, synthetic construct
  misc_feature 1..20: note = CRISPR gRNA sequence
  source 1..20: mol_type = other DNA
aatctcagggtttcctgggc

SEQ ID NO: 68216 - DNA, 20 bp, synthetic construct
  misc_feature 1..20: note = CRISPR gRNA sequence
  source 1..20: mol_type = other DNA
agggtttcctgggcatggga

SEQ ID NO: 68217 - DNA, 20 bp, synthetic construct
  misc_feature 1..20: note = CRISPR gRNA sequence
  source 1..20: mol_type = other DNA
cctgggcatgggatcataat

SEQ ID NO: 68218 - DNA, 20 bp, synthetic construct
  misc_feature 1..20: note = CRISPR gRNA sequence
  source 1..20: mol_type = other DNA
ctgggcatgggatcataatt

SEQ ID NO: 68219 - DNA, 20 bp, synthetic construct
  misc_feature 1..20: note = CRISPR gRNA sequence
  source 1..20: mol_type = other DNA
ggcatgggatcataatttct

SEQ ID NO: 68220 - DNA, 20 bp, synthetic construct
  misc_feature 1..20: note = CRISPR gRNA sequence
  source 1..20: mol_type = other DNA
ctatcccctgatgcccgggt

SEQ ID NO: 68221 - DNA, 20 bp, synthetic construct
  misc_feature 1..20: note = CRISPR gRNA sequence
  source 1..20: mol_type = other DNA
tatcccctgatgcccgggtg

SEQ ID NO: 68222 - DNA, 20 bp, synthetic construct
  misc_feature 1..20: note = CRISPR gRNA sequence
  source 1..20: mol_type = other DNA
tcccctgatgcccgggtgcc

SEQ ID NO: 68223 - DNA, 20 bp, synthetic construct
  misc_feature 1..20: note = CRISPR gRNA sequence
  source 1..20: mol_type = other DNA
atgcccgggtgccatgggga

SEQ ID NO: 68224 - DNA, 20 bp, synthetic construct
  misc_feature 1..20: note = CRISPR gRNA sequence
  source 1..20: mol_type = other DNA
ccatgctcacagaatgagtt

SEQ ID NO: 68225 - DNA, 20 bp, synthetic construct
  misc_feature 1..20: note = CRISPR gRNA sequence
  source 1..20: mol_type = other DNA
acagaatgagtttgggggtc

SEQ ID NO: 68226 - DNA, 20 bp, synthetic construct
  misc_feature 1..20: note = CRISPR gRNA sequence
  source 1..20: mol_type = other DNA
gggggtctcctctggttctg

SEQ ID NO: 68227 - DNA, 20 bp, synthetic construct
  misc_feature 1..20: note = CRISPR gRNA sequence
  source 1..20: mol_type = other DNA
ggggtctcctctggttctga

SEQ ID NO: 68228 - DNA, 20 bp, synthetic construct
  misc_feature 1..20: note = CRISPR gRNA sequence
  source 1..20: mol_type = other DNA
ctctggttctgaggcctcca

SEQ ID NO: 68229 - DNA, 20 bp, synthetic construct
  misc_feature 1..20: note = CRISPR gRNA sequence
  source 1..20: mol_type = other DNA
tggttctgaggcctccatcc

SEQ ID NO: 68230 - DNA, 20 bp, synthetic construct
  misc_feature 1..20: note = CRISPR gRNA sequence
  source 1..20: mol_type = other DNA
gttctgaggcctccatcctc

SEQ ID NO: 68231 - DNA, 20 bp, synthetic construct
  misc_feature 1..20: note = CRISPR gRNA sequence
  source 1..20: mol_type = other DNA
tgaggcctccatcctccctt

SEQ ID NO: 68232 - DNA, 20 bp, synthetic construct
  misc_feature 1..20: note = CRISPR gRNA sequence
  source 1..20: mol_type = other DNA
aggcctccatcctcccttgt

SEQ ID NO: 68233 - DNA, 20 bp, synthetic construct
  misc_feature 1..20: note = CRISPR gRNA sequence
  source 1..20: mol_type = other DNA
catcctcccttgtccttgtg

SEQ ID NO: 68234 - DNA, 20 bp, synthetic construct
  misc_feature 1..20: note = CRISPR gRNA sequence
  source 1..20: mol_type = other DNA
ccttgtccttgtgggtgcag

SEQ ID NO: 68235 - DNA, 20 bp, synthetic construct
  misc_feature 1..20: note = CRISPR gRNA sequence
  source 1..20: mol_type = other DNA
gtccttgtgggtgcagcccc

SEQ ID NO: 68236 - DNA, 20 bp, synthetic construct
  misc_feature 1..20: note = CRISPR gRNA sequence
  source 1..20: mol_type = other DNA
tccttgtgggtgcagccccg

SEQ ID NO: 68237 - DNA, 20 bp, synthetic construct
  misc_feature 1..20: note = CRISPR gRNA sequence
  source 1..20: mol_type = other DNA
gtgggtgcagccccgcttcc

SEQ ID NO: 68238 - DNA, 20 bp, synthetic construct
  misc_feature 1..20: note = CRISPR gRNA sequence
  source 1..20: mol_type = other DNA
tgggtgcagccccgcttccc

SEQ ID NO: 68239 - DNA, 20 bp, synthetic construct
  misc_feature 1..20: note = CRISPR gRNA sequence
  source 1..20: mol_type = other DNA
ccctctctgtgccctgtggg

SEQ ID NO: 68240 - DNA, 20 bp, synthetic construct
  misc_feature 1..20: note = CRISPR gRNA sequence
  source 1..20: mol_type = other DNA
cctctctgtgccctgtgggt

SEQ ID NO: 68241 - DNA, 20 bp, synthetic construct
  misc_feature 1..20: note = CRISPR gRNA sequence
  source 1..20: mol_type = other DNA
tctgtgccctgtgggtgccc

SEQ ID NO: 68242 - DNA, 20 bp, synthetic construct
  misc_feature 1..20: note = CRISPR gRNA sequence
  source 1..20: mol_type = other DNA
tgtgccctgtgggtgcccta

SEQ ID NO: 68243 - DNA, 20 bp, synthetic construct
  misc_feature 1..20: note = CRISPR gRNA sequence
  source 1..20: mol_type = other DNA
tgccctgtgggtgccctagg

SEQ ID NO: 68244 - DNA, 20 bp, synthetic construct
  misc_feature 1..20: note = CRISPR gRNA sequence
  source 1..20: mol_type = other DNA
tgggtgccctaggtgcctag

SEQ ID NO: 68245 - DNA, 20 bp, synthetic construct
  misc_feature 1..20: note = CRISPR gRNA sequence
  source 1..20: mol_type = other DNA
ggtgcctaggaagctggcat

SEQ ID NO: 68246 - DNA, 20 bp, synthetic construct
  misc_feature 1..20: note = CRISPR gRNA sequence
  source 1..20: mol_type = other DNA
ggaagctggcatgtctgggc

SEQ ID NO: 68247 - DNA, 20 bp, synthetic construct
  misc_feature 1..20: note = CRISPR gRNA sequence
  source 1..20: mol_type = other DNA
gcatgtctgggcaccgtgct

SEQ ID NO: 68248 - DNA, 20 bp, synthetic construct
  misc_feature 1..20: note = CRISPR gRNA sequence
  source 1..20: mol_type = other DNA
ggcaccgtgcttccccaggc

SEQ ID NO: 68249 - DNA, 20 bp, synthetic construct
  misc_feature 1..20: note = CRISPR gRNA sequence
  source 1..20: mol_type = other DNA
ccccaggcccttctctctgc

SEQ ID NO: 68250 - DNA, 20 bp, synthetic construct
  misc_feature 1..20: note = CRISPR gRNA sequence
  source 1..20: mol_type = other DNA
cccaggcccttctctctgca

SEQ ID NO: 68251 - DNA, 20 bp, synthetic construct
  misc_feature 1..20: note = CRISPR gRNA sequence
  source 1..20: mol_type = other DNA
ctctctgcagcctgggctct

SEQ ID NO: 68252 - DNA, 20 bp, synthetic construct
  misc_feature 1..20: note = CRISPR gRNA sequence
  source 1..20: mol_type = other DNA
tctctgcagcctgggctctg

SEQ ID NO: 68253 - DNA, 20 bp, synthetic construct
  misc_feature 1..20: note = CRISPR gRNA sequence
  source 1..20: mol_type = other DNA
tctgcagcctgggctctgag

SEQ ID NO: 68254 - DNA, 20 bp, synthetic construct
  misc_feature 1..20: note = CRISPR gRNA sequence
  source 1..20: mol_type = other DNA
tgcagcctgggctctgagca

SEQ ID NO: 68255 - DNA, 20 bp, synthetic construct
  misc_feature 1..20: note = CRISPR gRNA sequence
  source 1..20: mol_type = other DNA
cagcctgggctctgagcaga

SEQ ID NO: 68256 - DNA, 20 bp, synthetic construct
  misc_feature 1..20: note = CRISPR gRNA sequence
  source 1..20: mol_type = other DNA
ggctctgagcagagcttccg

SEQ ID NO: 68257 - DNA, 20 bp, synthetic construct
  misc_feature 1..20: note = CRISPR gRNA sequence
  source 1..20: mol_type = other DNA
tgagcagagcttccggattc

SEQ ID NO: 68258 - DNA, 20 bp, synthetic construct
  misc_feature 1..20: note = CRISPR gRNA sequence
  source 1..20: mol_type = other DNA
agcagagcttccggattcac

SEQ ID NO: 68259 - DNA, 20 bp, synthetic construct
  misc_feature 1..20: note = CRISPR gRNA sequence
  source 1..20: mol_type = other DNA
ccggattcacttctccagag

SEQ ID NO: 68260 - DNA, 20 bp, synthetic construct
  misc_feature 1..20: note = CRISPR gRNA sequence
  source 1..20: mol_type = other DNA
cggattcacttctccagaga

SEQ ID NO: 68261 - DNA, 20 bp, synthetic construct
  misc_feature 1..20: note = CRISPR gRNA sequence
  source 1..20: mol_type = other DNA
acttctccagagaggaccag

SEQ ID NO: 68262 - DNA, 20 bp, synthetic construct
  misc_feature 1..20: note = CRISPR gRNA sequence
  source 1..20: mol_type = other DNA
ctccagagaggaccaggctg

SEQ ID NO: 68263 - DNA, 20 bp, synthetic construct
  misc_feature 1..20: note = CRISPR gRNA sequence
  source 1..20: mol_type = other DNA
tccagagaggaccaggctgg

SEQ ID NO: 68264 - DNA, 20 bp, synthetic construct
  misc_feature 1..20: note = CRISPR gRNA sequence
  source 1..20: mol_type = other DNA
cagagaggaccaggctggga

SEQ ID NO: 68265 - DNA, 20 bp, synthetic construct
  misc_feature 1..20: note = CRISPR gRNA sequence
  source 1..20: mol_type = other DNA
ggaagacactcaggtaatcc

SEQ ID NO: 68266 - DNA, 20 bp, synthetic construct
  misc_feature 1..20: note = CRISPR gRNA sequence
  source 1..20: mol_type = other DNA
aggtaatccctgcagggtga

SEQ ID NO: 68267 - DNA, 20 bp, synthetic construct
  misc_feature 1..20: note = CRISPR gRNA sequence
  source 1..20: mol_type = other DNA
cagggtgatgggacagggga

SEQ ID NO: 68268 - DNA, 20 bp, synthetic construct
  misc_feature 1..20: note = CRISPR gRNA sequence
  source 1..20: mol_type = other DNA
accctatggcggcctccatg

SEQ ID NO: 68269 - DNA, 20 bp, synthetic construct
  misc_feature 1..20: note = CRISPR gRNA sequence
  source 1..20: mol_type = other DNA
tggcggcctccatggccccc

SEQ ID NO: 68270 - DNA, 20 bp, synthetic construct
  misc_feature 1..20: note = CRISPR gRNA sequence
  source 1..20: mol_type = other DNA
catggccccctcttccctgg

SEQ ID NO: 68271 - DNA, 20 bp, synthetic construct
  misc_feature 1..20: note = CRISPR gRNA sequence
  source 1..20: mol_type = other DNA
ttccctgggccctctcctcc

SEQ ID NO: 68272 - DNA, 20 bp, synthetic construct
  misc_feature 1..20: note = CRISPR gRNA sequence
  source 1..20: mol_type = other DNA
ccctgggccctctcctcctt

SEQ ID NO: 68273 - DNA, 20 bp, synthetic construct
  misc_feature 1..20: note = CRISPR gRNA sequence
  source 1..20: mol_type = other DNA
cctgggccctctcctccttt

SEQ ID NO: 68274 - DNA, 20 bp, synthetic construct
  misc_feature 1..20: note = CRISPR gRNA sequence
  source 1..20: mol_type = other DNA
ggccctctcctcctttagag

SEQ ID NO: 68275 - DNA, 20 bp, synthetic construct
  misc_feature 1..20: note = CRISPR gRNA sequence
  source 1..20: mol_type = other DNA
tcctcctttagagagcagct

SEQ ID NO: 68276 - DNA, 20 bp, synthetic construct
  misc_feature 1..20: note = CRISPR gRNA sequence
  source 1..20: mol_type = other DNA
ctcctttagagagcagcttc

SEQ ID NO: 68277 - DNA, 20 bp, synthetic construct
  misc_feature 1..20: note = CRISPR gRNA sequence
  source 1..20: mol_type = other DNA
ctttagagagcagcttcaag

SEQ ID NO: 68278 - DNA, 20 bp, synthetic construct
  misc_feature 1..20: note = CRISPR gRNA sequence
  source 1..20: mol_type = other DNA
tagagagcagcttcaagctc

SEQ ID NO: 68279 - DNA, 20 bp, synthetic construct
  misc_feature 1..20: note = CRISPR gRNA sequence
  source 1..20: mol_type = other DNA
agagagcagcttcaagctca

SEQ ID NO: 68280 - DNA, 20 bp, synthetic construct
  misc_feature 1..20: note = CRISPR gRNA sequence
  source 1..20: mol_type = other DNA
gagagcagcttcaagctcac

SEQ ID NO: 68281 - DNA, 20 bp, synthetic construct
  misc_feature 1..20: note = CRISPR gRNA sequence
  source 1..20: mol_type = other DNA
caagctcactgcctgggtct

SEQ ID NO: 68282 - DNA, 20 bp, synthetic construct
  misc_feature 1..20: note = CRISPR gRNA sequence
  source 1..20: mol_type = other DNA
aagctcactgcctgggtctg

SEQ ID NO: 68283 - DNA, 20 bp, synthetic construct
  misc_feature 1..20: note = CRISPR gRNA sequence
  source 1..20: mol_type = other DNA
actgcctgggtctgttcctc

SEQ ID NO: 68284 - DNA, 20 bp, synthetic construct
  misc_feature 1..20: note = CRISPR gRNA sequence
  source 1..20: mol_type = other DNA
cctgggtctgttcctccaga

SEQ ID NO: 68285 - DNA, 20 bp, synthetic construct
  misc_feature 1..20: note = CRISPR gRNA sequence
  source 1..20: mol_type = other DNA
ggtctgttcctccagatctg

SEQ ID NO: 68286 - DNA, 20 bp, synthetic construct
  misc_feature 1..20: note = CRISPR gRNA sequence
  source 1..20: mol_type = other DNA
ttcctccagatctgcccccg

SEQ ID NO: 68287 - DNA, 20 bp, synthetic construct
  misc_feature 1..20: note = CRISPR gRNA sequence
  source 1..20: mol_type = other DNA
ctccagatctgcccccgatg

SEQ ID NO: 68288 - DNA, 20 bp, synthetic construct
  misc_feature 1..20: note = CRISPR gRNA sequence
  source 1..20: mol_type = other DNA
cagatctgcccccgatgccc

SEQ ID NO: 68289 - DNA, 20 bp, synthetic construct
  misc_feature 1..20: note = CRISPR gRNA sequence
  source 1..20: mol_type = other DNA
cccccgatgccctggtaact

SEQ ID NO: 68290 - DNA, 20 bp, synthetic construct
  misc_feature 1..20: note = CRISPR gRNA sequence
  source 1..20: mol_type = other DNA
gtaactccagtctcagccag

SEQ ID NO: 68291 - DNA, 20 bp, synthetic construct
  misc_feature 1..20: note = CRISPR gRNA sequence
  source 1..20: mol_type = other DNA
cagtctcagccagggccttg

SEQ ID NO: 68292 - DNA, 20 bp, synthetic construct
  misc_feature 1..20: note = CRISPR gRNA sequence
  source 1..20: mol_type = other DNA
agccagggccttggcattga

SEQ ID NO: 68293 - DNA, 20 bp, synthetic construct
  misc_feature 1..20: note = CRISPR gRNA sequence
  source 1..20: mol_type = other DNA
ggcattgaacttgtgcctct

SEQ ID NO: 68294 - DNA, 20 bp, synthetic construct
  misc_feature 1..20: note = CRISPR gRNA sequence
  source 1..20: mol_type = other DNA
gcattgaacttgtgcctctt

SEQ ID NO: 68295 - DNA, 20 bp, synthetic construct
  misc_feature 1..20: note = CRISPR gRNA sequence
  source 1..20: mol_type = other DNA
aacttgtgcctcttagccca

SEQ ID NO: 68296 - DNA, 20 bp, synthetic construct
  misc_feature 1..20: note = CRISPR gRNA sequence
  source 1..20: mol_type = other DNA
gtgcctcttagcccaccatc

SEQ ID NO: 68297 - DNA, 20 bp, synthetic construct
  misc_feature 1..20: note = CRISPR gRNA sequence
  source 1..20: mol_type = other DNA
tgcctcttagcccaccatcc

SEQ ID NO: 68298 - DNA, 20 bp, synthetic construct
  misc_feature 1..20: note = CRISPR gRNA sequence
  source 1..20: mol_type = other DNA
ttagcccaccatcctaagcc

SEQ ID NO: 68299 - DNA, 20 bp, synthetic construct
  misc_feature 1..20: note = CRISPR gRNA sequence
  source 1..20: mol_type = other DNA
agcccaccatcctaagccca

SEQ ID NO: 68300 - DNA, 20 bp, synthetic construct
  misc_feature 1..20: note = CRISPR gRNA sequence
  source 1..20: mol_type = other DNA
gcccaccatcctaagcccaa

SEQ ID NO: 68301 - DNA, 20 bp, synthetic construct
  misc_feature 1..20: note = CRISPR gRNA sequence
  source 1..20: mol_type = other DNA
agcccaactcagcccaacat

SEQ ID NO: 68302 - DNA, 20 bp, synthetic construct
  misc_feature 1..20: note = CRISPR gRNA sequence
  source 1..20: mol_type = other DNA
agcccaacattctcttcctt

SEQ ID NO: 68303 - DNA, 20 bp, synthetic construct
  misc_feature 1..20: note = CRISPR gRNA sequence
  source 1..20: mol_type = other DNA
tcttccttgccatgtcctga

SEQ ID NO: 68304 - DNA, 20 bp, synthetic construct
  misc_feature 1..20: note = CRISPR gRNA sequence
  source 1..20: mol_type = other DNA
ttccttgccatgtcctgact

SEQ ID NO: 68305 - DNA, 20 bp, synthetic construct
  misc_feature 1..20: note = CRISPR gRNA sequence
  source 1..20: mol_type = other DNA
ccttgccatgtcctgactac

SEQ ID NO: 68306 - DNA, 20 bp, synthetic construct
  misc_feature 1..20: note = CRISPR gRNA sequence
  source 1..20: mol_type = other DNA
cttgccatgtcctgactaca

SEQ ID NO: 68307 - DNA, 20 bp, synthetic construct
  misc_feature 1..20: note = CRISPR gRNA sequence
  source 1..20: mol_type = other DNA
gccatgtcctgactacaggc

SEQ ID NO: 68308 - DNA, 20 bp, synthetic construct
  misc_feature 1..20: note = CRISPR gRNA sequence
  source 1..20: mol_type = other DNA
ccatgtcctgactacaggcc

SEQ ID NO: 68309 - DNA, 20 bp, synthetic construct
  misc_feature 1..20: note = CRISPR gRNA sequence
  source 1..20: mol_type = other DNA
actacaggccttgaggcttc

SEQ ID NO: 68310 - DNA, 20 bp, synthetic construct
  misc_feature 1..20: note = CRISPR gRNA sequence
  source 1..20: mol_type = other DNA
caggccttgaggcttctgag

SEQ ID NO: 68311 - DNA, 20 bp, synthetic construct
  misc_feature 1..20: note = CRISPR gRNA sequence
  source 1..20: mol_type = other DNA
gaggcttctgagtgtcacgg

SEQ ID NO: 68312 - DNA, 20 bp, synthetic construct
  misc_feature 1..20: note = CRISPR gRNA sequence
  source 1..20: mol_type = other DNA
aggcttctgagtgtcacggt

SEQ ID NO: 68313 - DNA, 20 bp, synthetic construct
  misc_feature 1..20: note = CRISPR gRNA sequence
  source 1..20: mol_type = other DNA
ctgagtgtcacggttaaaga

SEQ ID NO: 68314 - DNA, 20 bp, synthetic construct
  misc_feature 1..20: note = CRISPR gRNA sequence
  source 1..20: mol_type = other DNA
tgagtgtcacggttaaagat

SEQ ID NO: 68315 - DNA, 20 bp, synthetic construct
  misc_feature 1..20: note = CRISPR gRNA sequence
  source 1..20: mol_type = other DNA
agtgtcacggttaaagattt

SEQ ID NO: 68316 - DNA, 20 bp, synthetic construct
  misc_feature 1..20: note = CRISPR gRNA sequence
  source 1..20: mol_type = other DNA
aagattttgaagccaactga

SEQ ID NO: 68317 - DNA, 20 bp, synthetic construct
  misc_feature 1..20: note = CRISPR gRNA sequence
  source 1..20: mol_type = other DNA
tgaagccaactgaaaataaa

SEQ ID NO: 68318 - DNA, 20 bp, synthetic construct
  misc_feature 1..20: note = CRISPR gRNA sequence
  source 1..20: mol_type = other DNA
gaagccaactgaaaataaat

SEQ ID NO: 68319 - DNA, 20 bp, synthetic construct
  misc_feature 1..20: note = CRISPR gRNA sequence
  source 1..20: mol_type = other DNA
aagccaactgaaaataaatc

SEQ ID NO: 68320 - DNA, 20 bp, synthetic construct
  misc_feature 1..20: note = CRISPR gRNA sequence
  source 1..20: mol_type = other DNA
aaaataaatccctgatctgc

SEQ ID NO: 68321 - DNA, 20 bp, synthetic construct
  misc_feature 1..20: note = CRISPR gRNA sequence
  source 1..20: mol_type = other DNA
atctgccacttaccagctat

SEQ ID NO: 68322 - DNA, 20 bp, synthetic construct
  misc_feature 1..20: note = CRISPR gRNA sequence
  source 1..20: mol_type = other DNA
ccacttaccagctatgtggc

SEQ ID NO: 68323 - DNA, 20 bp, synthetic construct
  misc_feature 1..20: note = CRISPR gRNA sequence
  source 1..20: mol_type = other DNA
accagctatgtggccctgga

SEQ ID NO: 68324 - DNA, 20 bp, synthetic construct
  misc_feature 1..20: note = CRISPR gRNA sequence
  source 1..20: mol_type = other DNA
ccagctatgtggccctggac

SEQ ID NO: 68325 - DNA, 20 bp, synthetic construct
  misc_feature 1..20: note = CRISPR gRNA sequence
  source 1..20: mol_type = other DNA
tgtggccctggacaagtaaa

SEQ ID NO: 68326 - DNA, 20 bp, synthetic construct
  misc_feature 1..20: note = CRISPR gRNA sequence
  source 1..20: mol_type = other DNA
gacaagtaaaatggggataa

SEQ ID NO: 68327 - DNA, 20 bp, synthetic construct
  misc_feature 1..20: note = CRISPR gRNA sequence
  source 1..20: mol_type = other DNA
ccccttagggttattgtgag

SEQ ID NO: 68328 - DNA, 20 bp, synthetic construct
  misc_feature 1..20: note = CRISPR gRNA sequence
  source 1..20: mol_type = other DNA
agggttattgtgaggattaa

SEQ ID NO: 68329 - DNA, 20 bp, synthetic construct
  misc_feature 1..20: note = CRISPR gRNA sequence
  source 1..20: mol_type = other DNA
gggttattgtgaggattaaa

SEQ ID NO: 68330 - DNA, 20 bp, synthetic construct
  misc_feature 1..20: note = CRISPR gRNA sequence
  source 1..20: mol_type = other DNA
ttgtgaggattaaatgagtt

SEQ ID NO: 68331 - DNA, 20 bp, synthetic construct
  misc_feature 1..20: note = CRISPR gRNA sequence
  source 1..20: mol_type = other DNA
tgaggattaaatgagttaat

SEQ ID NO: 68332 - DNA, 20 bp, synthetic construct
  misc_feature 1..20: note = CRISPR gRNA sequence
  source 1..20: mol_type = other DNA
aatgagttaataagtataaa

SEQ ID NO: 68333 - DNA, 20 bp, synthetic construct
  misc_feature 1..20: note = CRISPR gRNA sequence
  source 1..20: mol_type = other DNA
ataagtataaagtgccagga

SEQ ID NO: 68334 - DNA, 20 bp, synthetic construct
  misc_feature 1..20: note = CRISPR gRNA sequence
  source 1..20: mol_type = other DNA
gctcatgggagtgctgtcag

SEQ ID NO: 68335 - DNA, 20 bp, synthetic construct
  misc_feature 1..20: note = CRISPR gRNA sequence
  source 1..20: mol_type = other DNA
atgggagtgctgtcagcagt

SEQ ID NO: 68336 - DNA, 20 bp, synthetic construct
  misc_feature 1..20: note = CRISPR gRNA sequence
  source 1..20: mol_type = other DNA
tcagcagttattgtaactgt

SEQ ID NO: 68337 - DNA, 20 bp, synthetic construct
  misc_feature 1..20: note = CRISPR gRNA sequence
  source 1..20: mol_type = other DNA
ttgtaactgttattattatt

SEQ ID NO: 68338 - DNA, 20 bp, synthetic construct
  misc_feature 1..20: note = CRISPR gRNA sequence
  source 1..20: mol_type = other DNA
taactgttattattattatt

SEQ ID NO: 68339 - DNA, 20 bp, synthetic construct
  misc_feature 1..20: note = CRISPR gRNA sequence
  source 1..20: mol_type = other DNA
ttattattattattattatt

SEQ ID NO: 68340 - DNA, 20 bp, synthetic construct
  misc_feature 1..20: note = CRISPR gRNA sequence
  source 1..20: mol_type = other DNA
ttattattattattattatt

SEQ ID NO: 68341 - DNA, 20 bp, synthetic construct
  misc_feature 1..20: note = CRISPR gRNA sequence
  source 1..20: mol_type = other DNA
ttattattattattattatt

SEQ ID NO: 68342 - DNA, 20 bp, synthetic construct
  misc_feature 1..20: note = CRISPR gRNA sequence
  source 1..20: mol_type = other DNA
ttattattattattattatt

SEQ ID NO: 68343 - DNA, 20 bp, synthetic construct
  misc_feature 1..20: note = CRISPR gRNA sequence
  source 1..20: mol_type = other DNA
ttattattattattattatt

SEQ ID NO: 68344 - DNA, 20 bp, synthetic construct
  misc_feature 1..20: note = CRISPR gRNA sequence
  source 1..20: mol_type = other DNA
ttattattattattattatc

SEQ ID NO: 68345 - DNA, 20 bp, synthetic construct
  misc_feature 1..20: note = CRISPR gRNA sequence
  source 1..20: mol_type = other DNA
ttattattattattatcatt

SEQ ID NO: 68346 - DNA, 20 bp, synthetic construct
  misc_feature 1..20: note = CRISPR gRNA sequence
  source 1..20: mol_type = other DNA
ttattattattatcattatc

SEQ ID NO: 68347 - DNA, 20 bp, synthetic construct
  misc_feature 1..20: note = CRISPR gRNA sequence
  source 1..20: mol_type = other DNA
ttattattatcattatcatt

SEQ ID NO: 68348 - DNA, 20 bp, synthetic construct
  misc_feature 1..20: note = CRISPR gRNA sequence
  source 1..20: mol_type = other DNA
ttattatcattatcattacc

SEQ ID NO: 68349 - DNA, 20 bp, synthetic construct
  misc_feature 1..20: note = CRISPR gRNA sequence
  source 1..20: mol_type = other DNA
ttatcattatcattacccct

SEQ ID NO: 68350 - DNA, 20 bp, synthetic construct
  misc_feature 1..20: note = CRISPR gRNA sequence
  source 1..20: mol_type = other DNA
tcattatcattacccctggt

SEQ ID NO: 68351 - DNA, 20 bp, synthetic construct
  misc_feature 1..20: note = CRISPR gRNA sequence
  source 1..20: mol_type = other DNA
tcattacccctggtagccct

SEQ ID NO: 68352 - DNA, 20 bp, synthetic construct
  misc_feature 1..20: note = CRISPR gRNA sequence
  source 1..20: mol_type = other DNA
cccctggtagccctgactca

SEQ ID NO: 68353 - DNA, 20 bp, synthetic construct
  misc_feature 1..20: note = CRISPR gRNA sequence
  source 1..20: mol_type = other DNA
gtagccctgactcactgcca

SEQ ID NO: 68354 - DNA, 20 bp, synthetic construct
  misc_feature 1..20: note = CRISPR gRNA sequence
  source 1..20: mol_type = other DNA
actcactgccacggccagtt

SEQ ID NO: 68355 - DNA, 20 bp, synthetic construct
  misc_feature 1..20: note = CRISPR gRNA sequence
  source 1..20: mol_type = other DNA
actgccacggccagttcctt

SEQ ID NO: 68356 - DNA, 20 bp, synthetic construct
  misc_feature 1..20: note = CRISPR gRNA sequence
  source 1..20: mol_type = other DNA
ccacggccagttcctttaca

SEQ ID NO: 68357 - DNA, 20 bp, synthetic construct
  misc_feature 1..20: note = CRISPR gRNA sequence
  source 1..20: mol_type = other DNA
ctttacatgtcttacttcag

SEQ ID NO: 68358 - DNA, 20 bp, synthetic construct
  misc_feature 1..20: note = CRISPR gRNA sequence
  source 1..20: mol_type = other DNA
tacatgtcttacttcagctg

SEQ ID NO: 68359 - DNA, 20 bp, synthetic construct
  misc_feature 1..20: note = CRISPR gRNA sequence
  source 1..20: mol_type = other DNA
acatgtcttacttcagctgt

SEQ ID NO: 68360 - DNA, 20 bp, synthetic construct
  misc_feature 1..20: note = CRISPR gRNA sequence
  source 1..20: mol_type = other DNA
catgtcttacttcagctgtg

SEQ ID NO: 68361 - DNA, 20 bp, synthetic construct
  misc_feature 1..20: note = CRISPR gRNA sequence
  source 1..20: mol_type = other DNA
acttcagctgtgaacagggc

SEQ ID NO: 68362 - DNA, 20 bp, synthetic construct
  misc_feature 1..20: note = CRISPR gRNA sequence
  source 1..20: mol_type = other DNA
cttcagctgtgaacagggcc

SEQ ID NO: 68363 - DNA, 20 bp, synthetic construct
  misc_feature 1..20: note = CRISPR gRNA sequence
  source 1..20: mol_type = other DNA
cagctgtgaacagggcctcc

SEQ ID NO: 68364 - DNA, 20 bp, synthetic construct
  misc_feature 1..20: note = CRISPR gRNA sequence
  source 1..20: mol_type = other DNA
agctgtgaacagggcctcca

SEQ ID NO: 68365 - DNA, 20 bp, synthetic construct
  misc_feature 1..20: note = CRISPR gRNA sequence
  source 1..20: mol_type = other DNA
tgaacagggcctccaaactg

SEQ ID NO: 68366 - DNA, 20 bp, synthetic construct
  misc_feature 1..20: note = CRISPR gRNA sequence
  source 1..20: mol_type = other DNA
caaactgatccctgcatctt

SEQ ID NO: 68367 - DNA, 20 bp, synthetic construct
  misc_feature 1..20: note = CRISPR gRNA sequence
  source 1..20: mol_type = other DNA
atccctgcatcttatcaggc

SEQ ID NO: 68368 - DNA, 20 bp, synthetic construct
  misc_feature 1..20: note = CRISPR gRNA sequence
  source 1..20: mol_type = other DNA
catcttatcaggcctcctcc

SEQ ID NO: 68369 - DNA, 20 bp, synthetic construct
  misc_feature 1..20: note = CRISPR gRNA sequence
  source 1..20: mol_type = other DNA
atcaggcctcctcccctcca

SEQ ID NO: 68370 - DNA, 20 bp, synthetic construct
  misc_feature 1..20: note = CRISPR gRNA sequence
  source 1..20: mol_type = other DNA
tcaggcctcctcccctccat

SEQ ID NO: 68371 - DNA, 20 bp, synthetic construct
  misc_feature 1..20: note = CRISPR gRNA sequence
  source 1..20: mol_type = other DNA
ctcccctccattcactccac

SEQ ID NO: 68372 - DNA, 20 bp, synthetic construct
  misc_feature 1..20: note = CRISPR gRNA sequence
  source 1..20: mol_type = other DNA
ccctccattcactccacagc

SEQ ID NO: 68373 - DNA, 20 bp, synthetic construct
  misc_feature 1..20: note = CRISPR gRNA sequence
  source 1..20: mol_type = other DNA
cattcactccacagccccca

SEQ ID NO: 68374 - DNA, 20 bp, synthetic construct
  misc_feature 1..20: note = CRISPR gRNA sequence
  source 1..20: mol_type = other DNA
actccacagcccccagaggg

SEQ ID NO: 68375 - DNA, 20 bp, synthetic construct
  misc_feature 1..20: note = CRISPR gRNA sequence
  source 1..20: mol_type = other DNA
cacagcccccagagggatct

SEQ ID NO: 68376 - DNA, 20 bp, synthetic construct
  misc_feature 1..20: note = CRISPR gRNA sequence
  source 1..20: mol_type = other DNA
cacaacacacatctgacagt

SEQ ID NO: 68377 - DNA, 20 bp, synthetic construct
  misc_feature 1..20: note = CRISPR gRNA sequence
  source 1..20: mol_type = other DNA
acaacacacatctgacagtg

SEQ ID NO: 68378 - DNA, 20 bp, synthetic construct
  misc_feature 1..20: note = CRISPR gRNA sequence
  source 1..20: mol_type = other DNA
acagtgcccctctgctactc

SEQ ID NO: 68379 - DNA, 20 bp, synthetic construct
  misc_feature 1..20: note = CRISPR gRNA sequence
  source 1..20: mol_type = other DNA
tgctactctgtgcccctcag

SEQ ID NO: 68380 - DNA, 20 bp, synthetic construct
  misc_feature 1..20: note = CRISPR gRNA sequence
  source 1..20: mol_type = other DNA
ctactctgtgcccctcagtg

SEQ ID NO: 68381 - DNA, 20 bp, synthetic construct
  misc_feature 1..20: note = CRISPR gRNA sequence
  source 1..20: mol_type = other DNA
ctctgtgcccctcagtggct

SEQ ID NO: 68382 - DNA, 20 bp, synthetic construct
  misc_feature 1..20: note = CRISPR gRNA sequence
  source 1..20: mol_type = other DNA
tgtgcccctcagtggctccc

SEQ ID NO: 68383 - DNA, 20 bp, synthetic construct
  misc_feature 1..20: note = CRISPR gRNA sequence
  source 1..20: mol_type = other DNA
tgcccctcagtggctcccca

SEQ ID NO: 68384 - DNA, 20 bp, synthetic construct
  misc_feature 1..20: note = CRISPR gRNA sequence
  source 1..20: mol_type = other DNA
agtggctccccattaacccc

SEQ ID NO: 68385 - DNA, 20 bp, synthetic construct
  misc_feature 1..20: note = CRISPR gRNA sequence
  source 1..20: mol_type = other DNA
cccattaaccccagggtgaa

SEQ ID NO: 68386 - DNA, 20 bp, synthetic construct
  misc_feature 1..20: note = CRISPR gRNA sequence
  source 1..20: mol_type = other DNA
accccagggtgaagttcaaa

SEQ ID NO: 68387 - DNA, 20 bp, synthetic construct
  misc_feature 1..20: note = CRISPR gRNA sequence
  source 1..20: mol_type = other DNA
aaagtccctagcatcttctc

SEQ ID NO: 68388 - DNA, 20 bp, synthetic construct
  misc_feature 1..20: note = CRISPR gRNA sequence
  source 1..20: mol_type = other DNA
gcatcttctccctcacagtc

SEQ ID NO: 68389 - DNA, 20 bp, synthetic construct
  misc_feature 1..20: note = CRISPR gRNA sequence
  source 1..20: mol_type = other DNA
ctccctcacagtctgatcca

SEQ ID NO: 68390 - DNA, 20 bp, synthetic construct
  misc_feature 1..20: note = CRISPR gRNA sequence
  source 1..20: mol_type = other DNA
tccctcacagtctgatccaa

SEQ ID NO: 68391 - DNA, 20 bp, synthetic construct
  misc_feature 1..20: note = CRISPR gRNA sequence
  source 1..20: mol_type = other DNA
cctcacagtctgatccaact

SEQ ID NO: 68392 - DNA, 20 bp, synthetic construct
  misc_feature 1..20: note = CRISPR gRNA sequence
  source 1..20: mol_type = other DNA
acagtctgatccaactgtca

SEQ ID NO: 68393 - DNA, 20 bp, synthetic construct
  misc_feature 1..20: note = CRISPR gRNA sequence
  source 1..20: mol_type = other DNA
atccaactgtcaccttccac

SEQ ID NO: 68394 - DNA, 20 bp, synthetic construct
  misc_feature 1..20: note = CRISPR gRNA sequence
  source 1..20: mol_type = other DNA
tcaccttccaccatgttcct

SEQ ID NO: 68395 - DNA, 20 bp, synthetic construct
  misc_feature 1..20: note = CRISPR gRNA sequence
  source 1..20: mol_type = other DNA
ccaccatgttccttcccacc

SEQ ID NO: 68396 - DNA, 20 bp, synthetic construct
  misc_feature 1..20: note = CRISPR gRNA sequence
  source 1..20: mol_type = other DNA
caccatgttccttcccacct

SEQ ID NO: 68397 - DNA, 20 bp, synthetic construct
  misc_feature 1..20: note = CRISPR gRNA sequence
  source 1..20: mol_type = other DNA
cttcccacctcccccacacc

SEQ ID NO: 68398 - DNA, 20 bp, synthetic construct
  misc_feature 1..20: note = CRISPR gRNA sequence
  source 1..20: mol_type = other DNA
cccacctcccccacaccaca

SEQ ID NO: 68399 - DNA, 20 bp, synthetic construct
  misc_feature 1..20: note = CRISPR gRNA sequence
  source 1..20: mol_type = other DNA
ccacctcccccacaccacac

SEQ ID NO: 68400 - DNA, 20 bp, synthetic construct
  misc_feature 1..20: note = CRISPR gRNA sequence
  source 1..20: mol_type = other DNA
ccccacaccacacacacgcc

SEQ ID NO: 68401 - DNA, 20 bp, synthetic construct
  misc_feature 1..20: note = CRISPR gRNA sequence
  source 1..20: mol_type = other DNA
cacaccaacccatataccac

SEQ ID NO: 68402 - DNA, 20 bp, synthetic construct
  misc_feature 1..20: note = CRISPR gRNA sequence
  source 1..20: mol_type = other DNA
gcacattacaaatacagcac

SEQ ID NO: 68403 - DNA, 20 bp, synthetic construct
  misc_feature 1..20: note = CRISPR gRNA sequence
  source 1..20: mol_type = other DNA
caaatacagcacacacacca

SEQ ID NO: 68404 - DNA, 20 bp, synthetic construct
  misc_feature 1..20: note = CRISPR gRNA sequence
  source 1..20: mol_type = other DNA
caaataccacatacacaaca

SEQ ID NO: 68405 - DNA, 20 bp, synthetic construct
  misc_feature 1..20: note = CRISPR gRNA sequence
  source 1..20: mol_type = other DNA
agccataaccttcactattt

SEQ ID NO: 68406 - DNA, 20 bp, synthetic construct
  misc_feature 1..20: note = CRISPR gRNA sequence
  source 1..20: mol_type = other DNA
cactatttgctcctagatca

SEQ ID NO: 68407 - DNA, 20 bp, synthetic construct
  misc_feature 1..20: note = CRISPR gRNA sequence
  source 1..20: mol_type = other DNA
actatttgctcctagatcaa

SEQ ID NO: 68408 - DNA, 20 bp, synthetic construct
  misc_feature 1..20: note = CRISPR gRNA sequence
  source 1..20: mol_type = other DNA
tttgctcctagatcaagccc

SEQ ID NO: 68409 - DNA, 20 bp, synthetic construct
  misc_feature 1..20: note = CRISPR gRNA sequence
  source 1..20: mol_type = other DNA
gctcctagatcaagccctgc

SEQ ID NO: 68410 - DNA, 20 bp, synthetic construct
  misc_feature 1..20: note = CRISPR gRNA sequence
  source 1..20: mol_type = other DNA
ctcctagatcaagccctgcc

SEQ ID NO: 68411 - DNA, 20 bp, synthetic construct
  misc_feature 1..20: note = CRISPR gRNA sequence
  source 1..20: mol_type = other DNA
ctagatcaagccctgcctga

SEQ ID NO: 68412 - DNA, 20 bp, synthetic construct
  misc_feature 1..20: note = CRISPR gRNA sequence
  source 1..20: mol_type = other DNA
gatcaagccctgcctgaaga

SEQ ID NO: 68413 - DNA, 20 bp, synthetic construct
  misc_feature 1..20: note = CRISPR gRNA sequence
  source 1..20: mol_type = other DNA
cctgaagattctctgcctct

SEQ ID NO: 68414 - DNA, 20 bp, synthetic construct
  misc_feature 1..20: note = CRISPR gRNA sequence
  source 1..20: mol_type = other DNA
aagattctctgcctctgctc

SEQ ID NO: 68415 - DNA, 20 bp, synthetic construct
  misc_feature 1..20: note = CRISPR gRNA sequence
  source 1..20: mol_type = other DNA
tctgcctctgctcacaccgc

SEQ ID NO: 68416 - DNA, 20 bp, synthetic construct
  misc_feature 1..20: note = CRISPR gRNA sequence
  source 1..20: mol_type = other DNA
tgcctctgctcacaccgcac

SEQ ID NO: 68417 - DNA, 20 bp, synthetic construct
  misc_feature 1..20: note = CRISPR gRNA sequence
  source 1..20: mol_type = other DNA
cctctgctcacaccgcactc

SEQ ID NO: 68418 - DNA, 20 bp, synthetic construct
  misc_feature 1..20: note = CRISPR gRNA sequence
  source 1..20: mol_type = other DNA
tgctcacaccgcactcagct

SEQ ID NO: 68419 - DNA, 20 bp, synthetic construct
  misc_feature 1..20: note = CRISPR gRNA sequence
  source 1..20: mol_type = other DNA
ctcacaccgcactcagctca

SEQ ID NO: 68420 - DNA, 20 bp, synthetic construct
  misc_feature 1..20: note = CRISPR gRNA sequence
  source 1..20: mol_type = other DNA
acaccgcactcagctcaaca

SEQ ID NO: 68421 - DNA, 20 bp, synthetic construct
  misc_feature 1..20: note = CRISPR gRNA sequence
  source 1..20: mol_type = other DNA
agctcaacattctcttcctt

SEQ ID NO: 68422 - DNA, 20 bp, synthetic construct
  misc_feature 1..20: note = CRISPR gRNA sequence
  source 1..20: mol_type = other DNA
aacattctcttccttgcctt

SEQ ID NO: 68423 - DNA, 20 bp, synthetic construct
  misc_feature 1..20: note = CRISPR gRNA sequence
  source 1..20: mol_type = other DNA
tcttccttgccttttctgag

SEQ ID NO: 68424 - DNA, 20 bp, synthetic construct
  misc_feature 1..20: note = CRISPR gRNA sequence
  source 1..20: mol_type = other DNA
ttccttgccttttctgagat

SEQ ID NO: 68425 - DNA, 20 bp, synthetic construct
  misc_feature 1..20: note = CRISPR gRNA sequence
  source 1..20: mol_type = other DNA
ccttgccttttctgagataa

SEQ ID NO: 68426 - DNA, 20 bp, synthetic construct
  misc_feature 1..20: note = CRISPR gRNA sequence
  source 1..20: mol_type = other DNA
cttgccttttctgagataaa

SEQ ID NO: 68427 - DNA, 20 bp, synthetic construct
  misc_feature 1..20: note = CRISPR gRNA sequence
  source 1..20: mol_type = other DNA
gccttttctgagataaaatt

SEQ ID NO: 68428 - DNA, 20 bp, synthetic construct
  misc_feature 1..20: note = CRISPR gRNA sequence
  source 1..20: mol_type = other DNA
ccttttctgagataaaattc

SEQ ID NO: 68429 - DNA, 20 bp, synthetic construct
  misc_feature 1..20: note = CRISPR gRNA sequence
  source 1..20: mol_type = other DNA
ttctgagataaaattctccc

SEQ ID NO: 68430 - DNA, 20 bp, synthetic construct
  misc_feature 1..20: note = CRISPR gRNA sequence
  source 1..20: mol_type = other DNA
tctgagataaaattctccca

SEQ ID NO: 68431 - DNA, 20 bp, synthetic construct
  misc_feature 1..20: note = CRISPR gRNA sequence
  source 1..20: mol_type = other DNA
ctgagataaaattctcccaa

SEQ ID NO: 68432 - DNA, 20 bp, synthetic construct
  misc_feature 1..20: note = CRISPR gRNA sequence
  source 1..20: mol_type = other DNA
tgagataaaattctcccaat

SEQ ID NO: 68433 - DNA, 20 bp, synthetic construct
  misc_feature 1..20: note = CRISPR gRNA sequence
  source 1..20: mol_type = other DNA
agataaaattctcccaatcc

SEQ ID NO: 68434 - DNA, 20 bp, synthetic construct
  misc_feature 1..20: note = CRISPR gRNA sequence
  source 1..20: mol_type = other DNA
tcccaatcctttaacaccca

SEQ ID NO: 68435 - DNA, 20 bp, synthetic construct
  misc_feature 1..20: note = CRISPR gRNA sequence
  source 1..20: mol_type = other DNA
ccaatcctttaacacccagc

SEQ ID NO: 68436 - DNA, 20 bp, synthetic construct
  misc_feature 1..20: note = CRISPR gRNA sequence
  source 1..20: mol_type = other DNA
taacacccagctcaaacatc

SEQ ID NO: 68437 - DNA, 20 bp, synthetic construct
  misc_feature 1..20: note = CRISPR gRNA sequence
  source 1..20: mol_type = other DNA
aacacccagctcaaacatca

SEQ ID NO: 68438 - DNA, 20 bp, synthetic construct
  misc_feature 1..20: note = CRISPR gRNA sequence
  source 1..20: mol_type = other DNA
acacccagctcaaacatcag

SEQ ID NO: 68439 - DNA, 20 bp, synthetic construct
  misc_feature 1..20: note = CRISPR gRNA sequence
  source 1..20: mol_type = other DNA
aaacatcagcccctcctgga

SEQ ID NO: 68440 - DNA, 20 bp, synthetic construct
  misc_feature 1..20: note = CRISPR gRNA sequence
  source 1..20: mol_type = other DNA
ctggaagtatcccagcagcc

SEQ ID NO: 68441 - DNA, 20 bp, synthetic construct
  misc_feature 1..20: note = CRISPR gRNA sequence
  source 1..20: mol_type = other DNA
gaagtatcccagcagccctg

SEQ ID NO: 68442 - DNA, 20 bp, synthetic construct
  misc_feature 1..20: note = CRISPR gRNA sequence
  source 1..20: mol_type = other DNA
cctcatcagagtgaactgcc

SEQ ID NO: 68443 - DNA, 20 bp, synthetic construct
  misc_feature 1..20: note = CRISPR gRNA sequence
  source 1..20: mol_type = other DNA
atcagagtgaactgccccga

SEQ ID NO: 68444 - DNA, 20 bp, synthetic construct
  misc_feature 1..20: note = CRISPR gRNA sequence
  source 1..20: mol_type = other DNA
ccccgaggttcactgggccc

SEQ ID NO: 68445 - DNA, 20 bp, synthetic construct
  misc_feature 1..20: note = CRISPR gRNA sequence
  source 1..20: mol_type = other DNA
actgggccctttcacttggc

SEQ ID NO: 68446 - DNA, 20 bp, synthetic construct
  misc_feature 1..20: note = CRISPR gRNA sequence
  source 1..20: mol_type = other DNA
ggccctttcacttggctggg

SEQ ID NO: 68447 - DNA, 20 bp, synthetic construct
  misc_feature 1..20: note = CRISPR gRNA sequence
  source 1..20: mol_type = other DNA
tcacttggctgggcccgtct

SEQ ID NO: 68448 - DNA, 20 bp, synthetic construct
  misc_feature 1..20: note = CRISPR gRNA sequence
  source 1..20: mol_type = other DNA
cacttggctgggcccgtctg

SEQ ID NO: 68449 - DNA, 20 bp, synthetic construct
  misc_feature 1..20: note = CRISPR gRNA sequence
  source 1..20: mol_type = other DNA
acttggctgggcccgtctgc

SEQ ID NO: 68450 - DNA, 20 bp, synthetic construct
  misc_feature 1..20: note = CRISPR gRNA sequence
  source 1..20: mol_type = other DNA
ggctgggcccgtctgctggc

SEQ ID NO: 68451 - DNA, 20 bp, synthetic construct
  misc_feature 1..20: note = CRISPR gRNA sequence
  source 1..20: mol_type = other DNA
gctgggcccgtctgctggcc

SEQ ID NO: 68452 - DNA, 20 bp, synthetic construct
  misc_feature 1..20: note = CRISPR gRNA sequence
  source 1..20: mol_type = other DNA
ggcccgtctgctggccaccc

SEQ ID NO: 68453 - DNA, 20 bp, synthetic construct
  misc_feature 1..20: note = CRISPR gRNA sequence
  source 1..20: mol_type = other DNA
ctggccacccagggctgaga

SEQ ID NO: 68454 - DNA, 20 bp, synthetic construct
  misc_feature 1..20: note = CRISPR gRNA sequence
  source 1..20: mol_type = other DNA
gccacccagggctgagatgc

SEQ ID NO: 68455 - DNA, 20 bp, synthetic construct
  misc_feature 1..20: note = CRISPR gRNA sequence
  source 1..20: mol_type = other DNA
agatgcctggacagcagagc

SEQ ID NO: 68456 - DNA, 20 bp, synthetic construct
  misc_feature 1..20: note = CRISPR gRNA sequence
  source 1..20: mol_type = other DNA
gacagcagagccccacggag

SEQ ID NO: 68457 - DNA, 20 bp, synthetic construct
  misc_feature 1..20: note = CRISPR gRNA sequence
  source 1..20: mol_type = other DNA
cctccccagggagctcagcc

SEQ ID NO: 68458 - DNA, 20 bp, synthetic construct
  misc_feature 1..20: note = CRISPR gRNA sequence
  source 1..20: mol_type = other DNA
cccagggagctcagccagtg

SEQ ID NO: 68459 - DNA, 20 bp, synthetic construct
  misc_feature 1..20: note = CRISPR gRNA sequence
  source 1..20: mol_type = other DNA
agccagtgctggtccgggag

SEQ ID NO: 68460 - DNA, 20 bp, synthetic construct
  misc_feature 1..20: note = CRISPR gRNA sequence
  source 1..20: mol_type = other DNA
gtccgggagagtaaggcagt

SEQ ID NO: 68461 - DNA, 20 bp, synthetic construct
  misc_feature 1..20: note = CRISPR gRNA sequence
  source 1..20: mol_type = other DNA
agagcttggggtctgcagtc

SEQ ID NO: 68462 - DNA, 20 bp, synthetic construct
  misc_feature 1..20: note = CRISPR gRNA sequence
  source 1..20: mol_type = other DNA
ggggtctgcagtcagactga

SEQ ID NO: 68463 - DNA, 20 bp, synthetic construct
  misc_feature 1..20: note = CRISPR gRNA sequence
  source 1..20: mol_type = other DNA
gggtctgcagtcagactgac

SEQ ID NO: 68464 - DNA, 20 bp, synthetic construct
  misc_feature 1..20: note = CRISPR gRNA sequence
  source 1..20: mol_type = other DNA
cagtcagactgacctggatg

SEQ ID NO: 68465 - DNA, 20 bp, synthetic construct
  misc_feature 1..20: note = CRISPR gRNA sequence
  source 1..20: mol_type = other DNA
acctggatggaaaccagatt

SEQ ID NO: 68466 - DNA, 20 bp, synthetic construct
  misc_feature 1..20: note = CRISPR gRNA sequence
  source 1..20: mol_type = other DNA
gatggaaaccagattctgcc

SEQ ID NO: 68467 - DNA, 20 bp, synthetic construct
  misc_feature 1..20: note = CRISPR gRNA sequence
  source 1..20: mol_type = other DNA
tgcccttctttcttatctgc

SEQ ID NO: 68468 - DNA, 20 bp, synthetic construct
  misc_feature 1..20: note = CRISPR gRNA sequence
  source 1..20: mol_type = other DNA
cccttctttcttatctgctg

SEQ ID NO: 68469 - DNA, 20 bp, synthetic construct
  misc_feature 1..20: note = CRISPR gRNA sequence
  source 1..20: mol_type = other DNA
ctttcttatctgctgtgtgt

SEQ ID NO: 68470 - DNA, 20 bp, synthetic construct
  misc_feature 1..20: note = CRISPR gRNA sequence
  source 1..20: mol_type = other DNA
tttcttatctgctgtgtgtc

SEQ ID NO: 68471 - DNA, 20 bp, synthetic construct
  misc_feature 1..20: note = CRISPR gRNA sequence
  source 1..20: mol_type = other DNA
tcttatctgctgtgtgtcct

SEQ ID NO: 68472 - DNA, 20 bp, synthetic construct
  misc_feature 1..20: note = CRISPR gRNA sequence
  source 1..20: mol_type = other DNA
cttatctgctgtgtgtcctt

SEQ ID NO: 68473 - DNA, 20 bp, synthetic construct
  misc_feature 1..20: note = CRISPR gRNA sequence
  source 1..20: mol_type = other DNA
ttatctgctgtgtgtccttg

SEQ ID NO: 68474 - DNA, 20 bp, synthetic construct
  misc_feature 1..20: note = CRISPR gRNA sequence
  source 1..20: mol_type = other DNA
atctgctgtgtgtccttggg

SEQ ID NO: 68475 - DNA, 20 bp, synthetic construct
  misc_feature 1..20: note = CRISPR gRNA sequence
  source 1..20: mol_type = other DNA
tctgctgtgtgtccttgggt

SEQ ID NO: 68476 - DNA, 20 bp, synthetic construct
  misc_feature 1..20: note = CRISPR gRNA sequence
  source 1..20: mol_type = other DNA
ctgtgtgtccttgggttagt

SEQ ID NO: 68477 - DNA, 20 bp, synthetic construct
  misc_feature 1..20: note = CRISPR gRNA sequence
  source 1..20: mol_type = other DNA
tgtgtccttgggttagtcag

SEQ ID NO: 68478 - DNA, 20 bp, synthetic construct
  misc_feature 1..20: note = CRISPR gRNA sequence
  source 1..20: mol_type = other DNA
gggttagtcagtttccccac

SEQ ID NO: 68479 - DNA, 20 bp, synthetic construct
  misc_feature 1..20: note = CRISPR gRNA sequence
  source 1..20: mol_type = other DNA
ggttagtcagtttccccacc

SEQ ID NO: 68480 - DNA, 20 bp, synthetic construct
  misc_feature 1..20: note = CRISPR gRNA sequence
  source 1..20: mol_type = other DNA
gtcagtttccccacctctaa

SEQ ID NO: 68481 - DNA, 20 bp, synthetic construct
  misc_feature 1..20: note = CRISPR gRNA sequence
  source 1..20: mol_type = other DNA
ccccacctctaattggtgct

SEQ ID NO: 68482 - DNA, 20 bp, synthetic construct
  misc_feature 1..20: note = CRISPR gRNA sequence
  source 1..20: mol_type = other DNA
cccacctctaattggtgcta

SEQ ID NO: 68483 - DNA, 20 bp, synthetic construct
  misc_feature 1..20: note = CRISPR gRNA sequence
  source 1..20: mol_type = other DNA
taattggtgctatgagaatt

SEQ ID NO: 68484 - DNA, 20 bp, synthetic construct
  misc_feature 1..20: note = CRISPR gRNA sequence
  source 1..20: mol_type = other DNA
attggtgctatgagaattaa

SEQ ID NO: 68485 - DNA, 20 bp, synthetic construct
  misc_feature 1..20: note = CRISPR gRNA sequence
  source 1..20: mol_type = other DNA
gtgctatgagaattaaagga

SEQ ID NO: 68486 - DNA, 20 bp, synthetic construct
  misc_feature 1..20: note = CRISPR gRNA sequence
  source 1..20: mol_type = other DNA
tgagaattaaaggagaccct

SEQ ID NO: 68487 - DNA, 20 bp, synthetic construct
  misc_feature 1..20: note = CRISPR gRNA sequence
  source 1..20: mol_type = other DNA
aaggagaccctgcgggtaag

SEQ ID NO: 68488 - DNA, 20 bp, synthetic construct
  misc_feature 1..20: note = CRISPR gRNA sequence
  source 1..20: mol_type = other DNA
cgggtaaggcaggaagtccc

SEQ ID NO: 68489 - DNA, 20 bp, synthetic construct
  misc_feature 1..20: note = CRISPR gRNA sequence
  source 1..20: mol_type = other DNA
gcacagtgcctgacctagag

SEQ ID NO: 68490 - DNA, 20 bp, synthetic construct
  misc_feature 1..20: note = CRISPR gRNA sequence
  source 1..20: mol_type = other DNA
acctagagtcagcctcccta

SEQ ID NO: 68491 - DNA, 20 bp, synthetic construct
  misc_feature 1..20: note = CRISPR gRNA sequence
  source 1..20: mol_type = other DNA
gagtcagcctccctaaataa

SEQ ID NO: 68492 - DNA, 20 bp, synthetic construct
  misc_feature 1..20: note = CRISPR gRNA sequence
  source 1..20: mol_type = other DNA
cctaaataacttactcctaa

SEQ ID NO: 68493 - DNA, 20 bp, synthetic construct
  misc_feature 1..20: note = CRISPR gRNA sequence
  source 1..20: mol_type = other DNA
aataacttactcctaatact

SEQ ID NO: 68494 - DNA, 20 bp, synthetic construct
  misc_feature 1..20: note = CRISPR gRNA sequence
  source 1..20: mol_type = other DNA
actcctaatactttcttaca

SEQ ID NO: 68495 - DNA, 20 bp, synthetic construct
  misc_feature 1..20: note = CRISPR gRNA sequence
  source 1..20: mol_type = other DNA
ctcctaatactttcttacag

SEQ ID NO: 68496 - DNA, 20 bp, synthetic construct
  misc_feature 1..20: note = CRISPR gRNA sequence
  source 1..20: mol_type = other DNA
ctaatactttcttacagggg

SEQ ID NO: 68497 - DNA, 20 bp, synthetic construct
  misc_feature 1..20: note = CRISPR gRNA sequence
  source 1..20: mol_type = other DNA
atactttcttacagggggtg

SEQ ID NO: 68498 - DNA, 20 bp, synthetic construct
  misc_feature 1..20: note = CRISPR gRNA sequence
  source 1..20: mol_type = other DNA
tcttacagggggtgtgggag

SEQ ID NO: 68499 - DNA, 20 bp, synthetic construct
  misc_feature 1..20: note = CRISPR gRNA sequence
  source 1..20: mol_type = other DNA
cttacagggggtgtgggagg

SEQ ID NO: 68500 - DNA, 20 bp, synthetic construct
  misc_feature 1..20: note = CRISPR gRNA sequence
  source 1..20: mol_type = other DNA
ttacagggggtgtgggaggt

SEQ ID NO: 68501 - DNA, 20 bp, synthetic construct
  misc_feature 1..20: note = CRISPR gRNA sequence
  source 1..20: mol_type = other DNA
acagggggtgtgggaggttc

SEQ ID NO: 68502 - DNA, 20 bp, synthetic construct
  misc_feature 1..20: note = CRISPR gRNA sequence
  source 1..20: mol_type = other DNA
cagggggtgtgggaggttcc

SEQ ID NO: 68503 - DNA, 20 bp, synthetic construct
  misc_feature 1..20: note = CRISPR gRNA sequence
  source 1..20: mol_type = other DNA
ctccccaaagagacaggaag

SEQ ID NO: 68504 - DNA, 20 bp, synthetic construct
  misc_feature 1..20: note = CRISPR gRNA sequence
  source 1..20: mol_type = other DNA
cccaaagagacaggaagctc

SEQ ID NO: 68505 - DNA, 20 bp, synthetic construct
  misc_feature 1..20: note = CRISPR gRNA sequence
  source 1..20: mol_type = other DNA
ccagagcaggagctgcatat

SEQ ID NO: 68506 - DNA, 20 bp, synthetic construct
  misc_feature 1..20: note = CRISPR gRNA sequence
  source 1..20: mol_type = other DNA
catatttggcctctcaggcc

SEQ ID NO: 68507 - DNA, 20 bp, synthetic construct
  misc_feature 1..20: note = CRISPR gRNA sequence
  source 1..20: mol_type = other DNA
ggcctctcaggccctgctcc

SEQ ID NO: 68508 - DNA, 20 bp, synthetic construct
  misc_feature 1..20: note = CRISPR gRNA sequence
  source 1..20: mol_type = other DNA
gcctctcaggccctgctcca

SEQ ID NO: 68509 - DNA, 20 bp, synthetic construct
  misc_feature 1..20: note = CRISPR gRNA sequence
  source 1..20: mol_type = other DNA
tcaggccctgctccaggcct

SEQ ID NO: 68510 - DNA, 20 bp, synthetic construct
  misc_feature 1..20: note = CRISPR gRNA sequence
  source 1..20: mol_type = other DNA
aggccctgctccaggccttt

SEQ ID NO: 68511 - DNA, 20 bp, synthetic construct
  misc_feature 1..20: note = CRISPR gRNA sequence
  source 1..20: mol_type = other DNA
ctccaggcctttgccctcag

SEQ ID NO: 68512 - DNA, 20 bp, synthetic construct
  misc_feature 1..20: note = CRISPR gRNA sequence
  source 1..20: mol_type = other DNA
caggcctttgccctcagagg

SEQ ID NO: 68513 - DNA, 20 bp, synthetic construct
  misc_feature 1..20: note = CRISPR gRNA sequence
  source 1..20: mol_type = other DNA
tgccctcagaggtgggatgc

SEQ ID NO: 68514 - DNA, 20 bp, synthetic construct
  misc_feature 1..20: note = CRISPR gRNA sequence
  source 1..20: mol_type = other DNA
gccctcagaggtgggatgct

SEQ ID NO: 68515 - DNA, 20 bp, synthetic construct
  misc_feature 1..20: note = CRISPR gRNA sequence
  source 1..20: mol_type = other DNA
ccctcagaggtgggatgctc

SEQ ID NO: 68516 - DNA, 20 bp, synthetic construct
  misc_feature 1..20: note = CRISPR gRNA sequence
  source 1..20: mol_type = other DNA
agaggtgggatgctccccca

SEQ ID NO: 68517 - DNA, 20 bp, synthetic construct
  misc_feature 1..20: note = CRISPR gRNA sequence
  source 1..20: mol_type = other DNA
ccccaataggccctcaggga

SEQ ID NO: 68518 - DNA, 20 bp, synthetic construct
  misc_feature 1..20: note = CRISPR gRNA sequence
  source 1..20: mol_type = other DNA
agggaggctgagatgaagct

SEQ ID NO: 68519 - DNA, 20 bp, synthetic construct
  misc_feature 1..20: note = CRISPR gRNA sequence
  source 1..20: mol_type = other DNA
agatgaagctgagcagcagt

SEQ ID NO: 68520 - DNA, 20 bp, synthetic construct
  misc_feature 1..20: note = CRISPR gRNA sequence
  source 1..20: mol_type = other DNA
agcagcagtgcccacaggcc

SEQ ID NO: 68521 - DNA, 20 bp, synthetic construct
  misc_feature 1..20: note = CRISPR gRNA sequence
  source 1..20: mol_type = other DNA
acccaggctctgccctggct

SEQ ID NO: 68522 - DNA, 20 bp, synthetic construct
  misc_feature 1..20: note = CRISPR gRNA sequence
  source 1..20: mol_type = other DNA
tgccctggctttctgccctc

SEQ ID NO: 68523 - DNA, 20 bp, synthetic construct
  misc_feature 1..20: note = CRISPR gRNA sequence
  source 1..20: mol_type = other DNA
ccctggctttctgccctcag

SEQ ID NO: 68524 - DNA, 20 bp, synthetic construct
  misc_feature 1..20: note = CRISPR gRNA sequence
  source 1..20: mol_type = other DNA
gctttctgccctcaggctaa

SEQ ID NO: 68525 - DNA, 20 bp, synthetic construct
  misc_feature 1..20: note = CRISPR gRNA sequence
  source 1..20: mol_type = other DNA
tctgccctcaggctaagtga

SEQ ID NO: 68526 - DNA, 20 bp, synthetic construct
  misc_feature 1..20: note = CRISPR gRNA sequence
  source 1..20: mol_type = other DNA
ctgccctcaggctaagtgag

SEQ ID NO: 68527 - DNA, 20 bp, synthetic construct
  misc_feature 1..20: note = CRISPR gRNA sequence
  source 1..20: mol_type = other DNA
tgccctcaggctaagtgagt

SEQ ID NO: 68528 - DNA, 20 bp, synthetic construct
  misc_feature 1..20: note = CRISPR gRNA sequence
  source 1..20: mol_type = other DNA
ccctcaggctaagtgagtgc

SEQ ID NO: 68529 - DNA, 20 bp, synthetic construct
  misc_feature 1..20: note = CRISPR gRNA sequence
  source 1..20: mol_type = other DNA
aggctaagtgagtgcagctt

SEQ ID NO: 68530 - DNA, 20 bp, synthetic construct
  misc_feature 1..20: note = CRISPR gRNA sequence
  source 1..20: mol_type = other DNA
agtgagtgcagcttccggcc

SEQ ID NO: 68531 - DNA, 20 bp, synthetic construct
  misc_feature 1..20: note = CRISPR gRNA sequence
  source 1..20: mol_type = other DNA
ccggccagagcacgtgtcca

SEQ ID NO: 68532 - DNA, 20 bp, synthetic construct
  misc_feature 1..20: note = CRISPR gRNA sequence
  source 1..20: mol_type = other DNA
cggccagagcacgtgtccag

SEQ ID NO: 68533 - DNA, 20 bp, synthetic construct
  misc_feature 1..20: note = CRISPR gRNA sequence
  source 1..20: mol_type = other DNA
gccaccggcttgagcaagtc

SEQ ID NO: 68534 - DNA, 20 bp, synthetic construct
  misc_feature 1..20: note = CRISPR gRNA sequence
  source 1..20: mol_type = other DNA
gagcaagtccctgcagctga

SEQ ID NO: 68535 - DNA, 20 bp, synthetic construct
  misc_feature 1..20: note = CRISPR gRNA sequence
  source 1..20: mol_type = other DNA
agcaagtccctgcagctgac

SEQ ID NO: 68536 - DNA, 20 bp, synthetic construct
  misc_feature 1..20: note = CRISPR gRNA sequence
  source 1..20: mol_type = other DNA
cagctgacggagctcacgtg

SEQ ID NO: 68537 - DNA, 20 bp, synthetic construct
  misc_feature 1..20: note = CRISPR gRNA sequence
  source 1..20: mol_type = other DNA
acggagctcacgtgagtgac

SEQ ID NO: 68538 - DNA, 20 bp, synthetic construct
  misc_feature 1..20: note = CRISPR gRNA sequence
  source 1..20: mol_type = other DNA
acgtgagtgacccacccagc

SEQ ID NO: 68539 - DNA, 20 bp, synthetic construct
  misc_feature 1..20: note = CRISPR gRNA sequence
  source 1..20: mol_type = other DNA
ccagagccacctcagtgact

SEQ ID NO: 68540 - DNA, 20 bp, synthetic construct
  misc_feature 1..20: note = CRISPR gRNA sequence
  source 1..20: mol_type = other DNA
agtgactgacctctgtctcc

SEQ ID NO: 68541 - DNA, 20 bp, synthetic construct
  misc_feature 1..20: note = CRISPR gRNA sequence
  source 1..20: mol_type = other DNA
acctctgtctccaggctgac

SEQ ID NO: 68542 - DNA, 20 bp, synthetic construct
  misc_feature 1..20: note = CRISPR gRNA sequence
  source 1..20: mol_type = other DNA
tgtctccaggctgacccagt

SEQ ID NO: 68543 - DNA, 20 bp, synthetic construct
  misc_feature 1..20: note = CRISPR gRNA sequence
  source 1..20: mol_type = other DNA
tctccaggctgacccagtgc

SEQ ID NO: 68544 - DNA, 20 bp, synthetic construct
  misc_feature 1..20: note = CRISPR gRNA sequence
  source 1..20: mol_type = other DNA
caggctgacccagtgctgcc

SEQ ID NO: 68545 - DNA, 20 bp, synthetic construct
  misc_feature 1..20: note = CRISPR gRNA sequence
  source 1..20: mol_type = other DNA
acccagtgctgcctgggcca

SEQ ID NO: 68546 - DNA, 20 bp, synthetic construct
  misc_feature 1..20: note = CRISPR gRNA sequence
  source 1..20: mol_type = other DNA
cctgggccagaagcagctgg

SEQ ID NO: 68547 - DNA, 20 bp, synthetic construct
  misc_feature 1..20: note = CRISPR gRNA sequence
  source 1..20: mol_type = other DNA
ggccagaagcagctggccat

SEQ ID NO: 68548 - DNA, 20 bp, synthetic construct
  misc_feature 1..20: note = CRISPR gRNA sequence
  source 1..20: mol_type = other DNA
gccatcctcctgagcttggt

SEQ ID NO: 68549 - DNA, 20 bp, synthetic construct
  misc_feature 1..20: note = CRISPR gRNA sequence
  source 1..20: mol_type = other DNA
ctgagcttggtggggcgacc

SEQ ID NO: 68550 - DNA, 20 bp, synthetic construct
  misc_feature 1..20: note = CRISPR gRNA sequence
  source 1..20: mol_type = other DNA
agcttggtggggcgacccgc

SEQ ID NO: 68551 - DNA, 20 bp, synthetic construct
  misc_feature 1..20: note = CRISPR gRNA sequence
  source 1..20: mol_type = other DNA
ggtggggcgacccgcagggc

SEQ ID NO: 68552 - DNA, 20 bp, synthetic construct
  misc_feature 1..20: note = CRISPR gRNA sequence
  source 1..20: mol_type = other DNA
gtggggcgacccgcagggct

SEQ ID NO: 68553 - DNA, 20 bp, synthetic construct
  misc_feature 1..20: note = CRISPR gRNA sequence
  source 1..20: mol_type = other DNA
ttcagcctcaggtacctcct

SEQ ID NO: 68554 - DNA, 20 bp, synthetic construct
  misc_feature 1..20: note = CRISPR gRNA sequence
  source 1..20: mol_type = other DNA
agcctcaggtacctcctccc

SEQ ID NO: 68555 - DNA, 20 bp, synthetic construct
  misc_feature 1..20: note = CRISPR gRNA sequence
  source 1..20: mol_type = other DNA
aggtacctcctcccccgctg

SEQ ID NO: 68556 - DNA, 20 bp, synthetic construct
  misc_feature 1..20: note = CRISPR gRNA sequence
  source 1..20: mol_type = other DNA
ctcccccgctgcctccggga

SEQ ID NO: 68557 - DNA, 20 bp, synthetic construct
  misc_feature 1..20: note = CRISPR gRNA sequence
  source 1..20: mol_type = other DNA
ccccgctgcctccgggaggg

SEQ ID NO: 68558 - DNA, 20 bp, synthetic construct
  misc_feature 1..20: note = CRISPR gRNA sequence
  source 1..20: mol_type = other DNA
cctccgggaggggccatggc

SEQ ID NO: 68559 - DNA, 20 bp, synthetic construct
  misc_feature 1..20: note = CRISPR gRNA sequence
  source 1..20: mol_type = other DNA
cgggaggggccatggcatga

SEQ ID NO: 68560 - DNA, 20 bp, synthetic construct
  misc_feature 1..20: note = CRISPR gRNA sequence
  source 1..20: mol_type = other DNA
gagtaagaggcccccaggat

SEQ ID NO: 68561 - DNA, 20 bp, synthetic construct
  misc_feature 1..20: note = CRISPR gRNA sequence
  source 1..20: mol_type = other DNA
cctgtacccacaaccctgcc

SEQ ID NO: 68562 - DNA, 20 bp, synthetic construct
  misc_feature 1..20: note = CRISPR gRNA sequence
  source 1..20: mol_type = other DNA
ctgtacccacaaccctgcca

SEQ ID NO: 68563 - DNA, 20 bp, synthetic construct
  misc_feature 1..20: note = CRISPR gRNA sequence
  source 1..20: mol_type = other DNA
tacccacaaccctgccatct

SEQ ID NO: 68564 - DNA, 20 bp, synthetic construct
  misc_feature 1..20: note = CRISPR gRNA sequence
  source 1..20: mol_type = other DNA
ccatctggaccctgagcaaa

SEQ ID NO: 68565 - DNA, 20 bp, synthetic construct
  misc_feature 1..20: note = CRISPR gRNA sequence
  source 1..20: mol_type = other DNA
gaccctgagcaaaccctgtc

SEQ ID NO: 68566 - DNA, 20 bp, synthetic construct
  misc_feature 1..20: note = CRISPR gRNA sequence
  source 1..20: mol_type = other DNA
agcaaaccctgtccatctgt

SEQ ID NO: 68567 - DNA, 20 bp, synthetic construct
  misc_feature 1..20: note = CRISPR gRNA sequence
  source 1..20: mol_type = other DNA
tccatctgtcccagagactc

SEQ ID NO: 68568 - DNA, 20 bp, synthetic construct
  misc_feature 1..20: note = CRISPR gRNA sequence
  source 1..20: mol_type = other DNA
tcccagagactccacaaggc

SEQ ID NO: 68569 - DNA, 20 bp, synthetic construct
  misc_feature 1..20: note = CRISPR gRNA sequence
  source 1..20: mol_type = other DNA
cacaaggcacacagagaaac

SEQ ID NO: 68570 - DNA, 20 bp, synthetic construct
  misc_feature 1..20: note = CRISPR gRNA sequence
  source 1..20: mol_type = other DNA
tccttccccacactggaggc

SEQ ID NO: 68571 - DNA, 20 bp, synthetic construct
  misc_feature 1..20: note = CRISPR gRNA sequence
  source 1..20: mol_type = other DNA
ccccacactggaggcctgtg

SEQ ID NO: 68572 - DNA, 20 bp, synthetic construct
  misc_feature 1..20: note = CRISPR gRNA sequence
  source 1..20: mol_type = other DNA
cccacactggaggcctgtgc

SEQ ID NO: 68573 - DNA, 20 bp, synthetic construct
  misc_feature 1..20: note = CRISPR gRNA sequence
  source 1..20: mol_type = other DNA
gaggcctgtgctttgggatt

SEQ ID NO: 68574 - DNA, 20 bp, synthetic construct
  misc_feature 1..20: note = CRISPR gRNA sequence
  source 1..20: mol_type = other DNA
tgctttgggatttaagaaaa

SEQ ID NO: 68575 - DNA, 20 bp, synthetic construct
  misc_feature 1..20: note = CRISPR gRNA sequence
  source 1..20: mol_type = other DNA
tgggatttaagaaaaaaaga

SEQ ID NO: 68576 - DNA, 20 bp, synthetic construct
  misc_feature 1..20: note = CRISPR gRNA sequence
  source 1..20: mol_type = other DNA
gggatttaagaaaaaaagaa

SEQ ID NO: 68577 - DNA, 20 bp, synthetic construct
  misc_feature 1..20: note = CRISPR gRNA sequence
  source 1..20: mol_type = other DNA
ggatttaagaaaaaaagaaa

SEQ ID NO: 68578 - DNA, 20 bp, synthetic construct
  misc_feature 1..20: note = CRISPR gRNA sequence
  source 1..20: mol_type = other DNA
aagaaaaaaagaaagaaaga

SEQ ID NO: 68579 - DNA, 20 bp, synthetic construct
  misc_feature 1..20: note = CRISPR gRNA sequence
  source 1..20: mol_type = other DNA
agaaaaaaagaaagaaagaa

SEQ ID NO: 68580 - DNA, 20 bp, synthetic construct
  misc_feature 1..20: note = CRISPR gRNA sequence
  source 1..20: mol_type = other DNA
cagaggatactgaactgagg

SEQ ID NO: 68581 - DNA, 20 bp, synthetic construct
  misc_feature 1..20: note = CRISPR gRNA sequence
  source 1..20: mol_type = other DNA
agaggatactgaactgagga

SEQ ID NO: 68582 - DNA, 20 bp, synthetic construct
  misc_feature 1..20: note = CRISPR gRNA sequence
  source 1..20: mol_type = other DNA
aactgaggacaaaaataaac

SEQ ID NO: 68583 - DNA, 20 bp, synthetic construct
  misc_feature 1..20: note = CRISPR gRNA sequence
  source 1..20: mol_type = other DNA
aggacaaaaataaactgaaa

SEQ ID NO: 68584 - DNA, 20 bp, synthetic construct
  misc_feature 1..20: note = CRISPR gRNA sequence
  source 1..20: mol_type = other DNA
aaacgaagttcttgtctgtc

SEQ ID NO: 68585 - DNA, 20 bp, synthetic construct
  misc_feature 1..20: note = CRISPR gRNA sequence
  source 1..20: mol_type = other DNA
ttgtctgtctgttcactatg

SEQ ID NO: 68586 - DNA, 20 bp, synthetic construct
  misc_feature 1..20: note = CRISPR gRNA sequence
  source 1..20: mol_type = other DNA
gtctgtctgttcactatgat

SEQ ID NO: 68587 - DNA, 20 bp, synthetic construct
  misc_feature 1..20: note = CRISPR gRNA sequence
  source 1..20: mol_type = other DNA
tctgtctgttcactatgatc

SEQ ID NO: 68588 - DNA, 20 bp, synthetic construct
  misc_feature 1..20: note = CRISPR gRNA sequence
  source 1..20: mol_type = other DNA
tctgttcactatgatcattt

SEQ ID NO: 68589 - DNA, 20 bp, synthetic construct
  misc_feature 1..20: note = CRISPR gRNA sequence
  source 1..20: mol_type = other DNA
ttcactatgatcattttaaa

SEQ ID NO: 68590 - DNA, 20 bp, synthetic construct
  misc_feature 1..20: note = CRISPR gRNA sequence
  source 1..20: mol_type = other DNA
actatgatcattttaaaaca

SEQ ID NO: 68591 - DNA, 20 bp, synthetic construct
  misc_feature 1..20: note = CRISPR gRNA sequence
  source 1..20: mol_type = other DNA
tgatcattttaaaacactca

SEQ ID NO: 68592 - DNA, 20 bp, synthetic construct
  misc_feature 1..20: note = CRISPR gRNA sequence
  source 1..20: mol_type = other DNA
taaaacactcagaaaaagaa

SEQ ID NO: 68593 - DNA, 20 bp, synthetic construct
  misc_feature 1..20: note = CRISPR gRNA sequence
  source 1..20: mol_type = other DNA
aaaacactcagaaaaagaag

SEQ ID NO: 68594 - DNA, 20 bp, synthetic construct
  misc_feature 1..20: note = CRISPR gRNA sequence
  source 1..20: mol_type = other DNA
aaacactcagaaaaagaaga

SEQ ID NO: 68595 - DNA, 20 bp, synthetic construct
  misc_feature 1..20: note = CRISPR gRNA sequence
  source 1..20: mol_type = other DNA
agaaaaagaagataccgaag

SEQ ID NO: 68596 - DNA, 20 bp, synthetic construct
  misc_feature 1..20: note = CRISPR gRNA sequence
  source 1..20: mol_type = other DNA
tttaaaactcctattcccag

SEQ ID NO: 68597 - DNA, 20 bp, synthetic construct
  misc_feature 1..20: note = CRISPR gRNA sequence
  source 1..20: mol_type = other DNA
ttaaaactcctattcccaga

SEQ ID NO: 68598 - DNA, 20 bp, synthetic construct
  misc_feature 1..20: note = CRISPR gRNA sequence
  source 1..20: mol_type = other DNA
taaaactcctattcccagaa

SEQ ID NO: 68599 - DNA, 20 bp, synthetic construct
  misc_feature 1..20: note = CRISPR gRNA sequence
  source 1..20: mol_type = other DNA
aaaactcctattcccagaac

SEQ ID NO: 68600 - DNA, 20 bp, synthetic construct
  misc_feature 1..20: note = CRISPR gRNA sequence
  source 1..20: mol_type = other DNA
aaactcctattcccagaacc

SEQ ID NO: 68601 - DNA, 20 bp, synthetic construct
  misc_feature 1..20: note = CRISPR gRNA sequence
  source 1..20: mol_type = other DNA
ctattcccagaacctaggtt

SEQ ID NO: 68602 - DNA, 20 bp, synthetic construct
  misc_feature 1..20: note = CRISPR gRNA sequence
  source 1..20: mol_type = other DNA
ttcccagaacctaggtttga

SEQ ID NO: 68603 - DNA, 20 bp, synthetic construct
  misc_feature 1..20: note = CRISPR gRNA sequence
  source 1..20: mol_type = other DNA
ccagaacctaggtttgacag

SEQ ID NO: 68604 - DNA, 20 bp, synthetic construct
  misc_feature 1..20: note = CRISPR gRNA sequence
  source 1..20: mol_type = other DNA
ggtttgacagttgttcatac

SEQ ID NO: 68605 - DNA, 20 bp, synthetic construct
  misc_feature 1..20: note = CRISPR gRNA sequence
  source 1..20: mol_type = other DNA
gacagttgttcatacttttt

SEQ ID NO: 68606 - DNA, 20 bp, synthetic construct
  misc_feature 1..20: note = CRISPR gRNA sequence
  source 1..20: mol_type = other DNA
acagttgttcatactttttt

SEQ ID NO: 68607 - DNA, 20 bp, synthetic construct
  misc_feature 1..20: note = CRISPR gRNA sequence
  source 1..20: mol_type = other DNA
ttcatactttttttatattt

SEQ ID NO: 68608 - DNA, 20 bp, synthetic construct
  misc_feature 1..20: note = CRISPR gRNA sequence
  source 1..20: mol_type = other DNA
atactttttttatatttgct

SEQ ID NO: 68609 - DNA, 20 bp, synthetic construct
  misc_feature 1..20: note = CRISPR gRNA sequence
  source 1..20: mol_type = other DNA
tttttatatttgcttctatt

SEQ ID NO: 68610 - DNA, 20 bp, synthetic construct
  misc_feature 1..20: note = CRISPR gRNA sequence
  source 1..20: mol_type = other DNA
ttttatatttgcttctattt

SEQ ID NO: 68611 - DNA, 20 bp, synthetic construct
  misc_feature 1..20: note = CRISPR gRNA sequence
  source 1..20: mol_type = other DNA
tttatatttgcttctatttt

SEQ ID NO: 68612 - DNA, 20 bp, synthetic construct
  misc_feature 1..20: note = CRISPR gRNA sequence
  source 1..20: mol_type = other DNA
ttatatttgcttctattttt

SEQ ID NO: 68613 - DNA, 20 bp, synthetic construct
  misc_feature 1..20: note = CRISPR gRNA sequence
  source 1..20: mol_type = other DNA
tatatttgcttctattttta

SEQ ID NO: 68614 - DNA, 20 bp, synthetic construct
  misc_feature 1..20: note = CRISPR gRNA sequence
  source 1..20: mol_type = other DNA
atatttgcttctatttttat

SEQ ID NO: 68615 - DNA, 20 bp, synthetic construct
  misc_feature 1..20: note = CRISPR gRNA sequence
  source 1..20: mol_type = other DNA
tatttgcttctatttttatt

SEQ ID NO: 68616 - DNA, 20 bp, synthetic construct
  misc_feature 1..20: note = CRISPR gRNA sequence
  source 1..20: mol_type = other DNA
gcttctatttttatttttat

SEQ ID NO: 68617 - DNA, 20 bp, synthetic construct
  misc_feature 1..20: note = CRISPR gRNA sequence
  source 1..20: mol_type = other DNA
cttctatttttatttttatt

SEQ ID NO: 68618 - DNA, 20 bp, synthetic construct
  misc_feature 1..20: note = CRISPR gRNA sequence
  source 1..20: mol_type = other DNA
ctatttttatttttatttca

SEQ ID NO: 68619 - DNA, 20 bp, synthetic construct
  misc_feature 1..20: note = CRISPR gRNA sequence
  source 1..20: mol_type = other DNA
tatttttatttttatttcag

SEQ ID NO: 68620 - DNA, 20 bp, synthetic construct
  misc_feature 1..20: note = CRISPR gRNA sequence
  source 1..20: mol_type = other DNA
tttttatttttatttcagct

SEQ ID NO: 68621 - DNA, 20 bp, synthetic construct
  misc_feature 1..20: note = CRISPR gRNA sequence
  source 1..20: mol_type = other DNA
ttatttttatttcagctgaa

SEQ ID NO: 68622 - DNA, 20 bp, synthetic construct
  misc_feature 1..20: note = CRISPR gRNA sequence
  source 1..20: mol_type = other DNA
tatttttatttcagctgaag

SEQ ID NO: 68623 - DNA, 20 bp, synthetic construct
  misc_feature 1..20: note = CRISPR gRNA sequence
  source 1..20: mol_type = other DNA
atttttatttcagctgaagc

SEQ ID NO: 68624 - DNA, 20 bp, synthetic construct
  misc_feature 1..20: note = CRISPR gRNA sequence
  source 1..20: mol_type = other DNA
tttttatttcagctgaagcg

SEQ ID NO: 68625 - DNA, 20 bp, synthetic construct
  misc_feature 1..20: note = CRISPR gRNA sequence
  source 1..20: mol_type = other DNA
ttatttcagctgaagcggtt

SEQ ID NO: 68626 - DNA, 20 bp, synthetic construct
  misc_feature 1..20: note = CRISPR gRNA sequence
  source 1..20: mol_type = other DNA
tatttcagctgaagcggttt

SEQ ID NO: 68627 - DNA, 20 bp, synthetic construct
  misc_feature 1..20: note = CRISPR gRNA sequence
  source 1..20: mol_type = other DNA
atttcagctgaagcggtttc

SEQ ID NO: 68628 - DNA, 20 bp, synthetic construct
  misc_feature 1..20: note = CRISPR gRNA sequence
  source 1..20: mol_type = other DNA
tttcagctgaagcggtttca

SEQ ID NO: 68629 - DNA, 20 bp, synthetic construct
  misc_feature 1..20: note = CRISPR gRNA sequence
  source 1..20: mol_type = other DNA
cagctgaagcggtttcaagt

SEQ ID NO: 68630 - DNA, 20 bp, synthetic construct
  misc_feature 1..20: note = CRISPR gRNA sequence
  source 1..20: mol_type = other DNA
agctgaagcggtttcaagta

SEQ ID NO: 68631 - DNA, 20 bp, synthetic construct
  misc_feature 1..20: note = CRISPR gRNA sequence
  source 1..20: mol_type = other DNA
aagcggtttcaagtaagtta

SEQ ID NO: 68632 - DNA, 20 bp, synthetic construct
  misc_feature 1..20: note = CRISPR gRNA sequence
  source 1..20: mol_type = other DNA
caagtaagttatagacctca

SEQ ID NO: 68633 - DNA, 20 bp, synthetic construct
  misc_feature 1..20: note = CRISPR gRNA sequence
  source 1..20: mol_type = other DNA
aagtaagttatagacctcat

SEQ ID NO: 68634 - DNA, 20 bp, synthetic construct
  misc_feature 1..20: note = CRISPR gRNA sequence
  source 1..20: mol_type = other DNA
tagacctcataatccatcac

SEQ ID NO: 68635 - DNA, 20 bp, synthetic construct
  misc_feature 1..20: note = CRISPR gRNA sequence
  source 1..20: mol_type = other DNA
ataatccatcactcctaaat

SEQ ID NO: 68636 - DNA, 20 bp, synthetic construct
  misc_feature 1..20: note = CRISPR gRNA sequence
  source 1..20: mol_type = other DNA
ctaaatatttcaccgtgaag

SEQ ID NO: 68637 - DNA, 20 bp, synthetic construct
  misc_feature 1..20: note = CRISPR gRNA sequence
  source 1..20: mol_type = other DNA
aatatttcaccgtgaagctc

SEQ ID NO: 68638 - DNA, 20 bp, synthetic construct
  misc_feature 1..20: note = CRISPR gRNA sequence
  source 1..20: mol_type = other DNA
caccgtgaagctccaaaaaa

SEQ ID NO: 68639 - DNA, 20 bp, synthetic construct
  misc_feature 1..20: note = CRISPR gRNA sequence
  source 1..20: mol_type = other DNA
accgtgaagctccaaaaaat

SEQ ID NO: 68640 - DNA, 20 bp, synthetic construct
  misc_feature 1..20: note = CRISPR gRNA sequence
  source 1..20: mol_type = other DNA
caaaaaataaggacattttt

SEQ ID NO: 68641 - DNA, 20 bp, synthetic construct
  misc_feature 1..20: note = CRISPR gRNA sequence
  source 1..20: mol_type = other DNA
ttttcagtaatcacagttcc

SEQ ID NO: 68642 - DNA, 20 bp, synthetic construct
  misc_feature 1..20: note = CRISPR gRNA sequence
  source 1..20: mol_type = other DNA
tttcagtaatcacagttcca

SEQ ID NO: 68643 - DNA, 20 bp, synthetic construct
  misc_feature 1..20: note = CRISPR gRNA sequence
  source 1..20: mol_type = other DNA
ttcagtaatcacagttccat

SEQ ID NO: 68644 - DNA, 20 bp, synthetic construct
  misc_feature 1..20: note = CRISPR gRNA sequence
  source 1..20: mol_type = other DNA
tcagtaatcacagttccatc

SEQ ID NO: 68645 - DNA, 20 bp, synthetic construct
  misc_feature 1..20: note = CRISPR gRNA sequence
  source 1..20: mol_type = other DNA
cagtaatcacagttccatca

SEQ ID NO: 68646 - DNA, 20 bp, synthetic construct
  misc_feature 1..20: note = CRISPR gRNA sequence
  source 1..20: mol_type = other DNA
agtaatcacagttccatcag

SEQ ID NO: 68647 - DNA, 20 bp, synthetic construct
  misc_feature 1..20: note = CRISPR gRNA sequence
  source 1..20: mol_type = other DNA
catcaggacacctaagaaac

SEQ ID NO: 68648 - DNA, 20 bp, synthetic construct
  misc_feature 1..20: note = CRISPR gRNA sequence
  source 1..20: mol_type = other DNA
agaaactcagttagcgattc

SEQ ID NO: 68649 - DNA, 20 bp, synthetic construct
  misc_feature 1..20: note = CRISPR gRNA sequence
  source 1..20: mol_type = other DNA
agttagcgattccttagtgt

SEQ ID NO: 68650 - DNA, 20 bp, synthetic construct
  misc_feature 1..20: note = CRISPR gRNA sequence
  source 1..20: mol_type = other DNA
gcgattccttagtgtcgggt

SEQ ID NO: 68651 - DNA, 20 bp, synthetic construct
  misc_feature 1..20: note = CRISPR gRNA sequence
  source 1..20: mol_type = other DNA
cttagtgtcgggtactacct

SEQ ID NO: 68652 - DNA, 20 bp, synthetic construct
  misc_feature 1..20: note = CRISPR gRNA sequence
  source 1..20: mol_type = other DNA
agtgtcgggtactacctagt

SEQ ID NO: 68653 - DNA, 20 bp, synthetic construct
  misc_feature 1..20: note = CRISPR gRNA sequence
  source 1..20: mol_type = other DNA
gtgtcgggtactacctagtc

SEQ ID NO: 68654 - DNA, 20 bp, synthetic construct
  misc_feature 1..20: note = CRISPR gRNA sequence
  source 1..20: mol_type = other DNA
cctagtctaatctaaaatgt

SEQ ID NO: 68655 - DNA, 20 bp, synthetic construct
  misc_feature 1..20: note = CRISPR gRNA sequence
  source 1..20: mol_type = other DNA
gtctaatctaaaatgtcccc

SEQ ID NO: 68656 - DNA, 20 bp, synthetic construct
  misc_feature 1..20: note = CRISPR gRNA sequence
  source 1..20: mol_type = other DNA
atctaaaatgtccccattgt

SEQ ID NO: 68657 - DNA, 20 bp, synthetic construct
  misc_feature 1..20: note = CRISPR gRNA sequence
  source 1..20: mol_type = other DNA
aaatgtccccattgtccccc

SEQ ID NO: 68658 - DNA, 20 bp, synthetic construct
  misc_feature 1..20: note = CRISPR gRNA sequence
  source 1..20: mol_type = other DNA
tcccccagataagacagctg

SEQ ID NO: 68659 - DNA, 20 bp, synthetic construct
  misc_feature 1..20: note = CRISPR gRNA sequence
  source 1..20: mol_type = other DNA
gcttttgggatccaggatct

SEQ ID NO: 68660 - DNA, 20 bp, synthetic construct
  misc_feature 1..20: note = CRISPR gRNA sequence
  source 1..20: mol_type = other DNA
ttgggatccaggatctgtca

SEQ ID NO: 68661 - DNA, 20 bp, synthetic construct
  misc_feature 1..20: note = CRISPR gRNA sequence
  source 1..20: mol_type = other DNA
tgggatccaggatctgtcac

SEQ ID NO: 68662 - DNA, 20 bp, synthetic construct
  misc_feature 1..20: note = CRISPR gRNA sequence
  source 1..20: mol_type = other DNA
gggatccaggatctgtcaca

SEQ ID NO: 68663 - DNA, 20 bp, synthetic construct
  misc_feature 1..20: note = CRISPR gRNA sequence
  source 1..20: mol_type = other DNA
ggatccaggatctgtcacat

SEQ ID NO: 68664 - DNA, 20 bp, synthetic construct
  misc_feature 1..20: note = CRISPR gRNA sequence
  source 1..20: mol_type = other DNA
tcacatctggtctgcatttg

SEQ ID NO: 68665 - DNA, 20 bp, synthetic construct
  misc_feature 1..20: note = CRISPR gRNA sequence
  source 1..20: mol_type = other DNA
gtctgcatttgcacgggatg

SEQ ID NO: 68666 - DNA, 20 bp, synthetic construct
  misc_feature 1..20: note = CRISPR gRNA sequence
  source 1..20: mol_type = other DNA
catttgcacgggatggcgat

SEQ ID NO: 68667 - DNA, 20 bp, synthetic construct
  misc_feature 1..20: note = CRISPR gRNA sequence
  source 1..20: mol_type = other DNA
gcacgggatggcgatggtct

SEQ ID NO: 68668 - DNA, 20 bp, synthetic construct
  misc_feature 1..20: note = CRISPR gRNA sequence
  source 1..20: mol_type = other DNA
cacgggatggcgatggtctt

SEQ ID NO: 68669 - DNA, 20 bp, synthetic construct
  misc_feature 1..20: note = CRISPR gRNA sequence
  source 1..20: mol_type = other DNA
ctgactcttctaacctgcgg

SEQ ID NO: 68670 - DNA, 20 bp, synthetic construct
  misc_feature 1..20: note = CRISPR gRNA sequence
  source 1..20: mol_type = other DNA
tgactcttctaacctgcggc

SEQ ID NO: 68671 - DNA, 20 bp, synthetic construct
  misc_feature 1..20: note = CRISPR gRNA sequence
  source 1..20: mol_type = other DNA
actcttctaacctgcggcat

SEQ ID NO: 68672 - DNA, 20 bp, synthetic construct
  misc_feature 1..20: note = CRISPR gRNA sequence
  source 1..20: mol_type = other DNA
ttctaacctgcggcatcact

SEQ ID NO: 68673 - DNA, 20 bp, synthetic construct
  misc_feature 1..20: note = CRISPR gRNA sequence
  source 1..20: mol_type = other DNA
ctaacctgcggcatcactgc

SEQ ID NO: 68674 - DNA, 20 bp, synthetic construct
  misc_feature 1..20: note = CRISPR gRNA sequence
  source 1..20: mol_type = other DNA
taacctgcggcatcactgcc

SEQ ID NO: 68675 - DNA, 20 bp, synthetic construct
  misc_feature 1..20: note = CRISPR gRNA sequence
  source 1..20: mol_type = other DNA
acctgcggcatcactgcccc

SEQ ID NO: 68676 - DNA, 20 bp, synthetic construct
  misc_feature 1..20: note = CRISPR gRNA sequence
  source 1..20: mol_type = other DNA
cggcatcactgcccccatcc

SEQ ID NO: 68677 - DNA, 20 bp, synthetic construct
  misc_feature 1..20: note = CRISPR gRNA sequence
  source 1..20: mol_type = other DNA
cccccatcccctcaccacag

SEQ ID NO: 68678 - DNA, 20 bp, synthetic construct
  misc_feature 1..20: note = CRISPR gRNA sequence
  source 1..20: mol_type = other DNA
accacagctttctgtttcat

SEQ ID NO: 68679 - DNA, 20 bp, synthetic construct
  misc_feature 1..20: note = CRISPR gRNA sequence
  source 1..20: mol_type = other DNA
tctgtttcatgtcagtgtct

SEQ ID NO: 68680 - DNA, 20 bp, synthetic construct
  misc_feature 1..20: note = CRISPR gRNA sequence
  source 1..20: mol_type = other DNA
ctgtttcatgtcagtgtctg

SEQ ID NO: 68681 - DNA, 20 bp, synthetic construct
  misc_feature 1..20: note = CRISPR gRNA sequence
  source 1..20: mol_type = other DNA
tgtttcatgtcagtgtctgt

SEQ ID NO: 68682 - DNA, 20 bp, synthetic construct
  misc_feature 1..20: note = CRISPR gRNA sequence
  source 1..20: mol_type = other DNA
tttcatgtcagtgtctgttg

SEQ ID NO: 68683 - DNA, 20 bp, synthetic construct
  misc_feature 1..20: note = CRISPR gRNA sequence
  source 1..20: mol_type = other DNA
catgtcagtgtctgttgaca

SEQ ID NO: 68684 - DNA, 20 bp, synthetic construct
  misc_feature 1..20: note = CRISPR gRNA sequence
  source 1..20: mol_type = other DNA
atgtcagtgtctgttgacaa

SEQ ID NO: 68685 - DNA, 20 bp, synthetic construct
  misc_feature 1..20: note = CRISPR gRNA sequence
  source 1..20: mol_type = other DNA
ttgacaaaatcagcaactgt

SEQ ID NO: 68686 - DNA, 20 bp, synthetic construct
  misc_feature 1..20: note = CRISPR gRNA sequence
  source 1..20: mol_type = other DNA
acaaaatcagcaactgtgtg

SEQ ID NO: 68687 - DNA, 20 bp, synthetic construct
  misc_feature 1..20: note = CRISPR gRNA sequence
  source 1..20: mol_type = other DNA
tgtgtactgcagactgtcct

SEQ ID NO: 68688 - DNA, 20 bp, synthetic construct
  misc_feature 1..20: note = CRISPR gRNA sequence
  source 1..20: mol_type = other DNA
cagactgtcctgctcctgac

SEQ ID NO: 68689 - DNA, 20 bp, synthetic construct
  misc_feature 1..20: note = CRISPR gRNA sequence
  source 1..20: mol_type = other DNA
tcctgctcctgactctggtg

SEQ ID NO: 68690 - DNA, 20 bp, synthetic construct
  misc_feature 1..20: note = CRISPR gRNA sequence
  source 1..20: mol_type = other DNA
ctcctgactctggtggcttt

SEQ ID NO: 68691 - DNA, 20 bp, synthetic construct
  misc_feature 1..20: note = CRISPR gRNA sequence
  source 1..20: mol_type = other DNA
ctgactctggtggctttctc

SEQ ID NO: 68692 - DNA, 20 bp, synthetic construct
  misc_feature 1..20: note = CRISPR gRNA sequence
  source 1..20: mol_type = other DNA
actctggtggctttctcatg

SEQ ID NO: 68693 - DNA, 20 bp, synthetic construct
  misc_feature 1..20: note = CRISPR gRNA sequence
  source 1..20: mol_type = other DNA
tggtggctttctcatgatgt

SEQ ID NO: 68694 - DNA, 20 bp, synthetic construct
  misc_feature 1..20: note = CRISPR gRNA sequence
  source 1..20: mol_type = other DNA
gtggctttctcatgatgtca

SEQ ID NO: 68695 - DNA, 20 bp, synthetic construct
  misc_feature 1..20: note = CRISPR gRNA sequence
  source 1..20: mol_type = other DNA
tctcatgatgtcatggcacg

SEQ ID NO: 68696 - DNA, 20 bp, synthetic construct
  misc_feature 1..20: note = CRISPR gRNA sequence
  source 1..20: mol_type = other DNA
ctcatgatgtcatggcacgt

SEQ ID NO: 68697 - DNA, 20 bp, synthetic construct
  misc_feature 1..20: note = CRISPR gRNA sequence
  source 1..20: mol_type = other DNA
tcatgatgtcatggcacgtg

SEQ ID NO: 68698 - DNA, 20 bp, synthetic construct
  misc_feature 1..20: note = CRISPR gRNA sequence
  source 1..20: mol_type = other DNA
atgatgtcatggcacgtgtt

SEQ ID NO: 68699 - DNA, 20 bp, synthetic construct
  misc_feature 1..20: note = CRISPR gRNA sequence
  source 1..20: mol_type = other DNA
ctctaaccccgactttcctg

SEQ ID NO: 68700 - DNA, 20 bp, synthetic construct
  misc_feature 1..20: note = CRISPR gRNA sequence
  source 1..20: mol_type = other DNA
taaccccgactttcctggaa

SEQ ID NO: 68701 - DNA, 20 bp, synthetic construct
  misc_feature 1..20: note = CRISPR gRNA sequence
  source 1..20: mol_type = other DNA
accccgactttcctggaaac

SEQ ID NO: 68702 - DNA, 20 bp, synthetic construct
  misc_feature 1..20: note = CRISPR gRNA sequence
  source 1..20: mol_type = other DNA
tcctggaaactggacgttag

SEQ ID NO: 68703 - DNA, 20 bp, synthetic construct
  misc_feature 1..20: note = CRISPR gRNA sequence
  source 1..20: mol_type = other DNA
cctggaaactggacgttaga

SEQ ID NO: 68704 - DNA, 20 bp, synthetic construct
  misc_feature 1..20: note = CRISPR gRNA sequence
  source 1..20: mol_type = other DNA
ctggaaactggacgttagat

SEQ ID NO: 68705 - DNA, 20 bp, synthetic construct
  misc_feature 1..20: note = CRISPR gRNA sequence
  source 1..20: mol_type = other DNA
gaaactggacgttagatcaa

SEQ ID NO: 68706 - DNA, 20 bp, synthetic construct
  misc_feature 1..20: note = CRISPR gRNA sequence
  source 1..20: mol_type = other DNA
gacgttagatcaaaaggctc

SEQ ID NO: 68707 - DNA, 20 bp, synthetic construct
  misc_feature 1..20: note = CRISPR gRNA sequence
  source 1..20: mol_type = other DNA
gatcaaaaggctccatgaca

SEQ ID NO: 68708 - DNA, 20 bp, synthetic construct
  misc_feature 1..20: note = CRISPR gRNA sequence
  source 1..20: mol_type = other DNA
catgacattcagtttcatgt

SEQ ID NO: 68709 - DNA, 20 bp, synthetic construct
  misc_feature 1..20: note = CRISPR gRNA sequence
  source 1..20: mol_type = other DNA
agtttcatgtttgtgcccaa

SEQ ID NO: 68710 - DNA, 20 bp, synthetic construct
  misc_feature 1..20: note = CRISPR gRNA sequence
  source 1..20: mol_type = other DNA
catgtttgtgcccaaaaaac

SEQ ID NO: 68711 - DNA, 20 bp, synthetic construct
  misc_feature 1..20: note = CRISPR gRNA sequence
  source 1..20: mol_type = other DNA
atgtttgtgcccaaaaaact

SEQ ID NO: 68712 - DNA, 20 bp, synthetic construct
  misc_feature 1..20: note = CRISPR gRNA sequence
  source 1..20: mol_type = other DNA
gtgcccaaaaaacttacgtc

SEQ ID NO: 68713 - DNA, 20 bp, synthetic construct
  misc_feature 1..20: note = CRISPR gRNA sequence
  source 1..20: mol_type = other DNA
tgcccaaaaaacttacgtca

SEQ ID NO: 68714 - DNA, 20 bp, synthetic construct
  misc_feature 1..20: note = CRISPR gRNA sequence
  source 1..20: mol_type = other DNA
acgtcaccgacagagctgtg

SEQ ID NO: 68715 - DNA, 20 bp, synthetic construct
  misc_feature 1..20: note = CRISPR gRNA sequence
  source 1..20: mol_type = other DNA
cgtcaccgacagagctgtgc

SEQ ID NO: 68716 - DNA, 20 bp, synthetic construct
  misc_feature 1..20: note = CRISPR gRNA sequence
  source 1..20: mol_type = other DNA
tgcacttctcattgcagcct

SEQ ID NO: 68717 - DNA, 20 bp, synthetic construct
  misc_feature 1..20: note = CRISPR gRNA sequence
  source 1..20: mol_type = other DNA
ctcattgcagcctgtgacaa

SEQ ID NO: 68718 - DNA, 20 bp, synthetic construct
  misc_feature 1..20: note = CRISPR gRNA sequence
  source 1..20: mol_type = other DNA
tcattgcagcctgtgacaag

SEQ ID NO: 68719 - DNA, 20 bp, synthetic construct
  misc_feature 1..20: note = CRISPR gRNA sequence
  source 1..20: mol_type = other DNA
attgcagcctgtgacaaggc

SEQ ID NO: 68720 - DNA, 20 bp, synthetic construct
  misc_feature 1..20: note = CRISPR gRNA sequence
  source 1..20: mol_type = other DNA
cagcctgtgacaaggcacct

SEQ ID NO: 68721 - DNA, 20 bp, synthetic construct
  misc_feature 1..20: note = CRISPR gRNA sequence
  source 1..20: mol_type = other DNA
tgacaaggcacctaagaact

SEQ ID NO: 68722 - DNA, 20 bp, synthetic construct
  misc_feature 1..20: note = CRISPR gRNA sequence
  source 1..20: mol_type = other DNA
agaactgactgttccccaaa

SEQ ID NO: 68723 - DNA, 20 bp, synthetic construct
  misc_feature 1..20: note = CRISPR gRNA sequence
  source 1..20: mol_type = other DNA
actgttccccaaaataacct

SEQ ID NO: 68724 - DNA, 20 bp, synthetic construct
  misc_feature 1..20: note = CRISPR gRNA sequence
  source 1..20: mol_type = other DNA
ttccccaaaataacctgtaa

SEQ ID NO: 68725 - DNA, 20 bp, synthetic construct
  misc_feature 1..20: note = CRISPR gRNA sequence
  source 1..20: mol_type = other DNA
cccaaaataacctgtaaaaa

SEQ ID NO: 68726 - DNA, 20 bp, synthetic construct
  misc_feature 1..20: note = CRISPR gRNA sequence
  source 1..20: mol_type = other DNA
taaaaattattataaaatac

SEQ ID NO: 68727 - DNA, 20 bp, synthetic construct
  misc_feature 1..20: note = CRISPR gRNA sequence
  source 1..20: mol_type = other DNA
ttataaaatacacataacaa

SEQ ID NO: 68728 - DNA, 20 bp, synthetic construct
  misc_feature 1..20: note = CRISPR gRNA sequence
  source 1..20: mol_type = other DNA
taaaatacacataacaaaat

SEQ ID NO: 68729 - DNA, 20 bp, synthetic construct
  misc_feature 1..20: note = CRISPR gRNA sequence
  source 1..20: mol_type = other DNA
gccatcttaatcatttctaa

SEQ ID NO: 68730 - DNA, 20 bp, synthetic construct
  misc_feature 1..20: note = CRISPR gRNA sequence
  source 1..20: mol_type = other DNA
ccatcttaatcatttctaag

SEQ ID NO: 68731 - DNA, 20 bp, synthetic construct
  misc_feature 1..20: note = CRISPR gRNA sequence
  source 1..20: mol_type = other DNA
aatcatttctaagtgtacca

SEQ ID NO: 68732 - DNA, 20 bp, synthetic construct
  misc_feature 1..20: note = CRISPR gRNA sequence
  source 1..20: mol_type = other DNA
atcatttctaagtgtaccat

SEQ ID NO: 68733 - DNA, 20 bp, synthetic construct
  misc_feature 1..20: note = CRISPR gRNA sequence
  source 1..20: mol_type = other DNA
ctaagtgtaccattcaggag

SEQ ID NO: 68734 - DNA, 20 bp, synthetic construct
  misc_feature 1..20: note = CRISPR gRNA sequence
  source 1..20: mol_type = other DNA
taagtgtaccattcaggagt

SEQ ID NO: 68735 - DNA, 20 bp, synthetic construct
  misc_feature 1..20: note = CRISPR gRNA sequence
  source 1..20: mol_type = other DNA
agtgtaccattcaggagtgt

SEQ ID NO: 68736 - DNA, 20 bp, synthetic construct
  misc_feature 1..20: note = CRISPR gRNA sequence
  source 1..20: mol_type = other DNA
aggagtgttaagtacatcca

SEQ ID NO: 68737 - DNA, 20 bp, synthetic construct
  misc_feature 1..20: note = CRISPR gRNA sequence
  source 1..20: mol_type = other DNA
agtacatccacttttttgta

SEQ ID NO: 68738 - DNA, 20 bp, synthetic construct
  misc_feature 1..20: note = CRISPR gRNA sequence
  source 1..20: mol_type = other DNA
ttttgtacggccaatctccg

SEQ ID NO: 68739 - DNA, 20 bp, synthetic construct
  misc_feature 1..20: note = CRISPR gRNA sequence
  source 1..20: mol_type = other DNA
tttgtacggccaatctccgg

SEQ ID NO: 68740 - DNA, 20 bp, synthetic construct
  misc_feature 1..20: note = CRISPR gRNA sequence
  source 1..20: mol_type = other DNA
ttgtacggccaatctccgga

SEQ ID NO: 68741 - DNA, 20 bp, synthetic construct
  misc_feature 1..20: note = CRISPR gRNA sequence
  source 1..20: mol_type = other DNA
tgtacggccaatctccggaa

SEQ ID NO: 68742 - DNA, 20 bp, synthetic construct
  misc_feature 1..20: note = CRISPR gRNA sequence
  source 1..20: mol_type = other DNA
gtacggccaatctccggaac

SEQ ID NO: 68743 - DNA, 20 bp, synthetic construct
  misc_feature 1..20: note = CRISPR gRNA sequence
  source 1..20: mol_type = other DNA
tacggccaatctccggaact

SEQ ID NO: 68744 - DNA, 20 bp, synthetic construct
  misc_feature 1..20: note = CRISPR gRNA sequence
  source 1..20: mol_type = other DNA
cggaactcttttcctcttgc

SEQ ID NO: 68745 - DNA, 20 bp, synthetic construct
  misc_feature 1..20: note = CRISPR gRNA sequence
  source 1..20: mol_type = other DNA
ttttcctcttgcaaaactga

SEQ ID NO: 68746 - DNA, 20 bp, synthetic construct
  misc_feature 1..20: note = CRISPR gRNA sequence
  source 1..20: mol_type = other DNA
ttcctcttgcaaaactgaat

SEQ ID NO: 68747 - DNA, 20 bp, synthetic construct
  misc_feature 1..20: note = CRISPR gRNA sequence
  source 1..20: mol_type = other DNA
tcctcttgcaaaactgaatc

SEQ ID NO: 68748 - DNA, 20 bp, synthetic construct
  misc_feature 1..20: note = CRISPR gRNA sequence
  source 1..20: mol_type = other DNA
cctcttgcaaaactgaatct

SEQ ID NO: 68749 - DNA, 20 bp, synthetic construct
  misc_feature 1..20: note = CRISPR gRNA sequence
  source 1..20: mol_type = other DNA
ctcttgcaaaactgaatctc

SEQ ID NO: 68750 - DNA, 20 bp, synthetic construct
  misc_feature 1..20: note = CRISPR gRNA sequence
  source 1..20: mol_type = other DNA
ttgcaaaactgaatctctat

SEQ ID NO: 68751 - DNA, 20 bp, synthetic construct
  misc_feature 1..20: note = CRISPR gRNA sequence
  source 1..20: mol_type = other DNA
gcaaaactgaatctctatcc

SEQ ID NO: 68752 - DNA, 20 bp, synthetic construct
  misc_feature 1..20: note = CRISPR gRNA sequence
  source 1..20: mol_type = other DNA
caaaactgaatctctatccc

SEQ ID NO: 68753 - DNA, 20 bp, synthetic construct
  misc_feature 1..20: note = CRISPR gRNA sequence
  source 1..20: mol_type = other DNA
aatctctatccccattaaac

SEQ ID NO: 68754 - DNA, 20 bp, synthetic construct
  misc_feature 1..20: note = CRISPR gRNA sequence
  source 1..20: mol_type = other DNA
tatccccattaaacaacacc

SEQ ID NO: 68755 - DNA, 20 bp, synthetic construct
  misc_feature 1..20: note = CRISPR gRNA sequence
  source 1..20: mol_type = other DNA
tccccattaaacaacacccc

SEQ ID NO: 68756 - DNA, 20 bp, synthetic construct
  misc_feature 1..20: note = CRISPR gRNA sequence
  source 1..20: mol_type = other DNA
aacaacaccccatttccccc

SEQ ID NO: 68757 - DNA, 20 bp, synthetic construct
  misc_feature 1..20: note = CRISPR gRNA sequence
  source 1..20: mol_type = other DNA
cccccctaccccagcccctg

SEQ ID NO: 68758 - DNA, 20 bp, synthetic construct
  misc_feature 1..20: note = CRISPR gRNA sequence
  source 1..20: mol_type = other DNA
ccccctaccccagcccctgg

SEQ ID NO: 68759 - DNA, 20 bp, synthetic construct
  misc_feature 1..20: note = CRISPR gRNA sequence
  source 1..20: mol_type = other DNA
ccccagcccctggcaaccac

SEQ ID NO: 68760 - DNA, 20 bp, synthetic construct
  misc_feature 1..20: note = CRISPR gRNA sequence
  source 1..20: mol_type = other DNA
gcaaccaccattctgctttc

SEQ ID NO: 68761 - DNA, 20 bp, synthetic construct
  misc_feature 1..20: note = CRISPR gRNA sequence
  source 1..20: mol_type = other DNA
tgctttctgtctctatgaat

SEQ ID NO: 68762 - DNA, 20 bp, synthetic construct
  misc_feature 1..20: note = CRISPR gRNA sequence
  source 1..20: mol_type = other DNA
ctttctgtctctatgaattg

SEQ ID NO: 68763 - DNA, 20 bp, synthetic construct
  misc_feature 1..20: note = CRISPR gRNA sequence
  source 1..20: mol_type = other DNA
tctgtctctatgaattggac

SEQ ID NO: 68764 - DNA, 20 bp, synthetic construct
  misc_feature 1..20: note = CRISPR gRNA sequence
  source 1..20: mol_type = other DNA
ctgtctctatgaattggact

SEQ ID NO: 68765 - DNA, 20 bp, synthetic construct
  misc_feature 1..20: note = CRISPR gRNA sequence
  source 1..20: mol_type = other DNA
tgtctctatgaattggactg

SEQ ID NO: 68766 - DNA, 20 bp, synthetic construct
  misc_feature 1..20: note = CRISPR gRNA sequence
  source 1..20: mol_type = other DNA
tctctatgaattggactgct

SEQ ID NO: 68767 - DNA, 20 bp, synthetic construct
  misc_feature 1..20: note = CRISPR gRNA sequence
  source 1..20: mol_type = other DNA
tatgaattggactgctctaa

SEQ ID NO: 68768 - DNA, 20 bp, synthetic construct
  misc_feature 1..20: note = CRISPR gRNA sequence
  source 1..20: mol_type = other DNA
tgaattggactgctctaaat

SEQ ID NO: 68769 - DNA, 20 bp, synthetic construct
  misc_feature 1..20: note = CRISPR gRNA sequence
  source 1..20: mol_type = other DNA
gactgctctaaatagtttat

SEQ ID NO: 68770 - DNA, 20 bp, synthetic construct
  misc_feature 1..20: note = CRISPR gRNA sequence
  source 1..20: mol_type = other DNA
ctctaaatagtttatatgag

SEQ ID NO: 68771 - DNA, 20 bp, synthetic construct
  misc_feature 1..20: note = CRISPR gRNA sequence
  source 1..20: mol_type = other DNA
taaatagtttatatgagtgg

SEQ ID NO: 68772 - DNA, 20 bp, synthetic construct
  misc_feature 1..20: note = CRISPR gRNA sequence
  source 1..20: mol_type = other DNA
aatagtttatatgagtggag

SEQ ID NO: 68773 - DNA, 20 bp, synthetic construct
  misc_feature 1..20: note = CRISPR gRNA sequence
  source 1..20: mol_type = other DNA
atatgagtggagtcatttgt

SEQ ID NO: 68774 - DNA, 20 bp, synthetic construct
  misc_feature 1..20: note = CRISPR gRNA sequence
  source 1..20: mol_type = other DNA
tatgagtggagtcatttgta

SEQ ID NO: 68775 - DNA, 20 bp, synthetic construct
  misc_feature 1..20: note = CRISPR gRNA sequence
  source 1..20: mol_type = other DNA
gtatttgtctgtatttgtct

SEQ ID NO: 68776 - DNA, 20 bp, synthetic construct
  misc_feature 1..20: note = CRISPR gRNA sequence
  source 1..20: mol_type = other DNA
tatttgtctgtatttgtctt

SEQ ID NO: 68777 - DNA, 20 bp, synthetic construct
  misc_feature 1..20: note = CRISPR gRNA sequence
  source 1..20: mol_type = other DNA
gtctgtatttgtctttttgt

SEQ ID NO: 68778 - DNA, 20 bp, synthetic construct
  misc_feature 1..20: note = CRISPR gRNA sequence
  source 1..20: mol_type = other DNA
tctgtatttgtctttttgtg

SEQ ID NO: 68779 - DNA, 20 bp, synthetic construct
  misc_feature 1..20: note = CRISPR gRNA sequence
  source 1..20: mol_type = other DNA
tatttgtctttttgtgactg

SEQ ID NO: 68780 - DNA, 20 bp, synthetic construct
  misc_feature 1..20: note = CRISPR gRNA sequence
  source 1..20: mol_type = other DNA
gtctttttgtgactggctca

SEQ ID NO: 68781 - DNA, 20 bp, synthetic construct
  misc_feature 1..20: note = CRISPR gRNA sequence
  source 1..20: mol_type = other DNA
tctttttgtgactggctcat

SEQ ID NO: 68782 - DNA, 20 bp, synthetic construct
  misc_feature 1..20: note = CRISPR gRNA sequence
  source 1..20: mol_type = other DNA
tttgtgactggctcatttca

SEQ ID NO: 68783 - DNA, 20 bp, synthetic construct
  misc_feature 1..20: note = CRISPR gRNA sequence
  source 1..20: mol_type = other DNA
ttgtgactggctcatttcat

SEQ ID NO: 68784 - DNA, 20 bp, synthetic construct
  misc_feature 1..20: note = CRISPR gRNA sequence
  source 1..20: mol_type = other DNA
tgtgactggctcatttcatt

SEQ ID NO: 68785 - DNA, 20 bp, synthetic construct
  misc_feature 1..20: note = CRISPR gRNA sequence
  source 1..20: mol_type = other DNA
gtgactggctcatttcattg

SEQ ID NO: 68786 - DNA, 20 bp, synthetic construct
  misc_feature 1..20: note = CRISPR gRNA sequence
  source 1..20: mol_type = other DNA
tgactggctcatttcattgg

SEQ ID NO: 68787 - DNA, 20 bp, synthetic construct
  misc_feature 1..20: note = CRISPR gRNA sequence
  source 1..20: mol_type = other DNA
gctcatttcattgggcataa

SEQ ID NO: 68788 - DNA, 20 bp, synthetic construct
  misc_feature 1..20: note = CRISPR gRNA sequence
  source 1..20: mol_type = other DNA
atttcattgggcataatgtc

SEQ ID NO: 68789 - DNA, 20 bp, synthetic construct
  misc_feature 1..20: note = CRISPR gRNA sequence
  source 1..20: mol_type = other DNA
cattgggcataatgtcctct

SEQ ID NO: 68790 - DNA, 20 bp, synthetic construct
  misc_feature 1..20: note = CRISPR gRNA sequence
  source 1..20: mol_type = other DNA
attgggcataatgtcctctg

SEQ ID NO: 68791 - DNA, 20 bp, synthetic construct
  misc_feature 1..20: note = CRISPR gRNA sequence
  source 1..20: mol_type = other DNA
ggcataatgtcctctggttc

SEQ ID NO: 68792 - DNA, 20 bp, synthetic construct
  misc_feature 1..20: note = CRISPR gRNA sequence
  source 1..20: mol_type = other DNA
tggttcattcatgttgcagc

SEQ ID NO: 68793 - DNA, 20 bp, synthetic construct
  misc_feature 1..20: note = CRISPR gRNA sequence
  source 1..20: mol_type = other DNA
gttcattcatgttgcagcgt

SEQ ID NO: 68794 - DNA, 20 bp, synthetic construct
  misc_feature 1..20: note = CRISPR gRNA sequence
  source 1..20: mol_type = other DNA
attcatgttgcagcgtgtgt

SEQ ID NO: 68795 - DNA, 20 bp, synthetic construct
  misc_feature 1..20: note = CRISPR gRNA sequence
  source 1..20: mol_type = other DNA
atgttgcagcgtgtgtcact

SEQ ID NO: 68796 - DNA, 20 bp, synthetic construct
  misc_feature 1..20: note = CRISPR gRNA sequence
  source 1..20: mol_type = other DNA
cagcgtgtgtcactgtgtca

SEQ ID NO: 68797 - DNA, 20 bp, synthetic construct
  misc_feature 1..20: note = CRISPR gRNA sequence
  source 1..20: mol_type = other DNA
tgtcagactttccttccttt

SEQ ID NO: 68798 - DNA, 20 bp, synthetic construct
  misc_feature 1..20: note = CRISPR gRNA sequence
  source 1..20: mol_type = other DNA
tccttccttttttttttttt

SEQ ID NO: 68799 - DNA, 20 bp, synthetic construct
  misc_feature 1..20: note = CRISPR gRNA sequence
  source 1..20: mol_type = other DNA
ccttcctttttttttttttt

SEQ ID NO: 68800 - DNA, 20 bp, synthetic construct
  misc_feature 1..20: note = CRISPR gRNA sequence
  source 1..20: mol_type = other DNA
cttccttttttttttttttt

SEQ ID NO: 68801 - DNA, 20 bp, synthetic construct
  misc_feature 1..20: note = CRISPR gRNA sequence
  source 1..20: mol_type = other DNA
cctttttttttttttttttt

SEQ ID NO: 68802 - DNA, 20 bp, synthetic construct
  misc_feature 1..20: note = CRISPR gRNA sequence
  source 1..20: mol_type = other DNA
cttttttttttttttttttt

SEQ ID NO: 68803 - DNA, 20 bp, synthetic construct
  misc_feature 1..20: note = CRISPR gRNA sequence
  source 1..20: mol_type = other DNA
tttttttttttttttttttt

SEQ ID NO: 68804 - DNA, 20 bp, synthetic construct
  misc_feature 1..20: note = CRISPR gRNA sequence
  source 1..20: mol_type = other DNA
tttttttttttttttttttt

SEQ ID NO: 68805 - DNA, 20 bp, synthetic construct
  misc_feature 1..20: note = CRISPR gRNA sequence
  source 1..20: mol_type = other DNA
tttttttttttttttttttg

SEQ ID NO: 68806 - DNA, 20 bp, synthetic construct
  misc_feature 1..20: note = CRISPR gRNA sequence
  source 1..20: mol_type = other DNA
ttttttttttttttttttga

SEQ ID NO: 68807 - DNA, 20 bp, synthetic construct
  misc_feature 1..20: note = CRISPR gRNA sequence
  source 1..20: mol_type = other DNA
tttttttttttttttttgag

SEQ ID NO: 68808 - DNA, 20 bp, synthetic construct
  misc_feature 1..20: note = CRISPR gRNA sequence
  source 1..20: mol_type = other DNA
ttttttttttttttttgaga

SEQ ID NO: 68809 - DNA, 20 bp, synthetic construct
  misc_feature 1..20: note = CRISPR gRNA sequence
  source 1..20: mol_type = other DNA
tttttttttttttttgagac

SEQ ID NO: 68810 - DNA, 20 bp, synthetic construct
  misc_feature 1..20: note = CRISPR gRNA sequence
  source 1..20: mol_type = other DNA
ttttttttttttttgagaca

SEQ ID NO: 68811 - DNA, 20 bp, synthetic construct
  misc_feature 1..20: note = CRISPR gRNA sequence
  source 1..20: mol_type = other DNA
tttttttttttttgagacag

SEQ ID NO: 68812 - DNA, 20 bp, synthetic construct
  misc_feature 1..20: note = CRISPR gRNA sequence
  source 1..20: mol_type = other DNA
ttttttttttttgagacaga

SEQ ID NO: 68813 - DNA, 20 bp, synthetic construct
  misc_feature 1..20: note = CRISPR gRNA sequence
  source 1..20: mol_type = other DNA
tttttttttttgagacagag

SEQ ID NO: 68814 - DNA, 20 bp, synthetic construct
  misc_feature 1..20: note = CRISPR gRNA sequence
  source 1..20: mol_type = other DNA
ttttttttttgagacagagt

SEQ ID NO: 68815 - DNA, 20 bp, synthetic construct
  misc_feature 1..20: note = CRISPR gRNA sequence
  source 1..20: mol_type = other DNA
tttttttttgagacagagtc

SEQ ID NO: 68816 - DNA, 20 bp, synthetic construct
  misc_feature 1..20: note = CRISPR gRNA sequence
  source 1..20: mol_type = other DNA
ttttttttgagacagagtct

SEQ ID NO: 68817 - DNA, 20 bp, synthetic construct
  misc_feature 1..20: note = CRISPR gRNA sequence
  source 1..20: mol_type = other DNA
tttttttgagacagagtctc

SEQ ID NO: 68818 - DNA, 20 bp, synthetic construct
  misc_feature 1..20: note = CRISPR gRNA sequence
  source 1..20: mol_type = other DNA
ttttttgagacagagtctca

SEQ ID NO: 68819 - DNA, 20 bp, synthetic construct
  misc_feature 1..20: note = CRISPR gRNA sequence
  source 1..20: mol_type = other DNA
tttttgagacagagtctcac

SEQ ID NO: 68820 - DNA, 20 bp, synthetic construct
  misc_feature 1..20: note = CRISPR gRNA sequence
  source 1..20: mol_type = other DNA
ttttgagacagagtctcact

SEQ ID NO: 68821 - DNA, 20 bp, synthetic construct
  misc_feature 1..20: note = CRISPR gRNA sequence
  source 1..20: mol_type = other DNA
tttgagacagagtctcactc

SEQ ID NO: 68822 - DNA, 20 bp, synthetic construct
  misc_feature 1..20: note = CRISPR gRNA sequence
  source 1..20: mol_type = other DNA
ttgagacagagtctcactct

SEQ ID NO: 68823 - DNA, 20 bp, synthetic construct
  misc_feature 1..20: note = CRISPR gRNA sequence
  source 1..20: mol_type = other DNA
tgagacagagtctcactctt

SEQ ID NO: 68824 - DNA, 20 bp, synthetic construct
  misc_feature 1..20: note = CRISPR gRNA sequence
  source 1..20: mol_type = other DNA
gagacagagtctcactcttg

SEQ ID NO: 68825 - DNA, 20 bp, synthetic construct
  misc_feature 1..20: note = CRISPR gRNA sequence
  source 1..20: mol_type = other DNA
agacagagtctcactcttgt

SEQ ID NO: 68826 - DNA, 20 bp, synthetic construct
  misc_feature 1..20: note = CRISPR gRNA sequence
  source 1..20: mol_type = other DNA
actcttgtcacctgggctgg

SEQ ID NO: 68827 - DNA, 20 bp, synthetic construct
  misc_feature 1..20: note = CRISPR gRNA sequence
  source 1..20: mol_type = other DNA
ttgtcacctgggctggagtg

SEQ ID NO: 68828 - DNA, 20 bp, synthetic construct
  misc_feature 1..20: note = CRISPR gRNA sequence
  source 1..20: mol_type = other DNA
gtcacctgggctggagtgca

SEQ ID NO: 68829 - DNA, 20 bp, synthetic construct
  misc_feature 1..20: note = CRISPR gRNA sequence
  source 1..20: mol_type = other DNA
tcacctgggctggagtgcac

SEQ ID NO: 68830 - DNA, 20 bp, synthetic construct
  misc_feature 1..20: note = CRISPR gRNA sequence
  source 1..20: mol_type = other DNA
ggctggagtgcactggctcg

SEQ ID NO: 68831 - DNA, 20 bp, synthetic construct
  misc_feature 1..20: note = CRISPR gRNA sequence
  source 1..20: mol_type = other DNA
gagtgcactggctcgatctc

SEQ ID NO: 68832 - DNA, 20 bp, synthetic construct
  misc_feature 1..20: note = CRISPR gRNA sequence
  source 1..20: mol_type = other DNA
gctcgatctcagctcactgc

SEQ ID NO: 68833 - DNA, 20 bp, synthetic construct
  misc_feature 1..20: note = CRISPR gRNA sequence
  source 1..20: mol_type = other DNA
gatctcagctcactgcaccc

SEQ ID NO: 68834 - DNA, 20 bp, synthetic construct
  misc_feature 1..20: note = CRISPR gRNA sequence
  source 1..20: mol_type = other DNA
agctcactgcaccctccacc

SEQ ID NO: 68835 - DNA, 20 bp, synthetic construct
  misc_feature 1..20: note = CRISPR gRNA sequence
  source 1..20: mol_type = other DNA
actgcaccctccacctcttg

SEQ ID NO: 68836 - DNA, 20 bp, synthetic construct
  misc_feature 1..20: note = CRISPR gRNA sequence
  source 1..20: mol_type = other DNA
caccctccacctcttgggtt

SEQ ID NO: 68837 - DNA, 20 bp, synthetic construct
  misc_feature 1..20: note = CRISPR gRNA sequence
  source 1..20: mol_type = other DNA
cacctcttgggttcaagcga

SEQ ID NO: 68838 - DNA, 20 bp, synthetic construct
  misc_feature 1..20: note = CRISPR gRNA sequence
  source 1..20: mol_type = other DNA
ttgggttcaagcgattctcc

SEQ ID NO: 68839 - DNA, 20 bp, synthetic construct
  misc_feature 1..20: note = CRISPR gRNA sequence
  source 1..20: mol_type = other DNA
gggttcaagcgattctcctg

SEQ ID NO: 68840 - DNA, 20 bp, synthetic construct
  misc_feature 1..20: note = CRISPR gRNA sequence
  source 1..20: mol_type = other DNA
ggttcaagcgattctcctgc

SEQ ID NO: 68841 - DNA, 20 bp, synthetic construct
  misc_feature 1..20: note = CRISPR gRNA sequence
  source 1..20: mol_type = other DNA
aagcgattctcctgcctcag

SEQ ID NO: 68842 - DNA, 20 bp, synthetic construct
  misc_feature 1..20: note = CRISPR gRNA sequence
  source 1..20: mol_type = other DNA
tcctgcctcagcctccggag

SEQ ID NO: 68843 - DNA, 20 bp, synthetic construct
  misc_feature 1..20: note = CRISPR gRNA sequence
  source 1..20: mol_type = other DNA
ctgcctcagcctccggagta

SEQ ID NO: 68844 - DNA, 20 bp, synthetic construct
  misc_feature 1..20: note = CRISPR gRNA sequence
  source 1..20: mol_type = other DNA
cctcagcctccggagtagct

SEQ ID NO: 68845 - DNA, 20 bp, synthetic construct
  misc_feature 1..20: note = CRISPR gRNA sequence
  source 1..20: mol_type = other DNA
agcctccggagtagctggga

SEQ ID NO: 68846 - DNA, 20 bp, synthetic construct
  misc_feature 1..20: note = CRISPR gRNA sequence
  source 1..20: mol_type = other DNA
cggagtagctgggattacag

SEQ ID NO: 68847 - DNA, 20 bp, synthetic construct
  misc_feature 1..20: note = CRISPR gRNA sequence
  source 1..20: mol_type = other DNA
ggattacaggcgcccgccac

SEQ ID NO: 68848 - DNA, 20 bp, synthetic construct
  misc_feature 1..20: note = CRISPR gRNA sequence
  source 1..20: mol_type = other DNA
caggcgcccgccaccacacc

SEQ ID NO: 68849 - DNA, 20 bp, synthetic construct
  misc_feature 1..20: note = CRISPR gRNA sequence
  source 1..20: mol_type = other DNA
atttttttttgtatttttgt

SEQ ID NO: 68850 - DNA, 20 bp, synthetic construct
  misc_feature 1..20: note = CRISPR gRNA sequence
  source 1..20: mol_type = other DNA
ttttttgtatttttgtagag

SEQ ID NO: 68851 - DNA, 20 bp, synthetic construct
  misc_feature 1..20: note = CRISPR gRNA sequence
  source 1..20: mol_type = other DNA
tttttgtatttttgtagaga

SEQ ID NO: 68852 - DNA, 20 bp, synthetic construct
  misc_feature 1..20: note = CRISPR gRNA sequence
  source 1..20: mol_type = other DNA
ttttgtatttttgtagagac

SEQ ID NO: 68853 - DNA, 20 bp, synthetic construct
  misc_feature 1..20: note = CRISPR gRNA sequence
  source 1..20: mol_type = other DNA
tttgtatttttgtagagaca

SEQ ID NO: 68854 - DNA, 20 bp, synthetic construct
  misc_feature 1..20: note = CRISPR gRNA sequence
  source 1..20: mol_type = other DNA
ttgtatttttgtagagacag

SEQ ID NO: 68855 - DNA, 20 bp, synthetic construct
  misc_feature 1..20: note = CRISPR gRNA sequence
  source 1..20: mol_type = other DNA
tgtatttttgtagagacagg

SEQ ID NO: 68856 - DNA, 20 bp, synthetic construct
  misc_feature 1..20: note = CRISPR gRNA sequence
  source 1..20: mol_type = other DNA
gtatttttgtagagacaggg

SEQ ID NO: 68857 - DNA, 20 bp, synthetic construct
  misc_feature 1..20: note = CRISPR gRNA sequence
  source 1..20: mol_type = other DNA
tatttttgtagagacagggt

SEQ ID NO: 68858 - DNA, 20 bp, synthetic construct
  misc_feature 1..20: note = CRISPR gRNA sequence
  source 1..20: mol_type = other DNA
ttgtagagacagggtttcac

SEQ ID NO: 68859 - DNA, 20 bp, synthetic construct
  misc_feature 1..20: note = CRISPR gRNA sequence
  source 1..20: mol_type = other DNA
tgtagagacagggtttcacc

SEQ ID NO: 68860 - DNA, 20 bp, synthetic construct
  misc_feature 1..20: note = CRISPR gRNA sequence
  source 1..20: mol_type = other DNA
gtagagacagggtttcacca

SEQ ID NO: 68861 - DNA, 20 bp, synthetic construct
  misc_feature 1..20: note = CRISPR gRNA sequence
  source 1..20: mol_type = other DNA
tagagacagggtttcaccat

SEQ ID NO: 68862 - DNA, 20 bp, synthetic construct
  misc_feature 1..20: note = CRISPR gRNA sequence
  source 1..20: mol_type = other DNA
caccatgttggcgaggctgg

SEQ ID NO: 68863 - DNA, 20 bp, synthetic construct
  misc_feature 1..20: note = CRISPR gRNA sequence
  source 1..20: mol_type = other DNA
accatgttggcgaggctggt

SEQ ID NO: 68864 - DNA, 20 bp, synthetic construct
  misc_feature 1..20: note = CRISPR gRNA sequence
  source 1..20: mol_type = other DNA
gcgaggctggtctcgaactc

SEQ ID NO: 68865 - DNA, 20 bp, synthetic construct
  misc_feature 1..20: note = CRISPR gRNA sequence
  source 1..20: mol_type = other DNA
gtctcgaactcctgacctca

SEQ ID NO: 68866 - DNA, 20 bp, synthetic construct
  misc_feature 1..20: note = CRISPR gRNA sequence
  source 1..20: mol_type = other DNA
gaactcctgacctcagatga

SEQ ID NO: 68867 - DNA, 20 bp, synthetic construct
  misc_feature 1..20: note = CRISPR gRNA sequence
  source 1..20: mol_type = other DNA
ctgacctcagatgatctgcc

SEQ ID NO: 68868 - DNA, 20 bp, synthetic construct
  misc_feature 1..20: note = CRISPR gRNA sequence
  source 1..20: mol_type = other DNA
acctcagatgatctgcccgt

SEQ ID NO: 68869 - DNA, 20 bp, synthetic construct
  misc_feature 1..20: note = CRISPR gRNA sequence
  source 1..20: mol_type = other DNA
agatgatctgcccgtttcgg

SEQ ID NO: 68870 - DNA, 20 bp, synthetic construct
  misc_feature 1..20: note = CRISPR gRNA sequence
  source 1..20: mol_type = other DNA
cccgtttcggccttccaaag

SEQ ID NO: 68871 - DNA, 20 bp, synthetic construct
  misc_feature 1..20: note = CRISPR gRNA sequence
  source 1..20: mol_type = other DNA
cggccttccaaagtgctggg

SEQ ID NO: 68872 - DNA, 20 bp, synthetic construct
  misc_feature 1..20: note = CRISPR gRNA sequence
  source 1..20: mol_type = other DNA
ggccttccaaagtgctggga

SEQ ID NO: 68873 - DNA, 20 bp, synthetic construct
  misc_feature 1..20: note = CRISPR gRNA sequence
  source 1..20: mol_type = other DNA
ccaaagtgctgggattacag

SEQ ID NO: 68874 - DNA, 20 bp, synthetic construct
  misc_feature 1..20: note = CRISPR gRNA sequence
  source 1..20: mol_type = other DNA
caaagtgctgggattacagg

SEQ ID NO: 68875 - DNA, 20 bp, synthetic construct
  misc_feature 1..20: note = CRISPR gRNA sequence
  source 1..20: mol_type = other DNA
ggattacaggcatgagccac

SEQ ID NO: 68876 - DNA, 20 bp, synthetic construct
  misc_feature 1..20: note = CRISPR gRNA sequence
  source 1..20: mol_type = other DNA
caggcatgagccaccacacc

SEQ ID NO: 68877 - DNA, 20 bp, synthetic construct
  misc_feature 1..20: note = CRISPR gRNA sequence
  source 1..20: mol_type = other DNA
tccttttttaaggctgcata

SEQ ID NO: 68878 - DNA, 20 bp, synthetic construct
  misc_feature 1..20: note = CRISPR gRNA sequence
  source 1..20: mol_type = other DNA
ccttttttaaggctgcataa

SEQ ID NO: 68879 - DNA, 20 bp, synthetic construct
  misc_feature 1..20: note = CRISPR gRNA sequence
  source 1..20: mol_type = other DNA
cttttttaaggctgcataat

SEQ ID NO: 68880 - DNA, 20 bp, synthetic construct
  misc_feature 1..20: note = CRISPR gRNA sequence
  source 1..20: mol_type = other DNA
ttttaaggctgcataatatt

SEQ ID NO: 68881 - DNA, 20 bp, synthetic construct
  misc_feature 1..20: note = CRISPR gRNA sequence
  source 1..20: mol_type = other DNA
tttaaggctgcataatattc

SEQ ID NO: 68882 - DNA, 20 bp, synthetic construct
  misc_feature 1..20: note = CRISPR gRNA sequence
  source 1..20: mol_type = other DNA
ttaaggctgcataatattcc

SEQ ID NO: 68883 - DNA, 20 bp, synthetic construct
  misc_feature 1..20: note = CRISPR gRNA sequence
  source 1..20: mol_type = other DNA
taaggctgcataatattcca

SEQ ID NO: 68884 - DNA, 20 bp, synthetic construct
  misc_feature 1..20: note = CRISPR gRNA sequence
  source 1..20: mol_type = other DNA
aaggctgcataatattccat

SEQ ID NO: 68885 - DNA, 20 bp, synthetic construct
  misc_feature 1..20: note = CRISPR gRNA sequence
  source 1..20: mol_type = other DNA
aggctgcataatattccatt

SEQ ID NO: 68886 - DNA, 20 bp, synthetic construct
  misc_feature 1..20: note = CRISPR gRNA sequence
  source 1..20: mol_type = other DNA
cataatattccattgtgtgg

SEQ ID NO: 68887 - DNA, 20 bp, synthetic construct
  misc_feature 1..20: note = CRISPR gRNA sequence
  source 1..20: mol_type = other DNA
cattgtgtggatggaccaca

SEQ ID NO: 68888 - DNA, 20 bp, synthetic construct
  misc_feature 1..20: note = CRISPR gRNA sequence
  source 1..20: mol_type = other DNA
tgtggatggaccacattttg

SEQ ID NO: 68889 - DNA, 20 bp, synthetic construct
  misc_feature 1..20: note = CRISPR gRNA sequence
  source 1..20: mol_type = other DNA
tgtgtatccacttatccatc

SEQ ID NO: 68890 - DNA, 20 bp, synthetic construct
  misc_feature 1..20: note = CRISPR gRNA sequence
  source 1..20: mol_type = other DNA
gtgtatccacttatccatca

SEQ ID NO: 68891 - DNA, 20 bp, synthetic construct
  misc_feature 1..20: note = CRISPR gRNA sequence
  source 1..20: mol_type = other DNA
tgtatccacttatccatcaa

SEQ ID NO: 68892 - DNA, 20 bp, synthetic construct
  misc_feature 1..20: note = CRISPR gRNA sequence
  source 1..20: mol_type = other DNA
atccatcaattgacacttgg

SEQ ID NO: 68893 - DNA, 20 bp, synthetic construct
  misc_feature 1..20: note = CRISPR gRNA sequence
  source 1..20: mol_type = other DNA
tccatcaattgacacttggg

SEQ ID NO: 68894 - DNA, 20 bp, synthetic construct
  misc_feature 1..20: note = CRISPR gRNA sequence
  source 1..20: mol_type = other DNA
acacttgggttgtccattca

SEQ ID NO: 68895 - DNA, 20 bp, synthetic construct
  misc_feature 1..20: note = CRISPR gRNA sequence
  source 1..20: mol_type = other DNA
gggttgtccattcaagtgcc

SEQ ID NO: 68896 - DNA, 20 bp, synthetic construct
  misc_feature 1..20: note = CRISPR gRNA sequence
  source 1..20: mol_type = other DNA
ggttgtccattcaagtgccc

SEQ ID NO: 68897 - DNA, 20 bp, synthetic construct
  misc_feature 1..20: note = CRISPR gRNA sequence
  source 1..20: mol_type = other DNA
tccattcaagtgcccaattg

SEQ ID NO: 68898 - DNA, 20 bp, synthetic construct
  misc_feature 1..20: note = CRISPR gRNA sequence
  source 1..20: mol_type = other DNA
aagtgcccaattgacagtcc

SEQ ID NO: 68899 - DNA, 20 bp, synthetic construct
  misc_feature 1..20: note = CRISPR gRNA sequence
  source 1..20: mol_type = other DNA
acagtccctgctttcttttt

SEQ ID NO: 68900 - DNA, 20 bp, synthetic construct
  misc_feature 1..20: note = CRISPR gRNA sequence
  source 1..20: mol_type = other DNA
ctttctttttttaaatatta

SEQ ID NO: 68901 - DNA, 20 bp, synthetic construct
  misc_feature 1..20: note = CRISPR gRNA sequence
  source 1..20: mol_type = other DNA
tctttttttaaatattattt

SEQ ID NO: 68902 - DNA, 20 bp, synthetic construct
  misc_feature 1..20: note = CRISPR gRNA sequence
  source 1..20: mol_type = other DNA
ctttttttaaatattatttt

SEQ ID NO: 68903 - DNA, 20 bp, synthetic construct
  misc_feature 1..20: note = CRISPR gRNA sequence
  source 1..20: mol_type = other DNA
tttttttaaatattatttta

SEQ ID NO: 68904 - DNA, 20 bp, synthetic construct
  misc_feature 1..20: note = CRISPR gRNA sequence
  source 1..20: mol_type = other DNA
tttttaaatattattttatt

SEQ ID NO: 68905 - DNA, 20 bp, synthetic construct
  misc_feature 1..20: note = CRISPR gRNA sequence
  source 1..20: mol_type = other DNA
ttttaaatattattttattt

SEQ ID NO: 68906 - DNA, 20 bp, synthetic construct
  misc_feature 1..20: note = CRISPR gRNA sequence
  source 1..20: mol_type = other DNA
tttaaatattattttatttc

SEQ ID NO: 68907 - DNA, 20 bp, synthetic construct
  misc_feature 1..20: note = CRISPR gRNA sequence
  source 1..20: mol_type = other DNA
ttaaatattattttatttca

SEQ ID NO: 68908 - DNA, 20 bp, synthetic construct
  misc_feature 1..20: note = CRISPR gRNA sequence
  source 1..20: mol_type = other DNA
taaatattattttatttcaa

SEQ ID NO: 68909 - DNA, 20 bp, synthetic construct
  misc_feature 1..20: note = CRISPR gRNA sequence
  source 1..20: mol_type = other DNA
aaatattattttatttcaaa

SEQ ID NO: 68910 - DNA, 20 bp, synthetic construct
  misc_feature 1..20: note = CRISPR gRNA sequence
  source 1..20: mol_type = other DNA
aatattattttatttcaaaa

SEQ ID NO: 68911 - DNA, 20 bp, synthetic construct
  misc_feature 1..20: note = CRISPR gRNA sequence
  source 1..20: mol_type = other DNA
ttttatttcaaaaacaatag

SEQ ID NO: 68912 - DNA, 20 bp, synthetic construct
  misc_feature 1..20: note = CRISPR gRNA sequence
  source 1..20: mol_type = other DNA
tatttcaaaaacaatagaga

SEQ ID NO: 68913 - DNA, 20 bp, synthetic construct
  misc_feature 1..20: note = CRISPR gRNA sequence
  source 1..20: mol_type = other DNA
atttcaaaaacaatagagat

SEQ ID NO: 68914 - DNA, 20 bp, synthetic construct
  misc_feature 1..20: note = CRISPR gRNA sequence
  source 1..20: mol_type = other DNA
tttcaaaaacaatagagatg

SEQ ID NO: 68915 - DNA, 20 bp, synthetic construct
  misc_feature 1..20: note = CRISPR gRNA sequence
  source 1..20: mol_type = other DNA
caaaaacaatagagatgagg

SEQ ID NO: 68916 - DNA, 20 bp, synthetic construct
  misc_feature 1..20: note = CRISPR gRNA sequence
  source 1..20: mol_type = other DNA
aaaaacaatagagatgaggt

SEQ ID NO: 68917 - DNA, 20 bp, synthetic construct
  misc_feature 1..20: note = CRISPR gRNA sequence
  source 1..20: mol_type = other DNA
actgttttgcccaggatgat

SEQ ID NO: 68918 - DNA, 20 bp, synthetic construct
  misc_feature 1..20: note = CRISPR gRNA sequence
  source 1..20: mol_type = other DNA
ttttgcccaggatgatcttg

SEQ ID NO: 68919 - DNA, 20 bp, synthetic construct
  misc_feature 1..20: note = CRISPR gRNA sequence
  source 1..20: mol_type = other DNA
tgcccaggatgatcttgatc

SEQ ID NO: 68920 - DNA, 20 bp, synthetic construct
  misc_feature 1..20: note = CRISPR gRNA sequence
  source 1..20: mol_type = other DNA
gcccaggatgatcttgatct

SEQ ID NO: 68921 - DNA, 20 bp, synthetic construct
  misc_feature 1..20: note = CRISPR gRNA sequence
  source 1..20: mol_type = other DNA
cccaggatgatcttgatctc

SEQ ID NO: 68922 - DNA, 20 bp, synthetic construct
  misc_feature 1..20: note = CRISPR gRNA sequence
  source 1..20: mol_type = other DNA
gatctcctgagctcaagtga

SEQ ID NO: 68923 - DNA, 20 bp, synthetic construct
  misc_feature 1..20: note = CRISPR gRNA sequence
  source 1..20: mol_type = other DNA
atctcctgagctcaagtgat

SEQ ID NO: 68924 - DNA, 20 bp, synthetic construct
  misc_feature 1..20: note = CRISPR gRNA sequence
  source 1..20: mol_type = other DNA
ctgagctcaagtgatcctcc

SEQ ID NO: 68925 - DNA, 20 bp, synthetic construct
  misc_feature 1..20: note = CRISPR gRNA sequence
  source 1..20: mol_type = other DNA
agctcaagtgatcctcccac

SEQ ID NO: 68926 - DNA, 20 bp, synthetic construct
  misc_feature 1..20: note = CRISPR gRNA sequence
  source 1..20: mol_type = other DNA
aagtgatcctcccacctcag

SEQ ID NO: 68927 - DNA, 20 bp, synthetic construct
  misc_feature 1..20: note = CRISPR gRNA sequence
  source 1..20: mol_type = other DNA
ccacctcagcctcccaaagt

SEQ ID NO: 68928 - DNA, 20 bp, synthetic construct
  misc_feature 1..20: note = CRISPR gRNA sequence
  source 1..20: mol_type = other DNA
agcctcccaaagtgctaggc

SEQ ID NO: 68929 - DNA, 20 bp, synthetic construct
  misc_feature 1..20: note = CRISPR gRNA sequence
  source 1..20: mol_type = other DNA
ccaaagtgctaggcgtgagc

SEQ ID NO: 68930 - DNA, 20 bp, synthetic construct
  misc_feature 1..20: note = CRISPR gRNA sequence
  source 1..20: mol_type = other DNA
ggcgtgagccaccatgccca

SEQ ID NO: 68931 - DNA, 20 bp, synthetic construct
  misc_feature 1..20: note = CRISPR gRNA sequence
  source 1..20: mol_type = other DNA
tcaattattttggttatata

SEQ ID NO: 68932 - DNA, 20 bp, synthetic construct
  misc_feature 1..20: note = CRISPR gRNA sequence
  source 1..20: mol_type = other DNA
caattattttggttatatat

SEQ ID NO: 68933 - DNA, 20 bp, synthetic construct
  misc_feature 1..20: note = CRISPR gRNA sequence
  source 1..20: mol_type = other DNA
aattattttggttatatatc

SEQ ID NO: 68934 - DNA, 20 bp, synthetic construct
  misc_feature 1..20: note = CRISPR gRNA sequence
  source 1..20: mol_type = other DNA
ttttggttatatatccagaa

SEQ ID NO: 68935 - DNA, 20 bp, synthetic construct
  misc_feature 1..20: note = CRISPR gRNA sequence
  source 1..20: mol_type = other DNA
tggttatatatccagaattg

SEQ ID NO: 68936 - DNA, 20 bp, synthetic construct
  misc_feature 1..20: note = CRISPR gRNA sequence
  source 1..20: mol_type = other DNA
ggttatatatccagaattgc

SEQ ID NO: 68937 - DNA, 20 bp, synthetic construct
  misc_feature 1..20: note = CRISPR gRNA sequence
  source 1..20: mol_type = other DNA
gttatatatccagaattgct

SEQ ID NO: 68938 - DNA, 20 bp, synthetic construct
  misc_feature 1..20: note = CRISPR gRNA sequence
  source 1..20: mol_type = other DNA
tatatccagaattgctagag

SEQ ID NO: 68939 - DNA, 20 bp, synthetic construct
  misc_feature 1..20: note = CRISPR gRNA sequence
  source 1..20: mol_type = other DNA
ctagagcacccaaaataact

SEQ ID NO: 68940 - DNA, 20 bp, synthetic construct
  misc_feature 1..20: note = CRISPR gRNA sequence
  source 1..20: mol_type = other DNA
gagcacccaaaataactttt

SEQ ID NO: 68941 - DNA, 20 bp, synthetic construct
  misc_feature 1..20: note = CRISPR gRNA sequence
  source 1..20: mol_type = other DNA
tttttttttgagacggagtc

SEQ ID NO: 68942 - DNA, 20 bp, synthetic construct
  misc_feature 1..20: note = CRISPR gRNA sequence
  source 1..20: mol_type = other DNA
ttttttttgagacggagtct

SEQ ID NO: 68943 - DNA, 20 bp, synthetic construct
  misc_feature 1..20: note = CRISPR gRNA sequence
  source 1..20: mol_type = other DNA
tttttttgagacggagtctc

SEQ ID NO: 68944 - DNA, 20 bp, synthetic construct
  misc_feature 1..20: note = CRISPR gRNA sequence
  source 1..20: mol_type = other DNA
ttttttgagacggagtctcg

SEQ ID NO: 68945 - DNA, 20 bp, synthetic construct
  misc_feature 1..20: note = CRISPR gRNA sequence
  source 1..20: mol_type = other DNA
tttttgagacggagtctcgc

SEQ ID NO: 68946 - DNA, 20 bp, synthetic construct
  misc_feature 1..20: note = CRISPR gRNA sequence
  source 1..20: mol_type = other DNA
ttttgagacggagtctcgct

SEQ ID NO: 68947 - DNA, 20 bp, synthetic construct
  misc_feature 1..20: note = CRISPR gRNA sequence
  source 1..20: mol_type = other DNA
tttgagacggagtctcgctc

SEQ ID NO: 68948 - DNA, 20 bp, synthetic construct
  misc_feature 1..20: note = CRISPR gRNA sequence
  source 1..20: mol_type = other DNA
ttgagacggagtctcgctct

SEQ ID NO: 68949 - DNA, 20 bp, synthetic construct
  misc_feature 1..20: note = CRISPR gRNA sequence
  source 1..20: mol_type = other DNA
tgagacggagtctcgctctg

SEQ ID NO: 68950 - DNA, 20 bp, synthetic construct
  misc_feature 1..20: note = CRISPR gRNA sequence
  source 1..20: mol_type = other DNA
gagacggagtctcgctctgt

SEQ ID NO: 68951 - DNA, 20 bp, synthetic construct
  misc_feature 1..20: note = CRISPR gRNA sequence
  source 1..20: mol_type = other DNA
agacggagtctcgctctgtt

SEQ ID NO: 68952 - DNA, 20 bp, synthetic construct
  misc_feature 1..20: note = CRISPR gRNA sequence
  source 1..20: mol_type = other DNA
gctctgttgcccaggttgga

SEQ ID NO: 68953 - DNA, 20 bp, synthetic construct
  misc_feature 1..20: note = CRISPR gRNA sequence
  source 1..20: mol_type = other DNA
tgttgcccaggttggagtgc

SEQ ID NO: 68954 - DNA, 20 bp, synthetic construct
  misc_feature 1..20: note = CRISPR gRNA sequence
  source 1..20: mol_type = other DNA
ttgcccaggttggagtgcag

SEQ ID NO: 68955 - DNA, 20 bp, synthetic construct
  misc_feature 1..20: note = CRISPR gRNA sequence
  source 1..20: mol_type = other DNA
cccaggttggagtgcagtgg

SEQ ID NO: 68956 - DNA, 20 bp, synthetic construct
  misc_feature 1..20: note = CRISPR gRNA sequence
  source 1..20: mol_type = other DNA
gagtgcagtggtgcgatctc

SEQ ID NO: 68957 - DNA, 20 bp, synthetic construct
  misc_feature 1..20: note = CRISPR gRNA sequence
  source 1..20: mol_type = other DNA
ggctcactgcaagctccgcc

SEQ ID NO: 68958 - DNA, 20 bp, synthetic construct
  misc_feature 1..20: note = CRISPR gRNA sequence
  source 1..20: mol_type = other DNA
actgcaagctccgcctcctg

SEQ ID NO: 68959 - DNA, 20 bp, synthetic construct
  misc_feature 1..20: note = CRISPR gRNA sequence
  source 1..20: mol_type = other DNA
caagctccgcctcctgggtt

SEQ ID NO: 68960 - DNA, 20 bp, synthetic construct
  misc_feature 1..20: note = CRISPR gRNA sequence
  source 1..20: mol_type = other DNA
cgcctcctgggttcacgcca

SEQ ID NO: 68961 - DNA, 20 bp, synthetic construct
  misc_feature 1..20: note = CRISPR gRNA sequence
  source 1..20: mol_type = other DNA
ctgggttcacgccattctcc

SEQ ID NO: 68962 - DNA, 20 bp, synthetic construct
  misc_feature 1..20: note = CRISPR gRNA sequence
  source 1..20: mol_type = other DNA
ggttcacgccattctcctgc

SEQ ID NO: 68963 - DNA, 20 bp, synthetic construct
  misc_feature 1..20: note = CRISPR gRNA sequence
  source 1..20: mol_type = other DNA
acgccattctcctgcctcag

SEQ ID NO: 68964 - DNA, 20 bp, synthetic construct
  misc_feature 1..20: note = CRISPR gRNA sequence
  source 1..20: mol_type = other DNA
tcctgcctcagcctccagag

SEQ ID NO: 68965 - DNA, 20 bp, synthetic construct
  misc_feature 1..20: note = CRISPR gRNA sequence
  source 1..20: mol_type = other DNA
ctgcctcagcctccagagta

SEQ ID NO: 68966 - DNA, 20 bp, synthetic construct
  misc_feature 1..20: note = CRISPR gRNA sequence
  source 1..20: mol_type = other DNA
cctcagcctccagagtagct

SEQ ID NO: 68967 - DNA, 20 bp, synthetic construct
  misc_feature 1..20: note = CRISPR gRNA sequence
  source 1..20: mol_type = other DNA
agcctccagagtagctggga

SEQ ID NO: 68968 - DNA, 20 bp, synthetic construct
  misc_feature 1..20: note = CRISPR gRNA sequence
  source 1..20: mol_type = other DNA
cagagtagctgggactacag

SEQ ID NO: 68969 - DNA, 20 bp, synthetic construct
  misc_feature 1..20: note = CRISPR gRNA sequence
  source 1..20: mol_type = other DNA
ggactacaggtgcccgccac

SEQ ID NO: 68970 - DNA, 20 bp, synthetic construct
  misc_feature 1..20: note = CRISPR gRNA sequence
  source 1..20: mol_type = other DNA
caggtgcccgccaccacgcc

SEQ ID NO: 68971 - DNA, 20 bp, synthetic construct
  misc_feature 1..20: note = CRISPR gRNA sequence
  source 1..20: mol_type = other DNA
actaatgttttgtattttta

SEQ ID NO: 68972 - DNA, 20 bp, synthetic construct
  misc_feature 1..20: note = CRISPR gRNA sequence
  source 1..20: mol_type = other DNA
atgttttgtatttttagtag

SEQ ID NO: 68973 - DNA, 20 bp, synthetic construct
  misc_feature 1..20: note = CRISPR gRNA sequence
  source 1..20: mol_type = other DNA
tgtatttttagtagagacgg

SEQ ID NO: 68974 - DNA, 20 bp, synthetic construct
  misc_feature 1..20: note = CRISPR gRNA sequence
  source 1..20: mol_type = other DNA
gtatttttagtagagacggg

SEQ ID NO: 68975 - DNA, 20 bp, synthetic construct
  misc_feature 1..20: note = CRISPR gRNA sequence
  source 1..20: mol_type = other DNA
tatttttagtagagacgggg

SEQ ID NO: 68976 - DNA, 20 bp, synthetic construct
  misc_feature 1..20: note = CRISPR gRNA sequence
  source 1..20: mol_type = other DNA
ttagtagagacggggtttca

SEQ ID NO: 68977 - DNA, 20 bp, synthetic construct
  misc_feature 1..20: note = CRISPR gRNA sequence
  source 1..20: mol_type = other DNA
tagtagagacggggtttcac

SEQ ID NO: 68978 - DNA, 20 bp, synthetic construct
  misc_feature 1..20: note = CRISPR gRNA sequence
  source 1..20: mol_type = other DNA
agtagagacggggtttcacc

SEQ ID NO: 68979 - DNA, 20 bp, synthetic construct
  misc_feature 1..20: note = CRISPR gRNA sequence
  source 1..20: mol_type = other DNA
gtagagacggggtttcacca

SEQ ID NO: 68980 - DNA, 20 bp, synthetic construct
  misc_feature 1..20: note = CRISPR gRNA sequence
  source 1..20: mol_type = other DNA
caccatgttagccaggatgg

SEQ ID NO: 68981 - DNA, 20 bp, synthetic construct
  misc_feature 1..20: note = CRISPR gRNA sequence
  source 1..20: mol_type = other DNA
accatgttagccaggatggt

SEQ ID NO: 68982 - DNA, 20 bp, synthetic construct
  misc_feature 1..20: note = CRISPR gRNA sequence
  source 1..20: mol_type = other DNA
gccaggatggtctcgatctc

SEQ ID NO: 68983 - DNA, 20 bp, synthetic construct
  misc_feature 1..20: note = CRISPR gRNA sequence
  source 1..20: mol_type = other DNA
gatctcctgacctcgtgatc

SEQ ID NO: 68984 - DNA, 20 bp, synthetic construct
  misc_feature 1..20: note = CRISPR gRNA sequence
  source 1..20: mol_type = other DNA
ctgacctcgtgatcccccca

SEQ ID NO: 68985 - DNA, 20 bp, synthetic construct
  misc_feature 1..20: note = CRISPR gRNA sequence
  source 1..20: mol_type = other DNA
acctcgtgatccccccacct

SEQ ID NO: 68986 - DNA, 20 bp, synthetic construct
  misc_feature 1..20: note = CRISPR gRNA sequence
  source 1..20: mol_type = other DNA
gtgatccccccacctcagcc

SEQ ID NO: 68987 - DNA, 20 bp, synthetic construct
  misc_feature 1..20: note = CRISPR gRNA sequence
  source 1..20: mol_type = other DNA
agcctcccaaagtgctggga

SEQ ID NO: 68988 - DNA, 20 bp, synthetic construct
  misc_feature 1..20: note = CRISPR gRNA sequence
  source 1..20: mol_type = other DNA
ccaaagtgctgggattacag

SEQ ID NO: 68989 - DNA, 20 bp, synthetic construct
  misc_feature 1..20: note = CRISPR gRNA sequence
  source 1..20: mol_type = other DNA
ggattacaggtgtgagccac

SEQ ID NO: 68990 - DNA, 20 bp, synthetic construct
  misc_feature 1..20: note = CRISPR gRNA sequence
  source 1..20: mol_type = other DNA
caggtgtgagccactgcacc

SEQ ID NO: 68991 - DNA, 20 bp, synthetic construct
  misc_feature 1..20: note = CRISPR gRNA sequence
  source 1..20: mol_type = other DNA
cacccagccaaaataacatt

SEQ ID NO: 68992 - DNA, 20 bp, synthetic construct
  misc_feature 1..20: note = CRISPR gRNA sequence
  source 1..20: mol_type = other DNA
tcaaataaaacttttcttag

SEQ ID NO: 68993 - DNA, 20 bp, synthetic construct
  misc_feature 1..20: note = CRISPR gRNA sequence
  source 1..20: mol_type = other DNA
caaataaaacttttcttagt

SEQ ID NO: 68994 - DNA, 20 bp, synthetic construct
  misc_feature 1..20: note = CRISPR gRNA sequence
  source 1..20: mol_type = other DNA
aaataaaacttttcttagtc

SEQ ID NO: 68995 - DNA, 20 bp, synthetic construct
  misc_feature 1..20: note = CRISPR gRNA sequence
  source 1..20: mol_type = other DNA
ttcttagtctaaaaataata

SEQ ID NO: 68996 - DNA, 20 bp, synthetic construct
  misc_feature 1..20: note = CRISPR gRNA sequence
  source 1..20: mol_type = other DNA
tcttagtctaaaaataatat

SEQ ID NO: 68997 - DNA, 20 bp, synthetic construct
  misc_feature 1..20: note = CRISPR gRNA sequence
  source 1..20: mol_type = other DNA
cttagtctaaaaataatatt

SEQ ID NO: 68998 - DNA, 20 bp, synthetic construct
  misc_feature 1..20: note = CRISPR gRNA sequence
  source 1..20: mol_type = other DNA
ttagtctaaaaataatattg

SEQ ID NO: 68999 - DNA, 20 bp, synthetic construct
  misc_feature 1..20: note = CRISPR gRNA sequence
  source 1..20: mol_type = other DNA
agtctaaaaataatattggt

SEQ ID NO: 69000 - DNA, 20 bp, synthetic construct
  misc_feature 1..20: note = CRISPR gRNA sequence
  source 1..20: mol_type = other DNA
gtctaaaaataatattggtt

SEQ ID NO: 69001 - DNA, 20 bp, synthetic construct
  misc_feature 1..20: note = CRISPR gRNA sequence
  source 1..20: mol_type = other DNA
aaaataatattggttggggg

SEQ ID NO: 69002 - DNA, 20 bp, synthetic construct
  misc_feature 1..20: note = CRISPR gRNA sequence
  source 1..20: mol_type = other DNA
gttgggggaagtggcacacg

SEQ ID NO: 69003 - DNA, 20 bp, synthetic construct
  misc_feature 1..20: note = CRISPR gRNA sequence
  source 1..20: mol_type = other DNA
ggggaagtggcacacgcctg

SEQ ID NO: 69004 - DNA, 20 bp, synthetic construct
  misc_feature 1..20: note = CRISPR gRNA sequence
  source 1..20: mol_type = other DNA
taatcccaacactttgggag

SEQ ID NO: 69005 - DNA, 20 bp, synthetic construct
  misc_feature 1..20: note = CRISPR gRNA sequence
  source 1..20: mol_type = other DNA
tgggaggctgaggtgggcag

SEQ ID NO: 69006 - DNA, 20 bp, synthetic construct
  misc_feature 1..20: note = CRISPR gRNA sequence
  source 1..20: mol_type = other DNA
gggaggctgaggtgggcaga

SEQ ID NO: 69007 - DNA, 20 bp, synthetic construct
  misc_feature 1..20: note = CRISPR gRNA sequence
  source 1..20: mol_type = other DNA
ggaggctgaggtgggcagat

SEQ ID NO: 69008 - DNA, 20 bp, synthetic construct
  misc_feature 1..20: note = CRISPR gRNA sequence
  source 1..20: mol_type = other DNA
aggtgggcagattgtttgag

SEQ ID NO: 69009 - DNA, 20 bp, synthetic construct
  misc_feature 1..20: note = CRISPR gRNA sequence
  source 1..20: mol_type = other DNA
tttgagctcaggcgttcaag

SEQ ID NO: 69010 - DNA, 20 bp, synthetic construct
  misc_feature 1..20: note = CRISPR gRNA sequence
  source 1..20: mol_type = other DNA
gagctcaggcgttcaagacc

SEQ ID NO: 69011 - DNA, 20 bp, synthetic construct
  misc_feature 1..20: note = CRISPR gRNA sequence
  source 1..20: mol_type = other DNA
agctcaggcgttcaagacca

SEQ ID NO: 69012 - DNA, 20 bp, synthetic construct
  misc_feature 1..20: note = CRISPR gRNA sequence
  source 1..20: mol_type = other DNA
aggcgttcaagaccagcctg

SEQ ID NO: 69013 - DNA, 20 bp, synthetic construct
  misc_feature 1..20: note = CRISPR gRNA sequence
  source 1..20: mol_type = other DNA
aagaccagcctggacaacat

SEQ ID NO: 69014 - DNA, 20 bp, synthetic construct
  misc_feature 1..20: note = CRISPR gRNA sequence
  source 1..20: mol_type = other DNA
gacaacatggcaaaacccca

SEQ ID NO: 69015 - DNA, 20 bp, synthetic construct
  misc_feature 1..20: note = CRISPR gRNA sequence
  source 1..20: mol_type = other DNA
caaaaaataaaaataaaaaa

SEQ ID NO: 69016 - DNA, 20 bp, synthetic construct
  misc_feature 1..20: note = CRISPR gRNA sequence
  source 1..20: mol_type = other DNA
aatcattgttgaaatgtgca

SEQ ID NO: 69017 - DNA, 20 bp, synthetic construct
  misc_feature 1..20: note = CRISPR gRNA sequence
  source 1..20: mol_type = other DNA
atcattgttgaaatgtgcag

SEQ ID NO: 69018 - DNA, 20 bp, synthetic construct
  misc_feature 1..20: note = CRISPR gRNA sequence
  source 1..20: mol_type = other DNA
ttgaaatgtgcagaaaatcc

SEQ ID NO: 69019 - DNA, 20 bp, synthetic construct
  misc_feature 1..20: note = CRISPR gRNA sequence
  source 1..20: mol_type = other DNA
aaatgtgcagaaaatccaga

SEQ ID NO: 69020 - DNA, 20 bp, synthetic construct
  misc_feature 1..20: note = CRISPR gRNA sequence
  source 1..20: mol_type = other DNA
taaaaattcagcataacttt

SEQ ID NO: 69021 - DNA, 20 bp, synthetic construct
  misc_feature 1..20: note = CRISPR gRNA sequence
  source 1..20: mol_type = other DNA
aaaaattcagcataacttta

SEQ ID NO: 69022 - DNA, 20 bp, synthetic construct
  misc_feature 1..20: note = CRISPR gRNA sequence
  source 1..20: mol_type = other DNA
aaaattcagcataactttaa

SEQ ID NO: 69023 - DNA, 20 bp, synthetic construct
  misc_feature 1..20: note = CRISPR gRNA sequence
  source 1..20: mol_type = other DNA
agcataactttaaagcagta

SEQ ID NO: 69024 - DNA, 20 bp, synthetic construct
  misc_feature 1..20: note = CRISPR gRNA sequence
  source 1..20: mol_type = other DNA
taaagcagtaatatttgact

SEQ ID NO: 69025 - DNA, 20 bp, synthetic construct
  misc_feature 1..20: note = CRISPR gRNA sequence
  source 1..20: mol_type = other DNA
aaagcagtaatatttgactt

SEQ ID NO: 69026 - DNA, 20 bp, synthetic construct
  misc_feature 1..20: note = CRISPR gRNA sequence
  source 1..20: mol_type = other DNA
aagcagtaatatttgactta

SEQ ID NO: 69027 - DNA, 20 bp, synthetic construct
  misc_feature 1..20: note = CRISPR gRNA sequence
  source 1..20: mol_type = other DNA
gacttaattctcttttttcc

SEQ ID NO: 69028 - DNA, 20 bp, synthetic construct
  misc_feature 1..20: note = CRISPR gRNA sequence
  source 1..20: mol_type = other DNA
acttaattctcttttttcct

SEQ ID NO: 69029 - DNA, 20 bp, synthetic construct
  misc_feature 1..20: note = CRISPR gRNA sequence
  source 1..20: mol_type = other DNA
aattctcttttttcctactt

SEQ ID NO: 69030 - DNA, 20 bp, synthetic construct
  misc_feature 1..20: note = CRISPR gRNA sequence
  source 1..20: mol_type = other DNA
attctcttttttcctacttt

SEQ ID NO: 69031 - DNA, 20 bp, synthetic construct
  misc_feature 1..20: note = CRISPR gRNA sequence
  source 1..20: mol_type = other DNA
tcttttttcctactttcaaa

SEQ ID NO: 69032 - DNA, 20 bp, synthetic construct
  misc_feature 1..20: note = CRISPR gRNA sequence
  source 1..20: mol_type = other DNA
ttttttcctactttcaaatt

SEQ ID NO: 69033 - DNA, 20 bp, synthetic construct
  misc_feature 1..20: note = CRISPR gRNA sequence
  source 1..20: mol_type = other DNA
ttttcctactttcaaattaa

SEQ ID NO: 69034 - DNA, 20 bp, synthetic construct
  misc_feature 1..20: note = CRISPR gRNA sequence
  source 1..20: mol_type = other DNA
tttcctactttcaaattaat

SEQ ID NO: 69035 - DNA, 20 bp, synthetic construct
  misc_feature 1..20: note = CRISPR gRNA sequence
  source 1..20: mol_type = other DNA
ttcctactttcaaattaatg

SEQ ID NO: 69036 - DNA, 20 bp, synthetic construct
  misc_feature 1..20: note = CRISPR gRNA sequence
  source 1..20: mol_type = other DNA
tcctactttcaaattaatgc

SEQ ID NO: 69037 - DNA, 20 bp, synthetic construct
  misc_feature 1..20: note = CRISPR gRNA sequence
  source 1..20: mol_type = other DNA
cctactttcaaattaatgca

SEQ ID NO: 69038 - DNA, 20 bp, synthetic construct
  misc_feature 1..20: note = CRISPR gRNA sequence
  source 1..20: mol_type = other DNA
ctactttcaaattaatgcac

SEQ ID NO: 69039 - DNA, 20 bp, synthetic construct
  misc_feature 1..20: note = CRISPR gRNA sequence
  source 1..20: mol_type = other DNA
ctttcaaattaatgcacatg

SEQ ID NO: 69040 - DNA, 20 bp, synthetic construct
  misc_feature 1..20: note = CRISPR gRNA sequence
  source 1..20: mol_type = other DNA
tcaaattaatgcacatgcat

SEQ ID NO: 69041 - DNA, 20 bp, synthetic construct
  misc_feature 1..20: note = CRISPR gRNA sequence
  source 1..20: mol_type = other DNA
caaattaatgcacatgcatt

SEQ ID NO: 69042 - DNA, 20 bp, synthetic construct
  misc_feature 1..20: note = CRISPR gRNA sequence
  source 1..20: mol_type = other DNA
aaattaatgcacatgcattg

SEQ ID NO: 69043 - DNA, 20 bp, synthetic construct
  misc_feature 1..20: note = CRISPR gRNA sequence
  source 1..20: mol_type = other DNA
atgcacatgcattgtagaaa

SEQ ID NO: 69044 - DNA, 20 bp, synthetic construct
  misc_feature 1..20: note = CRISPR gRNA sequence
  source 1..20: mol_type = other DNA
tagaaagtttagaaaatata

SEQ ID NO: 69045 - DNA, 20 bp, synthetic construct
  misc_feature 1..20: note = CRISPR gRNA sequence
  source 1..20: mol_type = other DNA
agaaaatatagaaaattaaa

SEQ ID NO: 69046 - DNA, 20 bp, synthetic construct
  misc_feature 1..20: note = CRISPR gRNA sequence
  source 1..20: mol_type = other DNA
gaaaatatagaaaattaaag

SEQ ID NO: 69047 - DNA, 20 bp, synthetic construct
  misc_feature 1..20: note = CRISPR gRNA sequence
  source 1..20: mol_type = other DNA
aagaagacataaaataaaaa

SEQ ID NO: 69048 - DNA, 20 bp, synthetic construct
  misc_feature 1..20: note = CRISPR gRNA sequence
  source 1..20: mol_type = other DNA
atgagaattctatcatctta

SEQ ID NO: 69049 - DNA, 20 bp, synthetic construct
  misc_feature 1..20: note = CRISPR gRNA sequence
  source 1..20: mol_type = other DNA
tatcatcttaaacaaccacc

SEQ ID NO: 69050 - DNA, 20 bp, synthetic construct
  misc_feature 1..20: note = CRISPR gRNA sequence
  source 1..20: mol_type = other DNA
tcatcttaaacaaccaccat

SEQ ID NO: 69051 - DNA, 20 bp, synthetic construct
  misc_feature 1..20: note = CRISPR gRNA sequence
  source 1..20: mol_type = other DNA
aaacaaccaccatgaacatt

SEQ ID NO: 69052 - DNA, 20 bp, synthetic construct
  misc_feature 1..20: note = CRISPR gRNA sequence
  source 1..20: mol_type = other DNA
aacaaccaccatgaacattt

SEQ ID NO: 69053 - DNA, 20 bp, synthetic construct
  misc_feature 1..20: note = CRISPR gRNA sequence
  source 1..20: mol_type = other DNA
aatatattttcctatgtttt

SEQ ID NO: 69054 - DNA, 20 bp, synthetic construct
  misc_feature 1..20: note = CRISPR gRNA sequence
  source 1..20: mol_type = other DNA
atatattttcctatgttttc

SEQ ID NO: 69055 - DNA, 20 bp, synthetic construct
  misc_feature 1..20: note = CRISPR gRNA sequence
  source 1..20: mol_type = other DNA
tcctatgttttccacacatc

SEQ ID NO: 69056 - DNA, 20 bp, synthetic construct
  misc_feature 1..20: note = CRISPR gRNA sequence
  source 1..20: mol_type = other DNA
cctatgttttccacacatct

SEQ ID NO: 69057 - DNA, 20 bp, synthetic construct
  misc_feature 1..20: note = CRISPR gRNA sequence
  source 1..20: mol_type = other DNA
ctatgttttccacacatctc

SEQ ID NO: 69058 - DNA, 20 bp, synthetic construct
  misc_feature 1..20: note = CRISPR gRNA sequence
  source 1..20: mol_type = other DNA
tgttttccacacatctctct

SEQ ID NO: 69059 - DNA, 20 bp, synthetic construct
  misc_feature 1..20: note = CRISPR gRNA sequence
  source 1..20: mol_type = other DNA
tccacacatctctctccctg

SEQ ID NO: 69060 - DNA, 20 bp, synthetic construct
  misc_feature 1..20: note = CRISPR gRNA sequence
  source 1..20: mol_type = other DNA
ccacacatctctctccctgt

SEQ ID NO: 69061 - DNA, 20 bp, synthetic construct
  misc_feature 1..20: note = CRISPR gRNA sequence
  source 1..20: mol_type = other DNA
cacacatctctctccctgtt

SEQ ID NO: 69062 - DNA, 20 bp, synthetic construct
  misc_feature 1..20: note = CRISPR gRNA sequence
  source 1..20: mol_type = other DNA
tctccctgtttctttccaca

SEQ ID NO: 69063 - DNA, 20 bp, synthetic construct
  misc_feature 1..20: note = CRISPR gRNA sequence
  source 1..20: mol_type = other DNA
tccctgtttctttccacact

SEQ ID NO: 69064 - DNA, 20 bp, synthetic construct
  misc_feature 1..20: note = CRISPR gRNA sequence
  source 1..20: mol_type = other DNA
cctgtttctttccacacttt

SEQ ID NO: 69065 - DNA, 20 bp, synthetic construct
  misc_feature 1..20: note = CRISPR gRNA sequence
  source 1..20: mol_type = other DNA
tttctttccacacttttttt

SEQ ID NO: 69066 - DNA, 20 bp, synthetic construct
  misc_feature 1..20: note = CRISPR gRNA sequence
  source 1..20: mol_type = other DNA
ctttccacactttttttctc

SEQ ID NO: 69067 - DNA, 20 bp, synthetic construct
  misc_feature 1..20: note = CRISPR gRNA sequence
  source 1..20: mol_type = other DNA
tttccacactttttttctcc

SEQ ID NO: 69068 - DNA, 20 bp, synthetic construct
  misc_feature 1..20: note = CRISPR gRNA sequence
  source 1..20: mol_type = other DNA
tccacactttttttctccaa

SEQ ID NO: 69069 - DNA, 20 bp, synthetic construct
  misc_feature 1..20: note = CRISPR gRNA sequence
  source 1..20: mol_type = other DNA
ccacactttttttctccaaa

SEQ ID NO: 69070 - DNA, 20 bp, synthetic construct
  misc_feature 1..20: note = CRISPR gRNA sequence
  source 1..20: mol_type = other DNA
cacactttttttctccaaat

SEQ ID NO: 69071 - DNA, 20 bp, synthetic construct
  misc_feature 1..20: note = CRISPR gRNA sequence
  source 1..20: mol_type = other DNA
tttttctccaaatactttcc

SEQ ID NO: 69072 - DNA, 20 bp, synthetic construct
  misc_feature 1..20: note = CRISPR gRNA sequence
  source 1..20: mol_type = other DNA
ttttctccaaatactttcct

SEQ ID NO: 69073 - DNA, 20 bp, synthetic construct
  misc_feature 1..20: note = CRISPR gRNA sequence
  source 1..20: mol_type = other DNA
tttctccaaatactttcctt

SEQ ID NO: 69074 - DNA, 20 bp, synthetic construct
  misc_feature 1..20: note = CRISPR gRNA sequence
  source 1..20: mol_type = other DNA
ttctccaaatactttccttt

SEQ ID NO: 69075 - DNA, 20 bp, synthetic construct
  misc_feature 1..20: note = CRISPR gRNA sequence
  source 1..20: mol_type = other DNA
tctccaaatactttcctttt

SEQ ID NO: 69076 - DNA, 20 bp, synthetic construct
  misc_feature 1..20: note = CRISPR gRNA sequence
  source 1..20: mol_type = other DNA
ctccaaatactttccttttt

SEQ ID NO: 69077 - DNA, 20 bp, synthetic construct
  misc_feature 1..20: note = CRISPR gRNA sequence
  source 1..20: mol_type = other DNA
tccaaatactttcctttttt

SEQ ID NO: 69078 - DNA, 20 bp, synthetic construct
  misc_feature 1..20: note = CRISPR gRNA sequence
  source 1..20: mol_type = other DNA
caaatactttcctttttttg

SEQ ID NO: 69079 - DNA, 20 bp, synthetic construct
  misc_feature 1..20: note = CRISPR gRNA sequence
  source 1..20: mol_type = other DNA
tcctttttttgaaatgcaaa

SEQ ID NO: 69080 - DNA, 20 bp, synthetic construct
  misc_feature 1..20: note = CRISPR gRNA sequence
  source 1..20: mol_type = other DNA
cctttttttgaaatgcaaaa

SEQ ID NO: 69081 - DNA, 20 bp, synthetic construct
  misc_feature 1..20: note = CRISPR gRNA sequence
  source 1..20: mol_type = other DNA
ctttttttgaaatgcaaaat

SEQ ID NO: 69082 - DNA, 20 bp, synthetic construct
  misc_feature 1..20: note = CRISPR gRNA sequence
  source 1..20: mol_type = other DNA
tttttgaaatgcaaaattgg

SEQ ID NO: 69083 - DNA, 20 bp, synthetic construct
  misc_feature 1..20: note = CRISPR gRNA sequence
  source 1..20: mol_type = other DNA
ttttgaaatgcaaaattggg

SEQ ID NO: 69084 - DNA, 20 bp, synthetic construct
  misc_feature 1..20: note = CRISPR gRNA sequence
  source 1..20: mol_type = other DNA
tttgaaatgcaaaattggga

SEQ ID NO: 69085 - DNA, 20 bp, synthetic construct
  misc_feature 1..20: note = CRISPR gRNA sequence
  source 1..20: mol_type = other DNA
ttgaaatgcaaaattgggat

SEQ ID NO: 69086 - DNA, 20 bp, synthetic construct
  misc_feature 1..20: note = CRISPR gRNA sequence
  source 1..20: mol_type = other DNA
tgaaatgcaaaattgggatc

SEQ ID NO: 69087 - DNA, 20 bp, synthetic construct
  misc_feature 1..20: note = CRISPR gRNA sequence
  source 1..20: mol_type = other DNA
gaaatgcaaaattgggatca

SEQ ID NO: 69088 - DNA, 20 bp, synthetic construct
  misc_feature 1..20: note = CRISPR gRNA sequence
  source 1..20: mol_type = other DNA
aaatgcaaaattgggatcat

SEQ ID NO: 69089 - DNA, 20 bp, synthetic construct
  misc_feature 1..20: note = CRISPR gRNA sequence
  source 1..20: mol_type = other DNA
ggatcatgttttatatacag

SEQ ID NO: 69090 - DNA, 20 bp, synthetic construct
  misc_feature 1..20: note = CRISPR gRNA sequence
  source 1..20: mol_type = other DNA
tatatacagtttggtttcct

SEQ ID NO: 69091 - DNA, 20 bp, synthetic construct
  misc_feature 1..20: note = CRISPR gRNA sequence
  source 1..20: mol_type = other DNA
atatacagtttggtttcctt

SEQ ID NO: 69092 - DNA, 20 bp, synthetic construct
  misc_feature 1..20: note = CRISPR gRNA sequence
  source 1..20: mol_type = other DNA
tatacagtttggtttcctta

SEQ ID NO: 69093 - DNA, 20 bp, synthetic construct
  misc_feature 1..20: note = CRISPR gRNA sequence
  source 1..20: mol_type = other DNA
ggtttccttacctttgtgat

SEQ ID NO: 69094 - DNA, 20 bp, synthetic construct
  misc_feature 1..20: note = CRISPR gRNA sequence
  source 1..20: mol_type = other DNA
gtttccttacctttgtgatg

SEQ ID NO: 69095 - DNA, 20 bp, synthetic construct
  misc_feature 1..20: note = CRISPR gRNA sequence
  source 1..20: mol_type = other DNA
ccttacctttgtgatgtaac

SEQ ID NO: 69096 - DNA, 20 bp, synthetic construct
  misc_feature 1..20: note = CRISPR gRNA sequence
  source 1..20: mol_type = other DNA
cttacctttgtgatgtaaca

SEQ ID NO: 69097 - DNA, 20 bp, synthetic construct
  misc_feature 1..20: note = CRISPR gRNA sequence
  source 1..20: mol_type = other DNA
acctttgtgatgtaacatta

SEQ ID NO: 69098 - DNA, 20 bp, synthetic construct
  misc_feature 1..20: note = CRISPR gRNA sequence
  source 1..20: mol_type = other DNA
cctttgtgatgtaacattat

SEQ ID NO: 69099 - DNA, 20 bp, synthetic construct
  misc_feature 1..20: note = CRISPR gRNA sequence
  source 1..20: mol_type = other DNA
tgtgatgtaacattatgtga

SEQ ID NO: 69100 - DNA, 20 bp, synthetic construct
  misc_feature 1..20: note = CRISPR gRNA sequence
  source 1..20: mol_type = other DNA
gtgatgtaacattatgtgaa

SEQ ID NO: 69101 - DNA, 20 bp, synthetic construct
  misc_feature 1..20: note = CRISPR gRNA sequence
  source 1..20: mol_type = other DNA
tgatgtaacattatgtgaat

SEQ ID NO: 69102 - DNA, 20 bp, synthetic construct
  misc_feature 1..20: note = CRISPR gRNA sequence
  source 1..20: mol_type = other DNA
tgtgaatcttttcttaaatc

SEQ ID NO: 69103 - DNA, 20 bp, synthetic construct
  misc_feature 1..20: note = CRISPR gRNA sequence
  source 1..20: mol_type = other DNA
ttcttaaatctaaaaatatc

SEQ ID NO: 69104 - DNA, 20 bp, synthetic construct
  misc_feature 1..20: note = CRISPR gRNA sequence
  source 1..20: mol_type = other DNA
tcttaaatctaaaaatatca

SEQ ID NO: 69105 - DNA, 20 bp, synthetic construct
  misc_feature 1..20: note = CRISPR gRNA sequence
  source 1..20: mol_type = other DNA
cttaaatctaaaaatatcag

SEQ ID NO: 69106 - DNA, 20 bp, synthetic construct
  misc_feature 1..20: note = CRISPR gRNA sequence
  source 1..20: mol_type = other DNA
ttaaatctaaaaatatcagt

SEQ ID NO: 69107 - DNA, 20 bp, synthetic construct
  misc_feature 1..20: note = CRISPR gRNA sequence
  source 1..20: mol_type = other DNA
aaatctaaaaatatcagtgg

SEQ ID NO: 69108 - DNA, 20 bp, synthetic construct
  misc_feature 1..20: note = CRISPR gRNA sequence
  source 1..20: mol_type = other DNA
aatctaaaaatatcagtggc

SEQ ID NO: 69109 - DNA, 20 bp, synthetic construct
  misc_feature 1..20: note = CRISPR gRNA sequence
  source 1..20: mol_type = other DNA
aaaatatcagtggcccagtg

SEQ ID NO: 69110 - DNA, 20 bp, synthetic construct
  misc_feature 1..20: note = CRISPR gRNA sequence
  source 1..20: mol_type = other DNA
acgcctgtaatcccagcact

SEQ ID NO: 69111 - DNA, 20 bp, synthetic construct
  misc_feature 1..20: note = CRISPR gRNA sequence
  source 1..20: mol_type = other DNA
taatcccagcactttgggag

SEQ ID NO: 69112 - DNA, 20 bp, synthetic construct
  misc_feature 1..20: note = CRISPR gRNA sequence
  source 1..20: mol_type = other DNA
tgggaggccgaggcaggtgg

SEQ ID NO: 69113 - DNA, 20 bp, synthetic construct
  misc_feature 1..20: note = CRISPR gRNA sequence
  source 1..20: mol_type = other DNA
gggaggccgaggcaggtgga

SEQ ID NO: 69114 - DNA, 20 bp, synthetic construct
  misc_feature 1..20: note = CRISPR gRNA sequence
  source 1..20: mol_type = other DNA
ggaggccgaggcaggtggat

SEQ ID NO: 69115 - DNA, 20 bp, synthetic construct
  misc_feature 1..20: note = CRISPR gRNA sequence
  source 1..20: mol_type = other DNA
gaggtcaggagttcaagacc

SEQ ID NO: 69116 - DNA, 20 bp, synthetic construct
  misc_feature 1..20: note = CRISPR gRNA sequence
  source 1..20: mol_type = other DNA
aggtcaggagttcaagacca

SEQ ID NO: 69117 - DNA, 20 bp, synthetic construct
  misc_feature 1..20: note = CRISPR gRNA sequence
  source 1..20: mol_type = other DNA
aagaccagcctgaccaacat

SEQ ID NO: 69118 - DNA, 20 bp, synthetic construct
  misc_feature 1..20: note = CRISPR gRNA sequence
  source 1..20: mol_type = other DNA
accaacatggtgaaacccca

SEQ ID NO: 69119 - DNA, 20 bp, synthetic construct
  misc_feature 1..20: note = CRISPR gRNA sequence
  source 1..20: mol_type = other DNA
tactaaaaatacaaaaatta

SEQ ID NO: 69120 - DNA, 20 bp, synthetic construct
  misc_feature 1..20: note = CRISPR gRNA sequence
  source 1..20: mol_type = other DNA
ctaaaaatacaaaaattagc

SEQ ID NO: 69121 - DNA, 20 bp, synthetic construct
  misc_feature 1..20: note = CRISPR gRNA sequence
  source 1..20: mol_type = other DNA
aaaatacaaaaattagccag

SEQ ID NO: 69122 - DNA, 20 bp, synthetic construct
  misc_feature 1..20: note = CRISPR gRNA sequence
  source 1..20: mol_type = other DNA
gccaggcgtggtggcgcatg

SEQ ID NO: 69123 - DNA, 20 bp, synthetic construct
  misc_feature 1..20: note = CRISPR gRNA sequence
  source 1..20: mol_type = other DNA
taatcccagctacttgggag

SEQ ID NO: 69124 - DNA, 20 bp, synthetic construct
  misc_feature 1..20: note = CRISPR gRNA sequence
  source 1..20: mol_type = other DNA
cttgggaggctgaggcagga

SEQ ID NO: 69125 - DNA, 20 bp, synthetic construct
  misc_feature 1..20: note = CRISPR gRNA sequence
  source 1..20: mol_type = other DNA
gggaggctgaggcaggagaa

SEQ ID NO: 69126 - DNA, 20 bp, synthetic construct
  misc_feature 1..20: note = CRISPR gRNA sequence
  source 1..20: mol_type = other DNA
ggaggctgaggcaggagaat

SEQ ID NO: 69127 - DNA, 20 bp, synthetic construct
  misc_feature 1..20: note = CRISPR gRNA sequence
  source 1..20: mol_type = other DNA
aggcaggagaatcgcttgaa

SEQ ID NO: 69128 - DNA, 20 bp, synthetic construct
  misc_feature 1..20: note = CRISPR gRNA sequence
  source 1..20: mol_type = other DNA
gaacccaggaggcagaggtt

SEQ ID NO: 69129 - DNA, 20 bp, synthetic construct
  misc_feature 1..20: note = CRISPR gRNA sequence
  source 1..20: mol_type = other DNA
aacccaggaggcagaggttg

SEQ ID NO: 69130 - DNA, 20 bp, synthetic construct
  misc_feature 1..20: note = CRISPR gRNA sequence
  source 1..20: mol_type = other DNA
cagtgatctgagatcatgcc

SEQ ID NO: 69131 - DNA, 20 bp, synthetic construct
  misc_feature 1..20: note = CRISPR gRNA sequence
  source 1..20: mol_type = other DNA
agatcatgccattgcactcc

SEQ ID NO: 69132 - DNA, 20 bp, synthetic construct
  misc_feature 1..20: note = CRISPR gRNA sequence
  source 1..20: mol_type = other DNA
cactccagtctgggcaacaa

SEQ ID NO: 69133 - DNA, 20 bp, synthetic construct
  misc_feature 1..20: note = CRISPR gRNA sequence
  source 1..20: mol_type = other DNA
cagtctgggcaacaagagca

SEQ ID NO: 69134 - DNA, 20 bp, synthetic construct
  misc_feature 1..20: note = CRISPR gRNA sequence
  source 1..20: mol_type = other DNA
ggcaacaagagcaaaactct

SEQ ID NO: 69135 - DNA, 20 bp, synthetic construct
  misc_feature 1..20: note = CRISPR gRNA sequence
  source 1..20: mol_type = other DNA
tgtctcaaaaataaaataag

SEQ ID NO: 69136 - DNA, 20 bp, synthetic construct
  misc_feature 1..20: note = CRISPR gRNA sequence
  source 1..20: mol_type = other DNA
tctcaaaaataaaataagat

SEQ ID NO: 69137 - DNA, 20 bp, synthetic construct
  misc_feature 1..20: note = CRISPR gRNA sequence
  source 1..20: mol_type = other DNA
aaaaataaaataagataaga

SEQ ID NO: 69138 - DNA, 20 bp, synthetic construct
  misc_feature 1..20: note = CRISPR gRNA sequence
  source 1..20: mol_type = other DNA
aaaaaataatattttctgtt

SEQ ID NO: 69139 - DNA, 20 bp, synthetic construct
  misc_feature 1..20: note = CRISPR gRNA sequence
  source 1..20: mol_type = other DNA
aaaaataatattttctgttt

SEQ ID NO: 69140 - DNA, 20 bp, synthetic construct
  misc_feature 1..20: note = CRISPR gRNA sequence
  source 1..20: mol_type = other DNA
tctgtttggattgtcacaac

SEQ ID NO: 69141 - DNA, 20 bp, synthetic construct
  misc_feature 1..20: note = CRISPR gRNA sequence
  source 1..20: mol_type = other DNA
ctgtttggattgtcacaaca

SEQ ID NO: 69142 - DNA, 20 bp, synthetic construct
  misc_feature 1..20: note = CRISPR gRNA sequence
  source 1..20: mol_type = other DNA
tgtttggattgtcacaacaa

SEQ ID NO: 69143 - DNA, 20 bp, synthetic construct
  misc_feature 1..20: note = CRISPR gRNA sequence
  source 1..20: mol_type = other DNA
tttggattgtcacaacaata

SEQ ID NO: 69144 - DNA, 20 bp, synthetic construct
  misc_feature 1..20: note = CRISPR gRNA sequence
  source 1..20: mol_type = other DNA
ggattgtcacaacaatagtt

SEQ ID NO: 69145 - DNA, 20 bp, synthetic construct
  misc_feature 1..20: note = CRISPR gRNA sequence
  source 1..20: mol_type = other DNA
gattgtcacaacaatagttg

SEQ ID NO: 69146 - DNA, 20 bp, synthetic construct
  misc_feature 1..20: note = CRISPR gRNA sequence
  source 1..20: mol_type = other DNA
tcacaacaatagttgttgga

SEQ ID NO: 69147 - DNA, 20 bp, synthetic construct
  misc_feature 1..20: note = CRISPR gRNA sequence
  source 1..20: mol_type = other DNA
ttggaataagggtgatgtta

SEQ ID NO: 69148 - DNA, 20 bp, synthetic construct
  misc_feature 1..20: note = CRISPR gRNA sequence
  source 1..20: mol_type = other DNA
gaataagggtgatgttaatt

SEQ ID NO: 69149 - DNA, 20 bp, synthetic construct
  misc_feature 1..20: note = CRISPR gRNA sequence
  source 1..20: mol_type = other DNA
atttccttttttagattgat

SEQ ID NO: 69150 - DNA, 20 bp, synthetic construct
  misc_feature 1..20: note = CRISPR gRNA sequence
  source 1..20: mol_type = other DNA
ccttttttagattgatgcct

SEQ ID NO: 69151 - DNA, 20 bp, synthetic construct
  misc_feature 1..20: note = CRISPR gRNA sequence
  source 1..20: mol_type = other DNA
cttttttagattgatgccta

SEQ ID NO: 69152 - DNA, 20 bp, synthetic construct
  misc_feature 1..20: note = CRISPR gRNA sequence
  source 1..20: mol_type = other DNA
ttttagattgatgcctactt

SEQ ID NO: 69153 - DNA, 20 bp, synthetic construct
  misc_feature 1..20: note = CRISPR gRNA sequence
  source 1..20: mol_type = other DNA
tttagattgatgcctacttg

SEQ ID NO: 69154 - DNA, 20 bp, synthetic construct
  misc_feature 1..20: note = CRISPR gRNA sequence
  source 1..20: mol_type = other DNA
ttagattgatgcctacttgt

SEQ ID NO: 69155 - DNA, 20 bp, synthetic construct
  misc_feature 1..20: note = CRISPR gRNA sequence
  source 1..20: mol_type = other DNA
tagattgatgcctacttgta

SEQ ID NO: 69156 - DNA, 20 bp, synthetic construct
  misc_feature 1..20: note = CRISPR gRNA sequence
  source 1..20: mol_type = other DNA
agattgatgcctacttgtat

SEQ ID NO: 69157 - DNA, 20 bp, synthetic construct
  misc_feature 1..20: note = CRISPR gRNA sequence
  source 1..20: mol_type = other DNA
gattgatgcctacttgtata

SEQ ID NO: 69158 - DNA, 20 bp, synthetic construct
  misc_feature 1..20: note = CRISPR gRNA sequence
  source 1..20: mol_type = other DNA
atgcctacttgtataatttt

SEQ ID NO: 69159 - DNA, 20 bp, synthetic construct
  misc_feature 1..20: note = CRISPR gRNA sequence
  source 1..20: mol_type = other DNA
cttgtataattttatagttt

SEQ ID NO: 69160 - DNA, 20 bp, synthetic construct
  misc_feature 1..20: note = CRISPR gRNA sequence
  source 1..20: mol_type = other DNA
gtataattttatagttttaa

SEQ ID NO: 69161 - DNA, 20 bp, synthetic construct
  misc_feature 1..20: note = CRISPR gRNA sequence
  source 1..20: mol_type = other DNA
tataattttatagttttaaa

SEQ ID NO: 69162 - DNA, 20 bp, synthetic construct
  misc_feature 1..20: note = CRISPR gRNA sequence
  source 1..20: mol_type = other DNA
tatagttttaaaatgagcaa

SEQ ID NO: 69163 - DNA, 20 bp, synthetic construct
  misc_feature 1..20: note = CRISPR gRNA sequence
  source 1..20: mol_type = other DNA
atagttttaaaatgagcaaa

SEQ ID NO: 69164 - DNA, 20 bp, synthetic construct
  misc_feature 1..20: note = CRISPR gRNA sequence
  source 1..20: mol_type = other DNA
tagttttaaaatgagcaaaa

SEQ ID NO: 69165 - DNA, 20 bp, synthetic construct
  misc_feature 1..20: note = CRISPR gRNA sequence
  source 1..20: mol_type = other DNA
taaaatgagcaaaaaaaact

SEQ ID NO: 69166 - DNA, 20 bp, synthetic construct
  misc_feature 1..20: note = CRISPR gRNA sequence
  source 1..20: mol_type = other DNA
aaaatgagcaaaaaaaactc

SEQ ID NO: 69167 - DNA, 20 bp, synthetic construct
  misc_feature 1..20: note = CRISPR gRNA sequence
  source 1..20: mol_type = other DNA
aaatgagcaaaaaaaactca

SEQ ID NO: 69168 - DNA, 20 bp, synthetic construct
  misc_feature 1..20: note = CRISPR gRNA sequence
  source 1..20: mol_type = other DNA
aaaaagcctctaggtccccc

SEQ ID NO: 69169 - DNA, 20 bp, synthetic construct
  misc_feature 1..20: note = CRISPR gRNA sequence
  source 1..20: mol_type = other DNA
taggtcccccccttgacact

SEQ ID NO: 69170 - DNA, 20 bp, synthetic construct
  misc_feature 1..20: note = CRISPR gRNA sequence
  source 1..20: mol_type = other DNA
ggtcccccccttgacactcc

SEQ ID NO: 69171 - DNA, 20 bp, synthetic construct
  misc_feature 1..20: note = CRISPR gRNA sequence
  source 1..20: mol_type = other DNA
gacactcctcccccggcccc

SEQ ID NO: 69172 - DNA, 20 bp, synthetic construct
  misc_feature 1..20: note = CRISPR gRNA sequence
  source 1..20: mol_type = other DNA
acactcctcccccggccccg

SEQ ID NO: 69173 - DNA, 20 bp, synthetic construct
  misc_feature 1..20: note = CRISPR gRNA sequence
  source 1..20: mol_type = other DNA
ctcccccggccccgtcatgt

SEQ ID NO: 69174 - DNA, 20 bp, synthetic construct
  misc_feature 1..20: note = CRISPR gRNA sequence
  source 1..20: mol_type = other DNA
ccccggccccgtcatgtgtg

SEQ ID NO: 69175 - DNA, 20 bp, synthetic construct
  misc_feature 1..20: note = CRISPR gRNA sequence
  source 1..20: mol_type = other DNA
attgtctgctgctcaccttg

SEQ ID NO: 69176 - DNA, 20 bp, synthetic construct
  misc_feature 1..20: note = CRISPR gRNA sequence
  source 1..20: mol_type = other DNA
tctgctgctcaccttggggg

SEQ ID NO: 69177 - DNA, 20 bp, synthetic construct
  misc_feature 1..20: note = CRISPR gRNA sequence
  source 1..20: mol_type = other DNA
ctgctcaccttgggggggcc

SEQ ID NO: 69178 - DNA, 20 bp, synthetic construct
  misc_feature 1..20: note = CRISPR gRNA sequence
  source 1..20: mol_type = other DNA
ctcaccttgggggggcctta

SEQ ID NO: 69179 - DNA, 20 bp, synthetic construct
  misc_feature 1..20: note = CRISPR gRNA sequence
  source 1..20: mol_type = other DNA
accttgggggggccttatct

SEQ ID NO: 69180 - DNA, 20 bp, synthetic construct
  misc_feature 1..20: note = CRISPR gRNA sequence
  source 1..20: mol_type = other DNA
gggggggccttatctgtgtc

SEQ ID NO: 69181 - DNA, 20 bp, synthetic construct
  misc_feature 1..20: note = CRISPR gRNA sequence
  source 1..20: mol_type = other DNA
ggggggccttatctgtgtcc

SEQ ID NO: 69182 - DNA, 20 bp, synthetic construct
  misc_feature 1..20: note = CRISPR gRNA sequence
  source 1..20: mol_type = other DNA
atctgtgtccccttctgtga

SEQ ID NO: 69183 - DNA, 20 bp, synthetic construct
  misc_feature 1..20: note = CRISPR gRNA sequence
  source 1..20: mol_type = other DNA
tctgtgtccccttctgtgac

SEQ ID NO: 69184 - DNA, 20 bp, synthetic construct
  misc_feature 1..20: note = CRISPR gRNA sequence
  source 1..20: mol_type = other DNA
tgtccccttctgtgacaggg

SEQ ID NO: 69185 - DNA, 20 bp, synthetic construct
  misc_feature 1..20: note = CRISPR gRNA sequence
  source 1..20: mol_type = other DNA
ctgtgacagggtgcaggagc

SEQ ID NO: 69186 - DNA, 20 bp, synthetic construct
  misc_feature 1..20: note = CRISPR gRNA sequence
  source 1..20: mol_type = other DNA
tgtgacagggtgcaggagcc

SEQ ID NO: 69187 - DNA, 20 bp, synthetic construct
  misc_feature 1..20: note = CRISPR gRNA sequence
  source 1..20: mol_type = other DNA
tgacagggtgcaggagccgt

SEQ ID NO: 69188 - DNA, 20 bp, synthetic construct
  misc_feature 1..20: note = CRISPR gRNA sequence
  source 1..20: mol_type = other DNA
tctccctgttagaagtctgc

SEQ ID NO: 69189 - DNA, 20 bp, synthetic construct
  misc_feature 1..20: note = CRISPR gRNA sequence
  source 1..20: mol_type = other DNA
tccctgttagaagtctgcgc

SEQ ID NO: 69190 - DNA, 20 bp, synthetic construct
  misc_feature 1..20: note = CRISPR gRNA sequence
  source 1..20: mol_type = other DNA
cctgttagaagtctgcgccc

SEQ ID NO: 69191 - DNA, 20 bp, synthetic construct
  misc_feature 1..20: note = CRISPR gRNA sequence
  source 1..20: mol_type = other DNA
ttagaagtctgcgcccaggc

SEQ ID NO: 69192 - DNA, 20 bp, synthetic construct
  misc_feature 1..20: note = CRISPR gRNA sequence
  source 1..20: mol_type = other DNA
gaagtctgcgcccaggcctc

SEQ ID NO: 69193 - DNA, 20 bp, synthetic construct
  misc_feature 1..20: note = CRISPR gRNA sequence
  source 1..20: mol_type = other DNA
cgcccaggcctcaggcagtg

SEQ ID NO: 69194 - DNA, 20 bp, synthetic construct
  misc_feature 1..20: note = CRISPR gRNA sequence
  source 1..20: mol_type = other DNA
aggcagtgtcactgaaatca

SEQ ID NO: 69195 - DNA, 20 bp, synthetic construct
  misc_feature 1..20: note = CRISPR gRNA sequence
  source 1..20: mol_type = other DNA
aaatcaggtgagtccagaga

SEQ ID NO: 69196 - DNA, 20 bp, synthetic construct
  misc_feature 1..20: note = CRISPR gRNA sequence
  source 1..20: mol_type = other DNA
tggaattcttcatctttcat

SEQ ID NO: 69197 - DNA, 20 bp, synthetic construct
  misc_feature 1..20: note = CRISPR gRNA sequence
  source 1..20: mol_type = other DNA
ggaattcttcatctttcata

SEQ ID NO: 69198 - DNA, 20 bp, synthetic construct
  misc_feature 1..20: note = CRISPR gRNA sequence
  source 1..20: mol_type = other DNA
gaattcttcatctttcataa

SEQ ID NO: 69199 - DNA, 20 bp, synthetic construct
  misc_feature 1..20: note = CRISPR gRNA sequence
  source 1..20: mol_type = other DNA
ttcatctttcataagcattg

SEQ ID NO: 69200 - DNA, 20 bp, synthetic construct
  misc_feature 1..20: note = CRISPR gRNA sequence
  source 1..20: mol_type = other DNA
catctttcataagcattggg

SEQ ID NO: 69201 - DNA, 20 bp, synthetic construct
  misc_feature 1..20: note = CRISPR gRNA sequence
  source 1..20: mol_type = other DNA
atctttcataagcattggga

SEQ ID NO: 69202 - DNA, 20 bp, synthetic construct
  misc_feature 1..20: note = CRISPR gRNA sequence
  source 1..20: mol_type = other DNA
tcataagcattgggactttt

SEQ ID NO: 69203 - DNA, 20 bp, synthetic construct
  misc_feature 1..20: note = CRISPR gRNA sequence
  source 1..20: mol_type = other DNA
cataagcattgggacttttc

SEQ ID NO: 69204 - DNA, 20 bp, synthetic construct
  misc_feature 1..20: note = CRISPR gRNA sequence
  source 1..20: mol_type = other DNA
ataagcattgggacttttcc

SEQ ID NO: 69205 - DNA, 20 bp, synthetic construct
  misc_feature 1..20: note = CRISPR gRNA sequence
  source 1..20: mol_type = other DNA
ggacttttccttgaccttcc

SEQ ID NO: 69206 - DNA, 20 bp, synthetic construct
  misc_feature 1..20: note = CRISPR gRNA sequence
  source 1..20: mol_type = other DNA
ttccttgaccttccctcatc

SEQ ID NO: 69207 - DNA, 20 bp, synthetic construct
  misc_feature 1..20: note = CRISPR gRNA sequence
  source 1..20: mol_type = other DNA
tccttgaccttccctcatcc

SEQ ID NO: 69208 - DNA, 20 bp, synthetic construct
  misc_feature 1..20: note = CRISPR gRNA sequence
  source 1..20: mol_type = other DNA
ccttgaccttccctcatcct

SEQ ID NO: 69209 - DNA, 20 bp, synthetic construct
  misc_feature 1..20: note = CRISPR gRNA sequence
  source 1..20: mol_type = other DNA
cttgaccttccctcatcctg

SEQ ID NO: 69210 - DNA, 20 bp, synthetic construct
  misc_feature 1..20: note = CRISPR gRNA sequence
  source 1..20: mol_type = other DNA
gaccttccctcatcctgtgg

SEQ ID NO: 69211 - DNA, 20 bp, synthetic construct
  misc_feature 1..20: note = CRISPR gRNA sequence
  source 1..20: mol_type = other DNA
accttccctcatcctgtggg

SEQ ID NO: 69212 - DNA, 20 bp, synthetic construct
  misc_feature 1..20: note = CRISPR gRNA sequence
  source 1..20: mol_type = other DNA
ccctcatcctgtggggtaat

SEQ ID NO: 69213 - DNA, 20 bp, synthetic construct
  misc_feature 1..20: note = CRISPR gRNA sequence
  source 1..20: mol_type = other DNA
cctcatcctgtggggtaata

SEQ ID NO: 69214 - DNA, 20 bp, synthetic construct
  misc_feature 1..20: note = CRISPR gRNA sequence
  source 1..20: mol_type = other DNA
atcctgtggggtaatagctg

SEQ ID NO: 69215 - DNA, 20 bp, synthetic construct
  misc_feature 1..20: note = CRISPR gRNA sequence
  source 1..20: mol_type = other DNA
tggggtaatagctgtgtcac

SEQ ID NO: 69216 - DNA, 20 bp, synthetic construct
  misc_feature 1..20: note = CRISPR gRNA sequence
  source 1..20: mol_type = other DNA
tgtcaccagctagttttcca

SEQ ID NO: 69217 - DNA, 20 bp, synthetic construct
  misc_feature 1..20: note = CRISPR gRNA sequence
  source 1..20: mol_type = other DNA
gttttccatgtccccagggt

SEQ ID NO: 69218 - DNA, 20 bp, synthetic construct
  misc_feature 1..20: note = CRISPR gRNA sequence
  source 1..20: mol_type = other DNA
tccatgtccccagggtagca

SEQ ID NO: 69219 - DNA, 20 bp, synthetic construct
  misc_feature 1..20: note = CRISPR gRNA sequence
  source 1..20: mol_type = other DNA
ccatgtccccagggtagcag

SEQ ID NO: 69220 - DNA, 20 bp, synthetic construct
  misc_feature 1..20: note = CRISPR gRNA sequence
  source 1..20: mol_type = other DNA
catgtccccagggtagcagg

SEQ ID NO: 69221 - DNA, 20 bp, synthetic construct
  misc_feature 1..20: note = CRISPR gRNA sequence
  source 1..20: mol_type = other DNA
ctggggcatatgtgaggggc

SEQ ID NO: 69222 - DNA, 20 bp, synthetic construct
  misc_feature 1..20: note = CRISPR gRNA sequence
  source 1..20: mol_type = other DNA
gggcatatgtgaggggctac

SEQ ID NO: 69223 - DNA, 20 bp, synthetic construct
  misc_feature 1..20: note = CRISPR gRNA sequence
  source 1..20: mol_type = other DNA
cacatttgttgggactagtg

SEQ ID NO: 69224 - DNA, 20 bp, synthetic construct
  misc_feature 1..20: note = CRISPR gRNA sequence
  source 1..20: mol_type = other DNA
gttgggactagtgcagtagt

SEQ ID NO: 69225 - DNA, 20 bp, synthetic construct
  misc_feature 1..20: note = CRISPR gRNA sequence
  source 1..20: mol_type = other DNA
ttgggactagtgcagtagtc

SEQ ID NO: 69226 - DNA, 20 bp, synthetic construct
  misc_feature 1..20: note = CRISPR gRNA sequence
  source 1..20: mol_type = other DNA
ggactagtgcagtagtcaag

SEQ ID NO: 69227 - DNA, 20 bp, synthetic construct
  misc_feature 1..20: note = CRISPR gRNA sequence
  source 1..20: mol_type = other DNA
gtgcagtagtcaagccacag

SEQ ID NO: 69228 - DNA, 20 bp, synthetic construct
  misc_feature 1..20: note = CRISPR gRNA sequence
  source 1..20: mol_type = other DNA
ttggatccaggcagacatgg

SEQ ID NO: 69229 - DNA, 20 bp, synthetic construct
  misc_feature 1..20: note = CRISPR gRNA sequence
  source 1..20: mol_type = other DNA
gatccaggcagacatggctg

SEQ ID NO: 69230 - DNA, 20 bp, synthetic construct
  misc_feature 1..20: note = CRISPR gRNA sequence
  source 1..20: mol_type = other DNA
ggagtccacgctggttgctt

SEQ ID NO: 69231 - DNA, 20 bp, synthetic construct
  misc_feature 1..20: note = CRISPR gRNA sequence
  source 1..20: mol_type = other DNA
gttgcttggaagtggccccc

SEQ ID NO: 69232 - DNA, 20 bp, synthetic construct
  misc_feature 1..20: note = CRISPR gRNA sequence
  source 1..20: mol_type = other DNA
cttggaagtggccccccaga

SEQ ID NO: 69233 - DNA, 20 bp, synthetic construct
  misc_feature 1..20: note = CRISPR gRNA sequence
  source 1..20: mol_type = other DNA
ggaagtggccccccagatgc

SEQ ID NO: 69234 - DNA, 20 bp, synthetic construct
  misc_feature 1..20: note = CRISPR gRNA sequence
  source 1..20: mol_type = other DNA
gaagtggccccccagatgca

SEQ ID NO: 69235 - DNA, 20 bp, synthetic construct
  misc_feature 1..20: note = CRISPR gRNA sequence
  source 1..20: mol_type = other DNA
tggctcttcaaccagaaata

SEQ ID NO: 69236 - DNA, 20 bp, synthetic construct
  misc_feature 1..20: note = CRISPR gRNA sequence
  source 1..20: mol_type = other DNA
ttcaaccagaaataacacaa

SEQ ID NO: 69237 - DNA, 20 bp, synthetic construct
  misc_feature 1..20: note = CRISPR gRNA sequence
  source 1..20: mol_type = other DNA
caaccagaaataacacaatg

SEQ ID NO: 69238 - DNA, 20 bp, synthetic construct
  misc_feature 1..20: note = CRISPR gRNA sequence
  source 1..20: mol_type = other DNA
aaccagaaataacacaatga

SEQ ID NO: 69239 - DNA, 20 bp, synthetic construct
  misc_feature 1..20: note = CRISPR gRNA sequence
  source 1..20: mol_type = other DNA
atagcaaaggttttagcatc

SEQ ID NO: 69240 - DNA, 20 bp, synthetic construct
  misc_feature 1..20: note = CRISPR gRNA sequence
  source 1..20: mol_type = other DNA
tagcaaaggttttagcatcc

SEQ ID NO: 69241 - DNA, 20 bp, synthetic construct
  misc_feature 1..20: note = CRISPR gRNA sequence
  source 1..20: mol_type = other DNA
tagcatcccactcagctatg

SEQ ID NO: 69242 - DNA, 20 bp, synthetic construct
  misc_feature 1..20: note = CRISPR gRNA sequence
  source 1..20: mol_type = other DNA
agcatcccactcagctatgt

SEQ ID NO: 69243 - DNA, 20 bp, synthetic construct
  misc_feature 1..20: note = CRISPR gRNA sequence
  source 1..20: mol_type = other DNA
gcatcccactcagctatgtt

SEQ ID NO: 69244 - DNA, 20 bp, synthetic construct
  misc_feature 1..20: note = CRISPR gRNA sequence
  source 1..20: mol_type = other DNA
agctatgttcagatcccaac

SEQ ID NO: 69245 - DNA, 20 bp, synthetic construct
  misc_feature 1..20: note = CRISPR gRNA sequence
  source 1..20: mol_type = other DNA
tgttcagatcccaactcagt

SEQ ID NO: 69246 - DNA, 20 bp, synthetic construct
  misc_feature 1..20: note = CRISPR gRNA sequence
  source 1..20: mol_type = other DNA
agatcccaactcagtcactt

SEQ ID NO: 69247 - DNA, 20 bp, synthetic construct
  misc_feature 1..20: note = CRISPR gRNA sequence
  source 1..20: mol_type = other DNA
agtcacttactggttggagc

SEQ ID NO: 69248 - DNA, 20 bp, synthetic construct
  misc_feature 1..20: note = CRISPR gRNA sequence
  source 1..20: mol_type = other DNA
actggttggagcccattact

SEQ ID NO: 69249 - DNA, 20 bp, synthetic construct
  misc_feature 1..20: note = CRISPR gRNA sequence
  source 1..20: mol_type = other DNA
ctggttggagcccattactg

SEQ ID NO: 69250 - DNA, 20 bp, synthetic construct
  misc_feature 1..20: note = CRISPR gRNA sequence
  source 1..20: mol_type = other DNA
gttggagcccattactgtgt

SEQ ID NO: 69251 - DNA, 20 bp, synthetic construct
  misc_feature 1..20: note = CRISPR gRNA sequence
  source 1..20: mol_type = other DNA
gagcccattactgtgtctct

SEQ ID NO: 69252 - DNA, 20 bp, synthetic construct
  misc_feature 1..20: note = CRISPR gRNA sequence
  source 1..20: mol_type = other DNA
ctgtgtctctctgacctcaa

SEQ ID NO: 69253 - DNA, 20 bp, synthetic construct
  misc_feature 1..20: note = CRISPR gRNA sequence
  source 1..20: mol_type = other DNA
tgtctctctgacctcaacct

SEQ ID NO: 69254 - DNA, 20 bp, synthetic construct
  misc_feature 1..20: note = CRISPR gRNA sequence
  source 1..20: mol_type = other DNA
tctgacctcaacctcctgct

SEQ ID NO: 69255 - DNA, 20 bp, synthetic construct
  misc_feature 1..20: note = CRISPR gRNA sequence
  source 1..20: mol_type = other DNA
tgacctcaacctcctgctct

SEQ ID NO: 69256 - DNA, 20 bp, synthetic construct
  misc_feature 1..20: note = CRISPR gRNA sequence
  source 1..20: mol_type = other DNA
acctcaacctcctgctctta

SEQ ID NO: 69257 - DNA, 20 bp, synthetic construct
  misc_feature 1..20: note = CRISPR gRNA sequence
  source 1..20: mol_type = other DNA
aacctcctgctcttaaaaga

SEQ ID NO: 69258 - DNA, 20 bp, synthetic construct
  misc_feature 1..20: note = CRISPR gRNA sequence
  source 1..20: mol_type = other DNA
ctgctcttaaaagagtctaa

SEQ ID NO: 69259 - DNA, 20 bp, synthetic construct
  misc_feature 1..20: note = CRISPR gRNA sequence
  source 1..20: mol_type = other DNA
ctcttaaaagagtctaatta

SEQ ID NO: 69260 - DNA, 20 bp, synthetic construct
  misc_feature 1..20: note = CRISPR gRNA sequence
  source 1..20: mol_type = other DNA
ttaaaagagtctaattacgg

SEQ ID NO: 69261 - DNA, 20 bp, synthetic construct
  misc_feature 1..20: note = CRISPR gRNA sequence
  source 1..20: mol_type = other DNA
aaaagagtctaattacggcc

SEQ ID NO: 69262 - DNA, 20 bp, synthetic construct
  misc_feature 1..20: note = CRISPR gRNA sequence
  source 1..20: mol_type = other DNA
aaagagtctaattacggccc

SEQ ID NO: 69263 - DNA, 20 bp, synthetic construct
  misc_feature 1..20: note = CRISPR gRNA sequence
  source 1..20: mol_type = other DNA
attacggccctttgcagggc

SEQ ID NO: 69264 - DNA, 20 bp, synthetic construct
  misc_feature 1..20: note = CRISPR gRNA sequence
  source 1..20: mol_type = other DNA
cggccctttgcagggctggg

SEQ ID NO: 69265 - DNA, 20 bp, synthetic construct
  misc_feature 1..20: note = CRISPR gRNA sequence
  source 1..20: mol_type = other DNA
tgcagggctgggaggattac

SEQ ID NO: 69266 - DNA, 20 bp, synthetic construct
  misc_feature 1..20: note = CRISPR gRNA sequence
  source 1..20: mol_type = other DNA
gcagggctgggaggattaca

SEQ ID NO: 69267 - DNA, 20 bp, synthetic construct
  misc_feature 1..20: note = CRISPR gRNA sequence
  source 1..20: mol_type = other DNA
cagggctgggaggattacaa

SEQ ID NO: 69268 - DNA, 20 bp, synthetic construct
  misc_feature 1..20: note = CRISPR gRNA sequence
  source 1..20: mol_type = other DNA
ggaggattacaagaactgga

SEQ ID NO: 69269 - DNA, 20 bp, synthetic construct
  misc_feature 1..20: note = CRISPR gRNA sequence
  source 1..20: mol_type = other DNA
caagaactggagcctgtaaa

SEQ ID NO: 69270 - DNA, 20 bp, synthetic construct
  misc_feature 1..20: note = CRISPR gRNA sequence
  source 1..20: mol_type = other DNA
gagcctgtaaagatgtctgc

SEQ ID NO: 69271 - DNA, 20 bp, synthetic construct
  misc_feature 1..20: note = CRISPR gRNA sequence
  source 1..20: mol_type = other DNA
taaagatgtctgctgtactg

SEQ ID NO: 69272 - DNA, 20 bp, synthetic construct
  misc_feature 1..20: note = CRISPR gRNA sequence
  source 1..20: mol_type = other DNA
ctgtactgtcaccagccaca

SEQ ID NO: 69273 - DNA, 20 bp, synthetic construct
  misc_feature 1..20: note = CRISPR gRNA sequence
  source 1..20: mol_type = other DNA
tactgtcaccagccacacag

SEQ ID NO: 69274 - DNA, 20 bp, synthetic construct
  misc_feature 1..20: note = CRISPR gRNA sequence
  source 1..20: mol_type = other DNA
tcaccagccacacagcctgc

SEQ ID NO: 69275 - DNA, 20 bp, synthetic construct
  misc_feature 1..20: note = CRISPR gRNA sequence
  source 1..20: mol_type = other DNA
ccctgcttcttccttctctc

SEQ ID NO: 69276 - DNA, 20 bp, synthetic construct
  misc_feature 1..20: note = CRISPR gRNA sequence
  source 1..20: mol_type = other DNA
cttcttccttctctcctcca

SEQ ID NO: 69277 - DNA, 20 bp, synthetic construct
  misc_feature 1..20: note = CRISPR gRNA sequence
  source 1..20: mol_type = other DNA
cttccttctctcctccagga

SEQ ID NO: 69278 - DNA, 20 bp, synthetic construct
  misc_feature 1..20: note = CRISPR gRNA sequence
  source 1..20: mol_type = other DNA
ttccttctctcctccaggag

SEQ ID NO: 69279 - DNA, 20 bp, synthetic construct
  misc_feature 1..20: note = CRISPR gRNA sequence
  source 1..20: mol_type = other DNA
ccttctctcctccaggagtg

SEQ ID NO: 69280 - DNA, 20 bp, synthetic construct
  misc_feature 1..20: note = CRISPR gRNA sequence
  source 1..20: mol_type = other DNA
cttctctcctccaggagtga

SEQ ID NO: 69281 - DNA, 20 bp, synthetic construct
  misc_feature 1..20: note = CRISPR gRNA sequence
  source 1..20: mol_type = other DNA
ctctcctccaggagtgagca

SEQ ID NO: 69282 - DNA, 20 bp, synthetic construct
  misc_feature 1..20: note = CRISPR gRNA sequence
  source 1..20: mol_type = other DNA
tctcctccaggagtgagcaa

SEQ ID NO: 69283 - DNA, 20 bp, synthetic construct
  misc_feature 1..20: note = CRISPR gRNA sequence
  source 1..20: mol_type = other DNA
tcctccaggagtgagcaagg

SEQ ID NO: 69284 - DNA, 20 bp, synthetic construct
  misc_feature 1..20: note = CRISPR gRNA sequence
  source 1..20: mol_type = other DNA
ctccaggagtgagcaagggg

SEQ ID NO: 69285 - DNA, 20 bp, synthetic construct
  misc_feature 1..20: note = CRISPR gRNA sequence
  source 1..20: mol_type = other DNA
caggagtgagcaaggggatg

SEQ ID NO: 69286 - DNA, 20 bp, synthetic construct
  misc_feature 1..20: note = CRISPR gRNA sequence
  source 1..20: mol_type = other DNA
tggggactttataatctccc

SEQ ID NO: 69287 - DNA, 20 bp, synthetic construct
  misc_feature 1..20: note = CRISPR gRNA sequence
  source 1..20: mol_type = other DNA
gggactttataatctcccat

SEQ ID NO: 69288 - DNA, 20 bp, synthetic construct
  misc_feature 1..20: note = CRISPR gRNA sequence
  source 1..20: mol_type = other DNA
tataatctcccatagccctc

SEQ ID NO: 69289 - DNA, 20 bp, synthetic construct
  misc_feature 1..20: note = CRISPR gRNA sequence
  source 1..20: mol_type = other DNA
ataatctcccatagccctct

SEQ ID NO: 69290 - DNA, 20 bp, synthetic construct
  misc_feature 1..20: note = CRISPR gRNA sequence
  source 1..20: mol_type = other DNA
taatctcccatagccctctc

SEQ ID NO: 69291 - DNA, 20 bp, synthetic construct
  misc_feature 1..20: note = CRISPR gRNA sequence
  source 1..20: mol_type = other DNA
ccatagccctctccccataa

SEQ ID NO: 69292 - DNA, 20 bp, synthetic construct
  misc_feature 1..20: note = CRISPR gRNA sequence
  source 1..20: mol_type = other DNA
tccccataagcaccccatga

SEQ ID NO: 69293 - DNA, 20 bp, synthetic construct
  misc_feature 1..20: note = CRISPR gRNA sequence
  source 1..20: mol_type = other DNA
cccataagcaccccatgaac

SEQ ID NO: 69294 - DNA, 20 bp, synthetic construct
  misc_feature 1..20: note = CRISPR gRNA sequence
  source 1..20: mol_type = other DNA
aagtgaaggcagtgagctta

SEQ ID NO: 69295 - DNA, 20 bp, synthetic construct
  misc_feature 1..20: note = CRISPR gRNA sequence
  source 1..20: mol_type = other DNA
agagcgcaaatgcagactcc

SEQ ID NO: 69296 - DNA, 20 bp, synthetic construct
  misc_feature 1..20: note = CRISPR gRNA sequence
  source 1..20: mol_type = other DNA
gagcgcaaatgcagactcca

SEQ ID NO: 69297 - DNA, 20 bp, synthetic construct
  misc_feature 1..20: note = CRISPR gRNA sequence
  source 1..20: mol_type = other DNA
cagacacatcccctacccca

SEQ ID NO: 69298 - DNA, 20 bp, synthetic construct
  misc_feature 1..20: note = CRISPR gRNA sequence
  source 1..20: mol_type = other DNA
ccccacccttccaccacact

SEQ ID NO: 69299 - DNA, 20 bp, synthetic construct
  misc_feature 1..20: note = CRISPR gRNA sequence
  source 1..20: mol_type = other DNA
ccaccacactgtggtccttg

SEQ ID NO: 69300 - DNA, 20 bp, synthetic construct
  misc_feature 1..20: note = CRISPR gRNA sequence
  source 1..20: mol_type = other DNA
caccacactgtggtccttgt

SEQ ID NO: 69301 - DNA, 20 bp, synthetic construct
  misc_feature 1..20: note = CRISPR gRNA sequence
  source 1..20: mol_type = other DNA
tggtccttgtgcccctccct

SEQ ID NO: 69302 - DNA, 20 bp, synthetic construct
  misc_feature 1..20: note = CRISPR gRNA sequence
  source 1..20: mol_type = other DNA
gtgcccctccctcagaaaat

SEQ ID NO: 69303 - DNA, 20 bp, synthetic construct
  misc_feature 1..20: note = CRISPR gRNA sequence
  source 1..20: mol_type = other DNA
tgcccctccctcagaaaatt

SEQ ID NO: 69304 - DNA, 20 bp, synthetic construct
  misc_feature 1..20: note = CRISPR gRNA sequence
  source 1..20: mol_type = other DNA
cctcagaaaattctggaact

SEQ ID NO: 69305 - DNA, 20 bp, synthetic construct
  misc_feature 1..20: note = CRISPR gRNA sequence
  source 1..20: mol_type = other DNA
agaaaattctggaactgccc

SEQ ID NO: 69306 - DNA, 20 bp, synthetic construct
  misc_feature 1..20: note = CRISPR gRNA sequence
  source 1..20: mol_type = other DNA
tggaactgcccttggatccc

SEQ ID NO: 69307 - DNA, 20 bp, synthetic construct
  misc_feature 1..20: note = CRISPR gRNA sequence
  source 1..20: mol_type = other DNA
gaactgcccttggatccctc

SEQ ID NO: 69308 - DNA, 20 bp, synthetic construct
  misc_feature 1..20: note = CRISPR gRNA sequence
  source 1..20: mol_type = other DNA
cccttggatccctctaatgg

SEQ ID NO: 69309 - DNA, 20 bp, synthetic construct
  misc_feature 1..20: note = CRISPR gRNA sequence
  source 1..20: mol_type = other DNA
ggatccctctaatggctttc

SEQ ID NO: 69310 - DNA, 20 bp, synthetic construct
  misc_feature 1..20: note = CRISPR gRNA sequence
  source 1..20: mol_type = other DNA
gatccctctaatggctttct

SEQ ID NO: 69311 - DNA, 20 bp, synthetic construct
  misc_feature 1..20: note = CRISPR gRNA sequence
  source 1..20: mol_type = other DNA
taatggctttctgtcatggt

SEQ ID NO: 69312 - DNA, 20 bp, synthetic construct
  misc_feature 1..20: note = CRISPR gRNA sequence
  source 1..20: mol_type = other DNA
atggctttctgtcatggtct

SEQ ID NO: 69313 - DNA, 20 bp, synthetic construct
  misc_feature 1..20: note = CRISPR gRNA sequence
  source 1..20: mol_type = other DNA
tctgtcatggtctgaaaagg

SEQ ID NO: 69314 - DNA, 20 bp, synthetic construct
  misc_feature 1..20: note = CRISPR gRNA sequence
  source 1..20: mol_type = other DNA
ctgtcatggtctgaaaaggc

SEQ ID NO: 69315 - DNA, 20 bp, synthetic construct
  misc_feature 1..20: note = CRISPR gRNA sequence
  source 1..20: mol_type = other DNA
tgtcatggtctgaaaaggct

SEQ ID NO: 69316 - DNA, 20 bp, synthetic construct
  misc_feature 1..20: note = CRISPR gRNA sequence
  source 1..20: mol_type = other DNA
tcatggtctgaaaaggctta

SEQ ID NO: 69317 - DNA, 20 bp, synthetic construct
  misc_feature 1..20: note = CRISPR gRNA sequence
  source 1..20: mol_type = other DNA
aaaaggcttatcaacttatt

SEQ ID NO: 69318 - DNA, 20 bp, synthetic construct
  misc_feature 1..20: note = CRISPR gRNA sequence
  source 1..20: mol_type = other DNA
atcaacttattaactttaaa

SEQ ID NO: 69319 - DNA, 20 bp, synthetic construct
  misc_feature 1..20: note = CRISPR gRNA sequence
  source 1..20: mol_type = other DNA
tcaacttattaactttaaat

SEQ ID NO: 69320 - DNA, 20 bp, synthetic construct
  misc_feature 1..20: note = CRISPR gRNA sequence
  source 1..20: mol_type = other DNA
attaactttaaattgttgaa

SEQ ID NO: 69321 - DNA, 20 bp, synthetic construct
  misc_feature 1..20: note = CRISPR gRNA sequence
  source 1..20: mol_type = other DNA
ttaactttaaattgttgaaa

SEQ ID NO: 69322 - DNA, 20 bp, synthetic construct
  misc_feature 1..20: note = CRISPR gRNA sequence
  source 1..20: mol_type = other DNA
actttaaattgttgaaaagg

SEQ ID NO: 69323 - DNA, 20 bp, synthetic construct
  misc_feature 1..20: note = CRISPR gRNA sequence
  source 1..20: mol_type = other DNA
taaattgttgaaaagggcca

SEQ ID NO: 69324 - DNA, 20 bp, synthetic construct
  misc_feature 1..20: note = CRISPR gRNA sequence
  source 1..20: mol_type = other DNA
aaattgttgaaaagggccag

SEQ ID NO: 69325 - DNA, 20 bp, synthetic construct
  misc_feature 1..20: note = CRISPR gRNA sequence
  source 1..20: mol_type = other DNA
aattgttgaaaagggccagg

SEQ ID NO: 69326 - DNA, 20 bp, synthetic construct
  misc_feature 1..20: note = CRISPR gRNA sequence
  source 1..20: mol_type = other DNA
ttgaaaagggccaggcgcgg

SEQ ID NO: 69327 - DNA, 20 bp, synthetic construct
  misc_feature 1..20: note = CRISPR gRNA sequence
  source 1..20: mol_type = other DNA
aaaagggccaggcgcggtgg

SEQ ID NO: 69328 - DNA, 20 bp, synthetic construct
  misc_feature 1..20: note = CRISPR gRNA sequence
  source 1..20: mol_type = other DNA
acgcctgtaaccccagcact

SEQ ID NO: 69329 - DNA, 20 bp, synthetic construct
  misc_feature 1..20: note = CRISPR gRNA sequence
  source 1..20: mol_type = other DNA
taaccccagcactttgggag

SEQ ID NO: 69330 - DNA, 20 bp, synthetic construct
  misc_feature 1..20: note = CRISPR gRNA sequence
  source 1..20: mol_type = other DNA
tgggaggccgaggcaggagg

SEQ ID NO: 69331 - DNA, 20 bp, synthetic construct
  misc_feature 1..20: note = CRISPR gRNA sequence
  source 1..20: mol_type = other DNA
gggaggccgaggcaggagga

SEQ ID NO: 69332 - DNA, 20 bp, synthetic construct
  misc_feature 1..20: note = CRISPR gRNA sequence
  source 1..20: mol_type = other DNA
ggaggccgaggcaggaggat

SEQ ID NO: 69333 - DNA, 20 bp, synthetic construct
  misc_feature 1..20: note = CRISPR gRNA sequence
  source 1..20: mol_type = other DNA
aagcccagagttcaaggctg

SEQ ID NO: 69334 - DNA, 20 bp, synthetic construct
  misc_feature 1..20: note = CRISPR gRNA sequence
  source 1..20: mol_type = other DNA
aaggctgcagtgagctatga

SEQ ID NO: 69335 - DNA, 20 bp, synthetic construct
  misc_feature 1..20: note = CRISPR gRNA sequence
  source 1..20: mol_type = other DNA
cagtgagctatgatcgtgcc

SEQ ID NO: 69336 - DNA, 20 bp, synthetic construct
  misc_feature 1..20: note = CRISPR gRNA sequence
  source 1..20: mol_type = other DNA
tgatcgtgcccaccactgca

SEQ ID NO: 69337 - DNA, 20 bp, synthetic construct
  misc_feature 1..20: note = CRISPR gRNA sequence
  source 1..20: mol_type = other DNA
cacttcagcctgggctacag

SEQ ID NO: 69338 - DNA, 20 bp, synthetic construct
  misc_feature 1..20: note = CRISPR gRNA sequence
  source 1..20: mol_type = other DNA
cagcctgggctacagagcaa

SEQ ID NO: 69339 - DNA, 20 bp, synthetic construct
  misc_feature 1..20: note = CRISPR gRNA sequence
  source 1..20: mol_type = other DNA
agcctgggctacagagcaag

SEQ ID NO: 69340 - DNA, 20 bp, synthetic construct
  misc_feature 1..20: note = CRISPR gRNA sequence
  source 1..20: mol_type = other DNA
ggctacagagcaagaccctg

SEQ ID NO: 69341 - DNA, 20 bp, synthetic construct
  misc_feature 1..20: note = CRISPR gRNA sequence
  source 1..20: mol_type = other DNA
cagagcaagaccctgtctct

SEQ ID NO: 69342 - DNA, 20 bp, synthetic construct
  misc_feature 1..20: note = CRISPR gRNA sequence
  source 1..20: mol_type = other DNA
tctctttaaaaaaaaaaaaa

SEQ ID NO: 69343 - DNA, 20 bp, synthetic construct
  misc_feature 1..20: note = CRISPR gRNA sequence
  source 1..20: mol_type = other DNA
tttaaaaaaaaaaaaaaaga

SEQ ID NO: 69344 - DNA, 20 bp, synthetic construct
  misc_feature 1..20: note = CRISPR gRNA sequence
  source 1..20: mol_type = other DNA
taaaaaaaaaaaaaaagaaa

SEQ ID NO: 69345 - DNA, 20 bp, synthetic construct
  misc_feature 1..20: note = CRISPR gRNA sequence
  source 1..20: mol_type = other DNA
aaaaaaaaaaaaaaagaaag

SEQ ID NO: 69346 - DNA, 20 bp, synthetic construct
  misc_feature 1..20: note = CRISPR gRNA sequence
  source 1..20: mol_type = other DNA
aaaaaaaaaaaaaagaaaga

SEQ ID NO: 69347 - DNA, 20 bp, synthetic construct
  misc_feature 1..20: note = CRISPR gRNA sequence
  source 1..20: mol_type = other DNA
ttgaaaaggcactacttggg

SEQ ID NO: 69348 - DNA, 20 bp, synthetic construct
  misc_feature 1..20: note = CRISPR gRNA sequence
  source 1..20: mol_type = other DNA
aaaaggcactacttggggta

SEQ ID NO: 69349 - DNA, 20 bp, synthetic construct
  misc_feature 1..20: note = CRISPR gRNA sequence
  source 1..20: mol_type = other DNA
cttggggtattgtgtgtgac

SEQ ID NO: 69350 - DNA, 20 bp, synthetic construct
  misc_feature 1..20: note = CRISPR gRNA sequence
  source 1..20: mol_type = other DNA
ggggtattgtgtgtgactca

SEQ ID NO: 69351 - DNA, 20 bp, synthetic construct
  misc_feature 1..20: note = CRISPR gRNA sequence
  source 1..20: mol_type = other DNA
gggtattgtgtgtgactcac

SEQ ID NO: 69352 - DNA, 20 bp, synthetic construct
  misc_feature 1..20: note = CRISPR gRNA sequence
  source 1..20: mol_type = other DNA
tgtgtgactcacggaagcac

SEQ ID NO: 69353 - DNA, 20 bp, synthetic construct
  misc_feature 1..20: note = CRISPR gRNA sequence
  source 1..20: mol_type = other DNA
acggaagcacctactttcca

SEQ ID NO: 69354 - DNA, 20 bp, synthetic construct
  misc_feature 1..20: note = CRISPR gRNA sequence
  source 1..20: mol_type = other DNA
ctttccagtcctaagctggt

SEQ ID NO: 69355 - DNA, 20 bp, synthetic construct
  misc_feature 1..20: note = CRISPR gRNA sequence
  source 1..20: mol_type = other DNA
tccagtcctaagctggtccc

SEQ ID NO: 69356 - DNA, 20 bp, synthetic construct
  misc_feature 1..20: note = CRISPR gRNA sequence
  source 1..20: mol_type = other DNA
ccagtcctaagctggtccct

SEQ ID NO: 69357 - DNA, 20 bp, synthetic construct
  misc_feature 1..20: note = CRISPR gRNA sequence
  source 1..20: mol_type = other DNA
cagtcctaagctggtccctg

SEQ ID NO: 69358 - DNA, 20 bp, synthetic construct
  misc_feature 1..20: note = CRISPR gRNA sequence
  source 1..20: mol_type = other DNA
agctggtccctggcagggga

SEQ ID NO: 69359 - DNA, 20 bp, synthetic construct
  misc_feature 1..20: note = CRISPR gRNA sequence
  source 1..20: mol_type = other DNA
gtccctggcaggggagaagg

SEQ ID NO: 69360 - DNA, 20 bp, synthetic construct
  misc_feature 1..20: note = CRISPR gRNA sequence
  source 1..20: mol_type = other DNA
gcaggggagaaggggaccca

SEQ ID NO: 69361 - DNA, 20 bp, synthetic construct
  misc_feature 1..20: note = CRISPR gRNA sequence
  source 1..20: mol_type = other DNA
agagttggagccgggcagcc

SEQ ID NO: 69362 - DNA, 20 bp, synthetic construct
  misc_feature 1..20: note = CRISPR gRNA sequence
  source 1..20: mol_type = other DNA
gagccgggcagcccaggtgc

SEQ ID NO: 69363 - DNA, 20 bp, synthetic construct
  misc_feature 1..20: note = CRISPR gRNA sequence
  source 1..20: mol_type = other DNA
ggccctccggggaaggctgc

SEQ ID NO: 69364 - DNA, 20 bp, synthetic construct
  misc_feature 1..20: note = CRISPR gRNA sequence
  source 1..20: mol_type = other DNA
cggggaaggctgcccgacct

SEQ ID NO: 69365 - DNA, 20 bp, synthetic construct
  misc_feature 1..20: note = CRISPR gRNA sequence
  source 1..20: mol_type = other DNA
cccgacctcacgttggttac

SEQ ID NO: 69366 - DNA, 20 bp, synthetic construct
  misc_feature 1..20: note = CRISPR gRNA sequence
  source 1..20: mol_type = other DNA
acgttggttactgctcactc

SEQ ID NO: 69367 - DNA, 20 bp, synthetic construct
  misc_feature 1..20: note = CRISPR gRNA sequence
  source 1..20: mol_type = other DNA
gttactgctcactcctcagc

SEQ ID NO: 69368 - DNA, 20 bp, synthetic construct
  misc_feature 1..20: note = CRISPR gRNA sequence
  source 1..20: mol_type = other DNA
ctgctcactcctcagcatct

SEQ ID NO: 69369 - DNA, 20 bp, synthetic construct
  misc_feature 1..20: note = CRISPR gRNA sequence
  source 1..20: mol_type = other DNA
ctcactcctcagcatctccg

SEQ ID NO: 69370 - DNA, 20 bp, synthetic construct
  misc_feature 1..20: note = CRISPR gRNA sequence
  source 1..20: mol_type = other DNA
actcctcagcatctccgaga

SEQ ID NO: 69371 - DNA, 20 bp, synthetic construct
  misc_feature 1..20: note = CRISPR gRNA sequence
  source 1..20: mol_type = other DNA
ctcagcatctccgagaccca

SEQ ID NO: 69372 - DNA, 20 bp, synthetic construct
  misc_feature 1..20: note = CRISPR gRNA sequence
  source 1..20: mol_type = other DNA
agcatctccgagacccagca

SEQ ID NO: 69373 - DNA, 20 bp, synthetic construct
  misc_feature 1..20: note = CRISPR gRNA sequence
  source 1..20: mol_type = other DNA
cgagacccagcagcagctct

SEQ ID NO: 69374 - DNA, 20 bp, synthetic construct
  misc_feature 1..20: note = CRISPR gRNA sequence
  source 1..20: mol_type = other DNA
tgtgtccagctggaatttcc

SEQ ID NO: 69375 - DNA, 20 bp, synthetic construct
  misc_feature 1..20: note = CRISPR gRNA sequence
  source 1..20: mol_type = other DNA
tgtccagctggaatttcctc

SEQ ID NO: 69376 - DNA, 20 bp, synthetic construct
  misc_feature 1..20: note = CRISPR gRNA sequence
  source 1..20: mol_type = other DNA
gaatttcctcgccaggaaga

SEQ ID NO: 69377 - DNA, 20 bp, synthetic construct
  misc_feature 1..20: note = CRISPR gRNA sequence
  source 1..20: mol_type = other DNA
cctcgccaggaagagaatcc

SEQ ID NO: 69378 - DNA, 20 bp, synthetic construct
  misc_feature 1..20: note = CRISPR gRNA sequence
  source 1..20: mol_type = other DNA
ctcgccaggaagagaatcca

SEQ ID NO: 69379 - DNA, 20 bp, synthetic construct
  misc_feature 1..20: note = CRISPR gRNA sequence
  source 1..20: mol_type = other DNA
gccaggaagagaatccagaa

SEQ ID NO: 69380 - DNA, 20 bp, synthetic construct
  misc_feature 1..20: note = CRISPR gRNA sequence
  source 1..20: mol_type = other DNA
tggcactcaggtgggaccca

SEQ ID NO: 69381 - DNA, 20 bp, synthetic construct
  misc_feature 1..20: note = CRISPR gRNA sequence
  source 1..20: mol_type = other DNA
aggtgggacccagcaccagg

SEQ ID NO: 69382 - DNA, 20 bp, synthetic construct
  misc_feature 1..20: note = CRISPR gRNA sequence
  source 1..20: mol_type = other DNA
gtgttggggagggggcaggg

SEQ ID NO: 69383 - DNA, 20 bp, synthetic construct
  misc_feature 1..20: note = CRISPR gRNA sequence
  source 1..20: mol_type = other DNA
gggagggggcagggctgctt

SEQ ID NO: 69384 - DNA, 20 bp, synthetic construct
  misc_feature 1..20: note = CRISPR gRNA sequence
  source 1..20: mol_type = other DNA
cttctgaccaatattcacca

SEQ ID NO: 69385 - DNA, 20 bp, synthetic construct
  misc_feature 1..20: note = CRISPR gRNA sequence
  source 1..20: mol_type = other DNA
ctgaccaatattcaccaccc

SEQ ID NO: 69386 - DNA, 20 bp, synthetic construct
  misc_feature 1..20: note = CRISPR gRNA sequence
  source 1..20: mol_type = other DNA
tgaccaatattcaccaccct

SEQ ID NO: 69387 - DNA, 20 bp, synthetic construct
  misc_feature 1..20: note = CRISPR gRNA sequence
  source 1..20: mol_type = other DNA
accaatattcaccaccctgc

SEQ ID NO: 69388 - DNA, 20 bp, synthetic construct
  misc_feature 1..20: note = CRISPR gRNA sequence
  source 1..20: mol_type = other DNA
accaccctgcccagagacct

SEQ ID NO: 69389 - DNA, 20 bp, synthetic construct
  misc_feature 1..20: note = CRISPR gRNA sequence
  source 1..20: mol_type = other DNA
cccagagaccttaggggttc

SEQ ID NO: 69390 - DNA, 20 bp, synthetic construct
  misc_feature 1..20: note = CRISPR gRNA sequence
  source 1..20: mol_type = other DNA
aggggttcgaagtctttaca

SEQ ID NO: 69391 - DNA, 20 bp, synthetic construct
  misc_feature 1..20: note = CRISPR gRNA sequence
  source 1..20: mol_type = other DNA
ggggttcgaagtctttacac

SEQ ID NO: 69392 - DNA, 20 bp, synthetic construct
  misc_feature 1..20: note = CRISPR gRNA sequence
  source 1..20: mol_type = other DNA
gaagtctttacacaggctac

SEQ ID NO: 69393 - DNA, 20 bp, synthetic construct
  misc_feature 1..20: note = CRISPR gRNA sequence
  source 1..20: mol_type = other DNA
tacacaggctacagaggtct

SEQ ID NO: 69394 - DNA, 20 bp, synthetic construct
  misc_feature 1..20: note = CRISPR gRNA sequence
  source 1..20: mol_type = other DNA
acacaggctacagaggtctg

SEQ ID NO: 69395 - DNA, 20 bp, synthetic construct
  misc_feature 1..20: note = CRISPR gRNA sequence
  source 1..20: mol_type = other DNA
cacaggctacagaggtctga

SEQ ID NO: 69396 - DNA, 20 bp, synthetic construct
  misc_feature 1..20: note = CRISPR gRNA sequence
  source 1..20: mol_type = other DNA
cagaggtctgaccaacccac

SEQ ID NO: 69397 - DNA, 20 bp, synthetic construct
  misc_feature 1..20: note = CRISPR gRNA sequence
  source 1..20: mol_type = other DNA
accaacccacttctgaggcg

SEQ ID NO: 69398 - DNA, 20 bp, synthetic construct
  misc_feature 1..20: note = CRISPR gRNA sequence
  source 1..20: mol_type = other DNA
ctgaggcgtttcagccccac

SEQ ID NO: 69399 - DNA, 20 bp, synthetic construct
  misc_feature 1..20: note = CRISPR gRNA sequence
  source 1..20: mol_type = other DNA
tgaggcgtttcagccccact

SEQ ID NO: 69400 - DNA, 20 bp, synthetic construct
  misc_feature 1..20: note = CRISPR gRNA sequence
  source 1..20: mol_type = other DNA
aggcgtttcagccccactcc

SEQ ID NO: 69401 - DNA, 20 bp, synthetic construct
  misc_feature 1..20: note = CRISPR gRNA sequence
  source 1..20: mol_type = other DNA
cagccccactccaggcccca

SEQ ID NO: 69402 - DNA, 20 bp, synthetic construct
  misc_feature 1..20: note = CRISPR gRNA sequence
  source 1..20: mol_type = other DNA
agccccactccaggccccag

SEQ ID NO: 69403 - DNA, 20 bp, synthetic construct
  misc_feature 1..20: note = CRISPR gRNA sequence
  source 1..20: mol_type = other DNA
caggccccagtctcagctcc

SEQ ID NO: 69404 - DNA, 20 bp, synthetic construct
  misc_feature 1..20: note = CRISPR gRNA sequence
  source 1..20: mol_type = other DNA
agctccagtcacccccatga

SEQ ID NO: 69405 - DNA, 20 bp, synthetic construct
  misc_feature 1..20: note = CRISPR gRNA sequence
  source 1..20: mol_type = other DNA
cagtcacccccatgaacttt

SEQ ID NO: 69406 - DNA, 20 bp, synthetic construct
  misc_feature 1..20: note = CRISPR gRNA sequence
  source 1..20: mol_type = other DNA
tcagttccccgaacaccatc

SEQ ID NO: 69407 - DNA, 20 bp, synthetic construct
  misc_feature 1..20: note = CRISPR gRNA sequence
  source 1..20: mol_type = other DNA
cagttccccgaacaccatct

SEQ ID NO: 69408 - DNA, 20 bp, synthetic construct
  misc_feature 1..20: note = CRISPR gRNA sequence
  source 1..20: mol_type = other DNA
agttccccgaacaccatctt

SEQ ID NO: 69409 - DNA, 20 bp, synthetic construct
  misc_feature 1..20: note = CRISPR gRNA sequence
  source 1..20: mol_type = other DNA
cccgaacaccatcttgctta

SEQ ID NO: 69410 - DNA, 20 bp, synthetic construct
  misc_feature 1..20: note = CRISPR gRNA sequence
  source 1..20: mol_type = other DNA
gcttagaccttagggcattt

SEQ ID NO: 69411 - DNA, 20 bp, synthetic construct
  misc_feature 1..20: note = CRISPR gRNA sequence
  source 1..20: mol_type = other DNA
cttagaccttagggcatttg

SEQ ID NO: 69412 - DNA, 20 bp, synthetic construct
  misc_feature 1..20: note = CRISPR gRNA sequence
  source 1..20: mol_type = other DNA
agaccttagggcatttgcac

SEQ ID NO: 69413 - DNA, 20 bp, synthetic construct
  misc_feature 1..20: note = CRISPR gRNA sequence
  source 1..20: mol_type = other DNA
gaccttagggcatttgcaca

SEQ ID NO: 69414 - DNA, 20 bp, synthetic construct
  misc_feature 1..20: note = CRISPR gRNA sequence
  source 1..20: mol_type = other DNA
agggcatttgcacaggctgt

SEQ ID NO: 69415 - DNA, 20 bp, synthetic construct
  misc_feature 1..20: note = CRISPR gRNA sequence
  source 1..20: mol_type = other DNA
gggcatttgcacaggctgtg

SEQ ID NO: 69416 - DNA, 20 bp, synthetic construct
  misc_feature 1..20: note = CRISPR gRNA sequence
  source 1..20: mol_type = other DNA
gcacaggctgtgctctctgc

SEQ ID NO: 69417 - DNA, 20 bp, synthetic construct
  misc_feature 1..20: note = CRISPR gRNA sequence
  source 1..20: mol_type = other DNA
cacaggctgtgctctctgcc

SEQ ID NO: 69418 - DNA, 20 bp, synthetic construct
  misc_feature 1..20: note = CRISPR gRNA sequence
  source 1..20: mol_type = other DNA
tgctctctgcccagaatgtt

SEQ ID NO: 69419 - DNA, 20 bp, synthetic construct
  misc_feature 1..20: note = CRISPR gRNA sequence
  source 1..20: mol_type = other DNA
tctgcccagaatgttctctt

SEQ ID NO: 69420 - DNA, 20 bp, synthetic construct
  misc_feature 1..20: note = CRISPR gRNA sequence
  source 1..20: mol_type = other DNA
tgcccagaatgttctcttca

SEQ ID NO: 69421 - DNA, 20 bp, synthetic construct
  misc_feature 1..20: note = CRISPR gRNA sequence
  source 1..20: mol_type = other DNA
cccagaatgttctcttcacg

SEQ ID NO: 69422 - DNA, 20 bp, synthetic construct
  misc_feature 1..20: note = CRISPR gRNA sequence
  source 1..20: mol_type = other DNA
tcttcacgcctacctgcttc

SEQ ID NO: 69423 - DNA, 20 bp, synthetic construct
  misc_feature 1..20: note = CRISPR gRNA sequence
  source 1..20: mol_type = other DNA
ttcacgcctacctgcttcac

SEQ ID NO: 69424 - DNA, 20 bp, synthetic construct
  misc_feature 1..20: note = CRISPR gRNA sequence
  source 1..20: mol_type = other DNA
cacgcctacctgcttcacct

SEQ ID NO: 69425 - DNA, 20 bp, synthetic construct
  misc_feature 1..20: note = CRISPR gRNA sequence
  source 1..20: mol_type = other DNA
acgcctacctgcttcacctg

SEQ ID NO: 69426 - DNA, 20 bp, synthetic construct
  misc_feature 1..20: note = CRISPR gRNA sequence
  source 1..20: mol_type = other DNA
cctgcttcacctgcctaact

SEQ ID NO: 69427 - DNA, 20 bp, synthetic construct
  misc_feature 1..20: note = CRISPR gRNA sequence
  source 1..20: mol_type = other DNA
cttcacctgcctaactcctc

SEQ ID NO: 69428 - DNA, 20 bp, synthetic construct
  misc_feature 1..20: note = CRISPR gRNA sequence
  source 1..20: mol_type = other DNA
cacctgcctaactcctcctc

SEQ ID NO: 69429 - DNA, 20 bp, synthetic construct
  misc_feature 1..20: note = CRISPR gRNA sequence
  source 1..20: mol_type = other DNA
acctgcctaactcctcctca

SEQ ID NO: 69430 - DNA, 20 bp, synthetic construct
  misc_feature 1..20: note = CRISPR gRNA sequence
  source 1..20: mol_type = other DNA
cctaactcctcctcatccct

SEQ ID NO: 69431 - DNA, 20 bp, synthetic construct
  misc_feature 1..20: note = CRISPR gRNA sequence
  source 1..20: mol_type = other DNA
actcctcctcatccctcagg

SEQ ID NO: 69432 - DNA, 20 bp, synthetic construct
  misc_feature 1..20: note = CRISPR gRNA sequence
  source 1..20: mol_type = other DNA
ctcctcatccctcaggtctc

SEQ ID NO: 69433 - DNA, 20 bp, synthetic construct
  misc_feature 1..20: note = CRISPR gRNA sequence
  source 1..20: mol_type = other DNA
ctcatccctcaggtctcagc

SEQ ID NO: 69434 - DNA, 20 bp, synthetic construct
  misc_feature 1..20: note = CRISPR gRNA sequence
  source 1..20: mol_type = other DNA
atccctcaggtctcagctta

SEQ ID NO: 69435 - DNA, 20 bp, synthetic construct
  misc_feature 1..20: note = CRISPR gRNA sequence
  source 1..20: mol_type = other DNA
aggtctcagcttaaatgcca

SEQ ID NO: 69436 - DNA, 20 bp, synthetic construct
  misc_feature 1..20: note = CRISPR gRNA sequence
  source 1..20: mol_type = other DNA
agcttaaatgccaccacctc

SEQ ID NO: 69437 - DNA, 20 bp, synthetic construct
  misc_feature 1..20: note = CRISPR gRNA sequence
  source 1..20: mol_type = other DNA
aaatgccaccacctcaggga

SEQ ID NO: 69438 - DNA, 20 bp, synthetic construct
  misc_feature 1..20: note = CRISPR gRNA sequence
  source 1..20: mol_type = other DNA
aatgccaccacctcagggag

SEQ ID NO: 69439 - DNA, 20 bp, synthetic construct
  misc_feature 1..20: note = CRISPR gRNA sequence
  source 1..20: mol_type = other DNA
agggaggccccctggacccc

SEQ ID NO: 69440 - DNA, 20 bp, synthetic construct
  misc_feature 1..20: note = CRISPR gRNA sequence
  source 1..20: mol_type = other DNA
gaccccaaggcttagtcaaa

SEQ ID NO: 69441 - DNA, 20 bp, synthetic construct
  misc_feature 1..20: note = CRISPR gRNA sequence
  source 1..20: mol_type = other DNA
agtcaaacacttccattatc

SEQ ID NO: 69442 - DNA, 20 bp, synthetic construct
  misc_feature 1..20: note = CRISPR gRNA sequence
  source 1..20: mol_type = other DNA
gtcaaacacttccattatcc

SEQ ID NO: 69443 - DNA, 20 bp, synthetic construct
  misc_feature 1..20: note = CRISPR gRNA sequence
  source 1..20: mol_type = other DNA
ccattatccactcttataga

SEQ ID NO: 69444 - DNA, 20 bp, synthetic construct
  misc_feature 1..20: note = CRISPR gRNA sequence
  source 1..20: mol_type = other DNA
cattatccactcttatagat

SEQ ID NO: 69445 - DNA, 20 bp, synthetic construct
  misc_feature 1..20: note = CRISPR gRNA sequence
  source 1..20: mol_type = other DNA
tccactcttatagatccctg

SEQ ID NO: 69446 - DNA, 20 bp, synthetic construct
  misc_feature 1..20: note = CRISPR gRNA sequence
  source 1..20: mol_type = other DNA
ttatagatccctggattcac

SEQ ID NO: 69447 - DNA, 20 bp, synthetic construct
  misc_feature 1..20: note = CRISPR gRNA sequence
  source 1..20: mol_type = other DNA
atagatccctggattcacag

SEQ ID NO: 69448 - DNA, 20 bp, synthetic construct
  misc_feature 1..20: note = CRISPR gRNA sequence
  source 1..20: mol_type = other DNA
tagatccctggattcacagc

SEQ ID NO: 69449 - DNA, 20 bp, synthetic construct
  misc_feature 1..20: note = CRISPR gRNA sequence
  source 1..20: mol_type = other DNA
gattcacagcacctctaaat

SEQ ID NO: 69450 - DNA, 20 bp, synthetic construct
  misc_feature 1..20: note = CRISPR gRNA sequence
  source 1..20: mol_type = other DNA
acagcacctctaaatccata

SEQ ID NO: 69451 - DNA, 20 bp, synthetic construct
  misc_feature 1..20: note = CRISPR gRNA sequence
  source 1..20: mol_type = other DNA
taaatccatatggcacagtt

SEQ ID NO: 69452 - DNA, 20 bp, synthetic construct
  misc_feature 1..20: note = CRISPR gRNA sequence
  source 1..20: mol_type = other DNA
aatccatatggcacagtttg

SEQ ID NO: 69453 - DNA, 20 bp, synthetic construct
  misc_feature 1..20: note = CRISPR gRNA sequence
  source 1..20: mol_type = other DNA
gggaaattaaaatgtcaccc

SEQ ID NO: 69454 - DNA, 20 bp, synthetic construct
  misc_feature 1..20: note = CRISPR gRNA sequence
  source 1..20: mol_type = other DNA
ggaaattaaaatgtcaccct

SEQ ID NO: 69455 - DNA, 20 bp, synthetic construct
  misc_feature 1..20: note = CRISPR gRNA sequence
  source 1..20: mol_type = other DNA
aaatgtcacccttttgagtg

SEQ ID NO: 69456 - DNA, 20 bp, synthetic construct
  misc_feature 1..20: note = CRISPR gRNA sequence
  source 1..20: mol_type = other DNA
ttgagtggatgcagccctgc

SEQ ID NO: 69457 - DNA, 20 bp, synthetic construct
  misc_feature 1..20: note = CRISPR gRNA sequence
  source 1..20: mol_type = other DNA
tgagtggatgcagccctgca

SEQ ID NO: 69458 - DNA, 20 bp, synthetic construct
  misc_feature 1..20: note = CRISPR gRNA sequence
  source 1..20: mol_type = other DNA
gagtggatgcagccctgcat

SEQ ID NO: 69459 - DNA, 20 bp, synthetic construct
  misc_feature 1..20: note = CRISPR gRNA sequence
  source 1..20: mol_type = other DNA
agtggatgcagccctgcatg

SEQ ID NO: 69460 - DNA, 20 bp, synthetic construct
  misc_feature 1..20: note = CRISPR gRNA sequence
  source 1..20: mol_type = other DNA
catgtgtacattctgggaaa

SEQ ID NO: 69461 - DNA, 20 bp, synthetic construct
  misc_feature 1..20: note = CRISPR gRNA sequence
  source 1..20: mol_type = other DNA
tgggaaatagagcatggtag

SEQ ID NO: 69462 - DNA, 20 bp, synthetic construct
  misc_feature 1..20: note = CRISPR gRNA sequence
  source 1..20: mol_type = other DNA
ggaaatagagcatggtagga

SEQ ID NO: 69463 - DNA, 20 bp, synthetic construct
  misc_feature 1..20: note = CRISPR gRNA sequence
  source 1..20: mol_type = other DNA
agcctcacctcacctcctcg

SEQ ID NO: 69464 - DNA, 20 bp, synthetic construct
  misc_feature 1..20: note = CRISPR gRNA sequence
  source 1..20: mol_type = other DNA
acctcacctcctcggctgtg

SEQ ID NO: 69465 - DNA, 20 bp, synthetic construct
  misc_feature 1..20: note = CRISPR gRNA sequence
  source 1..20: mol_type = other DNA
acctcctcggctgtgtgtcc

SEQ ID NO: 69466 - DNA, 20 bp, synthetic construct
  misc_feature 1..20: note = CRISPR gRNA sequence
  source 1..20: mol_type = other DNA
ctcggctgtgtgtccttgtg

SEQ ID NO: 69467 - DNA, 20 bp, synthetic construct
  misc_feature 1..20: note = CRISPR gRNA sequence
  source 1..20: mol_type = other DNA
ggctgtgtgtccttgtgcgg

SEQ ID NO: 69468 - DNA, 20 bp, synthetic construct
  misc_feature 1..20: note = CRISPR gRNA sequence
  source 1..20: mol_type = other DNA
tgtgtccttgtgcggtgaac

SEQ ID NO: 69469 - DNA, 20 bp, synthetic construct
  misc_feature 1..20: note = CRISPR gRNA sequence
  source 1..20: mol_type = other DNA
gtgcggtgaacaacctgcac

SEQ ID NO: 69470 - DNA, 20 bp, synthetic construct
  misc_feature 1..20: note = CRISPR gRNA sequence
  source 1..20: mol_type = other DNA
tgcggtgaacaacctgcaca

SEQ ID NO: 69471 - DNA, 20 bp, synthetic construct
  misc_feature 1..20: note = CRISPR gRNA sequence
  source 1..20: mol_type = other DNA
cacaaccataccagctgccc

SEQ ID NO: 69472 - DNA, 20 bp, synthetic construct
  misc_feature 1..20: note = CRISPR gRNA sequence
  source 1..20: mol_type = other DNA
ccccatctggactcctgctt

SEQ ID NO: 69473 - DNA, 20 bp, synthetic construct
  misc_feature 1..20: note = CRISPR gRNA sequence
  source 1..20: mol_type = other DNA
gactcctgcttcctagcact

SEQ ID NO: 69474 - DNA, 20 bp, synthetic construct
  misc_feature 1..20: note = CRISPR gRNA sequence
  source 1..20: mol_type = other DNA
ctgcttcctagcacttctca

SEQ ID NO: 69475 - DNA, 20 bp, synthetic construct
  misc_feature 1..20: note = CRISPR gRNA sequence
  source 1..20: mol_type = other DNA
cttcctagcacttctcataa

SEQ ID NO: 69476 - DNA, 20 bp, synthetic construct
  misc_feature 1..20: note = CRISPR gRNA sequence
  source 1..20: mol_type = other DNA
cctagcacttctcataagtg

SEQ ID NO: 69477 - DNA, 20 bp, synthetic construct
  misc_feature 1..20: note = CRISPR gRNA sequence
  source 1..20: mol_type = other DNA
ctagcacttctcataagtga

SEQ ID NO: 69478 - DNA, 20 bp, synthetic construct
  misc_feature 1..20: note = CRISPR gRNA sequence
  source 1..20: mol_type = other DNA
gcacttctcataagtgaata

SEQ ID NO: 69479 - DNA, 20 bp, synthetic construct
  misc_feature 1..20: note = CRISPR gRNA sequence
  source 1..20: mol_type = other DNA
ctcataagtgaatagcaaac

SEQ ID NO: 69480 - DNA, 20 bp, synthetic construct
  misc_feature 1..20: note = CRISPR gRNA sequence
  source 1..20: mol_type = other DNA
tcataagtgaatagcaaact

SEQ ID NO: 69481 - DNA, 20 bp, synthetic construct
  misc_feature 1..20: note = CRISPR gRNA sequence
  source 1..20: mol_type = other DNA
ataagtgaatagcaaactgt

SEQ ID NO: 69482 - DNA, 20 bp, synthetic construct
  misc_feature 1..20: note = CRISPR gRNA sequence
  source 1..20: mol_type = other DNA
taggacttcatttgatcagc

SEQ ID NO: 69483 - DNA, 20 bp, synthetic construct
  misc_feature 1..20: note = CRISPR gRNA sequence
  source 1..20: mol_type = other DNA
catttgatcagcatttattt

SEQ ID NO: 69484 - DNA, 20 bp, synthetic construct
  misc_feature 1..20: note = CRISPR gRNA sequence
  source 1..20: mol_type = other DNA
atttgatcagcatttattta

SEQ ID NO: 69485 - DNA, 20 bp, synthetic construct
  misc_feature 1..20: note = CRISPR gRNA sequence
  source 1..20: mol_type = other DNA
gatcagcatttatttacccc

SEQ ID NO: 69486 - DNA, 20 bp, synthetic construct
  misc_feature 1..20: note = CRISPR gRNA sequence
  source 1..20: mol_type = other DNA
atcagcatttatttacccct

SEQ ID NO: 69487 - DNA, 20 bp, synthetic construct
  misc_feature 1..20: note = CRISPR gRNA sequence
  source 1..20: mol_type = other DNA
atttacccctacaccataag

SEQ ID NO: 69488 - DNA, 20 bp, synthetic construct
  misc_feature 1..20: note = CRISPR gRNA sequence
  source 1..20: mol_type = other DNA
tttacccctacaccataagc

SEQ ID NO: 69489 - DNA, 20 bp, synthetic construct
  misc_feature 1..20: note = CRISPR gRNA sequence
  source 1..20: mol_type = other DNA
acccctacaccataagctcc

SEQ ID NO: 69490 - DNA, 20 bp, synthetic construct
  misc_feature 1..20: note = CRISPR gRNA sequence
  source 1..20: mol_type = other DNA
cccctacaccataagctcct

SEQ ID NO: 69491 - DNA, 20 bp, synthetic construct
  misc_feature 1..20: note = CRISPR gRNA sequence
  source 1..20: mol_type = other DNA
caccataagctccttgcagg

SEQ ID NO: 69492 - DNA, 20 bp, synthetic construct
  misc_feature 1..20: note = CRISPR gRNA sequence
  source 1..20: mol_type = other DNA
cttgcaggcagatactgaat

SEQ ID NO: 69493 - DNA, 20 bp, synthetic construct
  misc_feature 1..20: note = CRISPR gRNA sequence
  source 1..20: mol_type = other DNA
gcaggcagatactgaatccc

SEQ ID NO: 69494 - DNA, 20 bp, synthetic construct
  misc_feature 1..20: note = CRISPR gRNA sequence
  source 1..20: mol_type = other DNA
caggcagatactgaatccca

SEQ ID NO: 69495 - DNA, 20 bp, synthetic construct
  misc_feature 1..20: note = CRISPR gRNA sequence
  source 1..20: mol_type = other DNA
aatcccacatactggactag

SEQ ID NO: 69496 - DNA, 20 bp, synthetic construct
  misc_feature 1..20: note = CRISPR gRNA sequence
  source 1..20: mol_type = other DNA
gactagatgttccaaaactg

SEQ ID NO: 69497 - DNA, 20 bp, synthetic construct
  misc_feature 1..20: note = CRISPR gRNA sequence
  source 1..20: mol_type = other DNA
gatgttccaaaactgtcgtc

SEQ ID NO: 69498 - DNA, 20 bp, synthetic construct
  misc_feature 1..20: note = CRISPR gRNA sequence
  source 1..20: mol_type = other DNA
caaaactgtcgtctccctgt

SEQ ID NO: 69499 - DNA, 20 bp, synthetic construct
  misc_feature 1..20: note = CRISPR gRNA sequence
  source 1..20: mol_type = other DNA
tcgtctccctgtctgtgtcc

SEQ ID NO: 69500 - DNA, 20 bp, synthetic construct
  misc_feature 1..20: note = CRISPR gRNA sequence
  source 1..20: mol_type = other DNA
cctgtctgtgtccaggttgg

SEQ ID NO: 69501 - DNA, 20 bp, synthetic construct
  misc_feature 1..20: note = CRISPR gRNA sequence
  source 1..20: mol_type = other DNA
tctgtgtccaggttggctca

SEQ ID NO: 69502 - DNA, 20 bp, synthetic construct
  misc_feature 1..20: note = CRISPR gRNA sequence
  source 1..20: mol_type = other DNA
tgtccaggttggctcactgt

SEQ ID NO: 69503 - DNA, 20 bp, synthetic construct
  misc_feature 1..20: note = CRISPR gRNA sequence
  source 1..20: mol_type = other DNA
gctcactgtgaccttggagc

SEQ ID NO: 69504 - DNA, 20 bp, synthetic construct
  misc_feature 1..20: note = CRISPR gRNA sequence
  source 1..20: mol_type = other DNA
actgtgaccttggagcccac

SEQ ID NO: 69505 - DNA, 20 bp, synthetic construct
  misc_feature 1..20: note = CRISPR gRNA sequence
  source 1..20: mol_type = other DNA
tgaccttggagcccaccaca

SEQ ID NO: 69506 - DNA, 20 bp, synthetic construct
  misc_feature 1..20: note = CRISPR gRNA sequence
  source 1..20: mol_type = other DNA
ggagcccaccacagccttct

SEQ ID NO: 69507 - DNA, 20 bp, synthetic construct
  misc_feature 1..20: note = CRISPR gRNA sequence
  source 1..20: mol_type = other DNA
gagcccaccacagccttctt

SEQ ID NO: 69508 - DNA, 20 bp, synthetic construct
  misc_feature 1..20: note = CRISPR gRNA sequence
  source 1..20: mol_type = other DNA
cttgtcgggcagctgatgga

SEQ ID NO: 69509 - DNA, 20 bp, synthetic construct
  misc_feature 1..20: note = CRISPR gRNA sequence
  source 1..20: mol_type = other DNA
ttgtcgggcagctgatggag

SEQ ID NO: 69510 - DNA, 20 bp, synthetic construct
  misc_feature 1..20: note = CRISPR gRNA sequence
  source 1..20: mol_type = other DNA
gtcgggcagctgatggagac

SEQ ID NO: 69511 - DNA, 20 bp, synthetic construct
  misc_feature 1..20: note = CRISPR gRNA sequence
  source 1..20: mol_type = other DNA
tcgggcagctgatggagaca

SEQ ID NO: 69512 - DNA, 20 bp, synthetic construct
  misc_feature 1..20: note = CRISPR gRNA sequence
  source 1..20: mol_type = other DNA
atggagacatgtgccaggct

SEQ ID NO: 69513 - DNA, 20 bp, synthetic construct
  misc_feature 1..20: note = CRISPR gRNA sequence
  source 1..20: mol_type = other DNA
cagcagctcaggtcagcgcc

SEQ ID NO: 69514 - DNA, 20 bp, synthetic construct
  misc_feature 1..20: note = CRISPR gRNA sequence
  source 1..20: mol_type = other DNA
aggtcagcgcctggaaactc

SEQ ID NO: 69515 - DNA, 20 bp, synthetic construct
  misc_feature 1..20: note = CRISPR gRNA sequence
  source 1..20: mol_type = other DNA
gaaactctgtgtggggccct

SEQ ID NO: 69516 - DNA, 20 bp, synthetic construct
  misc_feature 1..20: note = CRISPR gRNA sequence
  source 1..20: mol_type = other DNA
tgtgtggggccctgagttct

SEQ ID NO: 69517 - DNA, 20 bp, synthetic construct
  misc_feature 1..20: note = CRISPR gRNA sequence
  source 1..20: mol_type = other DNA
tgtggggccctgagttctct

SEQ ID NO: 69518 - DNA, 20 bp, synthetic construct
  misc_feature 1..20: note = CRISPR gRNA sequence
  source 1..20: mol_type = other DNA
agttctctggttgaccctgg

SEQ ID NO: 69519 - DNA, 20 bp, synthetic construct
  misc_feature 1..20: note = CRISPR gRNA sequence
  source 1..20: mol_type = other DNA
tctggttgaccctggtacct

SEQ ID NO: 69520 - DNA, 20 bp, synthetic construct
  misc_feature 1..20: note = CRISPR gRNA sequence
  source 1..20: mol_type = other DNA
tggttgaccctggtacctac

SEQ ID NO: 69521 - DNA, 20 bp, synthetic construct
  misc_feature 1..20: note = CRISPR gRNA sequence
  source 1..20: mol_type = other DNA
gttgaccctggtacctactc

SEQ ID NO: 69522 - DNA, 20 bp, synthetic construct
  misc_feature 1..20: note = CRISPR gRNA sequence
  source 1..20: mol_type = other DNA
accctggtacctactccagg

SEQ ID NO: 69523 - DNA, 20 bp, synthetic construct
  misc_feature 1..20: note = CRISPR gRNA sequence
  source 1..20: mol_type = other DNA
gtacctactccaggccatgt

SEQ ID NO: 69524 - DNA, 20 bp, synthetic construct
  misc_feature 1..20: note = CRISPR gRNA sequence
  source 1..20: mol_type = other DNA
ctccaggccatgtgtgaccc

SEQ ID NO: 69525 - DNA, 20 bp, synthetic construct
  misc_feature 1..20: note = CRISPR gRNA sequence
  source 1..20: mol_type = other DNA
caggccatgtgtgaccctgg

SEQ ID NO: 69526 - DNA, 20 bp, synthetic construct
  misc_feature 1..20: note = CRISPR gRNA sequence
  source 1..20: mol_type = other DNA
gcattctcacttccttgtgc

SEQ ID NO: 69527 - DNA, 20 bp, synthetic construct
  misc_feature 1..20: note = CRISPR gRNA sequence
  source 1..20: mol_type = other DNA
tcacttccttgtgcaggaga

SEQ ID NO: 69528 - DNA, 20 bp, synthetic construct
  misc_feature 1..20: note = CRISPR gRNA sequence
  source 1..20: mol_type = other DNA
acttccttgtgcaggagaaa

SEQ ID NO: 69529 - DNA, 20 bp, synthetic construct
  misc_feature 1..20: note = CRISPR gRNA sequence
  source 1..20: mol_type = other DNA
ccttgtgcaggagaaaatca

SEQ ID NO: 69530 - DNA, 20 bp, synthetic construct
  misc_feature 1..20: note = CRISPR gRNA sequence
  source 1..20: mol_type = other DNA
cttgtgcaggagaaaatcac

SEQ ID NO: 69531 - DNA, 20 bp, synthetic construct
  misc_feature 1..20: note = CRISPR gRNA sequence
  source 1..20: mol_type = other DNA
gtgcaggagaaaatcacact

SEQ ID NO: 69532 - DNA, 20 bp, synthetic construct
  misc_feature 1..20: note = CRISPR gRNA sequence
  source 1..20: mol_type = other DNA
tgcaggagaaaatcacactt

SEQ ID NO: 69533 - DNA, 20 bp, synthetic construct
  misc_feature 1..20: note = CRISPR gRNA sequence
  source 1..20: mol_type = other DNA
ggccagtggaggggagggag

SEQ ID NO: 69534 - DNA, 20 bp, synthetic construct
  misc_feature 1..20: note = CRISPR gRNA sequence
  source 1..20: mol_type = other DNA
gccagtggaggggagggaga

SEQ ID NO: 69535 - DNA, 20 bp, synthetic construct
  misc_feature 1..20: note = CRISPR gRNA sequence
  source 1..20: mol_type = other DNA
aggggagctcttgggtggcc

SEQ ID NO: 69536 - DNA, 20 bp, synthetic construct
  misc_feature 1..20: note = CRISPR gRNA sequence
  source 1..20: mol_type = other DNA
ttgggtggccccttctcctc

SEQ ID NO: 69537 - DNA, 20 bp, synthetic construct
  misc_feature 1..20: note = CRISPR gRNA sequence
  source 1..20: mol_type = other DNA
gggtggccccttctcctctc

SEQ ID NO: 69538 - DNA, 20 bp, synthetic construct
  misc_feature 1..20: note = CRISPR gRNA sequence
  source 1..20: mol_type = other DNA
ggtggccccttctcctctct

SEQ ID NO: 69539 - DNA, 20 bp, synthetic construct
  misc_feature 1..20: note = CRISPR gRNA sequence
  source 1..20: mol_type = other DNA
ctcctctcttggcaccccct

SEQ ID NO: 69540 - DNA, 20 bp, synthetic construct
  misc_feature 1..20: note = CRISPR gRNA sequence
  source 1..20: mol_type = other DNA
tcctctcttggcaccccctt

SEQ ID NO: 69541 - DNA, 20 bp, synthetic construct
  misc_feature 1..20: note = CRISPR gRNA sequence
  source 1..20: mol_type = other DNA
ctctcttggcacccccttct

SEQ ID NO: 69542 - DNA, 20 bp, synthetic construct
  misc_feature 1..20: note = CRISPR gRNA sequence
  source 1..20: mol_type = other DNA
tcttggcacccccttctgga

SEQ ID NO: 69543 - DNA, 20 bp, synthetic construct
  misc_feature 1..20: note = CRISPR gRNA sequence
  source 1..20: mol_type = other DNA
ttggcacccccttctggatg

SEQ ID NO: 69544 - DNA, 20 bp, synthetic construct
  misc_feature 1..20: note = CRISPR gRNA sequence
  source 1..20: mol_type = other DNA
ggcacccccttctggatgtg

SEQ ID NO: 69545 - DNA, 20 bp, synthetic construct
  misc_feature 1..20: note = CRISPR gRNA sequence
  source 1..20: mol_type = other DNA
gcacccccttctggatgtga

SEQ ID NO: 69546 - DNA, 20 bp, synthetic construct
  misc_feature 1..20: note = CRISPR gRNA sequence
  source 1..20: mol_type = other DNA
ctggatgtgatgacctctga

SEQ ID NO: 69547 - DNA, 20 bp, synthetic construct
  misc_feature 1..20: note = CRISPR gRNA sequence
  source 1..20: mol_type = other DNA
tggatgtgatgacctctgag

SEQ ID NO: 69548 - DNA, 20 bp, synthetic construct
  misc_feature 1..20: note = CRISPR gRNA sequence
  source 1..20: mol_type = other DNA
gatgtgatgacctctgaggt

SEQ ID NO: 69549 - DNA, 20 bp, synthetic construct
  misc_feature 1..20: note = CRISPR gRNA sequence
  source 1..20: mol_type = other DNA
tgaggtgtgtccagcctgaa

SEQ ID NO: 69550 - DNA, 20 bp, synthetic construct
  misc_feature 1..20: note = CRISPR gRNA sequence
  source 1..20: mol_type = other DNA
aggtgtgtccagcctgaaat

SEQ ID NO: 69551 - DNA, 20 bp, synthetic construct
  misc_feature 1..20: note = CRISPR gRNA sequence
  source 1..20: mol_type = other DNA
aaatcctctagaatatcctt

SEQ ID NO: 69552 - DNA, 20 bp, synthetic construct
  misc_feature 1..20: note = CRISPR gRNA sequence
  source 1..20: mol_type = other DNA
tagaatatccttggaccttt

SEQ ID NO: 69553 - DNA, 20 bp, synthetic construct
  misc_feature 1..20: note = CRISPR gRNA sequence
  source 1..20: mol_type = other DNA
gaatatccttggaccttttc

SEQ ID NO: 69554 - DNA, 20 bp, synthetic construct
  misc_feature 1..20: note = CRISPR gRNA sequence
  source 1..20: mol_type = other DNA
ggaccttttcagcttgtctc

SEQ ID NO: 69555 - DNA, 20 bp, synthetic construct
  misc_feature 1..20: note = CRISPR gRNA sequence
  source 1..20: mol_type = other DNA
gaccttttcagcttgtctca

SEQ ID NO: 69556 - DNA, 20 bp, synthetic construct
  misc_feature 1..20: note = CRISPR gRNA sequence
  source 1..20: mol_type = other DNA
ttcagcttgtctcaggttaa

SEQ ID NO: 69557 - DNA, 20 bp, synthetic construct
  misc_feature 1..20: note = CRISPR gRNA sequence
  source 1..20: mol_type = other DNA
tcagcttgtctcaggttaac

SEQ ID NO: 69558 - DNA, 20 bp, synthetic construct
  misc_feature 1..20: note = CRISPR gRNA sequence
  source 1..20: mol_type = other DNA
cagcttgtctcaggttaacc

SEQ ID NO: 69559 - DNA, 20 bp, synthetic construct
  misc_feature 1..20: note = CRISPR gRNA sequence
  source 1..20: mol_type = other DNA
agcttgtctcaggttaacct

SEQ ID NO: 69560 - DNA, 20 bp, synthetic construct
  misc_feature 1..20: note = CRISPR gRNA sequence
  source 1..20: mol_type = other DNA
gtctcaggttaacctctgtg

SEQ ID NO: 69561 - DNA, 20 bp, synthetic construct
  misc_feature 1..20: note = CRISPR gRNA sequence
  source 1..20: mol_type = other DNA
tctcaggttaacctctgtga

SEQ ID NO: 69562 - DNA, 20 bp, synthetic construct
  misc_feature 1..20: note = CRISPR gRNA sequence
  source 1..20: mol_type = other DNA
aggttaacctctgtgaggac

SEQ ID NO: 69563 - DNA, 20 bp, synthetic construct
  misc_feature 1..20: note = CRISPR gRNA sequence
  source 1..20: mol_type = other DNA
acctctgtgaggacgatgat

SEQ ID NO: 69564 - DNA, 20 bp, synthetic construct
  misc_feature 1..20: note = CRISPR gRNA sequence
  source 1..20: mol_type = other DNA
tgtgaggacgatgatgccag

SEQ ID NO: 69565 - DNA, 20 bp, synthetic construct
  misc_feature 1..20: note = CRISPR gRNA sequence
  source 1..20: mol_type = other DNA
tgaggacgatgatgccagtt

SEQ ID NO: 69566 - DNA, 20 bp, synthetic construct
  misc_feature 1..20: note = CRISPR gRNA sequence
  source 1..20: mol_type = other DNA
cctgctgctgcagagcctcc

SEQ ID NO: 69567 - DNA, 20 bp, synthetic construct
  misc_feature 1..20: note = CRISPR gRNA sequence
  source 1..20: mol_type = other DNA
ctgctgcagagcctcctgct

SEQ ID NO: 69568 - DNA, 20 bp, synthetic construct
  misc_feature 1..20: note = CRISPR gRNA sequence
  source 1..20: mol_type = other DNA
ctgcagagcctcctgctgtc

SEQ ID NO: 69569 - DNA, 20 bp, synthetic construct
  misc_feature 1..20: note = CRISPR gRNA sequence
  source 1..20: mol_type = other DNA
cagagcctcctgctgtccct

SEQ ID NO: 69570 - DNA, 20 bp, synthetic construct
  misc_feature 1..20: note = CRISPR gRNA sequence
  source 1..20: mol_type = other DNA
ctgctgtccctctctgagct

SEQ ID NO: 69571 - DNA, 20 bp, synthetic construct
  misc_feature 1..20: note = CRISPR gRNA sequence
  source 1..20: mol_type = other DNA
ctgtccctctctgagctgaa

SEQ ID NO: 69572 - DNA, 20 bp, synthetic construct
  misc_feature 1..20: note = CRISPR gRNA sequence
  source 1..20: mol_type = other DNA
tccctctctgagctgaagac

SEQ ID NO: 69573 - DNA, 20 bp, synthetic construct
  misc_feature 1..20: note = CRISPR gRNA sequence
  source 1..20: mol_type = other DNA
tctgagctgaagacatttcg

SEQ ID NO: 69574 - DNA, 20 bp, synthetic construct
  misc_feature 1..20: note = CRISPR gRNA sequence
  source 1..20: mol_type = other DNA
tgagctgaagacatttcggt

SEQ ID NO: 69575 - DNA, 20 bp, synthetic construct
  misc_feature 1..20: note = CRISPR gRNA sequence
  source 1..20: mol_type = other DNA
agctgaagacatttcggtat

SEQ ID NO: 69576 - DNA, 20 bp, synthetic construct
  misc_feature 1..20: note = CRISPR gRNA sequence
  source 1..20: mol_type = other DNA
aagacatttcggtatgtaga

SEQ ID NO: 69577 - DNA, 20 bp, synthetic construct
  misc_feature 1..20: note = CRISPR gRNA sequence
  source 1..20: mol_type = other DNA
cggtatgtagacaagacatt

SEQ ID NO: 69578 - DNA, 20 bp, synthetic construct
  misc_feature 1..20: note = CRISPR gRNA sequence
  source 1..20: mol_type = other DNA
ggtatgtagacaagacattc

SEQ ID NO: 69579 - DNA, 20 bp, synthetic construct
  misc_feature 1..20: note = CRISPR gRNA sequence
  source 1..20: mol_type = other DNA
actcagtcccctttgcagct

SEQ ID NO: 69580 - DNA, 20 bp, synthetic construct
  misc_feature 1..20: note = CRISPR gRNA sequence
  source 1..20: mol_type = other DNA
agtcccctttgcagctctgc

SEQ ID NO: 69581 - DNA, 20 bp, synthetic construct
  misc_feature 1..20: note = CRISPR gRNA sequence
  source 1..20: mol_type = other DNA
tgcagctctgccctgccctg

SEQ ID NO: 69582 - DNA, 20 bp, synthetic construct
  misc_feature 1..20: note = CRISPR gRNA sequence
  source 1..20: mol_type = other DNA
gcagctctgccctgccctga

SEQ ID NO: 69583 - DNA, 20 bp, synthetic construct
  misc_feature 1..20: note = CRISPR gRNA sequence
  source 1..20: mol_type = other DNA
cagctctgccctgccctgac

SEQ ID NO: 69584 - DNA, 20 bp, synthetic construct
  misc_feature 1..20: note = CRISPR gRNA sequence
  source 1..20: mol_type = other DNA
tgccctgccctgacacctcc

SEQ ID NO: 69585 - DNA, 20 bp, synthetic construct
  misc_feature 1..20: note = CRISPR gRNA sequence
  source 1..20: mol_type = other DNA
ccctgccctgacacctcccg

SEQ ID NO: 69586 - DNA, 20 bp, synthetic construct
  misc_feature 1..20: note = CRISPR gRNA sequence
  source 1..20: mol_type = other DNA
ccctgacacctcccgttatt

SEQ ID NO: 69587 - DNA, 20 bp, synthetic construct
  misc_feature 1..20: note = CRISPR gRNA sequence
  source 1..20: mol_type = other DNA
acacctcccgttattcccag

SEQ ID NO: 69588 - DNA, 20 bp, synthetic construct
  misc_feature 1..20: note = CRISPR gRNA sequence
  source 1..20: mol_type = other DNA
ccgttattcccagccctggg

SEQ ID NO: 69589 - DNA, 20 bp, synthetic construct
  misc_feature 1..20: note = CRISPR gRNA sequence
  source 1..20: mol_type = other DNA
ttcccagccctgggctcaga

SEQ ID NO: 69590 - DNA, 20 bp, synthetic construct
  misc_feature 1..20: note = CRISPR gRNA sequence
  source 1..20: mol_type = other DNA
ccagccctgggctcagagga

SEQ ID NO: 69591 - DNA, 20 bp, synthetic construct
  misc_feature 1..20: note = CRISPR gRNA sequence
  source 1..20: mol_type = other DNA
ggctcagaggactcttactc

SEQ ID NO: 69592 - DNA, 20 bp, synthetic construct
  misc_feature 1..20: note = CRISPR gRNA sequence
  source 1..20: mol_type = other DNA
agaggactcttactctgtgt

SEQ ID NO: 69593 - DNA, 20 bp, synthetic construct
  misc_feature 1..20: note = CRISPR gRNA sequence
  source 1..20: mol_type = other DNA
ttactctgtgtcttactctg

SEQ ID NO: 69594 - DNA, 20 bp, synthetic construct
  misc_feature 1..20: note = CRISPR gRNA sequence
  source 1..20: mol_type = other DNA
actctgtgtcttactctgtg

SEQ ID NO: 69595 - DNA, 20 bp, synthetic construct
  misc_feature 1..20: note = CRISPR gRNA sequence
  source 1..20: mol_type = other DNA
ctctgtgtcttactctgtgg

SEQ ID NO: 69596 - DNA, 20 bp, synthetic construct
  misc_feature 1..20: note = CRISPR gRNA sequence
  source 1..20: mol_type = other DNA
tgtgtcttactctgtggaca

SEQ ID NO: 69597 - DNA, 20 bp, synthetic construct
  misc_feature 1..20: note = CRISPR gRNA sequence
  source 1..20: mol_type = other DNA
tgtcttactctgtggacaca

SEQ ID NO: 69598 - DNA, 20 bp, synthetic construct
  misc_feature 1..20: note = CRISPR gRNA sequence
  source 1..20: mol_type = other DNA
actctgtggacacaaaccac

SEQ ID NO: 69599 - DNA, 20 bp, synthetic construct
  misc_feature 1..20: note = CRISPR gRNA sequence
  source 1..20: mol_type = other DNA
ctctgtggacacaaaccaca

SEQ ID NO: 69600 - DNA, 20 bp, synthetic construct
  misc_feature 1..20: note = CRISPR gRNA sequence
  source 1..20: mol_type = other DNA
tgtggacacaaaccacaggt

SEQ ID NO: 69601 - DNA, 20 bp, synthetic construct
  misc_feature 1..20: note = CRISPR gRNA sequence
  source 1..20: mol_type = other DNA
tggacacaaaccacaggtgg

SEQ ID NO: 69602 - DNA, 20 bp, synthetic construct
  misc_feature 1..20: note = CRISPR gRNA sequence
  source 1..20: mol_type = other DNA
gagatgatttttaggggtac

SEQ ID NO: 69603 - DNA, 20 bp, synthetic construct
  misc_feature 1..20: note = CRISPR gRNA sequence
  source 1..20: mol_type = other DNA
ttaggggtacctagtcgtaa

SEQ ID NO: 69604 - DNA, 20 bp, synthetic construct
  misc_feature 1..20: note = CRISPR gRNA sequence
  source 1..20: mol_type = other DNA
taggggtacctagtcgtaaa

SEQ ID NO: 69605 - DNA, 20 bp, synthetic construct
  misc_feature 1..20: note = CRISPR gRNA sequence
  source 1..20: mol_type = other DNA
aggggtacctagtcgtaaac

SEQ ID NO: 69606 - DNA, 20 bp, synthetic construct
  misc_feature 1..20: note = CRISPR gRNA sequence
  source 1..20: mol_type = other DNA
ggggtacctagtcgtaaaca

SEQ ID NO: 69607 - DNA, 20 bp, synthetic construct
  misc_feature 1..20: note = CRISPR gRNA sequence
  source 1..20: mol_type = other DNA
gtcgtaaacatgaccttagg

SEQ ID NO: 69608 - DNA, 20 bp, synthetic construct
  misc_feature 1..20: note = CRISPR gRNA sequence
  source 1..20: mol_type = other DNA
aggaacattgagccacatgg

SEQ ID NO: 69609 - DNA, 20 bp, synthetic construct
  misc_feature 1..20: note = CRISPR gRNA sequence
  source 1..20: mol_type = other DNA
ggaacattgagccacatggc

SEQ ID NO: 69610 - DNA, 20 bp, synthetic construct
  misc_feature 1..20: note = CRISPR gRNA sequence
  source 1..20: mol_type = other DNA
agccacatggcaagaaagtt

SEQ ID NO: 69611 - DNA, 20 bp, synthetic construct
  misc_feature 1..20: note = CRISPR gRNA sequence
  source 1..20: mol_type = other DNA
ttccctttttaacactcttt

SEQ ID NO: 69612 - DNA, 20 bp, synthetic construct
  misc_feature 1..20: note = CRISPR gRNA sequence
  source 1..20: mol_type = other DNA
cctttttaacactctttcat

SEQ ID NO: 69613 - DNA, 20 bp, synthetic construct
  misc_feature 1..20: note = CRISPR gRNA sequence
  source 1..20: mol_type = other DNA
tttaacactctttcattgtt

SEQ ID NO: 69614 - DNA, 20 bp, synthetic construct
  misc_feature 1..20: note = CRISPR gRNA sequence
  source 1..20: mol_type = other DNA
ttaacactctttcattgttt

SEQ ID NO: 69615 - DNA, 20 bp, synthetic construct
  misc_feature 1..20: note = CRISPR gRNA sequence
  source 1..20: mol_type = other DNA
taacactctttcattgtttt

SEQ ID NO: 69616 - DNA, 20 bp, synthetic construct
  misc_feature 1..20: note = CRISPR gRNA sequence
  source 1..20: mol_type = other DNA
aacactctttcattgttttt

SEQ ID NO: 69617 - DNA, 20 bp, synthetic construct
  misc_feature 1..20: note = CRISPR gRNA sequence
  source 1..20: mol_type = other DNA
acactctttcattgtttttc

SEQ ID NO: 69618 - DNA, 20 bp, synthetic construct
  misc_feature 1..20: note = CRISPR gRNA sequence
  source 1..20: mol_type = other DNA
tttcattgtttttcttttaa

SEQ ID NO: 69619 - DNA, 20 bp, synthetic construct
  misc_feature 1..20: note = CRISPR gRNA sequence
  source 1..20: mol_type = other DNA
tcattgtttttcttttaaaa

SEQ ID NO: 69620 - DNA, 20 bp, synthetic construct
  misc_feature 1..20: note = CRISPR gRNA sequence
  source 1..20: mol_type = other DNA
cattgtttttcttttaaaat

SEQ ID NO: 69621 - DNA, 20 bp, synthetic construct
  misc_feature 1..20: note = CRISPR gRNA sequence
  source 1..20: mol_type = other DNA
attgtttttcttttaaaata

SEQ ID NO: 69622 - DNA, 20 bp, synthetic construct
  misc_feature 1..20: note = CRISPR gRNA sequence
  source 1..20: mol_type = other DNA
tttttcttttaaaataactg

SEQ ID NO: 69623 - DNA, 20 bp, synthetic construct
  misc_feature 1..20: note = CRISPR gRNA sequence
  source 1..20: mol_type = other DNA
ttcttttaaaataactgcga

SEQ ID NO: 69624 - DNA, 20 bp, synthetic construct
  misc_feature 1..20: note = CRISPR gRNA sequence
  source 1..20: mol_type = other DNA
tcttttaaaataactgcgaa

SEQ ID NO: 69625 - DNA, 20 bp, synthetic construct
  misc_feature 1..20: note = CRISPR gRNA sequence
  source 1..20: mol_type = other DNA
cttttaaaataactgcgaac

SEQ ID NO: 69626 - DNA, 20 bp, synthetic construct
  misc_feature 1..20: note = CRISPR gRNA sequence
  source 1..20: mol_type = other DNA
ttttaaaataactgcgaact

SEQ ID NO: 69627 - DNA, 20 bp, synthetic construct
  misc_feature 1..20: note = CRISPR gRNA sequence
  source 1..20: mol_type = other DNA
ttaaaataactgcgaactaa

SEQ ID NO: 69628 - DNA, 20 bp, synthetic construct
  misc_feature 1..20: note = CRISPR gRNA sequence
  source 1..20: mol_type = other DNA
taaaataactgcgaactaac

SEQ ID NO: 69629 - DNA, 20 bp, synthetic construct
  misc_feature 1..20: note = CRISPR gRNA sequence
  source 1..20: mol_type = other DNA
aaaataactgcgaactaaca

SEQ ID NO: 69630 - DNA, 20 bp, synthetic construct
  misc_feature 1..20: note = CRISPR gRNA sequence
  source 1..20: mol_type = other DNA
aaataactgcgaactaacac

SEQ ID NO: 69631 - DNA, 20 bp, synthetic construct
  misc_feature 1..20: note = CRISPR gRNA sequence
  source 1..20: mol_type = other DNA
cgaactaacacaaagtttca

SEQ ID NO: 69632 - DNA, 20 bp, synthetic construct
  misc_feature 1..20: note = CRISPR gRNA sequence
  source 1..20: mol_type = other DNA
acacaaagtttcaagaagac

SEQ ID NO: 69633 - DNA, 20 bp, synthetic construct
  misc_feature 1..20: note = CRISPR gRNA sequence
  source 1..20: mol_type = other DNA
caagaagactgagaactgct

SEQ ID NO: 69634 - DNA, 20 bp, synthetic construct
  misc_feature 1..20: note = CRISPR gRNA sequence
  source 1..20: mol_type = other DNA
aagaagactgagaactgctg

SEQ ID NO: 69635 - DNA, 20 bp, synthetic construct
  misc_feature 1..20: note = CRISPR gRNA sequence
  source 1..20: mol_type = other DNA
agaactgctgtgtgccattt

SEQ ID NO: 69636 - DNA, 20 bp, synthetic construct
  misc_feature 1..20: note = CRISPR gRNA sequence
  source 1..20: mol_type = other DNA
ctgtgtgccatttacccaaa

SEQ ID NO: 69637 - DNA, 20 bp, synthetic construct
  misc_feature 1..20: note = CRISPR gRNA sequence
  source 1..20: mol_type = other DNA
tgtgccatttacccaaattc

SEQ ID NO: 69638 - DNA, 20 bp, synthetic construct
  misc_feature 1..20: note = CRISPR gRNA sequence
  source 1..20: mol_type = other DNA
acccaaattcacccttagag

SEQ ID NO: 69639 - DNA, 20 bp, synthetic construct
  misc_feature 1..20: note = CRISPR gRNA sequence
  source 1..20: mol_type = other DNA
cccaaattcacccttagagc

SEQ ID NO: 69640 - DNA, 20 bp, synthetic construct
  misc_feature 1..20: note = CRISPR gRNA sequence
  source 1..20: mol_type = other DNA
acccttagagctgggcgtgg

SEQ ID NO: 69641 - DNA, 20 bp, synthetic construct
  misc_feature 1..20: note = CRISPR gRNA sequence
  source 1..20: mol_type = other DNA
agagctgggcgtggtggctc

SEQ ID NO: 69642 - DNA, 20 bp, synthetic construct
  misc_feature 1..20: note = CRISPR gRNA sequence
  source 1..20: mol_type = other DNA
gagctgggcgtggtggctca

SEQ ID NO: 69643 - DNA, 20 bp, synthetic construct
  misc_feature 1..20: note = CRISPR gRNA sequence
  source 1..20: mol_type = other DNA
ggcgtggtggctcatgtctg

SEQ ID NO: 69644 - DNA, 20 bp, synthetic construct
  misc_feature 1..20: note = CRISPR gRNA sequence
  source 1..20: mol_type = other DNA
atgtctgtaatcctagcact

SEQ ID NO: 69645 - DNA, 20 bp, synthetic construct
  misc_feature 1..20: note = CRISPR gRNA sequence
  source 1..20: mol_type = other DNA
taatcctagcactttgggag

SEQ ID NO: 69646 - DNA, 20 bp, synthetic construct
  misc_feature 1..20: note = CRISPR gRNA sequence
  source 1..20: mol_type = other DNA
gcactttgggaggccgaggc

SEQ ID NO: 69647 - DNA, 20 bp, synthetic construct
  misc_feature 1..20: note = CRISPR gRNA sequence
  source 1..20: mol_type = other DNA
tgggaggccgaggcaggtgg

SEQ ID NO: 69648 - DNA, 20 bp, synthetic construct
  misc_feature 1..20: note = CRISPR gRNA sequence
  source 1..20: mol_type = other DNA
gggaggccgaggcaggtgga

SEQ ID NO: 69649 - DNA, 20 bp, synthetic construct
  misc_feature 1..20: note = CRISPR gRNA sequence
  source 1..20: mol_type = other DNA
ggaggccgaggcaggtggat

SEQ ID NO: 69650 - DNA, 20 bp, synthetic construct
  misc_feature 1..20: note = CRISPR gRNA sequence
  source 1..20: mol_type = other DNA
cctgagctcaggaattcgag

SEQ ID NO: 69651 - DNA, 20 bp, synthetic construct
  misc_feature 1..20: note = CRISPR gRNA sequence
  source 1..20: mol_type = other DNA
agctcaggaattcgagacca

SEQ ID NO: 69652 - DNA, 20 bp, synthetic construct
  misc_feature 1..20: note = CRISPR gRNA sequence
  source 1..20: mol_type = other DNA
aggaattcgagaccaccctg

SEQ ID NO: 69653 - DNA, 20 bp, synthetic construct
  misc_feature 1..20: note = CRISPR gRNA sequence
  source 1..20: mol_type = other DNA
gagaccaccctggacaacac

SEQ ID NO: 69654 - DNA, 20 bp, synthetic construct
  misc_feature 1..20: note = CRISPR gRNA sequence
  source 1..20: mol_type = other DNA
gacaacacggtgaaaccccg

SEQ ID NO: 69655 - DNA, 20 bp, synthetic construct
  misc_feature 1..20: note = CRISPR gRNA sequence
  source 1..20: mol_type = other DNA
tactaaaatacaaaaaaatt

SEQ ID NO: 69656 - DNA, 20 bp, synthetic construct
  misc_feature 1..20: note = CRISPR gRNA sequence
  source 1..20: mol_type = other DNA
ctaaaatacaaaaaaattag

SEQ ID NO: 69657 - DNA, 20 bp, synthetic construct
  misc_feature 1..20: note = CRISPR gRNA sequence
  source 1..20: mol_type = other DNA
aaatacaaaaaaattagctg

SEQ ID NO: 69658 - DNA, 20 bp, synthetic construct
  misc_feature 1..20: note = CRISPR gRNA sequence
  source 1..20: mol_type = other DNA
gctgggcatggtggtgcatg

SEQ ID NO: 69659 - DNA, 20 bp, synthetic construct
  misc_feature 1..20: note = CRISPR gRNA sequence
  source 1..20: mol_type = other DNA
ggcatggtggtgcatgcctg

SEQ ID NO: 69660 - DNA, 20 bp, synthetic construct
  misc_feature 1..20: note = CRISPR gRNA sequence
  source 1..20: mol_type = other DNA
taatcccagctaattgggag

SEQ ID NO: 69661 - DNA, 20 bp, synthetic construct
  misc_feature 1..20: note = CRISPR gRNA sequence
  source 1..20: mol_type = other DNA
attgggaggctgaggcacaa

SEQ ID NO: 69662 - DNA, 20 bp, synthetic construct
  misc_feature 1..20: note = CRISPR gRNA sequence
  source 1..20: mol_type = other DNA
ggaggctgaggcacaagaat

SEQ ID NO: 69663 - DNA, 20 bp, synthetic construct
  misc_feature 1..20: note = CRISPR gRNA sequence
  source 1..20: mol_type = other DNA
aggcacaagaattgcttgaa

SEQ ID NO: 69664 - DNA, 20 bp, synthetic construct
  misc_feature 1..20: note = CRISPR gRNA sequence
  source 1..20: mol_type = other DNA
cttgaacccgggaggctgag

SEQ ID NO: 69665 - DNA, 20 bp, synthetic construct
  misc_feature 1..20: note = CRISPR gRNA sequence
  source 1..20: mol_type = other DNA
gaacccgggaggctgaggtt

SEQ ID NO: 69666 - DNA, 20 bp, synthetic construct
  misc_feature 1..20: note = CRISPR gRNA sequence
  source 1..20: mol_type = other DNA
aacccgggaggctgaggtta

SEQ ID NO: 69667 - DNA, 20 bp, synthetic construct
  misc_feature 1..20: note = CRISPR gRNA sequence
  source 1..20: mol_type = other DNA
aggttacagtgagccaagat

SEQ ID NO: 69668 - DNA, 20 bp, synthetic construct
  misc_feature 1..20: note = CRISPR gRNA sequence
  source 1..20: mol_type = other DNA
cagtgagccaagattgtgcc

SEQ ID NO: 69669 - DNA, 20 bp, synthetic construct
  misc_feature 1..20: note = CRISPR gRNA sequence
  source 1..20: mol_type = other DNA
tgccactgcactctagccta

SEQ ID NO: 69670 - DNA, 20 bp, synthetic construct
  misc_feature 1..20: note = CRISPR gRNA sequence
  source 1..20: mol_type = other DNA
cactctagcctaggtgacag

SEQ ID NO: 69671 - DNA, 20 bp, synthetic construct
  misc_feature 1..20: note = CRISPR gRNA sequence
  source 1..20: mol_type = other DNA
tagcctaggtgacagagcga

SEQ ID NO: 69672 - DNA, 20 bp, synthetic construct
  misc_feature 1..20: note = CRISPR gRNA sequence
  source 1..20: mol_type = other DNA
gcctaggtgacagagcgagg

SEQ ID NO: 69673 - DNA, 20 bp, synthetic construct
  misc_feature 1..20: note = CRISPR gRNA sequence
  source 1..20: mol_type = other DNA
ggtgacagagcgaggctcgg

SEQ ID NO: 69674 - DNA, 20 bp, synthetic construct
  misc_feature 1..20: note = CRISPR gRNA sequence
  source 1..20: mol_type = other DNA
ggtttccgaaaaaaaaaaaa

SEQ ID NO: 69675 - DNA, 20 bp, synthetic construct
  misc_feature 1..20: note = CRISPR gRNA sequence
  source 1..20: mol_type = other DNA
ccgaaaaaaaaaaaaaagaa

SEQ ID NO: 69676 - DNA, 20 bp, synthetic construct
  misc_feature 1..20: note = CRISPR gRNA sequence
  source 1..20: mol_type = other DNA
cgaaaaaaaaaaaaaagaac

SEQ ID NO: 69677 - DNA, 20 bp, synthetic construct
  misc_feature 1..20: note = CRISPR gRNA sequence
  source 1..20: mol_type = other DNA
accctttgccaatctttttc

SEQ ID NO: 69678 - DNA, 20 bp, synthetic construct
  misc_feature 1..20: note = CRISPR gRNA sequence
  source 1..20: mol_type = other DNA
tgccaatctttttccacatt

SEQ ID NO: 69679 - DNA, 20 bp, synthetic construct
  misc_feature 1..20: note = CRISPR gRNA sequence
  source 1..20: mol_type = other DNA
gccaatctttttccacattt

SEQ ID NO: 69680 - DNA, 20 bp, synthetic construct
  misc_feature 1..20: note = CRISPR gRNA sequence
  source 1..20: mol_type = other DNA
ccaatctttttccacatttg

SEQ ID NO: 69681 - DNA, 20 bp, synthetic construct
  misc_feature 1..20: note = CRISPR gRNA sequence
  source 1..20: mol_type = other DNA
tttccacatttgctcatttc

SEQ ID NO: 69682 - DNA, 20 bp, synthetic construct
  misc_feature 1..20: note = CRISPR gRNA sequence
  source 1..20: mol_type = other DNA
ttccacatttgctcatttct

SEQ ID NO: 69683 - DNA, 20 bp, synthetic construct
  misc_feature 1..20: note = CRISPR gRNA sequence
  source 1..20: mol_type = other DNA
tccacatttgctcatttctt

SEQ ID NO: 69684 - DNA, 20 bp, synthetic construct
  misc_feature 1..20: note = CRISPR gRNA sequence
  source 1..20: mol_type = other DNA
ccacatttgctcatttcttc

SEQ ID NO: 69685 - DNA, 20 bp, synthetic construct
  misc_feature 1..20: note = CRISPR gRNA sequence
  source 1..20: mol_type = other DNA
cacatttgctcatttcttcc

SEQ ID NO: 69686 - DNA, 20 bp, synthetic construct
  misc_feature 1..20: note = CRISPR gRNA sequence
  source 1..20: mol_type = other DNA
gctcatttcttccctccctc

SEQ ID NO: 69687 - DNA, 20 bp, synthetic construct
  misc_feature 1..20: note = CRISPR gRNA sequence
  source 1..20: mol_type = other DNA
ctcatttcttccctccctcc

SEQ ID NO: 69688 - DNA, 20 bp, synthetic construct
  misc_feature 1..20: note = CRISPR gRNA sequence
  source 1..20: mol_type = other DNA
atttcttccctccctccttc

SEQ ID NO: 69689 - DNA, 20 bp, synthetic construct
  misc_feature 1..20: note = CRISPR gRNA sequence
  source 1..20: mol_type = other DNA
cttccctccctccttctttc

SEQ ID NO: 69690 - DNA, 20 bp, synthetic construct
  misc_feature 1..20: note = CRISPR gRNA sequence
  source 1..20: mol_type = other DNA
ttccctccctccttctttcc

SEQ ID NO: 69691 - DNA, 20 bp, synthetic construct
  misc_feature 1..20: note = CRISPR gRNA sequence
  source 1..20: mol_type = other DNA
ccctccctccttctttccca

SEQ ID NO: 69692 - DNA, 20 bp, synthetic construct
  misc_feature 1..20: note = CRISPR gRNA sequence
  source 1..20: mol_type = other DNA
cctccctccttctttcccac

SEQ ID NO: 69693 - DNA, 20 bp, synthetic construct
  misc_feature 1..20: note = CRISPR gRNA sequence
  source 1..20: mol_type = other DNA
cctccttctttcccacctcc

SEQ ID NO: 69694 - DNA, 20 bp, synthetic construct
  misc_feature 1..20: note = CRISPR gRNA sequence
  source 1..20: mol_type = other DNA
cttctttcccacctcccttt

SEQ ID NO: 69695 - DNA, 20 bp, synthetic construct
  misc_feature 1..20: note = CRISPR gRNA sequence
  source 1..20: mol_type = other DNA
ctttcccacctcccttttct

SEQ ID NO: 69696 - DNA, 20 bp, synthetic construct
  misc_feature 1..20: note = CRISPR gRNA sequence
  source 1..20: mol_type = other DNA
tttcccacctcccttttctt

SEQ ID NO: 69697 - DNA, 20 bp, synthetic construct
  misc_feature 1..20: note = CRISPR gRNA sequence
  source 1..20: mol_type = other DNA
tcccacctcccttttctttc

SEQ ID NO: 69698 - DNA, 20 bp, synthetic construct
  misc_feature 1..20: note = CRISPR gRNA sequence
  source 1..20: mol_type = other DNA
cccacctcccttttctttca

SEQ ID NO: 69699 - DNA, 20 bp, synthetic construct
  misc_feature 1..20: note = CRISPR gRNA sequence
  source 1..20: mol_type = other DNA
ccacctcccttttctttcac

SEQ ID NO: 69700 - DNA, 20 bp, synthetic construct
  misc_feature 1..20: note = CRISPR gRNA sequence
  source 1..20: mol_type = other DNA
ccttttctttcactctctcc

SEQ ID NO: 69701 - DNA, 20 bp, synthetic construct
  misc_feature 1..20: note = CRISPR gRNA sequence
  source 1..20: mol_type = other DNA
ttctttcactctctccctct

SEQ ID NO: 69702 - DNA, 20 bp, synthetic construct
  misc_feature 1..20: note = CRISPR gRNA sequence
  source 1..20: mol_type = other DNA
tctttcactctctccctctc

SEQ ID NO: 69703 - DNA, 20 bp, synthetic construct
  misc_feature 1..20: note = CRISPR gRNA sequence
  source 1..20: mol_type = other DNA
ctttcactctctccctctct

SEQ ID NO: 69704 - DNA, 20 bp, synthetic construct
  misc_feature 1..20: note = CRISPR gRNA sequence
  source 1..20: mol_type = other DNA
tttcactctctccctctctc

SEQ ID NO: 69705 - DNA, 20 bp, synthetic construct
  misc_feature 1..20: note = CRISPR gRNA sequence
  source 1..20: mol_type = other DNA
tcactctctccctctctcct

SEQ ID NO: 69706 - DNA, 20 bp, synthetic construct
  misc_feature 1..20: note = CRISPR gRNA sequence
  source 1..20: mol_type = other DNA
cactctctccctctctcctt

SEQ ID NO: 69707 - DNA, 20 bp, synthetic construct
  misc_feature 1..20: note = CRISPR gRNA sequence
  source 1..20: mol_type = other DNA
actctctccctctctccttt

SEQ ID NO: 69708 - DNA, 20 bp, synthetic construct
  misc_feature 1..20: note = CRISPR gRNA sequence
  source 1..20: mol_type = other DNA
tctccctctctccttttctg

SEQ ID NO: 69709 - DNA, 20 bp, synthetic construct
  misc_feature 1..20: note = CRISPR gRNA sequence
  source 1..20: mol_type = other DNA
tccctctctccttttctgaa

SEQ ID NO: 69710 - DNA, 20 bp, synthetic construct
  misc_feature 1..20: note = CRISPR gRNA sequence
  source 1..20: mol_type = other DNA
cctctctccttttctgaacc

SEQ ID NO: 69711 - DNA, 20 bp, synthetic construct
  misc_feature 1..20: note = CRISPR gRNA sequence
  source 1..20: mol_type = other DNA
tctccttttctgaaccattt

SEQ ID NO: 69712 - DNA, 20 bp, synthetic construct
  misc_feature 1..20: note = CRISPR gRNA sequence
  source 1..20: mol_type = other DNA
tccttttctgaaccatttag

SEQ ID NO: 69713 - DNA, 20 bp, synthetic construct
  misc_feature 1..20: note = CRISPR gRNA sequence
  source 1..20: mol_type = other DNA
cttttctgaaccatttagaa

SEQ ID NO: 69714 - DNA, 20 bp, synthetic construct
  misc_feature 1..20: note = CRISPR gRNA sequence
  source 1..20: mol_type = other DNA
ttctgaaccatttagaagta

SEQ ID NO: 69715 - DNA, 20 bp, synthetic construct
  misc_feature 1..20: note = CRISPR gRNA sequence
  source 1..20: mol_type = other DNA
tctgaaccatttagaagtaa

SEQ ID NO: 69716 - DNA, 20 bp, synthetic construct
  misc_feature 1..20: note = CRISPR gRNA sequence
  source 1..20: mol_type = other DNA
ctgaaccatttagaagtaag

SEQ ID NO: 69717 - DNA, 20 bp, synthetic construct
  misc_feature 1..20: note = CRISPR gRNA sequence
  source 1..20: mol_type = other DNA
tgaaccatttagaagtaagt

SEQ ID NO: 69718 - DNA, 20 bp, synthetic construct
  misc_feature 1..20: note = CRISPR gRNA sequence
  source 1..20: mol_type = other DNA
aaccatttagaagtaagttg

SEQ ID NO: 69719 - DNA, 20 bp, synthetic construct
  misc_feature 1..20: note = CRISPR gRNA sequence
  source 1..20: mol_type = other DNA
agaagtaagttgtaatcatg

SEQ ID NO: 69720 - DNA, 20 bp, synthetic construct
  misc_feature 1..20: note = CRISPR gRNA sequence
  source 1..20: mol_type = other DNA
gaagtaagttgtaatcatgt

SEQ ID NO: 69721 - DNA, 20 bp, synthetic construct
  misc_feature 1..20: note = CRISPR gRNA sequence
  source 1..20: mol_type = other DNA
taatcatgtccctttacccg

SEQ ID NO: 69722 - DNA, 20 bp, synthetic construct
  misc_feature 1..20: note = CRISPR gRNA sequence
  source 1..20: mol_type = other DNA
tacccgttaacatttcagcg

SEQ ID NO: 69723 - DNA, 20 bp, synthetic construct
  misc_feature 1..20: note = CRISPR gRNA sequence
  source 1..20: mol_type = other DNA
acccgttaacatttcagcga

SEQ ID NO: 69724 - DNA, 20 bp, synthetic construct
  misc_feature 1..20: note = CRISPR gRNA sequence
  source 1..20: mol_type = other DNA
cccgttaacatttcagcgaa

SEQ ID NO: 69725 - DNA, 20 bp, synthetic construct
  misc_feature 1..20: note = CRISPR gRNA sequence
  source 1..20: mol_type = other DNA
acatttcagcgaatttgcta

SEQ ID NO: 69726 - DNA, 20 bp, synthetic construct
  misc_feature 1..20: note = CRISPR gRNA sequence
  source 1..20: mol_type = other DNA
cagcgaatttgctagaaata

SEQ ID NO: 69727 - DNA, 20 bp, synthetic construct
  misc_feature 1..20: note = CRISPR gRNA sequence
  source 1..20: mol_type = other DNA
agcgaatttgctagaaataa

SEQ ID NO: 69728 - DNA, 20 bp, synthetic construct
  misc_feature 1..20: note = CRISPR gRNA sequence
  source 1..20: mol_type = other DNA
gctagaaataaggacattct

SEQ ID NO: 69729 - DNA, 20 bp, synthetic construct
  misc_feature 1..20: note = CRISPR gRNA sequence
  source 1..20: mol_type = other DNA
ctagaaataaggacattctc

SEQ ID NO: 69730 - DNA, 20 bp, synthetic construct
  misc_feature 1..20: note = CRISPR gRNA sequence
  source 1..20: mol_type = other DNA
gaaataaggacattctcttc

SEQ ID NO: 69731 - DNA, 20 bp, synthetic construct
  misc_feature 1..20: note = CRISPR gRNA sequence
  source 1..20: mol_type = other DNA
tcttccataatccagtaaaa

SEQ ID NO: 69732 - DNA, 20 bp, synthetic construct
  misc_feature 1..20: note = CRISPR gRNA sequence
  source 1..20: mol_type = other DNA
ttccataatccagtaaaatt

SEQ ID NO: 69733 - DNA, 20 bp, synthetic construct
  misc_feature 1..20: note = CRISPR gRNA sequence
  source 1..20: mol_type = other DNA
ccataatccagtaaaattat

SEQ ID NO: 69734 - DNA, 20 bp, synthetic construct
  misc_feature 1..20: note = CRISPR gRNA sequence
  source 1..20: mol_type = other DNA
cataatccagtaaaattata

SEQ ID NO: 69735 - DNA, 20 bp, synthetic construct
  misc_feature 1..20: note = CRISPR gRNA sequence
  source 1..20: mol_type = other DNA
taaaatccaggaaatgtgac

SEQ ID NO: 69736 - DNA, 20 bp, synthetic construct
  misc_feature 1..20: note = CRISPR gRNA sequence
  source 1..20: mol_type = other DNA
atacactactattatctcaa

SEQ ID NO: 69737 - DNA, 20 bp, synthetic construct
  misc_feature 1..20: note = CRISPR gRNA sequence
  source 1..20: mol_type = other DNA
ctattatctcaactacagtt

SEQ ID NO: 69738 - DNA, 20 bp, synthetic construct
  misc_feature 1..20: note = CRISPR gRNA sequence
  source 1..20: mol_type = other DNA
ttatctcaactacagtttat

SEQ ID NO: 69739 - DNA, 20 bp, synthetic construct
  misc_feature 1..20: note = CRISPR gRNA sequence
  source 1..20: mol_type = other DNA
tctcaactacagtttatact

SEQ ID NO: 69740 - DNA, 20 bp, synthetic construct
  misc_feature 1..20: note = CRISPR gRNA sequence
  source 1..20: mol_type = other DNA
aactacagtttatactccaa

SEQ ID NO: 69741 - DNA, 20 bp, synthetic construct
  misc_feature 1..20: note = CRISPR gRNA sequence
  source 1..20: mol_type = other DNA
cagtttatactccaatctca

SEQ ID NO: 69742 - DNA, 20 bp, synthetic construct
  misc_feature 1..20: note = CRISPR gRNA sequence
  source 1..20: mol_type = other DNA
atactccaatctcaccagtt

SEQ ID NO: 69743 - DNA, 20 bp, synthetic construct
  misc_feature 1..20: note = CRISPR gRNA sequence
  source 1..20: mol_type = other DNA
tactccaatctcaccagttc

SEQ ID NO: 69744 - DNA, 20 bp, synthetic construct
  misc_feature 1..20: note = CRISPR gRNA sequence
  source 1..20: mol_type = other DNA
caatctcaccagttctccca

SEQ ID NO: 69745 - DNA, 20 bp, synthetic construct
  misc_feature 1..20: note = CRISPR gRNA sequence
  source 1..20: mol_type = other DNA
accagttctcccaataatgt

SEQ ID NO: 69746 - DNA, 20 bp, synthetic construct
  misc_feature 1..20: note = CRISPR gRNA sequence
  source 1..20: mol_type = other DNA
tcccaataatgttgcttatt

SEQ ID NO: 69747 - DNA, 20 bp, synthetic construct
  misc_feature 1..20: note = CRISPR gRNA sequence
  source 1..20: mol_type = other DNA
ccaataatgttgcttattgc

SEQ ID NO: 69748 - DNA, 20 bp, synthetic construct
  misc_feature 1..20: note = CRISPR gRNA sequence
  source 1..20: mol_type = other DNA
cttattgcatttttttccca

SEQ ID NO: 69749 - DNA, 20 bp, synthetic construct
  misc_feature 1..20: note = CRISPR gRNA sequence
  source 1..20: mol_type = other DNA
attgcatttttttcccagtt

SEQ ID NO: 69750 - DNA, 20 bp, synthetic construct
  misc_feature 1..20: note = CRISPR gRNA sequence
  source 1..20: mol_type = other DNA
ttgcatttttttcccagttg

SEQ ID NO: 69751 - DNA, 20 bp, synthetic construct
  misc_feature 1..20: note = CRISPR gRNA sequence
  source 1..20: mol_type = other DNA
catttttttcccagttgtgg

SEQ ID NO: 69752 - DNA, 20 bp, synthetic construct
  misc_feature 1..20: note = CRISPR gRNA sequence
  source 1..20: mol_type = other DNA
ttttcccagttgtggatcca

SEQ ID NO: 69753 - DNA, 20 bp, synthetic construct
  misc_feature 1..20: note = CRISPR gRNA sequence
  source 1..20: mol_type = other DNA
tttcccagttgtggatccaa

SEQ ID NO: 69754 - DNA, 20 bp, synthetic construct
  misc_feature 1..20: note = CRISPR gRNA sequence
  source 1..20: mol_type = other DNA
ttcccagttgtggatccaat

SEQ ID NO: 69755 - DNA, 20 bp, synthetic construct
  misc_feature 1..20: note = CRISPR gRNA sequence
  source 1..20: mol_type = other DNA
tcccagttgtggatccaatc

SEQ ID NO: 69756 - DNA, 20 bp, synthetic construct
  misc_feature 1..20: note = CRISPR gRNA sequence
  source 1..20: mol_type = other DNA
cccagttgtggatccaatcc

SEQ ID NO: 69757 - DNA, 20 bp, synthetic construct
  misc_feature 1..20: note = CRISPR gRNA sequence
  source 1..20: mol_type = other DNA
ccagttgtggatccaatcca

SEQ ID NO: 69758 - DNA, 20 bp, synthetic construct
  misc_feature 1..20: note = CRISPR gRNA sequence
  source 1..20: mol_type = other DNA
tggatccaatccaggatcac

SEQ ID NO: 69759 - DNA, 20 bp, synthetic construct
  misc_feature 1..20: note = CRISPR gRNA sequence
  source 1..20: mol_type = other DNA
atttagtgtcatctctttag

SEQ ID NO: 69760 - DNA, 20 bp, synthetic construct
  misc_feature 1..20: note = CRISPR gRNA sequence
  source 1..20: mol_type = other DNA
agtgtcatctctttagtgtc

SEQ ID NO: 69761 - DNA, 20 bp, synthetic construct
  misc_feature 1..20: note = CRISPR gRNA sequence
  source 1..20: mol_type = other DNA
gtgtcatctctttagtgtct

SEQ ID NO: 69762 - DNA, 20 bp, synthetic construct
  misc_feature 1..20: note = CRISPR gRNA sequence
  source 1..20: mol_type = other DNA
tttagtgtctccttcaatct

SEQ ID NO: 69763 - DNA, 20 bp, synthetic construct
  misc_feature 1..20: note = CRISPR gRNA sequence
  source 1..20: mol_type = other DNA
tagtgtctccttcaatctgg

SEQ ID NO: 69764 - DNA, 20 bp, synthetic construct
  misc_feature 1..20: note = CRISPR gRNA sequence
  source 1..20: mol_type = other DNA
agtgtctccttcaatctgga

SEQ ID NO: 69765 - DNA, 20 bp, synthetic construct
  misc_feature 1..20: note = CRISPR gRNA sequence
  source 1..20: mol_type = other DNA
gtgtctccttcaatctggaa

SEQ ID NO: 69766 - DNA, 20 bp, synthetic construct
  misc_feature 1..20: note = CRISPR gRNA sequence
  source 1..20: mol_type = other DNA
cttcaatctggaacacgtcc

SEQ ID NO: 69767 - DNA, 20 bp, synthetic construct
  misc_feature 1..20: note = CRISPR gRNA sequence
  source 1..20: mol_type = other DNA
caatctggaacacgtccttg

SEQ ID NO: 69768 - DNA, 20 bp, synthetic construct
  misc_feature 1..20: note = CRISPR gRNA sequence
  source 1..20: mol_type = other DNA
aatctggaacacgtccttgg

SEQ ID NO: 69769 - DNA, 20 bp, synthetic construct
  misc_feature 1..20: note = CRISPR gRNA sequence
  source 1..20: mol_type = other DNA
gaacacgtccttggcccttc

SEQ ID NO: 69770 - DNA, 20 bp, synthetic construct
  misc_feature 1..20: note = CRISPR gRNA sequence
  source 1..20: mol_type = other DNA
ggcccttctttgtctttcat

SEQ ID NO: 69771 - DNA, 20 bp, synthetic construct
  misc_feature 1..20: note = CRISPR gRNA sequence
  source 1..20: mol_type = other DNA
gcccttctttgtctttcata

SEQ ID NO: 69772 - DNA, 20 bp, synthetic construct
  misc_feature 1..20: note = CRISPR gRNA sequence
  source 1..20: mol_type = other DNA
ctttgtctttcatagcattg

SEQ ID NO: 69773 - DNA, 20 bp, synthetic construct
  misc_feature 1..20: note = CRISPR gRNA sequence
  source 1..20: mol_type = other DNA
tttgtctttcatagcattgt

SEQ ID NO: 69774 - DNA, 20 bp, synthetic construct
  misc_feature 1..20: note = CRISPR gRNA sequence
  source 1..20: mol_type = other DNA
tgtctttcatagcattgtct

SEQ ID NO: 69775 - DNA, 20 bp, synthetic construct
  misc_feature 1..20: note = CRISPR gRNA sequence
  source 1..20: mol_type = other DNA
gtctttcatagcattgtctc

SEQ ID NO: 69776 - DNA, 20 bp, synthetic construct
  misc_feature 1..20: note = CRISPR gRNA sequence
  source 1..20: mol_type = other DNA
tctttcatagcattgtctct

SEQ ID NO: 69777 - DNA, 20 bp, synthetic construct
  misc_feature 1..20: note = CRISPR gRNA sequence
  source 1..20: mol_type = other DNA
tcatagcattgtctctgaca

SEQ ID NO: 69778 - DNA, 20 bp, synthetic construct
  misc_feature 1..20: note = CRISPR gRNA sequence
  source 1..20: mol_type = other DNA
catagcattgtctctgacat

SEQ ID NO: 69779 - DNA, 20 bp, synthetic construct
  misc_feature 1..20: note = CRISPR gRNA sequence
  source 1..20: mol_type = other DNA
atagcattgtctctgacatt

SEQ ID NO: 69780 - DNA, 20 bp, synthetic construct
  misc_feature 1..20: note = CRISPR gRNA sequence
  source 1..20: mol_type = other DNA
tctctgacatttacaggcca

SEQ ID NO: 69781 - DNA, 20 bp, synthetic construct
  misc_feature 1..20: note = CRISPR gRNA sequence
  source 1..20: mol_type = other DNA
tgacatttacaggccagtta

SEQ ID NO: 69782 - DNA, 20 bp, synthetic construct
  misc_feature 1..20: note = CRISPR gRNA sequence
  source 1..20: mol_type = other DNA
acatttacaggccagttatt

SEQ ID NO: 69783 - DNA, 20 bp, synthetic construct
  misc_feature 1..20: note = CRISPR gRNA sequence
  source 1..20: mol_type = other DNA
acaggccagttattttatag

SEQ ID NO: 69784 - DNA, 20 bp, synthetic construct
  misc_feature 1..20: note = CRISPR gRNA sequence
  source 1..20: mol_type = other DNA
caggccagttattttataga

SEQ ID NO: 69785 - DNA, 20 bp, synthetic construct
  misc_feature 1..20: note = CRISPR gRNA sequence
  source 1..20: mol_type = other DNA
ttttatagaatgtccttcca

SEQ ID NO: 69786 - DNA, 20 bp, synthetic construct
  misc_feature 1..20: note = CRISPR gRNA sequence
  source 1..20: mol_type = other DNA
tatagaatgtccttccactt

SEQ ID NO: 69787 - DNA, 20 bp, synthetic construct
  misc_feature 1..20: note = CRISPR gRNA sequence
  source 1..20: mol_type = other DNA
atagaatgtccttccacttg

SEQ ID NO: 69788 - DNA, 20 bp, synthetic construct
  misc_feature 1..20: note = CRISPR gRNA sequence
  source 1..20: mol_type = other DNA
tagaatgtccttccacttgg

SEQ ID NO: 69789 - DNA, 20 bp, synthetic construct
  misc_feature 1..20: note = CRISPR gRNA sequence
  source 1..20: mol_type = other DNA
ccacttgggtttgtccaatg

SEQ ID NO: 69790 - DNA, 20 bp, synthetic construct
  misc_feature 1..20: note = CRISPR gRNA sequence
  source 1..20: mol_type = other DNA
cacttgggtttgtccaatgt

SEQ ID NO: 69791 - DNA, 20 bp, synthetic construct
  misc_feature 1..20: note = CRISPR gRNA sequence
  source 1..20: mol_type = other DNA
gggtttgtccaatgtttcct

SEQ ID NO: 69792 - DNA, 20 bp, synthetic construct
  misc_feature 1..20: note = CRISPR gRNA sequence
  source 1..20: mol_type = other DNA
ggtttgtccaatgtttcctc

SEQ ID NO: 69793 - DNA, 20 bp, synthetic construct
  misc_feature 1..20: note = CRISPR gRNA sequence
  source 1..20: mol_type = other DNA
gtccaatgtttcctcatgtt

SEQ ID NO: 69794 - DNA, 20 bp, synthetic construct
  misc_feature 1..20: note = CRISPR gRNA sequence
  source 1..20: mol_type = other DNA
tccaatgtttcctcatgttt

SEQ ID NO: 69795 - DNA, 20 bp, synthetic construct
  misc_feature 1..20: note = CRISPR gRNA sequence
  source 1..20: mol_type = other DNA
cctcatgtttagagttagag

SEQ ID NO: 69796 - DNA, 20 bp, synthetic construct
  misc_feature 1..20: note = CRISPR gRNA sequence
  source 1..20: mol_type = other DNA
ctcatgtttagagttagagt

SEQ ID NO: 69797 - DNA, 20 bp, synthetic construct
  misc_feature 1..20: note = CRISPR gRNA sequence
  source 1..20: mol_type = other DNA
atgtttagagttagagtctg

SEQ ID NO: 69798 - DNA, 20 bp, synthetic construct
  misc_feature 1..20: note = CRISPR gRNA sequence
  source 1..20: mol_type = other DNA
agagttagagtctgcccttt

SEQ ID NO: 69799 - DNA, 20 bp, synthetic construct
  misc_feature 1..20: note = CRISPR gRNA sequence
  source 1..20: mol_type = other DNA
gagttagagtctgccctttg

SEQ ID NO: 69800 - DNA, 20 bp, synthetic construct
  misc_feature 1..20: note = CRISPR gRNA sequence
  source 1..20: mol_type = other DNA
gagtctgccctttgggcagg

SEQ ID NO: 69801 - DNA, 20 bp, synthetic construct
  misc_feature 1..20: note = CRISPR gRNA sequence
  source 1..20: mol_type = other DNA
ccctttgggcaggaatatca

SEQ ID NO: 69802 - DNA, 20 bp, synthetic construct
  misc_feature 1..20: note = CRISPR gRNA sequence
  source 1..20: mol_type = other DNA
tgggcaggaatatcacacag

SEQ ID NO: 69803 - DNA, 20 bp, synthetic construct
  misc_feature 1..20: note = CRISPR gRNA sequence
  source 1..20: mol_type = other DNA
gggcaggaatatcacacagg

SEQ ID NO: 69804 - DNA, 20 bp, synthetic construct
  misc_feature 1..20: note = CRISPR gRNA sequence
  source 1..20: mol_type = other DNA
ggcaggaatatcacacaggt

SEQ ID NO: 69805 - DNA, 20 bp, synthetic construct
  misc_feature 1..20: note = CRISPR gRNA sequence
  source 1..20: mol_type = other DNA
tgttatcgtgccttccatcg

SEQ ID NO: 69806 - DNA, 20 bp, synthetic construct
  misc_feature 1..20: note = CRISPR gRNA sequence
  source 1..20: mol_type = other DNA
tcgtgccttccatcggggca

SEQ ID NO: 69807 - DNA, 20 bp, synthetic construct
  misc_feature 1..20: note = CRISPR gRNA sequence
  source 1..20: mol_type = other DNA
ccatcggggcacatgatgtg

SEQ ID NO: 69808 - DNA, 20 bp, synthetic construct
  misc_feature 1..20: note = CRISPR gRNA sequence
  source 1..20: mol_type = other DNA
catcggggcacatgatgtgt

SEQ ID NO: 69809 - DNA, 20 bp, synthetic construct
  misc_feature 1..20: note = CRISPR gRNA sequence
  source 1..20: mol_type = other DNA
gggctagtgatgttaactgt

SEQ ID NO: 69810 - DNA, 20 bp, synthetic construct
  misc_feature 1..20: note = CRISPR gRNA sequence
  source 1..20: mol_type = other DNA
gtgatgttaactgtgatcac

SEQ ID NO: 69811 - DNA, 20 bp, synthetic construct
  misc_feature 1..20: note = CRISPR gRNA sequence
  source 1..20: mol_type = other DNA
actgtgatcacctgtgacag

SEQ ID NO: 69812 - DNA, 20 bp, synthetic construct
  misc_feature 1..20: note = CRISPR gRNA sequence
  source 1..20: mol_type = other DNA
tgatcacctgtgacagtggt

SEQ ID NO: 69813 - DNA, 20 bp, synthetic construct
  misc_feature 1..20: note = CRISPR gRNA sequence
  source 1..20: mol_type = other DNA
tgacagtggtgtctgccagg

SEQ ID NO: 69814 - DNA, 20 bp, synthetic construct
  misc_feature 1..20: note = CRISPR gRNA sequence
  source 1..20: mol_type = other DNA
ccaggtctctccacttgcaa

SEQ ID NO: 69815 - DNA, 20 bp, synthetic construct
  misc_feature 1..20: note = CRISPR gRNA sequence
  source 1..20: mol_type = other DNA
tccacttgcaaatttactaa

SEQ ID NO: 69816 - DNA, 20 bp, synthetic construct
  misc_feature 1..20: note = CRISPR gRNA sequence
  source 1..20: mol_type = other DNA
cacttgcaaatttactaact

SEQ ID NO: 69817 - DNA, 20 bp, synthetic construct
  misc_feature 1..20: note = CRISPR gRNA sequence
  source 1..20: mol_type = other DNA
gcaaatttactaactttccc

SEQ ID NO: 69818 - DNA, 20 bp, synthetic construct
  misc_feature 1..20: note = CRISPR gRNA sequence
  source 1..20: mol_type = other DNA
caaatttactaactttccct

SEQ ID NO: 69819 - DNA, 20 bp, synthetic construct
  misc_feature 1..20: note = CRISPR gRNA sequence
  source 1..20: mol_type = other DNA
actaactttccctttgtaat

SEQ ID NO: 69820 - DNA, 20 bp, synthetic construct
  misc_feature 1..20: note = CRISPR gRNA sequence
  source 1..20: mol_type = other DNA
ctaactttccctttgtaatc

SEQ ID NO: 69821 - DNA, 20 bp, synthetic construct
  misc_feature 1..20: note = CRISPR gRNA sequence
  source 1..20: mol_type = other DNA
actttccctttgtaatcaac

SEQ ID NO: 69822 - DNA, 20 bp, synthetic construct
  misc_feature 1..20: note = CRISPR gRNA sequence
  source 1..20: mol_type = other DNA
tccctttgtaatcaacatag

SEQ ID NO: 69823 - DNA, 20 bp, synthetic construct
  misc_feature 1..20: note = CRISPR gRNA sequence
  source 1..20: mol_type = other DNA
ccctttgtaatcaacataga

SEQ ID NO: 69824 - DNA, 20 bp, synthetic construct
  misc_feature 1..20: note = CRISPR gRNA sequence
  source 1..20: mol_type = other DNA
cctttgtaatcaacatagat

SEQ ID NO: 69825 - DNA, 20 bp, synthetic construct
  misc_feature 1..20: note = CRISPR gRNA sequence
  source 1..20: mol_type = other DNA
tgtaatcaacatagattatg

SEQ ID NO: 69826 - DNA, 20 bp, synthetic construct
  misc_feature 1..20: note = CRISPR gRNA sequence
  source 1..20: mol_type = other DNA
gtaatcaacatagattatgt

SEQ ID NO: 69827 - DNA, 20 bp, synthetic construct
  misc_feature 1..20: note = CRISPR gRNA sequence
  source 1..20: mol_type = other DNA
taatcaacatagattatgtg

SEQ ID NO: 69828 - DNA, 20 bp, synthetic construct
  misc_feature 1..20: note = CRISPR gRNA sequence
  source 1..20: mol_type = other DNA
tgtggggagatactttaaga

SEQ ID NO: 69829 - DNA, 20 bp, synthetic construct
  misc_feature 1..20: note = CRISPR gRNA sequence
  source 1..20: mol_type = other DNA
taagattatgtattaagtct

SEQ ID NO: 69830 - DNA, 20 bp, synthetic construct
  misc_feature 1..20: note = CRISPR gRNA sequence
  source 1..20: mol_type = other DNA
aagattatgtattaagtctt

SEQ ID NO: 69831 - DNA, 20 bp, synthetic construct
  misc_feature 1..20: note = CRISPR gRNA sequence
  source 1..20: mol_type = other DNA
agattatgtattaagtcttc

SEQ ID NO: 69832 - DNA, 20 bp, synthetic construct
  misc_feature 1..20: note = CRISPR gRNA sequence
  source 1..20: mol_type = other DNA
tgtattaagtcttcctcaaa

SEQ ID NO: 69833 - DNA, 20 bp, synthetic construct
  misc_feature 1..20: note = CRISPR gRNA sequence
  source 1..20: mol_type = other DNA
agtcttcctcaaactctcat

SEQ ID NO: 69834 - DNA, 20 bp, synthetic construct
  misc_feature 1..20: note = CRISPR gRNA sequence
  source 1..20: mol_type = other DNA
cctcaaactctcattggcaa

SEQ ID NO: 69835 - DNA, 20 bp, synthetic construct
  misc_feature 1..20: note = CRISPR gRNA sequence
  source 1..20: mol_type = other DNA
ctcaaactctcattggcaaa

SEQ ID NO: 69836 - DNA, 20 bp, synthetic construct
  misc_feature 1..20: note = CRISPR gRNA sequence
  source 1..20: mol_type = other DNA
aaactctcattggcaaattt

SEQ ID NO: 69837 - DNA, 20 bp, synthetic construct
  misc_feature 1..20: note = CRISPR gRNA sequence
  source 1..20: mol_type = other DNA
tcattggcaaattttagcag

SEQ ID NO: 69838 - DNA, 20 bp, synthetic construct
  misc_feature 1..20: note = CRISPR gRNA sequence
  source 1..20: mol_type = other DNA
attggcaaattttagcagcc

SEQ ID NO: 69839 - DNA, 20 bp, synthetic construct
  misc_feature 1..20: note = CRISPR gRNA sequence
  source 1..20: mol_type = other DNA
gcaaattttagcagccgtta

SEQ ID NO: 69840 - DNA, 20 bp, synthetic construct
  misc_feature 1..20: note = CRISPR gRNA sequence
  source 1..20: mol_type = other DNA
tagcagccgttaataaatct

SEQ ID NO: 69841 - DNA, 20 bp, synthetic construct
  misc_feature 1..20: note = CRISPR gRNA sequence
  source 1..20: mol_type = other DNA
agcagccgttaataaatctt

SEQ ID NO: 69842 - DNA, 20 bp, synthetic construct
  misc_feature 1..20: note = CRISPR gRNA sequence
  source 1..20: mol_type = other DNA
gcagccgttaataaatctta

SEQ ID NO: 69843 - DNA, 20 bp, synthetic construct
  misc_feature 1..20: note = CRISPR gRNA sequence
  source 1..20: mol_type = other DNA
ataaatcttacttaaatcga

SEQ ID NO: 69844 - DNA, 20 bp, synthetic construct
  misc_feature 1..20: note = CRISPR gRNA sequence
  source 1..20: mol_type = other DNA
acttaaatcgatgaatcagc

SEQ ID NO: 69845 - DNA, 20 bp, synthetic construct
  misc_feature 1..20: note = CRISPR gRNA sequence
  source 1..20: mol_type = other DNA
cttaaatcgatgaatcagca

SEQ ID NO: 69846 - DNA, 20 bp, synthetic construct
  misc_feature 1..20: note = CRISPR gRNA sequence
  source 1..20: mol_type = other DNA
aaatcgatgaatcagcatga

SEQ ID NO: 69847 - DNA, 20 bp, synthetic construct
  misc_feature 1..20: note = CRISPR gRNA sequence
  source 1..20: mol_type = other DNA
aatcgatgaatcagcatgac

SEQ ID NO: 69848 - DNA, 20 bp, synthetic construct
  misc_feature 1..20: note = CRISPR gRNA sequence
  source 1..20: mol_type = other DNA
caaaatgtagctttcctaac

SEQ ID NO: 69849 - DNA, 20 bp, synthetic construct
  misc_feature 1..20: note = CRISPR gRNA sequence
  source 1..20: mol_type = other DNA
tcctaactttacattttatt

SEQ ID NO: 69850 - DNA, 20 bp, synthetic construct
  misc_feature 1..20: note = CRISPR gRNA sequence
  source 1..20: mol_type = other DNA
cctaactttacattttattt

SEQ ID NO: 69851 - DNA, 20 bp, synthetic construct
  misc_feature 1..20: note = CRISPR gRNA sequence
  source 1..20: mol_type = other DNA
ctaactttacattttatttc

SEQ ID NO: 69852 - DNA, 20 bp, synthetic construct
  misc_feature 1..20: note = CRISPR gRNA sequence
  source 1..20: mol_type = other DNA
actttacattttatttccat

SEQ ID NO: 69853 - DNA, 20 bp, synthetic construct
  misc_feature 1..20: note = CRISPR gRNA sequence
  source 1..20: mol_type = other DNA
tacattttatttccatctaa

SEQ ID NO: 69854 - DNA, 20 bp, synthetic construct
  misc_feature 1..20: note = CRISPR gRNA sequence
  source 1..20: mol_type = other DNA
acattttatttccatctaac

SEQ ID NO: 69855 - DNA, 20 bp, synthetic construct
  misc_feature 1..20: note = CRISPR gRNA sequence
  source 1..20: mol_type = other DNA
cattttatttccatctaact

SEQ ID NO: 69856 - DNA, 20 bp, synthetic construct
  misc_feature 1..20: note = CRISPR gRNA sequence
  source 1..20: mol_type = other DNA
tatttccatctaactgatta

SEQ ID NO: 69857 - DNA, 20 bp, synthetic construct
  misc_feature 1..20: note = CRISPR gRNA sequence
  source 1..20: mol_type = other DNA
atttccatctaactgattac

SEQ ID NO: 69858 - DNA, 20 bp, synthetic construct
  misc_feature 1..20: note = CRISPR gRNA sequence
  source 1..20: mol_type = other DNA
tttccatctaactgattaca

SEQ ID NO: 69859 - DNA, 20 bp, synthetic construct
  misc_feature 1..20: note = CRISPR gRNA sequence
  source 1..20: mol_type = other DNA
ccatctaactgattacacca

SEQ ID NO: 69860 - DNA, 20 bp, synthetic construct
  misc_feature 1..20: note = CRISPR gRNA sequence
  source 1..20: mol_type = other DNA
catctaactgattacaccaa

SEQ ID NO: 69861 - DNA, 20 bp, synthetic construct
  misc_feature 1..20: note = CRISPR gRNA sequence
  source 1..20: mol_type = other DNA
actgattacaccaagaagaa

SEQ ID NO: 69862 - DNA, 20 bp, synthetic construct
  misc_feature 1..20: note = CRISPR gRNA sequence
  source 1..20: mol_type = other DNA
attacaccaagaagaaactc

SEQ ID NO: 69863 - DNA, 20 bp, synthetic construct
  misc_feature 1..20: note = CRISPR gRNA sequence
  source 1..20: mol_type = other DNA
caccaagaagaaactcttgg

SEQ ID NO: 69864 - DNA, 20 bp, synthetic construct
  misc_feature 1..20: note = CRISPR gRNA sequence
  source 1..20: mol_type = other DNA
ttgggctgggaacagtggct

SEQ ID NO: 69865 - DNA, 20 bp, synthetic construct
  misc_feature 1..20: note = CRISPR gRNA sequence
  source 1..20: mol_type = other DNA
gggctgggaacagtggctca

SEQ ID NO: 69866 - DNA, 20 bp, synthetic construct
  misc_feature 1..20: note = CRISPR gRNA sequence
  source 1..20: mol_type = other DNA
ggctgggaacagtggctcaa

SEQ ID NO: 69867 - DNA, 20 bp, synthetic construct
  misc_feature 1..20: note = CRISPR gRNA sequence
  source 1..20: mol_type = other DNA
ggaacagtggctcaagcttg

SEQ ID NO: 69868 - DNA, 20 bp, synthetic construct
  misc_feature 1..20: note = CRISPR gRNA sequence
  source 1..20: mol_type = other DNA
aagcttgtaatcccagcact

SEQ ID NO: 69869 - DNA, 20 bp, synthetic construct
  misc_feature 1..20: note = CRISPR gRNA sequence
  source 1..20: mol_type = other DNA
gtaatcccagcactctggga

SEQ ID NO: 69870 - DNA, 20 bp, synthetic construct
  misc_feature 1..20: note = CRISPR gRNA sequence
  source 1..20: mol_type = other DNA
taatcccagcactctgggag

SEQ ID NO: 69871 - DNA, 20 bp, synthetic construct
  misc_feature 1..20: note = CRISPR gRNA sequence
  source 1..20: mol_type = other DNA
tgggaggccgaggaggaaaa

SEQ ID NO: 69872 - DNA, 20 bp, synthetic construct
  misc_feature 1..20: note = CRISPR gRNA sequence
  source 1..20: mol_type = other DNA
ggaggccgaggaggaaaaat

SEQ ID NO: 69873 - DNA, 20 bp, synthetic construct
  misc_feature 1..20: note = CRISPR gRNA sequence
  source 1..20: mol_type = other DNA
gagcccgggagttcgacacc

SEQ ID NO: 69874 - DNA, 20 bp, synthetic construct
  misc_feature 1..20: note = CRISPR gRNA sequence
  source 1..20: mol_type = other DNA
agcccgggagttcgacacca

SEQ ID NO: 69875 - DNA, 20 bp, synthetic construct
  misc_feature 1..20: note = CRISPR gRNA sequence
  source 1..20: mol_type = other DNA
gacaccagcctgagcaacat

SEQ ID NO: 69876 - DNA, 20 bp, synthetic construct
  misc_feature 1..20: note = CRISPR gRNA sequence
  source 1..20: mol_type = other DNA
agcaacatagcgagaccacc

SEQ ID NO: 69877 - DNA, 20 bp, synthetic construct
  misc_feature 1..20: note = CRISPR gRNA sequence
  source 1..20: mol_type = other DNA
tacaaaaaataaataaataa

SEQ ID NO: 69878 - DNA, 20 bp, synthetic construct
  misc_feature 1..20: note = CRISPR gRNA sequence
  source 1..20: mol_type = other DNA
caaaaaataaataaataaaa

SEQ ID NO: 69879 - DNA, 20 bp, synthetic construct
  misc_feature 1..20: note = CRISPR gRNA sequence
  source 1..20: mol_type = other DNA
aaaaaggaagaaactcttta

SEQ ID NO: 69880 - DNA, 20 bp, synthetic construct
  misc_feature 1..20: note = CRISPR gRNA sequence
  source 1..20: mol_type = other DNA
aaaaggaagaaactctttag

SEQ ID NO: 69881 - DNA, 20 bp, synthetic construct
  misc_feature 1..20: note = CRISPR gRNA sequence
  source 1..20: mol_type = other DNA
tttaggacagagagatcttt

SEQ ID NO: 69882 - DNA, 20 bp, synthetic construct
  misc_feature 1..20: note = CRISPR gRNA sequence
  source 1..20: mol_type = other DNA
taggacagagagatctttga

SEQ ID NO: 69883 - DNA, 20 bp, synthetic construct
  misc_feature 1..20: note = CRISPR gRNA sequence
  source 1..20: mol_type = other DNA
aggacagagagatctttgac

SEQ ID NO: 69884 - DNA, 20 bp, synthetic construct
  misc_feature 1..20: note = CRISPR gRNA sequence
  source 1..20: mol_type = other DNA
ggacagagagatctttgaca

SEQ ID NO: 69885 - DNA, 20 bp, synthetic construct
  misc_feature 1..20: note = CRISPR gRNA sequence
  source 1..20: mol_type = other DNA
tgacacttcttcagtatttg

SEQ ID NO: 69886 - DNA, 20 bp, synthetic construct
  misc_feature 1..20: note = CRISPR gRNA sequence
  source 1..20: mol_type = other DNA
gacacttcttcagtatttgc

SEQ ID NO: 69887 - DNA, 20 bp, synthetic construct
  misc_feature 1..20: note = CRISPR gRNA sequence
  source 1..20: mol_type = other DNA
acacttcttcagtatttgct

SEQ ID NO: 69888 - DNA, 20 bp, synthetic construct
  misc_feature 1..20: note = CRISPR gRNA sequence
  source 1..20: mol_type = other DNA
cttcagtatttgctttaaag

SEQ ID NO: 69889 - DNA, 20 bp, synthetic construct
  misc_feature 1..20: note = CRISPR gRNA sequence
  source 1..20: mol_type = other DNA
ttcagtatttgctttaaaga

SEQ ID NO: 69890 - DNA, 20 bp, synthetic construct
  misc_feature 1..20: note = CRISPR gRNA sequence
  source 1..20: mol_type = other DNA
cagtatttgctttaaagatg

SEQ ID NO: 69891 - DNA, 20 bp, synthetic construct
  misc_feature 1..20: note = CRISPR gRNA sequence
  source 1..20: mol_type = other DNA
agtatttgctttaaagatgc

SEQ ID NO: 69892 - DNA, 20 bp, synthetic construct
  misc_feature 1..20: note = CRISPR gRNA sequence
  source 1..20: mol_type = other DNA
gctttaaagatgcagagttt

SEQ ID NO: 69893 - DNA, 20 bp, synthetic construct
  misc_feature 1..20: note = CRISPR gRNA sequence
  source 1..20: mol_type = other DNA
ctttaaagatgcagagtttg

SEQ ID NO: 69894 - DNA, 20 bp, synthetic construct
  misc_feature 1..20: note = CRISPR gRNA sequence
  source 1..20: mol_type = other DNA
taaagatgcagagtttgtaa

SEQ ID NO: 69895 - DNA, 20 bp, synthetic construct
  misc_feature 1..20: note = CRISPR gRNA sequence
  source 1..20: mol_type = other DNA
aaagatgcagagtttgtaat

SEQ ID NO: 69896 - DNA, 20 bp, synthetic construct
  misc_feature 1..20: note = CRISPR gRNA sequence
  source 1..20: mol_type = other DNA
aagatgcagagtttgtaata

SEQ ID NO: 69897 - DNA, 20 bp, synthetic construct
  misc_feature 1..20: note = CRISPR gRNA sequence
  source 1..20: mol_type = other DNA
gtaataaacaacagtaacta

SEQ ID NO: 69898 - DNA, 20 bp, synthetic construct
  misc_feature 1..20: note = CRISPR gRNA sequence
  source 1..20: mol_type = other DNA
taataaacaacagtaactag

SEQ ID NO: 69899 - DNA, 20 bp, synthetic construct
  misc_feature 1..20: note = CRISPR gRNA sequence
  source 1..20: mol_type = other DNA
gctaaactacagtgatacct

SEQ ID NO: 69900 - DNA, 20 bp, synthetic construct
  misc_feature 1..20: note = CRISPR gRNA sequence
  source 1..20: mol_type = other DNA
aactacagtgatacctaatc

SEQ ID NO: 69901 - DNA, 20 bp, synthetic construct
  misc_feature 1..20: note = CRISPR gRNA sequence
  source 1..20: mol_type = other DNA
cagtgatacctaatcctggc

SEQ ID NO: 69902 - DNA, 20 bp, synthetic construct
  misc_feature 1..20: note = CRISPR gRNA sequence
  source 1..20: mol_type = other DNA
atcctggcttaagttgtgaa

SEQ ID NO: 69903 - DNA, 20 bp, synthetic construct
  misc_feature 1..20: note = CRISPR gRNA sequence
  source 1..20: mol_type = other DNA
gcttaagttgtgaagttgct

SEQ ID NO: 69904 - DNA, 20 bp, synthetic construct
  misc_feature 1..20: note = CRISPR gRNA sequence
  source 1..20: mol_type = other DNA
aagttgtgaagttgctacct

SEQ ID NO: 69905 - DNA, 20 bp, synthetic construct
  misc_feature 1..20: note = CRISPR gRNA sequence
  source 1..20: mol_type = other DNA
agttgtgaagttgctacctg

SEQ ID NO: 69906 - DNA, 20 bp, synthetic construct
  misc_feature 1..20: note = CRISPR gRNA sequence
  source 1..20: mol_type = other DNA
tgaagttgctacctgaatga

SEQ ID NO: 69907 - DNA, 20 bp, synthetic construct
  misc_feature 1..20: note = CRISPR gRNA sequence
  source 1..20: mol_type = other DNA
ctacctgaatgactgcggtt

SEQ ID NO: 69908 - DNA, 20 bp, synthetic construct
  misc_feature 1..20: note = CRISPR gRNA sequence
  source 1..20: mol_type = other DNA
cctgaatgactgcggtttag

SEQ ID NO: 69909 - DNA, 20 bp, synthetic construct
  misc_feature 1..20: note = CRISPR gRNA sequence
  source 1..20: mol_type = other DNA
aatgactgcggtttaggaaa

SEQ ID NO: 69910 - DNA, 20 bp, synthetic construct
  misc_feature 1..20: note = CRISPR gRNA sequence
  source 1..20: mol_type = other DNA
cggtttaggaaatactgaac

SEQ ID NO: 69911 - DNA, 20 bp, synthetic construct
  misc_feature 1..20: note = CRISPR gRNA sequence
  source 1..20: mol_type = other DNA
aggaaatactgaactagtcc

SEQ ID NO: 69912 - DNA, 20 bp, synthetic construct
  misc_feature 1..20: note = CRISPR gRNA sequence
  source 1..20: mol_type = other DNA
ggaaatactgaactagtcca

SEQ ID NO: 69913 - DNA, 20 bp, synthetic construct
  misc_feature 1..20: note = CRISPR gRNA sequence
  source 1..20: mol_type = other DNA
aactagtccatgcttctgct

SEQ ID NO: 69914 - DNA, 20 bp, synthetic construct
  misc_feature 1..20: note = CRISPR gRNA sequence
  source 1..20: mol_type = other DNA
gtccatgcttctgcttccaa

SEQ ID NO: 69915 - DNA, 20 bp, synthetic construct
  misc_feature 1..20: note = CRISPR gRNA sequence
  source 1..20: mol_type = other DNA
ctgcttccaagctctgtggt

SEQ ID NO: 69916 - DNA, 20 bp, synthetic construct
  misc_feature 1..20: note = CRISPR gRNA sequence
  source 1..20: mol_type = other DNA
tgcttccaagctctgtggtg

SEQ ID NO: 69917 - DNA, 20 bp, synthetic construct
  misc_feature 1..20: note = CRISPR gRNA sequence
  source 1..20: mol_type = other DNA
cttccaagctctgtggtggc

SEQ ID NO: 69918 - DNA, 20 bp, synthetic construct
  misc_feature 1..20: note = CRISPR gRNA sequence
  source 1..20: mol_type = other DNA
ccaagctctgtggtggctta

SEQ ID NO: 69919 - DNA, 20 bp, synthetic construct
  misc_feature 1..20: note = CRISPR gRNA sequence
  source 1..20: mol_type = other DNA
caagctctgtggtggcttaa

SEQ ID NO: 69920 - DNA, 20 bp, synthetic construct
  misc_feature 1..20: note = CRISPR gRNA sequence
  source 1..20: mol_type = other DNA
tgtggtggcttaatgagttc

SEQ ID NO: 69921 - DNA, 20 bp, synthetic construct
  misc_feature 1..20: note = CRISPR gRNA sequence
  source 1..20: mol_type = other DNA
tggtggcttaatgagttcat

SEQ ID NO: 69922 - DNA, 20 bp, synthetic construct
  misc_feature 1..20: note = CRISPR gRNA sequence
  source 1..20: mol_type = other DNA
aatgagttcatggtggaaga

SEQ ID NO: 69923 - DNA, 20 bp, synthetic construct
  misc_feature 1..20: note = CRISPR gRNA sequence
  source 1..20: mol_type = other DNA
atgagttcatggtggaagag

SEQ ID NO: 69924 - DNA, 20 bp, synthetic construct
  misc_feature 1..20: note = CRISPR gRNA sequence
  source 1..20: mol_type = other DNA
atggtggaagagatttacga

SEQ ID NO: 69925 - DNA, 20 bp, synthetic construct
  misc_feature 1..20: note = CRISPR gRNA sequence
  source 1..20: mol_type = other DNA
acgaagggaaggaggtctcc

SEQ ID NO: 69926 - DNA, 20 bp, synthetic construct
  misc_feature 1..20: note = CRISPR gRNA sequence
  source 1..20: mol_type = other DNA
cgaagggaaggaggtctcct

SEQ ID NO: 69927 - DNA, 20 bp, synthetic construct
  misc_feature 1..20: note = CRISPR gRNA sequence
  source 1..20: mol_type = other DNA
ctcacattgcccgccacatc

SEQ ID NO: 69928 - DNA, 20 bp, synthetic construct
  misc_feature 1..20: note = CRISPR gRNA sequence
  source 1..20: mol_type = other DNA
acattgcccgccacatccct

SEQ ID NO: 69929 - DNA, 20 bp, synthetic construct
  misc_feature 1..20: note = CRISPR gRNA sequence
  source 1..20: mol_type = other DNA
cccgccacatccctacccca

SEQ ID NO: 69930 - DNA, 20 bp, synthetic construct
  misc_feature 1..20: note = CRISPR gRNA sequence
  source 1..20: mol_type = other DNA
ccccacatccttgccctctg

SEQ ID NO: 69931 - DNA, 20 bp, synthetic construct
  misc_feature 1..20: note = CRISPR gRNA sequence
  source 1..20: mol_type = other DNA
gccctctgccaccagcattc

SEQ ID NO: 69932 - DNA, 20 bp, synthetic construct
  misc_feature 1..20: note = CRISPR gRNA sequence
  source 1..20: mol_type = other DNA
ccctctgccaccagcattca

SEQ ID NO: 69933 - DNA, 20 bp, synthetic construct
  misc_feature 1..20: note = CRISPR gRNA sequence
  source 1..20: mol_type = other DNA
tgccaccagcattcagagct

SEQ ID NO: 69934 - DNA, 20 bp, synthetic construct
  misc_feature 1..20: note = CRISPR gRNA sequence
  source 1..20: mol_type = other DNA
ccaccagcattcagagctcc

SEQ ID NO: 69935 - DNA, 20 bp, synthetic construct
  misc_feature 1..20: note = CRISPR gRNA sequence
  source 1..20: mol_type = other DNA
agagctcccaagacccaggg

SEQ ID NO: 69936 - DNA, 20 bp, synthetic construct
  misc_feature 1..20: note = CRISPR gRNA sequence
  source 1..20: mol_type = other DNA
ccaagacccagggcggctcc

SEQ ID NO: 69937 - DNA, 20 bp, synthetic construct
  misc_feature 1..20: note = CRISPR gRNA sequence
  source 1..20: mol_type = other DNA
ctgcctgacctgttgccctt

SEQ ID NO: 69938 - DNA, 20 bp, synthetic construct
  misc_feature 1..20: note = CRISPR gRNA sequence
  source 1..20: mol_type = other DNA
cctgacctgttgccctttga

SEQ ID NO: 69939 - DNA, 20 bp, synthetic construct
  misc_feature 1..20: note = CRISPR gRNA sequence
  source 1..20: mol_type = other DNA
acctgttgccctttgacccc

SEQ ID NO: 69940 - DNA, 20 bp, synthetic construct
  misc_feature 1..20: note = CRISPR gRNA sequence
  source 1..20: mol_type = other DNA
ttgccctttgacccccacca

SEQ ID NO: 69941 - DNA, 20 bp, synthetic construct
  misc_feature 1..20: note = CRISPR gRNA sequence
  source 1..20: mol_type = other DNA
ccctttgacccccaccaggc

SEQ ID NO: 69942 - DNA, 20 bp, synthetic construct
  misc_feature 1..20: note = CRISPR gRNA sequence
  source 1..20: mol_type = other DNA
tgacccccaccaggctgacc

SEQ ID NO: 69943 - DNA, 20 bp, synthetic construct
  misc_feature 1..20: note = CRISPR gRNA sequence
  source 1..20: mol_type = other DNA
gacccccaccaggctgacct

SEQ ID NO: 69944 - DNA, 20 bp, synthetic construct
  misc_feature 1..20: note = CRISPR gRNA sequence
  source 1..20: mol_type = other DNA
acccccaccaggctgacctc

SEQ ID NO: 69945 - DNA, 20 bp, synthetic construct
  misc_feature 1..20: note = CRISPR gRNA sequence
  source 1..20: mol_type = other DNA
acctccagctgtgtgagcac

SEQ ID NO: 69946 - DNA, 20 bp, synthetic construct
  misc_feature 1..20: note = CRISPR gRNA sequence
  source 1..20: mol_type = other DNA
cagctgtgtgagcaccgagg

SEQ ID NO: 69947 - DNA, 20 bp, synthetic construct
  misc_feature 1..20: note = CRISPR gRNA sequence
  source 1..20: mol_type = other DNA
tgtgagcaccgagggcctcg

SEQ ID NO: 69948 - DNA, 20 bp, synthetic construct
  misc_feature 1..20: note = CRISPR gRNA sequence
  source 1..20: mol_type = other DNA
gcccacctggcatctggtct

SEQ ID NO: 69949 - DNA, 20 bp, synthetic construct
  misc_feature 1..20: note = CRISPR gRNA sequence
  source 1..20: mol_type = other DNA
gcatctggtctgggccactg

SEQ ID NO: 69950 - DNA, 20 bp, synthetic construct
  misc_feature 1..20: note = CRISPR gRNA sequence
  source 1..20: mol_type = other DNA
gtctgggccactgccaccac

SEQ ID NO: 69951 - DNA, 20 bp, synthetic construct
  misc_feature 1..20: note = CRISPR gRNA sequence
  source 1..20: mol_type = other DNA
ggccactgccaccacttgga

SEQ ID NO: 69952 - DNA, 20 bp, synthetic construct
  misc_feature 1..20: note = CRISPR gRNA sequence
  source 1..20: mol_type = other DNA
ccaccacttggaggagctgg

SEQ ID NO: 69953 - DNA, 20 bp, synthetic construct
  misc_feature 1..20: note = CRISPR gRNA sequence
  source 1..20: mol_type = other DNA
ggaggagctggagtgagttg

SEQ ID NO: 69954 - DNA, 20 bp, synthetic construct
  misc_feature 1..20: note = CRISPR gRNA sequence
  source 1..20: mol_type = other DNA
gaggagctggagtgagttgc

SEQ ID NO: 69955 - DNA, 20 bp, synthetic construct
  misc_feature 1..20: note = CRISPR gRNA sequence
  source 1..20: mol_type = other DNA
gagtgagttgcagagtggag

SEQ ID NO: 69956 - DNA, 20 bp, synthetic construct
  misc_feature 1..20: note = CRISPR gRNA sequence
  source 1..20: mol_type = other DNA
cagagtggagggattgggga

SEQ ID NO: 69957 - DNA, 20 bp, synthetic construct
  misc_feature 1..20: note = CRISPR gRNA sequence
  source 1..20: mol_type = other DNA
gggacaagtggcccagctga

SEQ ID NO: 69958 - DNA, 20 bp, synthetic construct
  misc_feature 1..20: note = CRISPR gRNA sequence
  source 1..20: mol_type = other DNA
agggtgaggggtggagaaga

SEQ ID NO: 69959 - DNA, 20 bp, synthetic construct
  misc_feature 1..20: note = CRISPR gRNA sequence
  source 1..20: mol_type = other DNA
gggagggcaggcaatgagac

SEQ ID NO: 69960 - DNA, 20 bp, synthetic construct
  misc_feature 1..20: note = CRISPR gRNA sequence
  source 1..20: mol_type = other DNA
ggagggcaggcaatgagact

SEQ ID NO: 69961 - DNA, 20 bp, synthetic construct
  misc_feature 1..20: note = CRISPR gRNA sequence
  source 1..20: mol_type = other DNA
caaccaatgacccttcccct

SEQ ID NO: 69962 - DNA, 20 bp, synthetic construct
  misc_feature 1..20: note = CRISPR gRNA sequence
  source 1..20: mol_type = other DNA
aaccaatgacccttcccctg

SEQ ID NO: 69963 - DNA, 20 bp, synthetic construct
  misc_feature 1..20: note = CRISPR gRNA sequence
  source 1..20: mol_type = other DNA
cccctgatgaagtgcagcag

SEQ ID NO: 69964 - DNA, 20 bp, synthetic construct
  misc_feature 1..20: note = CRISPR gRNA sequence
  source 1..20: mol_type = other DNA
ccctgatgaagtgcagcagt

SEQ ID NO: 69965 - DNA, 20 bp, synthetic construct
  misc_feature 1..20: note = CRISPR gRNA sequence
  source 1..20: mol_type = other DNA
atgaagtgcagcagttctgg

SEQ ID NO: 69966 - DNA, 20 bp, synthetic construct
  misc_feature 1..20: note = CRISPR gRNA sequence
  source 1..20: mol_type = other DNA
tgggtgtggcctggggaagg

SEQ ID NO: 69967 - DNA, 20 bp, synthetic construct
  misc_feature 1..20: note = CRISPR gRNA sequence
  source 1..20: mol_type = other DNA
ggtgtggcctggggaaggaa

SEQ ID NO: 69968 - DNA, 20 bp, synthetic construct
  misc_feature 1..20: note = CRISPR gRNA sequence
  source 1..20: mol_type = other DNA
gggaaggaagagcaccacag

SEQ ID NO: 69969 - DNA, 20 bp, synthetic construct
  misc_feature 1..20: note = CRISPR gRNA sequence
  source 1..20: mol_type = other DNA
tggtctgaatttcgccactg

SEQ ID NO: 69970 - DNA, 20 bp, synthetic construct
  misc_feature 1..20: note = CRISPR gRNA sequence
  source 1..20: mol_type = other DNA
ggtctgaatttcgccactga

SEQ ID NO: 69971 - DNA, 20 bp, synthetic construct
  misc_feature 1..20: note = CRISPR gRNA sequence
  source 1..20: mol_type = other DNA
gtctgaatttcgccactgac

SEQ ID NO: 69972 - DNA, 20 bp, synthetic construct
  misc_feature 1..20: note = CRISPR gRNA sequence
  source 1..20: mol_type = other DNA
aatttcgccactgactcaca

SEQ ID NO: 69973 - DNA, 20 bp, synthetic construct
  misc_feature 1..20: note = CRISPR gRNA sequence
  source 1..20: mol_type = other DNA
cgccactgactcacagaggg

SEQ ID NO: 69974 - DNA, 20 bp, synthetic construct
  misc_feature 1..20: note = CRISPR gRNA sequence
  source 1..20: mol_type = other DNA
gccactgactcacagagggg

SEQ ID NO: 69975 - DNA, 20 bp, synthetic construct
  misc_feature 1..20: note = CRISPR gRNA sequence
  source 1..20: mol_type = other DNA
actcacagaggggctgtggg

SEQ ID NO: 69976 - DNA, 20 bp, synthetic construct
  misc_feature 1..20: note = CRISPR gRNA sequence
  source 1..20: mol_type = other DNA
acagaggggctgtgggcatg

SEQ ID NO: 69977 - DNA, 20 bp, synthetic construct
  misc_feature 1..20: note = CRISPR gRNA sequence
  source 1..20: mol_type = other DNA
tgggcatggctgttccactc

SEQ ID NO: 69978 - DNA, 20 bp, synthetic construct
  misc_feature 1..20: note = CRISPR gRNA sequence
  source 1..20: mol_type = other DNA
ttccactctgggctttgatt

SEQ ID NO: 69979 - DNA, 20 bp, synthetic construct
  misc_feature 1..20: note = CRISPR gRNA sequence
  source 1..20: mol_type = other DNA
cactctgggctttgattgcc

SEQ ID NO: 69980 - DNA, 20 bp, synthetic construct
  misc_feature 1..20: note = CRISPR gRNA sequence
  source 1..20: mol_type = other DNA
tgggctttgattgccttatc

SEQ ID NO: 69981 - DNA, 20 bp, synthetic construct
  misc_feature 1..20: note = CRISPR gRNA sequence
  source 1..20: mol_type = other DNA
ggctttgattgccttatcta

SEQ ID NO: 69982 - DNA, 20 bp, synthetic construct
  misc_feature 1..20: note = CRISPR gRNA sequence
  source 1..20: mol_type = other DNA
tgattgccttatctatgaaa

SEQ ID NO: 69983 - DNA, 20 bp, synthetic construct
  misc_feature 1..20: note = CRISPR gRNA sequence
  source 1..20: mol_type = other DNA
gattgccttatctatgaaaa

SEQ ID NO: 69984 - DNA, 20 bp, synthetic construct
  misc_feature 1..20: note = CRISPR gRNA sequence
  source 1..20: mol_type = other DNA
attgccttatctatgaaaat

SEQ ID NO: 69985 - DNA, 20 bp, synthetic construct
  misc_feature 1..20: note = CRISPR gRNA sequence
  source 1..20: mol_type = other DNA
ccttatctatgaaaatgggg

SEQ ID NO: 69986 - DNA, 20 bp, synthetic construct
  misc_feature 1..20: note = CRISPR gRNA sequence
  source 1..20: mol_type = other DNA
atctatgaaaatggggctca

SEQ ID NO: 69987 - DNA, 20 bp, synthetic construct
  misc_feature 1..20: note = CRISPR gRNA sequence
  source 1..20: mol_type = other DNA
tctatgaaaatggggctcat

SEQ ID NO: 69988 - DNA, 20 bp, synthetic construct
  misc_feature 1..20: note = CRISPR gRNA sequence
  source 1..20: mol_type = other DNA
tgaaaatggggctcatgagc

SEQ ID NO: 69989 - DNA, 20 bp, synthetic construct
  misc_feature 1..20: note = CRISPR gRNA sequence
  source 1..20: mol_type = other DNA
atgagccttgctctgctggg

SEQ ID NO: 69990 - DNA, 20 bp, synthetic construct
  misc_feature 1..20: note = CRISPR gRNA sequence
  source 1..20: mol_type = other DNA
gctctgctgggctggctgtg

SEQ ID NO: 69991 - DNA, 20 bp, synthetic construct
  misc_feature 1..20: note = CRISPR gRNA sequence
  source 1..20: mol_type = other DNA
ctctgctgggctggctgtgg

SEQ ID NO: 69992 - DNA, 20 bp, synthetic construct
  misc_feature 1..20: note = CRISPR gRNA sequence
  source 1..20: mol_type = other DNA
tgctgggctggctgtgggag

SEQ ID NO: 69993 - DNA, 20 bp, synthetic construct
  misc_feature 1..20: note = CRISPR gRNA sequence
  source 1..20: mol_type = other DNA
ctgggctggctgtgggagtc

SEQ ID NO: 69994 - DNA, 20 bp, synthetic construct
  misc_feature 1..20: note = CRISPR gRNA sequence
  source 1..20: mol_type = other DNA
ggctggctgtgggagtcagg

SEQ ID NO: 69995 - DNA, 20 bp, synthetic construct
  misc_feature 1..20: note = CRISPR gRNA sequence
  source 1..20: mol_type = other DNA
gctgtgggagtcaggctacg

SEQ ID NO: 69996 - DNA, 20 bp, synthetic construct
  misc_feature 1..20: note = CRISPR gRNA sequence
  source 1..20: mol_type = other DNA
tgggagtcaggctacggaga

SEQ ID NO: 69997 - DNA, 20 bp, synthetic construct
  misc_feature 1..20: note = CRISPR gRNA sequence
  source 1..20: mol_type = other DNA
cggagagggctgaagaacaa

SEQ ID NO: 69998 - DNA, 20 bp, synthetic construct
  misc_feature 1..20: note = CRISPR gRNA sequence
  source 1..20: mol_type = other DNA
aagaacaagagggtgtgtgt

SEQ ID NO: 69999 - DNA, 20 bp, synthetic construct
  misc_feature 1..20: note = CRISPR gRNA sequence
  source 1..20: mol_type = other DNA
gtcccccagcttcctctctg

SEQ ID NO: 70000 - DNA, 20 bp, synthetic construct
  misc_feature 1..20: note = CRISPR gRNA sequence
  source 1..20: mol_type = other DNA
cctctctgcagccttcatcc

SEQ ID NO: 70001 - DNA, 20 bp, synthetic construct
  misc_feature 1..20: note = CRISPR gRNA sequence
  source 1..20: mol_type = other DNA
ctctctgcagccttcatcca

SEQ ID NO: 70002 - DNA, 20 bp, synthetic construct
  misc_feature 1..20: note = CRISPR gRNA sequence
  source 1..20: mol_type = other DNA
tctgcagccttcatccaggg

SEQ ID NO: 70003 - DNA, 20 bp, synthetic construct
  misc_feature 1..20: note = CRISPR gRNA sequence
  source 1..20: mol_type = other DNA
tgcagccttcatccagggca

SEQ ID NO: 70004 - DNA, 20 bp, synthetic construct
  misc_feature 1..20: note = CRISPR gRNA sequence
  source 1..20: mol_type = other DNA
cagccttcatccagggcata

SEQ ID NO: 70005 - DNA, 20 bp, synthetic construct
  misc_feature 1..20: note = CRISPR gRNA sequence
  source 1..20: mol_type = other DNA
catccagggcatagtttctc

SEQ ID NO: 70006 - DNA, 20 bp, synthetic construct
  misc_feature 1..20: note = CRISPR gRNA sequence
  source 1..20: mol_type = other DNA
atccagggcatagtttctca

SEQ ID NO: 70007 - DNA, 20 bp, synthetic construct
  misc_feature 1..20: note = CRISPR gRNA sequence
  source 1..20: mol_type = other DNA
ctcagctgggccagctgtga

SEQ ID NO: 70008 - DNA, 20 bp, synthetic construct
  misc_feature 1..20: note = CRISPR gRNA sequence
  source 1..20: mol_type = other DNA
tcagctgggccagctgtgac

SEQ ID NO: 70009 - DNA, 20 bp, synthetic construct
  misc_feature 1..20: note = CRISPR gRNA sequence
  source 1..20: mol_type = other DNA
agctgggccagctgtgacta

SEQ ID NO: 70010 - DNA, 20 bp, synthetic construct
  misc_feature 1..20: note = CRISPR gRNA sequence
  source 1..20: mol_type = other DNA
ggccagctgtgactatcatg

SEQ ID NO: 70011 - DNA, 20 bp, synthetic construct
  misc_feature 1..20: note = CRISPR gRNA sequence
  source 1..20: mol_type = other DNA
tgactatcatgcctacccag

SEQ ID NO: 70012 - DNA, 20 bp, synthetic construct
  misc_feature 1..20: note = CRISPR gRNA sequence
  source 1..20: mol_type = other DNA
tcatgcctacccagagcctg

SEQ ID NO: 70013 - DNA, 20 bp, synthetic construct
  misc_feature 1..20: note = CRISPR gRNA sequence
  source 1..20: mol_type = other DNA
cccagagcctgagccctgga

SEQ ID NO: 70014 - DNA, 20 bp, synthetic construct
  misc_feature 1..20: note = CRISPR gRNA sequence
  source 1..20: mol_type = other DNA
agccctggagctagggatac

SEQ ID NO: 70015 - DNA, 20 bp, synthetic construct
  misc_feature 1..20: note = CRISPR gRNA sequence
  source 1..20: mol_type = other DNA
gagctagggatacccatggg

SEQ ID NO: 70016 - DNA, 20 bp, synthetic construct
  misc_feature 1..20: note = CRISPR gRNA sequence
  source 1..20: mol_type = other DNA
gggatacccatggggaacct

SEQ ID NO: 70017 - DNA, 20 bp, synthetic construct
  misc_feature 1..20: note = CRISPR gRNA sequence
  source 1..20: mol_type = other DNA
gacagcgagggtggcccagg

SEQ ID NO: 70018 - DNA, 20 bp, synthetic construct
  misc_feature 1..20: note = CRISPR gRNA sequence
  source 1..20: mol_type = other DNA
gcctcccaggggacagagca

SEQ ID NO: 70019 - DNA, 20 bp, synthetic construct
  misc_feature 1..20: note = CRISPR gRNA sequence
  source 1..20: mol_type = other DNA
ccaggggacagagcaggaga

SEQ ID NO: 70020 - DNA, 20 bp, synthetic construct
  misc_feature 1..20: note = CRISPR gRNA sequence
  source 1..20: mol_type = other DNA
acaggacagctcagctccag

SEQ ID NO: 70021 - DNA, 20 bp, synthetic construct
  misc_feature 1..20: note = CRISPR gRNA sequence
  source 1..20: mol_type = other DNA
agctccagggctgggcaggc

SEQ ID NO: 70022 - DNA, 20 bp, synthetic construct
  misc_feature 1..20: note = CRISPR gRNA sequence
  source 1..20: mol_type = other DNA
cagggctgggcaggctgcgc

SEQ ID NO: 70023 - DNA, 20 bp, synthetic construct
  misc_feature 1..20: note = CRISPR gRNA sequence
  source 1..20: mol_type = other DNA
ggcaggctgcgctaaccctt

SEQ ID NO: 70024 - DNA, 20 bp, synthetic construct
  misc_feature 1..20: note = CRISPR gRNA sequence
  source 1..20: mol_type = other DNA
cgctaacccttgcctctgcc

SEQ ID NO: 70025 - DNA, 20 bp, synthetic construct
  misc_feature 1..20: note = CRISPR gRNA sequence
  source 1..20: mol_type = other DNA
acccttgcctctgcctggtc

SEQ ID NO: 70026 - DNA, 20 bp, synthetic construct
  misc_feature 1..20: note = CRISPR gRNA sequence
  source 1..20: mol_type = other DNA
gcctctgcctggtcttctgc

SEQ ID NO: 70027 - DNA, 20 bp, synthetic construct
  misc_feature 1..20: note = CRISPR gRNA sequence
  source 1..20: mol_type = other DNA
cctctgcctggtcttctgca

SEQ ID NO: 70028 - DNA, 20 bp, synthetic construct
  misc_feature 1..20: note = CRISPR gRNA sequence
  source 1..20: mol_type = other DNA
tgcctggtcttctgcagctt

SEQ ID NO: 70029 - DNA, 20 bp, synthetic construct
  misc_feature 1..20: note = CRISPR gRNA sequence
  source 1..20: mol_type = other DNA
cctggtcttctgcagcttgt

SEQ ID NO: 70030 - DNA, 20 bp, synthetic construct
  misc_feature 1..20: note = CRISPR gRNA sequence
  source 1..20: mol_type = other DNA
gtcttctgcagcttgtctaa

SEQ ID NO: 70031 - DNA, 20 bp, synthetic construct
  misc_feature 1..20: note = CRISPR gRNA sequence
  source 1..20: mol_type = other DNA
ctgcagcttgtctaacaatc

SEQ ID NO: 70032 - DNA, 20 bp, synthetic construct
  misc_feature 1..20: note = CRISPR gRNA sequence
  source 1..20: mol_type = other DNA
tgcagcttgtctaacaatca

SEQ ID NO: 70033 - DNA, 20 bp, synthetic construct
  misc_feature 1..20: note = CRISPR gRNA sequence
  source 1..20: mol_type = other DNA
cagcttgtctaacaatcaat

SEQ ID NO: 70034 - DNA, 20 bp, synthetic construct
  misc_feature 1..20: note = CRISPR gRNA sequence
  source 1..20: mol_type = other DNA
gtctaacaatcaatttgatg

SEQ ID NO: 70035 - DNA, 20 bp, synthetic construct
  misc_feature 1..20: note = CRISPR gRNA sequence
  source 1..20: mol_type = other DNA
tctaacaatcaatttgatga

SEQ ID NO: 70036 - DNA, 20 bp, synthetic construct
  misc_feature 1..20: note = CRISPR gRNA sequence
  source 1..20: mol_type = other DNA
acaatcaatttgatgaggag

SEQ ID NO: 70037 - DNA, 20 bp, synthetic construct
  misc_feature 1..20: note = CRISPR gRNA sequence
  source 1..20: mol_type = other DNA
gatgaggagggcaccaaggc

SEQ ID NO: 70038 - DNA, 20 bp, synthetic construct
  misc_feature 1..20: note = CRISPR gRNA sequence
  source 1..20: mol_type = other DNA
atgaggagggcaccaaggcg

SEQ ID NO: 70039 - DNA, 20 bp, synthetic construct
  misc_feature 1..20: note = CRISPR gRNA sequence
  source 1..20: mol_type = other DNA
atgagggcccttgaggggaa

SEQ ID NO: 70040 - DNA, 20 bp, synthetic construct
  misc_feature 1..20: note = CRISPR gRNA sequence
  source 1..20: mol_type = other DNA
gaggggaaatggatgctaaa

SEQ ID NO: 70041 - DNA, 20 bp, synthetic construct
  misc_feature 1..20: note = CRISPR gRNA sequence
  source 1..20: mol_type = other DNA
aggggaaatggatgctaaag

SEQ ID NO: 70042 - DNA, 20 bp, synthetic construct
  misc_feature 1..20: note = CRISPR gRNA sequence
  source 1..20: mol_type = other DNA
aagaggctggagtaagtagt

SEQ ID NO: 70043 - DNA, 20 bp, synthetic construct
  misc_feature 1..20: note = CRISPR gRNA sequence
  source 1..20: mol_type = other DNA
gagtaagtagtgatggtggt

SEQ ID NO: 70044 - DNA, 20 bp, synthetic construct
  misc_feature 1..20: note = CRISPR gRNA sequence
  source 1..20: mol_type = other DNA
tgggtgagtgagtggtgggg

SEQ ID NO: 70045 - DNA, 20 bp, synthetic construct
  misc_feature 1..20: note = CRISPR gRNA sequence
  source 1..20: mol_type = other DNA
atggatggtggaagtgggtg

SEQ ID NO: 70046 - DNA, 20 bp, synthetic construct
  misc_feature 1..20: note = CRISPR gRNA sequence
  source 1..20: mol_type = other DNA
gttaatggatggtggaagtg

SEQ ID NO: 70047 - DNA, 20 bp, synthetic construct
  misc_feature 1..20: note = CRISPR gRNA sequence
  source 1..20: mol_type = other DNA
atggatggtggaagtgggtg

SEQ ID NO: 70048 - DNA, 20 bp, synthetic construct
  misc_feature 1..20: note = CRISPR gRNA sequence
  source 1..20: mol_type = other DNA
gttaatggggaatggggtga

SEQ ID NO: 70049 - DNA, 20 bp, synthetic construct
  misc_feature 1..20: note = CRISPR gRNA sequence
  source 1..20: mol_type = other DNA
atggggaatggggtgagtga

SEQ ID NO: 70050 - DNA, 20 bp, synthetic construct
  misc_feature 1..20: note = CRISPR gRNA sequence
  source 1..20: mol_type = other DNA
atggggaatgggctgagtga

SEQ ID NO: 70051 - DNA, 20 bp, synthetic construct
  misc_feature 1..20: note = CRISPR gRNA sequence
  source 1..20: mol_type = other DNA
agtgagtggtgggagtggtt

SEQ ID NO: 70052 - DNA, 20 bp, synthetic construct
  misc_feature 1..20: note = CRISPR gRNA sequence
  source 1..20: mol_type = other DNA
atggggaatggggtgagtga

SEQ ID NO: 70053 - DNA, 20 bp, synthetic construct
  misc_feature 1..20: note = CRISPR gRNA sequence
  source 1..20: mol_type = other DNA
atggggaagggtgtgagagt

SEQ ID NO: 70054 - DNA, 20 bp, synthetic construct
  misc_feature 1..20: note = CRISPR gRNA sequence
  source 1..20: mol_type = other DNA
atggggaagggggtgagtga

SEQ ID NO: 70055 - DNA, 20 bp, synthetic construct
  misc_feature 1..20: note = CRISPR gRNA sequence
  source 1..20: mol_type = other DNA
atggggaagtgttgtgagtg

SEQ ID NO: 70056 - DNA, 20 bp, synthetic construct
  misc_feature 1..20: note = CRISPR gRNA sequence
  source 1..20: mol_type = other DNA
tgagtgagttgtgttggtgg

SEQ ID NO: 70057 - DNA, 20 bp, synthetic construct
  misc_feature 1..20: note = CRISPR gRNA sequence
  source 1..20: mol_type = other DNA
tgttggtggttaatggggaa

SEQ ID NO: 70058 - DNA, 20 bp, synthetic construct
  misc_feature 1..20: note = CRISPR gRNA sequence
  source 1..20: mol_type = other DNA
gtggttaatggggaaggaga

SEQ ID NO: 70059 - DNA, 20 bp, synthetic construct
  misc_feature 1..20: note = CRISPR gRNA sequence
  source 1..20: mol_type = other DNA
atggggaaggagatgagtga

SEQ ID NO: 70060 - DNA, 20 bp, synthetic construct
  misc_feature 1..20: note = CRISPR gRNA sequence
  source 1..20: mol_type = other DNA
gtggttaatggggaagggtt

SEQ ID NO: 70061 - DNA, 20 bp, synthetic construct
  misc_feature 1..20: note = CRISPR gRNA sequence
  source 1..20: mol_type = other DNA
atggggaagggttgtgagtg

SEQ ID NO: 70062 - DNA, 20 bp, synthetic construct
  misc_feature 1..20: note = CRISPR gRNA sequence
  source 1..20: mol_type = other DNA
tgagtgagtggtggcgttgg

SEQ ID NO: 70063 - DNA, 20 bp, synthetic construct
  misc_feature 1..20: note = CRISPR gRNA sequence
  source 1..20: mol_type = other DNA
gttaatggggaagggggtga

SEQ ID NO: 70064 - DNA, 20 bp, synthetic construct
  misc_feature 1..20: note = CRISPR gRNA sequence
  source 1..20: mol_type = other DNA
atggggaagggggtgagtga

SEQ ID NO: 70065 - DNA, 20 bp, synthetic construct
  misc_feature 1..20: note = CRISPR gRNA sequence
  source 1..20: mol_type = other DNA
atggggaagagttgtgagtg

SEQ ID NO: 70066 - DNA, 20 bp, synthetic construct
  misc_feature 1..20: note = CRISPR gRNA sequence
  source 1..20: mol_type = other DNA
tgagtgagtggtgttggtgg

SEQ ID NO: 70067 - DNA, 20 bp, synthetic construct
  misc_feature 1..20: note = CRISPR gRNA sequence
  source 1..20: mol_type = other DNA
gtggttaatggggaaggggg

SEQ ID NO: 70068 - DNA, 20 bp, synthetic construct
  misc_feature 1..20: note = CRISPR gRNA sequence
  source 1..20: mol_type = other DNA
atggggaagggggtgagtga

SEQ ID NO: 70069 - DNA, 20 bp, synthetic construct
  misc_feature 1..20: note = CRISPR gRNA sequence
  source 1..20: mol_type = other DNA
gttaatggggaagtgttgtg

SEQ ID NO: 70070 - DNA, 20 bp, synthetic construct
  misc_feature 1..20: note = CRISPR gRNA sequence
  source 1..20: mol_type = other DNA
atggggaagtgttgtgagtg

SEQ ID NO: 70071 - DNA, 20 bp, synthetic construct
  misc_feature 1..20: note = CRISPR gRNA sequence
  source 1..20: mol_type = other DNA
tgagtgagtggtgatggtga

SEQ ID NO: 70072 - DNA, 20 bp, synthetic construct
  misc_feature 1..20: note = CRISPR gRNA sequence
  source 1..20: mol_type = other DNA
atggggaagggttgtgagtg

SEQ ID NO: 70073 - DNA, 20 bp, synthetic construct
  misc_feature 1..20: note = CRISPR gRNA sequence
  source 1..20: mol_type = other DNA
tgagtgagtggcgttggtgg

SEQ ID NO: 70074 - DNA, 20 bp, synthetic construct
  misc_feature 1..20: note = CRISPR gRNA sequence
  source 1..20: mol_type = other DNA
gtggttaatggggaagggag

SEQ ID NO: 70075 - DNA, 20 bp, synthetic construct
  misc_feature 1..20: note = CRISPR gRNA sequence
  source 1..20: mol_type = other DNA
atggggaagggagggagtga

SEQ ID NO: 70076 - DNA, 20 bp, synthetic construct
  misc_feature 1..20: note = CRISPR gRNA sequence
  source 1..20: mol_type = other DNA
atggggaagggttgtgagtg

SEQ ID NO: 70077 - DNA, 20 bp, synthetic construct
  misc_feature 1..20: note = CRISPR gRNA sequence
  source 1..20: mol_type = other DNA
tgagtgagttgtggggttgg

SEQ ID NO: 70078 - DNA, 20 bp, synthetic construct
  misc_feature 1..20: note = CRISPR gRNA sequence
  source 1..20: mol_type = other DNA
tggggttggttaatggggaa

SEQ ID NO: 70079 - DNA, 20 bp, synthetic construct
  misc_feature 1..20: note = CRISPR gRNA sequence
  source 1..20: mol_type = other DNA
gttaatggggaagcgttgtg

SEQ ID NO: 70080 - DNA, 20 bp, synthetic construct
  misc_feature 1..20: note = CRISPR gRNA sequence
  source 1..20: mol_type = other DNA
atggggaagcgttgtgagtg

SEQ ID NO: 70081 - DNA, 20 bp, synthetic construct
  misc_feature 1..20: note = CRISPR gRNA sequence
  source 1..20: mol_type = other DNA
tgagtgagtggtgatggttg

SEQ ID NO: 70082 - DNA, 20 bp, synthetic construct
  misc_feature 1..20: note = CRISPR gRNA sequence
  source 1..20: mol_type = other DNA
gttaatggggaagggttgtg

SEQ ID NO: 70083 - DNA, 20 bp, synthetic construct
  misc_feature 1..20: note = CRISPR gRNA sequence
  source 1..20: mol_type = other DNA
atggggaagggttgtgagtg

SEQ ID NO: 70084 - DNA, 20 bp, synthetic construct
  misc_feature 1..20: note = CRISPR gRNA sequence
  source 1..20: mol_type = other DNA
tgagtgagtggtgatggtgg

SEQ ID NO: 70085 - DNA, 20 bp, synthetic construct
  misc_feature 1..20: note = CRISPR gRNA sequence
  source 1..20: mol_type = other DNA
atggggaagggggtgagtga

SEQ ID NO: 70086 - DNA, 20 bp, synthetic construct
  misc_feature 1..20: note = CRISPR gRNA sequence
  source 1..20: mol_type = other DNA
gtggttaatggggaagtgtt

SEQ ID NO: 70087 - DNA, 20 bp, synthetic construct
  misc_feature 1..20: note = CRISPR gRNA sequence
  source 1..20: mol_type = other DNA
atggggaagtgttgtgagtg

SEQ ID NO: 70088 - DNA, 20 bp, synthetic construct
  misc_feature 1..20: note = CRISPR gRNA sequence
  source 1..20: mol_type = other DNA
tgagtgagtggtgatggtgg

SEQ ID NO: 70089 - DNA, 20 bp, synthetic construct
  misc_feature 1..20: note = CRISPR gRNA sequence
  source 1..20: mol_type = other DNA
atggggaagggttgtgagtg

SEQ ID NO: 70090 - DNA, 20 bp, synthetic construct
  misc_feature 1..20: note = CRISPR gRNA sequence
  source 1..20: mol_type = other DNA
tgagtgagtggtgttggtgg

SEQ ID NO: 70091 - DNA, 20 bp, synthetic construct
  misc_feature 1..20: note = CRISPR gRNA sequence
  source 1..20: mol_type = other DNA
gtggttaatggggaaggggg

SEQ ID NO: 70092 - DNA, 20 bp, synthetic construct
  misc_feature 1..20: note = CRISPR gRNA sequence
  source 1..20: mol_type = other DNA
atggggaagggggtgagtga

SEQ ID NO: 70093 - DNA, 20 bp, synthetic construct
  misc_feature 1..20: note = CRISPR gRNA sequence
  source 1..20: mol_type = other DNA
atggggaagggttgtgagtg

SEQ ID NO: 70094 - DNA, 20 bp, synthetic construct
  misc_feature 1..20: note = CRISPR gRNA sequence
  source 1..20: mol_type = other DNA
tgagtgagtggtggggttgg

SEQ ID NO: 70095 - DNA, 20 bp, synthetic construct
  misc_feature 1..20: note = CRISPR gRNA sequence
  source 1..20: mol_type = other DNA
gttaacggggaagggggtga

SEQ ID NO: 70096 - DNA, 20 bp, synthetic construct
  misc_feature 1..20: note = CRISPR gRNA sequence
  source 1..20: mol_type = other DNA
acggggaagggggtgagtga

SEQ ID NO: 70097 - DNA, 20 bp, synthetic construct
  misc_feature 1..20: note = CRISPR gRNA sequence
  source 1..20: mol_type = other DNA
atggggaagggggtgagtga

SEQ ID NO: 70098 - DNA, 20 bp, synthetic construct
  misc_feature 1..20: note = CRISPR gRNA sequence
  source 1..20: mol_type = other DNA
gtggttaatggggaaggggg

SEQ ID NO: 70099 - DNA, 20 bp, synthetic construct
  misc_feature 1..20: note = CRISPR gRNA sequence
  source 1..20: mol_type = other DNA
atggggaagggggtgggtga

SEQ ID NO: 70100 - DNA, 20 bp, synthetic construct
  misc_feature 1..20: note = CRISPR gRNA sequence
  source 1..20: mol_type = other DNA
atgggaagggagtgagtggt

SEQ ID NO: 70101 - DNA, 20 bp, synthetic construct
  misc_feature 1..20: note = CRISPR gRNA sequence
  source 1..20: mol_type = other DNA
atggggaagggttgtgagtg

SEQ ID NO: 70102 - DNA, 20 bp, synthetic construct
  misc_feature 1..20: note = CRISPR gRNA sequence
  source 1..20: mol_type = other DNA
tgagtgagtggtgatggtgg

SEQ ID NO: 70103 - DNA, 20 bp, synthetic construct
  misc_feature 1..20: note = CRISPR gRNA sequence
  source 1..20: mol_type = other DNA
atggggaagggggtgagtaa

SEQ ID NO: 70104 - DNA, 20 bp, synthetic construct
  misc_feature 1..20: note = CRISPR gRNA sequence
  source 1..20: mol_type = other DNA
atagggaagagttgtgagtg

SEQ ID NO: 70105 - DNA, 20 bp, synthetic construct
  misc_feature 1..20: note = CRISPR gRNA sequence
  source 1..20: mol_type = other DNA
tgagtgagtggtggggttgg

SEQ ID NO: 70106 - DNA, 20 bp, synthetic construct
  misc_feature 1..20: note = CRISPR gRNA sequence
  source 1..20: mol_type = other DNA
gttaatggggaagggggtga

SEQ ID NO: 70107 - DNA, 20 bp, synthetic construct
  misc_feature 1..20: note = CRISPR gRNA sequence
  source 1..20: mol_type = other DNA
atggggaagggggtgagtga

SEQ ID NO: 70108 - DNA, 20 bp, synthetic construct
  misc_feature 1..20: note = CRISPR gRNA sequence
  source 1..20: mol_type = other DNA
atggggaaaggagtgagtga

SEQ ID NO: 70109 - DNA, 20 bp, synthetic construct
  misc_feature 1..20: note = CRISPR gRNA sequence
  source 1..20: mol_type = other DNA
agtgctgcatggtcagtgag

SEQ ID NO: 70110 - DNA, 20 bp, synthetic construct
  misc_feature 1..20: note = CRISPR gRNA sequence
  source 1..20: mol_type = other DNA
gtgctgcatggtcagtgagt

SEQ ID NO: 70111 - DNA, 20 bp, synthetic construct
  misc_feature 1..20: note = CRISPR gRNA sequence
  source 1..20: mol_type = other DNA
catggtcagtgagtagcatg

SEQ ID NO: 70112 - DNA, 20 bp, synthetic construct
  misc_feature 1..20: note = CRISPR gRNA sequence
  source 1..20: mol_type = other DNA
ggaacctttgcatgttttgt

SEQ ID NO: 70113 - DNA, 20 bp, synthetic construct
  misc_feature 1..20: note = CRISPR gRNA sequence
  source 1..20: mol_type = other DNA
tgcatgttttgtgaacacaa

SEQ ID NO: 70114 - DNA, 20 bp, synthetic construct
  misc_feature 1..20: note = CRISPR gRNA sequence
  source 1..20: mol_type = other DNA
gcatgttttgtgaacacaaa

SEQ ID NO: 70115 - DNA, 20 bp, synthetic construct
  misc_feature 1..20: note = CRISPR gRNA sequence
  source 1..20: mol_type = other DNA
catgttttgtgaacacaaac

SEQ ID NO: 70116 - DNA, 20 bp, synthetic construct
  misc_feature 1..20: note = CRISPR gRNA sequence
  source 1..20: mol_type = other DNA
tgtgaacacaaaccgccatg

SEQ ID NO: 70117 - DNA, 20 bp, synthetic construct
  misc_feature 1..20: note = CRISPR gRNA sequence
  source 1..20: mol_type = other DNA
gtgaacacaaaccgccatgt

SEQ ID NO: 70118 - DNA, 20 bp, synthetic construct
  misc_feature 1..20: note = CRISPR gRNA sequence
  source 1..20: mol_type = other DNA
tgaacacaaaccgccatgtt

SEQ ID NO: 70119 - DNA, 20 bp, synthetic construct
  misc_feature 1..20: note = CRISPR gRNA sequence
  source 1..20: mol_type = other DNA
ctggatggacccaggtgagc

SEQ ID NO: 70120 - DNA, 20 bp, synthetic construct
  misc_feature 1..20: note = CRISPR gRNA sequence
  source 1..20: mol_type = other DNA
tggatggacccaggtgagct

SEQ ID NO: 70121 - DNA, 20 bp, synthetic construct
  misc_feature 1..20: note = CRISPR gRNA sequence
  source 1..20: mol_type = other DNA
gatggacccaggtgagctga

SEQ ID NO: 70122 - DNA, 20 bp, synthetic construct
  misc_feature 1..20: note = CRISPR gRNA sequence
  source 1..20: mol_type = other DNA
aatgcccttacatgaccttt

SEQ ID NO: 70123 - DNA, 20 bp, synthetic construct
  misc_feature 1..20: note = CRISPR gRNA sequence
  source 1..20: mol_type = other DNA
acatgaccttttactttcta

SEQ ID NO: 70124 - DNA, 20 bp, synthetic construct
  misc_feature 1..20: note = CRISPR gRNA sequence
  source 1..20: mol_type = other DNA
catgaccttttactttctat

SEQ ID NO: 70125 - DNA, 20 bp, synthetic construct
  misc_feature 1..20: note = CRISPR gRNA sequence
  source 1..20: mol_type = other DNA
ttactttctattctggatct

SEQ ID NO: 70126 - DNA, 20 bp, synthetic construct
  misc_feature 1..20: note = CRISPR gRNA sequence
  source 1..20: mol_type = other DNA
tactttctattctggatctc

SEQ ID NO: 70127 - DNA, 20 bp, synthetic construct
  misc_feature 1..20: note = CRISPR gRNA sequence
  source 1..20: mol_type = other DNA
actttctattctggatctca

SEQ ID NO: 70128 - DNA, 20 bp, synthetic construct
  misc_feature 1..20: note = CRISPR gRNA sequence
  source 1..20: mol_type = other DNA
ctttctattctggatctcag

SEQ ID NO: 70129 - DNA, 20 bp, synthetic construct
  misc_feature 1..20: note = CRISPR gRNA sequence
  source 1..20: mol_type = other DNA
tctattctggatctcagtgc

SEQ ID NO: 70130 - DNA, 20 bp, synthetic construct
  misc_feature 1..20: note = CRISPR gRNA sequence
  source 1..20: mol_type = other DNA
ctattctggatctcagtgcc

SEQ ID NO: 70131 - DNA, 20 bp, synthetic construct
  misc_feature 1..20: note = CRISPR gRNA sequence
  source 1..20: mol_type = other DNA
tattctggatctcagtgcca

SEQ ID NO: 70132 - DNA, 20 bp, synthetic construct
  misc_feature 1..20: note = CRISPR gRNA sequence
  source 1..20: mol_type = other DNA
ttctggatctcagtgccagc

SEQ ID NO: 70133 - DNA, 20 bp, synthetic construct
  misc_feature 1..20: note = CRISPR gRNA sequence
  source 1..20: mol_type = other DNA
tggatctcagtgccagcaag

SEQ ID NO: 70134 - DNA, 20 bp, synthetic construct
  misc_feature 1..20: note = CRISPR gRNA sequence
  source 1..20: mol_type = other DNA
gatctcagtgccagcaagaa

SEQ ID NO: 70135 - DNA, 20 bp, synthetic construct
  misc_feature 1..20: note = CRISPR gRNA sequence
  source 1..20: mol_type = other DNA
agtgccagcaagaaccttgg

SEQ ID NO: 70136 - DNA, 20 bp, synthetic construct
  misc_feature 1..20: note = CRISPR gRNA sequence
  source 1..20: mol_type = other DNA
ggtcataggaaacagaatac

SEQ ID NO: 70137 - DNA, 20 bp, synthetic construct
  misc_feature 1..20: note = CRISPR gRNA sequence
  source 1..20: mol_type = other DNA
gtcataggaaacagaataca

SEQ ID NO: 70138 - DNA, 20 bp, synthetic construct
  misc_feature 1..20: note = CRISPR gRNA sequence
  source 1..20: mol_type = other DNA
aaagcaatccaagacagaaa

SEQ ID NO: 70139 - DNA, 20 bp, synthetic construct
  misc_feature 1..20: note = CRISPR gRNA sequence
  source 1..20: mol_type = other DNA
gcttatgtcatggaaaatta

SEQ ID NO: 70140 - DNA, 20 bp, synthetic construct
  misc_feature 1..20: note = CRISPR gRNA sequence
  source 1..20: mol_type = other DNA
atgtcatggaaaattacgag

SEQ ID NO: 70141 - DNA, 20 bp, synthetic construct
  misc_feature 1..20: note = CRISPR gRNA sequence
  source 1..20: mol_type = other DNA
tgtcatggaaaattacgagg

SEQ ID NO: 70142 - DNA, 20 bp, synthetic construct
  misc_feature 1..20: note = CRISPR gRNA sequence
  source 1..20: mol_type = other DNA
cgaggccaatgacttcaggc

SEQ ID NO: 70143 - DNA, 20 bp, synthetic construct
  misc_feature 1..20: note = CRISPR gRNA sequence
  source 1..20: mol_type = other DNA
caggcacagctggatccagg

SEQ ID NO: 70144 - DNA, 20 bp, synthetic construct
  misc_feature 1..20: note = CRISPR gRNA sequence
  source 1..20: mol_type = other DNA
aggcacagctggatccaggg

SEQ ID NO: 70145 - DNA, 20 bp, synthetic construct
  misc_feature 1..20: note = CRISPR gRNA sequence
  source 1..20: mol_type = other DNA
gatccaggggttctatattt

SEQ ID NO: 70146 - DNA, 20 bp, synthetic construct
  misc_feature 1..20: note = CRISPR gRNA sequence
  source 1..20: mol_type = other DNA
tatatttgtcaggcttctct

SEQ ID NO: 70147 - DNA, 20 bp, synthetic construct
  misc_feature 1..20: note = CRISPR gRNA sequence
  source 1..20: mol_type = other DNA
tatttgtcaggcttctctct

SEQ ID NO: 70148 - DNA, 20 bp, synthetic construct
  misc_feature 1..20: note = CRISPR gRNA sequence
  source 1..20: mol_type = other DNA
gtcaggcttctctctcacac

SEQ ID NO: 70149 - DNA, 20 bp, synthetic construct
  misc_feature 1..20: note = CRISPR gRNA sequence
  source 1..20: mol_type = other DNA
tcaggcttctctctcacaca

SEQ ID NO: 70150 - DNA, 20 bp, synthetic construct
  misc_feature 1..20: note = CRISPR gRNA sequence
  source 1..20: mol_type = other DNA
ctctctcacacacttcactc

SEQ ID NO: 70151 - DNA, 20 bp, synthetic construct
  misc_feature 1..20: note = CRISPR gRNA sequence
  source 1..20: mol_type = other DNA
tctctcacacacttcactct

SEQ ID NO: 70152 - DNA, 20 bp, synthetic construct
  misc_feature 1..20: note = CRISPR gRNA sequence
  source 1..20: mol_type = other DNA
tctcacacacttcactctgg

SEQ ID NO: 70153 - DNA, 20 bp, synthetic construct
  misc_feature 1..20: note = CRISPR gRNA sequence
  source 1..20: mol_type = other DNA
tcacacacttcactctggcc

SEQ ID NO: 70154 - DNA, 20 bp, synthetic construct
  misc_feature 1..20: note = CRISPR gRNA sequence
  source 1..20: mol_type = other DNA
acacacttcactctggccct

SEQ ID NO: 70155 - DNA, 20 bp, synthetic construct
  misc_feature 1..20: note = CRISPR gRNA sequence
  source 1..20: mol_type = other DNA
cactctggcccttactcttt

SEQ ID NO: 70156 - DNA, 20 bp, synthetic construct
  misc_feature 1..20: note = CRISPR gRNA sequence
  source 1..20: mol_type = other DNA
actctggcccttactctttc

SEQ ID NO: 70157 - DNA, 20 bp, synthetic construct
  misc_feature 1..20: note = CRISPR gRNA sequence
  source 1..20: mol_type = other DNA
tggcccttactctttctctg

SEQ ID NO: 70158 - DNA, 20 bp, synthetic construct
  misc_feature 1..20: note = CRISPR gRNA sequence
  source 1..20: mol_type = other DNA
gcccttactctttctctgtc

SEQ ID NO: 70159 - DNA, 20 bp, synthetic construct
  misc_feature 1..20: note = CRISPR gRNA sequence
  source 1..20: mol_type = other DNA
actctttctctgtccacctt

SEQ ID NO: 70160 - DNA, 20 bp, synthetic construct
  misc_feature 1..20: note = CRISPR gRNA sequence
  source 1..20: mol_type = other DNA
ctctttctctgtccaccttg

SEQ ID NO: 70161 - DNA, 20 bp, synthetic construct
  misc_feature 1..20: note = CRISPR gRNA sequence
  source 1..20: mol_type = other DNA
tttctctgtccaccttggct

SEQ ID NO: 70162 - DNA, 20 bp, synthetic construct
  misc_feature 1..20: note = CRISPR gRNA sequence
  source 1..20: mol_type = other DNA
tctctgtccaccttggcttc

SEQ ID NO: 70163 - DNA, 20 bp, synthetic construct
  misc_feature 1..20: note = CRISPR gRNA sequence
  source 1..20: mol_type = other DNA
ctctgtccaccttggcttcc

SEQ ID NO: 70164 - DNA, 20 bp, synthetic construct
  misc_feature 1..20: note = CRISPR gRNA sequence
  source 1..20: mol_type = other DNA
tctgtccaccttggcttcct

SEQ ID NO: 70165 - DNA, 20 bp, synthetic construct
  misc_feature 1..20: note = CRISPR gRNA sequence
  source 1..20: mol_type = other DNA
tgtccaccttggcttccttc

SEQ ID NO: 70166 - DNA, 20 bp, synthetic construct
  misc_feature 1..20: note = CRISPR gRNA sequence
  source 1..20: mol_type = other DNA
tccaccttggcttccttctc

SEQ ID NO: 70167 - DNA, 20 bp, synthetic construct
  misc_feature 1..20: note = CRISPR gRNA sequence
  source 1..20: mol_type = other DNA
ggcttccttctcaggcaggc

SEQ ID NO: 70168 - DNA, 20 bp, synthetic construct
  misc_feature 1..20: note = CRISPR gRNA sequence
  source 1..20: mol_type = other DNA
gcttccttctcaggcaggcc

SEQ ID NO: 70169 - DNA, 20 bp, synthetic construct
  misc_feature 1..20: note = CRISPR gRNA sequence
  source 1..20: mol_type = other DNA
ccttctcaggcaggccatcc

SEQ ID NO: 70170 - DNA, 20 bp, synthetic construct
  misc_feature 1..20: note = CRISPR gRNA sequence
  source 1..20: mol_type = other DNA
cttctcaggcaggccatccc

SEQ ID NO: 70171 - DNA, 20 bp, synthetic construct
  misc_feature 1..20: note = CRISPR gRNA sequence
  source 1..20: mol_type = other DNA
ctcaggcaggccatccctgc

SEQ ID NO: 70172 - DNA, 20 bp, synthetic construct
  misc_feature 1..20: note = CRISPR gRNA sequence
  source 1..20: mol_type = other DNA
tcaggcaggccatccctgca

SEQ ID NO: 70173 - DNA, 20 bp, synthetic construct
  misc_feature 1..20: note = CRISPR gRNA sequence
  source 1..20: mol_type = other DNA
aggcaggccatccctgcacc

SEQ ID NO: 70174 - DNA, 20 bp, synthetic construct
  misc_feature 1..20: note = CRISPR gRNA sequence
  source 1..20: mol_type = other DNA
cacctgcaggcttactttct

SEQ ID NO: 70175 - DNA, 20 bp, synthetic construct
  misc_feature 1..20: note = CRISPR gRNA sequence
  source 1..20: mol_type = other DNA
caggcttactttctctcagc

SEQ ID NO: 70176 - DNA, 20 bp, synthetic construct
  misc_feature 1..20: note = CRISPR gRNA sequence
  source 1..20: mol_type = other DNA
actttctctcagcttagtgg

SEQ ID NO: 70177 - DNA, 20 bp, synthetic construct
  misc_feature 1..20: note = CRISPR gRNA sequence
  source 1..20: mol_type = other DNA
ctttctctcagcttagtgga

SEQ ID NO: 70178 - DNA, 20 bp, synthetic construct
  misc_feature 1..20: note = CRISPR gRNA sequence
  source 1..20: mol_type = other DNA
tctctcagcttagtggaaag

SEQ ID NO: 70179 - DNA, 20 bp, synthetic construct
  misc_feature 1..20: note = CRISPR gRNA sequence
  source 1..20: mol_type = other DNA
ctctcagcttagtggaaagg

SEQ ID NO: 70180 - DNA, 20 bp, synthetic construct
  misc_feature 1..20: note = CRISPR gRNA sequence
  source 1..20: mol_type = other DNA
tctcagcttagtggaaaggg

SEQ ID NO: 70181 - DNA, 20 bp, synthetic construct
  misc_feature 1..20: note = CRISPR gRNA sequence
  source 1..20: mol_type = other DNA
tcagcttagtggaaagggag

SEQ ID NO: 70182 - DNA, 20 bp, synthetic construct
  misc_feature 1..20: note = CRISPR gRNA sequence
  source 1..20: mol_type = other DNA
agcttagtggaaagggagta

SEQ ID NO: 70183 - DNA, 20 bp, synthetic construct
  misc_feature 1..20: note = CRISPR gRNA sequence
  source 1..20: mol_type = other DNA
agtggaaagggagtaccatt

SEQ ID NO: 70184 - DNA, 20 bp, synthetic construct
  misc_feature 1..20: note = CRISPR gRNA sequence
  source 1..20: mol_type = other DNA
gtggaaagggagtaccattc

SEQ ID NO: 70185 - DNA, 20 bp, synthetic construct
  misc_feature 1..20: note = CRISPR gRNA sequence
  source 1..20: mol_type = other DNA
tctctgtggttacaacaaaa

SEQ ID NO: 70186 - DNA, 20 bp, synthetic construct
  misc_feature 1..20: note = CRISPR gRNA sequence
  source 1..20: mol_type = other DNA
tctgtggttacaacaaaagg

SEQ ID NO: 70187 - DNA, 20 bp, synthetic construct
  misc_feature 1..20: note = CRISPR gRNA sequence
  source 1..20: mol_type = other DNA
tgtggttacaacaaaaggtc

SEQ ID NO: 70188 - DNA, 20 bp, synthetic construct
  misc_feature 1..20: note = CRISPR gRNA sequence
  source 1..20: mol_type = other DNA
tggttacaacaaaaggtcct

SEQ ID NO: 70189 - DNA, 20 bp, synthetic construct
  misc_feature 1..20: note = CRISPR gRNA sequence
  source 1..20: mol_type = other DNA
caacaaaaggtcctagactg

SEQ ID NO: 70190 - DNA, 20 bp, synthetic construct
  misc_feature 1..20: note = CRISPR gRNA sequence
  source 1..20: mol_type = other DNA
gactgagtctcactggacta

SEQ ID NO: 70191 - DNA, 20 bp, synthetic construct
  misc_feature 1..20: note = CRISPR gRNA sequence
  source 1..20: mol_type = other DNA
agtctcactggactagcttg

SEQ ID NO: 70192 - DNA, 20 bp, synthetic construct
  misc_feature 1..20: note = CRISPR gRNA sequence
  source 1..20: mol_type = other DNA
actggactagcttgagtcac

SEQ ID NO: 70193 - DNA, 20 bp, synthetic construct
  misc_feature 1..20: note = CRISPR gRNA sequence
  source 1..20: mol_type = other DNA
gactagcttgagtcacctgc

SEQ ID NO: 70194 - DNA, 20 bp, synthetic construct
  misc_feature 1..20: note = CRISPR gRNA sequence
  source 1..20: mol_type = other DNA
gcttgagtcacctgccccac

SEQ ID NO: 70195 - DNA, 20 bp, synthetic construct
  misc_feature 1..20: note = CRISPR gRNA sequence
  source 1..20: mol_type = other DNA
gagtcacctgccccacccta

SEQ ID NO: 70196 - DNA, 20 bp, synthetic construct
  misc_feature 1..20: note = CRISPR gRNA sequence
  source 1..20: mol_type = other DNA
agtcacctgccccaccctaa

SEQ ID NO: 70197 - DNA, 20 bp, synthetic construct
  misc_feature 1..20: note = CRISPR gRNA sequence
  source 1..20: mol_type = other DNA
ccccaccctaaagcaatcac

SEQ ID NO: 70198 - DNA, 20 bp, synthetic construct
  misc_feature 1..20: note = CRISPR gRNA sequence
  source 1..20: mol_type = other DNA
aagcaatcactgtggctgtg

SEQ ID NO: 70199 - DNA, 20 bp, synthetic construct
  misc_feature 1..20: note = CRISPR gRNA sequence
  source 1..20: mol_type = other DNA
tggctgtgagcacaaaatat

SEQ ID NO: 70200 - DNA, 20 bp, synthetic construct
  misc_feature 1..20: note = CRISPR gRNA sequence
  source 1..20: mol_type = other DNA
tgagcacaaaatattctcct

SEQ ID NO: 70201 - DNA, 20 bp, synthetic construct
  misc_feature 1..20: note = CRISPR gRNA sequence
  source 1..20: mol_type = other DNA
tcctcactggccagacctgg

SEQ ID NO: 70202 - DNA, 20 bp, synthetic construct
  misc_feature 1..20: note = CRISPR gRNA sequence
  source 1..20: mol_type = other DNA
ctcactggccagacctgggc

SEQ ID NO: 70203 - DNA, 20 bp, synthetic construct
  misc_feature 1..20: note = CRISPR gRNA sequence
  source 1..20: mol_type = other DNA
actggccagacctgggcgca

SEQ ID NO: 70204 - DNA, 20 bp, synthetic construct
  misc_feature 1..20: note = CRISPR gRNA sequence
  source 1..20: mol_type = other DNA
gccagacctgggcgcatgca

SEQ ID NO: 70205 - DNA, 20 bp, synthetic construct
  misc_feature 1..20: note = CRISPR gRNA sequence
  source 1..20: mol_type = other DNA
ggcgcatgcacaccctatct

SEQ ID NO: 70206 - DNA, 20 bp, synthetic construct
  misc_feature 1..20: note = CRISPR gRNA sequence
  source 1..20: mol_type = other DNA
tcttctggacttagaggggt

SEQ ID NO: 70207 - DNA, 20 bp, synthetic construct
  misc_feature 1..20: note = CRISPR gRNA sequence
  source 1..20: mol_type = other DNA
ctggacttagaggggtggta

SEQ ID NO: 70208 - DNA, 20 bp, synthetic construct
  misc_feature 1..20: note = CRISPR gRNA sequence
  source 1..20: mol_type = other DNA
tggacttagaggggtggtat

SEQ ID NO: 70209 - DNA, 20 bp, synthetic construct
  misc_feature 1..20: note = CRISPR gRNA sequence
  source 1..20: mol_type = other DNA
gacttagaggggtggtattt

SEQ ID NO: 70210 - DNA, 20 bp, synthetic construct
  misc_feature 1..20: note = CRISPR gRNA sequence
  source 1..20: mol_type = other DNA
agaggggtggtatttcagga

SEQ ID NO: 70211 - DNA, 20 bp, synthetic construct
  misc_feature 1..20: note = CRISPR gRNA sequence
  source 1..20: mol_type = other DNA
gaggggtggtatttcaggat

SEQ ID NO: 70212 - DNA, 20 bp, synthetic construct
  misc_feature 1..20: note = CRISPR gRNA sequence
  source 1..20: mol_type = other DNA
caggatgtgagtaacagaag

SEQ ID NO: 70213 - DNA, 20 bp, synthetic construct
  misc_feature 1..20: note = CRISPR gRNA sequence
  source 1..20: mol_type = other DNA
aggatgtgagtaacagaaga

SEQ ID NO: 70214 - DNA, 20 bp, synthetic construct
  misc_feature 1..20: note = CRISPR gRNA sequence
  source 1..20: mol_type = other DNA
tgggcagaaaaaaatctaca

SEQ ID NO: 70215 - DNA, 20 bp, synthetic construct
  misc_feature 1..20: note = CRISPR gRNA sequence
  source 1..20: mol_type = other DNA
ggcagaaaaaaatctacaga

SEQ ID NO: 70216 - DNA, 20 bp, synthetic construct
  misc_feature 1..20: note = CRISPR gRNA sequence
  source 1..20: mol_type = other DNA
cagatgtccactacatttgt

SEQ ID NO: 70217 - DNA, 20 bp, synthetic construct
  misc_feature 1..20: note = CRISPR gRNA sequence
  source 1..20: mol_type = other DNA
catttgtctacagttgtttc

SEQ ID NO: 70218 - DNA, 20 bp, synthetic construct
  misc_feature 1..20: note = CRISPR gRNA sequence
  source 1..20: mol_type = other DNA
gtctacagttgtttccttgg

SEQ ID NO: 70219 - DNA, 20 bp, synthetic construct
  misc_feature 1..20: note = CRISPR gRNA sequence
  source 1..20: mol_type = other DNA
tctacagttgtttccttggt

SEQ ID NO: 70220 - DNA, 20 bp, synthetic construct
  misc_feature 1..20: note = CRISPR gRNA sequence
  source 1..20: mol_type = other DNA
cagttgtttccttggtaact

SEQ ID NO: 70221 - DNA, 20 bp, synthetic construct
  misc_feature 1..20: note = CRISPR gRNA sequence
  source 1..20: mol_type = other DNA
tttccttggtaactggcagc

SEQ ID NO: 70222 - DNA, 20 bp, synthetic construct
  misc_feature 1..20: note = CRISPR gRNA sequence
  source 1..20: mol_type = other DNA
ccttggtaactggcagcttt

SEQ ID NO: 70223 - DNA, 20 bp, synthetic construct
  misc_feature 1..20: note = CRISPR gRNA sequence
  source 1..20: mol_type = other DNA
cttggtaactggcagctttt

SEQ ID NO: 70224 - DNA, 20 bp, synthetic construct
  misc_feature 1..20: note = CRISPR gRNA sequence
  source 1..20: mol_type = other DNA
ggtaactggcagcttttact

SEQ ID NO: 70225 - DNA, 20 bp, synthetic construct
  misc_feature 1..20: note = CRISPR gRNA sequence
  source 1..20: mol_type = other DNA
gtaactggcagcttttacta

SEQ ID NO: 70226 - DNA, 20 bp, synthetic construct
  misc_feature 1..20: note = CRISPR gRNA sequence
  source 1..20: mol_type = other DNA
gcagcttttactactctccc

SEQ ID NO: 70227 - DNA, 20 bp, synthetic construct
  misc_feature 1..20: note = CRISPR gRNA sequence
  source 1..20: mol_type = other DNA
ttactactctcccccataat

SEQ ID NO: 70228 - DNA, 20 bp, synthetic construct
  misc_feature 1..20: note = CRISPR gRNA sequence
  source 1..20: mol_type = other DNA
tactactctcccccataatt

SEQ ID NO: 70229 - DNA, 20 bp, synthetic construct
  misc_feature 1..20: note = CRISPR gRNA sequence
  source 1..20: mol_type = other DNA
actactctcccccataattt

SEQ ID NO: 70230 - DNA, 20 bp, synthetic construct
  misc_feature 1..20: note = CRISPR gRNA sequence
  source 1..20: mol_type = other DNA
ctactctcccccataatttg

SEQ ID NO: 70231 - DNA, 20 bp, synthetic construct
  misc_feature 1..20: note = CRISPR gRNA sequence
  source 1..20: mol_type = other DNA
ctctcccccataatttgaag

SEQ ID NO: 70232 - DNA, 20 bp, synthetic construct
  misc_feature 1..20: note = CRISPR gRNA sequence
  source 1..20: mol_type = other DNA
tcccccataatttgaagtca

SEQ ID NO: 70233 - DNA, 20 bp, synthetic construct
  misc_feature 1..20: note = CRISPR gRNA sequence
  source 1..20: mol_type = other DNA
ccccataatttgaagtcatc

SEQ ID NO: 70234 - DNA, 20 bp, synthetic construct
  misc_feature 1..20: note = CRISPR gRNA sequence
  source 1..20: mol_type = other DNA
gaagtcatcaaattcttaga

SEQ ID NO: 70235 - DNA, 20 bp, synthetic construct
  misc_feature 1..20: note = CRISPR gRNA sequence
  source 1..20: mol_type = other DNA
aagtcatcaaattcttagaa

SEQ ID NO: 70236 - DNA, 20 bp, synthetic construct
  misc_feature 1..20: note = CRISPR gRNA sequence
  source 1..20: mol_type = other DNA
ttagaaatgccagaaacagc

SEQ ID NO: 70237 - DNA, 20 bp, synthetic construct
  misc_feature 1..20: note = CRISPR gRNA sequence
  source 1..20: mol_type = other DNA
agaaatgccagaaacagcct

SEQ ID NO: 70238 - DNA, 20 bp, synthetic construct
  misc_feature 1..20: note = CRISPR gRNA sequence
  source 1..20: mol_type = other DNA
gaaatgccagaaacagcctc

SEQ ID NO: 70239 - DNA, 20 bp, synthetic construct
  misc_feature 1..20: note = CRISPR gRNA sequence
  source 1..20: mol_type = other DNA
agtctaaaagacaggtcccc

SEQ ID NO: 70240 - DNA, 20 bp, synthetic construct
  misc_feature 1..20: note = CRISPR gRNA sequence
  source 1..20: mol_type = other DNA
aaagacaggtccccgtcctg

SEQ ID NO: 70241 - DNA, 20 bp, synthetic construct
  misc_feature 1..20: note = CRISPR gRNA sequence
  source 1..20: mol_type = other DNA
cacagattcctgtttagaca

SEQ ID NO: 70242 - DNA, 20 bp, synthetic construct
  misc_feature 1..20: note = CRISPR gRNA sequence
  source 1..20: mol_type = other DNA
ctgtttagacagtatctgga

SEQ ID NO: 70243 - DNA, 20 bp, synthetic construct
  misc_feature 1..20: note = CRISPR gRNA sequence
  source 1..20: mol_type = other DNA
tttagacagtatctggacag

SEQ ID NO: 70244 - DNA, 20 bp, synthetic construct
  misc_feature 1..20: note = CRISPR gRNA sequence
  source 1..20: mol_type = other DNA
agacagtatctggacagaaa

SEQ ID NO: 70245 - DNA, 20 bp, synthetic construct
  misc_feature 1..20: note = CRISPR gRNA sequence
  source 1..20: mol_type = other DNA
gacagtatctggacagaaaa

SEQ ID NO: 70246 - DNA, 20 bp, synthetic construct
  misc_feature 1..20: note = CRISPR gRNA sequence
  source 1..20: mol_type = other DNA
gacagaaaatttaacagaat

SEQ ID NO: 70247 - DNA, 20 bp, synthetic construct
  misc_feature 1..20: note = CRISPR gRNA sequence
  source 1..20: mol_type = other DNA
aacagaatatcttctgcttt

SEQ ID NO: 70248 - DNA, 20 bp, synthetic construct
  misc_feature 1..20: note = CRISPR gRNA sequence
  source 1..20: mol_type = other DNA
acagaatatcttctgctttt

SEQ ID NO: 70249 - DNA, 20 bp, synthetic construct
  misc_feature 1..20: note = CRISPR gRNA sequence
  source 1..20: mol_type = other DNA
ctgcttttcatctcttaact

SEQ ID NO: 70250 - DNA, 20 bp, synthetic construct
  misc_feature 1..20: note = CRISPR gRNA sequence
  source 1..20: mol_type = other DNA
tgcttttcatctcttaactt

SEQ ID NO: 70251 - DNA, 20 bp, synthetic construct
  misc_feature 1..20: note = CRISPR gRNA sequence
  source 1..20: mol_type = other DNA
cttttcatctcttaactttt

SEQ ID NO: 70252 - DNA, 20 bp, synthetic construct
  misc_feature 1..20: note = CRISPR gRNA sequence
  source 1..20: mol_type = other DNA
ttcatctcttaactttttct

SEQ ID NO: 70253 - DNA, 20 bp, synthetic construct
  misc_feature 1..20: note = CRISPR gRNA sequence
  source 1..20: mol_type = other DNA
tcatctcttaactttttctg

SEQ ID NO: 70254 - DNA, 20 bp, synthetic construct
  misc_feature 1..20: note = CRISPR gRNA sequence
  source 1..20: mol_type = other DNA
catctcttaactttttctga

SEQ ID NO: 70255 - DNA, 20 bp, synthetic construct
  misc_feature 1..20: note = CRISPR gRNA sequence
  source 1..20: mol_type = other DNA
atctcttaactttttctgat

SEQ ID NO: 70256 - DNA, 20 bp, synthetic construct
  misc_feature 1..20: note = CRISPR gRNA sequence
  source 1..20: mol_type = other DNA
ttaactttttctgatgacca

SEQ ID NO: 70257 - DNA, 20 bp, synthetic construct
  misc_feature 1..20: note = CRISPR gRNA sequence
  source 1..20: mol_type = other DNA
aactttttctgatgaccaaa

SEQ ID NO: 70258 - DNA, 20 bp, synthetic construct
  misc_feature 1..20: note = CRISPR gRNA sequence
  source 1..20: mol_type = other DNA
actttttctgatgaccaaaa

SEQ ID NO: 70259 - DNA, 20 bp, synthetic construct
  misc_feature 1..20: note = CRISPR gRNA sequence
  source 1..20: mol_type = other DNA
tttctgatgaccaaaaaagt

SEQ ID NO: 70260 - DNA, 20 bp, synthetic construct
  misc_feature 1..20: note = CRISPR gRNA sequence
  source 1..20: mol_type = other DNA
ttctgatgaccaaaaaagtt

SEQ ID NO: 70261 - DNA, 20 bp, synthetic construct
  misc_feature 1..20: note = CRISPR gRNA sequence
  source 1..20: mol_type = other DNA
tctgatgaccaaaaaagttc

SEQ ID NO: 70262 - DNA, 20 bp, synthetic construct
  misc_feature 1..20: note = CRISPR gRNA sequence
  source 1..20: mol_type = other DNA
ctgatgaccaaaaaagttcc

SEQ ID NO: 70263 - DNA, 20 bp, synthetic construct
  misc_feature 1..20: note = CRISPR gRNA sequence
  source 1..20: mol_type = other DNA
tgatgaccaaaaaagttcca

SEQ ID NO: 70264 - DNA, 20 bp, synthetic construct
  misc_feature 1..20: note = CRISPR gRNA sequence
  source 1..20: mol_type = other DNA
atgaccaaaaaagttccatc

SEQ ID NO: 70265 - DNA, 20 bp, synthetic construct
  misc_feature 1..20: note = CRISPR gRNA sequence
  source 1..20: mol_type = other DNA
catctttctagaaatatgta

SEQ ID NO: 70266 - DNA, 20 bp, synthetic construct
  misc_feature 1..20: note = CRISPR gRNA sequence
  source 1..20: mol_type = other DNA
tctagaaatatgtaacaaat

SEQ ID NO: 70267 - DNA, 20 bp, synthetic construct
  misc_feature 1..20: note = CRISPR gRNA sequence
  source 1..20: mol_type = other DNA
ctagaaatatgtaacaaata

SEQ ID NO: 70268 - DNA, 20 bp, synthetic construct
  misc_feature 1..20: note = CRISPR gRNA sequence
  source 1..20: mol_type = other DNA
tagaaatatgtaacaaataa

SEQ ID NO: 70269 - DNA, 20 bp, synthetic construct
  misc_feature 1..20: note = CRISPR gRNA sequence
  source 1..20: mol_type = other DNA
gaaatatgtaacaaataaca

SEQ ID NO: 70270 - DNA, 20 bp, synthetic construct
  misc_feature 1..20: note = CRISPR gRNA sequence
  source 1..20: mol_type = other DNA
agaaaacttctgttgaacgg

SEQ ID NO: 70271 - DNA, 20 bp, synthetic construct
  misc_feature 1..20: note = CRISPR gRNA sequence
  source 1..20: mol_type = other DNA
ctgttgaacggtttgtgaat

SEQ ID NO: 70272 - DNA, 20 bp, synthetic construct
  misc_feature 1..20: note = CRISPR gRNA sequence
  source 1..20: mol_type = other DNA
tgttgaacggtttgtgaatt

SEQ ID NO: 70273 - DNA, 20 bp, synthetic construct
  misc_feature 1..20: note = CRISPR gRNA sequence
  source 1..20: mol_type = other DNA
ttgaacggtttgtgaatttt

SEQ ID NO: 70274 - DNA, 20 bp, synthetic construct
  misc_feature 1..20: note = CRISPR gRNA sequence
  source 1..20: mol_type = other DNA
aacggtttgtgaatttttct

SEQ ID NO: 70275 - DNA, 20 bp, synthetic construct
  misc_feature 1..20: note = CRISPR gRNA sequence
  source 1..20: mol_type = other DNA
gtgaatttttctccagattt

SEQ ID NO: 70276 - DNA, 20 bp, synthetic construct
  misc_feature 1..20: note = CRISPR gRNA sequence
  source 1..20: mol_type = other DNA
tgaatttttctccagatttt

SEQ ID NO: 70277 - DNA, 20 bp, synthetic construct
  misc_feature 1..20: note = CRISPR gRNA sequence
  source 1..20: mol_type = other DNA
ttctccagatttttttttct

SEQ ID NO: 70278 - DNA, 20 bp, synthetic construct
  misc_feature 1..20: note = CRISPR gRNA sequence
  source 1..20: mol_type = other DNA
tctccagatttttttttcta

SEQ ID NO: 70279 - DNA, 20 bp, synthetic construct
  misc_feature 1..20: note = CRISPR gRNA sequence
  source 1..20: mol_type = other DNA
ctccagatttttttttctac

SEQ ID NO: 70280 - DNA, 20 bp, synthetic construct
  misc_feature 1..20: note = CRISPR gRNA sequence
  source 1..20: mol_type = other DNA
tccagatttttttttctaca

SEQ ID NO: 70281 - DNA, 20 bp, synthetic construct
  misc_feature 1..20: note = CRISPR gRNA sequence
  source 1..20: mol_type = other DNA
cagatttttttttctacata

SEQ ID NO: 70282 - DNA, 20 bp, synthetic construct
  misc_feature 1..20: note = CRISPR gRNA sequence
  source 1..20: mol_type = other DNA
ttttttctacatatgttttg

SEQ ID NO: 70283 - DNA, 20 bp, synthetic construct
  misc_feature 1..20: note = CRISPR gRNA sequence
  source 1..20: mol_type = other DNA
tttttctacatatgttttga

SEQ ID NO: 70284 - DNA, 20 bp, synthetic construct
  misc_feature 1..20: note = CRISPR gRNA sequence
  source 1..20: mol_type = other DNA
ttttctacatatgttttgaa

SEQ ID NO: 70285 - DNA, 20 bp, synthetic construct
  misc_feature 1..20: note = CRISPR gRNA sequence
  source 1..20: mol_type = other DNA
tttctacatatgttttgaat

SEQ ID NO: 70286 - DNA, 20 bp, synthetic construct
  misc_feature 1..20: note = CRISPR gRNA sequence
  source 1..20: mol_type = other DNA
ttctacatatgttttgaatt

SEQ ID NO: 70287 - DNA, 20 bp, synthetic construct
  misc_feature 1..20: note = CRISPR gRNA sequence
  source 1..20: mol_type = other DNA
tctacatatgttttgaattc

SEQ ID NO: 70288 - DNA, 20 bp, synthetic construct
  misc_feature 1..20: note = CRISPR gRNA sequence
  source 1..20: mol_type = other DNA
ctacatatgttttgaattca

SEQ ID NO: 70289 - DNA, 20 bp, synthetic construct
  misc_feature 1..20: note = CRISPR gRNA sequence
  source 1..20: mol_type = other DNA
tacatatgttttgaattcag

SEQ ID NO: 70290 - DNA, 20 bp, synthetic construct
  misc_feature 1..20: note = CRISPR gRNA sequence
  source 1..20: mol_type = other DNA
catatgttttgaattcagct

SEQ ID NO: 70291 - DNA, 20 bp, synthetic construct
  misc_feature 1..20: note = CRISPR gRNA sequence
  source 1..20: mol_type = other DNA
tgaattcagcttgaaagtag

SEQ ID NO: 70292 - DNA, 20 bp, synthetic construct
  misc_feature 1..20: note = CRISPR gRNA sequence
  source 1..20: mol_type = other DNA
gaattcagcttgaaagtagc

SEQ ID NO: 70293 - DNA, 20 bp, synthetic construct
  misc_feature 1..20: note = CRISPR gRNA sequence
  source 1..20: mol_type = other DNA
aattcagcttgaaagtagcc

SEQ ID NO: 70294 - DNA, 20 bp, synthetic construct
  misc_feature 1..20: note = CRISPR gRNA sequence
  source 1..20: mol_type = other DNA
agcttgaaagtagccttttg

SEQ ID NO: 70295 - DNA, 20 bp, synthetic construct
  misc_feature 1..20: note = CRISPR gRNA sequence
  source 1..20: mol_type = other DNA
gaaagtagccttttgacttt

SEQ ID NO: 70296 - DNA, 20 bp, synthetic construct
  misc_feature 1..20: note = CRISPR gRNA sequence
  source 1..20: mol_type = other DNA
aaagtagccttttgactttt

SEQ ID NO: 70297 - DNA, 20 bp, synthetic construct
  misc_feature 1..20: note = CRISPR gRNA sequence
  source 1..20: mol_type = other DNA
ttgactttttgccccttaac

SEQ ID NO: 70298 - DNA, 20 bp, synthetic construct
  misc_feature 1..20: note = CRISPR gRNA sequence
  source 1..20: mol_type = other DNA
tgactttttgccccttaaca

SEQ ID NO: 70299 - DNA, 20 bp, synthetic construct
  misc_feature 1..20: note = CRISPR gRNA sequence
  source 1..20: mol_type = other DNA
gactttttgccccttaacat

SEQ ID NO: 70300 - DNA, 20 bp, synthetic construct
  misc_feature 1..20: note = CRISPR gRNA sequence
  source 1..20: mol_type = other DNA
actttttgccccttaacatt

SEQ ID NO: 70301 - DNA, 20 bp, synthetic construct
  misc_feature 1..20: note = CRISPR gRNA sequence
  source 1..20: mol_type = other DNA
tttgccccttaacattgaaa

SEQ ID NO: 70302 - DNA, 20 bp, synthetic construct
  misc_feature 1..20: note = CRISPR gRNA sequence
  source 1..20: mol_type = other DNA
ttgccccttaacattgaaat

SEQ ID NO: 70303 - DNA, 20 bp, synthetic construct
  misc_feature 1..20: note = CRISPR gRNA sequence
  source 1..20: mol_type = other DNA
tgccccttaacattgaaatt

SEQ ID NO: 70304 - DNA, 20 bp, synthetic construct
  misc_feature 1..20: note = CRISPR gRNA sequence
  source 1..20: mol_type = other DNA
gccccttaacattgaaattc

SEQ ID NO: 70305 - DNA, 20 bp, synthetic construct
  misc_feature 1..20: note = CRISPR gRNA sequence
  source 1..20: mol_type = other DNA
ccccttaacattgaaattct

SEQ ID NO: 70306 - DNA, 20 bp, synthetic construct
  misc_feature 1..20: note = CRISPR gRNA sequence
  source 1..20: mol_type = other DNA
aacattgaaattcttccgct

SEQ ID NO: 70307 - DNA, 20 bp, synthetic construct
  misc_feature 1..20: note = CRISPR gRNA sequence
  source 1..20: mol_type = other DNA
acattgaaattcttccgctt

SEQ ID NO: 70308 - DNA, 20 bp, synthetic construct
  misc_feature 1..20: note = CRISPR gRNA sequence
  source 1..20: mol_type = other DNA
aaattcttccgcttgtccct

SEQ ID NO: 70309 - DNA, 20 bp, synthetic construct
  misc_feature 1..20: note = CRISPR gRNA sequence
  source 1..20: mol_type = other DNA
ttccgcttgtccctctttgc

SEQ ID NO: 70310 - DNA, 20 bp, synthetic construct
  misc_feature 1..20: note = CRISPR gRNA sequence
  source 1..20: mol_type = other DNA
ccgcttgtccctctttgctt

SEQ ID NO: 70311 - DNA, 20 bp, synthetic construct
  misc_feature 1..20: note = CRISPR gRNA sequence
  source 1..20: mol_type = other DNA
cgcttgtccctctttgcttg

SEQ ID NO: 70312 - DNA, 20 bp, synthetic construct
  misc_feature 1..20: note = CRISPR gRNA sequence
  source 1..20: mol_type = other DNA
gtccctctttgcttgtcctg

SEQ ID NO: 70313 - DNA, 20 bp, synthetic construct
  misc_feature 1..20: note = CRISPR gRNA sequence
  source 1..20: mol_type = other DNA
tccctctttgcttgtcctgg

SEQ ID NO: 70314 - DNA, 20 bp, synthetic construct
  misc_feature 1..20: note = CRISPR gRNA sequence
  source 1..20: mol_type = other DNA
tttgcttgtcctggggagag

SEQ ID NO: 70315 - DNA, 20 bp, synthetic construct
  misc_feature 1..20: note = CRISPR gRNA sequence
  source 1..20: mol_type = other DNA
tgcttgtcctggggagagga

SEQ ID NO: 70316 - DNA, 20 bp, synthetic construct
  misc_feature 1..20: note = CRISPR gRNA sequence
  source 1..20: mol_type = other DNA
gcttgtcctggggagaggat

SEQ ID NO: 70317 - DNA, 20 bp, synthetic construct
  misc_feature 1..20: note = CRISPR gRNA sequence
  source 1..20: mol_type = other DNA
cttgtcctggggagaggatc

SEQ ID NO: 70318 - DNA, 20 bp, synthetic construct
  misc_feature 1..20: note = CRISPR gRNA sequence
  source 1..20: mol_type = other DNA
gtcctggggagaggatcagg

SEQ ID NO: 70319 - DNA, 20 bp, synthetic construct
  misc_feature 1..20: note = CRISPR gRNA sequence
  source 1..20: mol_type = other DNA
tcctggggagaggatcaggt

SEQ ID NO: 70320 - DNA, 20 bp, synthetic construct
  misc_feature 1..20: note = CRISPR gRNA sequence
  source 1..20: mol_type = other DNA
gggagaggatcaggtaaaag

SEQ ID NO: 70321 - DNA, 20 bp, synthetic construct
  misc_feature 1..20: note = CRISPR gRNA sequence
  source 1..20: mol_type = other DNA
cagagacctttgaccacagg

SEQ ID NO: 70322 - DNA, 20 bp, synthetic construct
  misc_feature 1..20: note = CRISPR gRNA sequence
  source 1..20: mol_type = other DNA
tgaccacagggccctcctgt

SEQ ID NO: 70323 - DNA, 20 bp, synthetic construct
  misc_feature 1..20: note = CRISPR gRNA sequence
  source 1..20: mol_type = other DNA
gaccacagggccctcctgtc

SEQ ID NO: 70324 - DNA, 20 bp, synthetic construct
  misc_feature 1..20: note = CRISPR gRNA sequence
  source 1..20: mol_type = other DNA
accacagggccctcctgtcg

SEQ ID NO: 70325 - DNA, 20 bp, synthetic construct
  misc_feature 1..20: note = CRISPR gRNA sequence
  source 1..20: mol_type = other DNA
ctgtcgtctcactggtctgt

SEQ ID NO: 70326 - DNA, 20 bp, synthetic construct
  misc_feature 1..20: note = CRISPR gRNA sequence
  source 1..20: mol_type = other DNA
tcgtctcactggtctgtttc

SEQ ID NO: 70327 - DNA, 20 bp, synthetic construct
  misc_feature 1..20: note = CRISPR gRNA sequence
  source 1..20: mol_type = other DNA
actggtctgtttctttgccc

SEQ ID NO: 70328 - DNA, 20 bp, synthetic construct
  misc_feature 1..20: note = CRISPR gRNA sequence
  source 1..20: mol_type = other DNA
gtctgtttctttgcccactg

SEQ ID NO: 70329 - DNA, 20 bp, synthetic construct
  misc_feature 1..20: note = CRISPR gRNA sequence
  source 1..20: mol_type = other DNA
tttctttgcccactgtccat

SEQ ID NO: 70330 - DNA, 20 bp, synthetic construct
  misc_feature 1..20: note = CRISPR gRNA sequence
  source 1..20: mol_type = other DNA
ctttgcccactgtccatgta

SEQ ID NO: 70331 - DNA, 20 bp, synthetic construct
  misc_feature 1..20: note = CRISPR gRNA sequence
  source 1..20: mol_type = other DNA
tttgcccactgtccatgtac

SEQ ID NO: 70332 - DNA, 20 bp, synthetic construct
  misc_feature 1..20: note = CRISPR gRNA sequence
  source 1..20: mol_type = other DNA
tgcccactgtccatgtacct

SEQ ID NO: 70333 - DNA, 20 bp, synthetic construct
  misc_feature 1..20: note = CRISPR gRNA sequence
  source 1..20: mol_type = other DNA
gcccactgtccatgtacctg

SEQ ID NO: 70334 - DNA, 20 bp, synthetic construct
  misc_feature 1..20: note = CRISPR gRNA sequence
  source 1..20: mol_type = other DNA
cccactgtccatgtacctgc

SEQ ID NO: 70335 - DNA, 20 bp, synthetic construct
  misc_feature 1..20: note = CRISPR gRNA sequence
  source 1..20: mol_type = other DNA
tccatgtacctgcatctcgg

SEQ ID NO: 70336 - DNA, 20 bp, synthetic construct
  misc_feature 1..20: note = CRISPR gRNA sequence
  source 1..20: mol_type = other DNA
catctcggctcagccttctg

SEQ ID NO: 70337 - DNA, 20 bp, synthetic construct
  misc_feature 1..20: note = CRISPR gRNA sequence
  source 1..20: mol_type = other DNA
ggctcagccttctggaagct

SEQ ID NO: 70338 - DNA, 20 bp, synthetic construct
  misc_feature 1..20: note = CRISPR gRNA sequence
  source 1..20: mol_type = other DNA
agccttctggaagcttttat

SEQ ID NO: 70339 - DNA, 20 bp, synthetic construct
  misc_feature 1..20: note = CRISPR gRNA sequence
  source 1..20: mol_type = other DNA
ctggaagcttttatttaggg

SEQ ID NO: 70340 - DNA, 20 bp, synthetic construct
  misc_feature 1..20: note = CRISPR gRNA sequence
  source 1..20: mol_type = other DNA
tggaagcttttatttagggg

SEQ ID NO: 70341 - DNA, 20 bp, synthetic construct
  misc_feature 1..20: note = CRISPR gRNA sequence
  source 1..20: mol_type = other DNA
gaagcttttatttaggggat

SEQ ID NO: 70342 - DNA, 20 bp, synthetic construct
  misc_feature 1..20: note = CRISPR gRNA sequence
  source 1..20: mol_type = other DNA
ttatttaggggattggaggc

SEQ ID NO: 70343 - DNA, 20 bp, synthetic construct
  misc_feature 1..20: note = CRISPR gRNA sequence
  source 1..20: mol_type = other DNA
tatttaggggattggaggcc

SEQ ID NO: 70344 - DNA, 20 bp, synthetic construct
  misc_feature 1..20: note = CRISPR gRNA sequence
  source 1..20: mol_type = other DNA
atttaggggattggaggccc

SEQ ID NO: 70345 - DNA, 20 bp, synthetic construct
  misc_feature 1..20: note = CRISPR gRNA sequence
  source 1..20: mol_type = other DNA
tttaggggattggaggccca

SEQ ID NO: 70346 - DNA, 20 bp, synthetic construct
  misc_feature 1..20: note = CRISPR gRNA sequence
  source 1..20: mol_type = other DNA
aggggattggaggcccagtg

SEQ ID NO: 70347 - DNA, 20 bp, synthetic construct
  misc_feature 1..20: note = CRISPR gRNA sequence
  source 1..20: mol_type = other DNA
ggggattggaggcccagtga

SEQ ID NO: 70348 - DNA, 20 bp, synthetic construct
  misc_feature 1..20: note = CRISPR gRNA sequence
  source 1..20: mol_type = other DNA
gaggcccagtgaggtcattc

SEQ ID NO: 70349 - DNA, 20 bp, synthetic construct
  misc_feature 1..20: note = CRISPR gRNA sequence
  source 1..20: mol_type = other DNA
attggctcattcatgcattc

SEQ ID NO: 70350 - DNA, 20 bp, synthetic construct
  misc_feature 1..20: note = CRISPR gRNA sequence
  source 1..20: mol_type = other DNA
gctcattcatgcattcgaca

SEQ ID NO: 70351 - DNA, 20 bp, synthetic construct
  misc_feature 1..20: note = CRISPR gRNA sequence
  source 1..20: mol_type = other DNA
attcatgcattcgacaaata

SEQ ID NO: 70352 - DNA, 20 bp, synthetic construct
  misc_feature 1..20: note = CRISPR gRNA sequence
  source 1..20: mol_type = other DNA
atgcattcgacaaatatgta

SEQ ID NO: 70353 - DNA, 20 bp, synthetic construct
  misc_feature 1..20: note = CRISPR gRNA sequence
  source 1..20: mol_type = other DNA
gacaaatatgtactgagctg

SEQ ID NO: 70354 - DNA, 20 bp, synthetic construct
  misc_feature 1..20: note = CRISPR gRNA sequence
  source 1..20: mol_type = other DNA
agctgggcacctgggccggg

SEQ ID NO: 70355 - DNA, 20 bp, synthetic construct
  misc_feature 1..20: note = CRISPR gRNA sequence
  source 1..20: mol_type = other DNA
ggcacctgggccggggacag

SEQ ID NO: 70356 - DNA, 20 bp, synthetic construct
  misc_feature 1..20: note = CRISPR gRNA sequence
  source 1..20: mol_type = other DNA
ggccggggacaggacagatt

SEQ ID NO: 70357 - DNA, 20 bp, synthetic construct
  misc_feature 1..20: note = CRISPR gRNA sequence
  source 1..20: mol_type = other DNA
atccatgcccctgggggcct

SEQ ID NO: 70358 - DNA, 20 bp, synthetic construct
  misc_feature 1..20: note = CRISPR gRNA sequence
  source 1..20: mol_type = other DNA
ggggcctttttcttcctcct

SEQ ID NO: 70359 - DNA, 20 bp, synthetic construct
  misc_feature 1..20: note = CRISPR gRNA sequence
  source 1..20: mol_type = other DNA
tttcttcctcctgatttccc

SEQ ID NO: 70360 - DNA, 20 bp, synthetic construct
  misc_feature 1..20: note = CRISPR gRNA sequence
  source 1..20: mol_type = other DNA
ttcttcctcctgatttccca

SEQ ID NO: 70361 - DNA, 20 bp, synthetic construct
  misc_feature 1..20: note = CRISPR gRNA sequence
  source 1..20: mol_type = other DNA
tcttcctcctgatttcccag

SEQ ID NO: 70362 - DNA, 20 bp, synthetic construct
  misc_feature 1..20: note = CRISPR gRNA sequence
  source 1..20: mol_type = other DNA
cttcctcctgatttcccagg

SEQ ID NO: 70363 - DNA, 20 bp, synthetic construct
  misc_feature 1..20: note = CRISPR gRNA sequence
  source 1..20: mol_type = other DNA
ttcctcctgatttcccaggc

SEQ ID NO: 70364 - DNA, 20 bp, synthetic construct
  misc_feature 1..20: note = CRISPR gRNA sequence
  source 1..20: mol_type = other DNA
cctcctgatttcccaggcac

SEQ ID NO: 70365 - DNA, 20 bp, synthetic construct
  misc_feature 1..20: note = CRISPR gRNA sequence
  source 1..20: mol_type = other DNA
ctcctgatttcccaggcacc

SEQ ID NO: 70366 - DNA, 20 bp, synthetic construct
  misc_feature 1..20: note = CRISPR gRNA sequence
  source 1..20: mol_type = other DNA
ctgatttcccaggcaccatg

SEQ ID NO: 70367 - DNA, 20 bp, synthetic construct
  misc_feature 1..20: note = CRISPR gRNA sequence
  source 1..20: mol_type = other DNA
atttcccaggcaccatgtgc

SEQ ID NO: 70368 - DNA, 20 bp, synthetic construct
  misc_feature 1..20: note = CRISPR gRNA sequence
  source 1..20: mol_type = other DNA
cccaggcaccatgtgctgct

SEQ ID NO: 70369 - DNA, 20 bp, synthetic construct
  misc_feature 1..20: note = CRISPR gRNA sequence
  source 1..20: mol_type = other DNA
ccaggcaccatgtgctgctc

SEQ ID NO: 70370 - DNA, 20 bp, synthetic construct
  misc_feature 1..20: note = CRISPR gRNA sequence
  source 1..20: mol_type = other DNA
ctccttacctcctgctgcct

SEQ ID NO: 70371 - DNA, 20 bp, synthetic construct
  misc_feature 1..20: note = CRISPR gRNA sequence
  source 1..20: mol_type = other DNA
cttacctcctgctgccttag

SEQ ID NO: 70372 - DNA, 20 bp, synthetic construct
  misc_feature 1..20: note = CRISPR gRNA sequence
  source 1..20: mol_type = other DNA
acctcctgctgccttagttg

SEQ ID NO: 70373 - DNA, 20 bp, synthetic construct
  misc_feature 1..20: note = CRISPR gRNA sequence
  source 1..20: mol_type = other DNA
cctcctgctgccttagttgc

SEQ ID NO: 70374 - DNA, 20 bp, synthetic construct
  misc_feature 1..20: note = CRISPR gRNA sequence
  source 1..20: mol_type = other DNA
ctgctgccttagttgcccta

SEQ ID NO: 70375 - DNA, 20 bp, synthetic construct
  misc_feature 1..20: note = CRISPR gRNA sequence
  source 1..20: mol_type = other DNA
ctgccttagttgccctatct

SEQ ID NO: 70376 - DNA, 20 bp, synthetic construct
  misc_feature 1..20: note = CRISPR gRNA sequence
  source 1..20: mol_type = other DNA
ccttagttgccctatctgta

SEQ ID NO: 70377 - DNA, 20 bp, synthetic construct
  misc_feature 1..20: note = CRISPR gRNA sequence
  source 1..20: mol_type = other DNA
agttgccctatctgtaaact

SEQ ID NO: 70378 - DNA, 20 bp, synthetic construct
  misc_feature 1..20: note = CRISPR gRNA sequence
  source 1..20: mol_type = other DNA
gttgccctatctgtaaactg

SEQ ID NO: 70379 - DNA, 20 bp, synthetic construct
  misc_feature 1..20: note = CRISPR gRNA sequence
  source 1..20: mol_type = other DNA
ccctatctgtaaactgggca

SEQ ID NO: 70380 - DNA, 20 bp, synthetic construct
  misc_feature 1..20: note = CRISPR gRNA sequence
  source 1..20: mol_type = other DNA
tctgtaaactgggcataata

SEQ ID NO: 70381 - DNA, 20 bp, synthetic construct
  misc_feature 1..20: note = CRISPR gRNA sequence
  source 1..20: mol_type = other DNA
taaactgggcataatatctt

SEQ ID NO: 70382 - DNA, 20 bp, synthetic construct
  misc_feature 1..20: note = CRISPR gRNA sequence
  source 1..20: mol_type = other DNA
ggcataatatcttccctgtc

SEQ ID NO: 70383 - DNA, 20 bp, synthetic construct
  misc_feature 1..20: note = CRISPR gRNA sequence
  source 1..20: mol_type = other DNA
ccctgtccgaaggaagggga

SEQ ID NO: 70384 - DNA, 20 bp, synthetic construct
  misc_feature 1..20: note = CRISPR gRNA sequence
  source 1..20: mol_type = other DNA
cctgtccgaaggaaggggat

SEQ ID NO: 70385 - DNA, 20 bp, synthetic construct
  misc_feature 1..20: note = CRISPR gRNA sequence
  source 1..20: mol_type = other DNA
tccgaaggaaggggatggat

SEQ ID NO: 70386 - DNA, 20 bp, synthetic construct
  misc_feature 1..20: note = CRISPR gRNA sequence
  source 1..20: mol_type = other DNA
ttcccatctcagatctgtca

SEQ ID NO: 70387 - DNA, 20 bp, synthetic construct
  misc_feature 1..20: note = CRISPR gRNA sequence
  source 1..20: mol_type = other DNA
cccatctcagatctgtcatt

SEQ ID NO: 70388 - DNA, 20 bp, synthetic construct
  misc_feature 1..20: note = CRISPR gRNA sequence
  source 1..20: mol_type = other DNA
ccatctcagatctgtcattt

SEQ ID NO: 70389 - DNA, 20 bp, synthetic construct
  misc_feature 1..20: note = CRISPR gRNA sequence
  source 1..20: mol_type = other DNA
agatctgtcatttccaagtg

SEQ ID NO: 70390 - DNA, 20 bp, synthetic construct
  misc_feature 1..20: note = CRISPR gRNA sequence
  source 1..20: mol_type = other DNA
tcatttccaagtgtaactcc

SEQ ID NO: 70391 - DNA, 20 bp, synthetic construct
  misc_feature 1..20: note = CRISPR gRNA sequence
  source 1..20: mol_type = other DNA
ccaagtgtaactccccacag

SEQ ID NO: 70392 - DNA, 20 bp, synthetic construct
  misc_feature 1..20: note = CRISPR gRNA sequence
  source 1..20: mol_type = other DNA
caagtgtaactccccacagg

SEQ ID NO: 70393 - DNA, 20 bp, synthetic construct
  misc_feature 1..20: note = CRISPR gRNA sequence
  source 1..20: mol_type = other DNA
cccacaggcagttaccctca

SEQ ID NO: 70394 - DNA, 20 bp, synthetic construct
  misc_feature 1..20: note = CRISPR gRNA sequence
  source 1..20: mol_type = other DNA
ccctcaaatccagtcagctt

SEQ ID NO: 70395 - DNA, 20 bp, synthetic construct
  misc_feature 1..20: note = CRISPR gRNA sequence
  source 1..20: mol_type = other DNA
aaatccagtcagcttcttcc

SEQ ID NO: 70396 - DNA, 20 bp, synthetic construct
  misc_feature 1..20: note = CRISPR gRNA sequence
  source 1..20: mol_type = other DNA
cttccagctgtatacctgtg

SEQ ID NO: 70397 - DNA, 20 bp, synthetic construct
  misc_feature 1..20: note = CRISPR gRNA sequence
  source 1..20: mol_type = other DNA
ttccagctgtatacctgtga

SEQ ID NO: 70398 - DNA, 20 bp, synthetic construct
  misc_feature 1..20: note = CRISPR gRNA sequence
  source 1..20: mol_type = other DNA
ccagctgtatacctgtgatg

SEQ ID NO: 70399 - DNA, 20 bp, synthetic construct
  misc_feature 1..20: note = CRISPR gRNA sequence
  source 1..20: mol_type = other DNA
cagctgtatacctgtgatgg

SEQ ID NO: 70400 - DNA, 20 bp, synthetic construct
  misc_feature 1..20: note = CRISPR gRNA sequence
  source 1..20: mol_type = other DNA
tatacctgtgatggagtggg

SEQ ID NO: 70401 - DNA, 20 bp, synthetic construct
  misc_feature 1..20: note = CRISPR gRNA sequence
  source 1..20: mol_type = other DNA
tgatggagtgggtaggagca

SEQ ID NO: 70402 - DNA, 20 bp, synthetic construct
  misc_feature 1..20: note = CRISPR gRNA sequence
  source 1..20: mol_type = other DNA
gttaggagcctcactgcctg

SEQ ID NO: 70403 - DNA, 20 bp, synthetic construct
  misc_feature 1..20: note = CRISPR gRNA sequence
  source 1..20: mol_type = other DNA
ggagcctcactgcctgggtt

SEQ ID NO: 70404 - DNA, 20 bp, synthetic construct
  misc_feature 1..20: note = CRISPR gRNA sequence
  source 1..20: mol_type = other DNA
actgcctgggttcaactctg

SEQ ID NO: 70405 - DNA, 20 bp, synthetic construct
  misc_feature 1..20: note = CRISPR gRNA sequence
  source 1..20: mol_type = other DNA
cctgggttcaactctgggtg

SEQ ID NO: 70406 - DNA, 20 bp, synthetic construct
  misc_feature 1..20: note = CRISPR gRNA sequence
  source 1..20: mol_type = other DNA
ggttcaactctgggtggggt

SEQ ID NO: 70407 - DNA, 20 bp, synthetic construct
  misc_feature 1..20: note = CRISPR gRNA sequence
  source 1..20: mol_type = other DNA
aactctgggtggggtaactg

SEQ ID NO: 70408 - DNA, 20 bp, synthetic construct
  misc_feature 1..20: note = CRISPR gRNA sequence
  source 1..20: mol_type = other DNA
tgggtggggtaactgacact

SEQ ID NO: 70409 - DNA, 20 bp, synthetic construct
  misc_feature 1..20: note = CRISPR gRNA sequence
  source 1..20: mol_type = other DNA
ggtggggtaactgacacttc

SEQ ID NO: 70410 - DNA, 20 bp, synthetic construct
  misc_feature 1..20: note = CRISPR gRNA sequence
  source 1..20: mol_type = other DNA
acacttccagtttgcttgga

SEQ ID NO: 70411 - DNA, 20 bp, synthetic construct
  misc_feature 1..20: note = CRISPR gRNA sequence
  source 1..20: mol_type = other DNA
ccagtttgcttggagctttc

SEQ ID NO: 70412 - DNA, 20 bp, synthetic construct
  misc_feature 1..20: note = CRISPR gRNA sequence
  source 1..20: mol_type = other DNA
cagtttgcttggagctttcc

SEQ ID NO: 70413 - DNA, 20 bp, synthetic construct
  misc_feature 1..20: note = CRISPR gRNA sequence
  source 1..20: mol_type = other DNA
gcttggagctttccccattt

SEQ ID NO: 70414 - DNA, 20 bp, synthetic construct
  misc_feature 1..20: note = CRISPR gRNA sequence
  source 1..20: mol_type = other DNA
cttggagctttccccatttt

SEQ ID NO: 70415 - DNA, 20 bp, synthetic construct
  misc_feature 1..20: note = CRISPR gRNA sequence
  source 1..20: mol_type = other DNA
ggagctttccccattttggc

SEQ ID NO: 70416 - DNA, 20 bp, synthetic construct
  misc_feature 1..20: note = CRISPR gRNA sequence
  source 1..20: mol_type = other DNA
gagctttccccattttggca

SEQ ID NO: 70417 - DNA, 20 bp, synthetic construct
  misc_feature 1..20: note = CRISPR gRNA sequence
  source 1..20: mol_type = other DNA
tccccattttggcacccaaa

SEQ ID NO: 70418 - DNA, 20 bp, synthetic construct
  misc_feature 1..20: note = CRISPR gRNA sequence
  source 1..20: mol_type = other DNA
ccccattttggcacccaaag

SEQ ID NO: 70419 - DNA, 20 bp, synthetic construct
  misc_feature 1..20: note = CRISPR gRNA sequence
  source 1..20: mol_type = other DNA
cccattttggcacccaaagt

SEQ ID NO: 70420 - DNA, 20 bp, synthetic construct
  misc_feature 1..20: note = CRISPR gRNA sequence
  source 1..20: mol_type = other DNA
tggcacccaaagtcccacat

SEQ ID NO: 70421 - DNA, 20 bp, synthetic construct
  misc_feature 1..20: note = CRISPR gRNA sequence
  source 1..20: mol_type = other DNA
ggcacccaaagtcccacatc

SEQ ID NO: 70422 - DNA, 20 bp, synthetic construct
  misc_feature 1..20: note = CRISPR gRNA sequence
  source 1..20: mol_type = other DNA
gcacccaaagtcccacatcc

SEQ ID NO: 70423 - DNA, 20 bp, synthetic construct
  misc_feature 1..20: note = CRISPR gRNA sequence
  source 1..20: mol_type = other DNA
ttctgttctgagccaaccaa

SEQ ID NO: 70424 - DNA, 20 bp, synthetic construct
  misc_feature 1..20: note = CRISPR gRNA sequence
  source 1..20: mol_type = other DNA
ctgttctgagccaaccaaga

SEQ ID NO: 70425 - DNA, 20 bp, synthetic construct
  misc_feature 1..20: note = CRISPR gRNA sequence
  source 1..20: mol_type = other DNA
tgttctgagccaaccaagac

SEQ ID NO: 70426 - DNA, 20 bp, synthetic construct
  misc_feature 1..20: note = CRISPR gRNA sequence
  source 1..20: mol_type = other DNA
ttctgagccaaccaagacag

SEQ ID NO: 70427 - DNA, 20 bp, synthetic construct
  misc_feature 1..20: note = CRISPR gRNA sequence
  source 1..20: mol_type = other DNA
tgagccaaccaagacagttg

SEQ ID NO: 70428 - DNA, 20 bp, synthetic construct
  misc_feature 1..20: note = CRISPR gRNA sequence
  source 1..20: mol_type = other DNA
agccaaccaagacagttgac

SEQ ID NO: 70429 - DNA, 20 bp, synthetic construct
  misc_feature 1..20: note = CRISPR gRNA sequence
  source 1..20: mol_type = other DNA
accatcttttgcttctgcct

SEQ ID NO: 70430 - DNA, 20 bp, synthetic construct
  misc_feature 1..20: note = CRISPR gRNA sequence
  source 1..20: mol_type = other DNA
ttgcttctgcctcttatttt

SEQ ID NO: 70431 - DNA, 20 bp, synthetic construct
  misc_feature 1..20: note = CRISPR gRNA sequence
  source 1..20: mol_type = other DNA
tgcttctgcctcttatttta

SEQ ID NO: 70432 - DNA, 20 bp, synthetic construct
  misc_feature 1..20: note = CRISPR gRNA sequence
  source 1..20: mol_type = other DNA
gcttctgcctcttattttat

SEQ ID NO: 70433 - DNA, 20 bp, synthetic construct
  misc_feature 1..20: note = CRISPR gRNA sequence
  source 1..20: mol_type = other DNA
cttctgcctcttattttatt

SEQ ID NO: 70434 - DNA, 20 bp, synthetic construct
  misc_feature 1..20: note = CRISPR gRNA sequence
  source 1..20: mol_type = other DNA
ctgcctcttattttattatt

SEQ ID NO: 70435 - DNA, 20 bp, synthetic construct
  misc_feature 1..20: note = CRISPR gRNA sequence
  source 1..20: mol_type = other DNA
tgcctcttattttattattt

SEQ ID NO: 70436 - DNA, 20 bp, synthetic construct
  misc_feature 1..20: note = CRISPR gRNA sequence
  source 1..20: mol_type = other DNA
cctcttattttattatttat

SEQ ID NO: 70437 - DNA, 20 bp, synthetic construct
  misc_feature 1..20: note = CRISPR gRNA sequence
  source 1..20: mol_type = other DNA
ttattttattatttatttat

SEQ ID NO: 70438 - DNA, 20 bp, synthetic construct
  misc_feature 1..20: note = CRISPR gRNA sequence
  source 1..20: mol_type = other DNA
attttattatttatttattt

SEQ ID NO: 70439 - DNA, 20 bp, synthetic construct
  misc_feature 1..20: note = CRISPR gRNA sequence
  source 1..20: mol_type = other DNA
ttttattatttatttatttg

SEQ ID NO: 70440 - DNA, 20 bp, synthetic construct
  misc_feature 1..20: note = CRISPR gRNA sequence
  source 1..20: mol_type = other DNA
tattatttatttatttgaga

SEQ ID NO: 70441 - DNA, 20 bp, synthetic construct
  misc_feature 1..20: note = CRISPR gRNA sequence
  source 1..20: mol_type = other DNA
attatttatttatttgagac

SEQ ID NO: 70442 - DNA, 20 bp, synthetic construct
  misc_feature 1..20: note = CRISPR gRNA sequence
  source 1..20: mol_type = other DNA
ttatttatttatttgagacc

SEQ ID NO: 70443 - DNA, 20 bp, synthetic construct
  misc_feature 1..20: note = CRISPR gRNA sequence
  source 1..20: mol_type = other DNA
tttatttatttgagacccag

SEQ ID NO: 70444 - DNA, 20 bp, synthetic construct
  misc_feature 1..20: note = CRISPR gRNA sequence
  source 1..20: mol_type = other DNA
atttatttgagacccagtct

SEQ ID NO: 70445 - DNA, 20 bp, synthetic construct
  misc_feature 1..20: note = CRISPR gRNA sequence
  source 1..20: mol_type = other DNA
tttatttgagacccagtctc

SEQ ID NO: 70446 - DNA, 20 bp, synthetic construct
  misc_feature 1..20: note = CRISPR gRNA sequence
  source 1..20: mol_type = other DNA
atttgagacccagtctctct

SEQ ID NO: 70447 - DNA, 20 bp, synthetic construct
  misc_feature 1..20: note = CRISPR gRNA sequence
  source 1..20: mol_type = other DNA
tttgagacccagtctctctc

SEQ ID NO: 70448 - DNA, 20 bp, synthetic construct
  misc_feature 1..20: note = CRISPR gRNA sequence
  source 1..20: mol_type = other DNA
gagacccagtctctctccgt

SEQ ID NO: 70449 - DNA, 20 bp, synthetic construct
  misc_feature 1..20: note = CRISPR gRNA sequence
  source 1..20: mol_type = other DNA
agacccagtctctctccgtt

SEQ ID NO: 70450 - DNA, 20 bp, synthetic construct
  misc_feature 1..20: note = CRISPR gRNA sequence
  source 1..20: mol_type = other DNA
tctccgttgcccaggctgga

SEQ ID NO: 70451 - DNA, 20 bp, synthetic construct
  misc_feature 1..20: note = CRISPR gRNA sequence
  source 1..20: mol_type = other DNA
tccgttgcccaggctggagt

SEQ ID NO: 70452 - DNA, 20 bp, synthetic construct
  misc_feature 1..20: note = CRISPR gRNA sequence
  source 1..20: mol_type = other DNA
cgttgcccaggctggagtgc

SEQ ID NO: 70453 - DNA, 20 bp, synthetic construct
  misc_feature 1..20: note = CRISPR gRNA sequence
  source 1..20: mol_type = other DNA
cccaggctggagtgcagtgg

SEQ ID NO: 70454 - DNA, 20 bp, synthetic construct
  misc_feature 1..20: note = CRISPR gRNA sequence
  source 1..20: mol_type = other DNA
gagtgcagtggcacagtctt

SEQ ID NO: 70455 - DNA, 20 bp, synthetic construct
  misc_feature 1..20: note = CRISPR gRNA sequence
  source 1..20: mol_type = other DNA
ggctcactgcaacctccgcc

SEQ ID NO: 70456 - DNA, 20 bp, synthetic construct
  misc_feature 1..20: note = CRISPR gRNA sequence
  source 1..20: mol_type = other DNA
gctcactgcaacctccgcct

SEQ ID NO: 70457 - DNA, 20 bp, synthetic construct
  misc_feature 1..20: note = CRISPR gRNA sequence
  source 1..20: mol_type = other DNA
actgcaacctccgcctcccg

SEQ ID NO: 70458 - DNA, 20 bp, synthetic construct
  misc_feature 1..20: note = CRISPR gRNA sequence
  source 1..20: mol_type = other DNA
caacctccgcctcccgggtt

SEQ ID NO: 70459 - DNA, 20 bp, synthetic construct
  misc_feature 1..20: note = CRISPR gRNA sequence
  source 1..20: mol_type = other DNA
cgcctcccgggttcaagcaa

SEQ ID NO: 70460 - DNA, 20 bp, synthetic construct
  misc_feature 1..20: note = CRISPR gRNA sequence
  source 1..20: mol_type = other DNA
ccgggttcaagcaaccctcc

SEQ ID NO: 70461 - DNA, 20 bp, synthetic construct
  misc_feature 1..20: note = CRISPR gRNA sequence
  source 1..20: mol_type = other DNA
aagcaaccctcctgcctcag

SEQ ID NO: 70462 - DNA, 20 bp, synthetic construct
  misc_feature 1..20: note = CRISPR gRNA sequence
  source 1..20: mol_type = other DNA
ctgcctcagcctcccaagta

SEQ ID NO: 70463 - DNA, 20 bp, synthetic construct
  misc_feature 1..20: note = CRISPR gRNA sequence
  source 1..20: mol_type = other DNA
cctcagcctcccaagtagct

SEQ ID NO: 70464 - DNA, 20 bp, synthetic construct
  misc_feature 1..20: note = CRISPR gRNA sequence
  source 1..20: mol_type = other DNA
agcctcccaagtagctggca

SEQ ID NO: 70465 - DNA, 20 bp, synthetic construct
  misc_feature 1..20: note = CRISPR gRNA sequence
  source 1..20: mol_type = other DNA
ccaagtagctggcattacag

SEQ ID NO: 70466 - DNA, 20 bp, synthetic construct
  misc_feature 1..20: note = CRISPR gRNA sequence
  source 1..20: mol_type = other DNA
gcattacaggcacatgccac

SEQ ID NO: 70467 - DNA, 20 bp, synthetic construct
  misc_feature 1..20: note = CRISPR gRNA sequence
  source 1..20: mol_type = other DNA
caggcacatgccaccaggcc

SEQ ID NO: 70468 - DNA, 20 bp, synthetic construct
  misc_feature 1..20: note = CRISPR gRNA sequence
  source 1..20: mol_type = other DNA
atttttctatttttagtgga

SEQ ID NO: 70469 - DNA, 20 bp, synthetic construct
  misc_feature 1..20: note = CRISPR gRNA sequence
  source 1..20: mol_type = other DNA
ttctatttttagtggagatg

SEQ ID NO: 70470 - DNA, 20 bp, synthetic construct
  misc_feature 1..20: note = CRISPR gRNA sequence
  source 1..20: mol_type = other DNA
tctatttttagtggagatgg

SEQ ID NO: 70471 - DNA, 20 bp, synthetic construct
  misc_feature 1..20: note = CRISPR gRNA sequence
  source 1..20: mol_type = other DNA
ctatttttagtggagatggg

SEQ ID NO: 70472 - DNA, 20 bp, synthetic construct
  misc_feature 1..20: note = CRISPR gRNA sequence
  source 1..20: mol_type = other DNA
tatttttagtggagatgggg

SEQ ID NO: 70473 - DNA, 20 bp, synthetic construct
  misc_feature 1..20: note = CRISPR gRNA sequence
  source 1..20: mol_type = other DNA
tttttagtggagatggggtt

SEQ ID NO: 70474 - DNA, 20 bp, synthetic construct
  misc_feature 1..20: note = CRISPR gRNA sequence
  source 1..20: mol_type = other DNA
ttagtggagatggggtttca

SEQ ID NO: 70475 - DNA, 20 bp, synthetic construct
  misc_feature 1..20: note = CRISPR gRNA sequence
  source 1..20: mol_type = other DNA
tagtggagatggggtttcac

SEQ ID NO: 70476 - DNA, 20 bp, synthetic construct
  misc_feature 1..20: note = CRISPR gRNA sequence
  source 1..20: mol_type = other DNA
agtggagatggggtttcact

SEQ ID NO: 70477 - DNA, 20 bp, synthetic construct
  misc_feature 1..20: note = CRISPR gRNA sequence
  source 1..20: mol_type = other DNA
gtggagatggggtttcactt

SEQ ID NO: 70478 - DNA, 20 bp, synthetic construct
  misc_feature 1..20: note = CRISPR gRNA sequence
  source 1..20: mol_type = other DNA
cactttgttggccaggctgg

SEQ ID NO: 70479 - DNA, 20 bp, synthetic construct
  misc_feature 1..20: note = CRISPR gRNA sequence
  source 1..20: mol_type = other DNA
actttgttggccaggctggt

SEQ ID NO: 70480 - DNA, 20 bp, synthetic construct
  misc_feature 1..20: note = CRISPR gRNA sequence
  source 1..20: mol_type = other DNA
tgttggccaggctggtctcg

SEQ ID NO: 70481 - DNA, 20 bp, synthetic construct
  misc_feature 1..20: note = CRISPR gRNA sequence
  source 1..20: mol_type = other DNA
gttggccaggctggtctcga

SEQ ID NO: 70482 - DNA, 20 bp, synthetic construct
  misc_feature 1..20: note = CRISPR gRNA sequence
  source 1..20: mol_type = other DNA
ttggccaggctggtctcgaa

SEQ ID NO: 70483 - DNA, 20 bp, synthetic construct
  misc_feature 1..20: note = CRISPR gRNA sequence
  source 1..20: mol_type = other DNA
gccaggctggtctcgaactc

SEQ ID NO: 70484 - DNA, 20 bp, synthetic construct
  misc_feature 1..20: note = CRISPR gRNA sequence
  source 1..20: mol_type = other DNA
gtctcgaactcctgacctca

SEQ ID NO: 70485 - DNA, 20 bp, synthetic construct
  misc_feature 1..20: note = CRISPR gRNA sequence
  source 1..20: mol_type = other DNA
gaactcctgacctcaggtga

SEQ ID NO: 70486 - DNA, 20 bp, synthetic construct
  misc_feature 1..20: note = CRISPR gRNA sequence
  source 1..20: mol_type = other DNA
ctgacctcaggtgattcacc

SEQ ID NO: 70487 - DNA, 20 bp, synthetic construct
  misc_feature 1..20: note = CRISPR gRNA sequence
  source 1..20: mol_type = other DNA
acctcaggtgattcacccgc

SEQ ID NO: 70488 - DNA, 20 bp, synthetic construct
  misc_feature 1..20: note = CRISPR gRNA sequence
  source 1..20: mol_type = other DNA
aggtgattcacccgccttgg

SEQ ID NO: 70489 - DNA, 20 bp, synthetic construct
  misc_feature 1..20: note = CRISPR gRNA sequence
  source 1..20: mol_type = other DNA
acccgccttggcctcacaaa

SEQ ID NO: 70490 - DNA, 20 bp, synthetic construct
  misc_feature 1..20: note = CRISPR gRNA sequence
  source 1..20: mol_type = other DNA
ggcctcacaaagtcctggga

SEQ ID NO: 70491 - DNA, 20 bp, synthetic construct
  misc_feature 1..20: note = CRISPR gRNA sequence
  source 1..20: mol_type = other DNA
gcctcacaaagtcctgggat

SEQ ID NO: 70492 - DNA, 20 bp, synthetic construct
  misc_feature 1..20: note = CRISPR gRNA sequence
  source 1..20: mol_type = other DNA
acaaagtcctgggattacag

SEQ ID NO: 70493 - DNA, 20 bp, synthetic construct
  misc_feature 1..20: note = CRISPR gRNA sequence
  source 1..20: mol_type = other DNA
ggattacaggcatgagccat

SEQ ID NO: 70494 - DNA, 20 bp, synthetic construct
  misc_feature 1..20: note = CRISPR gRNA sequence
  source 1..20: mol_type = other DNA
caggcatgagccattgcgcc

SEQ ID NO: 70495 - DNA, 20 bp, synthetic construct
  misc_feature 1..20: note = CRISPR gRNA sequence
  source 1..20: mol_type = other DNA
cgcccagccagttctgtttc

SEQ ID NO: 70496 - DNA, 20 bp, synthetic construct
  misc_feature 1..20: note = CRISPR gRNA sequence
  source 1..20: mol_type = other DNA
tgtttcttaatgtgtgaact

SEQ ID NO: 70497 - DNA, 20 bp, synthetic construct
  misc_feature 1..20: note = CRISPR gRNA sequence
  source 1..20: mol_type = other DNA
tttcttaatgtgtgaactcg

SEQ ID NO: 70498 - DNA, 20 bp, synthetic construct
  misc_feature 1..20: note = CRISPR gRNA sequence
  source 1..20: mol_type = other DNA
cttaatgtgtgaactcgtgc

SEQ ID NO: 70499 - DNA, 20 bp, synthetic construct
  misc_feature 1..20: note = CRISPR gRNA sequence
  source 1..20: mol_type = other DNA
ttaatgtgtgaactcgtgcc

SEQ ID NO: 70500 - DNA, 20 bp, synthetic construct
  misc_feature 1..20: note = CRISPR gRNA sequence
  source 1..20: mol_type = other DNA
aatgtgtgaactcgtgccag

SEQ ID NO: 70501 - DNA, 20 bp, synthetic construct
  misc_feature 1..20: note = CRISPR gRNA sequence
  source 1..20: mol_type = other DNA
atgtgtgaactcgtgccagt

SEQ ID NO: 70502 - DNA, 20 bp, synthetic construct
  misc_feature 1..20: note = CRISPR gRNA sequence
  source 1..20: mol_type = other DNA
gtgccagtccctcagcctct

SEQ ID NO: 70503 - DNA, 20 bp, synthetic construct
  misc_feature 1..20: note = CRISPR gRNA sequence
  source 1..20: mol_type = other DNA
agcctctctgttctttggcc

SEQ ID NO: 70504 - DNA, 20 bp, synthetic construct
  misc_feature 1..20: note = CRISPR gRNA sequence
  source 1..20: mol_type = other DNA
tctgttctttggcctcctca

SEQ ID NO: 70505 - DNA, 20 bp, synthetic construct
  misc_feature 1..20: note = CRISPR gRNA sequence
  source 1..20: mol_type = other DNA
tgttctttggcctcctcatc

SEQ ID NO: 70506 - DNA, 20 bp, synthetic construct
  misc_feature 1..20: note = CRISPR gRNA sequence
  source 1..20: mol_type = other DNA
ttctttggcctcctcatctt

SEQ ID NO: 70507 - DNA, 20 bp, synthetic construct
  misc_feature 1..20: note = CRISPR gRNA sequence
  source 1..20: mol_type = other DNA
tttggcctcctcatcttaac

SEQ ID NO: 70508 - DNA, 20 bp, synthetic construct
  misc_feature 1..20: note = CRISPR gRNA sequence
  source 1..20: mol_type = other DNA
tggcctcctcatcttaactt

SEQ ID NO: 70509 - DNA, 20 bp, synthetic construct
  misc_feature 1..20: note = CRISPR gRNA sequence
  source 1..20: mol_type = other DNA
ggcctcctcatcttaacttt

SEQ ID NO: 70510 - DNA, 20 bp, synthetic construct
  misc_feature 1..20: note = CRISPR gRNA sequence
  source 1..20: mol_type = other DNA
gcctcctcatcttaactttg

SEQ ID NO: 70511 - DNA, 20 bp, synthetic construct
  misc_feature 1..20: note = CRISPR gRNA sequence
  source 1..20: mol_type = other DNA
ctcatcttaactttgaggat

SEQ ID NO: 70512 - DNA, 20 bp, synthetic construct
  misc_feature 1..20: note = CRISPR gRNA sequence
  source 1..20: mol_type = other DNA
atcttaactttgaggataag

SEQ ID NO: 70513 - DNA, 20 bp, synthetic construct
  misc_feature 1..20: note = CRISPR gRNA sequence
  source 1..20: mol_type = other DNA
aactttgaggataagagcaa

SEQ ID NO: 70514 - DNA, 20 bp, synthetic construct
  misc_feature 1..20: note = CRISPR gRNA sequence
  source 1..20: mol_type = other DNA
actttgaggataagagcaat

SEQ ID NO: 70515 - DNA, 20 bp, synthetic construct
  misc_feature 1..20: note = CRISPR gRNA sequence
  source 1..20: mol_type = other DNA
tgaggataagagcaatctcc

SEQ ID NO: 70516 - DNA, 20 bp, synthetic construct
  misc_feature 1..20: note = CRISPR gRNA sequence
  source 1..20: mol_type = other DNA
gaggataagagcaatctccc

SEQ ID NO: 70517 - DNA, 20 bp, synthetic construct
  misc_feature 1..20: note = CRISPR gRNA sequence
  source 1..20: mol_type = other DNA
aggataagagcaatctcccc

SEQ ID NO: 70518 - DNA, 20 bp, synthetic construct
  misc_feature 1..20: note = CRISPR gRNA sequence
  source 1..20: mol_type = other DNA
ccctgctacggttgttgtga

SEQ ID NO: 70519 - DNA, 20 bp, synthetic construct
  misc_feature 1..20: note = CRISPR gRNA sequence
  source 1..20: mol_type = other DNA
ctacggttgttgtgagtatt

SEQ ID NO: 70520 - DNA, 20 bp, synthetic construct
  misc_feature 1..20: note = CRISPR gRNA sequence
  source 1..20: mol_type = other DNA
cggttgttgtgagtattaaa

SEQ ID NO: 70521 - DNA, 20 bp, synthetic construct
  misc_feature 1..20: note = CRISPR gRNA sequence
  source 1..20: mol_type = other DNA
ttgtgagtattaaatgagat

SEQ ID NO: 70522 - DNA, 20 bp, synthetic construct
  misc_feature 1..20: note = CRISPR gRNA sequence
  source 1..20: mol_type = other DNA
tgagtattaaatgagataat

SEQ ID NO: 70523 - DNA, 20 bp, synthetic construct
  misc_feature 1..20: note = CRISPR gRNA sequence
  source 1..20: mol_type = other DNA
aatgagataatatgtgttac

SEQ ID NO: 70524 - DNA, 20 bp, synthetic construct
  misc_feature 1..20: note = CRISPR gRNA sequence
  source 1..20: mol_type = other DNA
cagtcttagagtctggtcag

SEQ ID NO: 70525 - DNA, 20 bp, synthetic construct
  misc_feature 1..20: note = CRISPR gRNA sequence
  source 1..20: mol_type = other DNA
agagtctggtcagagttcac

SEQ ID NO: 70526 - DNA, 20 bp, synthetic construct
  misc_feature 1..20: note = CRISPR gRNA sequence
  source 1..20: mol_type = other DNA
gagtctggtcagagttcaca

SEQ ID NO: 70527 - DNA, 20 bp, synthetic construct
  misc_feature 1..20: note = CRISPR gRNA sequence
  source 1..20: mol_type = other DNA
gtcagagttcacactctaca

SEQ ID NO: 70528 - DNA, 20 bp, synthetic construct
  misc_feature 1..20: note = CRISPR gRNA sequence
  source 1..20: mol_type = other DNA
acactctacaagtgctagct

SEQ ID NO: 70529 - DNA, 20 bp, synthetic construct
  misc_feature 1..20: note = CRISPR gRNA sequence
  source 1..20: mol_type = other DNA
tacaagtgctagctattgtt

SEQ ID NO: 70530 - DNA, 20 bp, synthetic construct
  misc_feature 1..20: note = CRISPR gRNA sequence
  source 1..20: mol_type = other DNA
caagtgctagctattgttat

SEQ ID NO: 70531 - DNA, 20 bp, synthetic construct
  misc_feature 1..20: note = CRISPR gRNA sequence
  source 1..20: mol_type = other DNA
gctattgttattctcctctc

SEQ ID NO: 70532 - DNA, 20 bp, synthetic construct
  misc_feature 1..20: note = CRISPR gRNA sequence
  source 1..20: mol_type = other DNA
ttgttattctcctctcctgc

SEQ ID NO: 70533 - DNA, 20 bp, synthetic construct
  misc_feature 1..20: note = CRISPR gRNA sequence
  source 1..20: mol_type = other DNA
ttattctcctctcctgccta

SEQ ID NO: 70534 - DNA, 20 bp, synthetic construct
  misc_feature 1..20: note = CRISPR gRNA sequence
  source 1..20: mol_type = other DNA
ttctcctctcctgcctaggc

SEQ ID NO: 70535 - DNA, 20 bp, synthetic construct
  misc_feature 1..20: note = CRISPR gRNA sequence
  source 1..20: mol_type = other DNA
tcctctcctgcctaggctgg

SEQ ID NO: 70536 - DNA, 20 bp, synthetic construct
  misc_feature 1..20: note = CRISPR gRNA sequence
  source 1..20: mol_type = other DNA
ctctcctgcctaggctgggg

SEQ ID NO: 70537 - DNA, 20 bp, synthetic construct
  misc_feature 1..20: note = CRISPR gRNA sequence
  source 1..20: mol_type = other DNA
tcctgcctaggctgggggcc

SEQ ID NO: 70538 - DNA, 20 bp, synthetic construct
  misc_feature 1..20: note = CRISPR gRNA sequence
  source 1..20: mol_type = other DNA
ctgcctaggctgggggcctc

SEQ ID NO: 70539 - DNA, 20 bp, synthetic construct
  misc_feature 1..20: note = CRISPR gRNA sequence
  source 1..20: mol_type = other DNA
cctaggctgggggcctctag

SEQ ID NO: 70540 - DNA, 20 bp, synthetic construct
  misc_feature 1..20: note = CRISPR gRNA sequence
  source 1..20: mol_type = other DNA
ggctgggggcctctagaagt

SEQ ID NO: 70541 - DNA, 20 bp, synthetic construct
  misc_feature 1..20: note = CRISPR gRNA sequence
  source 1..20: mol_type = other DNA
ggggcctctagaagtacaat

SEQ ID NO: 70542 - DNA, 20 bp, synthetic construct
  misc_feature 1..20: note = CRISPR gRNA sequence
  source 1..20: mol_type = other DNA
tagaagtacaatcgcctggg

SEQ ID NO: 70543 - DNA, 20 bp, synthetic construct
  misc_feature 1..20: note = CRISPR gRNA sequence
  source 1..20: mol_type = other DNA
gaagtacaatcgcctgggtc

SEQ ID NO: 70544 - DNA, 20 bp, synthetic construct
  misc_feature 1..20: note = CRISPR gRNA sequence
  source 1..20: mol_type = other DNA
ggtcacatatggttggggct

SEQ ID NO: 70545 - DNA, 20 bp, synthetic construct
  misc_feature 1..20: note = CRISPR gRNA sequence
  source 1..20: mol_type = other DNA
gggctcaggaatgggagttc

SEQ ID NO: 70546 - DNA, 20 bp, synthetic construct
  misc_feature 1..20: note = CRISPR gRNA sequence
  source 1..20: mol_type = other DNA
aggaatgggagttctatagt

SEQ ID NO: 70547 - DNA, 20 bp, synthetic construct
  misc_feature 1..20: note = CRISPR gRNA sequence
  source 1..20: mol_type = other DNA
tatagtttttggttctgttc

SEQ ID NO: 70548 - DNA, 20 bp, synthetic construct
  misc_feature 1..20: note = CRISPR gRNA sequence
  source 1..20: mol_type = other DNA
tagtttttggttctgttcct

SEQ ID NO: 70549 - DNA, 20 bp, synthetic construct
  misc_feature 1..20: note = CRISPR gRNA sequence
  source 1..20: mol_type = other DNA
ttggttctgttcctgaagca

SEQ ID NO: 70550 - DNA, 20 bp, synthetic construct
  misc_feature 1..20: note = CRISPR gRNA sequence
  source 1..20: mol_type = other DNA
tggttctgttcctgaagcag

SEQ ID NO: 70551 - DNA, 20 bp, synthetic construct
  misc_feature 1..20: note = CRISPR gRNA sequence
  source 1..20: mol_type = other DNA
ggttctgttcctgaagcagc

SEQ ID NO: 70552 - DNA, 20 bp, synthetic construct
  misc_feature 1..20: note = CRISPR gRNA sequence
  source 1..20: mol_type = other DNA
gttctgttcctgaagcagcc

SEQ ID NO: 70553 - DNA, 20 bp, synthetic construct
  misc_feature 1..20: note = CRISPR gRNA sequence
  source 1..20: mol_type = other DNA
tgttcctgaagcagccactt

SEQ ID NO: 70554 - DNA, 20 bp, synthetic construct
  misc_feature 1..20: note = CRISPR gRNA sequence
  source 1..20: mol_type = other DNA
ttcctgaagcagccactttg

SEQ ID NO: 70555 - DNA, 20 bp, synthetic construct
  misc_feature 1..20: note = CRISPR gRNA sequence
  source 1..20: mol_type = other DNA
ctgaagcagccactttgtgt

SEQ ID NO: 70556 - DNA, 20 bp, synthetic construct
  misc_feature 1..20: note = CRISPR gRNA sequence
  source 1..20: mol_type = other DNA
aagcagccactttgtgtatg

SEQ ID NO: 70557 - DNA, 20 bp, synthetic construct
  misc_feature 1..20: note = CRISPR gRNA sequence
  source 1..20: mol_type = other DNA
tgtgtatgaccttaagcaag

SEQ ID NO: 70558 - DNA, 20 bp, synthetic construct
  misc_feature 1..20: note = CRISPR gRNA sequence
  source 1..20: mol_type = other DNA
gtgtatgaccttaagcaagt

SEQ ID NO: 70559 - DNA, 20 bp, synthetic construct
  misc_feature 1..20: note = CRISPR gRNA sequence
  source 1..20: mol_type = other DNA
tgtatgaccttaagcaagtt

SEQ ID NO: 70560 - DNA, 20 bp, synthetic construct
  misc_feature 1..20: note = CRISPR gRNA sequence
  source 1..20: mol_type = other DNA
aagcaagttctctaactctc

SEQ ID NO: 70561 - DNA, 20 bp, synthetic construct
  misc_feature 1..20: note = CRISPR gRNA sequence
  source 1..20: mol_type = other DNA
agcaagttctctaactctct

SEQ ID NO: 70562 - DNA, 20 bp, synthetic construct
  misc_feature 1..20: note = CRISPR gRNA sequence
  source 1..20: mol_type = other DNA
tctaactctctgaaccttgg

SEQ ID NO: 70563 - DNA, 20 bp, synthetic construct
  misc_feature 1..20: note = CRISPR gRNA sequence
  source 1..20: mol_type = other DNA
taactctctgaaccttggtg

SEQ ID NO: 70564 - DNA, 20 bp, synthetic construct
  misc_feature 1..20: note = CRISPR gRNA sequence
  source 1..20: mol_type = other DNA
actctctgaaccttggtgtt

SEQ ID NO: 70565 - DNA, 20 bp, synthetic construct
  misc_feature 1..20: note = CRISPR gRNA sequence
  source 1..20: mol_type = other DNA
tctgaaccttggtgttcctc

SEQ ID NO: 70566 - DNA, 20 bp, synthetic construct
  misc_feature 1..20: note = CRISPR gRNA sequence
  source 1..20: mol_type = other DNA
tgaaccttggtgttcctcac

SEQ ID NO: 70567 - DNA, 20 bp, synthetic construct
  misc_feature 1..20: note = CRISPR gRNA sequence
  source 1..20: mol_type = other DNA
aaccttggtgttcctcacct

SEQ ID NO: 70568 - DNA, 20 bp, synthetic construct
  misc_feature 1..20: note = CRISPR gRNA sequence
  source 1..20: mol_type = other DNA
ggtgttcctcacctgtaaaa

SEQ ID NO: 70569 - DNA, 20 bp, synthetic construct
  misc_feature 1..20: note = CRISPR gRNA sequence
  source 1..20: mol_type = other DNA
gtgttcctcacctgtaaaat

SEQ ID NO: 70570 - DNA, 20 bp, synthetic construct
  misc_feature 1..20: note = CRISPR gRNA sequence
  source 1..20: mol_type = other DNA
ctcacctgtaaaatggggac

SEQ ID NO: 70571 - DNA, 20 bp, synthetic construct
  misc_feature 1..20: note = CRISPR gRNA sequence
  source 1..20: mol_type = other DNA
acctgtaaaatggggacgat

SEQ ID NO: 70572 - DNA, 20 bp, synthetic construct
  misc_feature 1..20: note = CRISPR gRNA sequence
  source 1..20: mol_type = other DNA
taaaatggggacgataataa

SEQ ID NO: 70573 - DNA, 20 bp, synthetic construct
  misc_feature 1..20: note = CRISPR gRNA sequence
  source 1..20: mol_type = other DNA
tccagatggccccaagccct

SEQ ID NO: 70574 - DNA, 20 bp, synthetic construct
  misc_feature 1..20: note = CRISPR gRNA sequence
  source 1..20: mol_type = other DNA
ccagatggccccaagccctg

SEQ ID NO: 70575 - DNA, 20 bp, synthetic construct
  misc_feature 1..20: note = CRISPR gRNA sequence
  source 1..20: mol_type = other DNA
cagatggccccaagccctga

SEQ ID NO: 70576 - DNA, 20 bp, synthetic construct
  misc_feature 1..20: note = CRISPR gRNA sequence
  source 1..20: mol_type = other DNA
agtttggcccacattttatg

SEQ ID NO: 70577 - DNA, 20 bp, synthetic construct
  misc_feature 1..20: note = CRISPR gRNA sequence
  source 1..20: mol_type = other DNA
ggcccacattttatgatcaa

SEQ ID NO: 70578 - DNA, 20 bp, synthetic construct
  misc_feature 1..20: note = CRISPR gRNA sequence
  source 1..20: mol_type = other DNA
gcccacattttatgatcaat

SEQ ID NO: 70579 - DNA, 20 bp, synthetic construct
  misc_feature 1..20: note = CRISPR gRNA sequence
  source 1..20: mol_type = other DNA
tatgatcaatgtgtgaccgc

SEQ ID NO: 70580 - DNA, 20 bp, synthetic construct
  misc_feature 1..20: note = CRISPR gRNA sequence
  source 1..20: mol_type = other DNA
atgatcaatgtgtgaccgcc

SEQ ID NO: 70581 - DNA, 20 bp, synthetic construct
  misc_feature 1..20: note = CRISPR gRNA sequence
  source 1..20: mol_type = other DNA
tgatcaatgtgtgaccgcca

SEQ ID NO: 70582 - DNA, 20 bp, synthetic construct
  misc_feature 1..20: note = CRISPR gRNA sequence
  source 1..20: mol_type = other DNA
ttacggatcattagtcttgg

SEQ ID NO: 70583 - DNA, 20 bp, synthetic construct
  misc_feature 1..20: note = CRISPR gRNA sequence
  source 1..20: mol_type = other DNA
cggatcattagtcttggtcc

SEQ ID NO: 70584 - DNA, 20 bp, synthetic construct
  misc_feature 1..20: note = CRISPR gRNA sequence
  source 1..20: mol_type = other DNA
gtcttggtccatgtggttca

SEQ ID NO: 70585 - DNA, 20 bp, synthetic construct
  misc_feature 1..20: note = CRISPR gRNA sequence
  source 1..20: mol_type = other DNA
ggtccatgtggttcagaaca

SEQ ID NO: 70586 - DNA, 20 bp, synthetic construct
  misc_feature 1..20: note = CRISPR gRNA sequence
  source 1..20: mol_type = other DNA
gtccatgtggttcagaacat

SEQ ID NO: 70587 - DNA, 20 bp, synthetic construct
  misc_feature 1..20: note = CRISPR gRNA sequence
  source 1..20: mol_type = other DNA
agaacatagaactgctgcct

SEQ ID NO: 70588 - DNA, 20 bp, synthetic construct
  misc_feature 1..20: note = CRISPR gRNA sequence
  source 1..20: mol_type = other DNA
ctgcctgcctgacctcagta

SEQ ID NO: 70589 - DNA, 20 bp, synthetic construct
  misc_feature 1..20: note = CRISPR gRNA sequence
  source 1..20: mol_type = other DNA
cctgcctgacctcagtaatt

SEQ ID NO: 70590 - DNA, 20 bp, synthetic construct
  misc_feature 1..20: note = CRISPR gRNA sequence
  source 1..20: mol_type = other DNA
cctgacctcagtaattcatg

SEQ ID NO: 70591 - DNA, 20 bp, synthetic construct
  misc_feature 1..20: note = CRISPR gRNA sequence
  source 1..20: mol_type = other DNA
acctcagtaattcatgcaga

SEQ ID NO: 70592 - DNA, 20 bp, synthetic construct
  misc_feature 1..20: note = CRISPR gRNA sequence
  source 1..20: mol_type = other DNA
agtaattcatgcagagaaac

SEQ ID NO: 70593 - DNA, 20 bp, synthetic construct
  misc_feature 1..20: note = CRISPR gRNA sequence
  source 1..20: mol_type = other DNA
atgcagagaaacagcatttg

SEQ ID NO: 70594 - DNA, 20 bp, synthetic construct
  misc_feature 1..20: note = CRISPR gRNA sequence
  source 1..20: mol_type = other DNA
ggacctcccagtacagttca

SEQ ID NO: 70595 - DNA, 20 bp, synthetic construct
  misc_feature 1..20: note = CRISPR gRNA sequence
  source 1..20: mol_type = other DNA
gacctcccagtacagttcat

SEQ ID NO: 70596 - DNA, 20 bp, synthetic construct
  misc_feature 1..20: note = CRISPR gRNA sequence
  source 1..20: mol_type = other DNA
ccagtacagttcattttgta

SEQ ID NO: 70597 - DNA, 20 bp, synthetic construct
  misc_feature 1..20: note = CRISPR gRNA sequence
  source 1..20: mol_type = other DNA
attttgtagaatttttacac

SEQ ID NO: 70598 - DNA, 20 bp, synthetic construct
  misc_feature 1..20: note = CRISPR gRNA sequence
  source 1..20: mol_type = other DNA
tgtagaatttttacactgtg

SEQ ID NO: 70599 - DNA, 20 bp, synthetic construct
  misc_feature 1..20: note = CRISPR gRNA sequence
  source 1..20: mol_type = other DNA
gtagaatttttacactgtgt

SEQ ID NO: 70600 - DNA, 20 bp, synthetic construct
  misc_feature 1..20: note = CRISPR gRNA sequence
  source 1..20: mol_type = other DNA
tagaatttttacactgtgtg

SEQ ID NO: 70601 - DNA, 20 bp, synthetic construct
  misc_feature 1..20: note = CRISPR gRNA sequence
  source 1..20: mol_type = other DNA
ttacactgtgtggatataag

SEQ ID NO: 70602 - DNA, 20 bp, synthetic construct
  misc_feature 1..20: note = CRISPR gRNA sequence
  source 1..20: mol_type = other DNA
tacactgtgtggatataagt

SEQ ID NO: 70603 - DNA, 20 bp, synthetic construct
  misc_feature 1..20: note = CRISPR gRNA sequence
  source 1..20: mol_type = other DNA
acactgtgtggatataagtg

SEQ ID NO: 70604 - DNA, 20 bp, synthetic construct
  misc_feature 1..20: note = CRISPR gRNA sequence
  source 1..20: mol_type = other DNA
cactgtgtggatataagtgg

SEQ ID NO: 70605 - DNA, 20 bp, synthetic construct
  misc_feature 1..20: note = CRISPR gRNA sequence
  source 1..20: mol_type = other DNA
tgtggatataagtggctgtc

SEQ ID NO: 70606 - DNA, 20 bp, synthetic construct
  misc_feature 1..20: note = CRISPR gRNA sequence
  source 1..20: mol_type = other DNA
tcttggaggtccctaggctt

SEQ ID NO: 70607 - DNA, 20 bp, synthetic construct
  misc_feature 1..20: note = CRISPR gRNA sequence
  source 1..20: mol_type = other DNA
ggaggtccctaggcttgcta

SEQ ID NO: 70608 - DNA, 20 bp, synthetic construct
  misc_feature 1..20: note = CRISPR gRNA sequence
  source 1..20: mol_type = other DNA
gaggtccctaggcttgctaa

SEQ ID NO: 70609 - DNA, 20 bp, synthetic construct
  misc_feature 1..20: note = CRISPR gRNA sequence
  source 1..20: mol_type = other DNA
ggcttgctaagcacagaggc

SEQ ID NO: 70610 - DNA, 20 bp, synthetic construct
  misc_feature 1..20: note = CRISPR gRNA sequence
  source 1..20: mol_type = other DNA
gctaagcacagaggcctcag

SEQ ID NO: 70611 - DNA, 20 bp, synthetic construct
  misc_feature 1..20: note = CRISPR gRNA sequence
  source 1..20: mol_type = other DNA
ctaagcacagaggcctcaga

SEQ ID NO: 70612 - DNA, 20 bp, synthetic construct
  misc_feature 1..20: note = CRISPR gRNA sequence
  source 1..20: mol_type = other DNA
agcacagaggcctcagaccc

SEQ ID NO: 70613 - DNA, 20 bp, synthetic construct
  misc_feature 1..20: note = CRISPR gRNA sequence
  source 1..20: mol_type = other DNA
agacccccagactggacagt

SEQ ID NO: 70614 - DNA, 20 bp, synthetic construct
  misc_feature 1..20: note = CRISPR gRNA sequence
  source 1..20: mol_type = other DNA
gacagtgccccacccccaga

SEQ ID NO: 70615 - DNA, 20 bp, synthetic construct
  misc_feature 1..20: note = CRISPR gRNA sequence
  source 1..20: mol_type = other DNA
acctggcctcctcttctcca

SEQ ID NO: 70616 - DNA, 20 bp, synthetic construct
  misc_feature 1..20: note = CRISPR gRNA sequence
  source 1..20: mol_type = other DNA
gcctcctcttctccagcctc

SEQ ID NO: 70617 - DNA, 20 bp, synthetic construct
  misc_feature 1..20: note = CRISPR gRNA sequence
  source 1..20: mol_type = other DNA
ctcttctccagcctcagtca

SEQ ID NO: 70618 - DNA, 20 bp, synthetic construct
  misc_feature 1..20: note = CRISPR gRNA sequence
  source 1..20: mol_type = other DNA
ttctccagcctcagtcacct

SEQ ID NO: 70619 - DNA, 20 bp, synthetic construct
  misc_feature 1..20: note = CRISPR gRNA sequence
  source 1..20: mol_type = other DNA
ctccagcctcagtcaccttc

SEQ ID NO: 70620 - DNA, 20 bp, synthetic construct
  misc_feature 1..20: note = CRISPR gRNA sequence
  source 1..20: mol_type = other DNA
tccagcctcagtcaccttct

SEQ ID NO: 70621 - DNA, 20 bp, synthetic construct
  misc_feature 1..20: note = CRISPR gRNA sequence
  source 1..20: mol_type = other DNA
cagcctcagtcaccttctgc

SEQ ID NO: 70622 - DNA, 20 bp, synthetic construct
  misc_feature 1..20: note = CRISPR gRNA sequence
  source 1..20: mol_type = other DNA
agtcaccttctgctgaacag

SEQ ID NO: 70623 - DNA, 20 bp, synthetic construct
  misc_feature 1..20: note = CRISPR gRNA sequence
  source 1..20: mol_type = other DNA
ctgctgaacagctccacctt

SEQ ID NO: 70624 - DNA, 20 bp, synthetic construct
  misc_feature 1..20: note = CRISPR gRNA sequence
  source 1..20: mol_type = other DNA
tgctgaacagctccaccttg

SEQ ID NO: 70625 - DNA, 20 bp, synthetic construct
  misc_feature 1..20: note = CRISPR gRNA sequence
  source 1..20: mol_type = other DNA
ctgaacagctccaccttggc

SEQ ID NO: 70626 - DNA, 20 bp, synthetic construct
  misc_feature 1..20: note = CRISPR gRNA sequence
  source 1..20: mol_type = other DNA
aacagctccaccttggcctt

SEQ ID NO: 70627 - DNA, 20 bp, synthetic construct
  misc_feature 1..20: note = CRISPR gRNA sequence
  source 1..20: mol_type = other DNA
caccttggccttgcttactc

SEQ ID NO: 70628 - DNA, 20 bp, synthetic construct
  misc_feature 1..20: note = CRISPR gRNA sequence
  source 1..20: mol_type = other DNA
ggccttgcttactcacagac

SEQ ID NO: 70629 - DNA, 20 bp, synthetic construct
  misc_feature 1..20: note = CRISPR gRNA sequence
  source 1..20: mol_type = other DNA
gccttgcttactcacagact

SEQ ID NO: 70630 - DNA, 20 bp, synthetic construct
  misc_feature 1..20: note = CRISPR gRNA sequence
  source 1..20: mol_type = other DNA
gcttactcacagactaagcc

SEQ ID NO: 70631 - DNA, 20 bp, synthetic construct
  misc_feature 1..20: note = CRISPR gRNA sequence
  source 1..20: mol_type = other DNA
cttactcacagactaagcca

SEQ ID NO: 70632 - DNA, 20 bp, synthetic construct
  misc_feature 1..20: note = CRISPR gRNA sequence
  source 1..20: mol_type = other DNA
actcacagactaagccagat

SEQ ID NO: 70633 - DNA, 20 bp, synthetic construct
  misc_feature 1..20: note = CRISPR gRNA sequence
  source 1..20: mol_type = other DNA
ctcacagactaagccagatg

SEQ ID NO: 70634 - DNA, 20 bp, synthetic construct
  misc_feature 1..20: note = CRISPR gRNA sequence
  source 1..20: mol_type = other DNA
acagactaagccagatgacc

SEQ ID NO: 70635 - DNA, 20 bp, synthetic construct
  misc_feature 1..20: note = CRISPR gRNA sequence
  source 1..20: mol_type = other DNA
agccagatgacctgcctgca

SEQ ID NO: 70636 - DNA, 20 bp, synthetic construct
  misc_feature 1..20: note = CRISPR gRNA sequence
  source 1..20: mol_type = other DNA
cctgcagagcctcaggtgag

SEQ ID NO: 70637 - DNA, 20 bp, synthetic construct
  misc_feature 1..20: note = CRISPR gRNA sequence
  source 1..20: mol_type = other DNA
cagagcctcaggtgagtgac

SEQ ID NO: 70638 - DNA, 20 bp, synthetic construct
  misc_feature 1..20: note = CRISPR gRNA sequence
  source 1..20: mol_type = other DNA
aggtgagtgaccgagcggcc

SEQ ID NO: 70639 - DNA, 20 bp, synthetic construct
  misc_feature 1..20: note = CRISPR gRNA sequence
  source 1..20: mol_type = other DNA
cccactcagttgggaccaca

SEQ ID NO: 70640 - DNA, 20 bp, synthetic construct
  misc_feature 1..20: note = CRISPR gRNA sequence
  source 1..20: mol_type = other DNA
ccactcagttgggaccacat

SEQ ID NO: 70641 - DNA, 20 bp, synthetic construct
  misc_feature 1..20: note = CRISPR gRNA sequence
  source 1..20: mol_type = other DNA
agttgggaccacatccaggg

SEQ ID NO: 70642 - DNA, 20 bp, synthetic construct
  misc_feature 1..20: note = CRISPR gRNA sequence
  source 1..20: mol_type = other DNA
ggaccacatccagggaagca

SEQ ID NO: 70643 - DNA, 20 bp, synthetic construct
  misc_feature 1..20: note = CRISPR gRNA sequence
  source 1..20: mol_type = other DNA
aggccacctcccaggggatc

SEQ ID NO: 70644 - DNA, 20 bp, synthetic construct
  misc_feature 1..20: note = CRISPR gRNA sequence
  source 1..20: mol_type = other DNA
ccaggggatcctttgcggat

SEQ ID NO: 70645 - DNA, 20 bp, synthetic construct
  misc_feature 1..20: note = CRISPR gRNA sequence
  source 1..20: mol_type = other DNA
tgcggatccctcccaggccc

SEQ ID NO: 70646 - DNA, 20 bp, synthetic construct
  misc_feature 1..20: note = CRISPR gRNA sequence
  source 1..20: mol_type = other DNA
gcggatccctcccaggccca

SEQ ID NO: 70647 - DNA, 20 bp, synthetic construct
  misc_feature 1..20: note = CRISPR gRNA sequence
  source 1..20: mol_type = other DNA
cggatccctcccaggcccat

SEQ ID NO: 70648 - DNA, 20 bp, synthetic construct
  misc_feature 1..20: note = CRISPR gRNA sequence
  source 1..20: mol_type = other DNA
ccaggcccatccctgtgccc

SEQ ID NO: 70649 - DNA, 20 bp, synthetic construct
  misc_feature 1..20: note = CRISPR gRNA sequence
  source 1..20: mol_type = other DNA
tgccctcccaggtgggtgcc

SEQ ID NO: 70650 - DNA, 20 bp, synthetic construct
  misc_feature 1..20: note = CRISPR gRNA sequence
  source 1..20: mol_type = other DNA
ccaggtgggtgcccactgct

SEQ ID NO: 70651 - DNA, 20 bp, synthetic construct
  misc_feature 1..20: note = CRISPR gRNA sequence
  source 1..20: mol_type = other DNA
ctcttgccttctaatgccat

SEQ ID NO: 70652 - DNA, 20 bp, synthetic construct
  misc_feature 1..20: note = CRISPR gRNA sequence
  source 1..20: mol_type = other DNA
ttgccttctaatgccatcag

SEQ ID NO: 70653 - DNA, 20 bp, synthetic construct
  misc_feature 1..20: note = CRISPR gRNA sequence
  source 1..20: mol_type = other DNA
gccttctaatgccatcagct

SEQ ID NO: 70654 - DNA, 20 bp, synthetic construct
  misc_feature 1..20: note = CRISPR gRNA sequence
  source 1..20: mol_type = other DNA
ccttctaatgccatcagctt

SEQ ID NO: 70655 - DNA, 20 bp, synthetic construct
  misc_feature 1..20: note = CRISPR gRNA sequence
  source 1..20: mol_type = other DNA
ctaatgccatcagcttcctc

SEQ ID NO: 70656 - DNA, 20 bp, synthetic construct
  misc_feature 1..20: note = CRISPR gRNA sequence
  source 1..20: mol_type = other DNA
taatgccatcagcttcctcc

SEQ ID NO: 70657 - DNA, 20 bp, synthetic construct
  misc_feature 1..20: note = CRISPR gRNA sequence
  source 1..20: mol_type = other DNA
atgccatcagcttcctcctg

SEQ ID NO: 70658 - DNA, 20 bp, synthetic construct
  misc_feature 1..20: note = CRISPR gRNA sequence
  source 1..20: mol_type = other DNA
cctcctggttacaaaagtgg

SEQ ID NO: 70659 - DNA, 20 bp, synthetic construct
  misc_feature 1..20: note = CRISPR gRNA sequence
  source 1..20: mol_type = other DNA
ctcctggttacaaaagtggc

SEQ ID NO: 70660 - DNA, 20 bp, synthetic construct
  misc_feature 1..20: note = CRISPR gRNA sequence
  source 1..20: mol_type = other DNA
ctggttacaaaagtggccta

SEQ ID NO: 70661 - DNA, 20 bp, synthetic construct
  misc_feature 1..20: note = CRISPR gRNA sequence
  source 1..20: mol_type = other DNA
gttacaaaagtggcctaaag

SEQ ID NO: 70662 - DNA, 20 bp, synthetic construct
  misc_feature 1..20: note = CRISPR gRNA sequence
  source 1..20: mol_type = other DNA
caaaagtggcctaaagggct

SEQ ID NO: 70663 - DNA, 20 bp, synthetic construct
  misc_feature 1..20: note = CRISPR gRNA sequence
  source 1..20: mol_type = other DNA
aagggcttaggcccacgtcg

SEQ ID NO: 70664 - DNA, 20 bp, synthetic construct
  misc_feature 1..20: note = CRISPR gRNA sequence
  source 1..20: mol_type = other DNA
aggcccacgtcgtagaacaa

SEQ ID NO: 70665 - DNA, 20 bp, synthetic construct
  misc_feature 1..20: note = CRISPR gRNA sequence
  source 1..20: mol_type = other DNA
ggcccacgtcgtagaacaac

SEQ ID NO: 70666 - DNA, 20 bp, synthetic construct
  misc_feature 1..20: note = CRISPR gRNA sequence
  source 1..20: mol_type = other DNA
gaggcacacacacagttcac

SEQ ID NO: 70667 - DNA, 20 bp, synthetic construct
  misc_feature 1..20: note = CRISPR gRNA sequence
  source 1..20: mol_type = other DNA
aggcacacacacagttcacc

SEQ ID NO: 70668 - DNA, 20 bp, synthetic construct
  misc_feature 1..20: note = CRISPR gRNA sequence
  source 1..20: mol_type = other DNA
accctgggctcttgttaaaa

SEQ ID NO: 70669 - DNA, 20 bp, synthetic construct
  misc_feature 1..20: note = CRISPR gRNA sequence
  source 1..20: mol_type = other DNA
ggctcttgttaaaatgctca

SEQ ID NO: 70670 - DNA, 20 bp, synthetic construct
  misc_feature 1..20: note = CRISPR gRNA sequence
  source 1..20: mol_type = other DNA
ttgttaaaatgctcattctg

SEQ ID NO: 70671 - DNA, 20 bp, synthetic construct
  misc_feature 1..20: note = CRISPR gRNA sequence
  source 1..20: mol_type = other DNA
gttaaaatgctcattctgat

SEQ ID NO: 70672 - DNA, 20 bp, synthetic construct
  misc_feature 1..20: note = CRISPR gRNA sequence
  source 1..20: mol_type = other DNA
ttaaaatgctcattctgatt

SEQ ID NO: 70673 - DNA, 20 bp, synthetic construct
  misc_feature 1..20: note = CRISPR gRNA sequence
  source 1..20: mol_type = other DNA
aaatgctcattctgattccc

SEQ ID NO: 70674 - DNA, 20 bp, synthetic construct
  misc_feature 1..20: note = CRISPR gRNA sequence
  source 1..20: mol_type = other DNA
attctgattccccaggtctg

SEQ ID NO: 70675 - DNA, 20 bp, synthetic construct
  misc_feature 1..20: note = CRISPR gRNA sequence
  source 1..20: mol_type = other DNA
tgattccccaggtctggaat

SEQ ID NO: 70676 - DNA, 20 bp, synthetic construct
  misc_feature 1..20: note = CRISPR gRNA sequence
  source 1..20: mol_type = other DNA
attccccaggtctggaattc

SEQ ID NO: 70677 - DNA, 20 bp, synthetic construct
  misc_feature 1..20: note = CRISPR gRNA sequence
  source 1..20: mol_type = other DNA
cccaggtctggaattctgcc

SEQ ID NO: 70678 - DNA, 20 bp, synthetic construct
  misc_feature 1..20: note = CRISPR gRNA sequence
  source 1..20: mol_type = other DNA
gaattctgcctagactgtgc

SEQ ID NO: 70679 - DNA, 20 bp, synthetic construct
  misc_feature 1..20: note = CRISPR gRNA sequence
  source 1..20: mol_type = other DNA
tgcctagactgtgctttttt

SEQ ID NO: 70680 - DNA, 20 bp, synthetic construct
  misc_feature 1..20: note = CRISPR gRNA sequence
  source 1..20: mol_type = other DNA
cctagactgtgctttttttt

SEQ ID NO: 70681 - DNA, 20 bp, synthetic construct
  misc_feature 1..20: note = CRISPR gRNA sequence
  source 1..20: mol_type = other DNA
gactgtgctttttttttttt

SEQ ID NO: 70682 - DNA, 20 bp, synthetic construct
  misc_feature 1..20: note = CRISPR gRNA sequence
  source 1..20: mol_type = other DNA
tgcttttttttttttttttt

SEQ ID NO: 70683 - DNA, 20 bp, synthetic construct
  misc_feature 1..20: note = CRISPR gRNA sequence
  source 1..20: mol_type = other DNA
tttttttttttttttttttt

SEQ ID NO: 70684 - DNA, 20 bp, synthetic construct
  misc_feature 1..20: note = CRISPR gRNA sequence
  source 1..20: mol_type = other DNA
tttttttttttttttttttt

SEQ ID NO: 70685 - DNA, 20 bp, synthetic construct
  misc_feature 1..20: note = CRISPR gRNA sequence
  source 1..20: mol_type = other DNA
tttttttttttttttttttt

SEQ ID NO: 70686 - DNA, 20 bp, synthetic construct
  misc_feature 1..20: note = CRISPR gRNA sequence
  source 1..20: mol_type = other DNA
tttttttttttttttttttt

SEQ ID NO: 70687 - DNA, 20 bp, synthetic construct
  misc_feature 1..20: note = CRISPR gRNA sequence
  source 1..20: mol_type = other DNA
tttttttttttttttttttt

SEQ ID NO: 70688 - DNA, 20 bp, synthetic construct
  misc_feature 1..20: note = CRISPR gRNA sequence
  source 1..20: mol_type = other DNA
tttttttttttttttttttt

SEQ ID NO: 70689 - DNA, 20 bp, synthetic construct
  misc_feature 1..20: note = CRISPR gRNA sequence
  source 1..20: mol_type = other DNA
tttttttttttttttttttt

SEQ ID NO: 70690 - DNA, 20 bp, synthetic construct
  misc_feature 1..20: note = CRISPR gRNA sequence
  source 1..20: mol_type = other DNA
tttttttttttttttttttt

SEQ ID NO: 70691 - DNA, 20 bp, synthetic construct
  misc_feature 1..20: note = CRISPR gRNA sequence
  source 1..20: mol_type = other DNA
tttttttttttttttttttt

SEQ ID NO: 70692 - DNA, 20 bp, synthetic construct
  misc_feature 1..20: note = CRISPR gRNA sequence
  source 1..20: mol_type = other DNA
tttttttttttttttttttt

SEQ ID NO: 70693 - DNA, 20 bp, synthetic construct
  misc_feature 1..20: note = CRISPR gRNA sequence
  source 1..20: mol_type = other DNA
tttttttttttttttttttt

SEQ ID NO: 70694 - DNA, 20 bp, synthetic construct
  misc_feature 1..20: note = CRISPR gRNA sequence
  source 1..20: mol_type = other DNA
tttttttttttttttttttt

SEQ ID NO: 70695 - DNA, 20 bp, synthetic construct
  misc_feature 1..20: note = CRISPR gRNA sequence
  source 1..20: mol_type = other DNA
tttttttttttttttttttt

SEQ ID NO: 70696 - DNA, 20 bp, synthetic construct
  misc_feature 1..20: note = CRISPR gRNA sequence
  source 1..20: mol_type = other DNA
tttttttttttttttttttt

SEQ ID NO: 70697 - DNA, 20 bp, synthetic construct
  misc_feature 1..20: note = CRISPR gRNA sequence
  source 1..20: mol_type = other DNA
tttttttttttttttttttt

SEQ ID NO: 70698 - DNA, 20 bp, synthetic construct
  misc_feature 1..20: note = CRISPR gRNA sequence
  source 1..20: mol_type = other DNA
tttttttttttttttttttt

SEQ ID NO: 70699 - DNA, 20 bp, synthetic construct
  misc_feature 1..20: note = CRISPR gRNA sequence
  source 1..20: mol_type = other DNA
tttttttttttttttttttt

SEQ ID NO: 70700 - DNA, 20 bp, synthetic construct
  misc_feature 1..20: note = CRISPR gRNA sequence
  source 1..20: mol_type = other DNA
tttttttttttttttttttt

SEQ ID NO: 70701 - DNA, 20 bp, synthetic construct
  misc_feature 1..20: note = CRISPR gRNA sequence
  source 1..20: mol_type = other DNA
tttttttttttttttttttt

SEQ ID NO: 70702 - DNA, 20 bp, synthetic construct
  misc_feature 1..20: note = CRISPR gRNA sequence
  source 1..20: mol_type = other DNA
tttttttttttttttttttt

SEQ ID NO: 70703 - DNA, 20 bp, synthetic construct
  misc_feature 1..20: note = CRISPR gRNA sequence
  source 1..20: mol_type = other DNA
tttttttttttttttttttt

SEQ ID NO: 70704 - DNA, 20 bp, synthetic construct
  misc_feature 1..20: note = CRISPR gRNA sequence
  source 1..20: mol_type = other DNA
tttttttttttttttttttg

SEQ ID NO: 70705 - DNA, 20 bp, synthetic construct
  misc_feature 1..20: note = CRISPR gRNA sequence
  source 1..20: mol_type = other DNA
ttttttttttttttttttga

SEQ ID NO: 70706 - DNA, 20 bp, synthetic construct
  misc_feature 1..20: note = CRISPR gRNA sequence
  source 1..20: mol_type = other DNA
tttttttttttttttttgag

SEQ ID NO: 70707 - DNA, 20 bp, synthetic construct
  misc_feature 1..20: note = CRISPR gRNA sequence
  source 1..20: mol_type = other DNA
ttttttttttttttttgagt

SEQ ID NO: 70708 - DNA, 20 bp, synthetic construct
  misc_feature 1..20: note = CRISPR gRNA sequence
  source 1..20: mol_type = other DNA
tttttttttttttttgagtt

SEQ ID NO: 70709 - DNA, 20 bp, synthetic construct
  misc_feature 1..20: note = CRISPR gRNA sequence
  source 1..20: mol_type = other DNA
ttttttttttttttgagttg

SEQ ID NO: 70710 - DNA, 20 bp, synthetic construct
  misc_feature 1..20: note = CRISPR gRNA sequence
  source 1..20: mol_type = other DNA
tttttttttttttgagttgg

SEQ ID NO: 70711 - DNA, 20 bp, synthetic construct
  misc_feature 1..20: note = CRISPR gRNA sequence
  source 1..20: mol_type = other DNA
ttttttttttttgagttggg

SEQ ID NO: 70712 - DNA, 20 bp, synthetic construct
  misc_feature 1..20: note = CRISPR gRNA sequence
  source 1..20: mol_type = other DNA
tttttttttttgagttgggg

SEQ ID NO: 70713 - DNA, 20 bp, synthetic construct
  misc_feature 1..20: note = CRISPR gRNA sequence
  source 1..20: mol_type = other DNA
ttttttttttgagttggggc

SEQ ID NO: 70714 - DNA, 20 bp, synthetic construct
  misc_feature 1..20: note = CRISPR gRNA sequence
  source 1..20: mol_type = other DNA
tttttttttgagttggggcc

SEQ ID NO: 70715 - DNA, 20 bp, synthetic construct
  misc_feature 1..20: note = CRISPR gRNA sequence
  source 1..20: mol_type = other DNA
ttttttttgagttggggcct

SEQ ID NO: 70716 - DNA, 20 bp, synthetic construct
  misc_feature 1..20: note = CRISPR gRNA sequence
  source 1..20: mol_type = other DNA
tttttttgagttggggcctc

SEQ ID NO: 70717 - DNA, 20 bp, synthetic construct
  misc_feature 1..20: note = CRISPR gRNA sequence
  source 1..20: mol_type = other DNA
ttttttgagttggggcctca

SEQ ID NO: 70718 - DNA, 20 bp, synthetic construct
  misc_feature 1..20: note = CRISPR gRNA sequence
  source 1..20: mol_type = other DNA
tttttgagttggggcctcac

SEQ ID NO: 70719 - DNA, 20 bp, synthetic construct
  misc_feature 1..20: note = CRISPR gRNA sequence
  source 1..20: mol_type = other DNA
ttttgagttggggcctcact

SEQ ID NO: 70720 - DNA, 20 bp, synthetic construct
  misc_feature 1..20: note = CRISPR gRNA sequence
  source 1..20: mol_type = other DNA
tttgagttggggcctcactg

SEQ ID NO: 70721 - DNA, 20 bp, synthetic construct
  misc_feature 1..20: note = CRISPR gRNA sequence
  source 1..20: mol_type = other DNA
ttgagttggggcctcactgt

SEQ ID NO: 70722 - DNA, 20 bp, synthetic construct
  misc_feature 1..20: note = CRISPR gRNA sequence
  source 1..20: mol_type = other DNA
tgagttggggcctcactgtg

SEQ ID NO: 70723 - DNA, 20 bp, synthetic construct
  misc_feature 1..20: note = CRISPR gRNA sequence
  source 1..20: mol_type = other DNA
gagttggggcctcactgtgt

SEQ ID NO: 70724 - DNA, 20 bp, synthetic construct
  misc_feature 1..20: note = CRISPR gRNA sequence
  source 1..20: mol_type = other DNA
agttggggcctcactgtgtg

SEQ ID NO: 70725 - DNA, 20 bp, synthetic construct
  misc_feature 1..20: note = CRISPR gRNA sequence
  source 1..20: mol_type = other DNA
gggcctcactgtgtggccca

SEQ ID NO: 70726 - DNA, 20 bp, synthetic construct
  misc_feature 1..20: note = CRISPR gRNA sequence
  source 1..20: mol_type = other DNA
actgtgtggcccaggctgga

SEQ ID NO: 70727 - DNA, 20 bp, synthetic construct
  misc_feature 1..20: note = CRISPR gRNA sequence
  source 1..20: mol_type = other DNA
tgtggcccaggctggagtgc

SEQ ID NO: 70728 - DNA, 20 bp, synthetic construct
  misc_feature 1..20: note = CRISPR gRNA sequence
  source 1..20: mol_type = other DNA
gagtgcagtggcaatgcaca

SEQ ID NO: 70729 - DNA, 20 bp, synthetic construct
  misc_feature 1..20: note = CRISPR gRNA sequence
  source 1..20: mol_type = other DNA
cactgcagcctcaaactcct

SEQ ID NO: 70730 - DNA, 20 bp, synthetic construct
  misc_feature 1..20: note = CRISPR gRNA sequence
  source 1..20: mol_type = other DNA
cagcctcaaactcctgggcg

SEQ ID NO: 70731 - DNA, 20 bp, synthetic construct
  misc_feature 1..20: note = CRISPR gRNA sequence
  source 1..20: mol_type = other DNA
aaactcctgggcgaacgtga

SEQ ID NO: 70732 - DNA, 20 bp, synthetic construct
  misc_feature 1..20: note = CRISPR gRNA sequence
  source 1..20: mol_type = other DNA
ctgggcgaacgtgatcctcc

SEQ ID NO: 70733 - DNA, 20 bp, synthetic construct
  misc_feature 1..20: note = CRISPR gRNA sequence
  source 1..20: mol_type = other DNA
ggcgaacgtgatcctcctgc

SEQ ID NO: 70734 - DNA, 20 bp, synthetic construct
  misc_feature 1..20: note = CRISPR gRNA sequence
  source 1..20: mol_type = other DNA
ctgcctcaccctcctaagca

SEQ ID NO: 70735 - DNA, 20 bp, synthetic construct
  misc_feature 1..20: note = CRISPR gRNA sequence
  source 1..20: mol_type = other DNA
cctcaccctcctaagcagct

SEQ ID NO: 70736 - DNA, 20 bp, synthetic construct
  misc_feature 1..20: note = CRISPR gRNA sequence
  source 1..20: mol_type = other DNA
accctcctaagcagctggga

SEQ ID NO: 70737 - DNA, 20 bp, synthetic construct
  misc_feature 1..20: note = CRISPR gRNA sequence
  source 1..20: mol_type = other DNA
ctaagcagctgggactacag

SEQ ID NO: 70738 - DNA, 20 bp, synthetic construct
  misc_feature 1..20: note = CRISPR gRNA sequence
  source 1..20: mol_type = other DNA
agcagctgggactacaggcc

SEQ ID NO: 70739 - DNA, 20 bp, synthetic construct
  misc_feature 1..20: note = CRISPR gRNA sequence
  source 1..20: mol_type = other DNA
ggactacaggcctaaggcgt

SEQ ID NO: 70740 - DNA, 20 bp, synthetic construct
  misc_feature 1..20: note = CRISPR gRNA sequence
  source 1..20: mol_type = other DNA
caggcctaaggcgttgcacc

SEQ ID NO: 70741 - DNA, 20 bp, synthetic construct
  misc_feature 1..20: note = CRISPR gRNA sequence
  source 1..20: mol_type = other DNA
aggcgttgcacccaaactta

SEQ ID NO: 70742 - DNA, 20 bp, synthetic construct
  misc_feature 1..20: note = CRISPR gRNA sequence
  source 1..20: mol_type = other DNA
cacccaaacttagcatttct

SEQ ID NO: 70743 - DNA, 20 bp, synthetic construct
  misc_feature 1..20: note = CRISPR gRNA sequence
  source 1..20: mol_type = other DNA
agcatttctttttttgtttg

SEQ ID NO: 70744 - DNA, 20 bp, synthetic construct
  misc_feature 1..20: note = CRISPR gRNA sequence
  source 1..20: mol_type = other DNA
gcatttctttttttgtttgt

SEQ ID NO: 70745 - DNA, 20 bp, synthetic construct
  misc_feature 1..20: note = CRISPR gRNA sequence
  source 1..20: mol_type = other DNA
ctttttttgtttgtttgttt

SEQ ID NO: 70746 - DNA, 20 bp, synthetic construct
  misc_feature 1..20: note = CRISPR gRNA sequence
  source 1..20: mol_type = other DNA
tttttttgtttgtttgtttt

SEQ ID NO: 70747 - DNA, 20 bp, synthetic construct
  misc_feature 1..20: note = CRISPR gRNA sequence
  source 1..20: mol_type = other DNA
tttttgtttgtttgtttttg

SEQ ID NO: 70748 - DNA, 20 bp, synthetic construct
  misc_feature 1..20: note = CRISPR gRNA sequence
  source 1..20: mol_type = other DNA
ttttgtttgtttgtttttga

SEQ ID NO: 70749 - DNA, 20 bp, synthetic construct
  misc_feature 1..20: note = CRISPR gRNA sequence
  source 1..20: mol_type = other DNA
tttgtttgtttgtttttgag

SEQ ID NO: 70750 - DNA, 20 bp, synthetic construct
  misc_feature 1..20: note = CRISPR gRNA sequence
  source 1..20: mol_type = other DNA
ttgtttgtttgtttttgaga

SEQ ID NO: 70751 - DNA, 20 bp, synthetic construct
  misc_feature 1..20: note = CRISPR gRNA sequence
  source 1..20: mol_type = other DNA
tgtttgtttgtttttgagac

SEQ ID NO: 70752 - DNA, 20 bp, synthetic construct
  misc_feature 1..20: note = CRISPR gRNA sequence
  source 1..20: mol_type = other DNA
gtttgtttgtttttgagaca

SEQ ID NO: 70753 - DNA, 20 bp, synthetic construct
  misc_feature 1..20: note = CRISPR gRNA sequence
  source 1..20: mol_type = other DNA
tttgtttgtttttgagacag

SEQ ID NO: 70754 - DNA, 20 bp, synthetic construct
  misc_feature 1..20: note = CRISPR gRNA sequence
  source 1..20: mol_type = other DNA
gtttgtttttgagacagagt

SEQ ID NO: 70755 - DNA, 20 bp, synthetic construct
  misc_feature 1..20: note = CRISPR gRNA sequence
  source 1..20: mol_type = other DNA
tttgtttttgagacagagtt

SEQ ID NO: 70756 - DNA, 20 bp, synthetic construct
  misc_feature 1..20: note = CRISPR gRNA sequence
  source 1..20: mol_type = other DNA
gtttttgagacagagtttcg

SEQ ID NO: 70757 - DNA, 20 bp, synthetic construct
  misc_feature 1..20: note = CRISPR gRNA sequence
  source 1..20: mol_type = other DNA
tttttgagacagagtttcgc

SEQ ID NO: 70758 - DNA, 20 bp, synthetic construct
  misc_feature 1..20: note = CRISPR gRNA sequence
  source 1..20: mol_type = other DNA
ttgagacagagtttcgctct

SEQ ID NO: 70759 - DNA, 20 bp, synthetic construct
  misc_feature 1..20: note = CRISPR gRNA sequence
  source 1..20: mol_type = other DNA
tgagacagagtttcgctctt

SEQ ID NO: 70760 - DNA, 20 bp, synthetic construct
  misc_feature 1..20: note = CRISPR gRNA sequence
  source 1..20: mol_type = other DNA
gagacagagtttcgctcttg

SEQ ID NO: 70761 - DNA, 20 bp, synthetic construct
  misc_feature 1..20: note = CRISPR gRNA sequence
  source 1..20: mol_type = other DNA
agacagagtttcgctcttgt

SEQ ID NO: 70762 - DNA, 20 bp, synthetic construct
  misc_feature 1..20: note = CRISPR gRNA sequence
  source 1..20: mol_type = other DNA
cgctcttgttgcccaggctg

SEQ ID NO: 70763 - DNA, 20 bp, synthetic construct
  misc_feature 1..20: note = CRISPR gRNA sequence
  source 1..20: mol_type = other DNA
gctcttgttgcccaggctgg

SEQ ID NO: 70764 - DNA, 20 bp, synthetic construct
  misc_feature 1..20: note = CRISPR gRNA sequence
  source 1..20: mol_type = other DNA
ttgttgcccaggctggagtg

SEQ ID NO: 70765 - DNA, 20 bp, synthetic construct
  misc_feature 1..20: note = CRISPR gRNA sequence
  source 1..20: mol_type = other DNA
gttgcccaggctggagtgca

SEQ ID NO: 70766 - DNA, 20 bp, synthetic construct
  misc_feature 1..20: note = CRISPR gRNA sequence
  source 1..20: mol_type = other DNA
ttgcccaggctggagtgcaa

SEQ ID NO: 70767 - DNA, 20 bp, synthetic construct
  misc_feature 1..20: note = CRISPR gRNA sequence
  source 1..20: mol_type = other DNA
cccaggctggagtgcaatgg

SEQ ID NO: 70768 - DNA, 20 bp, synthetic construct
  misc_feature 1..20: note = CRISPR gRNA sequence
  source 1..20: mol_type = other DNA
gagtgcaatggcacaatctc

SEQ ID NO: 70769 - DNA, 20 bp, synthetic construct
  misc_feature 1..20: note = CRISPR gRNA sequence
  source 1..20: mol_type = other DNA
agctcactgcaacctccgcc

SEQ ID NO: 70770 - DNA, 20 bp, synthetic construct
  misc_feature 1..20: note = CRISPR gRNA sequence
  source 1..20: mol_type = other DNA
actgcaacctccgcctcccg

SEQ ID NO: 70771 - DNA, 20 bp, synthetic construct
  misc_feature 1..20: note = CRISPR gRNA sequence
  source 1..20: mol_type = other DNA
caacctccgcctcccgggtt

SEQ ID NO: 70772 - DNA, 20 bp, synthetic construct
  misc_feature 1..20: note = CRISPR gRNA sequence
  source 1..20: mol_type = other DNA
cgcctcccgggttcaagcga

SEQ ID NO: 70773 - DNA, 20 bp, synthetic construct
  misc_feature 1..20: note = CRISPR gRNA sequence
  source 1..20: mol_type = other DNA
ccgggttcaagcgattctcc

SEQ ID NO: 70774 - DNA, 20 bp, synthetic construct
  misc_feature 1..20: note = CRISPR gRNA sequence
  source 1..20: mol_type = other DNA
aagcgattctcctgcctcag

SEQ ID NO: 70775 - DNA, 20 bp, synthetic construct
  misc_feature 1..20: note = CRISPR gRNA sequence
  source 1..20: mol_type = other DNA
tcctgcctcagcctcccgag

SEQ ID NO: 70776 - DNA, 20 bp, synthetic construct
  misc_feature 1..20: note = CRISPR gRNA sequence
  source 1..20: mol_type = other DNA
ctgcctcagcctcccgagta

SEQ ID NO: 70777 - DNA, 20 bp, synthetic construct
  misc_feature 1..20: note = CRISPR gRNA sequence
  source 1..20: mol_type = other DNA
cctcagcctcccgagtagcc

SEQ ID NO: 70778 - DNA, 20 bp, synthetic construct
  misc_feature 1..20: note = CRISPR gRNA sequence
  source 1..20: mol_type = other DNA
agcctcccgagtagccggga

SEQ ID NO: 70779 - DNA, 20 bp, synthetic construct
  misc_feature 1..20: note = CRISPR gRNA sequence
  source 1..20: mol_type = other DNA
ccgagtagccgggattatag

SEQ ID NO: 70780 - DNA, 20 bp, synthetic construct
  misc_feature 1..20: note = CRISPR gRNA sequence
  source 1..20: mol_type = other DNA
taggcatgtgccaccacgcc

SEQ ID NO: 70781 - DNA, 20 bp, synthetic construct
  misc_feature 1..20: note = CRISPR gRNA sequence
  source 1..20: mol_type = other DNA
atttttgtatttttggtaga

SEQ ID NO: 70782 - DNA, 20 bp, synthetic construct
  misc_feature 1..20: note = CRISPR gRNA sequence
  source 1..20: mol_type = other DNA
ttgtatttttggtagagaca

SEQ ID NO: 70783 - DNA, 20 bp, synthetic construct
  misc_feature 1..20: note = CRISPR gRNA sequence
  source 1..20: mol_type = other DNA
tgtatttttggtagagacag

SEQ ID NO: 70784 - DNA, 20 bp, synthetic construct
  misc_feature 1..20: note = CRISPR gRNA sequence
  source 1..20: mol_type = other DNA
gtatttttggtagagacagt

SEQ ID NO: 70785 - DNA, 20 bp, synthetic construct
  misc_feature 1..20: note = CRISPR gRNA sequence
  source 1..20: mol_type = other DNA
tatttttggtagagacagtg

SEQ ID NO: 70786 - DNA, 20 bp, synthetic construct
  misc_feature 1..20: note = CRISPR gRNA sequence
  source 1..20: mol_type = other DNA
ttggtagagacagtgtttct

SEQ ID NO: 70787 - DNA, 20 bp, synthetic construct
  misc_feature 1..20: note = CRISPR gRNA sequence
  source 1..20: mol_type = other DNA
tggtagagacagtgtttctc

SEQ ID NO: 70788 - DNA, 20 bp, synthetic construct
  misc_feature 1..20: note = CRISPR gRNA sequence
  source 1..20: mol_type = other DNA
ggtagagacagtgtttctcc

SEQ ID NO: 70789 - DNA, 20 bp, synthetic construct
  misc_feature 1..20: note = CRISPR gRNA sequence
  source 1..20: mol_type = other DNA
gtagagacagtgtttctcca

SEQ ID NO: 70790 - DNA, 20 bp, synthetic construct
  misc_feature 1..20: note = CRISPR gRNA sequence
  source 1..20: mol_type = other DNA
ctccatgttggtcaggctgg

SEQ ID NO: 70791 - DNA, 20 bp, synthetic construct
  misc_feature 1..20: note = CRISPR gRNA sequence
  source 1..20: mol_type = other DNA
tccatgttggtcaggctggt

SEQ ID NO: 70792 - DNA, 20 bp, synthetic construct
  misc_feature 1..20: note = CRISPR gRNA sequence
  source 1..20: mol_type = other DNA
catgttggtcaggctggtct

SEQ ID NO: 70793 - DNA, 20 bp, synthetic construct
  misc_feature 1..20: note = CRISPR gRNA sequence
  source 1..20: mol_type = other DNA
gtcaggctggtcttgaacgt

SEQ ID NO: 70794 - DNA, 20 bp, synthetic construct
  misc_feature 1..20: note = CRISPR gRNA sequence
  source 1..20: mol_type = other DNA
gtcttgaacgtccaacctca

SEQ ID NO: 70795 - DNA, 20 bp, synthetic construct
  misc_feature 1..20: note = CRISPR gRNA sequence
  source 1..20: mol_type = other DNA
gaacgtccaacctcaggtga

SEQ ID NO: 70796 - DNA, 20 bp, synthetic construct
  misc_feature 1..20: note = CRISPR gRNA sequence
  source 1..20: mol_type = other DNA
aacgtccaacctcaggtgat

SEQ ID NO: 70797 - DNA, 20 bp, synthetic construct
  misc_feature 1..20: note = CRISPR gRNA sequence
  source 1..20: mol_type = other DNA
aggtgatctgcccacctcgg

SEQ ID NO: 70798 - DNA, 20 bp, synthetic construct
  misc_feature 1..20: note = CRISPR gRNA sequence
  source 1..20: mol_type = other DNA
cccacctcggcctcccaaag

SEQ ID NO: 70799 - DNA, 20 bp, synthetic construct
  misc_feature 1..20: note = CRISPR gRNA sequence
  source 1..20: mol_type = other DNA
ggcctcccaaagtgctggga

SEQ ID NO: 70800 - DNA, 20 bp, synthetic construct
  misc_feature 1..20: note = CRISPR gRNA sequence
  source 1..20: mol_type = other DNA
ccaaagtgctgggattacag

SEQ ID NO: 70801 - DNA, 20 bp, synthetic construct
  misc_feature 1..20: note = CRISPR gRNA sequence
  source 1..20: mol_type = other DNA
ggattacaggcgtgagccac

SEQ ID NO: 70802 - DNA, 20 bp, synthetic construct
  misc_feature 1..20: note = CRISPR gRNA sequence
  source 1..20: mol_type = other DNA
caggcgtgagccaccacgcc

SEQ ID NO: 70803 - DNA, 20 bp, synthetic construct
  misc_feature 1..20: note = CRISPR gRNA sequence
  source 1..20: mol_type = other DNA
gcttcagactctgcattttc

SEQ ID NO: 70804 - DNA, 20 bp, synthetic construct
  misc_feature 1..20: note = CRISPR gRNA sequence
  source 1..20: mol_type = other DNA
cagactctgcattttctaac

SEQ ID NO: 70805 - DNA, 20 bp, synthetic construct
  misc_feature 1..20: note = CRISPR gRNA sequence
  source 1..20: mol_type = other DNA
agactctgcattttctaaca

SEQ ID NO: 70806 - DNA, 20 bp, synthetic construct
  misc_feature 1..20: note = CRISPR gRNA sequence
  source 1..20: mol_type = other DNA
tgcattttctaacaagcttc

SEQ ID NO: 70807 - DNA, 20 bp, synthetic construct
  misc_feature 1..20: note = CRISPR gRNA sequence
  source 1..20: mol_type = other DNA
cattttctaacaagcttccg

SEQ ID NO: 70808 - DNA, 20 bp, synthetic construct
  misc_feature 1..20: note = CRISPR gRNA sequence
  source 1..20: mol_type = other DNA
tctaacaagcttccgggtgg

SEQ ID NO: 70809 - DNA, 20 bp, synthetic construct
  misc_feature 1..20: note = CRISPR gRNA sequence
  source 1..20: mol_type = other DNA
ctaacaagcttccgggtggt

SEQ ID NO: 70810 - DNA, 20 bp, synthetic construct
  misc_feature 1..20: note = CRISPR gRNA sequence
  source 1..20: mol_type = other DNA
taacaagcttccgggtggta

SEQ ID NO: 70811 - DNA, 20 bp, synthetic construct
  misc_feature 1..20: note = CRISPR gRNA sequence
  source 1..20: mol_type = other DNA
acaagcttccgggtggtatc

SEQ ID NO: 70812 - DNA, 20 bp, synthetic construct
  misc_feature 1..20: note = CRISPR gRNA sequence
  source 1..20: mol_type = other DNA
ccgggtggtatcaattctgg

SEQ ID NO: 70813 - DNA, 20 bp, synthetic construct
  misc_feature 1..20: note = CRISPR gRNA sequence
  source 1..20: mol_type = other DNA
cgggtggtatcaattctggg

SEQ ID NO: 70814 - DNA, 20 bp, synthetic construct
  misc_feature 1..20: note = CRISPR gRNA sequence
  source 1..20: mol_type = other DNA
tgggggccacggtcagcact

SEQ ID NO: 70815 - DNA, 20 bp, synthetic construct
  misc_feature 1..20: note = CRISPR gRNA sequence
  source 1..20: mol_type = other DNA
ggggccacggtcagcacttt

SEQ ID NO: 70816 - DNA, 20 bp, synthetic construct
  misc_feature 1..20: note = CRISPR gRNA sequence
  source 1..20: mol_type = other DNA
tgagtagtgtgggtctagac

SEQ ID NO: 70817 - DNA, 20 bp, synthetic construct
  misc_feature 1..20: note = CRISPR gRNA sequence
  source 1..20: mol_type = other DNA
gagtagtgtgggtctagact

SEQ ID NO: 70818 - DNA, 20 bp, synthetic construct
  misc_feature 1..20: note = CRISPR gRNA sequence
  source 1..20: mol_type = other DNA
agtagtgtgggtctagactc

SEQ ID NO: 70819 - DNA, 20 bp, synthetic construct
  misc_feature 1..20: note = CRISPR gRNA sequence
  source 1..20: mol_type = other DNA
gactcagatggggtggcctt

SEQ ID NO: 70820 - DNA, 20 bp, synthetic construct
  misc_feature 1..20: note = CRISPR gRNA sequence
  source 1..20: mol_type = other DNA
agatggggtggccttcctac

SEQ ID NO: 70821 - DNA, 20 bp, synthetic construct
  misc_feature 1..20: note = CRISPR gRNA sequence
  source 1..20: mol_type = other DNA
cctacactccctttgtgatt

SEQ ID NO: 70822 - DNA, 20 bp, synthetic construct
  misc_feature 1..20: note = CRISPR gRNA sequence
  source 1..20: mol_type = other DNA
ctacactccctttgtgattt

SEQ ID NO: 70823 - DNA, 20 bp, synthetic construct
  misc_feature 1..20: note = CRISPR gRNA sequence
  source 1..20: mol_type = other DNA
cactccctttgtgatttcac

SEQ ID NO: 70824 - DNA, 20 bp, synthetic construct
  misc_feature 1..20: note = CRISPR gRNA sequence
  source 1..20: mol_type = other DNA
cctttgtgatttcactccct

SEQ ID NO: 70825 - DNA, 20 bp, synthetic construct
  misc_feature 1..20: note = CRISPR gRNA sequence
  source 1..20: mol_type = other DNA
tgtgatttcactccctgctg

SEQ ID NO: 70826 - DNA, 20 bp, synthetic construct
  misc_feature 1..20: note = CRISPR gRNA sequence
  source 1..20: mol_type = other DNA
gtgatttcactccctgctgc

SEQ ID NO: 70827 - DNA, 20 bp, synthetic construct
  misc_feature 1..20: note = CRISPR gRNA sequence
  source 1..20: mol_type = other DNA
tgatttcactccctgctgct

SEQ ID NO: 70828 - DNA, 20 bp, synthetic construct
  misc_feature 1..20: note = CRISPR gRNA sequence
  source 1..20: mol_type = other DNA
cactccctgctgctaggata

SEQ ID NO: 70829 - DNA, 20 bp, synthetic construct
  misc_feature 1..20: note = CRISPR gRNA sequence
  source 1..20: mol_type = other DNA
actccctgctgctaggataa

SEQ ID NO: 70830 - DNA, 20 bp, synthetic construct
  misc_feature 1..20: note = CRISPR gRNA sequence
  source 1..20: mol_type = other DNA
cctgctgctaggataaataa

SEQ ID NO: 70831 - DNA, 20 bp, synthetic construct
  misc_feature 1..20: note = CRISPR gRNA sequence
  source 1..20: mol_type = other DNA
ctgctaggataaataaacat

SEQ ID NO: 70832 - DNA, 20 bp, synthetic construct
  misc_feature 1..20: note = CRISPR gRNA sequence
  source 1..20: mol_type = other DNA
ctaggataaataaacatgac

SEQ ID NO: 70833 - DNA, 20 bp, synthetic construct
  misc_feature 1..20: note = CRISPR gRNA sequence
  source 1..20: mol_type = other DNA
ggataaataaacatgacact

SEQ ID NO: 70834 - DNA, 20 bp, synthetic construct
  misc_feature 1..20: note = CRISPR gRNA sequence
  source 1..20: mol_type = other DNA
actttcaatgtgatttttca

SEQ ID NO: 70835 - DNA, 20 bp, synthetic construct
  misc_feature 1..20: note = CRISPR gRNA sequence
  source 1..20: mol_type = other DNA
ctttcaatgtgatttttcaa

SEQ ID NO: 70836 - DNA, 20 bp, synthetic construct
  misc_feature 1..20: note = CRISPR gRNA sequence
  source 1..20: mol_type = other DNA
tcaatgtgatttttcaaaac

SEQ ID NO: 70837 - DNA, 20 bp, synthetic construct
  misc_feature 1..20: note = CRISPR gRNA sequence
  source 1..20: mol_type = other DNA
caatgtgatttttcaaaaca

SEQ ID NO: 70838 - DNA, 20 bp, synthetic construct
  misc_feature 1..20: note = CRISPR gRNA sequence
  source 1..20: mol_type = other DNA
aatgtgatttttcaaaacat

SEQ ID NO: 70839 - DNA, 20 bp, synthetic construct
  misc_feature 1..20: note = CRISPR gRNA sequence
  source 1..20: mol_type = other DNA
ttcaaaacatgaaatcttgt

SEQ ID NO: 70840 - DNA, 20 bp, synthetic construct
  misc_feature 1..20: note = CRISPR gRNA sequence
  source 1..20: mol_type = other DNA
tcaaaacatgaaatcttgtg

SEQ ID NO: 70841 - DNA, 20 bp, synthetic construct
  misc_feature 1..20: note = CRISPR gRNA sequence
  source 1..20: mol_type = other DNA
caaaacatgaaatcttgtga

SEQ ID NO: 70842 - DNA, 20 bp, synthetic construct
  misc_feature 1..20: note = CRISPR gRNA sequence
  source 1..20: mol_type = other DNA
aaaacatgaaatcttgtgac

SEQ ID NO: 70843 - DNA, 20 bp, synthetic construct
  misc_feature 1..20: note = CRISPR gRNA sequence
  source 1..20: mol_type = other DNA
gtgactaaaaacaaatccaa

SEQ ID NO: 70844 - DNA, 20 bp, synthetic construct
  misc_feature 1..20: note = CRISPR gRNA sequence
  source 1..20: mol_type = other DNA
tgactaaaaacaaatccaag

SEQ ID NO: 70845 - DNA, 20 bp, synthetic construct
  misc_feature 1..20: note = CRISPR gRNA sequence
  source 1..20: mol_type = other DNA
aaaacaaatccaagcagtga

SEQ ID NO: 70846 - DNA, 20 bp, synthetic construct
  misc_feature 1..20: note = CRISPR gRNA sequence
  source 1..20: mol_type = other DNA
ctttgtttatatccaagtac

SEQ ID NO: 70847 - DNA, 20 bp, synthetic construct
  misc_feature 1..20: note = CRISPR gRNA sequence
  source 1..20: mol_type = other DNA
tgtttatatccaagtacacc

SEQ ID NO: 70848 - DNA, 20 bp, synthetic construct
  misc_feature 1..20: note = CRISPR gRNA sequence
  source 1..20: mol_type = other DNA
gtttatatccaagtacacct

SEQ ID NO: 70849 - DNA, 20 bp, synthetic construct
  misc_feature 1..20: note = CRISPR gRNA sequence
  source 1..20: mol_type = other DNA
tttatatccaagtacacctc

SEQ ID NO: 70850 - DNA, 20 bp, synthetic construct
  misc_feature 1..20: note = CRISPR gRNA sequence
  source 1..20: mol_type = other DNA
atatccaagtacacctccta

SEQ ID NO: 70851 - DNA, 20 bp, synthetic construct
  misc_feature 1..20: note = CRISPR gRNA sequence
  source 1..20: mol_type = other DNA
tatccaagtacacctcctac

SEQ ID NO: 70852 - DNA, 20 bp, synthetic construct
  misc_feature 1..20: note = CRISPR gRNA sequence
  source 1..20: mol_type = other DNA
ctaccccctacctcgggcag

SEQ ID NO: 70853 - DNA, 20 bp, synthetic construct
  misc_feature 1..20: note = CRISPR gRNA sequence
  source 1..20: mol_type = other DNA
ccccctacctcgggcagagc

SEQ ID NO: 70854 - DNA, 20 bp, synthetic construct
  misc_feature 1..20: note = CRISPR gRNA sequence
  source 1..20: mol_type = other DNA
cctcgggcagagcagagtag

SEQ ID NO: 70855 - DNA, 20 bp, synthetic construct
  misc_feature 1..20: note = CRISPR gRNA sequence
  source 1..20: mol_type = other DNA
gggcagagcagagtaggtag

SEQ ID NO: 70856 - DNA, 20 bp, synthetic construct
  misc_feature 1..20: note = CRISPR gRNA sequence
  source 1..20: mol_type = other DNA
gagagttccaggaggttata

SEQ ID NO: 70857 - DNA, 20 bp, synthetic construct
  misc_feature 1..20: note = CRISPR gRNA sequence
  source 1..20: mol_type = other DNA
caggaggttatatcatattg

SEQ ID NO: 70858 - DNA, 20 bp, synthetic construct
  misc_feature 1..20: note = CRISPR gRNA sequence
  source 1..20: mol_type = other DNA
tatcatattggaccatttca

SEQ ID NO: 70859 - DNA, 20 bp, synthetic construct
  misc_feature 1..20: note = CRISPR gRNA sequence
  source 1..20: mol_type = other DNA
gaccatttcacccaaaatta

SEQ ID NO: 70860 - DNA, 20 bp, synthetic construct
  misc_feature 1..20: note = CRISPR gRNA sequence
  source 1..20: mol_type = other DNA
cacccaaaattaatttactg

SEQ ID NO: 70861 - DNA, 20 bp, synthetic construct
  misc_feature 1..20: note = CRISPR gRNA sequence
  source 1..20: mol_type = other DNA
acccaaaattaatttactga

SEQ ID NO: 70862 - DNA, 20 bp, synthetic construct
  misc_feature 1..20: note = CRISPR gRNA sequence
  source 1..20: mol_type = other DNA
atttactgaaaggtgatcca

SEQ ID NO: 70863 - DNA, 20 bp, synthetic construct
  misc_feature 1..20: note = CRISPR gRNA sequence
  source 1..20: mol_type = other DNA
actgaaaggtgatccattaa

SEQ ID NO: 70864 - DNA, 20 bp, synthetic construct
  misc_feature 1..20: note = CRISPR gRNA sequence
  source 1..20: mol_type = other DNA
ctgaaaggtgatccattaaa

SEQ ID NO: 70865 - DNA, 20 bp, synthetic construct
  misc_feature 1..20: note = CRISPR gRNA sequence
  source 1..20: mol_type = other DNA
aaaggtgatccattaaagtg

SEQ ID NO: 70866 - DNA, 20 bp, synthetic construct
  misc_feature 1..20: note = CRISPR gRNA sequence
  source 1..20: mol_type = other DNA
aagtgtatttatttatttct

SEQ ID NO: 70867 - DNA, 20 bp, synthetic construct
  misc_feature 1..20: note = CRISPR gRNA sequence
  source 1..20: mol_type = other DNA
atttatttctattttatttt

SEQ ID NO: 70868 - DNA, 20 bp, synthetic construct
  misc_feature 1..20: note = CRISPR gRNA sequence
  source 1..20: mol_type = other DNA
tttatttctattttattttt

SEQ ID NO: 70869 - DNA, 20 bp, synthetic construct
  misc_feature 1..20: note = CRISPR gRNA sequence
  source 1..20: mol_type = other DNA
atttctattttatttttatt

SEQ ID NO: 70870 - DNA, 20 bp, synthetic construct
  misc_feature 1..20: note = CRISPR gRNA sequence
  source 1..20: mol_type = other DNA
tttctattttatttttattt

SEQ ID NO: 70871 - DNA, 20 bp, synthetic construct
  misc_feature 1..20: note = CRISPR gRNA sequence
  source 1..20: mol_type = other DNA
ctattttatttttatttttt

SEQ ID NO: 70872 - DNA, 20 bp, synthetic construct
  misc_feature 1..20: note = CRISPR gRNA sequence
  source 1..20: mol_type = other DNA
tattttatttttattttttg

SEQ ID NO: 70873 - DNA, 20 bp, synthetic construct
  misc_feature 1..20: note = CRISPR gRNA sequence
  source 1..20: mol_type = other DNA
ttttatttttattttttgag

SEQ ID NO: 70874 - DNA, 20 bp, synthetic construct
  misc_feature 1..20: note = CRISPR gRNA sequence
  source 1..20: mol_type = other DNA
tatttttattttttgagaca

SEQ ID NO: 70875 - DNA, 20 bp, synthetic construct
  misc_feature 1..20: note = CRISPR gRNA sequence
  source 1..20: mol_type = other DNA
atttttattttttgagacac

SEQ ID NO: 70876 - DNA, 20 bp, synthetic construct
  misc_feature 1..20: note = CRISPR gRNA sequence
  source 1..20: mol_type = other DNA
tttttattttttgagacaca

SEQ ID NO: 70877 - DNA, 20 bp, synthetic construct
  misc_feature 1..20: note = CRISPR gRNA sequence
  source 1..20: mol_type = other DNA
ttattttttgagacacagtc

SEQ ID NO: 70878 - DNA, 20 bp, synthetic construct
  misc_feature 1..20: note = CRISPR gRNA sequence
  source 1..20: mol_type = other DNA
tattttttgagacacagtct

SEQ ID NO: 70879 - DNA, 20 bp, synthetic construct
  misc_feature 1..20: note = CRISPR gRNA sequence
  source 1..20: mol_type = other DNA
attttttgagacacagtctc

SEQ ID NO: 70880 - DNA, 20 bp, synthetic construct
  misc_feature 1..20: note = CRISPR gRNA sequence
  source 1..20: mol_type = other DNA
ttttttgagacacagtctca

SEQ ID NO: 70881 - DNA, 20 bp, synthetic construct
  misc_feature 1..20: note = CRISPR gRNA sequence
  source 1..20: mol_type = other DNA
tttgagacacagtctcactc

SEQ ID NO: 70882 - DNA, 20 bp, synthetic construct
  misc_feature 1..20: note = CRISPR gRNA sequence
  source 1..20: mol_type = other DNA
ttgagacacagtctcactct

SEQ ID NO: 70883 - DNA, 20 bp, synthetic construct
  misc_feature 1..20: note = CRISPR gRNA sequence
  source 1..20: mol_type = other DNA
tgagacacagtctcactctg

SEQ ID NO: 70884 - DNA, 20 bp, synthetic construct
  misc_feature 1..20: note = CRISPR gRNA sequence
  source 1..20: mol_type = other DNA
gagacacagtctcactctgt

SEQ ID NO: 70885 - DNA, 20 bp, synthetic construct
  misc_feature 1..20: note = CRISPR gRNA sequence
  source 1..20: mol_type = other DNA
agacacagtctcactctgtc

SEQ ID NO: 70886 - DNA, 20 bp, synthetic construct
  misc_feature 1..20: note = CRISPR gRNA sequence
  source 1..20: mol_type = other DNA
actctgtcgcccaggctgga

SEQ ID NO: 70887 - DNA, 20 bp, synthetic construct
  misc_feature 1..20: note = CRISPR gRNA sequence
  source 1..20: mol_type = other DNA
tgtcgcccaggctggagtgc

SEQ ID NO: 70888 - DNA, 20 bp, synthetic construct
  misc_feature 1..20: note = CRISPR gRNA sequence
  source 1..20: mol_type = other DNA
tcgcccaggctggagtgcag

SEQ ID NO: 70889 - DNA, 20 bp, synthetic construct
  misc_feature 1..20: note = CRISPR gRNA sequence
  source 1..20: mol_type = other DNA
gagtgcagtggcatgatctc

SEQ ID NO: 70890 - DNA, 20 bp, synthetic construct
  misc_feature 1..20: note = CRISPR gRNA sequence
  source 1..20: mol_type = other DNA
acttcactgcaacctctgcc

SEQ ID NO: 70891 - DNA, 20 bp, synthetic construct
  misc_feature 1..20: note = CRISPR gRNA sequence
  source 1..20: mol_type = other DNA
cactgcaacctctgcctcct

SEQ ID NO: 70892 - DNA, 20 bp, synthetic construct
  misc_feature 1..20: note = CRISPR gRNA sequence
  source 1..20: mol_type = other DNA
actgcaacctctgcctcctg

SEQ ID NO: 70893 - DNA, 20 bp, synthetic construct
  misc_feature 1..20: note = CRISPR gRNA sequence
  source 1..20: mol_type = other DNA
caacctctgcctcctgggtt

SEQ ID NO: 70894 - DNA, 20 bp, synthetic construct
  misc_feature 1..20: note = CRISPR gRNA sequence
  source 1..20: mol_type = other DNA
tgcctcctgggttcaagcga

SEQ ID NO: 70895 - DNA, 20 bp, synthetic construct
  misc_feature 1..20: note = CRISPR gRNA sequence
  source 1..20: mol_type = other DNA
cctcctgggttcaagcgatt

SEQ ID NO: 70896 - DNA, 20 bp, synthetic construct
  misc_feature 1..20: note = CRISPR gRNA sequence
  source 1..20: mol_type = other DNA
ctgggttcaagcgattctgg

SEQ ID NO: 70897 - DNA, 20 bp, synthetic construct
  misc_feature 1..20: note = CRISPR gRNA sequence
  source 1..20: mol_type = other DNA
ggttcaagcgattctggtgc

SEQ ID NO: 70898 - DNA, 20 bp, synthetic construct
  misc_feature 1..20: note = CRISPR gRNA sequence
  source 1..20: mol_type = other DNA
aagcgattctggtgcctcag

SEQ ID NO: 70899 - DNA, 20 bp, synthetic construct
  misc_feature 1..20: note = CRISPR gRNA sequence
  source 1..20: mol_type = other DNA
tggtgcctcagccgcccaag

SEQ ID NO: 70900 - DNA, 20 bp, synthetic construct
  misc_feature 1..20: note = CRISPR gRNA sequence
  source 1..20: mol_type = other DNA
gtgcctcagccgcccaagta

SEQ ID NO: 70901 - DNA, 20 bp, synthetic construct
  misc_feature 1..20: note = CRISPR gRNA sequence
  source 1..20: mol_type = other DNA
agccgcccaagtagctggga

SEQ ID NO: 70902 - DNA, 20 bp, synthetic construct
  misc_feature 1..20: note = CRISPR gRNA sequence
  source 1..20: mol_type = other DNA
ggattacaggtatgcaccac

SEQ ID NO: 70903 - DNA, 20 bp, synthetic construct
  misc_feature 1..20: note = CRISPR gRNA sequence
  source 1..20: mol_type = other DNA
caggtatgcaccaccacgcc

SEQ ID NO: 70904 - DNA, 20 bp, synthetic construct
  misc_feature 1..20: note = CRISPR gRNA sequence
  source 1..20: mol_type = other DNA
ttgtatatttttagtacaaa

SEQ ID NO: 70905 - DNA, 20 bp, synthetic construct
  misc_feature 1..20: note = CRISPR gRNA sequence
  source 1..20: mol_type = other DNA
tgtatatttttagtacaaat

SEQ ID NO: 70906 - DNA, 20 bp, synthetic construct
  misc_feature 1..20: note = CRISPR gRNA sequence
  source 1..20: mol_type = other DNA
gtatatttttagtacaaatg

SEQ ID NO: 70907 - DNA, 20 bp, synthetic construct
  misc_feature 1..20: note = CRISPR gRNA sequence
  source 1..20: mol_type = other DNA
tatatttttagtacaaatgg

SEQ ID NO: 70908 - DNA, 20 bp, synthetic construct
  misc_feature 1..20: note = CRISPR gRNA sequence
  source 1..20: mol_type = other DNA
ttagtacaaatggggtttca

SEQ ID NO: 70909 - DNA, 20 bp, synthetic construct
  misc_feature 1..20: note = CRISPR gRNA sequence
  source 1..20: mol_type = other DNA
tagtacaaatggggtttcac

SEQ ID NO: 70910 - DNA, 20 bp, synthetic construct
  misc_feature 1..20: note = CRISPR gRNA sequence
  source 1..20: mol_type = other DNA
agtacaaatggggtttcacc

SEQ ID NO: 70911 - DNA, 20 bp, synthetic construct
  misc_feature 1..20: note = CRISPR gRNA sequence
  source 1..20: mol_type = other DNA
gtacaaatggggtttcacca

SEQ ID NO: 70912 - DNA, 20 bp, synthetic construct
  misc_feature 1..20: note = CRISPR gRNA sequence
  source 1..20: mol_type = other DNA
caccatgttggccgggctgg

SEQ ID NO: 70913 - DNA, 20 bp, synthetic construct
  misc_feature 1..20: note = CRISPR gRNA sequence
  source 1..20: mol_type = other DNA
accatgttggccgggctggt

SEQ ID NO: 70914 - DNA, 20 bp, synthetic construct
  misc_feature 1..20: note = CRISPR gRNA sequence
  source 1..20: mol_type = other DNA
gccgggctggtctcgaaccc

SEQ ID NO: 70915 - DNA, 20 bp, synthetic construct
  misc_feature 1..20: note = CRISPR gRNA sequence
  source 1..20: mol_type = other DNA
gtctcgaacccctgacctca

SEQ ID NO: 70916 - DNA, 20 bp, synthetic construct
  misc_feature 1..20: note = CRISPR gRNA sequence
  source 1..20: mol_type = other DNA
gaacccctgacctcaaatga

SEQ ID NO: 70917 - DNA, 20 bp, synthetic construct
  misc_feature 1..20: note = CRISPR gRNA sequence
  source 1..20: mol_type = other DNA
acctcaaatgatccacctgc

SEQ ID NO: 70918 - DNA, 20 bp, synthetic construct
  misc_feature 1..20: note = CRISPR gRNA sequence
  source 1..20: mol_type = other DNA
aaatgatccacctgcctaga

SEQ ID NO: 70919 - DNA, 20 bp, synthetic construct
  misc_feature 1..20: note = CRISPR gRNA sequence
  source 1..20: mol_type = other DNA
cctagactccgaaagtgctg

SEQ ID NO: 70920 - DNA, 20 bp, synthetic construct
  misc_feature 1..20: note = CRISPR gRNA sequence
  source 1..20: mol_type = other DNA
gactccgaaagtgctgggaa

SEQ ID NO: 70921 - DNA, 20 bp, synthetic construct
  misc_feature 1..20: note = CRISPR gRNA sequence
  source 1..20: mol_type = other DNA
cgaaagtgctgggaatacag

SEQ ID NO: 70922 - DNA, 20 bp, synthetic construct
  misc_feature 1..20: note = CRISPR gRNA sequence
  source 1..20: mol_type = other DNA
ggaatacaggtgtgaaccac

SEQ ID NO: 70923 - DNA, 20 bp, synthetic construct
  misc_feature 1..20: note = CRISPR gRNA sequence
  source 1..20: mol_type = other DNA
ctcccagccccattaaaatt

SEQ ID NO: 70924 - DNA, 20 bp, synthetic construct
  misc_feature 1..20: note = CRISPR gRNA sequence
  source 1..20: mol_type = other DNA
ccagccccattaaaatttaa

SEQ ID NO: 70925 - DNA, 20 bp, synthetic construct
  misc_feature 1..20: note = CRISPR gRNA sequence
  source 1..20: mol_type = other DNA
aaatttaatttgcaaaataa

SEQ ID NO: 70926 - DNA, 20 bp, synthetic construct
  misc_feature 1..20: note = CRISPR gRNA sequence
  source 1..20: mol_type = other DNA
aatttgcaaaataaaagaaa

SEQ ID NO: 70927 - DNA, 20 bp, synthetic construct
  misc_feature 1..20: note = CRISPR gRNA sequence
  source 1..20: mol_type = other DNA
atttgcaaaataaaagaaag

SEQ ID NO: 70928 - DNA, 20 bp, synthetic construct
  misc_feature 1..20: note = CRISPR gRNA sequence
  source 1..20: mol_type = other DNA
gcaaaataaaagaaagtaaa

SEQ ID NO: 70929 - DNA, 20 bp, synthetic construct
  misc_feature 1..20: note = CRISPR gRNA sequence
  source 1..20: mol_type = other DNA
caaaataaaagaaagtaaaa

SEQ ID NO: 70930 - DNA, 20 bp, synthetic construct
  misc_feature 1..20: note = CRISPR gRNA sequence
  source 1..20: mol_type = other DNA
cccaaggggctaagaccatt

SEQ ID NO: 70931 - DNA, 20 bp, synthetic construct
  misc_feature 1..20: note = CRISPR gRNA sequence
  source 1..20: mol_type = other DNA
ccaaggggctaagaccattt

SEQ ID NO: 70932 - DNA, 20 bp, synthetic construct
  misc_feature 1..20: note = CRISPR gRNA sequence
  source 1..20: mol_type = other DNA
agaccatttgcctcagctat

SEQ ID NO: 70933 - DNA, 20 bp, synthetic construct
  misc_feature 1..20: note = CRISPR gRNA sequence
  source 1..20: mol_type = other DNA
gcctcagctatttattgttt

SEQ ID NO: 70934 - DNA, 20 bp, synthetic construct
  misc_feature 1..20: note = CRISPR gRNA sequence
  source 1..20: mol_type = other DNA
cctcagctatttattgtttt

SEQ ID NO: 70935 - DNA, 20 bp, synthetic construct
  misc_feature 1..20: note = CRISPR gRNA sequence
  source 1..20: mol_type = other DNA
agctatttattgttttttcc

SEQ ID NO: 70936 - DNA, 20 bp, synthetic construct
  misc_feature 1..20: note = CRISPR gRNA sequence
  source 1..20: mol_type = other DNA
tttattgttttttcctaccc

SEQ ID NO: 70937 - DNA, 20 bp, synthetic construct
  misc_feature 1..20: note = CRISPR gRNA sequence
  source 1..20: mol_type = other DNA
attgttttttcctacccagg

SEQ ID NO: 70938 - DNA, 20 bp, synthetic construct
  misc_feature 1..20: note = CRISPR gRNA sequence
  source 1..20: mol_type = other DNA
ttgttttttcctacccaggc

SEQ ID NO: 70939 - DNA, 20 bp, synthetic construct
  misc_feature 1..20: note = CRISPR gRNA sequence
  source 1..20: mol_type = other DNA
ttttttcctacccaggcaga

SEQ ID NO: 70940 - DNA, 20 bp, synthetic construct
  misc_feature 1..20: note = CRISPR gRNA sequence
  source 1..20: mol_type = other DNA
tttcctacccaggcagagca

SEQ ID NO: 70941 - DNA, 20 bp, synthetic construct
  misc_feature 1..20: note = CRISPR gRNA sequence
  source 1..20: mol_type = other DNA
ttcctacccaggcagagcaa

SEQ ID NO: 70942 - DNA, 20 bp, synthetic construct
  misc_feature 1..20: note = CRISPR gRNA sequence
  source 1..20: mol_type = other DNA
tcctacccaggcagagcaag

SEQ ID NO: 70943 - DNA, 20 bp, synthetic construct
  misc_feature 1..20: note = CRISPR gRNA sequence
  source 1..20: mol_type = other DNA
cctacccaggcagagcaagg

SEQ ID NO: 70944 - DNA, 20 bp, synthetic construct
  misc_feature 1..20: note = CRISPR gRNA sequence
  source 1..20: mol_type = other DNA
ctacccaggcagagcaaggt

SEQ ID NO: 70945 - DNA, 20 bp, synthetic construct
  misc_feature 1..20: note = CRISPR gRNA sequence
  source 1..20: mol_type = other DNA
cccaggcagagcaaggtcag

SEQ ID NO: 70946 - DNA, 20 bp, synthetic construct
  misc_feature 1..20: note = CRISPR gRNA sequence
  source 1..20: mol_type = other DNA
agtaaagacaataccctggg

SEQ ID NO: 70947 - DNA, 20 bp, synthetic construct
  misc_feature 1..20: note = CRISPR gRNA sequence
  source 1..20: mol_type = other DNA
ggtttaaggaaaaacctacc

SEQ ID NO: 70948 - DNA, 20 bp, synthetic construct
  misc_feature 1..20: note = CRISPR gRNA sequence
  source 1..20: mol_type = other DNA
aaggaaaaacctaccatttg

SEQ ID NO: 70949 - DNA, 20 bp, synthetic construct
  misc_feature 1..20: note = CRISPR gRNA sequence
  source 1..20: mol_type = other DNA
aggaaaaacctaccatttgc

SEQ ID NO: 70950 - DNA, 20 bp, synthetic construct
  misc_feature 1..20: note = CRISPR gRNA sequence
  source 1..20: mol_type = other DNA
ccatttgcatggatgagaac

SEQ ID NO: 70951 - DNA, 20 bp, synthetic construct
  misc_feature 1..20: note = CRISPR gRNA sequence
  source 1..20: mol_type = other DNA
gcatggatgagaacacatat

SEQ ID NO: 70952 - DNA, 20 bp, synthetic construct
  misc_feature 1..20: note = CRISPR gRNA sequence
  source 1..20: mol_type = other DNA
catggatgagaacacatatg

SEQ ID NO: 70953 - DNA, 20 bp, synthetic construct
  misc_feature 1..20: note = CRISPR gRNA sequence
  source 1..20: mol_type = other DNA
agaactgatctgcgtgaatc

SEQ ID NO: 70954 - DNA, 20 bp, synthetic construct
  misc_feature 1..20: note = CRISPR gRNA sequence
  source 1..20: mol_type = other DNA
atctgcgtgaatcagagaat

SEQ ID NO: 70955 - DNA, 20 bp, synthetic construct
  misc_feature 1..20: note = CRISPR gRNA sequence
  source 1..20: mol_type = other DNA
cgtgaatcagagaatcccac

SEQ ID NO: 70956 - DNA, 20 bp, synthetic construct
  misc_feature 1..20: note = CRISPR gRNA sequence
  source 1..20: mol_type = other DNA
agccgggccagcccggagat

SEQ ID NO: 70957 - DNA, 20 bp, synthetic construct
  misc_feature 1..20: note = CRISPR gRNA sequence
  source 1..20: mol_type = other DNA
acacagaggctgaggtgaag

SEQ ID NO: 70958 - DNA, 20 bp, synthetic construct
  misc_feature 1..20: note = CRISPR gRNA sequence
  source 1..20: mol_type = other DNA
aggtgaagcttggcaaagaa

SEQ ID NO: 70959 - DNA, 20 bp, synthetic construct
  misc_feature 1..20: note = CRISPR gRNA sequence
  source 1..20: mol_type = other DNA
ggcaaagaaatgtagagact

SEQ ID NO: 70960 - DNA, 20 bp, synthetic construct
  misc_feature 1..20: note = CRISPR gRNA sequence
  source 1..20: mol_type = other DNA
gcaaagaaatgtagagactc

SEQ ID NO: 70961 - DNA, 20 bp, synthetic construct
  misc_feature 1..20: note = CRISPR gRNA sequence
  source 1..20: mol_type = other DNA
ctcctgggccaggggctctg

SEQ ID NO: 70962 - DNA, 20 bp, synthetic construct
  misc_feature 1..20: note = CRISPR gRNA sequence
  source 1..20: mol_type = other DNA
ctgggccaggggctctggat

SEQ ID NO: 70963 - DNA, 20 bp, synthetic construct
  misc_feature 1..20: note = CRISPR gRNA sequence
  source 1..20: mol_type = other DNA
ggccaggggctctggatttg

SEQ ID NO: 70964 - DNA, 20 bp, synthetic construct
  misc_feature 1..20: note = CRISPR gRNA sequence
  source 1..20: mol_type = other DNA
tggatttgtttccacccagc

SEQ ID NO: 70965 - DNA, 20 bp, synthetic construct
  misc_feature 1..20: note = CRISPR gRNA sequence
  source 1..20: mol_type = other DNA
gatttgtttccacccagcct

SEQ ID NO: 70966 - DNA, 20 bp, synthetic construct
  misc_feature 1..20: note = CRISPR gRNA sequence
  source 1..20: mol_type = other DNA
gtttccacccagcctgcaag

SEQ ID NO: 70967 - DNA, 20 bp, synthetic construct
  misc_feature 1..20: note = CRISPR gRNA sequence
  source 1..20: mol_type = other DNA
tttccacccagcctgcaagt

SEQ ID NO: 70968 - DNA, 20 bp, synthetic construct
  misc_feature 1..20: note = CRISPR gRNA sequence
  source 1..20: mol_type = other DNA
ccacccagcctgcaagtccc

SEQ ID NO: 70969 - DNA, 20 bp, synthetic construct
  misc_feature 1..20: note = CRISPR gRNA sequence
  source 1..20: mol_type = other DNA
cacccagcctgcaagtccct

SEQ ID NO: 70970 - DNA, 20 bp, synthetic construct
  misc_feature 1..20: note = CRISPR gRNA sequence
  source 1..20: mol_type = other DNA
caagtccctaagtctctggc

SEQ ID NO: 70971 - DNA, 20 bp, synthetic construct
  misc_feature 1..20: note = CRISPR gRNA sequence
  source 1..20: mol_type = other DNA
agtctctggccagtcacagc

SEQ ID NO: 70972 - DNA, 20 bp, synthetic construct
  misc_feature 1..20: note = CRISPR gRNA sequence
  source 1..20: mol_type = other DNA
tggccagtcacagctcactg

SEQ ID NO: 70973 - DNA, 20 bp, synthetic construct
  misc_feature 1..20: note = CRISPR gRNA sequence
  source 1..20: mol_type = other DNA
gccagtcacagctcactgct

SEQ ID NO: 70974 - DNA, 20 bp, synthetic construct
  misc_feature 1..20: note = CRISPR gRNA sequence
  source 1..20: mol_type = other DNA
actgctggctctcaagtttt

SEQ ID NO: 70975 - DNA, 20 bp, synthetic construct
  misc_feature 1..20: note = CRISPR gRNA sequence
  source 1..20: mol_type = other DNA
ctggctctcaagttttctca

SEQ ID NO: 70976 - DNA, 20 bp, synthetic construct
  misc_feature 1..20: note = CRISPR gRNA sequence
  source 1..20: mol_type = other DNA
gctctcaagttttctcacct

SEQ ID NO: 70977 - DNA, 20 bp, synthetic construct
  misc_feature 1..20: note = CRISPR gRNA sequence
  source 1..20: mol_type = other DNA
tcaagttttctcacctggac

SEQ ID NO: 70978 - DNA, 20 bp, synthetic construct
  misc_feature 1..20: note = CRISPR gRNA sequence
  source 1..20: mol_type = other DNA
aagttttctcacctggacac

SEQ ID NO: 70979 - DNA, 20 bp, synthetic construct
  misc_feature 1..20: note = CRISPR gRNA sequence
  source 1..20: mol_type = other DNA
tctcacctggacactgggga

SEQ ID NO: 70980 - DNA, 20 bp, synthetic construct
  misc_feature 1..20: note = CRISPR gRNA sequence
  source 1..20: mol_type = other DNA
ctcacctggacactggggac

SEQ ID NO: 70981 - DNA, 20 bp, synthetic construct
  misc_feature 1..20: note = CRISPR gRNA sequence
  source 1..20: mol_type = other DNA
tcacctggacactggggaca

SEQ ID NO: 70982 - DNA, 20 bp, synthetic construct
  misc_feature 1..20: note = CRISPR gRNA sequence
  source 1..20: mol_type = other DNA
acctggacactggggacaat

SEQ ID NO: 70983 - DNA, 20 bp, synthetic construct
  misc_feature 1..20: note = CRISPR gRNA sequence
  source 1..20: mol_type = other DNA
gacactggggacaataattc

SEQ ID NO: 70984 - DNA, 20 bp, synthetic construct
  misc_feature 1..20: note = CRISPR gRNA sequence
  source 1..20: mol_type = other DNA
gggacaataattcccacctt

SEQ ID NO: 70985 - DNA, 20 bp, synthetic construct
  misc_feature 1..20: note = CRISPR gRNA sequence
  source 1..20: mol_type = other DNA
ccaccttgctcaccactccc

SEQ ID NO: 70986 - DNA, 20 bp, synthetic construct
  misc_feature 1..20: note = CRISPR gRNA sequence
  source 1..20: mol_type = other DNA
gctcaccactccccacctgc

SEQ ID NO: 70987 - DNA, 20 bp, synthetic construct
  misc_feature 1..20: note = CRISPR gRNA sequence
  source 1..20: mol_type = other DNA
ctcaccactccccacctgcc

SEQ ID NO: 70988 - DNA, 20 bp, synthetic construct
  misc_feature 1..20: note = CRISPR gRNA sequence
  source 1..20: mol_type = other DNA
accactccccacctgccatg

SEQ ID NO: 70989 - DNA, 20 bp, synthetic construct
  misc_feature 1..20: note = CRISPR gRNA sequence
  source 1..20: mol_type = other DNA
cccacctgccatgaccccca

SEQ ID NO: 70990 - DNA, 20 bp, synthetic construct
  misc_feature 1..20: note = CRISPR gRNA sequence
  source 1..20: mol_type = other DNA
ccatgacccccagaagtttt

SEQ ID NO: 70991 - DNA, 20 bp, synthetic construct
  misc_feature 1..20: note = CRISPR gRNA sequence
  source 1..20: mol_type = other DNA
tgctaccagcatatgaattc

SEQ ID NO: 70992 - DNA, 20 bp, synthetic construct
  misc_feature 1..20: note = CRISPR gRNA sequence
  source 1..20: mol_type = other DNA
gctaccagcatatgaattcc

SEQ ID NO: 70993 - DNA, 20 bp, synthetic construct
  misc_feature 1..20: note = CRISPR gRNA sequence
  source 1..20: mol_type = other DNA
ctaccagcatatgaattcct

SEQ ID NO: 70994 - DNA, 20 bp, synthetic construct
  misc_feature 1..20: note = CRISPR gRNA sequence
  source 1..20: mol_type = other DNA
ccagcatatgaattcctggg

SEQ ID NO: 70995 - DNA, 20 bp, synthetic construct
  misc_feature 1..20: note = CRISPR gRNA sequence
  source 1..20: mol_type = other DNA
ctgggcgtgtaaggctttgc

SEQ ID NO: 70996 - DNA, 20 bp, synthetic construct
  misc_feature 1..20: note = CRISPR gRNA sequence
  source 1..20: mol_type = other DNA
ggcgtgtaaggctttgcaaa

SEQ ID NO: 70997 - DNA, 20 bp, synthetic construct
  misc_feature 1..20: note = CRISPR gRNA sequence
  source 1..20: mol_type = other DNA
tgcaaactgtagagttctta

SEQ ID NO: 70998 - DNA, 20 bp, synthetic construct
  misc_feature 1..20: note = CRISPR gRNA sequence
  source 1..20: mol_type = other DNA
gcaaactgtagagttcttag

SEQ ID NO: 70999 - DNA, 20 bp, synthetic construct
  misc_feature 1..20: note = CRISPR gRNA sequence
  source 1..20: mol_type = other DNA
caaactgtagagttcttagc

SEQ ID NO: 71000 - DNA, 20 bp, synthetic construct
  misc_feature 1..20: note = CRISPR gRNA sequence
  source 1..20: mol_type = other DNA
tagagttcttagcacagcac

SEQ ID NO: 71001 - DNA, 20 bp, synthetic construct
  misc_feature 1..20: note = CRISPR gRNA sequence
  source 1..20: mol_type = other DNA
ttagcacagcacctgcaaag

SEQ ID NO: 71002 - DNA, 20 bp, synthetic construct
  misc_feature 1..20: note = CRISPR gRNA sequence
  source 1..20: mol_type = other DNA
agcacagcacctgcaaaggc

SEQ ID NO: 71003 - DNA, 20 bp, synthetic construct
  misc_feature 1..20: note = CRISPR gRNA sequence
  source 1..20: mol_type = other DNA
gcacagcacctgcaaaggcc

SEQ ID NO: 71004 - DNA, 20 bp, synthetic construct
  misc_feature 1..20: note = CRISPR gRNA sequence
  source 1..20: mol_type = other DNA
caaaggcctttaagctcctg

SEQ ID NO: 71005 - DNA, 20 bp, synthetic construct
  misc_feature 1..20: note = CRISPR gRNA sequence
  source 1..20: mol_type = other DNA
taagctcctgaaagcctctt

SEQ ID NO: 71006 - DNA, 20 bp, synthetic construct
  misc_feature 1..20: note = CRISPR gRNA sequence
  source 1..20: mol_type = other DNA
aagctcctgaaagcctcttg

SEQ ID NO: 71007 - DNA, 20 bp, synthetic construct
  misc_feature 1..20: note = CRISPR gRNA sequence
  source 1..20: mol_type = other DNA
agctcctgaaagcctcttgg

SEQ ID NO: 71008 - DNA, 20 bp, synthetic construct
  misc_feature 1..20: note = CRISPR gRNA sequence
  source 1..20: mol_type = other DNA
ctgaaagcctcttggtctat

SEQ ID NO: 71009 - DNA, 20 bp, synthetic construct
  misc_feature 1..20: note = CRISPR gRNA sequence
  source 1..20: mol_type = other DNA
aaagcctcttggtctattcc

SEQ ID NO: 71010 - DNA, 20 bp, synthetic construct
  misc_feature 1..20: note = CRISPR gRNA sequence
  source 1..20: mol_type = other DNA
ttggtctattccctgctttt

SEQ ID NO: 71011 - DNA, 20 bp, synthetic construct
  misc_feature 1..20: note = CRISPR gRNA sequence
  source 1..20: mol_type = other DNA
ggtctattccctgcttttcc

SEQ ID NO: 71012 - DNA, 20 bp, synthetic construct
  misc_feature 1..20: note = CRISPR gRNA sequence
  source 1..20: mol_type = other DNA
gtctattccctgcttttcca

SEQ ID NO: 71013 - DNA, 20 bp, synthetic construct
  misc_feature 1..20: note = CRISPR gRNA sequence
  source 1..20: mol_type = other DNA
ttccctgcttttccagactg

SEQ ID NO: 71014 - DNA, 20 bp, synthetic construct
  misc_feature 1..20: note = CRISPR gRNA sequence
  source 1..20: mol_type = other DNA
cctgcttttccagactgaac

SEQ ID NO: 71015 - DNA, 20 bp, synthetic construct
  misc_feature 1..20: note = CRISPR gRNA sequence
  source 1..20: mol_type = other DNA
cttttccagactgaacagga

SEQ ID NO: 71016 - DNA, 20 bp, synthetic construct
  misc_feature 1..20: note = CRISPR gRNA sequence
  source 1..20: mol_type = other DNA
ttccagactgaacaggaaca

SEQ ID NO: 71017 - DNA, 20 bp, synthetic construct
  misc_feature 1..20: note = CRISPR gRNA sequence
  source 1..20: mol_type = other DNA
tccagactgaacaggaacag

SEQ ID NO: 71018 - DNA, 20 bp, synthetic construct
  misc_feature 1..20: note = CRISPR gRNA sequence
  source 1..20: mol_type = other DNA
ccagactgaacaggaacagt

SEQ ID NO: 71019 - DNA, 20 bp, synthetic construct
  misc_feature 1..20: note = CRISPR gRNA sequence
  source 1..20: mol_type = other DNA
cagactgaacaggaacagta

SEQ ID NO: 71020 - DNA, 20 bp, synthetic construct
  misc_feature 1..20: note = CRISPR gRNA sequence
  source 1..20: mol_type = other DNA
aacaggaacagtatcggtga

SEQ ID NO: 71021 - DNA, 20 bp, synthetic construct
  misc_feature 1..20: note = CRISPR gRNA sequence
  source 1..20: mol_type = other DNA
ctgccacctttctgaggctc

SEQ ID NO: 71022 - DNA, 20 bp, synthetic construct
  misc_feature 1..20: note = CRISPR gRNA sequence
  source 1..20: mol_type = other DNA
ccacctttctgaggctctca

SEQ ID NO: 71023 - DNA, 20 bp, synthetic construct
  misc_feature 1..20: note = CRISPR gRNA sequence
  source 1..20: mol_type = other DNA
tctgaggctctcagggctgc

SEQ ID NO: 71024 - DNA, 20 bp, synthetic construct
  misc_feature 1..20: note = CRISPR gRNA sequence
  source 1..20: mol_type = other DNA
ctgaggctctcagggctgcc

SEQ ID NO: 71025 - DNA, 20 bp, synthetic construct
  misc_feature 1..20: note = CRISPR gRNA sequence
  source 1..20: mol_type = other DNA
tgaggctctcagggctgcca

SEQ ID NO: 71026 - DNA, 20 bp, synthetic construct
  misc_feature 1..20: note = CRISPR gRNA sequence
  source 1..20: mol_type = other DNA
aggctctcagggctgccacc

SEQ ID NO: 71027 - DNA, 20 bp, synthetic construct
  misc_feature 1..20: note = CRISPR gRNA sequence
  source 1..20: mol_type = other DNA
tcagggctgccaccagccta

SEQ ID NO: 71028 - DNA, 20 bp, synthetic construct
  misc_feature 1..20: note = CRISPR gRNA sequence
  source 1..20: mol_type = other DNA
agggctgccaccagcctaga

SEQ ID NO: 71029 - DNA, 20 bp, synthetic construct
  misc_feature 1..20: note = CRISPR gRNA sequence
  source 1..20: mol_type = other DNA
ccaccagcctagaggagctg

SEQ ID NO: 71030 - DNA, 20 bp, synthetic construct
  misc_feature 1..20: note = CRISPR gRNA sequence
  source 1..20: mol_type = other DNA
gaggagctggagtgagttgc

SEQ ID NO: 71031 - DNA, 20 bp, synthetic construct
  misc_feature 1..20: note = CRISPR gRNA sequence
  source 1..20: mol_type = other DNA
gagtgagttgcccattctgc

SEQ ID NO: 71032 - DNA, 20 bp, synthetic construct
  misc_feature 1..20: note = CRISPR gRNA sequence
  source 1..20: mol_type = other DNA
cccattctgcccccagaccc

SEQ ID NO: 71033 - DNA, 20 bp, synthetic construct
  misc_feature 1..20: note = CRISPR gRNA sequence
  source 1..20: mol_type = other DNA
tgcccccagacccaggacaa

SEQ ID NO: 71034 - DNA, 20 bp, synthetic construct
  misc_feature 1..20: note = CRISPR gRNA sequence
  source 1..20: mol_type = other DNA
cccccagacccaggacaatt

SEQ ID NO: 71035 - DNA, 20 bp, synthetic construct
  misc_feature 1..20: note = CRISPR gRNA sequence
  source 1..20: mol_type = other DNA
tggccgggaaagatgacaag

SEQ ID NO: 71036 - DNA, 20 bp, synthetic construct
  misc_feature 1..20: note = CRISPR gRNA sequence
  source 1..20: mol_type = other DNA
ggccgggaaagatgacaagg

SEQ ID NO: 71037 - DNA, 20 bp, synthetic construct
  misc_feature 1..20: note = CRISPR gRNA sequence
  source 1..20: mol_type = other DNA
gccgggaaagatgacaaggg

SEQ ID NO: 71038 - DNA, 20 bp, synthetic construct
  misc_feature 1..20: note = CRISPR gRNA sequence
  source 1..20: mol_type = other DNA
cctgagcacgccctttgctt

SEQ ID NO: 71039 - DNA, 20 bp, synthetic construct
  misc_feature 1..20: note = CRISPR gRNA sequence
  source 1..20: mol_type = other DNA
agcacgccctttgcttcttc

SEQ ID NO: 71040 - DNA, 20 bp, synthetic construct
  misc_feature 1..20: note = CRISPR gRNA sequence
  source 1..20: mol_type = other DNA
tgcttcttcatctcatctcc

SEQ ID NO: 71041 - DNA, 20 bp, synthetic construct
  misc_feature 1..20: note = CRISPR gRNA sequence
  source 1..20: mol_type = other DNA
gcttcttcatctcatctcct

SEQ ID NO: 71042 - DNA, 20 bp, synthetic construct
  misc_feature 1..20: note = CRISPR gRNA sequence
  source 1..20: mol_type = other DNA
cttcttcatctcatctcctt

SEQ ID NO: 71043 - DNA, 20 bp, synthetic construct
  misc_feature 1..20: note = CRISPR gRNA sequence
  source 1..20: mol_type = other DNA
cttcatctcatctccttcac

SEQ ID NO: 71044 - DNA, 20 bp, synthetic construct
  misc_feature 1..20: note = CRISPR gRNA sequence
  source 1..20: mol_type = other DNA
ttcatctcatctccttcacc

SEQ ID NO: 71045 - DNA, 20 bp, synthetic construct
  misc_feature 1..20: note = CRISPR gRNA sequence
  source 1..20: mol_type = other DNA
catctcatctccttcaccca

SEQ ID NO: 71046 - DNA, 20 bp, synthetic construct
  misc_feature 1..20: note = CRISPR gRNA sequence
  source 1..20: mol_type = other DNA
atctcatctccttcacccac

SEQ ID NO: 71047 - DNA, 20 bp, synthetic construct
  misc_feature 1..20: note = CRISPR gRNA sequence
  source 1..20: mol_type = other DNA
atctccttcacccacttcta

SEQ ID NO: 71048 - DNA, 20 bp, synthetic construct
  misc_feature 1..20: note = CRISPR gRNA sequence
  source 1..20: mol_type = other DNA
cttcacccacttctacactg

SEQ ID NO: 71049 - DNA, 20 bp, synthetic construct
  misc_feature 1..20: note = CRISPR gRNA sequence
  source 1..20: mol_type = other DNA
cacccacttctacactgtgt

SEQ ID NO: 71050 - DNA, 20 bp, synthetic construct
  misc_feature 1..20: note = CRISPR gRNA sequence
  source 1..20: mol_type = other DNA
acccacttctacactgtgta

SEQ ID NO: 71051 - DNA, 20 bp, synthetic construct
  misc_feature 1..20: note = CRISPR gRNA sequence
  source 1..20: mol_type = other DNA
ctacactgtgtaaacaacct

SEQ ID NO: 71052 - DNA, 20 bp, synthetic construct
  misc_feature 1..20: note = CRISPR gRNA sequence
  source 1..20: mol_type = other DNA
tacactgtgtaaacaacctg

SEQ ID NO: 71053 - DNA, 20 bp, synthetic construct
  misc_feature 1..20: note = CRISPR gRNA sequence
  source 1..20: mol_type = other DNA
cactgtgtaaacaacctggg

SEQ ID NO: 71054 - DNA, 20 bp, synthetic construct
  misc_feature 1..20: note = CRISPR gRNA sequence
  source 1..20: mol_type = other DNA
tgtaaacaacctggggccta

SEQ ID NO: 71055 - DNA, 20 bp, synthetic construct
  misc_feature 1..20: note = CRISPR gRNA sequence
  source 1..20: mol_type = other DNA
gggcctagaagcttggggga

SEQ ID NO: 71056 - DNA, 20 bp, synthetic construct
  misc_feature 1..20: note = CRISPR gRNA sequence
  source 1..20: mol_type = other DNA
gaagcttgggggacccaaag

SEQ ID NO: 71057 - DNA, 20 bp, synthetic construct
  misc_feature 1..20: note = CRISPR gRNA sequence
  source 1..20: mol_type = other DNA
gggggacccaaagacaggat

SEQ ID NO: 71058 - DNA, 20 bp, synthetic construct
  misc_feature 1..20: note = CRISPR gRNA sequence
  source 1..20: mol_type = other DNA
ggggacccaaagacaggatg

SEQ ID NO: 71059 - DNA, 20 bp, synthetic construct
  misc_feature 1..20: note = CRISPR gRNA sequence
  source 1..20: mol_type = other DNA
tagcaagagggatttaggtc

SEQ ID NO: 71060 - DNA, 20 bp, synthetic construct
  misc_feature 1..20: note = CRISPR gRNA sequence
  source 1..20: mol_type = other DNA
aggtcagacaatggggagaa

SEQ ID NO: 71061 - DNA, 20 bp, synthetic construct
  misc_feature 1..20: note = CRISPR gRNA sequence
  source 1..20: mol_type = other DNA
ggtcagacaatggggagaac

SEQ ID NO: 71062 - DNA, 20 bp, synthetic construct
  misc_feature 1..20: note = CRISPR gRNA sequence
  source 1..20: mol_type = other DNA
aacagaagccaagggttagg

SEQ ID NO: 71063 - DNA, 20 bp, synthetic construct
  misc_feature 1..20: note = CRISPR gRNA sequence
  source 1..20: mol_type = other DNA
ggagctgtcactcaacatgg

SEQ ID NO: 71064 - DNA, 20 bp, synthetic construct
  misc_feature 1..20: note = CRISPR gRNA sequence
  source 1..20: mol_type = other DNA
tcactcaacatggggtgatg

SEQ ID NO: 71065 - DNA, 20 bp, synthetic construct
  misc_feature 1..20: note = CRISPR gRNA sequence
  source 1..20: mol_type = other DNA
aacatggggtgatggggctc

SEQ ID NO: 71066 - DNA, 20 bp, synthetic construct
  misc_feature 1..20: note = CRISPR gRNA sequence
  source 1..20: mol_type = other DNA
tctgtgtgagtcgaggccct

SEQ ID NO: 71067 - DNA, 20 bp, synthetic construct
  misc_feature 1..20: note = CRISPR gRNA sequence
  source 1..20: mol_type = other DNA
tgtgtgagtcgaggcccttc

SEQ ID NO: 71068 - DNA, 20 bp, synthetic construct
  misc_feature 1..20: note = CRISPR gRNA sequence
  source 1..20: mol_type = other DNA
tgtgagtcgaggcccttcct

SEQ ID NO: 71069 - DNA, 20 bp, synthetic construct
  misc_feature 1..20: note = CRISPR gRNA sequence
  source 1..20: mol_type = other DNA
cctgggacttcagcctcccc

SEQ ID NO: 71070 - DNA, 20 bp, synthetic construct
  misc_feature 1..20: note = CRISPR gRNA sequence
  source 1..20: mol_type = other DNA
ctgggacttcagcctcccct

SEQ ID NO: 71071 - DNA, 20 bp, synthetic construct
  misc_feature 1..20: note = CRISPR gRNA sequence
  source 1..20: mol_type = other DNA
ggacttcagcctccccttct

SEQ ID NO: 71072 - DNA, 20 bp, synthetic construct
  misc_feature 1..20: note = CRISPR gRNA sequence
  source 1..20: mol_type = other DNA
cagcctccccttctttttct

SEQ ID NO: 71073 - DNA, 20 bp, synthetic construct
  misc_feature 1..20: note = CRISPR gRNA sequence
  source 1..20: mol_type = other DNA
agcctccccttctttttctg

SEQ ID NO: 71074 - DNA, 20 bp, synthetic construct
  misc_feature 1..20: note = CRISPR gRNA sequence
  source 1..20: mol_type = other DNA
cccttctttttctgggagtg

SEQ ID NO: 71075 - DNA, 20 bp, synthetic construct
  misc_feature 1..20: note = CRISPR gRNA sequence
  source 1..20: mol_type = other DNA
ctttttctgggagtggggtg

SEQ ID NO: 71076 - DNA, 20 bp, synthetic construct
  misc_feature 1..20: note = CRISPR gRNA sequence
  source 1..20: mol_type = other DNA
tttttctgggagtggggtgt

SEQ ID NO: 71077 - DNA, 20 bp, synthetic construct
  misc_feature 1..20: note = CRISPR gRNA sequence
  source 1..20: mol_type = other DNA
tttctgggagtggggtgtgg

SEQ ID NO: 71078 - DNA, 20 bp, synthetic construct
  misc_feature 1..20: note = CRISPR gRNA sequence
  source 1..20: mol_type = other DNA
ttctgggagtggggtgtgga

SEQ ID NO: 71079 - DNA, 20 bp, synthetic construct
  misc_feature 1..20: note = CRISPR gRNA sequence
  source 1..20: mol_type = other DNA
tctgggagtggggtgtggac

SEQ ID NO: 71080 - DNA, 20 bp, synthetic construct
  misc_feature 1..20: note = CRISPR gRNA sequence
  source 1..20: mol_type = other DNA
ctgggagtggggtgtggaca

SEQ ID NO: 71081 - DNA, 20 bp, synthetic construct
  misc_feature 1..20: note = CRISPR gRNA sequence
  source 1..20: mol_type = other DNA
tgggagtggggtgtggacaa

SEQ ID NO: 71082 - DNA, 20 bp, synthetic construct
  misc_feature 1..20: note = CRISPR gRNA sequence
  source 1..20: mol_type = other DNA
ggagtggggtgtggacaaga

SEQ ID NO: 71083 - DNA, 20 bp, synthetic construct
  misc_feature 1..20: note = CRISPR gRNA sequence
  source 1..20: mol_type = other DNA
atgaagctgttttctccccc

SEQ ID NO: 71084 - DNA, 20 bp, synthetic construct
  misc_feature 1..20: note = CRISPR gRNA sequence
  source 1..20: mol_type = other DNA
ttttctcccccaagcttgag

SEQ ID NO: 71085 - DNA, 20 bp, synthetic construct
  misc_feature 1..20: note = CRISPR gRNA sequence
  source 1..20: mol_type = other DNA
tctcccccaagcttgagcca

SEQ ID NO: 71086 - DNA, 20 bp, synthetic construct
  misc_feature 1..20: note = CRISPR gRNA sequence
  source 1..20: mol_type = other DNA
ctcccccaagcttgagccac

SEQ ID NO: 71087 - DNA, 20 bp, synthetic construct
  misc_feature 1..20: note = CRISPR gRNA sequence
  source 1..20: mol_type = other DNA
tcccccaagcttgagccaca

SEQ ID NO: 71088 - DNA, 20 bp, synthetic construct
  misc_feature 1..20: note = CRISPR gRNA sequence
  source 1..20: mol_type = other DNA
ccccaagcttgagccacaac

SEQ ID NO: 71089 - DNA, 20 bp, synthetic construct
  misc_feature 1..20: note = CRISPR gRNA sequence
  source 1..20: mol_type = other DNA
gagccacaaccagattggag

SEQ ID NO: 71090 - DNA, 20 bp, synthetic construct
  misc_feature 1..20: note = CRISPR gRNA sequence
  source 1..20: mol_type = other DNA
agccacaaccagattggaga

SEQ ID NO: 71091 - DNA, 20 bp, synthetic construct
  misc_feature 1..20: note = CRISPR gRNA sequence
  source 1..20: mol_type = other DNA
gagacgctggtgtccagcac

SEQ ID NO: 71092 - DNA, 20 bp, synthetic construct
  misc_feature 1..20: note = CRISPR gRNA sequence
  source 1..20: mol_type = other DNA
gtgtccagcacttagctacc

SEQ ID NO: 71093 - DNA, 20 bp, synthetic construct
  misc_feature 1..20: note = CRISPR gRNA sequence
  source 1..20: mol_type = other DNA
agctaccatcctgcctgggc

SEQ ID NO: 71094 - DNA, 20 bp, synthetic construct
  misc_feature 1..20: note = CRISPR gRNA sequence
  source 1..20: mol_type = other DNA
gctaccatcctgcctgggct

SEQ ID NO: 71095 - DNA, 20 bp, synthetic construct
  misc_feature 1..20: note = CRISPR gRNA sequence
  source 1..20: mol_type = other DNA
ccatcctgcctgggctgcca

SEQ ID NO: 71096 - DNA, 20 bp, synthetic construct
  misc_feature 1..20: note = CRISPR gRNA sequence
  source 1..20: mol_type = other DNA
cctgggctgccagagctcag

SEQ ID NO: 71097 - DNA, 20 bp, synthetic construct
  misc_feature 1..20: note = CRISPR gRNA sequence
  source 1..20: mol_type = other DNA
ggctgccagagctcaggaag

SEQ ID NO: 71098 - DNA, 20 bp, synthetic construct
  misc_feature 1..20: note = CRISPR gRNA sequence
  source 1..20: mol_type = other DNA
ccagagctcaggaagataga

SEQ ID NO: 71099 - DNA, 20 bp, synthetic construct
  misc_feature 1..20: note = CRISPR gRNA sequence
  source 1..20: mol_type = other DNA
aggaagatagagtgagtagc

SEQ ID NO: 71100 - DNA, 20 bp, synthetic construct
  misc_feature 1..20: note = CRISPR gRNA sequence
  source 1..20: mol_type = other DNA
cagaggagggccacaggggt

SEQ ID NO: 71101 - DNA, 20 bp, synthetic construct
  misc_feature 1..20: note = CRISPR gRNA sequence
  source 1..20: mol_type = other DNA
ggagatactggcccctagct

SEQ ID NO: 71102 - DNA, 20 bp, synthetic construct
  misc_feature 1..20: note = CRISPR gRNA sequence
  source 1..20: mol_type = other DNA
gcccctagctgaggccagca

SEQ ID NO: 71103 - DNA, 20 bp, synthetic construct
  misc_feature 1..20: note = CRISPR gRNA sequence
  source 1..20: mol_type = other DNA
gctgaggccagcatggtaaa

SEQ ID NO: 71104 - DNA, 20 bp, synthetic construct
  misc_feature 1..20: note = CRISPR gRNA sequence
  source 1..20: mol_type = other DNA
aggccagcatggtaaaatct

SEQ ID NO: 71105 - DNA, 20 bp, synthetic construct
  misc_feature 1..20: note = CRISPR gRNA sequence
  source 1..20: mol_type = other DNA
ccctgcgccaacctcagtgt

SEQ ID NO: 71106 - DNA, 20 bp, synthetic construct
  misc_feature 1..20: note = CRISPR gRNA sequence
  source 1..20: mol_type = other DNA
cgccaacctcagtgtccagg

SEQ ID NO: 71107 - DNA, 20 bp, synthetic construct
  misc_feature 1..20: note = CRISPR gRNA sequence
  source 1..20: mol_type = other DNA
agtgtccaggcagtggggct

SEQ ID NO: 71108 - DNA, 20 bp, synthetic construct
  misc_feature 1..20: note = CRISPR gRNA sequence
  source 1..20: mol_type = other DNA
ggtgacctcctggccctcac

SEQ ID NO: 71109 - DNA, 20 bp, synthetic construct
  misc_feature 1..20: note = CRISPR gRNA sequence
  source 1..20: mol_type = other DNA
ctggccctcactgcgggacc

SEQ ID NO: 71110 - DNA, 20 bp, synthetic construct
  misc_feature 1..20: note = CRISPR gRNA sequence
  source 1..20: mol_type = other DNA
gccctcactgcgggacctta

SEQ ID NO: 71111 - DNA, 20 bp, synthetic construct
  misc_feature 1..20: note = CRISPR gRNA sequence
  source 1..20: mol_type = other DNA
actgcgggaccttaagccac

SEQ ID NO: 71112 - DNA, 20 bp, synthetic construct
  misc_feature 1..20: note = CRISPR gRNA sequence
  source 1..20: mol_type = other DNA
cgggaccttaagccacccca

SEQ ID NO: 71113 - DNA, 20 bp, synthetic construct
  misc_feature 1..20: note = CRISPR gRNA sequence
  source 1..20: mol_type = other DNA
aagccaccccagcccctgct

SEQ ID NO: 71114 - DNA, 20 bp, synthetic construct
  misc_feature 1..20: note = CRISPR gRNA sequence
  source 1..20: mol_type = other DNA
agccaccccagcccctgctc

SEQ ID NO: 71115 - DNA, 20 bp, synthetic construct
  misc_feature 1..20: note = CRISPR gRNA sequence
  source 1..20: mol_type = other DNA
ctcttctctgggcctttctg

SEQ ID NO: 71116 - DNA, 20 bp, synthetic construct
  misc_feature 1..20: note = CRISPR gRNA sequence
  source 1..20: mol_type = other DNA
ttctctgggcctttctgcct

SEQ ID NO: 71117 - DNA, 20 bp, synthetic construct
  misc_feature 1..20: note = CRISPR gRNA sequence
  source 1..20: mol_type = other DNA
ctctgggcctttctgcctca

SEQ ID NO: 71118 - DNA, 20 bp, synthetic construct
  misc_feature 1..20: note = CRISPR gRNA sequence
  source 1..20: mol_type = other DNA
tctgggcctttctgcctcat

SEQ ID NO: 71119 - DNA, 20 bp, synthetic construct
  misc_feature 1..20: note = CRISPR gRNA sequence
  source 1..20: mol_type = other DNA
tgggcctttctgcctcattg

SEQ ID NO: 71120 - DNA, 20 bp, synthetic construct
  misc_feature 1..20: note = CRISPR gRNA sequence
  source 1..20: mol_type = other DNA
ggcctttctgcctcattgtc

SEQ ID NO: 71121 - DNA, 20 bp, synthetic construct
  misc_feature 1..20: note = CRISPR gRNA sequence
  source 1..20: mol_type = other DNA
tctgcctcattgtctgggta

SEQ ID NO: 71122 - DNA, 20 bp, synthetic construct
  misc_feature 1..20: note = CRISPR gRNA sequence
  source 1..20: mol_type = other DNA
ctgcctcattgtctgggtag

SEQ ID NO: 71123 - DNA, 20 bp, synthetic construct
  misc_feature 1..20: note = CRISPR gRNA sequence
  source 1..20: mol_type = other DNA
tgcctcattgtctgggtagg

SEQ ID NO: 71124 - DNA, 20 bp, synthetic construct
  misc_feature 1..20: note = CRISPR gRNA sequence
  source 1..20: mol_type = other DNA
cctcattgtctgggtaggtg

SEQ ID NO: 71125 - DNA, 20 bp, synthetic construct
  misc_feature 1..20: note = CRISPR gRNA sequence
  source 1..20: mol_type = other DNA
attgtctgggtaggtgtgtg

SEQ ID NO: 71126 - DNA, 20 bp, synthetic construct
  misc_feature 1..20: note = CRISPR gRNA sequence
  source 1..20: mol_type = other DNA
tctgggtaggtgtgtggtgt

SEQ ID NO: 71127 - DNA, 20 bp, synthetic construct
  misc_feature 1..20: note = CRISPR gRNA sequence
  source 1..20: mol_type = other DNA
ggtaggtgtgtggtgtcggg

SEQ ID NO: 71128 - DNA, 20 bp, synthetic construct
  misc_feature 1..20: note = CRISPR gRNA sequence
  source 1..20: mol_type = other DNA
tctcttaggccccctgaagc

SEQ ID NO: 71129 - DNA, 20 bp, synthetic construct
  misc_feature 1..20: note = CRISPR gRNA sequence
  source 1..20: mol_type = other DNA
ttaggccccctgaagcaggg

SEQ ID NO: 71130 - DNA, 20 bp, synthetic construct
  misc_feature 1..20: note = CRISPR gRNA sequence
  source 1..20: mol_type = other DNA
aggccccctgaagcaggggt

SEQ ID NO: 71131 - DNA, 20 bp, synthetic construct
  misc_feature 1..20: note = CRISPR gRNA sequence
  source 1..20: mol_type = other DNA
ggccccctgaagcaggggtg

SEQ ID NO: 71132 - DNA, 20 bp, synthetic construct
  misc_feature 1..20: note = CRISPR gRNA sequence
  source 1..20: mol_type = other DNA
aagcaggggtggcagaccca

SEQ ID NO: 71133 - DNA, 20 bp, synthetic construct
  misc_feature 1..20: note = CRISPR gRNA sequence
  source 1..20: mol_type = other DNA
gggtgtcggggagagggggc

SEQ ID NO: 71134 - DNA, 20 bp, synthetic construct
  misc_feature 1..20: note = CRISPR gRNA sequence
  source 1..20: mol_type = other DNA
atggctgcccccctcccaca

SEQ ID NO: 71135 - DNA, 20 bp, synthetic construct
  misc_feature 1..20: note = CRISPR gRNA sequence
  source 1..20: mol_type = other DNA
cccccctcccacagcctctc

SEQ ID NO: 71136 - DNA, 20 bp, synthetic construct
  misc_feature 1..20: note = CRISPR gRNA sequence
  source 1..20: mol_type = other DNA
ccacagcctctcagggaata

SEQ ID NO: 71137 - DNA, 20 bp, synthetic construct
  misc_feature 1..20: note = CRISPR gRNA sequence
  source 1..20: mol_type = other DNA
tcagggaatagcatcagctc

SEQ ID NO: 71138 - DNA, 20 bp, synthetic construct
  misc_feature 1..20: note = CRISPR gRNA sequence
  source 1..20: mol_type = other DNA
agggaatagcatcagctcag

SEQ ID NO: 71139 - DNA, 20 bp, synthetic construct
  misc_feature 1..20: note = CRISPR gRNA sequence
  source 1..20: mol_type = other DNA
agccgggggagtgcagttgg

SEQ ID NO: 71140 - DNA, 20 bp, synthetic construct
  misc_feature 1..20: note = CRISPR gRNA sequence
  source 1..20: mol_type = other DNA
gcagagtctctcgttctttg

SEQ ID NO: 71141 - DNA, 20 bp, synthetic construct
  misc_feature 1..20: note = CRISPR gRNA sequence
  source 1..20: mol_type = other DNA
tcgttctttgcaggcgcctg

SEQ ID NO: 71142 - DNA, 20 bp, synthetic construct
  misc_feature 1..20: note = CRISPR gRNA sequence
  source 1..20: mol_type = other DNA
gttctttgcaggcgcctgga

SEQ ID NO: 71143 - DNA, 20 bp, synthetic construct
  misc_feature 1..20: note = CRISPR gRNA sequence
  source 1..20: mol_type = other DNA
tttgcaggcgcctggaggag

SEQ ID NO: 71144 - DNA, 20 bp, synthetic construct
  misc_feature 1..20: note = CRISPR gRNA sequence
  source 1..20: mol_type = other DNA
tgcaggcgcctggaggagtt

SEQ ID NO: 71145 - DNA, 20 bp, synthetic construct
  misc_feature 1..20: note = CRISPR gRNA sequence
  source 1..20: mol_type = other DNA
gcaggcgcctggaggagttg

SEQ ID NO: 71146 - DNA, 20 bp, synthetic construct
  misc_feature 1..20: note = CRISPR gRNA sequence
  source 1..20: mol_type = other DNA
caggcgcctggaggagttga

SEQ ID NO: 71147 - DNA, 20 bp, synthetic construct
  misc_feature 1..20: note = CRISPR gRNA sequence
  source 1..20: mol_type = other DNA
gaggagttgatgtgagtgtc

SEQ ID NO: 71148 - DNA, 20 bp, synthetic construct
  misc_feature 1..20: note = CRISPR gRNA sequence
  source 1..20: mol_type = other DNA
atgtgagtgtctgcccaggt

SEQ ID NO: 71149 - DNA, 20 bp, synthetic construct
  misc_feature 1..20: note = CRISPR gRNA sequence
  source 1..20: mol_type = other DNA
cccaggtggcctctgccctc

SEQ ID NO: 71150 - DNA, 20 bp, synthetic construct
  misc_feature 1..20: note = CRISPR gRNA sequence
  source 1..20: mol_type = other DNA
tgccctctgtgccccccagg

SEQ ID NO: 71151 - DNA, 20 bp, synthetic construct
  misc_feature 1..20: note = CRISPR gRNA sequence
  source 1..20: mol_type = other DNA
ccctctgtgccccccaggtc

SEQ ID NO: 71152 - DNA, 20 bp, synthetic construct
  misc_feature 1..20: note = CRISPR gRNA sequence
  source 1..20: mol_type = other DNA
tgtgccccccaggtccacct

SEQ ID NO: 71153 - DNA, 20 bp, synthetic construct
  misc_feature 1..20: note = CRISPR gRNA sequence
  source 1..20: mol_type = other DNA
tgccccccaggtccacctgg

SEQ ID NO: 71154 - DNA, 20 bp, synthetic construct
  misc_feature 1..20: note = CRISPR gRNA sequence
  source 1..20: mol_type = other DNA
gcctcctctcccgcagtggg

SEQ ID NO: 71155 - DNA, 20 bp, synthetic construct
  misc_feature 1..20: note = CRISPR gRNA sequence
  source 1..20: mol_type = other DNA
ctctcccgcagtgggcacag

SEQ ID NO: 71156 - DNA, 20 bp, synthetic construct
  misc_feature 1..20: note = CRISPR gRNA sequence
  source 1..20: mol_type = other DNA
tcccgcagtgggcacagggc

SEQ ID NO: 71157 - DNA, 20 bp, synthetic construct
  misc_feature 1..20: note = CRISPR gRNA sequence
  source 1..20: mol_type = other DNA
ccgcagtgggcacagggcag

SEQ ID NO: 71158 - DNA, 20 bp, synthetic construct
  misc_feature 1..20: note = CRISPR gRNA sequence
  source 1..20: mol_type = other DNA
aatgctcattcctctcctct

SEQ ID NO: 71159 - DNA, 20 bp, synthetic construct
  misc_feature 1..20: note = CRISPR gRNA sequence
  source 1..20: mol_type = other DNA
attcctctcctcttccaggc

SEQ ID NO: 71160 - DNA, 20 bp, synthetic construct
  misc_feature 1..20: note = CRISPR gRNA sequence
  source 1..20: mol_type = other DNA
ctctcctcttccaggcttgg

SEQ ID NO: 71161 - DNA, 20 bp, synthetic construct
  misc_feature 1..20: note = CRISPR gRNA sequence
  source 1..20: mol_type = other DNA
tcctcttccaggcttggctg

SEQ ID NO: 71162 - DNA, 20 bp, synthetic construct
  misc_feature 1..20: note = CRISPR gRNA sequence
  source 1..20: mol_type = other DNA
ctcttccaggcttggctgca

SEQ ID NO: 71163 - DNA, 20 bp, synthetic construct
  misc_feature 1..20: note = CRISPR gRNA sequence
  source 1..20: mol_type = other DNA
ttccaggcttggctgcaatg

SEQ ID NO: 71164 - DNA, 20 bp, synthetic construct
  misc_feature 1..20: note = CRISPR gRNA sequence
  source 1..20: mol_type = other DNA
ccaggcttggctgcaatgcc

SEQ ID NO: 71165 - DNA, 20 bp, synthetic construct
  misc_feature 1..20: note = CRISPR gRNA sequence
  source 1..20: mol_type = other DNA
caggcttggctgcaatgccc

SEQ ID NO: 71166 - DNA, 20 bp, synthetic construct
  misc_feature 1..20: note = CRISPR gRNA sequence
  source 1..20: mol_type = other DNA
ggctgcaatgccctggggga

SEQ ID NO: 71167 - DNA, 20 bp, synthetic construct
  misc_feature 1..20: note = CRISPR gRNA sequence
  source 1..20: mol_type = other DNA
gctgcaatgccctgggggat

SEQ ID NO: 71168 - DNA, 20 bp, synthetic construct
  misc_feature 1..20: note = CRISPR gRNA sequence
  source 1..20: mol_type = other DNA
caatgccctgggggatccca

SEQ ID NO: 71169 - DNA, 20 bp, synthetic construct
  misc_feature 1..20: note = CRISPR gRNA sequence
  source 1..20: mol_type = other DNA
ggggatcccacagccctggg

SEQ ID NO: 71170 - DNA, 20 bp, synthetic construct
  misc_feature 1..20: note = CRISPR gRNA sequence
  source 1..20: mol_type = other DNA
gggctggctcaggagctgcc

SEQ ID NO: 71171 - DNA, 20 bp, synthetic construct
  misc_feature 1..20: note = CRISPR gRNA sequence
  source 1..20: mol_type = other DNA
gctcaggagctgccccagca

SEQ ID NO: 71172 - DNA, 20 bp, synthetic construct
  misc_feature 1..20: note = CRISPR gRNA sequence
  source 1..20: mol_type = other DNA
aggagctgccccagcacctg

SEQ ID NO: 71173 - DNA, 20 bp, synthetic construct
  misc_feature 1..20: note = CRISPR gRNA sequence
  source 1..20: mol_type = other DNA
ccccagcacctgagggtcct

SEQ ID NO: 71174 - DNA, 20 bp, synthetic construct
  misc_feature 1..20: note = CRISPR gRNA sequence
  source 1..20: mol_type = other DNA
agggtcctacagtgagtggc

SEQ ID NO: 71175 - DNA, 20 bp, synthetic construct
  misc_feature 1..20: note = CRISPR gRNA sequence
  source 1..20: mol_type = other DNA
cagtgagtggccccctgccc

SEQ ID NO: 71176 - DNA, 20 bp, synthetic construct
  misc_feature 1..20: note = CRISPR gRNA sequence
  source 1..20: mol_type = other DNA
cccataccatgcagggctgg

SEQ ID NO: 71177 - DNA, 20 bp, synthetic construct
  misc_feature 1..20: note = CRISPR gRNA sequence
  source 1..20: mol_type = other DNA
gtggggaggagggtcctcgg

SEQ ID NO: 71178 - DNA, 20 bp, synthetic construct
  misc_feature 1..20: note = CRISPR gRNA sequence
  source 1..20: mol_type = other DNA
gggagcagtgggggggtcca

SEQ ID NO: 71179 - DNA, 20 bp, synthetic construct
  misc_feature 1..20: note = CRISPR gRNA sequence
  source 1..20: mol_type = other DNA
agctgccctgccccaagtca

SEQ ID NO: 71180 - DNA, 20 bp, synthetic construct
  misc_feature 1..20: note = CRISPR gRNA sequence
  source 1..20: mol_type = other DNA
ccctgccccaagtcaagctt

SEQ ID NO: 71181 - DNA, 20 bp, synthetic construct
  misc_feature 1..20: note = CRISPR gRNA sequence
  source 1..20: mol_type = other DNA
ccccaagtcaagcttggcat

SEQ ID NO: 71182 - DNA, 20 bp, synthetic construct
  misc_feature 1..20: note = CRISPR gRNA sequence
  source 1..20: mol_type = other DNA
ggcatatacccactctcctg

SEQ ID NO: 71183 - DNA, 20 bp, synthetic construct
  misc_feature 1..20: note = CRISPR gRNA sequence
  source 1..20: mol_type = other DNA
gcatatacccactctcctgc

SEQ ID NO: 71184 - DNA, 20 bp, synthetic construct
  misc_feature 1..20: note = CRISPR gRNA sequence
  source 1..20: mol_type = other DNA
tcctgcctgttccttccctg

SEQ ID NO: 71185 - DNA, 20 bp, synthetic construct
  misc_feature 1..20: note = CRISPR gRNA sequence
  source 1..20: mol_type = other DNA
ctgcctgttccttccctgcc

SEQ ID NO: 71186 - DNA, 20 bp, synthetic construct
  misc_feature 1..20: note = CRISPR gRNA sequence
  source 1..20: mol_type = other DNA
cctgttccttccctgcctct

SEQ ID NO: 71187 - DNA, 20 bp, synthetic construct
  misc_feature 1..20: note = CRISPR gRNA sequence
  source 1..20: mol_type = other DNA
ttccttccctgcctctgatg

SEQ ID NO: 71188 - DNA, 20 bp, synthetic construct
  misc_feature 1..20: note = CRISPR gRNA sequence
  source 1..20: mol_type = other DNA
cttccctgcctctgatgtct

SEQ ID NO: 71189 - DNA, 20 bp, synthetic construct
  misc_feature 1..20: note = CRISPR gRNA sequence
  source 1..20: mol_type = other DNA
ccctgcctctgatgtctgca

SEQ ID NO: 71190 - DNA, 20 bp, synthetic construct
  misc_feature 1..20: note = CRISPR gRNA sequence
  source 1..20: mol_type = other DNA
cctgcctctgatgtctgcag

SEQ ID NO: 71191 - DNA, 20 bp, synthetic construct
  misc_feature 1..20: note = CRISPR gRNA sequence
  source 1..20: mol_type = other DNA
cctctgatgtctgcagcaag

SEQ ID NO: 71192 - DNA, 20 bp, synthetic construct
  misc_feature 1..20: note = CRISPR gRNA sequence
  source 1..20: mol_type = other DNA
tgatgtctgcagcaagaaaa

SEQ ID NO: 71193 - DNA, 20 bp, synthetic construct
  misc_feature 1..20: note = CRISPR gRNA sequence
  source 1..20: mol_type = other DNA
atgtctgcagcaagaaaatc

SEQ ID NO: 71194 - DNA, 20 bp, synthetic construct
  misc_feature 1..20: note = CRISPR gRNA sequence
  source 1..20: mol_type = other DNA
cagcaagaaaatcaggaggc

SEQ ID NO: 71195 - DNA, 20 bp, synthetic construct
  misc_feature 1..20: note = CRISPR gRNA sequence
  source 1..20: mol_type = other DNA
gtcctggctctgccactggc

SEQ ID NO: 71196 - DNA, 20 bp, synthetic construct
  misc_feature 1..20: note = CRISPR gRNA sequence
  source 1..20: mol_type = other DNA
gctctgccactggcccctgc

SEQ ID NO: 71197 - DNA, 20 bp, synthetic construct
  misc_feature 1..20: note = CRISPR gRNA sequence
  source 1..20: mol_type = other DNA
tgccactggcccctgcctga

SEQ ID NO: 71198 - DNA, 20 bp, synthetic construct
  misc_feature 1..20: note = CRISPR gRNA sequence
  source 1..20: mol_type = other DNA
ccactggcccctgcctgacc

SEQ ID NO: 71199 - DNA, 20 bp, synthetic construct
  misc_feature 1..20: note = CRISPR gRNA sequence
  source 1..20: mol_type = other DNA
gcccctgcctgaccttggcc

SEQ ID NO: 71200 - DNA, 20 bp, synthetic construct
  misc_feature 1..20: note = CRISPR gRNA sequence
  source 1..20: mol_type = other DNA
cctgaccttggccaaacccc

SEQ ID NO: 71201 - DNA, 20 bp, synthetic construct
  misc_feature 1..20: note = CRISPR gRNA sequence
  source 1..20: mol_type = other DNA
accttggccaaacccctgcc

SEQ ID NO: 71202 - DNA, 20 bp, synthetic construct
  misc_feature 1..20: note = CRISPR gRNA sequence
  source 1..20: mol_type = other DNA
ggccaaacccctgccccttc

SEQ ID NO: 71203 - DNA, 20 bp, synthetic construct
  misc_feature 1..20: note = CRISPR gRNA sequence
  source 1..20: mol_type = other DNA
gccaaacccctgccccttct

SEQ ID NO: 71204 - DNA, 20 bp, synthetic construct
  misc_feature 1..20: note = CRISPR gRNA sequence
  source 1..20: mol_type = other DNA
ccccttctcagcctcagttt

SEQ ID NO: 71205 - DNA, 20 bp, synthetic construct
  misc_feature 1..20: note = CRISPR gRNA sequence
  source 1..20: mol_type = other DNA
ctcagcctcagtttcttcac

SEQ ID NO: 71206 - DNA, 20 bp, synthetic construct
  misc_feature 1..20: note = CRISPR gRNA sequence
  source 1..20: mol_type = other DNA
tcagcctcagtttcttcaca

SEQ ID NO: 71207 - DNA, 20 bp, synthetic construct
  misc_feature 1..20: note = CRISPR gRNA sequence
  source 1..20: mol_type = other DNA
agcctcagtttcttcacatg

SEQ ID NO: 71208 - DNA, 20 bp, synthetic construct
  misc_feature 1..20: note = CRISPR gRNA sequence
  source 1..20: mol_type = other DNA
agtttcttcacatgcaaaag

SEQ ID NO: 71209 - DNA, 20 bp, synthetic construct
  misc_feature 1..20: note = CRISPR gRNA sequence
  source 1..20: mol_type = other DNA
cttcacatgcaaaagaagta

SEQ ID NO: 71210 - DNA, 20 bp, synthetic construct
  misc_feature 1..20: note = CRISPR gRNA sequence
  source 1..20: mol_type = other DNA
ttcacatgcaaaagaagtac

SEQ ID NO: 71211 - DNA, 20 bp, synthetic construct
  misc_feature 1..20: note = CRISPR gRNA sequence
  source 1..20: mol_type = other DNA
cacatgcaaaagaagtacaa

SEQ ID NO: 71212 - DNA, 20 bp, synthetic construct
  misc_feature 1..20: note = CRISPR gRNA sequence
  source 1..20: mol_type = other DNA
acatgcaaaagaagtacaat

SEQ ID NO: 71213 - DNA, 20 bp, synthetic construct
  misc_feature 1..20: note = CRISPR gRNA sequence
  source 1..20: mol_type = other DNA
attgtgccctgtgagcgggt

SEQ ID NO: 71214 - DNA, 20 bp, synthetic construct
  misc_feature 1..20: note = CRISPR gRNA sequence
  source 1..20: mol_type = other DNA
tgccctgtgagcgggtccct

SEQ ID NO: 71215 - DNA, 20 bp, synthetic construct
  misc_feature 1..20: note = CRISPR gRNA sequence
  source 1..20: mol_type = other DNA
tgagcgggtccctgagggcg

SEQ ID NO: 71216 - DNA, 20 bp, synthetic construct
  misc_feature 1..20: note = CRISPR gRNA sequence
  source 1..20: mol_type = other DNA
agggcgaatgagaaatcctg

SEQ ID NO: 71217 - DNA, 20 bp, synthetic construct
  misc_feature 1..20: note = CRISPR gRNA sequence
  source 1..20: mol_type = other DNA
gcagagggcttcgcaggagc

SEQ ID NO: 71218 - DNA, 20 bp, synthetic construct
  misc_feature 1..20: note = CRISPR gRNA sequence
  source 1..20: mol_type = other DNA
cgcaggagcacggtgccaat

SEQ ID NO: 71219 - DNA, 20 bp, synthetic construct
  misc_feature 1..20: note = CRISPR gRNA sequence
  source 1..20: mol_type = other DNA
gcaggagcacggtgccaatc

SEQ ID NO: 71220 - DNA, 20 bp, synthetic construct
  misc_feature 1..20: note = CRISPR gRNA sequence
  source 1..20: mol_type = other DNA
agcacttcacaaatgacctc

SEQ ID NO: 71221 - DNA, 20 bp, synthetic construct
  misc_feature 1..20: note = CRISPR gRNA sequence
  source 1..20: mol_type = other DNA
cacaaatgacctcattgcag

SEQ ID NO: 71222 - DNA, 20 bp, synthetic construct
  misc_feature 1..20: note = CRISPR gRNA sequence
  source 1..20: mol_type = other DNA
acaaatgacctcattgcagc

SEQ ID NO: 71223 - DNA, 20 bp, synthetic construct
  misc_feature 1..20: note = CRISPR gRNA sequence
  source 1..20: mol_type = other DNA
attgcagccccatggcagcc

SEQ ID NO: 71224 - DNA, 20 bp, synthetic construct
  misc_feature 1..20: note = CRISPR gRNA sequence
  source 1..20: mol_type = other DNA
cagccccatggcagccccca

SEQ ID NO: 71225 - DNA, 20 bp, synthetic construct
  misc_feature 1..20: note = CRISPR gRNA sequence
  source 1..20: mol_type = other DNA
ggaccttgtttttttttttt

SEQ ID NO: 71226 - DNA, 20 bp, synthetic construct
  misc_feature 1..20: note = CRISPR gRNA sequence
  source 1..20: mol_type = other DNA
gttttttttttttttttttt

SEQ ID NO: 71227 - DNA, 20 bp, synthetic construct
  misc_feature 1..20: note = CRISPR gRNA sequence
  source 1..20: mol_type = other DNA
tttttttttttttttttttt

SEQ ID NO: 71228 - DNA, 20 bp, synthetic construct
  misc_feature 1..20: note = CRISPR gRNA sequence
  source 1..20: mol_type = other DNA
tttttttttttttttttttt

SEQ ID NO: 71229 - DNA, 20 bp, synthetic construct
  misc_feature 1..20: note = CRISPR gRNA sequence
  source 1..20: mol_type = other DNA
tttttttttttttttttttt

SEQ ID NO: 71230 - DNA, 20 bp, synthetic construct
  misc_feature 1..20: note = CRISPR gRNA sequence
  source 1..20: mol_type = other DNA
ttttttttttttttttttta

SEQ ID NO: 71231 - DNA, 20 bp, synthetic construct
  misc_feature 1..20: note = CRISPR gRNA sequence
  source 1..20: mol_type = other DNA
ttttttttttttttttttag

SEQ ID NO: 71232 - DNA, 20 bp, synthetic construct
  misc_feature 1..20: note = CRISPR gRNA sequence
  source 1..20: mol_type = other DNA
tttttttttttttttttaga

SEQ ID NO: 71233 - DNA, 20 bp, synthetic construct
  misc_feature 1..20: note = CRISPR gRNA sequence
  source 1..20: mol_type = other DNA
ttttttttttttttttagat

SEQ ID NO: 71234 - DNA, 20 bp, synthetic construct
  misc_feature 1..20: note = CRISPR gRNA sequence
  source 1..20: mol_type = other DNA
tttttttttttttttagatg

SEQ ID NO: 71235 - DNA, 20 bp, synthetic construct
  misc_feature 1..20: note = CRISPR gRNA sequence
  source 1..20: mol_type = other DNA
ttttttttttttttagatgg

SEQ ID NO: 71236 - DNA, 20 bp, synthetic construct
  misc_feature 1..20: note = CRISPR gRNA sequence
  source 1..20: mol_type = other DNA
tttttttttttttagatgga

SEQ ID NO: 71237 - DNA, 20 bp, synthetic construct
  misc_feature 1..20: note = CRISPR gRNA sequence
  source 1..20: mol_type = other DNA
ttttttttttttagatggag

SEQ ID NO: 71238 - DNA, 20 bp, synthetic construct
  misc_feature 1..20: note = CRISPR gRNA sequence
  source 1..20: mol_type = other DNA
tttttttttttagatggagt

SEQ ID NO: 71239 - DNA, 20 bp, synthetic construct
  misc_feature 1..20: note = CRISPR gRNA sequence
  source 1..20: mol_type = other DNA
ttttttttttagatggagtc

SEQ ID NO: 71240 - DNA, 20 bp, synthetic construct
  misc_feature 1..20: note = CRISPR gRNA sequence
  source 1..20: mol_type = other DNA
tttttttttagatggagtct

SEQ ID NO: 71241 - DNA, 20 bp, synthetic construct
  misc_feature 1..20: note = CRISPR gRNA sequence
  source 1..20: mol_type = other DNA
ttttttttagatggagtctc

SEQ ID NO: 71242 - DNA, 20 bp, synthetic construct
  misc_feature 1..20: note = CRISPR gRNA sequence
  source 1..20: mol_type = other DNA
tttttttagatggagtctct

SEQ ID NO: 71243 - DNA, 20 bp, synthetic construct
  misc_feature 1..20: note = CRISPR gRNA sequence
  source 1..20: mol_type = other DNA
ttttttagatggagtctctc

SEQ ID NO: 71244 - DNA, 20 bp, synthetic construct
  misc_feature 1..20: note = CRISPR gRNA sequence
  source 1..20: mol_type = other DNA
tttttagatggagtctctct

SEQ ID NO: 71245 - DNA, 20 bp, synthetic construct
  misc_feature 1..20: note = CRISPR gRNA sequence
  source 1..20: mol_type = other DNA
ttttagatggagtctctctc

SEQ ID NO: 71246 - DNA, 20 bp, synthetic construct
  misc_feature 1..20: note = CRISPR gRNA sequence
  source 1..20: mol_type = other DNA
tttagatggagtctctctct

SEQ ID NO: 71247 - DNA, 20 bp, synthetic construct
  misc_feature 1..20: note = CRISPR gRNA sequence
  source 1..20: mol_type = other DNA
ttagatggagtctctctctg

SEQ ID NO: 71248 - DNA, 20 bp, synthetic construct
  misc_feature 1..20: note = CRISPR gRNA sequence
  source 1..20: mol_type = other DNA
tagatggagtctctctctgt

SEQ ID NO: 71249 - DNA, 20 bp, synthetic construct
  misc_feature 1..20: note = CRISPR gRNA sequence
  source 1..20: mol_type = other DNA
agatggagtctctctctgtc

SEQ ID NO: 71250 - DNA, 20 bp, synthetic construct
  misc_feature 1..20: note = CRISPR gRNA sequence
  source 1..20: mol_type = other DNA
gatggagtctctctctgtca

SEQ ID NO: 71251 - DNA, 20 bp, synthetic construct
  misc_feature 1..20: note = CRISPR gRNA sequence
  source 1..20: mol_type = other DNA
tctctgtcacccaggctgga

SEQ ID NO: 71252 - DNA, 20 bp, synthetic construct
  misc_feature 1..20: note = CRISPR gRNA sequence
  source 1..20: mol_type = other DNA
tctgtcacccaggctggagt

SEQ ID NO: 71253 - DNA, 20 bp, synthetic construct
  misc_feature 1..20: note = CRISPR gRNA sequence
  source 1..20: mol_type = other DNA
tgtcacccaggctggagtgc

SEQ ID NO: 71254 - DNA, 20 bp, synthetic construct
  misc_feature 1..20: note = CRISPR gRNA sequence
  source 1..20: mol_type = other DNA
tcacccaggctggagtgcag

SEQ ID NO: 71255 - DNA, 20 bp, synthetic construct
  misc_feature 1..20: note = CRISPR gRNA sequence
  source 1..20: mol_type = other DNA
gagtgcagtggtgcaacctc

SEQ ID NO: 71256 - DNA, 20 bp, synthetic construct
  misc_feature 1..20: note = CRISPR gRNA sequence
  source 1..20: mol_type = other DNA
ggctcactgcaacctccacc

SEQ ID NO: 71257 - DNA, 20 bp, synthetic construct
  misc_feature 1..20: note = CRISPR gRNA sequence
  source 1..20: mol_type = other DNA
actgcaacctccacctcccg

SEQ ID NO: 71258 - DNA, 20 bp, synthetic construct
  misc_feature 1..20: note = CRISPR gRNA sequence
  source 1..20: mol_type = other DNA
caacctccacctcccgggtt

SEQ ID NO: 71259 - DNA, 20 bp, synthetic construct
  misc_feature 1..20: note = CRISPR gRNA sequence
  source 1..20: mol_type = other DNA
cacctcccgggttcaagcaa

SEQ ID NO: 71260 - DNA, 20 bp, synthetic construct
  misc_feature 1..20: note = CRISPR gRNA sequence
  source 1..20: mol_type = other DNA
ccgggttcaagcaattcttg

SEQ ID NO: 71261 - DNA, 20 bp, synthetic construct
  misc_feature 1..20: note = CRISPR gRNA sequence
  source 1..20: mol_type = other DNA
aagcaattcttgtgcctcag

SEQ ID NO: 71262 - DNA, 20 bp, synthetic construct
  misc_feature 1..20: note = CRISPR gRNA sequence
  source 1..20: mol_type = other DNA
ttgtgcctcagctaccagag

SEQ ID NO: 71263 - DNA, 20 bp, synthetic construct
  misc_feature 1..20: note = CRISPR gRNA sequence
  source 1..20: mol_type = other DNA
gtgcctcagctaccagagta

SEQ ID NO: 71264 - DNA, 20 bp, synthetic construct
  misc_feature 1..20: note = CRISPR gRNA sequence
  source 1..20: mol_type = other DNA
tgcctcagctaccagagtag

SEQ ID NO: 71265 - DNA, 20 bp, synthetic construct
  misc_feature 1..20: note = CRISPR gRNA sequence
  source 1..20: mol_type = other DNA
agctaccagagtagctggga

SEQ ID NO: 71266 - DNA, 20 bp, synthetic construct
  misc_feature 1..20: note = CRISPR gRNA sequence
  source 1..20: mol_type = other DNA
ccagagtagctgggattacg

SEQ ID NO: 71267 - DNA, 20 bp, synthetic construct
  misc_feature 1..20: note = CRISPR gRNA sequence
  source 1..20: mol_type = other DNA
ggattacgagcatgcccacc

SEQ ID NO: 71268 - DNA, 20 bp, synthetic construct
  misc_feature 1..20: note = CRISPR gRNA sequence
  source 1..20: mol_type = other DNA
cgagcatgcccaccatgccc

SEQ ID NO: 71269 - DNA, 20 bp, synthetic construct
  misc_feature 1..20: note = CRISPR gRNA sequence
  source 1..20: mol_type = other DNA
atttttgtatttttagtaga

SEQ ID NO: 71270 - DNA, 20 bp, synthetic construct
  misc_feature 1..20: note = CRISPR gRNA sequence
  source 1..20: mol_type = other DNA
ttgtatttttagtagagacg

SEQ ID NO: 71271 - DNA, 20 bp, synthetic construct
  misc_feature 1..20: note = CRISPR gRNA sequence
  source 1..20: mol_type = other DNA
tgtatttttagtagagacgg

SEQ ID NO: 71272 - DNA, 20 bp, synthetic construct
  misc_feature 1..20: note = CRISPR gRNA sequence
  source 1..20: mol_type = other DNA
gtatttttagtagagacggc

SEQ ID NO: 71273 - DNA, 20 bp, synthetic construct
  misc_feature 1..20: note = CRISPR gRNA sequence
  source 1..20: mol_type = other DNA
tatttttagtagagacggca

SEQ ID NO: 71274 - DNA, 20 bp, synthetic construct
  misc_feature 1..20: note = CRISPR gRNA sequence
  source 1..20: mol_type = other DNA
ttagtagagacggcatttca

SEQ ID NO: 71275 - DNA, 20 bp, synthetic construct
  misc_feature 1..20: note = CRISPR gRNA sequence
  source 1..20: mol_type = other DNA
tagtagagacggcatttcac

SEQ ID NO: 71276 - DNA, 20 bp, synthetic construct
  misc_feature 1..20: note = CRISPR gRNA sequence
  source 1..20: mol_type = other DNA
agtagagacggcatttcacc

SEQ ID NO: 71277 - DNA, 20 bp, synthetic construct
  misc_feature 1..20: note = CRISPR gRNA sequence
  source 1..20: mol_type = other DNA
gtagagacggcatttcacca

SEQ ID NO: 71278 - DNA, 20 bp, synthetic construct
  misc_feature 1..20: note = CRISPR gRNA sequence
  source 1..20: mol_type = other DNA
caccatattgcccaggctgg

SEQ ID NO: 71279 - DNA, 20 bp, synthetic construct
  misc_feature 1..20: note = CRISPR gRNA sequence
  source 1..20: mol_type = other DNA
accatattgcccaggctggt

SEQ ID NO: 71280 - DNA, 20 bp, synthetic construct
  misc_feature 1..20: note = CRISPR gRNA sequence
  source 1..20: mol_type = other DNA
cccaggctggtcttggactc

SEQ ID NO: 71281 - DNA, 20 bp, synthetic construct
  misc_feature 1..20: note = CRISPR gRNA sequence
  source 1..20: mol_type = other DNA
gtcttggactcctggcctca

SEQ ID NO: 71282 - DNA, 20 bp, synthetic construct
  misc_feature 1..20: note = CRISPR gRNA sequence
  source 1..20: mol_type = other DNA
ggactcctggcctcaagtga

SEQ ID NO: 71283 - DNA, 20 bp, synthetic construct
  misc_feature 1..20: note = CRISPR gRNA sequence
  source 1..20: mol_type = other DNA
gactcctggcctcaagtgat

SEQ ID NO: 71284 - DNA, 20 bp, synthetic construct
  misc_feature 1..20: note = CRISPR gRNA sequence
  source 1..20: mol_type = other DNA
ctggcctcaagtgatccacc

SEQ ID NO: 71285 - DNA, 20 bp, synthetic construct
  misc_feature 1..20: note = CRISPR gRNA sequence
  source 1..20: mol_type = other DNA
gcctcaagtgatccacccac

SEQ ID NO: 71286 - DNA, 20 bp, synthetic construct
  misc_feature 1..20: note = CRISPR gRNA sequence
  source 1..20: mol_type = other DNA
aagtgatccacccacctcag

SEQ ID NO: 71287 - DNA, 20 bp, synthetic construct
  misc_feature 1..20: note = CRISPR gRNA sequence
  source 1..20: mol_type = other DNA
agcctccaaaagtgctggga

SEQ ID NO: 71288 - DNA, 20 bp, synthetic construct
  misc_feature 1..20: note = CRISPR gRNA sequence
  source 1..20: mol_type = other DNA
caaaagtgctgggattacag

SEQ ID NO: 71289 - DNA, 20 bp, synthetic construct
  misc_feature 1..20: note = CRISPR gRNA sequence
  source 1..20: mol_type = other DNA
ggattacaggcgtgagccac

SEQ ID NO: 71290 - DNA, 20 bp, synthetic construct
  misc_feature 1..20: note = CRISPR gRNA sequence
  source 1..20: mol_type = other DNA
caggcgtgagccaccatggc

SEQ ID NO: 71291 - DNA, 20 bp, synthetic construct
  misc_feature 1..20: note = CRISPR gRNA sequence
  source 1..20: mol_type = other DNA
gctggtgctgggacttttat

SEQ ID NO: 71292 - DNA, 20 bp, synthetic construct
  misc_feature 1..20: note = CRISPR gRNA sequence
  source 1..20: mol_type = other DNA
gtgctgggacttttatgtgc

SEQ ID NO: 71293 - DNA, 20 bp, synthetic construct
  misc_feature 1..20: note = CRISPR gRNA sequence
  source 1..20: mol_type = other DNA
ggacttttatgtgctccctt

SEQ ID NO: 71294 - DNA, 20 bp, synthetic construct
  misc_feature 1..20: note = CRISPR gRNA sequence
  source 1..20: mol_type = other DNA
ttatgtgctcccttttccag

SEQ ID NO: 71295 - DNA, 20 bp, synthetic construct
  misc_feature 1..20: note = CRISPR gRNA sequence
  source 1..20: mol_type = other DNA
tatgtgctcccttttccagg

SEQ ID NO: 71296 - DNA, 20 bp, synthetic construct
  misc_feature 1..20: note = CRISPR gRNA sequence
  source 1..20: mol_type = other DNA
atgtgctcccttttccaggc

SEQ ID NO: 71297 - DNA, 20 bp, synthetic construct
  misc_feature 1..20: note = CRISPR gRNA sequence
  source 1..20: mol_type = other DNA
tgtgctcccttttccaggca

SEQ ID NO: 71298 - DNA, 20 bp, synthetic construct
  misc_feature 1..20: note = CRISPR gRNA sequence
  source 1..20: mol_type = other DNA
ccttttccaggcaagggaat

SEQ ID NO: 71299 - DNA, 20 bp, synthetic construct
  misc_feature 1..20: note = CRISPR gRNA sequence
  source 1..20: mol_type = other DNA
ttccaggcaagggaatgaag

SEQ ID NO: 71300 - DNA, 20 bp, synthetic construct
  misc_feature 1..20: note = CRISPR gRNA sequence
  source 1..20: mol_type = other DNA
tccaggcaagggaatgaagg

SEQ ID NO: 71301 - DNA, 20 bp, synthetic construct
  misc_feature 1..20: note = CRISPR gRNA sequence
  source 1..20: mol_type = other DNA
ccaggcaagggaatgaaggc

SEQ ID NO: 71302 - DNA, 20 bp, synthetic construct
  misc_feature 1..20: note = CRISPR gRNA sequence
  source 1..20: mol_type = other DNA
caggcaagggaatgaaggcc

SEQ ID NO: 71303 - DNA, 20 bp, synthetic construct
  misc_feature 1..20: note = CRISPR gRNA sequence
  source 1..20: mol_type = other DNA
tccttactcatacacgaagg

SEQ ID NO: 71304 - DNA, 20 bp, synthetic construct
  misc_feature 1..20: note = CRISPR gRNA sequence
  source 1..20: mol_type = other DNA
ccttactcatacacgaagga

SEQ ID NO: 71305 - DNA, 20 bp, synthetic construct
  misc_feature 1..20: note = CRISPR gRNA sequence
  source 1..20: mol_type = other DNA
cttactcatacacgaaggac

SEQ ID NO: 71306 - DNA, 20 bp, synthetic construct
  misc_feature 1..20: note = CRISPR gRNA sequence
  source 1..20: mol_type = other DNA
actcatacacgaaggaccca

SEQ ID NO: 71307 - DNA, 20 bp, synthetic construct
  misc_feature 1..20: note = CRISPR gRNA sequence
  source 1..20: mol_type = other DNA
ctcatacacgaaggacccag

SEQ ID NO: 71308 - DNA, 20 bp, synthetic construct
  misc_feature 1..20: note = CRISPR gRNA sequence
  source 1..20: mol_type = other DNA
atacacgaaggacccaggtg

SEQ ID NO: 71309 - DNA, 20 bp, synthetic construct
  misc_feature 1..20: note = CRISPR gRNA sequence
  source 1..20: mol_type = other DNA
aatttgggatctcagacccc

SEQ ID NO: 71310 - DNA, 20 bp, synthetic construct
  misc_feature 1..20: note = CRISPR gRNA sequence
  source 1..20: mol_type = other DNA
gggatctcagaccccaaagc

SEQ ID NO: 71311 - DNA, 20 bp, synthetic construct
  misc_feature 1..20: note = CRISPR gRNA sequence
  source 1..20: mol_type = other DNA
ggatctcagaccccaaagcc

SEQ ID NO: 71312 - DNA, 20 bp, synthetic construct
  misc_feature 1..20: note = CRISPR gRNA sequence
  source 1..20: mol_type = other DNA
agaccccaaagccagggtcc

SEQ ID NO: 71313 - DNA, 20 bp, synthetic construct
  misc_feature 1..20: note = CRISPR gRNA sequence
  source 1..20: mol_type = other DNA
gatacctacccaggtcctgt

SEQ ID NO: 71314 - DNA, 20 bp, synthetic construct
  misc_feature 1..20: note = CRISPR gRNA sequence
  source 1..20: mol_type = other DNA
atacctacccaggtcctgtg

SEQ ID NO: 71315 - DNA, 20 bp, synthetic construct
  misc_feature 1..20: note = CRISPR gRNA sequence
  source 1..20: mol_type = other DNA
cccaggtcctgtgtggatgg

SEQ ID NO: 71316 - DNA, 20 bp, synthetic construct
  misc_feature 1..20: note = CRISPR gRNA sequence
  source 1..20: mol_type = other DNA
tgtggatggggaattagcca

SEQ ID NO: 71317 - DNA, 20 bp, synthetic construct
  misc_feature 1..20: note = CRISPR gRNA sequence
  source 1..20: mol_type = other DNA
gccagagactgtctacgggc

SEQ ID NO: 71318 - DNA, 20 bp, synthetic construct
  misc_feature 1..20: note = CRISPR gRNA sequence
  source 1..20: mol_type = other DNA
tctacgggctggcactgcag

SEQ ID NO: 71319 - DNA, 20 bp, synthetic construct
  misc_feature 1..20: note = CRISPR gRNA sequence
  source 1..20: mol_type = other DNA
cgggctggcactgcagcctg

SEQ ID NO: 71320 - DNA, 20 bp, synthetic construct
  misc_feature 1..20: note = CRISPR gRNA sequence
  source 1..20: mol_type = other DNA
gcactgcagcctgagacaag

SEQ ID NO: 71321 - DNA, 20 bp, synthetic construct
  misc_feature 1..20: note = CRISPR gRNA sequence
  source 1..20: mol_type = other DNA
cagcctgagacaaggctgag

SEQ ID NO: 71322 - DNA, 20 bp, synthetic construct
  misc_feature 1..20: note = CRISPR gRNA sequence
  source 1..20: mol_type = other DNA
agacaaggctgagggtgggg

SEQ ID NO: 71323 - DNA, 20 bp, synthetic construct
  misc_feature 1..20: note = CRISPR gRNA sequence
  source 1..20: mol_type = other DNA
agggtggggctctggaaacg

SEQ ID NO: 71324 - DNA, 20 bp, synthetic construct
  misc_feature 1..20: note = CRISPR gRNA sequence
  source 1..20: mol_type = other DNA
tggaaacgccagtccctcag

SEQ ID NO: 71325 - DNA, 20 bp, synthetic construct
  misc_feature 1..20: note = CRISPR gRNA sequence
  source 1..20: mol_type = other DNA
gaaacgccagtccctcaggc

SEQ ID NO: 71326 - DNA, 20 bp, synthetic construct
  misc_feature 1..20: note = CRISPR gRNA sequence
  source 1..20: mol_type = other DNA
aggctcctctcaccctctcc

SEQ ID NO: 71327 - DNA, 20 bp, synthetic construct
  misc_feature 1..20: note = CRISPR gRNA sequence
  source 1..20: mol_type = other DNA
ctctcaccctctcctctttc

SEQ ID NO: 71328 - DNA, 20 bp, synthetic construct
  misc_feature 1..20: note = CRISPR gRNA sequence
  source 1..20: mol_type = other DNA
tcaccctctcctctttcccc

SEQ ID NO: 71329 - DNA, 20 bp, synthetic construct
  misc_feature 1..20: note = CRISPR gRNA sequence
  source 1..20: mol_type = other DNA
accctctcctctttccccag

SEQ ID NO: 71330 - DNA, 20 bp, synthetic construct
  misc_feature 1..20: note = CRISPR gRNA sequence
  source 1..20: mol_type = other DNA
tcctctttccccagcctacc

SEQ ID NO: 71331 - DNA, 20 bp, synthetic construct
  misc_feature 1..20: note = CRISPR gRNA sequence
  source 1..20: mol_type = other DNA
ctctttccccagcctaccat

SEQ ID NO: 71332 - DNA, 20 bp, synthetic construct
  misc_feature 1..20: note = CRISPR gRNA sequence
  source 1..20: mol_type = other DNA
tttccccagcctaccattca

SEQ ID NO: 71333 - DNA, 20 bp, synthetic construct
  misc_feature 1..20: note = CRISPR gRNA sequence
  source 1..20: mol_type = other DNA
tccccagcctaccattcagc

SEQ ID NO: 71334 - DNA, 20 bp, synthetic construct
  misc_feature 1..20: note = CRISPR gRNA sequence
  source 1..20: mol_type = other DNA
ccccagcctaccattcagcc

SEQ ID NO: 71335 - DNA, 20 bp, synthetic construct
  misc_feature 1..20: note = CRISPR gRNA sequence
  source 1..20: mol_type = other DNA
cccagcctaccattcagcca

SEQ ID NO: 71336 - DNA, 20 bp, synthetic construct
  misc_feature 1..20: note = CRISPR gRNA sequence
  source 1..20: mol_type = other DNA
ccattcagccatctgggccc

SEQ ID NO: 71337 - DNA, 20 bp, synthetic construct
  misc_feature 1..20: note = CRISPR gRNA sequence
  source 1..20: mol_type = other DNA
agccatctgggcccaggtgg

SEQ ID NO: 71338 - DNA, 20 bp, synthetic construct
  misc_feature 1..20: note = CRISPR gRNA sequence
  source 1..20: mol_type = other DNA
ggcccaggtggggccctgag

SEQ ID NO: 71339 - DNA, 20 bp, synthetic construct
  misc_feature 1..20: note = CRISPR gRNA sequence
  source 1..20: mol_type = other DNA
agcctggcccaggccctgga

SEQ ID NO: 71340 - DNA, 20 bp, synthetic construct
  misc_feature 1..20: note = CRISPR gRNA sequence
  source 1..20: mol_type = other DNA
gcccaggccctggatggatc

SEQ ID NO: 71341 - DNA, 20 bp, synthetic construct
  misc_feature 1..20: note = CRISPR gRNA sequence
  source 1..20: mol_type = other DNA
gatggatccccccatttgga

SEQ ID NO: 71342 - DNA, 20 bp, synthetic construct
  misc_feature 1..20: note = CRISPR gRNA sequence
  source 1..20: mol_type = other DNA
ggaagagatcaggtaagtag

SEQ ID NO: 71343 - DNA, 20 bp, synthetic construct
  misc_feature 1..20: note = CRISPR gRNA sequence
  source 1..20: mol_type = other DNA
gaagagatcaggtaagtagg

SEQ ID NO: 71344 - DNA, 20 bp, synthetic construct
  misc_feature 1..20: note = CRISPR gRNA sequence
  source 1..20: mol_type = other DNA
cccagcccaggcacggggac

SEQ ID NO: 71345 - DNA, 20 bp, synthetic construct
  misc_feature 1..20: note = CRISPR gRNA sequence
  source 1..20: mol_type = other DNA
ggcgggtctgggggttcctc

SEQ ID NO: 71346 - DNA, 20 bp, synthetic construct
  misc_feature 1..20: note = CRISPR gRNA sequence
  source 1..20: mol_type = other DNA
ggggttcctctcacaggtat

SEQ ID NO: 71347 - DNA, 20 bp, synthetic construct
  misc_feature 1..20: note = CRISPR gRNA sequence
  source 1..20: mol_type = other DNA
ctctcacaggtatctcccct

SEQ ID NO: 71348 - DNA, 20 bp, synthetic construct
  misc_feature 1..20: note = CRISPR gRNA sequence
  source 1..20: mol_type = other DNA
tcacaggtatctcccctacc

SEQ ID NO: 71349 - DNA, 20 bp, synthetic construct
  misc_feature 1..20: note = CRISPR gRNA sequence
  source 1..20: mol_type = other DNA
acaggtatctcccctaccct

SEQ ID NO: 71350 - DNA, 20 bp, synthetic construct
  misc_feature 1..20: note = CRISPR gRNA sequence
  source 1..20: mol_type = other DNA
ccctaccctgcagcttggcg

SEQ ID NO: 71351 - DNA, 20 bp, synthetic construct
  misc_feature 1..20: note = CRISPR gRNA sequence
  source 1..20: mol_type = other DNA
ccctgcagcttggcggaaaa

SEQ ID NO: 71352 - DNA, 20 bp, synthetic construct
  misc_feature 1..20: note = CRISPR gRNA sequence
  source 1..20: mol_type = other DNA
cagcttggcggaaaacaacc

SEQ ID NO: 71353 - DNA, 20 bp, synthetic construct
  misc_feature 1..20: note = CRISPR gRNA sequence
  source 1..20: mol_type = other DNA
ggcggaaaacaacctggctg

SEQ ID NO: 71354 - DNA, 20 bp, synthetic construct
  misc_feature 1..20: note = CRISPR gRNA sequence
  source 1..20: mol_type = other DNA
gcggaaaacaacctggctgg

SEQ ID NO: 71355 - DNA, 20 bp, synthetic construct
  misc_feature 1..20: note = CRISPR gRNA sequence
  source 1..20: mol_type = other DNA
gctggaggggtcctgcgttt

SEQ ID NO: 71356 - DNA, 20 bp, synthetic construct
  misc_feature 1..20: note = CRISPR gRNA sequence
  source 1..20: mol_type = other DNA
gaggggtcctgcgtttctgt

SEQ ID NO: 71357 - DNA, 20 bp, synthetic construct
  misc_feature 1..20: note = CRISPR gRNA sequence
  source 1..20: mol_type = other DNA
cgtttctgtatggagctccc

SEQ ID NO: 71358 - DNA, 20 bp, synthetic construct
  misc_feature 1..20: note = CRISPR gRNA sequence
  source 1..20: mol_type = other DNA
ctgtatggagctcccgctgc

SEQ ID NO: 71359 - DNA, 20 bp, synthetic construct
  misc_feature 1..20: note = CRISPR gRNA sequence
  source 1..20: mol_type = other DNA
tgtatggagctcccgctgct

SEQ ID NO: 71360 - DNA, 20 bp, synthetic construct
  misc_feature 1..20: note = CRISPR gRNA sequence
  source 1..20: mol_type = other DNA
tatggagctcccgctgctca

SEQ ID NO: 71361 - DNA, 20 bp, synthetic construct
  misc_feature 1..20: note = CRISPR gRNA sequence
  source 1..20: mol_type = other DNA
ccgctgctcagacagataga

SEQ ID NO: 71362 - DNA, 20 bp, synthetic construct
  misc_feature 1..20: note = CRISPR gRNA sequence
  source 1..20: mol_type = other DNA
ctcagacagatagagtaagt

SEQ ID NO: 71363 - DNA, 20 bp, synthetic construct
  misc_feature 1..20: note = CRISPR gRNA sequence
  source 1..20: mol_type = other DNA
agacagatagagtaagtagc

SEQ ID NO: 71364 - DNA, 20 bp, synthetic construct
  misc_feature 1..20: note = CRISPR gRNA sequence
  source 1..20: mol_type = other DNA
ccctgcctgcctaggggacc

SEQ ID NO: 71365 - DNA, 20 bp, synthetic construct
  misc_feature 1..20: note = CRISPR gRNA sequence
  source 1..20: mol_type = other DNA
cctgcctaggggaccagtgg

SEQ ID NO: 71366 - DNA, 20 bp, synthetic construct
  misc_feature 1..20: note = CRISPR gRNA sequence
  source 1..20: mol_type = other DNA
cctaggggaccagtggcagg

SEQ ID NO: 71367 - DNA, 20 bp, synthetic construct
  misc_feature 1..20: note = CRISPR gRNA sequence
  source 1..20: mol_type = other DNA
ggggaccagtggcaggctga

SEQ ID NO: 71368 - DNA, 20 bp, synthetic construct
  misc_feature 1..20: note = CRISPR gRNA sequence
  source 1..20: mol_type = other DNA
agggcagcccttctctgact

SEQ ID NO: 71369 - DNA, 20 bp, synthetic construct
  misc_feature 1..20: note = CRISPR gRNA sequence
  source 1..20: mol_type = other DNA
ctctgactgagcctaacacc

SEQ ID NO: 71370 - DNA, 20 bp, synthetic construct
  misc_feature 1..20: note = CRISPR gRNA sequence
  source 1..20: mol_type = other DNA
tctgactgagcctaacacct

SEQ ID NO: 71371 - DNA, 20 bp, synthetic construct
  misc_feature 1..20: note = CRISPR gRNA sequence
  source 1..20: mol_type = other DNA
tgactgagcctaacacctgg

SEQ ID NO: 71372 - DNA, 20 bp, synthetic construct
  misc_feature 1..20: note = CRISPR gRNA sequence
  source 1..20: mol_type = other DNA
actgagcctaacacctgggg

SEQ ID NO: 71373 - DNA, 20 bp, synthetic construct
  misc_feature 1..20: note = CRISPR gRNA sequence
  source 1..20: mol_type = other DNA
agcctaacacctggggaggc

SEQ ID NO: 71374 - DNA, 20 bp, synthetic construct
  misc_feature 1..20: note = CRISPR gRNA sequence
  source 1..20: mol_type = other DNA
acacctggggaggcctttga

SEQ ID NO: 71375 - DNA, 20 bp, synthetic construct
  misc_feature 1..20: note = CRISPR gRNA sequence
  source 1..20: mol_type = other DNA
gggaggcctttgaagtgata

SEQ ID NO: 71376 - DNA, 20 bp, synthetic construct
  misc_feature 1..20: note = CRISPR gRNA sequence
  source 1..20: mol_type = other DNA
tgaagtgatagaagccccag

SEQ ID NO: 71377 - DNA, 20 bp, synthetic construct
  misc_feature 1..20: note = CRISPR gRNA sequence
  source 1..20: mol_type = other DNA
gaagtgatagaagccccagg

SEQ ID NO: 71378 - DNA, 20 bp, synthetic construct
  misc_feature 1..20: note = CRISPR gRNA sequence
  source 1..20: mol_type = other DNA
aagtgatagaagccccaggg

SEQ ID NO: 71379 - DNA, 20 bp, synthetic construct
  misc_feature 1..20: note = CRISPR gRNA sequence
  source 1..20: mol_type = other DNA
gctcaagaaaggaagtcttt

SEQ ID NO: 71380 - DNA, 20 bp, synthetic construct
  misc_feature 1..20: note = CRISPR gRNA sequence
  source 1..20: mol_type = other DNA
aagaaaggaagtctttccta

SEQ ID NO: 71381 - DNA, 20 bp, synthetic construct
  misc_feature 1..20: note = CRISPR gRNA sequence
  source 1..20: mol_type = other DNA
tcctaaaacgcctagcttac

SEQ ID NO: 71382 - DNA, 20 bp, synthetic construct
  misc_feature 1..20: note = CRISPR gRNA sequence
  source 1..20: mol_type = other DNA
cctaaaacgcctagcttacc

SEQ ID NO: 71383 - DNA, 20 bp, synthetic construct
  misc_feature 1..20: note = CRISPR gRNA sequence
  source 1..20: mol_type = other DNA
ctaaaacgcctagcttaccc

SEQ ID NO: 71384 - DNA, 20 bp, synthetic construct
  misc_feature 1..20: note = CRISPR gRNA sequence
  source 1..20: mol_type = other DNA
aaacgcctagcttaccccag

SEQ ID NO: 71385 - DNA, 20 bp, synthetic construct
  misc_feature 1..20: note = CRISPR gRNA sequence
  source 1..20: mol_type = other DNA
gcttaccccagaccctggtg

SEQ ID NO: 71386 - DNA, 20 bp, synthetic construct
  misc_feature 1..20: note = CRISPR gRNA sequence
  source 1..20: mol_type = other DNA
accccagaccctggtggctc

SEQ ID NO: 71387 - DNA, 20 bp, synthetic construct
  misc_feature 1..20: note = CRISPR gRNA sequence
  source 1..20: mol_type = other DNA
ccccagaccctggtggctct

SEQ ID NO: 71388 - DNA, 20 bp, synthetic construct
  misc_feature 1..20: note = CRISPR gRNA sequence
  source 1..20: mol_type = other DNA
gtggctctggaggcaggacc

SEQ ID NO: 71389 - DNA, 20 bp, synthetic construct
  misc_feature 1..20: note = CRISPR gRNA sequence
  source 1..20: mol_type = other DNA
tggaggcaggacctgctaga

SEQ ID NO: 71390 - DNA, 20 bp, synthetic construct
  misc_feature 1..20: note = CRISPR gRNA sequence
  source 1..20: mol_type = other DNA
gaggcaggacctgctagatc

SEQ ID NO: 71391 - DNA, 20 bp, synthetic construct
  misc_feature 1..20: note = CRISPR gRNA sequence
  source 1..20: mol_type = other DNA
ctagatcccctgactcaaac

SEQ ID NO: 71392 - DNA, 20 bp, synthetic construct
  misc_feature 1..20: note = CRISPR gRNA sequence
  source 1..20: mol_type = other DNA
gatcccctgactcaaacaac

SEQ ID NO: 71393 - DNA, 20 bp, synthetic construct
  misc_feature 1..20: note = CRISPR gRNA sequence
  source 1..20: mol_type = other DNA
actcaaacaacccccatccc

SEQ ID NO: 71394 - DNA, 20 bp, synthetic construct
  misc_feature 1..20: note = CRISPR gRNA sequence
  source 1..20: mol_type = other DNA
aaacaacccccatcccatcc

SEQ ID NO: 71395 - DNA, 20 bp, synthetic construct
  misc_feature 1..20: note = CRISPR gRNA sequence
  source 1..20: mol_type = other DNA
ctccatccccagcctggttt

SEQ ID NO: 71396 - DNA, 20 bp, synthetic construct
  misc_feature 1..20: note = CRISPR gRNA sequence
  source 1..20: mol_type = other DNA
tccatccccagcctggtttc

SEQ ID NO: 71397 - DNA, 20 bp, synthetic construct
  misc_feature 1..20: note = CRISPR gRNA sequence
  source 1..20: mol_type = other DNA
catccccagcctggtttcct

SEQ ID NO: 71398 - DNA, 20 bp, synthetic construct
  misc_feature 1..20: note = CRISPR gRNA sequence
  source 1..20: mol_type = other DNA
gtttcctgtaagattgacaa

SEQ ID NO: 71399 - DNA, 20 bp, synthetic construct
  misc_feature 1..20: note = CRISPR gRNA sequence
  source 1..20: mol_type = other DNA
cctgtaagattgacaaccag

SEQ ID NO: 71400 - DNA, 20 bp, synthetic construct
  misc_feature 1..20: note = CRISPR gRNA sequence
  source 1..20: mol_type = other DNA
ctgtaagattgacaaccaga

SEQ ID NO: 71401 - DNA, 20 bp, synthetic construct
  misc_feature 1..20: note = CRISPR gRNA sequence
  source 1..20: mol_type = other DNA
taagattgacaaccagactg

SEQ ID NO: 71402 - DNA, 20 bp, synthetic construct
  misc_feature 1..20: note = CRISPR gRNA sequence
  source 1..20: mol_type = other DNA
acaaccagactgccaagctc

SEQ ID NO: 71403 - DNA, 20 bp, synthetic construct
  misc_feature 1..20: note = CRISPR gRNA sequence
  source 1..20: mol_type = other DNA
ccaagctcctcacctccagc

SEQ ID NO: 71404 - DNA, 20 bp, synthetic construct
  misc_feature 1..20: note = CRISPR gRNA sequence
  source 1..20: mol_type = other DNA
ctcacctccagcttcacgag

SEQ ID NO: 71405 - DNA, 20 bp, synthetic construct
  misc_feature 1..20: note = CRISPR gRNA sequence
  source 1..20: mol_type = other DNA
acctccagcttcacgagctg

SEQ ID NO: 71406 - DNA, 20 bp, synthetic construct
  misc_feature 1..20: note = CRISPR gRNA sequence
  source 1..20: mol_type = other DNA
cagcttcacgagctgccctg

SEQ ID NO: 71407 - DNA, 20 bp, synthetic construct
  misc_feature 1..20: note = CRISPR gRNA sequence
  source 1..20: mol_type = other DNA
cacgagctgccctgccctgg

SEQ ID NO: 71408 - DNA, 20 bp, synthetic construct
  misc_feature 1..20: note = CRISPR gRNA sequence
  source 1..20: mol_type = other DNA
acgagctgccctgccctgga

SEQ ID NO: 71409 - DNA, 20 bp, synthetic construct
  misc_feature 1..20: note = CRISPR gRNA sequence
  source 1..20: mol_type = other DNA
ccctgccctggaagtaatct

SEQ ID NO: 71410 - DNA, 20 bp, synthetic construct
  misc_feature 1..20: note = CRISPR gRNA sequence
  source 1..20: mol_type = other DNA
ccctggaagtaatcttgtga

SEQ ID NO: 71411 - DNA, 20 bp, synthetic construct
  misc_feature 1..20: note = CRISPR gRNA sequence
  source 1..20: mol_type = other DNA
gaagtaatcttgtgagtgat

SEQ ID NO: 71412 - DNA, 20 bp, synthetic construct
  misc_feature 1..20: note = CRISPR gRNA sequence
  source 1..20: mol_type = other DNA
gtgagtgattggaagagccc

SEQ ID NO: 71413 - DNA, 20 bp, synthetic construct
  misc_feature 1..20: note = CRISPR gRNA sequence
  source 1..20: mol_type = other DNA
tgagtgattggaagagccct

SEQ ID NO: 71414 - DNA, 20 bp, synthetic construct
  misc_feature 1..20: note = CRISPR gRNA sequence
  source 1..20: mol_type = other DNA
gaagagccctgagctggctg

SEQ ID NO: 71415 - DNA, 20 bp, synthetic construct
  misc_feature 1..20: note = CRISPR gRNA sequence
  source 1..20: mol_type = other DNA
agctggctgggaaaaggaaa

SEQ ID NO: 71416 - DNA, 20 bp, synthetic construct
  misc_feature 1..20: note = CRISPR gRNA sequence
  source 1..20: mol_type = other DNA
gctgggaaaaggaaaagtcg

SEQ ID NO: 71417 - DNA, 20 bp, synthetic construct
  misc_feature 1..20: note = CRISPR gRNA sequence
  source 1..20: mol_type = other DNA
ggaaaaggaaaagtcgggag

SEQ ID NO: 71418 - DNA, 20 bp, synthetic construct
  misc_feature 1..20: note = CRISPR gRNA sequence
  source 1..20: mol_type = other DNA
gctccagcctgctgtgtggc

SEQ ID NO: 71419 - DNA, 20 bp, synthetic construct
  misc_feature 1..20: note = CRISPR gRNA sequence
  source 1..20: mol_type = other DNA
cagcctgctgtgtggcctgg

SEQ ID NO: 71420 - DNA, 20 bp, synthetic construct
  misc_feature 1..20: note = CRISPR gRNA sequence
  source 1..20: mol_type = other DNA
ctgtgtggcctggagctgct

SEQ ID NO: 71421 - DNA, 20 bp, synthetic construct
  misc_feature 1..20: note = CRISPR gRNA sequence
  source 1..20: mol_type = other DNA
tgtggcctggagctgctccc

SEQ ID NO: 71422 - DNA, 20 bp, synthetic construct
  misc_feature 1..20: note = CRISPR gRNA sequence
  source 1..20: mol_type = other DNA
gagctgctcccatcctctct

SEQ ID NO: 71423 - DNA, 20 bp, synthetic construct
  misc_feature 1..20: note = CRISPR gRNA sequence
  source 1..20: mol_type = other DNA
ctcccatcctctctggccag

SEQ ID NO: 71424 - DNA, 20 bp, synthetic construct
  misc_feature 1..20: note = CRISPR gRNA sequence
  source 1..20: mol_type = other DNA
ccatcctctctggccagtcc

SEQ ID NO: 71425 - DNA, 20 bp, synthetic construct
  misc_feature 1..20: note = CRISPR gRNA sequence
  source 1..20: mol_type = other DNA
tctggccagtcctcccattt

SEQ ID NO: 71426 - DNA, 20 bp, synthetic construct
  misc_feature 1..20: note = CRISPR gRNA sequence
  source 1..20: mol_type = other DNA
tggccagtcctcccatttgt

SEQ ID NO: 71427 - DNA, 20 bp, synthetic construct
  misc_feature 1..20: note = CRISPR gRNA sequence
  source 1..20: mol_type = other DNA
gccagtcctcccatttgtaa

SEQ ID NO: 71428 - DNA, 20 bp, synthetic construct
  misc_feature 1..20: note = CRISPR gRNA sequence
  source 1..20: mol_type = other DNA
ccatttgtaaatggggaaga

SEQ ID NO: 71429 - DNA, 20 bp, synthetic construct
  misc_feature 1..20: note = CRISPR gRNA sequence
  source 1..20: mol_type = other DNA
gtaaatggggaagatcatcc

SEQ ID NO: 71430 - DNA, 20 bp, synthetic construct
  misc_feature 1..20: note = CRISPR gRNA sequence
  source 1..20: mol_type = other DNA
taaatggggaagatcatcct

SEQ ID NO: 71431 - DNA, 20 bp, synthetic construct
  misc_feature 1..20: note = CRISPR gRNA sequence
  source 1..20: mol_type = other DNA
actcagacatcctctcaaag

SEQ ID NO: 71432 - DNA, 20 bp, synthetic construct
  misc_feature 1..20: note = CRISPR gRNA sequence
  source 1..20: mol_type = other DNA
ctcagacatcctctcaaaga

SEQ ID NO: 71433 - DNA, 20 bp, synthetic construct
  misc_feature 1..20: note = CRISPR gRNA sequence
  source 1..20: mol_type = other DNA
agacatcctctcaaagacat

SEQ ID NO: 71434 - DNA, 20 bp, synthetic construct
  misc_feature 1..20: note = CRISPR gRNA sequence
  source 1..20: mol_type = other DNA
tcaaagacattttaacactt

SEQ ID NO: 71435 - DNA, 20 bp, synthetic construct
  misc_feature 1..20: note = CRISPR gRNA sequence
  source 1..20: mol_type = other DNA
aaagacattttaacacttga

SEQ ID NO: 71436 - DNA, 20 bp, synthetic construct
  misc_feature 1..20: note = CRISPR gRNA sequence
  source 1..20: mol_type = other DNA
taacacttgagctgcaggta

SEQ ID NO: 71437 - DNA, 20 bp, synthetic construct
  misc_feature 1..20: note = CRISPR gRNA sequence
  source 1..20: mol_type = other DNA
aacacttgagctgcaggtaa

SEQ ID NO: 71438 - DNA, 20 bp, synthetic construct
  misc_feature 1..20: note = CRISPR gRNA sequence
  source 1..20: mol_type = other DNA
acacttgagctgcaggtaat

SEQ ID NO: 71439 - DNA, 20 bp, synthetic construct
  misc_feature 1..20: note = CRISPR gRNA sequence
  source 1..20: mol_type = other DNA
gagctgcaggtaatgttggg

SEQ ID NO: 71440 - DNA, 20 bp, synthetic construct
  misc_feature 1..20: note = CRISPR gRNA sequence
  source 1..20: mol_type = other DNA
agctgcaggtaatgttgggt

SEQ ID NO: 71441 - DNA, 20 bp, synthetic construct
  misc_feature 1..20: note = CRISPR gRNA sequence
  source 1..20: mol_type = other DNA
caggtaatgttgggtaaaac

SEQ ID NO: 71442 - DNA, 20 bp, synthetic construct
  misc_feature 1..20: note = CRISPR gRNA sequence
  source 1..20: mol_type = other DNA
ggtaaaacagtttaccttct

SEQ ID NO: 71443 - DNA, 20 bp, synthetic construct
  misc_feature 1..20: note = CRISPR gRNA sequence
  source 1..20: mol_type = other DNA
accttcttctgcctttttcc

SEQ ID NO: 71444 - DNA, 20 bp, synthetic construct
  misc_feature 1..20: note = CRISPR gRNA sequence
  source 1..20: mol_type = other DNA
ccttcttctgcctttttccc

SEQ ID NO: 71445 - DNA, 20 bp, synthetic construct
  misc_feature 1..20: note = CRISPR gRNA sequence
  source 1..20: mol_type = other DNA
cttctgcctttttccccatt

SEQ ID NO: 71446 - DNA, 20 bp, synthetic construct
  misc_feature 1..20: note = CRISPR gRNA sequence
  source 1..20: mol_type = other DNA
ttctgcctttttccccattt

SEQ ID NO: 71447 - DNA, 20 bp, synthetic construct
  misc_feature 1..20: note = CRISPR gRNA sequence
  source 1..20: mol_type = other DNA
ctgcctttttccccatttgt

SEQ ID NO: 71448 - DNA, 20 bp, synthetic construct
  misc_feature 1..20: note = CRISPR gRNA sequence
  source 1..20: mol_type = other DNA
tgcctttttccccatttgta

SEQ ID NO: 71449 - DNA, 20 bp, synthetic construct
  misc_feature 1..20: note = CRISPR gRNA sequence
  source 1..20: mol_type = other DNA
cctttttccccatttgtaga

SEQ ID NO: 71450 - DNA, 20 bp, synthetic construct
  misc_feature 1..20: note = CRISPR gRNA sequence
  source 1..20: mol_type = other DNA
tttccccatttgtagattgg

SEQ ID NO: 71451 - DNA, 20 bp, synthetic construct
  misc_feature 1..20: note = CRISPR gRNA sequence
  source 1..20: mol_type = other DNA
ttccccatttgtagattggt

SEQ ID NO: 71452 - DNA, 20 bp, synthetic construct
  misc_feature 1..20: note = CRISPR gRNA sequence
  source 1..20: mol_type = other DNA
tccccatttgtagattggtg

SEQ ID NO: 71453 - DNA, 20 bp, synthetic construct
  misc_feature 1..20: note = CRISPR gRNA sequence
  source 1..20: mol_type = other DNA
ccccatttgtagattggtgg

SEQ ID NO: 71454 - DNA, 20 bp, synthetic construct
  misc_feature 1..20: note = CRISPR gRNA sequence
  source 1..20: mol_type = other DNA
cccatttgtagattggtggg

SEQ ID NO: 71455 - DNA, 20 bp, synthetic construct
  misc_feature 1..20: note = CRISPR gRNA sequence
  source 1..20: mol_type = other DNA
gtagattggtgggaggggag

SEQ ID NO: 71456 - DNA, 20 bp, synthetic construct
  misc_feature 1..20: note = CRISPR gRNA sequence
  source 1..20: mol_type = other DNA
tagattggtgggaggggagg

SEQ ID NO: 71457 - DNA, 20 bp, synthetic construct
  misc_feature 1..20: note = CRISPR gRNA sequence
  source 1..20: mol_type = other DNA
gtgggaggggaggtggacca

SEQ ID NO: 71458 - DNA, 20 bp, synthetic construct
  misc_feature 1..20: note = CRISPR gRNA sequence
  source 1..20: mol_type = other DNA
taaaggtttttggtccaacc

SEQ ID NO: 71459 - DNA, 20 bp, synthetic construct
  misc_feature 1..20: note = CRISPR gRNA sequence
  source 1..20: mol_type = other DNA
aaaggtttttggtccaacct

SEQ ID NO: 71460 - DNA, 20 bp, synthetic construct
  misc_feature 1..20: note = CRISPR gRNA sequence
  source 1..20: mol_type = other DNA
aaggtttttggtccaacctt

SEQ ID NO: 71461 - DNA, 20 bp, synthetic construct
  misc_feature 1..20: note = CRISPR gRNA sequence
  source 1..20: mol_type = other DNA
ttggtccaaccttccttttg

SEQ ID NO: 71462 - DNA, 20 bp, synthetic construct
  misc_feature 1..20: note = CRISPR gRNA sequence
  source 1..20: mol_type = other DNA
tggtccaaccttccttttgg

SEQ ID NO: 71463 - DNA, 20 bp, synthetic construct
  misc_feature 1..20: note = CRISPR gRNA sequence
  source 1..20: mol_type = other DNA
ggtccaaccttccttttggg

SEQ ID NO: 71464 - DNA, 20 bp, synthetic construct
  misc_feature 1..20: note = CRISPR gRNA sequence
  source 1..20: mol_type = other DNA
gtccaaccttccttttggga

SEQ ID NO: 71465 - DNA, 20 bp, synthetic construct
  misc_feature 1..20: note = CRISPR gRNA sequence
  source 1..20: mol_type = other DNA
ccttttgggaggcaactgga

SEQ ID NO: 71466 - DNA, 20 bp, synthetic construct
  misc_feature 1..20: note = CRISPR gRNA sequence
  source 1..20: mol_type = other DNA
cttttgggaggcaactggat

SEQ ID NO: 71467 - DNA, 20 bp, synthetic construct
  misc_feature 1..20: note = CRISPR gRNA sequence
  source 1..20: mol_type = other DNA
ttgggaggcaactggataga

SEQ ID NO: 71468 - DNA, 20 bp, synthetic construct
  misc_feature 1..20: note = CRISPR gRNA sequence
  source 1..20: mol_type = other DNA
tgggaggcaactggatagac

SEQ ID NO: 71469 - DNA, 20 bp, synthetic construct
  misc_feature 1..20: note = CRISPR gRNA sequence
  source 1..20: mol_type = other DNA
gggaggcaactggatagacc

SEQ ID NO: 71470 - DNA, 20 bp, synthetic construct
  misc_feature 1..20: note = CRISPR gRNA sequence
  source 1..20: mol_type = other DNA
ggaggcaactggatagacca

SEQ ID NO: 71471 - DNA, 20 bp, synthetic construct
  misc_feature 1..20: note = CRISPR gRNA sequence
  source 1..20: mol_type = other DNA
gatagaccaccttgcctgct

SEQ ID NO: 71472 - DNA, 20 bp, synthetic construct
  misc_feature 1..20: note = CRISPR gRNA sequence
  source 1..20: mol_type = other DNA
gcctgcttgatgaaacctcc

SEQ ID NO: 71473 - DNA, 20 bp, synthetic construct
  misc_feature 1..20: note = CRISPR gRNA sequence
  source 1..20: mol_type = other DNA
cctgcttgatgaaacctcca

SEQ ID NO: 71474 - DNA, 20 bp, synthetic construct
  misc_feature 1..20: note = CRISPR gRNA sequence
  source 1..20: mol_type = other DNA
cttgatgaaacctccattta

SEQ ID NO: 71475 - DNA, 20 bp, synthetic construct
  misc_feature 1..20: note = CRISPR gRNA sequence
  source 1..20: mol_type = other DNA
gatgaaacctccatttatga

SEQ ID NO: 71476 - DNA, 20 bp, synthetic construct
  misc_feature 1..20: note = CRISPR gRNA sequence
  source 1..20: mol_type = other DNA
atgaaacctccatttatgaa

SEQ ID NO: 71477 - DNA, 20 bp, synthetic construct
  misc_feature 1..20: note = CRISPR gRNA sequence
  source 1..20: mol_type = other DNA
catttatgaaccacagttgg

SEQ ID NO: 71478 - DNA, 20 bp, synthetic construct
  misc_feature 1..20: note = CRISPR gRNA sequence
  source 1..20: mol_type = other DNA
atgaaccacagttggtagaa

SEQ ID NO: 71479 - DNA, 20 bp, synthetic construct
  misc_feature 1..20: note = CRISPR gRNA sequence
  source 1..20: mol_type = other DNA
tgaaccacagttggtagaaa

SEQ ID NO: 71480 - DNA, 20 bp, synthetic construct
  misc_feature 1..20: note = CRISPR gRNA sequence
  source 1..20: mol_type = other DNA
gtagaaacagtggctaaagc

SEQ ID NO: 71481 - DNA, 20 bp, synthetic construct
  misc_feature 1..20: note = CRISPR gRNA sequence
  source 1..20: mol_type = other DNA
aagccaggagaaagccaccc

SEQ ID NO: 71482 - DNA, 20 bp, synthetic construct
  misc_feature 1..20: note = CRISPR gRNA sequence
  source 1..20: mol_type = other DNA
ctggctggccgtgcttggct

SEQ ID NO: 71483 - DNA, 20 bp, synthetic construct
  misc_feature 1..20: note = CRISPR gRNA sequence
  source 1..20: mol_type = other DNA
gctggccgtgcttggctgtc

SEQ ID NO: 71484 - DNA, 20 bp, synthetic construct
  misc_feature 1..20: note = CRISPR gRNA sequence
  source 1..20: mol_type = other DNA
gccgtgcttggctgtctctt

SEQ ID NO: 71485 - DNA, 20 bp, synthetic construct
  misc_feature 1..20: note = CRISPR gRNA sequence
  source 1..20: mol_type = other DNA
ggctgtctcttagcaatcag

SEQ ID NO: 71486 - DNA, 20 bp, synthetic construct
  misc_feature 1..20: note = CRISPR gRNA sequence
  source 1..20: mol_type = other DNA
gctgtctcttagcaatcaga

SEQ ID NO: 71487 - DNA, 20 bp, synthetic construct
  misc_feature 1..20: note = CRISPR gRNA sequence
  source 1..20: mol_type = other DNA
tctcttagcaatcagaatcc

SEQ ID NO: 71488 - DNA, 20 bp, synthetic construct
  misc_feature 1..20: note = CRISPR gRNA sequence
  source 1..20: mol_type = other DNA
ttagcaatcagaatccccca

SEQ ID NO: 71489 - DNA, 20 bp, synthetic construct
  misc_feature 1..20: note = CRISPR gRNA sequence
  source 1..20: mol_type = other DNA
agcaatcagaatcccccaga

SEQ ID NO: 71490 - DNA, 20 bp, synthetic construct
  misc_feature 1..20: note = CRISPR gRNA sequence
  source 1..20: mol_type = other DNA
gcaatcagaatcccccagac

SEQ ID NO: 71491 - DNA, 20 bp, synthetic construct
  misc_feature 1..20: note = CRISPR gRNA sequence
  source 1..20: mol_type = other DNA
ggggctttgcagtgctgcct

SEQ ID NO: 71492 - DNA, 20 bp, synthetic construct
  misc_feature 1..20: note = CRISPR gRNA sequence
  source 1..20: mol_type = other DNA
gggctttgcagtgctgcctc

SEQ ID NO: 71493 - DNA, 20 bp, synthetic construct
  misc_feature 1..20: note = CRISPR gRNA sequence
  source 1..20: mol_type = other DNA
tgcagtgctgcctcatgagt

SEQ ID NO: 71494 - DNA, 20 bp, synthetic construct
  misc_feature 1..20: note = CRISPR gRNA sequence
  source 1..20: mol_type = other DNA
gcagtgctgcctcatgagta

SEQ ID NO: 71495 - DNA, 20 bp, synthetic construct
  misc_feature 1..20: note = CRISPR gRNA sequence
  source 1..20: mol_type = other DNA
cagtgctgcctcatgagtaa

SEQ ID NO: 71496 - DNA, 20 bp, synthetic construct
  misc_feature 1..20: note = CRISPR gRNA sequence
  source 1..20: mol_type = other DNA
cctcatgagtaaactagaat

SEQ ID NO: 71497 - DNA, 20 bp, synthetic construct
  misc_feature 1..20: note = CRISPR gRNA sequence
  source 1..20: mol_type = other DNA
atgagtaaactagaattcta

SEQ ID NO: 71498 - DNA, 20 bp, synthetic construct
  misc_feature 1..20: note = CRISPR gRNA sequence
  source 1..20: mol_type = other DNA
gaattctaggactagcctgg

SEQ ID NO: 71499 - DNA, 20 bp, synthetic construct
  misc_feature 1..20: note = CRISPR gRNA sequence
  source 1..20: mol_type = other DNA
taggactagcctgggaccct

SEQ ID NO: 71500 - DNA, 20 bp, synthetic construct
  misc_feature 1..20: note = CRISPR gRNA sequence
  source 1..20: mol_type = other DNA
ggactagcctgggaccctaa

SEQ ID NO: 71501 - DNA, 20 bp, synthetic construct
  misc_feature 1..20: note = CRISPR gRNA sequence
  source 1..20: mol_type = other DNA
gcctgggaccctaaccatgg

SEQ ID NO: 71502 - DNA, 20 bp, synthetic construct
  misc_feature 1..20: note = CRISPR gRNA sequence
  source 1..20: mol_type = other DNA
ggaccctaaccatggtatgg

SEQ ID NO: 71503 - DNA, 20 bp, synthetic construct
  misc_feature 1..20: note = CRISPR gRNA sequence
  source 1..20: mol_type = other DNA
accatggtatggaggacaaa

SEQ ID NO: 71504 - DNA, 20 bp, synthetic construct
  misc_feature 1..20: note = CRISPR gRNA sequence
  source 1..20: mol_type = other DNA
tttcctaaagaacaggacac

SEQ ID NO: 71505 - DNA, 20 bp, synthetic construct
  misc_feature 1..20: note = CRISPR gRNA sequence
  source 1..20: mol_type = other DNA
cctaaagaacaggacacaag

SEQ ID NO: 71506 - DNA, 20 bp, synthetic construct
  misc_feature 1..20: note = CRISPR gRNA sequence
  source 1..20: mol_type = other DNA
ctaaagaacaggacacaagt

SEQ ID NO: 71507 - DNA, 20 bp, synthetic construct
  misc_feature 1..20: note = CRISPR gRNA sequence
  source 1..20: mol_type = other DNA
aagaacaggacacaagtgat

SEQ ID NO: 71508 - DNA, 20 bp, synthetic construct
  misc_feature 1..20: note = CRISPR gRNA sequence
  source 1..20: mol_type = other DNA
cgagaagattttagtttgca

SEQ ID NO: 71509 - DNA, 20 bp, synthetic construct
  misc_feature 1..20: note = CRISPR gRNA sequence
  source 1..20: mol_type = other DNA
tagtttgcatcctaaaggtc

SEQ ID NO: 71510 - DNA, 20 bp, synthetic construct
  misc_feature 1..20: note = CRISPR gRNA sequence
  source 1..20: mol_type = other DNA
agtttgcatcctaaaggtct

SEQ ID NO: 71511 - DNA, 20 bp, synthetic construct
  misc_feature 1..20: note = CRISPR gRNA sequence
  source 1..20: mol_type = other DNA
gtttgcatcctaaaggtctt

SEQ ID NO: 71512 - DNA, 20 bp, synthetic construct
  misc_feature 1..20: note = CRISPR gRNA sequence
  source 1..20: mol_type = other DNA
gcatcctaaaggtcttaacc

SEQ ID NO: 71513 - DNA, 20 bp, synthetic construct
  misc_feature 1..20: note = CRISPR gRNA sequence
  source 1..20: mol_type = other DNA
catcctaaaggtcttaaccc

SEQ ID NO: 71514 - DNA, 20 bp, synthetic construct
  misc_feature 1..20: note = CRISPR gRNA sequence
  source 1..20: mol_type = other DNA
aaggtcttaacccttctcat

SEQ ID NO: 71515 - DNA, 20 bp, synthetic construct
  misc_feature 1..20: note = CRISPR gRNA sequence
  source 1..20: mol_type = other DNA
aacccttctcattacaccaa

SEQ ID NO: 71516 - DNA, 20 bp, synthetic construct
  misc_feature 1..20: note = CRISPR gRNA sequence
  source 1..20: mol_type = other DNA
acccttctcattacaccaaa

SEQ ID NO: 71517 - DNA, 20 bp, synthetic construct
  misc_feature 1..20: note = CRISPR gRNA sequence
  source 1..20: mol_type = other DNA
ctcattacaccaaagcgaaa

SEQ ID NO: 71518 - DNA, 20 bp, synthetic construct
  misc_feature 1..20: note = CRISPR gRNA sequence
  source 1..20: mol_type = other DNA
tcattacaccaaagcgaaag

SEQ ID NO: 71519 - DNA, 20 bp, synthetic construct
  misc_feature 1..20: note = CRISPR gRNA sequence
  source 1..20: mol_type = other DNA
attacaccaaagcgaaagtc

SEQ ID NO: 71520 - DNA, 20 bp, synthetic construct
  misc_feature 1..20: note = CRISPR gRNA sequence
  source 1..20: mol_type = other DNA
caccaaagcgaaagtctcag

SEQ ID NO: 71521 - DNA, 20 bp, synthetic construct
  misc_feature 1..20: note = CRISPR gRNA sequence
  source 1..20: mol_type = other DNA
agatcagtggtaattcatct

SEQ ID NO: 71522 - DNA, 20 bp, synthetic construct
  misc_feature 1..20: note = CRISPR gRNA sequence
  source 1..20: mol_type = other DNA
atctttaacacctaacactg

SEQ ID NO: 71523 - DNA, 20 bp, synthetic construct
  misc_feature 1..20: note = CRISPR gRNA sequence
  source 1..20: mol_type = other DNA
taacacctaacactggattc

SEQ ID NO: 71524 - DNA, 20 bp, synthetic construct
  misc_feature 1..20: note = CRISPR gRNA sequence
  source 1..20: mol_type = other DNA
aacacctaacactggattct

SEQ ID NO: 71525 - DNA, 20 bp, synthetic construct
  misc_feature 1..20: note = CRISPR gRNA sequence
  source 1..20: mol_type = other DNA
acacctaacactggattctc

SEQ ID NO: 71526 - DNA, 20 bp, synthetic construct
  misc_feature 1..20: note = CRISPR gRNA sequence
  source 1..20: mol_type = other DNA
acactggattctcccttttt

SEQ ID NO: 71527 - DNA, 20 bp, synthetic construct
  misc_feature 1..20: note = CRISPR gRNA sequence
  source 1..20: mol_type = other DNA
gattctccctttttaaccaa

SEQ ID NO: 71528 - DNA, 20 bp, synthetic construct
  misc_feature 1..20: note = CRISPR gRNA sequence
  source 1..20: mol_type = other DNA
tccctttttaaccaaaaggg

SEQ ID NO: 71529 - DNA, 20 bp, synthetic construct
  misc_feature 1..20: note = CRISPR gRNA sequence
  source 1..20: mol_type = other DNA
cctttttaaccaaaagggtt

SEQ ID NO: 71530 - DNA, 20 bp, synthetic construct
  misc_feature 1..20: note = CRISPR gRNA sequence
  source 1..20: mol_type = other DNA
tttaaccaaaagggttaaaa

SEQ ID NO: 71531 - DNA, 20 bp, synthetic construct
  misc_feature 1..20: note = CRISPR gRNA sequence
  source 1..20: mol_type = other DNA
ttaaccaaaagggttaaaaa

SEQ ID NO: 71532 - DNA, 20 bp, synthetic construct
  misc_feature 1..20: note = CRISPR gRNA sequence
  source 1..20: mol_type = other DNA
taaccaaaagggttaaaaac

SEQ ID NO: 71533 - DNA, 20 bp, synthetic construct
  misc_feature 1..20: note = CRISPR gRNA sequence
  source 1..20: mol_type = other DNA
aaccaaaagggttaaaaacc

SEQ ID NO: 71534 - DNA, 20 bp, synthetic construct
  misc_feature 1..20: note = CRISPR gRNA sequence
  source 1..20: mol_type = other DNA
accaaaagggttaaaaaccc

SEQ ID NO: 71535 - DNA, 20 bp, synthetic construct
  misc_feature 1..20: note = CRISPR gRNA sequence
  source 1..20: mol_type = other DNA
aaaacccaacatcttaggaa

SEQ ID NO: 71536 - DNA, 20 bp, synthetic construct
  misc_feature 1..20: note = CRISPR gRNA sequence
  source 1..20: mol_type = other DNA
aggaagggcatatgttccaa

SEQ ID NO: 71537 - DNA, 20 bp, synthetic construct
  misc_feature 1..20: note = CRISPR gRNA sequence
  source 1..20: mol_type = other DNA
ggaagggcatatgttccaac

SEQ ID NO: 71538 - DNA, 20 bp, synthetic construct
  misc_feature 1..20: note = CRISPR gRNA sequence
  source 1..20: mol_type = other DNA
caactagaagttaataccat

SEQ ID NO: 71539 - DNA, 20 bp, synthetic construct
  misc_feature 1..20: note = CRISPR gRNA sequence
  source 1..20: mol_type = other DNA
gaagttaataccattgtttg

SEQ ID NO: 71540 - DNA, 20 bp, synthetic construct
  misc_feature 1..20: note = CRISPR gRNA sequence
  source 1..20: mol_type = other DNA
ataccattgtttgtactata

SEQ ID NO: 71541 - DNA, 20 bp, synthetic construct
  misc_feature 1..20: note = CRISPR gRNA sequence
  source 1..20: mol_type = other DNA
tttgtactatatttattttt

SEQ ID NO: 71542 - DNA, 20 bp, synthetic construct
  misc_feature 1..20: note = CRISPR gRNA sequence
  source 1..20: mol_type = other DNA
gtactatatttatttttgta

SEQ ID NO: 71543 - DNA, 20 bp, synthetic construct
  misc_feature 1..20: note = CRISPR gRNA sequence
  source 1..20: mol_type = other DNA
tactatatttatttttgtaa

SEQ ID NO: 71544 - DNA, 20 bp, synthetic construct
  misc_feature 1..20: note = CRISPR gRNA sequence
  source 1..20: mol_type = other DNA
tatttatttttgtaactacc

SEQ ID NO: 71545 - DNA, 20 bp, synthetic construct
  misc_feature 1..20: note = CRISPR gRNA sequence
  source 1..20: mol_type = other DNA
atttttgtaactaccttcta

SEQ ID NO: 71546 - DNA, 20 bp, synthetic construct
  misc_feature 1..20: note = CRISPR gRNA sequence
  source 1..20: mol_type = other DNA
tttttgtaactaccttctat

SEQ ID NO: 71547 - DNA, 20 bp, synthetic construct
  misc_feature 1..20: note = CRISPR gRNA sequence
  source 1..20: mol_type = other DNA
ttgtaactaccttctatatg

SEQ ID NO: 71548 - DNA, 20 bp, synthetic construct
  misc_feature 1..20: note = CRISPR gRNA sequence
  source 1..20: mol_type = other DNA
tgtaactaccttctatatgg

SEQ ID NO: 71549 - DNA, 20 bp, synthetic construct
  misc_feature 1..20: note = CRISPR gRNA sequence
  source 1..20: mol_type = other DNA
gtaactaccttctatatgga

SEQ ID NO: 71550 - DNA, 20 bp, synthetic construct
  misc_feature 1..20: note = CRISPR gRNA sequence
  source 1..20: mol_type = other DNA
taactaccttctatatggag

SEQ ID NO: 71551 - DNA, 20 bp, synthetic construct
  misc_feature 1..20: note = CRISPR gRNA sequence
  source 1..20: mol_type = other DNA
ccttctatatggagtctgta

SEQ ID NO: 71552 - DNA, 20 bp, synthetic construct
  misc_feature 1..20: note = CRISPR gRNA sequence
  source 1..20: mol_type = other DNA
ctatatggagtctgtaacac

SEQ ID NO: 71553 - DNA, 20 bp, synthetic construct
  misc_feature 1..20: note = CRISPR gRNA sequence
  source 1..20: mol_type = other DNA
tatatggagtctgtaacaca

SEQ ID NO: 71554 - DNA, 20 bp, synthetic construct
  misc_feature 1..20: note = CRISPR gRNA sequence
  source 1..20: mol_type = other DNA
tatggagtctgtaacacaag

SEQ ID NO: 71555 - DNA, 20 bp, synthetic construct
  misc_feature 1..20: note = CRISPR gRNA sequence
  source 1..20: mol_type = other DNA
taacacaagttttccattga

SEQ ID NO: 71556 - DNA, 20 bp, synthetic construct
  misc_feature 1..20: note = CRISPR gRNA sequence
  source 1..20: mol_type = other DNA
tccattgatagtagcaataa

SEQ ID NO: 71557 - DNA, 20 bp, synthetic construct
  misc_feature 1..20: note = CRISPR gRNA sequence
  source 1..20: mol_type = other DNA
ccattgatagtagcaataaa

SEQ ID NO: 71558 - DNA, 20 bp, synthetic construct
  misc_feature 1..20: note = CRISPR gRNA sequence
  source 1..20: mol_type = other DNA
cattgatagtagcaataaaa

SEQ ID NO: 71559 - DNA, 20 bp, synthetic construct
  misc_feature 1..20: note = CRISPR gRNA sequence
  source 1..20: mol_type = other DNA
atagtagcaataaaagtttc

SEQ ID NO: 71560 - DNA, 20 bp, synthetic construct
  misc_feature 1..20: note = CRISPR gRNA sequence
  source 1..20: mol_type = other DNA
cctttcaagatttttttttt

SEQ ID NO: 71561 - DNA, 20 bp, synthetic construct
  misc_feature 1..20: note = CRISPR gRNA sequence
  source 1..20: mol_type = other DNA
ctttcaagattttttttttt

SEQ ID NO: 71562 - DNA, 20 bp, synthetic construct
  misc_feature 1..20: note = CRISPR gRNA sequence
  source 1..20: mol_type = other DNA
tcaagatttttttttttttt

SEQ ID NO: 71563 - DNA, 20 bp, synthetic construct
  misc_feature 1..20: note = CRISPR gRNA sequence
  source 1..20: mol_type = other DNA
caagattttttttttttttt

SEQ ID NO: 71564 - DNA, 20 bp, synthetic construct
  misc_feature 1..20: note = CRISPR gRNA sequence
  source 1..20: mol_type = other DNA
aagatttttttttttttttt

SEQ ID NO: 71565 - DNA, 20 bp, synthetic construct
  misc_feature 1..20: note = CRISPR gRNA sequence
  source 1..20: mol_type = other DNA
ttttttttttttttttttga

SEQ ID NO: 71566 - DNA, 20 bp, synthetic construct
  misc_feature 1..20: note = CRISPR gRNA sequence
  source 1..20: mol_type = other DNA
tttttttttttttttttgag

SEQ ID NO: 71567 - DNA, 20 bp, synthetic construct
  misc_feature 1..20: note = CRISPR gRNA sequence
  source 1..20: mol_type = other DNA
ttttttttttttttttgaga

SEQ ID NO: 71568 - DNA, 20 bp, synthetic construct
  misc_feature 1..20: note = CRISPR gRNA sequence
  source 1..20: mol_type = other DNA
tttttttttttttttgagat

SEQ ID NO: 71569 - DNA, 20 bp, synthetic construct
  misc_feature 1..20: note = CRISPR gRNA sequence
  source 1..20: mol_type = other DNA
ttttttttttttttgagatg

SEQ ID NO: 71570 - DNA, 20 bp, synthetic construct
  misc_feature 1..20: note = CRISPR gRNA sequence
  source 1..20: mol_type = other DNA
tttttttttttttgagatgg

SEQ ID NO: 71571 - DNA, 20 bp, synthetic construct
  misc_feature 1..20: note = CRISPR gRNA sequence
  source 1..20: mol_type = other DNA
ttttttttttttgagatgga

SEQ ID NO: 71572 - DNA, 20 bp, synthetic construct
  misc_feature 1..20: note = CRISPR gRNA sequence
  source 1..20: mol_type = other DNA
tttttttttttgagatggag

SEQ ID NO: 71573 - DNA, 20 bp, synthetic construct
  misc_feature 1..20: note = CRISPR gRNA sequence
  source 1..20: mol_type = other DNA
ttttttttttgagatggagt

SEQ ID NO: 71574 - DNA, 20 bp, synthetic construct
  misc_feature 1..20: note = CRISPR gRNA sequence
  source 1..20: mol_type = other DNA
tttttttttgagatggagtc

SEQ ID NO: 71575 - DNA, 20 bp, synthetic construct
  misc_feature 1..20: note = CRISPR gRNA sequence
  source 1..20: mol_type = other DNA
ttttttttgagatggagtct

SEQ ID NO: 71576 - DNA, 20 bp, synthetic construct
  misc_feature 1..20: note = CRISPR gRNA sequence
  source 1..20: mol_type = other DNA
tttttttgagatggagtctc

SEQ ID NO: 71577 - DNA, 20 bp, synthetic construct
  misc_feature 1..20: note = CRISPR gRNA sequence
  source 1..20: mol_type = other DNA
ttttttgagatggagtctcc

SEQ ID NO: 71578 - DNA, 20 bp, synthetic construct
  misc_feature 1..20: note = CRISPR gRNA sequence
  source 1..20: mol_type = other DNA
tttttgagatggagtctccc

SEQ ID NO: 71579 - DNA, 20 bp, synthetic construct
  misc_feature 1..20: note = CRISPR gRNA sequence
  source 1..20: mol_type = other DNA
ttttgagatggagtctccct

SEQ ID NO: 71580 - DNA, 20 bp, synthetic construct
  misc_feature 1..20: note = CRISPR gRNA sequence
  source 1..20: mol_type = other DNA
tttgagatggagtctccctc

SEQ ID NO: 71581 - DNA, 20 bp, synthetic construct
  misc_feature 1..20: note = CRISPR gRNA sequence
  source 1..20: mol_type = other DNA
ttgagatggagtctccctct

SEQ ID NO: 71582 - DNA, 20 bp, synthetic construct
  misc_feature 1..20: note = CRISPR gRNA sequence
  source 1..20: mol_type = other DNA
tgagatggagtctccctctg

SEQ ID NO: 71583 - DNA, 20 bp, synthetic construct
  misc_feature 1..20: note = CRISPR gRNA sequence
  source 1..20: mol_type = other DNA
gagatggagtctccctctgt

SEQ ID NO: 71584 - DNA, 20 bp, synthetic construct
  misc_feature 1..20: note = CRISPR gRNA sequence
  source 1..20: mol_type = other DNA
agatggagtctccctctgtt

SEQ ID NO: 71585 - DNA, 20 bp, synthetic construct
  misc_feature 1..20: note = CRISPR gRNA sequence
  source 1..20: mol_type = other DNA
cctctgttacccaggctgga

SEQ ID NO: 71586 - DNA, 20 bp, synthetic construct
  misc_feature 1..20: note = CRISPR gRNA sequence
  source 1..20: mol_type = other DNA
tgttacccaggctggagtgc

SEQ ID NO: 71587 - DNA, 20 bp, synthetic construct
  misc_feature 1..20: note = CRISPR gRNA sequence
  source 1..20: mol_type = other DNA
ttacccaggctggagtgcag

SEQ ID NO: 71588 - DNA, 20 bp, synthetic construct
  misc_feature 1..20: note = CRISPR gRNA sequence
  source 1..20: mol_type = other DNA
cccaggctggagtgcagtgg

SEQ ID NO: 71589 - DNA, 20 bp, synthetic construct
  misc_feature 1..20: note = CRISPR gRNA sequence
  source 1..20: mol_type = other DNA
gagtgcagtggtgcaatctc

SEQ ID NO: 71590 - DNA, 20 bp, synthetic construct
  misc_feature 1..20: note = CRISPR gRNA sequence
  source 1..20: mol_type = other DNA
ggctcactgcaacctccacc

SEQ ID NO: 71591 - DNA, 20 bp, synthetic construct
  misc_feature 1..20: note = CRISPR gRNA sequence
  source 1..20: mol_type = other DNA
actgcaacctccacctgccg

SEQ ID NO: 71592 - DNA, 20 bp, synthetic construct
  misc_feature 1..20: note = CRISPR gRNA sequence
  source 1..20: mol_type = other DNA
caacctccacctgccgggtt

SEQ ID NO: 71593 - DNA, 20 bp, synthetic construct
  misc_feature 1..20: note = CRISPR gRNA sequence
  source 1..20: mol_type = other DNA
cacctgccgggttcaagaga

SEQ ID NO: 71594 - DNA, 20 bp, synthetic construct
  misc_feature 1..20: note = CRISPR gRNA sequence
  source 1..20: mol_type = other DNA
ccgggttcaagagattctcc

SEQ ID NO: 71595 - DNA, 20 bp, synthetic construct
  misc_feature 1..20: note = CRISPR gRNA sequence
  source 1..20: mol_type = other DNA
aagagattctcctgcctcag

SEQ ID NO: 71596 - DNA, 20 bp, synthetic construct
  misc_feature 1..20: note = CRISPR gRNA sequence
  source 1..20: mol_type = other DNA
tcctgcctcagcctcctgag

SEQ ID NO: 71597 - DNA, 20 bp, synthetic construct
  misc_feature 1..20: note = CRISPR gRNA sequence
  source 1..20: mol_type = other DNA
ctgcctcagcctcctgagta

SEQ ID NO: 71598 - DNA, 20 bp, synthetic construct
  misc_feature 1..20: note = CRISPR gRNA sequence
  source 1..20: mol_type = other DNA
cctcagcctcctgagtagct

SEQ ID NO: 71599 - DNA, 20 bp, synthetic construct
  misc_feature 1..20: note = CRISPR gRNA sequence
  source 1..20: mol_type = other DNA
agcctcctgagtagctggga

SEQ ID NO: 71600 - DNA, 20 bp, synthetic construct
  misc_feature 1..20: note = CRISPR gRNA sequence
  source 1..20: mol_type = other DNA
ctgagtagctgggattacaa

SEQ ID NO: 71601 - DNA, 20 bp, synthetic construct
  misc_feature 1..20: note = CRISPR gRNA sequence
  source 1..20: mol_type = other DNA
agtagctgggattacaagtg

SEQ ID NO: 71602 - DNA, 20 bp, synthetic construct
  misc_feature 1..20: note = CRISPR gRNA sequence
  source 1..20: mol_type = other DNA
ggattacaagtgcccaccac

SEQ ID NO: 71603 - DNA, 20 bp, synthetic construct
  misc_feature 1..20: note = CRISPR gRNA sequence
  source 1..20: mol_type = other DNA
caagtgcccaccaccacacc

SEQ ID NO: 71604 - DNA, 20 bp, synthetic construct
  misc_feature 1..20: note = CRISPR gRNA sequence
  source 1..20: mol_type = other DNA
atttttgtatttttagtaga

SEQ ID NO: 71605 - DNA, 20 bp, synthetic construct
  misc_feature 1..20: note = CRISPR gRNA sequence
  source 1..20: mol_type = other DNA
ttgtatttttagtagagaca

SEQ ID NO: 71606 - DNA, 20 bp, synthetic construct
  misc_feature 1..20: note = CRISPR gRNA sequence
  source 1..20: mol_type = other DNA
tgtatttttagtagagacag

SEQ ID NO: 71607 - DNA, 20 bp, synthetic construct
  misc_feature 1..20: note = CRISPR gRNA sequence
  source 1..20: mol_type = other DNA
gtatttttagtagagacagg

SEQ ID NO: 71608 - DNA, 20 bp, synthetic construct
  misc_feature 1..20: note = CRISPR gRNA sequence
  source 1..20: mol_type = other DNA
tatttttagtagagacagga

SEQ ID NO: 71609 - DNA, 20 bp, synthetic construct
  misc_feature 1..20: note = CRISPR gRNA sequence
  source 1..20: mol_type = other DNA
ttagtagagacaggatttca

SEQ ID NO: 71610 - DNA, 20 bp, synthetic construct
  misc_feature 1..20: note = CRISPR gRNA sequence
  source 1..20: mol_type = other DNA
tagtagagacaggatttcac

SEQ ID NO: 71611 - DNA, 20 bp, synthetic construct
  misc_feature 1..20: note = CRISPR gRNA sequence
  source 1..20: mol_type = other DNA
agtagagacaggatttcacc

SEQ ID NO: 71612 - DNA, 20 bp, synthetic construct
  misc_feature 1..20: note = CRISPR gRNA sequence
  source 1..20: mol_type = other DNA
gtagagacaggatttcacca

SEQ ID NO: 71613 - DNA, 20 bp, synthetic construct
  misc_feature 1..20: note = CRISPR gRNA sequence
  source 1..20: mol_type = other DNA
caccatgttggttaggctcg

SEQ ID NO: 71614 - DNA, 20 bp, synthetic construct
  misc_feature 1..20: note = CRISPR gRNA sequence
  source 1..20: mol_type = other DNA
accatgttggttaggctcgt

SEQ ID NO: 71615 - DNA, 20 bp, synthetic construct
  misc_feature 1..20: note = CRISPR gRNA sequence
  source 1..20: mol_type = other DNA
gttaggctcgtctcaaacac

SEQ ID NO: 71616 - DNA, 20 bp, synthetic construct
  misc_feature 1..20: note = CRISPR gRNA sequence
  source 1..20: mol_type = other DNA
ggctcgtctcaaacacctga

SEQ ID NO: 71617 - DNA, 20 bp, synthetic construct
  misc_feature 1..20: note = CRISPR gRNA sequence
  source 1..20: mol_type = other DNA
gtctcaaacacctgaccttg

SEQ ID NO: 71618 - DNA, 20 bp, synthetic construct
  misc_feature 1..20: note = CRISPR gRNA sequence
  source 1..20: mol_type = other DNA
aaacacctgaccttggcctc

SEQ ID NO: 71619 - DNA, 20 bp, synthetic construct
  misc_feature 1..20: note = CRISPR gRNA sequence
  source 1..20: mol_type = other DNA
accttggcctcccaaagtgc

SEQ ID NO: 71620 - DNA, 20 bp, synthetic construct
  misc_feature 1..20: note = CRISPR gRNA sequence
  source 1..20: mol_type = other DNA
ggcctcccaaagtgctggga

SEQ ID NO: 71621 - DNA, 20 bp, synthetic construct
  misc_feature 1..20: note = CRISPR gRNA sequence
  source 1..20: mol_type = other DNA
gcctcccaaagtgctgggat

SEQ ID NO: 71622 - DNA, 20 bp, synthetic construct
  misc_feature 1..20: note = CRISPR gRNA sequence
  source 1..20: mol_type = other DNA
ccaaagtgctgggattacag

SEQ ID NO: 71623 - DNA, 20 bp, synthetic construct
  misc_feature 1..20: note = CRISPR gRNA sequence
  source 1..20: mol_type = other DNA
ggattacaggcgtgagcaac

SEQ ID NO: 71624 - DNA, 20 bp, synthetic construct
  misc_feature 1..20: note = CRISPR gRNA sequence
  source 1..20: mol_type = other DNA
caggcgtgagcaaccacgcc

SEQ ID NO: 71625 - DNA, 20 bp, synthetic construct
  misc_feature 1..20: note = CRISPR gRNA sequence
  source 1..20: mol_type = other DNA
attttttaaagtaagaaaaa

SEQ ID NO: 71626 - DNA, 20 bp, synthetic construct
  misc_feature 1..20: note = CRISPR gRNA sequence
  source 1..20: mol_type = other DNA
tttaaagtaagaaaaaagag

SEQ ID NO: 71627 - DNA, 20 bp, synthetic construct
  misc_feature 1..20: note = CRISPR gRNA sequence
  source 1..20: mol_type = other DNA
ttaaagtaagaaaaaagagg

SEQ ID NO: 71628 - DNA, 20 bp, synthetic construct
  misc_feature 1..20: note = CRISPR gRNA sequence
  source 1..20: mol_type = other DNA
taaagtaagaaaaaagaggg

SEQ ID NO: 71629 - DNA, 20 bp, synthetic construct
  misc_feature 1..20: note = CRISPR gRNA sequence
  source 1..20: mol_type = other DNA
aaagtaagaaaaaagagggg

SEQ ID NO: 71630 - DNA, 20 bp, synthetic construct
  misc_feature 1..20: note = CRISPR gRNA sequence
  source 1..20: mol_type = other DNA
aagtaagaaaaaagaggggg

SEQ ID NO: 71631 - DNA, 20 bp, synthetic construct
  misc_feature 1..20: note = CRISPR gRNA sequence
  source 1..20: mol_type = other DNA
aaagaaaaatatgatgcatc

SEQ ID NO: 71632 - DNA, 20 bp, synthetic construct
  misc_feature 1..20: note = CRISPR gRNA sequence
  source 1..20: mol_type = other DNA
aagaaaaatatgatgcatct

SEQ ID NO: 71633 - DNA, 20 bp, synthetic construct
  misc_feature 1..20: note = CRISPR gRNA sequence
  source 1..20: mol_type = other DNA
aaatacaggaggtacatgta

SEQ ID NO: 71634 - DNA, 20 bp, synthetic construct
  misc_feature 1..20: note = CRISPR gRNA sequence
  source 1..20: mol_type = other DNA
aatacaggaggtacatgtat

SEQ ID NO: 71635 - DNA, 20 bp, synthetic construct
  misc_feature 1..20: note = CRISPR gRNA sequence
  source 1..20: mol_type = other DNA
gtgaacaacgtcatgattca

SEQ ID NO: 71636 - DNA, 20 bp, synthetic construct
  misc_feature 1..20: note = CRISPR gRNA sequence
  source 1..20: mol_type = other DNA
tgaacaacgtcatgattcaa

SEQ ID NO: 71637 - DNA, 20 bp, synthetic construct
  misc_feature 1..20: note = CRISPR gRNA sequence
  source 1..20: mol_type = other DNA
aaacttgacggggaggggag

SEQ ID NO: 71638 - DNA, 20 bp, synthetic construct
  misc_feature 1..20: note = CRISPR gRNA sequence
  source 1..20: mol_type = other DNA
gacggggaggggagcaggga

SEQ ID NO: 71639 - DNA, 20 bp, synthetic construct
  misc_feature 1..20: note = CRISPR gRNA sequence
  source 1..20: mol_type = other DNA
acggggaggggagcagggag

SEQ ID NO: 71640 - DNA, 20 bp, synthetic construct
  misc_feature 1..20: note = CRISPR gRNA sequence
  source 1..20: mol_type = other DNA
caccctgacgtcttcagggg

SEQ ID NO: 71641 - DNA, 20 bp, synthetic construct
  misc_feature 1..20: note = CRISPR gRNA sequence
  source 1..20: mol_type = other DNA
acgtcttcaggggaggacac

SEQ ID NO: 71642 - DNA, 20 bp, synthetic construct
  misc_feature 1..20: note = CRISPR gRNA sequence
  source 1..20: mol_type = other DNA
caggggaggacacacaagca

SEQ ID NO: 71643 - DNA, 20 bp, synthetic construct
  misc_feature 1..20: note = CRISPR gRNA sequence
  source 1..20: mol_type = other DNA
aggggaggacacacaagcac

SEQ ID NO: 71644 - DNA, 20 bp, synthetic construct
  misc_feature 1..20: note = CRISPR gRNA sequence
  source 1..20: mol_type = other DNA
tcaggtggcctctcttgaaa

SEQ ID NO: 71645 - DNA, 20 bp, synthetic construct
  misc_feature 1..20: note = CRISPR gRNA sequence
  source 1..20: mol_type = other DNA
tcttgaaaacccttgccccc

SEQ ID NO: 71646 - DNA, 20 bp, synthetic construct
  misc_feature 1..20: note = CRISPR gRNA sequence
  source 1..20: mol_type = other DNA
ttgaaaacccttgcccccac

SEQ ID NO: 71647 - DNA, 20 bp, synthetic construct
  misc_feature 1..20: note = CRISPR gRNA sequence
  source 1..20: mol_type = other DNA
gaaaacccttgcccccacga

SEQ ID NO: 71648 - DNA, 20 bp, synthetic construct
  misc_feature 1..20: note = CRISPR gRNA sequence
  source 1..20: mol_type = other DNA
aaaacccttgcccccacgac

SEQ ID NO: 71649 - DNA, 20 bp, synthetic construct
  misc_feature 1..20: note = CRISPR gRNA sequence
  source 1..20: mol_type = other DNA
gcccccacgactggcaccct

SEQ ID NO: 71650 - DNA, 20 bp, synthetic construct
  misc_feature 1..20: note = CRISPR gRNA sequence
  source 1..20: mol_type = other DNA
cccccacgactggcaccctg

SEQ ID NO: 71651 - DNA, 20 bp, synthetic construct
  misc_feature 1..20: note = CRISPR gRNA sequence
  source 1..20: mol_type = other DNA
gcaccctgctttccccattc

SEQ ID NO: 71652 - DNA, 20 bp, synthetic construct
  misc_feature 1..20: note = CRISPR gRNA sequence
  source 1..20: mol_type = other DNA
ctttccccattcactgcctt

SEQ ID NO: 71653 - DNA, 20 bp, synthetic construct
  misc_feature 1..20: note = CRISPR gRNA sequence
  source 1..20: mol_type = other DNA
tccccattcactgccttgtc

SEQ ID NO: 71654 - DNA, 20 bp, synthetic construct
  misc_feature 1..20: note = CRISPR gRNA sequence
  source 1..20: mol_type = other DNA
ccccattcactgccttgtct

SEQ ID NO: 71655 - DNA, 20 bp, synthetic construct
  misc_feature 1..20: note = CRISPR gRNA sequence
  source 1..20: mol_type = other DNA
cccattcactgccttgtctc

SEQ ID NO: 71656 - DNA, 20 bp, synthetic construct
  misc_feature 1..20: note = CRISPR gRNA sequence
  source 1..20: mol_type = other DNA
actgccttgtctccacccct

SEQ ID NO: 71657 - DNA, 20 bp, synthetic construct
  misc_feature 1..20: note = CRISPR gRNA sequence
  source 1..20: mol_type = other DNA
ccttgtctccacccctcgac

SEQ ID NO: 71658 - DNA, 20 bp, synthetic construct
  misc_feature 1..20: note = CRISPR gRNA sequence
  source 1..20: mol_type = other DNA
gtctccacccctcgacctcc

SEQ ID NO: 71659 - DNA, 20 bp, synthetic construct
  misc_feature 1..20: note = CRISPR gRNA sequence
  source 1..20: mol_type = other DNA
tctccacccctcgacctcct

SEQ ID NO: 71660 - DNA, 20 bp, synthetic construct
  misc_feature 1..20: note = CRISPR gRNA sequence
  source 1..20: mol_type = other DNA
cacccctcgacctccttgct

SEQ ID NO: 71661 - DNA, 20 bp, synthetic construct
  misc_feature 1..20: note = CRISPR gRNA sequence
  source 1..20: mol_type = other DNA
gacctccttgctctcctgcc

SEQ ID NO: 71662 - DNA, 20 bp, synthetic construct
  misc_feature 1..20: note = CRISPR gRNA sequence
  source 1..20: mol_type = other DNA
cttgctctcctgccgctgac

SEQ ID NO: 71663 - DNA, 20 bp, synthetic construct
  misc_feature 1..20: note = CRISPR gRNA sequence
  source 1..20: mol_type = other DNA
gctctcctgccgctgacttt

SEQ ID NO: 71664 - DNA, 20 bp, synthetic construct
  misc_feature 1..20: note = CRISPR gRNA sequence
  source 1..20: mol_type = other DNA
ctctcctgccgctgactttg

SEQ ID NO: 71665 - DNA, 20 bp, synthetic construct
  misc_feature 1..20: note = CRISPR gRNA sequence
  source 1..20: mol_type = other DNA
tcctgccgctgactttggga

SEQ ID NO: 71666 - DNA, 20 bp, synthetic construct
  misc_feature 1..20: note = CRISPR gRNA sequence
  source 1..20: mol_type = other DNA
ctgccgctgactttgggacc

SEQ ID NO: 71667 - DNA, 20 bp, synthetic construct
  misc_feature 1..20: note = CRISPR gRNA sequence
  source 1..20: mol_type = other DNA
ccgctgactttgggacccct

SEQ ID NO: 71668 - DNA, 20 bp, synthetic construct
  misc_feature 1..20: note = CRISPR gRNA sequence
  source 1..20: mol_type = other DNA
actttgggacccctaccctg

SEQ ID NO: 71669 - DNA, 20 bp, synthetic construct
  misc_feature 1..20: note = CRISPR gRNA sequence
  source 1..20: mol_type = other DNA
tgggacccctaccctgcagg

SEQ ID NO: 71670 - DNA, 20 bp, synthetic construct
  misc_feature 1..20: note = CRISPR gRNA sequence
  source 1..20: mol_type = other DNA
gggacccctaccctgcaggc

SEQ ID NO: 71671 - DNA, 20 bp, synthetic construct
  misc_feature 1..20: note = CRISPR gRNA sequence
  source 1..20: mol_type = other DNA
ggacccctaccctgcaggct

SEQ ID NO: 71672 - DNA, 20 bp, synthetic construct
  misc_feature 1..20: note = CRISPR gRNA sequence
  source 1..20: mol_type = other DNA
ccctgcaggctgtcctggaa

SEQ ID NO: 71673 - DNA, 20 bp, synthetic construct
  misc_feature 1..20: note = CRISPR gRNA sequence
  source 1..20: mol_type = other DNA
caggctgtcctggaatctcc

SEQ ID NO: 71674 - DNA, 20 bp, synthetic construct
  misc_feature 1..20: note = CRISPR gRNA sequence
  source 1..20: mol_type = other DNA
tcctggaatctcctcgggga

SEQ ID NO: 71675 - DNA, 20 bp, synthetic construct
  misc_feature 1..20: note = CRISPR gRNA sequence
  source 1..20: mol_type = other DNA
gaatctcctcggggatgagg

SEQ ID NO: 71676 - DNA, 20 bp, synthetic construct
  misc_feature 1..20: note = CRISPR gRNA sequence
  source 1..20: mol_type = other DNA
ctcggggatgaggcagctgc

SEQ ID NO: 71677 - DNA, 20 bp, synthetic construct
  misc_feature 1..20: note = CRISPR gRNA sequence
  source 1..20: mol_type = other DNA
ggggatgaggcagctgccga

SEQ ID NO: 71678 - DNA, 20 bp, synthetic construct
  misc_feature 1..20: note = CRISPR gRNA sequence
  source 1..20: mol_type = other DNA
ccgagctggcccaggtgctg

SEQ ID NO: 71679 - DNA, 20 bp, synthetic construct
  misc_feature 1..20: note = CRISPR gRNA sequence
  source 1..20: mol_type = other DNA
gcccaggtgctgccgcagat

SEQ ID NO: 71680 - DNA, 20 bp, synthetic construct
  misc_feature 1..20: note = CRISPR gRNA sequence
  source 1..20: mol_type = other DNA
ccgcagatgggccggctgaa

SEQ ID NO: 71681 - DNA, 20 bp, synthetic construct
  misc_feature 1..20: note = CRISPR gRNA sequence
  source 1..20: mol_type = other DNA
aagagagtggagtatgaggg

SEQ ID NO: 71682 - DNA, 20 bp, synthetic construct
  misc_feature 1..20: note = CRISPR gRNA sequence
  source 1..20: mol_type = other DNA
aagggggacctacatcccgg

SEQ ID NO: 71683 - DNA, 20 bp, synthetic construct
  misc_feature 1..20: note = CRISPR gRNA sequence
  source 1..20: mol_type = other DNA
catcccgggaacaccaagag

SEQ ID NO: 71684 - DNA, 20 bp, synthetic construct
  misc_feature 1..20: note = CRISPR gRNA sequence
  source 1..20: mol_type = other DNA
ggtcagtcccctgcctccca

SEQ ID NO: 71685 - DNA, 20 bp, synthetic construct
  misc_feature 1..20: note = CRISPR gRNA sequence
  source 1..20: mol_type = other DNA
cctcccagaaagcccttcct

SEQ ID NO: 71686 - DNA, 20 bp, synthetic construct
  misc_feature 1..20: note = CRISPR gRNA sequence
  source 1..20: mol_type = other DNA
ccagaaagcccttccttgag

SEQ ID NO: 71687 - DNA, 20 bp, synthetic construct
  misc_feature 1..20: note = CRISPR gRNA sequence
  source 1..20: mol_type = other DNA
ccttgagttgcacactctgg

SEQ ID NO: 71688 - DNA, 20 bp, synthetic construct
  misc_feature 1..20: note = CRISPR gRNA sequence
  source 1..20: mol_type = other DNA
cttgagttgcacactctggc

SEQ ID NO: 71689 - DNA, 20 bp, synthetic construct
  misc_feature 1..20: note = CRISPR gRNA sequence
  source 1..20: mol_type = other DNA
gagttgcacactctggcctg

SEQ ID NO: 71690 - DNA, 20 bp, synthetic construct
  misc_feature 1..20: note = CRISPR gRNA sequence
  source 1..20: mol_type = other DNA
agttgcacactctggcctgt

SEQ ID NO: 71691 - DNA, 20 bp, synthetic construct
  misc_feature 1..20: note = CRISPR gRNA sequence
  source 1..20: mol_type = other DNA
cacactctggcctgttccaa

SEQ ID NO: 71692 - DNA, 20 bp, synthetic construct
  misc_feature 1..20: note = CRISPR gRNA sequence
  source 1..20: mol_type = other DNA
tggcctgttccaagcccctg

SEQ ID NO: 71693 - DNA, 20 bp, synthetic construct
  misc_feature 1..20: note = CRISPR gRNA sequence
  source 1..20: mol_type = other DNA
gcctgttccaagcccctgcc

SEQ ID NO: 71694 - DNA, 20 bp, synthetic construct
  misc_feature 1..20: note = CRISPR gRNA sequence
  source 1..20: mol_type = other DNA
ttccaagcccctgccaggct

SEQ ID NO: 71695 - DNA, 20 bp, synthetic construct
  misc_feature 1..20: note = CRISPR gRNA sequence
  source 1..20: mol_type = other DNA
caagcccctgccaggcttag

SEQ ID NO: 71696 - DNA, 20 bp, synthetic construct
  misc_feature 1..20: note = CRISPR gRNA sequence
  source 1..20: mol_type = other DNA
ccaggcttagttccccctgg

SEQ ID NO: 71697 - DNA, 20 bp, synthetic construct
  misc_feature 1..20: note = CRISPR gRNA sequence
  source 1..20: mol_type = other DNA
agttccccctgggttctagc

SEQ ID NO: 71698 - DNA, 20 bp, synthetic construct
  misc_feature 1..20: note = CRISPR gRNA sequence
  source 1..20: mol_type = other DNA
gttccccctgggttctagcc

SEQ ID NO: 71699 - DNA, 20 bp, synthetic construct
  misc_feature 1..20: note = CRISPR gRNA sequence
  source 1..20: mol_type = other DNA
cccctgggttctagccttca

SEQ ID NO: 71700 - DNA, 20 bp, synthetic construct
  misc_feature 1..20: note = CRISPR gRNA sequence
  source 1..20: mol_type = other DNA
ggttctagccttcagccttc

SEQ ID NO: 71701 - DNA, 20 bp, synthetic construct
  misc_feature 1..20: note = CRISPR gRNA sequence
  source 1..20: mol_type = other DNA
tagccttcagccttcctgct

SEQ ID NO: 71702 - DNA, 20 bp, synthetic construct
  misc_feature 1..20: note = CRISPR gRNA sequence
  source 1..20: mol_type = other DNA
gccttcagccttcctgctgc

SEQ ID NO: 71703 - DNA, 20 bp, synthetic construct
  misc_feature 1..20: note = CRISPR gRNA sequence
  source 1..20: mol_type = other DNA
cagccttcctgctgcacctg

SEQ ID NO: 71704 - DNA, 20 bp, synthetic construct
  misc_feature 1..20: note = CRISPR gRNA sequence
  source 1..20: mol_type = other DNA
agccttcctgctgcacctgc

SEQ ID NO: 71705 - DNA, 20 bp, synthetic construct
  misc_feature 1..20: note = CRISPR gRNA sequence
  source 1..20: mol_type = other DNA
cctgctgcacctgccaccag

SEQ ID NO: 71706 - DNA, 20 bp, synthetic construct
  misc_feature 1..20: note = CRISPR gRNA sequence
  source 1..20: mol_type = other DNA
ctgctgcacctgccaccagt

SEQ ID NO: 71707 - DNA, 20 bp, synthetic construct
  misc_feature 1..20: note = CRISPR gRNA sequence
  source 1..20: mol_type = other DNA
ctgcacctgccaccagtccc

SEQ ID NO: 71708 - DNA, 20 bp, synthetic construct
  misc_feature 1..20: note = CRISPR gRNA sequence
  source 1..20: mol_type = other DNA
cacctgccaccagtcccctg

SEQ ID NO: 71709 - DNA, 20 bp, synthetic construct
  misc_feature 1..20: note = CRISPR gRNA sequence
  source 1..20: mol_type = other DNA
ccaccagtcccctgttgtct

SEQ ID NO: 71710 - DNA, 20 bp, synthetic construct
  misc_feature 1..20: note = CRISPR gRNA sequence
  source 1..20: mol_type = other DNA
ttgtcttttgggttccctga

SEQ ID NO: 71711 - DNA, 20 bp, synthetic construct
  misc_feature 1..20: note = CRISPR gRNA sequence
  source 1..20: mol_type = other DNA
tcttttgggttccctgagaa

SEQ ID NO: 71712 - DNA, 20 bp, synthetic construct
  misc_feature 1..20: note = CRISPR gRNA sequence
  source 1..20: mol_type = other DNA
ttgggttccctgagaaggta

SEQ ID NO: 71713 - DNA, 20 bp, synthetic construct
  misc_feature 1..20: note = CRISPR gRNA sequence
  source 1..20: mol_type = other DNA
tgggttccctgagaaggtag

SEQ ID NO: 71714 - DNA, 20 bp, synthetic construct
  misc_feature 1..20: note = CRISPR gRNA sequence
  source 1..20: mol_type = other DNA
gggttccctgagaaggtagt

SEQ ID NO: 71715 - DNA, 20 bp, synthetic construct
  misc_feature 1..20: note = CRISPR gRNA sequence
  source 1..20: mol_type = other DNA
ggttccctgagaaggtagtg

SEQ ID NO: 71716 - DNA, 20 bp, synthetic construct
  misc_feature 1..20: note = CRISPR gRNA sequence
  source 1..20: mol_type = other DNA
cctgagaaggtagtgtggga

SEQ ID NO: 71717 - DNA, 20 bp, synthetic construct
  misc_feature 1..20: note = CRISPR gRNA sequence
  source 1..20: mol_type = other DNA
agaaggtagtgtgggagact

SEQ ID NO: 71718 - DNA, 20 bp, synthetic construct
  misc_feature 1..20: note = CRISPR gRNA sequence
  source 1..20: mol_type = other DNA
tgtcccctgaccttggcctg

SEQ ID NO: 71719 - DNA, 20 bp, synthetic construct
  misc_feature 1..20: note = CRISPR gRNA sequence
  source 1..20: mol_type = other DNA
accttggcctgaggaaggga

SEQ ID NO: 71720 - DNA, 20 bp, synthetic construct
  misc_feature 1..20: note = CRISPR gRNA sequence
  source 1..20: mol_type = other DNA
ggcctgaggaagggacctag

SEQ ID NO: 71721 - DNA, 20 bp, synthetic construct
  misc_feature 1..20: note = CRISPR gRNA sequence
  source 1..20: mol_type = other DNA
gcctgaggaagggacctagg

SEQ ID NO: 71722 - DNA, 20 bp, synthetic construct
  misc_feature 1..20: note = CRISPR gRNA sequence
  source 1..20: mol_type = other DNA
aggaagggacctaggaaact

SEQ ID NO: 71723 - DNA, 20 bp, synthetic construct
  misc_feature 1..20: note = CRISPR gRNA sequence
  source 1..20: mol_type = other DNA
ggaaactctcacacccattc

SEQ ID NO: 71724 - DNA, 20 bp, synthetic construct
  misc_feature 1..20: note = CRISPR gRNA sequence
  source 1..20: mol_type = other DNA
tcacacccattctcatggcc

SEQ ID NO: 71725 - DNA, 20 bp, synthetic construct
  misc_feature 1..20: note = CRISPR gRNA sequence
  source 1..20: mol_type = other DNA
acacccattctcatggccgt

SEQ ID NO: 71726 - DNA, 20 bp, synthetic construct
  misc_feature 1..20: note = CRISPR gRNA sequence
  source 1..20: mol_type = other DNA
tcatggccgtgtttctcttt

SEQ ID NO: 71727 - DNA, 20 bp, synthetic construct
  misc_feature 1..20: note = CRISPR gRNA sequence
  source 1..20: mol_type = other DNA
atggccgtgtttctctttcc

SEQ ID NO: 71728 - DNA, 20 bp, synthetic construct
  misc_feature 1..20: note = CRISPR gRNA sequence
  source 1..20: mol_type = other DNA
ctctttcccctcccctcact

SEQ ID NO: 71729 - DNA, 20 bp, synthetic construct
  misc_feature 1..20: note = CRISPR gRNA sequence
  source 1..20: mol_type = other DNA
tctttcccctcccctcactg

SEQ ID NO: 71730 - DNA, 20 bp, synthetic construct
  misc_feature 1..20: note = CRISPR gRNA sequence
  source 1..20: mol_type = other DNA
tttcccctcccctcactgtc

SEQ ID NO: 71731 - DNA, 20 bp, synthetic construct
  misc_feature 1..20: note = CRISPR gRNA sequence
  source 1..20: mol_type = other DNA
tcccctcccctcactgtcca

SEQ ID NO: 71732 - DNA, 20 bp, synthetic construct
  misc_feature 1..20: note = CRISPR gRNA sequence
  source 1..20: mol_type = other DNA
cccctcccctcactgtccac

SEQ ID NO: 71733 - DNA, 20 bp, synthetic construct
  misc_feature 1..20: note = CRISPR gRNA sequence
  source 1..20: mol_type = other DNA
ccctcccctcactgtccact

SEQ ID NO: 71734 - DNA, 20 bp, synthetic construct
  misc_feature 1..20: note = CRISPR gRNA sequence
  source 1..20: mol_type = other DNA
ccctcactgtccactgagaa

SEQ ID NO: 71735 - DNA, 20 bp, synthetic construct
  misc_feature 1..20: note = CRISPR gRNA sequence
  source 1..20: mol_type = other DNA
actgtccactgagaagcctg

SEQ ID NO: 71736 - DNA, 20 bp, synthetic construct
  misc_feature 1..20: note = CRISPR gRNA sequence
  source 1..20: mol_type = other DNA
tccactgagaagcctggaga

SEQ ID NO: 71737 - DNA, 20 bp, synthetic construct
  misc_feature 1..20: note = CRISPR gRNA sequence
  source 1..20: mol_type = other DNA
agaagcctggagaagaatca

SEQ ID NO: 71738 - DNA, 20 bp, synthetic construct
  misc_feature 1..20: note = CRISPR gRNA sequence
  source 1..20: mol_type = other DNA
gagaagaatcagatcacagc

SEQ ID NO: 71739 - DNA, 20 bp, synthetic construct
  misc_feature 1..20: note = CRISPR gRNA sequence
  source 1..20: mol_type = other DNA
tgggggcctggctcctggct

SEQ ID NO: 71740 - DNA, 20 bp, synthetic construct
  misc_feature 1..20: note = CRISPR gRNA sequence
  source 1..20: mol_type = other DNA
gggggcctggctcctggctg

SEQ ID NO: 71741 - DNA, 20 bp, synthetic construct
  misc_feature 1..20: note = CRISPR gRNA sequence
  source 1..20: mol_type = other DNA
ggggcctggctcctggctga

SEQ ID NO: 71742 - DNA, 20 bp, synthetic construct
  misc_feature 1..20: note = CRISPR gRNA sequence
  source 1..20: mol_type = other DNA
gctcctggctgaaggactgg

SEQ ID NO: 71743 - DNA, 20 bp, synthetic construct
  misc_feature 1..20: note = CRISPR gRNA sequence
  source 1..20: mol_type = other DNA
ctggctgaaggactggccca

SEQ ID NO: 71744 - DNA, 20 bp, synthetic construct
  misc_feature 1..20: note = CRISPR gRNA sequence
  source 1..20: mol_type = other DNA
gctgaaggactggcccaggg

SEQ ID NO: 71745 - DNA, 20 bp, synthetic construct
  misc_feature 1..20: note = CRISPR gRNA sequence
  source 1..20: mol_type = other DNA
aaggactggcccaggggtct

SEQ ID NO: 71746 - DNA, 20 bp, synthetic construct
  misc_feature 1..20: note = CRISPR gRNA sequence
  source 1..20: mol_type = other DNA
gcccaggggtctagcatcca

SEQ ID NO: 71747 - DNA, 20 bp, synthetic construct
  misc_feature 1..20: note = CRISPR gRNA sequence
  source 1..20: mol_type = other DNA
gcatccaagtcatccggtaa

SEQ ID NO: 71748 - DNA, 20 bp, synthetic construct
  misc_feature 1..20: note = CRISPR gRNA sequence
  source 1..20: mol_type = other DNA
caggggcagggatggtgggt

SEQ ID NO: 71749 - DNA, 20 bp, synthetic construct
  misc_feature 1..20: note = CRISPR gRNA sequence
  source 1..20: mol_type = other DNA
caccaacccccagatctaat

SEQ ID NO: 71750 - DNA, 20 bp, synthetic construct
  misc_feature 1..20: note = CRISPR gRNA sequence
  source 1..20: mol_type = other DNA
atgggactccctggaggagg

SEQ ID NO: 71751 - DNA, 20 bp, synthetic construct
  misc_feature 1..20: note = CRISPR gRNA sequence
  source 1..20: mol_type = other DNA
cctggaggaggcggcagggc

SEQ ID NO: 71752 - DNA, 20 bp, synthetic construct
  misc_feature 1..20: note = CRISPR gRNA sequence
  source 1..20: mol_type = other DNA
gaggaggcggcagggcctgg

SEQ ID NO: 71753 - DNA, 20 bp, synthetic construct
  misc_feature 1..20: note = CRISPR gRNA sequence
  source 1..20: mol_type = other DNA
ggctggggattatcaaagga

SEQ ID NO: 71754 - DNA, 20 bp, synthetic construct
  misc_feature 1..20: note = CRISPR gRNA sequence
  source 1..20: mol_type = other DNA
gggattatcaaaggagactt

SEQ ID NO: 71755 - DNA, 20 bp, synthetic construct
  misc_feature 1..20: note = CRISPR gRNA sequence
  source 1..20: mol_type = other DNA
tcaaaggagacttggaccac

SEQ ID NO: 71756 - DNA, 20 bp, synthetic construct
  misc_feature 1..20: note = CRISPR gRNA sequence
  source 1..20: mol_type = other DNA
ggaccactccaccaagaatt

SEQ ID NO: 71757 - DNA, 20 bp, synthetic construct
  misc_feature 1..20: note = CRISPR gRNA sequence
  source 1..20: mol_type = other DNA
gaccactccaccaagaattt

SEQ ID NO: 71758 - DNA, 20 bp, synthetic construct
  misc_feature 1..20: note = CRISPR gRNA sequence
  source 1..20: mol_type = other DNA
caccaagaatttggcagcaa

SEQ ID NO: 71759 - DNA, 20 bp, synthetic construct
  misc_feature 1..20: note = CRISPR gRNA sequence
  source 1..20: mol_type = other DNA
ggcagcaagcagacttggat

SEQ ID NO: 71760 - DNA, 20 bp, synthetic construct
  misc_feature 1..20: note = CRISPR gRNA sequence
  source 1..20: mol_type = other DNA
gcagcaagcagacttggatc

SEQ ID NO: 71761 - DNA, 20 bp, synthetic construct
  misc_feature 1..20: note = CRISPR gRNA sequence
  source 1..20: mol_type = other DNA
ggatcaaaccccagctctgc

SEQ ID NO: 71762 - DNA, 20 bp, synthetic construct
  misc_feature 1..20: note = CRISPR gRNA sequence
  source 1..20: mol_type = other DNA
gatcaaaccccagctctgcc

SEQ ID NO: 71763 - DNA, 20 bp, synthetic construct
  misc_feature 1..20: note = CRISPR gRNA sequence
  source 1..20: mol_type = other DNA
tgccacttgccaactgtgta

SEQ ID NO: 71764 - DNA, 20 bp, synthetic construct
  misc_feature 1..20: note = CRISPR gRNA sequence
  source 1..20: mol_type = other DNA
ccacttgccaactgtgtaac

SEQ ID NO: 71765 - DNA, 20 bp, synthetic construct
  misc_feature 1..20: note = CRISPR gRNA sequence
  source 1..20: mol_type = other DNA
gccaactgtgtaactttgta

SEQ ID NO: 71766 - DNA, 20 bp, synthetic construct
  misc_feature 1..20: note = CRISPR gRNA sequence
  source 1..20: mol_type = other DNA
ccaactgtgtaactttgtag

SEQ ID NO: 71767 - DNA, 20 bp, synthetic construct
  misc_feature 1..20: note = CRISPR gRNA sequence
  source 1..20: mol_type = other DNA
tgtaactttgtagccataac

SEQ ID NO: 71768 - DNA, 20 bp, synthetic construct
  misc_feature 1..20: note = CRISPR gRNA sequence
  source 1..20: mol_type = other DNA
tgtagccataactcaacctc

SEQ ID NO: 71769 - DNA, 20 bp, synthetic construct
  misc_feature 1..20: note = CRISPR gRNA sequence
  source 1..20: mol_type = other DNA
gtagccataactcaacctct

SEQ ID NO: 71770 - DNA, 20 bp, synthetic construct
  misc_feature 1..20: note = CRISPR gRNA sequence
  source 1..20: mol_type = other DNA
tagccataactcaacctctc

SEQ ID NO: 71771 - DNA, 20 bp, synthetic construct
  misc_feature 1..20: note = CRISPR gRNA sequence
  source 1..20: mol_type = other DNA
aacctctctgaaccccaatt

SEQ ID NO: 71772 - DNA, 20 bp, synthetic construct
  misc_feature 1..20: note = CRISPR gRNA sequence
  source 1..20: mol_type = other DNA
tctgaaccccaattttctca

SEQ ID NO: 71773 - DNA, 20 bp, synthetic construct
  misc_feature 1..20: note = CRISPR gRNA sequence
  source 1..20: mol_type = other DNA
tgaaccccaattttctcatc

SEQ ID NO: 71774 - DNA, 20 bp, synthetic construct
  misc_feature 1..20: note = CRISPR gRNA sequence
  source 1..20: mol_type = other DNA
aaccccaattttctcatctg

SEQ ID NO: 71775 - DNA, 20 bp, synthetic construct
  misc_feature 1..20: note = CRISPR gRNA sequence
  source 1..20: mol_type = other DNA
tctcatctgtgaaatgggga

SEQ ID NO: 71776 - DNA, 20 bp, synthetic construct
  misc_feature 1..20: note = CRISPR gRNA sequence
  source 1..20: mol_type = other DNA
ctcatctgtgaaatggggat

SEQ ID NO: 71777 - DNA, 20 bp, synthetic construct
  misc_feature 1..20: note = CRISPR gRNA sequence
  source 1..20: mol_type = other DNA
tcatctgtgaaatggggata

SEQ ID NO: 71778 - DNA, 20 bp, synthetic construct
  misc_feature 1..20: note = CRISPR gRNA sequence
  source 1..20: mol_type = other DNA
atctgtgaaatggggatact

SEQ ID NO: 71779 - DNA, 20 bp, synthetic construct
  misc_feature 1..20: note = CRISPR gRNA sequence
  source 1..20: mol_type = other DNA
tgaaatggggatactgatag

SEQ ID NO: 71780 - DNA, 20 bp, synthetic construct
  misc_feature 1..20: note = CRISPR gRNA sequence
  source 1..20: mol_type = other DNA
atagtatctacctcagagag

SEQ ID NO: 71781 - DNA, 20 bp, synthetic construct
  misc_feature 1..20: note = CRISPR gRNA sequence
  source 1..20: mol_type = other DNA
cctcagagagttgtgaagac

SEQ ID NO: 71782 - DNA, 20 bp, synthetic construct
  misc_feature 1..20: note = CRISPR gRNA sequence
  source 1..20: mol_type = other DNA
agagagttgtgaagactaaa

SEQ ID NO: 71783 - DNA, 20 bp, synthetic construct
  misc_feature 1..20: note = CRISPR gRNA sequence
  source 1..20: mol_type = other DNA
tgaagactaaatgagcatat

SEQ ID NO: 71784 - DNA, 20 bp, synthetic construct
  misc_feature 1..20: note = CRISPR gRNA sequence
  source 1..20: mol_type = other DNA
aatgagcatataaagcactg

SEQ ID NO: 71785 - DNA, 20 bp, synthetic construct
  misc_feature 1..20: note = CRISPR gRNA sequence
  source 1..20: mol_type = other DNA
aacccaatgcctggcacata

SEQ ID NO: 71786 - DNA, 20 bp, synthetic construct
  misc_feature 1..20: note = CRISPR gRNA sequence
  source 1..20: mol_type = other DNA
gcacatagtaagcacttaaa

SEQ ID NO: 71787 - DNA, 20 bp, synthetic construct
  misc_feature 1..20: note = CRISPR gRNA sequence
  source 1..20: mol_type = other DNA
aaaatggcagctataatcag

SEQ ID NO: 71788 - DNA, 20 bp, synthetic construct
  misc_feature 1..20: note = CRISPR gRNA sequence
  source 1..20: mol_type = other DNA
aaatggcagctataatcaga

SEQ ID NO: 71789 - DNA, 20 bp, synthetic construct
  misc_feature 1..20: note = CRISPR gRNA sequence
  source 1..20: mol_type = other DNA
taatcagagccatcacatac

SEQ ID NO: 71790 - DNA, 20 bp, synthetic construct
  misc_feature 1..20: note = CRISPR gRNA sequence
  source 1..20: mol_type = other DNA
tataggttgtgcactgcaca

SEQ ID NO: 71791 - DNA, 20 bp, synthetic construct
  misc_feature 1..20: note = CRISPR gRNA sequence
  source 1..20: mol_type = other DNA
tgcactgcacaagggcatta

SEQ ID NO: 71792 - DNA, 20 bp, synthetic construct
  misc_feature 1..20: note = CRISPR gRNA sequence
  source 1..20: mol_type = other DNA
cacaagggcattaaacctaa

SEQ ID NO: 71793 - DNA, 20 bp, synthetic construct
  misc_feature 1..20: note = CRISPR gRNA sequence
  source 1..20: mol_type = other DNA
aacctaaggggcaccattca

SEQ ID NO: 71794 - DNA, 20 bp, synthetic construct
  misc_feature 1..20: note = CRISPR gRNA sequence
  source 1..20: mol_type = other DNA
aggggcaccattcacattgt

SEQ ID NO: 71795 - DNA, 20 bp, synthetic construct
  misc_feature 1..20: note = CRISPR gRNA sequence
  source 1..20: mol_type = other DNA
acattgtcaacctgctagat

SEQ ID NO: 71796 - DNA, 20 bp, synthetic construct
  misc_feature 1..20: note = CRISPR gRNA sequence
  source 1..20: mol_type = other DNA
tcaacctgctagatttctag

SEQ ID NO: 71797 - DNA, 20 bp, synthetic construct
  misc_feature 1..20: note = CRISPR gRNA sequence
  source 1..20: mol_type = other DNA
ctagatttctagcagatgag

SEQ ID NO: 71798 - DNA, 20 bp, synthetic construct
  misc_feature 1..20: note = CRISPR gRNA sequence
  source 1..20: mol_type = other DNA
gatttctagcagatgagagt

SEQ ID NO: 71799 - DNA, 20 bp, synthetic construct
  misc_feature 1..20: note = CRISPR gRNA sequence
  source 1..20: mol_type = other DNA
ctagcagatgagagtaaagt

SEQ ID NO: 71800 - DNA, 20 bp, synthetic construct
  misc_feature 1..20: note = CRISPR gRNA sequence
  source 1..20: mol_type = other DNA
tagcagatgagagtaaagta

SEQ ID NO: 71801 - DNA, 20 bp, synthetic construct
  misc_feature 1..20: note = CRISPR gRNA sequence
  source 1..20: mol_type = other DNA
gcagatgagagtaaagtacc

SEQ ID NO: 71802 - DNA, 20 bp, synthetic construct
  misc_feature 1..20: note = CRISPR gRNA sequence
  source 1..20: mol_type = other DNA
gttctaccaaaatcatatat

SEQ ID NO: 71803 - DNA, 20 bp, synthetic construct
  misc_feature 1..20: note = CRISPR gRNA sequence
  source 1..20: mol_type = other DNA
ttctaccaaaatcatatatt

SEQ ID NO: 71804 - DNA, 20 bp, synthetic construct
  misc_feature 1..20: note = CRISPR gRNA sequence
  source 1..20: mol_type = other DNA
taccaaaatcatatattatg

SEQ ID NO: 71805 - DNA, 20 bp, synthetic construct
  misc_feature 1..20: note = CRISPR gRNA sequence
  source 1..20: mol_type = other DNA
ccaaaatcatatattatgac

SEQ ID NO: 71806 - DNA, 20 bp, synthetic construct
  misc_feature 1..20: note = CRISPR gRNA sequence
  source 1..20: mol_type = other DNA
tgacaatttcagacagatgg

SEQ ID NO: 71807 - DNA, 20 bp, synthetic construct
  misc_feature 1..20: note = CRISPR gRNA sequence
  source 1..20: mol_type = other DNA
cagacagatggaagtaaaac

SEQ ID NO: 71808 - DNA, 20 bp, synthetic construct
  misc_feature 1..20: note = CRISPR gRNA sequence
  source 1..20: mol_type = other DNA
agacagatggaagtaaaaca

SEQ ID NO: 71809 - DNA, 20 bp, synthetic construct
  misc_feature 1..20: note = CRISPR gRNA sequence
  source 1..20: mol_type = other DNA
gaagaaagagggtcttttcc

SEQ ID NO: 71810 - DNA, 20 bp, synthetic construct
  misc_feature 1..20: note = CRISPR gRNA sequence
  source 1..20: mol_type = other DNA
aagaaagagggtcttttcct

SEQ ID NO: 71811 - DNA, 20 bp, synthetic construct
  misc_feature 1..20: note = CRISPR gRNA sequence
  source 1..20: mol_type = other DNA
ttccttatttgcacaaatgt

SEQ ID NO: 71812 - DNA, 20 bp, synthetic construct
  misc_feature 1..20: note = CRISPR gRNA sequence
  source 1..20: mol_type = other DNA
tccttatttgcacaaatgtg

SEQ ID NO: 71813 - DNA, 20 bp, synthetic construct
  misc_feature 1..20: note = CRISPR gRNA sequence
  source 1..20: mol_type = other DNA
ccttatttgcacaaatgtgt

SEQ ID NO: 71814 - DNA, 20 bp, synthetic construct
  misc_feature 1..20: note = CRISPR gRNA sequence
  source 1..20: mol_type = other DNA
cttatttgcacaaatgtgtc

SEQ ID NO: 71815 - DNA, 20 bp, synthetic construct
  misc_feature 1..20: note = CRISPR gRNA sequence
  source 1..20: mol_type = other DNA
atttgcacaaatgtgtcata

SEQ ID NO: 71816 - DNA, 20 bp, synthetic construct
  misc_feature 1..20: note = CRISPR gRNA sequence
  source 1..20: mol_type = other DNA
tttgcacaaatgtgtcatat

SEQ ID NO: 71817 - DNA, 20 bp, synthetic construct
  misc_feature 1..20: note = CRISPR gRNA sequence
  source 1..20: mol_type = other DNA
gcacaaatgtgtcatatgag

SEQ ID NO: 71818 - DNA, 20 bp, synthetic construct
  misc_feature 1..20: note = CRISPR gRNA sequence
  source 1..20: mol_type = other DNA
cacaaatgtgtcatatgagt

SEQ ID NO: 71819 - DNA, 20 bp, synthetic construct
  misc_feature 1..20: note = CRISPR gRNA sequence
  source 1..20: mol_type = other DNA
agctggcatcactatctccc

SEQ ID NO: 71820 - DNA, 20 bp, synthetic construct
  misc_feature 1..20: note = CRISPR gRNA sequence
  source 1..20: mol_type = other DNA
gctggcatcactatctccca

SEQ ID NO: 71821 - DNA, 20 bp, synthetic construct
  misc_feature 1..20: note = CRISPR gRNA sequence
  source 1..20: mol_type = other DNA
gcatcactatctcccaggga

SEQ ID NO: 71822 - DNA, 20 bp, synthetic construct
  misc_feature 1..20: note = CRISPR gRNA sequence
  source 1..20: mol_type = other DNA
tctcccagggaggaaggttg

SEQ ID NO: 71823 - DNA, 20 bp, synthetic construct
  misc_feature 1..20: note = CRISPR gRNA sequence
  source 1..20: mol_type = other DNA
ccagggaggaaggttgagtt

SEQ ID NO: 71824 - DNA, 20 bp, synthetic construct
  misc_feature 1..20: note = CRISPR gRNA sequence
  source 1..20: mol_type = other DNA
agttggaggactcaggaggc

SEQ ID NO: 71825 - DNA, 20 bp, synthetic construct
  misc_feature 1..20: note = CRISPR gRNA sequence
  source 1..20: mol_type = other DNA
gaggactcaggaggcaggtg

SEQ ID NO: 71826 - DNA, 20 bp, synthetic construct
  misc_feature 1..20: note = CRISPR gRNA sequence
  source 1..20: mol_type = other DNA
aggaggcaggtgtggggtac

SEQ ID NO: 71827 - DNA, 20 bp, synthetic construct
  misc_feature 1..20: note = CRISPR gRNA sequence
  source 1..20: mol_type = other DNA
tccctaggtcagctatgctg

SEQ ID NO: 71828 - DNA, 20 bp, synthetic construct
  misc_feature 1..20: note = CRISPR gRNA sequence
  source 1..20: mol_type = other DNA
cctaggtcagctatgctggt

SEQ ID NO: 71829 - DNA, 20 bp, synthetic construct
  misc_feature 1..20: note = CRISPR gRNA sequence
  source 1..20: mol_type = other DNA
ggtcagctatgctggtctaa

SEQ ID NO: 71830 - DNA, 20 bp, synthetic construct
  misc_feature 1..20: note = CRISPR gRNA sequence
  source 1..20: mol_type = other DNA
tgctggtctaacacctgcct

SEQ ID NO: 71831 - DNA, 20 bp, synthetic construct
  misc_feature 1..20: note = CRISPR gRNA sequence
  source 1..20: mol_type = other DNA
gtctaacacctgcctctgcc

SEQ ID NO: 71832 - DNA, 20 bp, synthetic construct
  misc_feature 1..20: note = CRISPR gRNA sequence
  source 1..20: mol_type = other DNA
acacctgcctctgccaggta

SEQ ID NO: 71833 - DNA, 20 bp, synthetic construct
  misc_feature 1..20: note = CRISPR gRNA sequence
  source 1..20: mol_type = other DNA
cctctgccaggtaactctag

SEQ ID NO: 71834 - DNA, 20 bp, synthetic construct
  misc_feature 1..20: note = CRISPR gRNA sequence
  source 1..20: mol_type = other DNA
tgccaggtaactctaggcac

SEQ ID NO: 71835 - DNA, 20 bp, synthetic construct
  misc_feature 1..20: note = CRISPR gRNA sequence
  source 1..20: mol_type = other DNA
ccaggtaactctaggcacag

SEQ ID NO: 71836 - DNA, 20 bp, synthetic construct
  misc_feature 1..20: note = CRISPR gRNA sequence
  source 1..20: mol_type = other DNA
taggcacagctctacctttt

SEQ ID NO: 71837 - DNA, 20 bp, synthetic construct
  misc_feature 1..20: note = CRISPR gRNA sequence
  source 1..20: mol_type = other DNA
ggcacagctctacctttttg

SEQ ID NO: 71838 - DNA, 20 bp, synthetic construct
  misc_feature 1..20: note = CRISPR gRNA sequence
  source 1..20: mol_type = other DNA
tacctttttgggcctcagcc

SEQ ID NO: 71839 - DNA, 20 bp, synthetic construct
  misc_feature 1..20: note = CRISPR gRNA sequence
  source 1..20: mol_type = other DNA
cctttttgggcctcagcctc

SEQ ID NO: 71840 - DNA, 20 bp, synthetic construct
  misc_feature 1..20: note = CRISPR gRNA sequence
  source 1..20: mol_type = other DNA
tttgggcctcagcctcccaa

SEQ ID NO: 71841 - DNA, 20 bp, synthetic construct
  misc_feature 1..20: note = CRISPR gRNA sequence
  source 1..20: mol_type = other DNA
ttgggcctcagcctcccaat

SEQ ID NO: 71842 - DNA, 20 bp, synthetic construct
  misc_feature 1..20: note = CRISPR gRNA sequence
  source 1..20: mol_type = other DNA
tgggcctcagcctcccaatc

SEQ ID NO: 71843 - DNA, 20 bp, synthetic construct
  misc_feature 1..20: note = CRISPR gRNA sequence
  source 1..20: mol_type = other DNA
gggcctcagcctcccaatct

SEQ ID NO: 71844 - DNA, 20 bp, synthetic construct
  misc_feature 1..20: note = CRISPR gRNA sequence
  source 1..20: mol_type = other DNA
ggcctcagcctcccaatctg

SEQ ID NO: 71845 - DNA, 20 bp, synthetic construct
  misc_feature 1..20: note = CRISPR gRNA sequence
  source 1..20: mol_type = other DNA
agcctcccaatctgcagata

SEQ ID NO: 71846 - DNA, 20 bp, synthetic construct
  misc_feature 1..20: note = CRISPR gRNA sequence
  source 1..20: mol_type = other DNA
ccaatctgcagatacgacag

SEQ ID NO: 71847 - DNA, 20 bp, synthetic construct
  misc_feature 1..20: note = CRISPR gRNA sequence
  source 1..20: mol_type = other DNA
cagatacgacagatggcaaa

SEQ ID NO: 71848 - DNA, 20 bp, synthetic construct
  misc_feature 1..20: note = CRISPR gRNA sequence
  source 1..20: mol_type = other DNA
tatctgtgccccacagcctc

SEQ ID NO: 71849 - DNA, 20 bp, synthetic construct
  misc_feature 1..20: note = CRISPR gRNA sequence
  source 1..20: mol_type = other DNA
tgccccacagcctctggaat

SEQ ID NO: 71850 - DNA, 20 bp, synthetic construct
  misc_feature 1..20: note = CRISPR gRNA sequence
  source 1..20: mol_type = other DNA
tggaataaccccattccctg

SEQ ID NO: 71851 - DNA, 20 bp, synthetic construct
  misc_feature 1..20: note = CRISPR gRNA sequence
  source 1..20: mol_type = other DNA
gaataaccccattccctgcg

SEQ ID NO: 71852 - DNA, 20 bp, synthetic construct
  misc_feature 1..20: note = CRISPR gRNA sequence
  source 1..20: mol_type = other DNA
cctgcgacatggcccagcac

SEQ ID NO: 71853 - DNA, 20 bp, synthetic construct
  misc_feature 1..20: note = CRISPR gRNA sequence
  source 1..20: mol_type = other DNA
cgacatggcccagcacctga

SEQ ID NO: 71854 - DNA, 20 bp, synthetic construct
  misc_feature 1..20: note = CRISPR gRNA sequence
  source 1..20: mol_type = other DNA
aagagccaggagcccaggct

SEQ ID NO: 71855 - DNA, 20 bp, synthetic construct
  misc_feature 1..20: note = CRISPR gRNA sequence
  source 1..20: mol_type = other DNA
gactttgccttctttgacaa

SEQ ID NO: 71856 - DNA, 20 bp, synthetic construct
  misc_feature 1..20: note = CRISPR gRNA sequence
  source 1..20: mol_type = other DNA
tgccttctttgacaaccagc

SEQ ID NO: 71857 - DNA, 20 bp, synthetic construct
  misc_feature 1..20: note = CRISPR gRNA sequence
  source 1..20: mol_type = other DNA
gccttctttgacaaccagcc

SEQ ID NO: 71858 - DNA, 20 bp, synthetic construct
  misc_feature 1..20: note = CRISPR gRNA sequence
  source 1..20: mol_type = other DNA
ccttctttgacaaccagccc

SEQ ID NO: 71859 - DNA, 20 bp, synthetic construct
  misc_feature 1..20: note = CRISPR gRNA sequence
  source 1..20: mol_type = other DNA
ctttgacaaccagccccagg

SEQ ID NO: 71860 - DNA, 20 bp, synthetic construct
  misc_feature 1..20: note = CRISPR gRNA sequence
  source 1..20: mol_type = other DNA
tttgacaaccagccccaggc

SEQ ID NO: 71861 - DNA, 20 bp, synthetic construct
  misc_feature 1..20: note = CRISPR gRNA sequence
  source 1..20: mol_type = other DNA
tgacaaccagccccaggccc

SEQ ID NO: 71862 - DNA, 20 bp, synthetic construct
  misc_feature 1..20: note = CRISPR gRNA sequence
  source 1..20: mol_type = other DNA
gacaaccagccccaggcccc

SEQ ID NO: 71863 - DNA, 20 bp, synthetic construct
  misc_feature 1..20: note = CRISPR gRNA sequence
  source 1..20: mol_type = other DNA
acaaccagccccaggcccct

SEQ ID NO: 71864 - DNA, 20 bp, synthetic construct
  misc_feature 1..20: note = CRISPR gRNA sequence
  source 1..20: mol_type = other DNA
ggggtacttgatggccccct

SEQ ID NO: 71865 - DNA, 20 bp, synthetic construct
  misc_feature 1..20: note = CRISPR gRNA sequence
  source 1..20: mol_type = other DNA
gggtacttgatggccccctc

SEQ ID NO: 71866 - DNA, 20 bp, synthetic construct
  misc_feature 1..20: note = CRISPR gRNA sequence
  source 1..20: mol_type = other DNA
gatggccccctcaagacctt

SEQ ID NO: 71867 - DNA, 20 bp, synthetic construct
  misc_feature 1..20: note = CRISPR gRNA sequence
  source 1..20: mol_type = other DNA
atggccccctcaagaccttt

SEQ ID NO: 71868 - DNA, 20 bp, synthetic construct
  misc_feature 1..20: note = CRISPR gRNA sequence
  source 1..20: mol_type = other DNA
aagacctttggaatccagcc

SEQ ID NO: 71869 - DNA, 20 bp, synthetic construct
  misc_feature 1..20: note = CRISPR gRNA sequence
  source 1..20: mol_type = other DNA
tggaatccagccaagtgatg

SEQ ID NO: 71870 - DNA, 20 bp, synthetic construct
  misc_feature 1..20: note = CRISPR gRNA sequence
  source 1..20: mol_type = other DNA
ggaatccagccaagtgatgc

SEQ ID NO: 71871 - DNA, 20 bp, synthetic construct
  misc_feature 1..20: note = CRISPR gRNA sequence
  source 1..20: mol_type = other DNA
gaatccagccaagtgatgca

SEQ ID NO: 71872 - DNA, 20 bp, synthetic construct
  misc_feature 1..20: note = CRISPR gRNA sequence
  source 1..20: mol_type = other DNA
tcgcccactgggataattga

SEQ ID NO: 71873 - DNA, 20 bp, synthetic construct
  misc_feature 1..20: note = CRISPR gRNA sequence
  source 1..20: mol_type = other DNA
cgcccactgggataattgac

SEQ ID NO: 71874 - DNA, 20 bp, synthetic construct
  misc_feature 1..20: note = CRISPR gRNA sequence
  source 1..20: mol_type = other DNA
gcccactgggataattgact

SEQ ID NO: 71875 - DNA, 20 bp, synthetic construct
  misc_feature 1..20: note = CRISPR gRNA sequence
  source 1..20: mol_type = other DNA
ggataattgactcaggaaag

SEQ ID NO: 71876 - DNA, 20 bp, synthetic construct
  misc_feature 1..20: note = CRISPR gRNA sequence
  source 1..20: mol_type = other DNA
actcaggaaagaagagcctc

SEQ ID NO: 71877 - DNA, 20 bp, synthetic construct
  misc_feature 1..20: note = CRISPR gRNA sequence
  source 1..20: mol_type = other DNA
aggaaagaagagcctcggca

SEQ ID NO: 71878 - DNA, 20 bp, synthetic construct
  misc_feature 1..20: note = CRISPR gRNA sequence
  source 1..20: mol_type = other DNA
ggcagggcgctctgcactcc

SEQ ID NO: 71879 - DNA, 20 bp, synthetic construct
  misc_feature 1..20: note = CRISPR gRNA sequence
  source 1..20: mol_type = other DNA
tgcactccacccaggaggaa

SEQ ID NO: 71880 - DNA, 20 bp, synthetic construct
  misc_feature 1..20: note = CRISPR gRNA sequence
  source 1..20: mol_type = other DNA
cactccacccaggaggaagg

SEQ ID NO: 71881 - DNA, 20 bp, synthetic construct
  misc_feature 1..20: note = CRISPR gRNA sequence
  source 1..20: mol_type = other DNA
cacccaggaggaaggatacg

SEQ ID NO: 71882 - DNA, 20 bp, synthetic construct
  misc_feature 1..20: note = CRISPR gRNA sequence
  source 1..20: mol_type = other DNA
ctgcagtcctcagggagaac

SEQ ID NO: 71883 - DNA, 20 bp, synthetic construct
  misc_feature 1..20: note = CRISPR gRNA sequence
  source 1..20: mol_type = other DNA
cagtcctcagggagaacttt

SEQ ID NO: 71884 - DNA, 20 bp, synthetic construct
  misc_feature 1..20: note = CRISPR gRNA sequence
  source 1..20: mol_type = other DNA
agggagaacttttttgggaa

SEQ ID NO: 71885 - DNA, 20 bp, synthetic construct
  misc_feature 1..20: note = CRISPR gRNA sequence
  source 1..20: mol_type = other DNA
ttttgggaaccaggagctgg

SEQ ID NO: 71886 - DNA, 20 bp, synthetic construct
  misc_feature 1..20: note = CRISPR gRNA sequence
  source 1..20: mol_type = other DNA
tttgggaaccaggagctggg

SEQ ID NO: 71887 - DNA, 20 bp, synthetic construct
  misc_feature 1..20: note = CRISPR gRNA sequence
  source 1..20: mol_type = other DNA
ttgggaaccaggagctgggt

SEQ ID NO: 71888 - DNA, 20 bp, synthetic construct
  misc_feature 1..20: note = CRISPR gRNA sequence
  source 1..20: mol_type = other DNA
tgggaaccaggagctgggtc

SEQ ID NO: 71889 - DNA, 20 bp, synthetic construct
  misc_feature 1..20: note = CRISPR gRNA sequence
  source 1..20: mol_type = other DNA
gggaaccaggagctgggtct

SEQ ID NO: 71890 - DNA, 20 bp, synthetic construct
  misc_feature 1..20: note = CRISPR gRNA sequence
  source 1..20: mol_type = other DNA
ggaaccaggagctgggtctg

SEQ ID NO: 71891 - DNA, 20 bp, synthetic construct
  misc_feature 1..20: note = CRISPR gRNA sequence
  source 1..20: mol_type = other DNA
ggtctggacaaaggagtacc

SEQ ID NO: 71892 - DNA, 20 bp, synthetic construct
  misc_feature 1..20: note = CRISPR gRNA sequence
  source 1..20: mol_type = other DNA
gacaaaggagtaccctgcat

SEQ ID NO: 71893 - DNA, 20 bp, synthetic construct
  misc_feature 1..20: note = CRISPR gRNA sequence
  source 1..20: mol_type = other DNA
cattacgtgggatatgtgtg

SEQ ID NO: 71894 - DNA, 20 bp, synthetic construct
  misc_feature 1..20: note = CRISPR gRNA sequence
  source 1..20: mol_type = other DNA
cgtgggatatgtgtgatcaa

SEQ ID NO: 71895 - DNA, 20 bp, synthetic construct
  misc_feature 1..20: note = CRISPR gRNA sequence
  source 1..20: mol_type = other DNA
gggacatgcgacacacaatg

SEQ ID NO: 71896 - DNA, 20 bp, synthetic construct
  misc_feature 1..20: note = CRISPR gRNA sequence
  source 1..20: mol_type = other DNA
tatgtggcagtgtgacccct

SEQ ID NO: 71897 - DNA, 20 bp, synthetic construct
  misc_feature 1..20: note = CRISPR gRNA sequence
  source 1..20: mol_type = other DNA
gacatgtggcgttacatgaa

SEQ ID NO: 71898 - DNA, 20 bp, synthetic construct
  misc_feature 1..20: note = CRISPR gRNA sequence
  source 1..20: mol_type = other DNA
acatgtggcgttacatgaaa

SEQ ID NO: 71899 - DNA, 20 bp, synthetic construct
  misc_feature 1..20: note = CRISPR gRNA sequence
  source 1..20: mol_type = other DNA
catgaaagtcagtgtggcac

SEQ ID NO: 71900 - DNA, 20 bp, synthetic construct
  misc_feature 1..20: note = CRISPR gRNA sequence
  source 1..20: mol_type = other DNA
tgtggcatgggtgctggcat

SEQ ID NO: 71901 - DNA, 20 bp, synthetic construct
  misc_feature 1..20: note = CRISPR gRNA sequence
  source 1..20: mol_type = other DNA
tggcatgggtgctggcatcc

SEQ ID NO: 71902 - DNA, 20 bp, synthetic construct
  misc_feature 1..20: note = CRISPR gRNA sequence
  source 1..20: mol_type = other DNA
gcatcccaagtagcaggata

SEQ ID NO: 71903 - DNA, 20 bp, synthetic construct
  misc_feature 1..20: note = CRISPR gRNA sequence
  source 1..20: mol_type = other DNA
ttggtctatatatgacacat

SEQ ID NO: 71904 - DNA, 20 bp, synthetic construct
  misc_feature 1..20: note = CRISPR gRNA sequence
  source 1..20: mol_type = other DNA
gtctatatatgacacatgac

SEQ ID NO: 71905 - DNA, 20 bp, synthetic construct
  misc_feature 1..20: note = CRISPR gRNA sequence
  source 1..20: mol_type = other DNA
tatatgacacatgacaaatg

SEQ ID NO: 71906 - DNA, 20 bp, synthetic construct
  misc_feature 1..20: note = CRISPR gRNA sequence
  source 1..20: mol_type = other DNA
atggctggccagatgacctc

SEQ ID NO: 71907 - DNA, 20 bp, synthetic construct
  misc_feature 1..20: note = CRISPR gRNA sequence
  source 1..20: mol_type = other DNA
gccagatgacctcaggctgg

SEQ ID NO: 71908 - DNA, 20 bp, synthetic construct
  misc_feature 1..20: note = CRISPR gRNA sequence
  source 1..20: mol_type = other DNA
aggctggcccaagatctaat

SEQ ID NO: 71909 - DNA, 20 bp, synthetic construct
  misc_feature 1..20: note = CRISPR gRNA sequence
  source 1..20: mol_type = other DNA
gcccaagatctaatttatta

SEQ ID NO: 71910 - DNA, 20 bp, synthetic construct
  misc_feature 1..20: note = CRISPR gRNA sequence
  source 1..20: mol_type = other DNA
atttattaatttttaaagca

SEQ ID NO: 71911 - DNA, 20 bp, synthetic construct
  misc_feature 1..20: note = CRISPR gRNA sequence
  source 1..20: mol_type = other DNA
attaatttttaaagcaaata

SEQ ID NO: 71912 - DNA, 20 bp, synthetic construct
  misc_feature 1..20: note = CRISPR gRNA sequence
  source 1..20: mol_type = other DNA
ttaatttttaaagcaaatac

SEQ ID NO: 71913 - DNA, 20 bp, synthetic construct
  misc_feature 1..20: note = CRISPR gRNA sequence
  source 1..20: mol_type = other DNA
atttttaaagcaaatacata

SEQ ID NO: 71914 - DNA, 20 bp, synthetic construct
  misc_feature 1..20: note = CRISPR gRNA sequence
  source 1..20: mol_type = other DNA
ttaaagcaaatacatattta

SEQ ID NO: 71915 - DNA, 20 bp, synthetic construct
  misc_feature 1..20: note = CRISPR gRNA sequence
  source 1..20: mol_type = other DNA
taaagcaaatacatatttat

SEQ ID NO: 71916 - DNA, 20 bp, synthetic construct
  misc_feature 1..20: note = CRISPR gRNA sequence
  source 1..20: mol_type = other DNA
aaagcaaatacatatttata

SEQ ID NO: 71917 - DNA, 20 bp, synthetic construct
  misc_feature 1..20: note = CRISPR gRNA sequence
  source 1..20: mol_type = other DNA
aagcaaatacatatttatag

SEQ ID NO: 71918 - DNA, 20 bp, synthetic construct
  misc_feature 1..20: note = CRISPR gRNA sequence
  source 1..20: mol_type = other DNA
atagattgtgtgtatggagc

SEQ ID NO: 71919 - DNA, 20 bp, synthetic construct
  misc_feature 1..20: note = CRISPR gRNA sequence
  source 1..20: mol_type = other DNA
tagattgtgtgtatggagca

SEQ ID NO: 71920 - DNA, 20 bp, synthetic construct
  misc_feature 1..20: note = CRISPR gRNA sequence
  source 1..20: mol_type = other DNA
tgtgtatggagcagctaagt

SEQ ID NO: 71921 - DNA, 20 bp, synthetic construct
  misc_feature 1..20: note = CRISPR gRNA sequence
  source 1..20: mol_type = other DNA
agtcaggaaaagtcttccgc

SEQ ID NO: 71922 - DNA, 20 bp, synthetic construct
  misc_feature 1..20: note = CRISPR gRNA sequence
  source 1..20: mol_type = other DNA
ccgcccgagctgggagggga

SEQ ID NO: 71923 - DNA, 20 bp, synthetic construct
  misc_feature 1..20: note = CRISPR gRNA sequence
  source 1..20: mol_type = other DNA
cgcccgagctgggaggggag

SEQ ID NO: 71924 - DNA, 20 bp, synthetic construct
  misc_feature 1..20: note = CRISPR gRNA sequence
  source 1..20: mol_type = other DNA
ggaggggagagtgtccatgc

SEQ ID NO: 71925 - DNA, 20 bp, synthetic construct
  misc_feature 1..20: note = CRISPR gRNA sequence
  source 1..20: mol_type = other DNA
accagtccaggggctcaagg

SEQ ID NO: 71926 - DNA, 20 bp, synthetic construct
  misc_feature 1..20: note = CRISPR gRNA sequence
  source 1..20: mol_type = other DNA
aagggccagggctctggaac

SEQ ID NO: 71927 - DNA, 20 bp, synthetic construct
  misc_feature 1..20: note = CRISPR gRNA sequence
  source 1..20: mol_type = other DNA
tggaacaagccagggactca

SEQ ID NO: 71928 - DNA, 20 bp, synthetic construct
  misc_feature 1..20: note = CRISPR gRNA sequence
  source 1..20: mol_type = other DNA
gaacaagccagggactcagc

SEQ ID NO: 71929 - DNA, 20 bp, synthetic construct
  misc_feature 1..20: note = CRISPR gRNA sequence
  source 1..20: mol_type = other DNA
agccattaagtcccctcctg

SEQ ID NO: 71930 - DNA, 20 bp, synthetic construct
  misc_feature 1..20: note = CRISPR gRNA sequence
  source 1..20: mol_type = other DNA
agtcccctcctgcctcaatc

SEQ ID NO: 71931 - DNA, 20 bp, synthetic construct
  misc_feature 1..20: note = CRISPR gRNA sequence
  source 1..20: mol_type = other DNA
ctgcctcaatcctcagccta

SEQ ID NO: 71932 - DNA, 20 bp, synthetic construct
  misc_feature 1..20: note = CRISPR gRNA sequence
  source 1..20: mol_type = other DNA
cctcaatcctcagcctaccc

SEQ ID NO: 71933 - DNA, 20 bp, synthetic construct
  misc_feature 1..20: note = CRISPR gRNA sequence
  source 1..20: mol_type = other DNA
aatcctcagcctacccatct

SEQ ID NO: 71934 - DNA, 20 bp, synthetic construct
  misc_feature 1..20: note = CRISPR gRNA sequence
  source 1..20: mol_type = other DNA
agcctacccatctataaact

SEQ ID NO: 71935 - DNA, 20 bp, synthetic construct
  misc_feature 1..20: note = CRISPR gRNA sequence
  source 1..20: mol_type = other DNA
cccatctataaacttgatga

SEQ ID NO: 71936 - DNA, 20 bp, synthetic construct
  misc_feature 1..20: note = CRISPR gRNA sequence
  source 1..20: mol_type = other DNA
taaacttgatgactcctccc

SEQ ID NO: 71937 - DNA, 20 bp, synthetic construct
  misc_feature 1..20: note = CRISPR gRNA sequence
  source 1..20: mol_type = other DNA
gatgactcctcccttactta

SEQ ID NO: 71938 - DNA, 20 bp, synthetic construct
  misc_feature 1..20: note = CRISPR gRNA sequence
  source 1..20: mol_type = other DNA
atgactcctcccttacttac

SEQ ID NO: 71939 - DNA, 20 bp, synthetic construct
  misc_feature 1..20: note = CRISPR gRNA sequence
  source 1..20: mol_type = other DNA
ctcccttacttacatactag

SEQ ID NO: 71940 - DNA, 20 bp, synthetic construct
  misc_feature 1..20: note = CRISPR gRNA sequence
  source 1..20: mol_type = other DNA
ccttacttacatactagctt

SEQ ID NO: 71941 - DNA, 20 bp, synthetic construct
  misc_feature 1..20: note = CRISPR gRNA sequence
  source 1..20: mol_type = other DNA
acttacatactagcttccaa

SEQ ID NO: 71942 - DNA, 20 bp, synthetic construct
  misc_feature 1..20: note = CRISPR gRNA sequence
  source 1..20: mol_type = other DNA
cttacatactagcttccaag

SEQ ID NO: 71943 - DNA, 20 bp, synthetic construct
  misc_feature 1..20: note = CRISPR gRNA sequence
  source 1..20: mol_type = other DNA
acatactagcttccaaggac

SEQ ID NO: 71944 - DNA, 20 bp, synthetic construct
  misc_feature 1..20: note = CRISPR gRNA sequence
  source 1..20: mol_type = other DNA
catactagcttccaaggaca

SEQ ID NO: 71945 - DNA, 20 bp, synthetic construct
  misc_feature 1..20: note = CRISPR gRNA sequence
  source 1..20: mol_type = other DNA
gcttccaaggacaggtggag

SEQ ID NO: 71946 - DNA, 20 bp, synthetic construct
  misc_feature 1..20: note = CRISPR gRNA sequence
  source 1..20: mol_type = other DNA
ccaaggacaggtggaggtag

SEQ ID NO: 71947 - DNA, 20 bp, synthetic construct
  misc_feature 1..20: note = CRISPR gRNA sequence
  source 1..20: mol_type = other DNA
caaggacaggtggaggtagg

SEQ ID NO: 71948 - DNA, 20 bp, synthetic construct
  misc_feature 1..20: note = CRISPR gRNA sequence
  source 1..20: mol_type = other DNA
gcgggagtggagaagcccag

SEQ ID NO: 71949 - DNA, 20 bp, synthetic construct
  misc_feature 1..20: note = CRISPR gRNA sequence
  source 1..20: mol_type = other DNA
tcctatgtaagggacaaagc

SEQ ID NO: 71950 - DNA, 20 bp, synthetic construct
  misc_feature 1..20: note = CRISPR gRNA sequence
  source 1..20: mol_type = other DNA
tgtaagggacaaagccaggt

SEQ ID NO: 71951 - DNA, 20 bp, synthetic construct
  misc_feature 1..20: note = CRISPR gRNA sequence
  source 1..20: mol_type = other DNA
atggtactgggtagggggca

SEQ ID NO: 71952 - DNA, 20 bp, synthetic construct
  misc_feature 1..20: note = CRISPR gRNA sequence
  source 1..20: mol_type = other DNA
ggtagggggcactgccaaga

SEQ ID NO: 71953 - DNA, 20 bp, synthetic construct
  misc_feature 1..20: note = CRISPR gRNA sequence
  source 1..20: mol_type = other DNA
ccaagacaataagctaggct

SEQ ID NO: 71954 - DNA, 20 bp, synthetic construct
  misc_feature 1..20: note = CRISPR gRNA sequence
  source 1..20: mol_type = other DNA
ggctactgggtccagctact

SEQ ID NO: 71955 - DNA, 20 bp, synthetic construct
  misc_feature 1..20: note = CRISPR gRNA sequence
  source 1..20: mol_type = other DNA
ctgggtccagctactacttt

SEQ ID NO: 71956 - DNA, 20 bp, synthetic construct
  misc_feature 1..20: note = CRISPR gRNA sequence
  source 1..20: mol_type = other DNA
ggtccagctactactttggt

SEQ ID NO: 71957 - DNA, 20 bp, synthetic construct
  misc_feature 1..20: note = CRISPR gRNA sequence
  source 1..20: mol_type = other DNA
ctactttggtgggattcagg

SEQ ID NO: 71958 - DNA, 20 bp, synthetic construct
  misc_feature 1..20: note = CRISPR gRNA sequence
  source 1..20: mol_type = other DNA
ctttggtgggattcaggtga

SEQ ID NO: 71959 - DNA, 20 bp, synthetic construct
  misc_feature 1..20: note = CRISPR gRNA sequence
  source 1..20: mol_type = other DNA
tggtgggattcaggtgagtc

SEQ ID NO: 71960 - DNA, 20 bp, synthetic construct
  misc_feature 1..20: note = CRISPR gRNA sequence
  source 1..20: mol_type = other DNA
ggtgggattcaggtgagtct

SEQ ID NO: 71961 - DNA, 20 bp, synthetic construct
  misc_feature 1..20: note = CRISPR gRNA sequence
  source 1..20: mol_type = other DNA
gtgggattcaggtgagtctc

SEQ ID NO: 71962 - DNA, 20 bp, synthetic construct
  misc_feature 1..20: note = CRISPR gRNA sequence
  source 1..20: mol_type = other DNA
aggtgagtctccatgcactt

SEQ ID NO: 71963 - DNA, 20 bp, synthetic construct
  misc_feature 1..20: note = CRISPR gRNA sequence
  source 1..20: mol_type = other DNA
catgcacttcacatgttacc

SEQ ID NO: 71964 - DNA, 20 bp, synthetic construct
  misc_feature 1..20: note = CRISPR gRNA sequence
  source 1..20: mol_type = other DNA
cacatgttacccagtgttct

SEQ ID NO: 71965 - DNA, 20 bp, synthetic construct
  misc_feature 1..20: note = CRISPR gRNA sequence
  source 1..20: mol_type = other DNA
acatgttacccagtgttctt

SEQ ID NO: 71966 - DNA, 20 bp, synthetic construct
  misc_feature 1..20: note = CRISPR gRNA sequence
  source 1..20: mol_type = other DNA
cccagtgttcttgttacttc

SEQ ID NO: 71967 - DNA, 20 bp, synthetic construct
  misc_feature 1..20: note = CRISPR gRNA sequence
  source 1..20: mol_type = other DNA
ttgttacttccaaggagaac

SEQ ID NO: 71968 - DNA, 20 bp, synthetic construct
  misc_feature 1..20: note = CRISPR gRNA sequence
  source 1..20: mol_type = other DNA
gttacttccaaggagaacca

SEQ ID NO: 71969 - DNA, 20 bp, synthetic construct
  misc_feature 1..20: note = CRISPR gRNA sequence
  source 1..20: mol_type = other DNA
ttacttccaaggagaaccaa

SEQ ID NO: 71970 - DNA, 20 bp, synthetic construct
  misc_feature 1..20: note = CRISPR gRNA sequence
  source 1..20: mol_type = other DNA
cttccaaggagaaccaagaa

SEQ ID NO: 71971 - DNA, 20 bp, synthetic construct
  misc_feature 1..20: note = CRISPR gRNA sequence
  source 1..20: mol_type = other DNA
ccaaggagaaccaagaatgg

SEQ ID NO: 71972 - DNA, 20 bp, synthetic construct
  misc_feature 1..20: note = CRISPR gRNA sequence
  source 1..20: mol_type = other DNA
caaggagaaccaagaatggc

SEQ ID NO: 71973 - DNA, 20 bp, synthetic construct
  misc_feature 1..20: note = CRISPR gRNA sequence
  source 1..20: mol_type = other DNA
tgtcacactcgaagccaggc

SEQ ID NO: 71974 - DNA, 20 bp, synthetic construct
  misc_feature 1..20: note = CRISPR gRNA sequence
  source 1..20: mol_type = other DNA
tcacactcgaagccaggctt

SEQ ID NO: 71975 - DNA, 20 bp, synthetic construct
  misc_feature 1..20: note = CRISPR gRNA sequence
  source 1..20: mol_type = other DNA
gaagccaggcttgatcaata

SEQ ID NO: 71976 - DNA, 20 bp, synthetic construct
  misc_feature 1..20: note = CRISPR gRNA sequence
  source 1..20: mol_type = other DNA
gatcaataaacacaatggta

SEQ ID NO: 71977 - DNA, 20 bp, synthetic construct
  misc_feature 1..20: note = CRISPR gRNA sequence
  source 1..20: mol_type = other DNA
atcaataaacacaatggtat

SEQ ID NO: 71978 - DNA, 20 bp, synthetic construct
  misc_feature 1..20: note = CRISPR gRNA sequence
  source 1..20: mol_type = other DNA
cacgtctagcgtgaatccaa

SEQ ID NO: 71979 - DNA, 20 bp, synthetic construct
  misc_feature 1..20: note = CRISPR gRNA sequence
  source 1..20: mol_type = other DNA
gcgtgaatccaatgtttcct

SEQ ID NO: 71980 - DNA, 20 bp, synthetic construct
  misc_feature 1..20: note = CRISPR gRNA sequence
  source 1..20: mol_type = other DNA
cctcttaccccactgaagtc

SEQ ID NO: 71981 - DNA, 20 bp, synthetic construct
  misc_feature 1..20: note = CRISPR gRNA sequence
  source 1..20: mol_type = other DNA
ctcttaccccactgaagtca

SEQ ID NO: 71982 - DNA, 20 bp, synthetic construct
  misc_feature 1..20: note = CRISPR gRNA sequence
  source 1..20: mol_type = other DNA
ttaccccactgaagtcagag

SEQ ID NO: 71983 - DNA, 20 bp, synthetic construct
  misc_feature 1..20: note = CRISPR gRNA sequence
  source 1..20: mol_type = other DNA
accccactgaagtcagaggt

SEQ ID NO: 71984 - DNA, 20 bp, synthetic construct
  misc_feature 1..20: note = CRISPR gRNA sequence
  source 1..20: mol_type = other DNA
ccccactgaagtcagaggtg

SEQ ID NO: 71985 - DNA, 20 bp, synthetic construct
  misc_feature 1..20: note = CRISPR gRNA sequence
  source 1..20: mol_type = other DNA
aagtcagaggtggttcaccc

SEQ ID NO: 71986 - DNA, 20 bp, synthetic construct
  misc_feature 1..20: note = CRISPR gRNA sequence
  source 1..20: mol_type = other DNA
accccctgccgtaaggactg

SEQ ID NO: 71987 - DNA, 20 bp, synthetic construct
  misc_feature 1..20: note = CRISPR gRNA sequence
  source 1..20: mol_type = other DNA
ccgtaaggactggacagcag

SEQ ID NO: 71988 - DNA, 20 bp, synthetic construct
  misc_feature 1..20: note = CRISPR gRNA sequence
  source 1..20: mol_type = other DNA
gacagcagcgcaaacaacag

SEQ ID NO: 71989 - DNA, 20 bp, synthetic construct
  misc_feature 1..20: note = CRISPR gRNA sequence
  source 1..20: mol_type = other DNA
tctgttgtttgcgctgctgt

SEQ ID NO: 71990 - DNA, 20 bp, synthetic construct
  misc_feature 1..20: note = CRISPR gRNA sequence
  source 1..20: mol_type = other DNA
tgttgtttgcgctgctgtcc

SEQ ID NO: 71991 - DNA, 20 bp, synthetic construct
  misc_feature 1..20: note = CRISPR gRNA sequence
  source 1..20: mol_type = other DNA
ttgtttgcgctgctgtccag

SEQ ID NO: 71992 - DNA, 20 bp, synthetic construct
  misc_feature 1..20: note = CRISPR gRNA sequence
  source 1..20: mol_type = other DNA
tttgcgctgctgtccagtcc

SEQ ID NO: 71993 - DNA, 20 bp, synthetic construct
  misc_feature 1..20: note = CRISPR gRNA sequence
  source 1..20: mol_type = other DNA
gcgctgctgtccagtcctta

SEQ ID NO: 71994 - DNA, 20 bp, synthetic construct
  misc_feature 1..20: note = CRISPR gRNA sequence
  source 1..20: mol_type = other DNA
cgctgctgtccagtccttac

SEQ ID NO: 71995 - DNA, 20 bp, synthetic construct
  misc_feature 1..20: note = CRISPR gRNA sequence
  source 1..20: mol_type = other DNA
ctgtccagtccttacggcag

SEQ ID NO: 71996 - DNA, 20 bp, synthetic construct
  misc_feature 1..20: note = CRISPR gRNA sequence
  source 1..20: mol_type = other DNA
tccagtccttacggcagggg

SEQ ID NO: 71997 - DNA, 20 bp, synthetic construct
  misc_feature 1..20: note = CRISPR gRNA sequence
  source 1..20: mol_type = other DNA
acggcagggggtgaaccacc

SEQ ID NO: 71998 - DNA, 20 bp, synthetic construct
  misc_feature 1..20: note = CRISPR gRNA sequence
  source 1..20: mol_type = other DNA
cggcagggggtgaaccacct

SEQ ID NO: 71999 - DNA, 20 bp, synthetic construct
  misc_feature 1..20: note = CRISPR gRNA sequence
  source 1..20: mol_type = other DNA
tgacttcagtggggtaagag

SEQ ID NO: 72000 - DNA, 20 bp, synthetic construct
  misc_feature 1..20: note = CRISPR gRNA sequence
  source 1..20: mol_type = other DNA
acttcagtggggtaagagga

SEQ ID NO: 72001 - DNA, 20 bp, synthetic construct
  misc_feature 1..20: note = CRISPR gRNA sequence
  source 1..20: mol_type = other DNA
cagtggggtaagaggaaaca

SEQ ID NO: 72002 - DNA, 20 bp, synthetic construct
  misc_feature 1..20: note = CRISPR gRNA sequence
  source 1..20: mol_type = other DNA
agtggggtaagaggaaacat

SEQ ID NO: 72003 - DNA, 20 bp, synthetic construct
  misc_feature 1..20: note = CRISPR gRNA sequence
  source 1..20: mol_type = other DNA
gattcacgctagacgtggaa

SEQ ID NO: 72004 - DNA, 20 bp, synthetic construct
  misc_feature 1..20: note = CRISPR gRNA sequence
  source 1..20: mol_type = other DNA
acgctagacgtggaatacca

SEQ ID NO: 72005 - DNA, 20 bp, synthetic construct
  misc_feature 1..20: note = CRISPR gRNA sequence
  source 1..20: mol_type = other DNA
gacgtggaataccattgtgt

SEQ ID NO: 72006 - DNA, 20 bp, synthetic construct
  misc_feature 1..20: note = CRISPR gRNA sequence
  source 1..20: mol_type = other DNA
tgtttattgatcaagcctgg

SEQ ID NO: 72007 - DNA, 20 bp, synthetic construct
  misc_feature 1..20: note = CRISPR gRNA sequence
  source 1..20: mol_type = other DNA
attgatcaagcctggcttcg

SEQ ID NO: 72008 - DNA, 20 bp, synthetic construct
  misc_feature 1..20: note = CRISPR gRNA sequence
  source 1..20: mol_type = other DNA
ttgatcaagcctggcttcga

SEQ ID NO: 72009 - DNA, 20 bp, synthetic construct
  misc_feature 1..20: note = CRISPR gRNA sequence
  source 1..20: mol_type = other DNA
atcaagcctggcttcgagtg

SEQ ID NO: 72010 - DNA, 20 bp, synthetic construct
  misc_feature 1..20: note = CRISPR gRNA sequence
  source 1..20: mol_type = other DNA
gcttcgagtgtgacagagcc

SEQ ID NO: 72011 - DNA, 20 bp, synthetic construct
  misc_feature 1..20: note = CRISPR gRNA sequence
  source 1..20: mol_type = other DNA
cgagtgtgacagagccattc

SEQ ID NO: 72012 - DNA, 20 bp, synthetic construct
  misc_feature 1..20: note = CRISPR gRNA sequence
  source 1..20: mol_type = other DNA
gagtgtgacagagccattct

SEQ ID NO: 72013 - DNA, 20 bp, synthetic construct
  misc_feature 1..20: note = CRISPR gRNA sequence
  source 1..20: mol_type = other DNA
ttggttctccttggaagtaa

SEQ ID NO: 72014 - DNA, 20 bp, synthetic construct
  misc_feature 1..20: note = CRISPR gRNA sequence
  source 1..20: mol_type = other DNA
ggttctccttggaagtaaca

SEQ ID NO: 72015 - DNA, 20 bp, synthetic construct
  misc_feature 1..20: note = CRISPR gRNA sequence
  source 1..20: mol_type = other DNA
gttctccttggaagtaacaa

SEQ ID NO: 72016 - DNA, 20 bp, synthetic construct
  misc_feature 1..20: note = CRISPR gRNA sequence
  source 1..20: mol_type = other DNA
tccttggaagtaacaagaac

SEQ ID NO: 72017 - DNA, 20 bp, synthetic construct
  misc_feature 1..20: note = CRISPR gRNA sequence
  source 1..20: mol_type = other DNA
cttggaagtaacaagaacac

SEQ ID NO: 72018 - DNA, 20 bp, synthetic construct
  misc_feature 1..20: note = CRISPR gRNA sequence
  source 1..20: mol_type = other DNA
ggaagtaacaagaacactgg

SEQ ID NO: 72019 - DNA, 20 bp, synthetic construct
  misc_feature 1..20: note = CRISPR gRNA sequence
  source 1..20: mol_type = other DNA
gaagtaacaagaacactggg

SEQ ID NO: 72020 - DNA, 20 bp, synthetic construct
  misc_feature 1..20: note = CRISPR gRNA sequence
  source 1..20: mol_type = other DNA
ggtaacatgtgaagtgcatg

SEQ ID NO: 72021 - DNA, 20 bp, synthetic construct
  misc_feature 1..20: note = CRISPR gRNA sequence
  source 1..20: mol_type = other DNA
acctgaatcccaccaaagta

SEQ ID NO: 72022 - DNA, 20 bp, synthetic construct
  misc_feature 1..20: note = CRISPR gRNA sequence
  source 1..20: mol_type = other DNA
aatcccaccaaagtagtagc

SEQ ID NO: 72023 - DNA, 20 bp, synthetic construct
  misc_feature 1..20: note = CRISPR gRNA sequence
  source 1..20: mol_type = other DNA
gacccagtagcctagcttat

SEQ ID NO: 72024 - DNA, 20 bp, synthetic construct
  misc_feature 1..20: note = CRISPR gRNA sequence
  source 1..20: mol_type = other DNA
gcttattgtcttggcagtgc

SEQ ID NO: 72025 - DNA, 20 bp, synthetic construct
  misc_feature 1..20: note = CRISPR gRNA sequence
  source 1..20: mol_type = other DNA
attgtcttggcagtgccccc

SEQ ID NO: 72026 - DNA, 20 bp, synthetic construct
  misc_feature 1..20: note = CRISPR gRNA sequence
  source 1..20: mol_type = other DNA
ttgtcttggcagtgccccct

SEQ ID NO: 72027 - DNA, 20 bp, synthetic construct
  misc_feature 1..20: note = CRISPR gRNA sequence
  source 1..20: mol_type = other DNA
tcttggcagtgccccctacc

SEQ ID NO: 72028 - DNA, 20 bp, synthetic construct
  misc_feature 1..20: note = CRISPR gRNA sequence
  source 1..20: mol_type = other DNA
ggcagtgccccctacccagt

SEQ ID NO: 72029 - DNA, 20 bp, synthetic construct
  misc_feature 1..20: note = CRISPR gRNA sequence
  source 1..20: mol_type = other DNA
gcagtgccccctacccagta

SEQ ID NO: 72030 - DNA, 20 bp, synthetic construct
  misc_feature 1..20: note = CRISPR gRNA sequence
  source 1..20: mol_type = other DNA
cccagtaccattagacctgg

SEQ ID NO: 72031 - DNA, 20 bp, synthetic construct
  misc_feature 1..20: note = CRISPR gRNA sequence
  source 1..20: mol_type = other DNA
gacctggctttgtcccttac

SEQ ID NO: 72032 - DNA, 20 bp, synthetic construct
  misc_feature 1..20: note = CRISPR gRNA sequence
  source 1..20: mol_type = other DNA
gctttgtcccttacatagga

SEQ ID NO: 72033 - DNA, 20 bp, synthetic construct
  misc_feature 1..20: note = CRISPR gRNA sequence
  source 1..20: mol_type = other DNA
tgtcccttacataggacaga

SEQ ID NO: 72034 - DNA, 20 bp, synthetic construct
  misc_feature 1..20: note = CRISPR gRNA sequence
  source 1..20: mol_type = other DNA
gtcccttacataggacagac

SEQ ID NO: 72035 - DNA, 20 bp, synthetic construct
  misc_feature 1..20: note = CRISPR gRNA sequence
  source 1..20: mol_type = other DNA
tcccttacataggacagact

SEQ ID NO: 72036 - DNA, 20 bp, synthetic construct
  misc_feature 1..20: note = CRISPR gRNA sequence
  source 1..20: mol_type = other DNA
acataggacagactgggctt

SEQ ID NO: 72037 - DNA, 20 bp, synthetic construct
  misc_feature 1..20: note = CRISPR gRNA sequence
  source 1..20: mol_type = other DNA
cataggacagactgggcttc

SEQ ID NO: 72038 - DNA, 20 bp, synthetic construct
  misc_feature 1..20: note = CRISPR gRNA sequence
  source 1..20: mol_type = other DNA
ggcttctccactcccgccag

SEQ ID NO: 72039 - DNA, 20 bp, synthetic construct
  misc_feature 1..20: note = CRISPR gRNA sequence
  source 1..20: mol_type = other DNA
ctccactcccgccaggctgg

SEQ ID NO: 72040 - DNA, 20 bp, synthetic construct
  misc_feature 1..20: note = CRISPR gRNA sequence
  source 1..20: mol_type = other DNA
tccactcccgccaggctggc

SEQ ID NO: 72041 - DNA, 20 bp, synthetic construct
  misc_feature 1..20: note = CRISPR gRNA sequence
  source 1..20: mol_type = other DNA
cactcccgccaggctggccc

SEQ ID NO: 72042 - DNA, 20 bp, synthetic construct
  misc_feature 1..20: note = CRISPR gRNA sequence
  source 1..20: mol_type = other DNA
ccgccaggctggccctacct

SEQ ID NO: 72043 - DNA, 20 bp, synthetic construct
  misc_feature 1..20: note = CRISPR gRNA sequence
  source 1..20: mol_type = other DNA
gccctacctccacctgtcct

SEQ ID NO: 72044 - DNA, 20 bp, synthetic construct
  misc_feature 1..20: note = CRISPR gRNA sequence
  source 1..20: mol_type = other DNA
cctccacctgtccttggaag

SEQ ID NO: 72045 - DNA, 20 bp, synthetic construct
  misc_feature 1..20: note = CRISPR gRNA sequence
  source 1..20: mol_type = other DNA
cacctgtccttggaagctag

SEQ ID NO: 72046 - DNA, 20 bp, synthetic construct
  misc_feature 1..20: note = CRISPR gRNA sequence
  source 1..20: mol_type = other DNA
tccttggaagctagtatgta

SEQ ID NO: 72047 - DNA, 20 bp, synthetic construct
  misc_feature 1..20: note = CRISPR gRNA sequence
  source 1..20: mol_type = other DNA
ggaagctagtatgtaagtaa

SEQ ID NO: 72048 - DNA, 20 bp, synthetic construct
  misc_feature 1..20: note = CRISPR gRNA sequence
  source 1..20: mol_type = other DNA
gaagctagtatgtaagtaag

SEQ ID NO: 72049 - DNA, 20 bp, synthetic construct
  misc_feature 1..20: note = CRISPR gRNA sequence
  source 1..20: mol_type = other DNA
gtatgtaagtaagggaggag

SEQ ID NO: 72050 - DNA, 20 bp, synthetic construct
  misc_feature 1..20: note = CRISPR gRNA sequence
  source 1..20: mol_type = other DNA
atagatgggtaggctgagga

SEQ ID NO: 72051 - DNA, 20 bp, synthetic construct
  misc_feature 1..20: note = CRISPR gRNA sequence
  source 1..20: mol_type = other DNA
tagatgggtaggctgaggat

SEQ ID NO: 72052 - DNA, 20 bp, synthetic construct
  misc_feature 1..20: note = CRISPR gRNA sequence
  source 1..20: mol_type = other DNA
aggattgaggcaggagggga

SEQ ID NO: 72053 - DNA, 20 bp, synthetic construct
  misc_feature 1..20: note = CRISPR gRNA sequence
  source 1..20: mol_type = other DNA
aggcaggaggggacttaatg

SEQ ID NO: 72054 - DNA, 20 bp, synthetic construct
  misc_feature 1..20: note = CRISPR gRNA sequence
  source 1..20: mol_type = other DNA
aatggctgagtccctggctt

SEQ ID NO: 72055 - DNA, 20 bp, synthetic construct
  misc_feature 1..20: note = CRISPR gRNA sequence
  source 1..20: mol_type = other DNA
atggctgagtccctggcttg

SEQ ID NO: 72056 - DNA, 20 bp, synthetic construct
  misc_feature 1..20: note = CRISPR gRNA sequence
  source 1..20: mol_type = other DNA
agtccctggcttgttccaga

SEQ ID NO: 72057 - DNA, 20 bp, synthetic construct
  misc_feature 1..20: note = CRISPR gRNA sequence
  source 1..20: mol_type = other DNA
gcttgttccagagccctggc

SEQ ID NO: 72058 - DNA, 20 bp, synthetic construct
  misc_feature 1..20: note = CRISPR gRNA sequence
  source 1..20: mol_type = other DNA
gttccagagccctggccctt

SEQ ID NO: 72059 - DNA, 20 bp, synthetic construct
  misc_feature 1..20: note = CRISPR gRNA sequence
  source 1..20: mol_type = other DNA
ttccagagccctggcccttg

SEQ ID NO: 72060 - DNA, 20 bp, synthetic construct
  misc_feature 1..20: note = CRISPR gRNA sequence
  source 1..20: mol_type = other DNA
cagagccctggcccttgagc

SEQ ID NO: 72061 - DNA, 20 bp, synthetic construct
  misc_feature 1..20: note = CRISPR gRNA sequence
  source 1..20: mol_type = other DNA
gcccttgagcccctggactg

SEQ ID NO: 72062 - DNA, 20 bp, synthetic construct
  misc_feature 1..20: note = CRISPR gRNA sequence
  source 1..20: mol_type = other DNA
gagcccctggactggtcagt

SEQ ID NO: 72063 - DNA, 20 bp, synthetic construct
  misc_feature 1..20: note = CRISPR gRNA sequence
  source 1..20: mol_type = other DNA
agcccctggactggtcagtg

SEQ ID NO: 72064 - DNA, 20 bp, synthetic construct
  misc_feature 1..20: note = CRISPR gRNA sequence
  source 1..20: mol_type = other DNA
gactggtcagtgcatggaca

SEQ ID NO: 72065 - DNA, 20 bp, synthetic construct
  misc_feature 1..20: note = CRISPR gRNA sequence
  source 1..20: mol_type = other DNA
gtcagtgcatggacactctc

SEQ ID NO: 72066 - DNA, 20 bp, synthetic construct
  misc_feature 1..20: note = CRISPR gRNA sequence
  source 1..20: mol_type = other DNA
tcccctcccagctcgggcgg

SEQ ID NO: 72067 - DNA, 20 bp, synthetic construct
  misc_feature 1..20: note = CRISPR gRNA sequence
  source 1..20: mol_type = other DNA
ccctcccagctcgggcggaa

SEQ ID NO: 72068 - DNA, 20 bp, synthetic construct
  misc_feature 1..20: note = CRISPR gRNA sequence
  source 1..20: mol_type = other DNA
ccagctcgggcggaagactt

SEQ ID NO: 72069 - DNA, 20 bp, synthetic construct
  misc_feature 1..20: note = CRISPR gRNA sequence
  source 1..20: mol_type = other DNA
gggcggaagacttttcctga

SEQ ID NO: 72070 - DNA, 20 bp, synthetic construct
  misc_feature 1..20: note = CRISPR gRNA sequence
  source 1..20: mol_type = other DNA
ttcctgacttagctgctcca

SEQ ID NO: 72071 - DNA, 20 bp, synthetic construct
  misc_feature 1..20: note = CRISPR gRNA sequence
  source 1..20: mol_type = other DNA
tcctgacttagctgctccat

SEQ ID NO: 72072 - DNA, 20 bp, synthetic construct
  misc_feature 1..20: note = CRISPR gRNA sequence
  source 1..20: mol_type = other DNA
cctgacttagctgctccata

SEQ ID NO: 72073 - DNA, 20 bp, synthetic construct
  misc_feature 1..20: note = CRISPR gRNA sequence
  source 1..20: mol_type = other DNA
ctgacttagctgctccatac

SEQ ID NO: 72074 - DNA, 20 bp, synthetic construct
  misc_feature 1..20: note = CRISPR gRNA sequence
  source 1..20: mol_type = other DNA
acttagctgctccatacaca

SEQ ID NO: 72075 - DNA, 20 bp, synthetic construct
  misc_feature 1..20: note = CRISPR gRNA sequence
  source 1..20: mol_type = other DNA
agctgctccatacacacaat

SEQ ID NO: 72076 - DNA, 20 bp, synthetic construct
  misc_feature 1..20: note = CRISPR gRNA sequence
  source 1..20: mol_type = other DNA
gctgctccatacacacaatc

SEQ ID NO: 72077 - DNA, 20 bp, synthetic construct
  misc_feature 1..20: note = CRISPR gRNA sequence
  source 1..20: mol_type = other DNA
ctccatacacacaatctata

SEQ ID NO: 72078 - DNA, 20 bp, synthetic construct
  misc_feature 1..20: note = CRISPR gRNA sequence
  source 1..20: mol_type = other DNA
catacacacaatctataaat

SEQ ID NO: 72079 - DNA, 20 bp, synthetic construct
  misc_feature 1..20: note = CRISPR gRNA sequence
  source 1..20: mol_type = other DNA
taaatatgtatttgctttaa

SEQ ID NO: 72080 - DNA, 20 bp, synthetic construct
  misc_feature 1..20: note = CRISPR gRNA sequence
  source 1..20: mol_type = other DNA
gctttaaaaattaataaatt

SEQ ID NO: 72081 - DNA, 20 bp, synthetic construct
  misc_feature 1..20: note = CRISPR gRNA sequence
  source 1..20: mol_type = other DNA
ctttaaaaattaataaatta

SEQ ID NO: 72082 - DNA, 20 bp, synthetic construct
  misc_feature 1..20: note = CRISPR gRNA sequence
  source 1..20: mol_type = other DNA
taaaaattaataaattagat

SEQ ID NO: 72083 - DNA, 20 bp, synthetic construct
  misc_feature 1..20: note = CRISPR gRNA sequence
  source 1..20: mol_type = other DNA
aaaaattaataaattagatc

SEQ ID NO: 72084 - DNA, 20 bp, synthetic construct
  misc_feature 1..20: note = CRISPR gRNA sequence
  source 1..20: mol_type = other DNA
aaaattaataaattagatct

SEQ ID NO: 72085 - DNA, 20 bp, synthetic construct
  misc_feature 1..20: note = CRISPR gRNA sequence
  source 1..20: mol_type = other DNA
ataaattagatcttgggcca

SEQ ID NO: 72086 - DNA, 20 bp, synthetic construct
  misc_feature 1..20: note = CRISPR gRNA sequence
  source 1..20: mol_type = other DNA
gatcttgggccagcctgagg

SEQ ID NO: 72087 - DNA, 20 bp, synthetic construct
  misc_feature 1..20: note = CRISPR gRNA sequence
  source 1..20: mol_type = other DNA
gggccagcctgaggtcatct

SEQ ID NO: 72088 - DNA, 20 bp, synthetic construct
  misc_feature 1..20: note = CRISPR gRNA sequence
  source 1..20: mol_type = other DNA
ggccagcctgaggtcatctg

SEQ ID NO: 72089 - DNA, 20 bp, synthetic construct
  misc_feature 1..20: note = CRISPR gRNA sequence
  source 1..20: mol_type = other DNA
aggtcatctggccagccatg

SEQ ID NO: 72090 - DNA, 20 bp, synthetic construct
  misc_feature 1..20: note = CRISPR gRNA sequence
  source 1..20: mol_type = other DNA
gccagccatgagtcctgtga

SEQ ID NO: 72091 - DNA, 20 bp, synthetic construct
  misc_feature 1..20: note = CRISPR gRNA sequence
  source 1..20: mol_type = other DNA
tgacatggacatttgtcatg

SEQ ID NO: 72092 - DNA, 20 bp, synthetic construct
  misc_feature 1..20: note = CRISPR gRNA sequence
  source 1..20: mol_type = other DNA
gtcatgtgtcatatatagac

SEQ ID NO: 72093 - DNA, 20 bp, synthetic construct
  misc_feature 1..20: note = CRISPR gRNA sequence
  source 1..20: mol_type = other DNA
tcatgtgtcatatatagacc

SEQ ID NO: 72094 - DNA, 20 bp, synthetic construct
  misc_feature 1..20: note = CRISPR gRNA sequence
  source 1..20: mol_type = other DNA
ctacttgggatgccagcacc

SEQ ID NO: 72095 - DNA, 20 bp, synthetic construct
  misc_feature 1..20: note = CRISPR gRNA sequence
  source 1..20: mol_type = other DNA
cttgggatgccagcacccat

SEQ ID NO: 72096 - DNA, 20 bp, synthetic construct
  misc_feature 1..20: note = CRISPR gRNA sequence
  source 1..20: mol_type = other DNA
gggatgccagcacccatgcc

SEQ ID NO: 72097 - DNA, 20 bp, synthetic construct
  misc_feature 1..20: note = CRISPR gRNA sequence
  source 1..20: mol_type = other DNA
ggatgccagcacccatgcca

SEQ ID NO: 72098 - DNA, 20 bp, synthetic construct
  misc_feature 1..20: note = CRISPR gRNA sequence
  source 1..20: mol_type = other DNA
actttcatgtaacgccacat

SEQ ID NO: 72099 - DNA, 20 bp, synthetic construct
  misc_feature 1..20: note = CRISPR gRNA sequence
  source 1..20: mol_type = other DNA
tcatgtaacgccacatgtca

SEQ ID NO: 72100 - DNA, 20 bp, synthetic construct
  misc_feature 1..20: note = CRISPR gRNA sequence
  source 1..20: mol_type = other DNA
catgtaacgccacatgtcaa

SEQ ID NO: 72101 - DNA, 20 bp, synthetic construct
  misc_feature 1..20: note = CRISPR gRNA sequence
  source 1..20: mol_type = other DNA
atgtaacgccacatgtcaag

SEQ ID NO: 72102 - DNA, 20 bp, synthetic construct
  misc_feature 1..20: note = CRISPR gRNA sequence
  source 1..20: mol_type = other DNA
ccacatataaccgtacgtgt

SEQ ID NO: 72103 - DNA, 20 bp, synthetic construct
  misc_feature 1..20: note = CRISPR gRNA sequence
  source 1..20: mol_type = other DNA
tcatgacaccctcattgtgt

SEQ ID NO: 72104 - DNA, 20 bp, synthetic construct
  misc_feature 1..20: note = CRISPR gRNA sequence
  source 1..20: mol_type = other DNA
attgtgtgtcgcatgtcccc

SEQ ID NO: 72105 - DNA, 20 bp, synthetic construct
  misc_feature 1..20: note = CRISPR gRNA sequence
  source 1..20: mol_type = other DNA
tgtgtcgcatgtccccaatt

SEQ ID NO: 72106 - DNA, 20 bp, synthetic construct
  misc_feature 1..20: note = CRISPR gRNA sequence
  source 1..20: mol_type = other DNA
atcacacatatcccacgtaa

SEQ ID NO: 72107 - DNA, 20 bp, synthetic construct
  misc_feature 1..20: note = CRISPR gRNA sequence
  source 1..20: mol_type = other DNA
ctttgtccagacccagctcc

SEQ ID NO: 72108 - DNA, 20 bp, synthetic construct
  misc_feature 1..20: note = CRISPR gRNA sequence
  source 1..20: mol_type = other DNA
tgtccagacccagctcctgg

SEQ ID NO: 72109 - DNA, 20 bp, synthetic construct
  misc_feature 1..20: note = CRISPR gRNA sequence
  source 1..20: mol_type = other DNA
gtccagacccagctcctggt

SEQ ID NO: 72110 - DNA, 20 bp, synthetic construct
  misc_feature 1..20: note = CRISPR gRNA sequence
  source 1..20: mol_type = other DNA
tccagacccagctcctggtt

SEQ ID NO: 72111 - DNA, 20 bp, synthetic construct
  misc_feature 1..20: note = CRISPR gRNA sequence
  source 1..20: mol_type = other DNA
ctggttcccaaaaaagttct

SEQ ID NO: 72112 - DNA, 20 bp, synthetic construct
  misc_feature 1..20: note = CRISPR gRNA sequence
  source 1..20: mol_type = other DNA
gttcccaaaaaagttctccc

SEQ ID NO: 72113 - DNA, 20 bp, synthetic construct
  misc_feature 1..20: note = CRISPR gRNA sequence
  source 1..20: mol_type = other DNA
ccaaaaaagttctccctgag

SEQ ID NO: 72114 - DNA, 20 bp, synthetic construct
  misc_feature 1..20: note = CRISPR gRNA sequence
  source 1..20: mol_type = other DNA
tccctgaggactgcagcagg

SEQ ID NO: 72115 - DNA, 20 bp, synthetic construct
  misc_feature 1..20: note = CRISPR gRNA sequence
  source 1..20: mol_type = other DNA
cctgaggactgcagcaggac

SEQ ID NO: 72116 - DNA, 20 bp, synthetic construct
  misc_feature 1..20: note = CRISPR gRNA sequence
  source 1..20: mol_type = other DNA
aggactgcagcaggacacac

SEQ ID NO: 72117 - DNA, 20 bp, synthetic construct
  misc_feature 1..20: note = CRISPR gRNA sequence
  source 1..20: mol_type = other DNA
cagcaggacacacgtatcct

SEQ ID NO: 72118 - DNA, 20 bp, synthetic construct
  misc_feature 1..20: note = CRISPR gRNA sequence
  source 1..20: mol_type = other DNA
cctcctgggtggagtgcaga

SEQ ID NO: 72119 - DNA, 20 bp, synthetic construct
  misc_feature 1..20: note = CRISPR gRNA sequence
  source 1..20: mol_type = other DNA
ctcctgggtggagtgcagag

SEQ ID NO: 72120 - DNA, 20 bp, synthetic construct
  misc_feature 1..20: note = CRISPR gRNA sequence
  source 1..20: mol_type = other DNA
ctgggtggagtgcagagcgc

SEQ ID NO: 72121 - DNA, 20 bp, synthetic construct
  misc_feature 1..20: note = CRISPR gRNA sequence
  source 1..20: mol_type = other DNA
ggtggagtgcagagcgccct

SEQ ID NO: 72122 - DNA, 20 bp, synthetic construct
  misc_feature 1..20: note = CRISPR gRNA sequence
  source 1..20: mol_type = other DNA
ccgaggctcttctttcctga

SEQ ID NO: 72123 - DNA, 20 bp, synthetic construct
  misc_feature 1..20: note = CRISPR gRNA sequence
  source 1..20: mol_type = other DNA
ttctttcctgagtcaattat

SEQ ID NO: 72124 - DNA, 20 bp, synthetic construct
  misc_feature 1..20: note = CRISPR gRNA sequence
  source 1..20: mol_type = other DNA
ctttcctgagtcaattatcc

SEQ ID NO: 72125 - DNA, 20 bp, synthetic construct
  misc_feature 1..20: note = CRISPR gRNA sequence
  source 1..20: mol_type = other DNA
tttcctgagtcaattatccc

SEQ ID NO: 72126 - DNA, 20 bp, synthetic construct
  misc_feature 1..20: note = CRISPR gRNA sequence
  source 1..20: mol_type = other DNA
tcctgagtcaattatcccag

SEQ ID NO: 72127 - DNA, 20 bp, synthetic construct
  misc_feature 1..20: note = CRISPR gRNA sequence
  source 1..20: mol_type = other DNA
cctgagtcaattatcccagt

SEQ ID NO: 72128 - DNA, 20 bp, synthetic construct
  misc_feature 1..20: note = CRISPR gRNA sequence
  source 1..20: mol_type = other DNA
ctgagtcaattatcccagtg

SEQ ID NO: 72129 - DNA, 20 bp, synthetic construct
  misc_feature 1..20: note = CRISPR gRNA sequence
  source 1..20: mol_type = other DNA
agtcaattatcccagtgggc

SEQ ID NO: 72130 - DNA, 20 bp, synthetic construct
  misc_feature 1..20: note = CRISPR gRNA sequence
  source 1..20: mol_type = other DNA
tcccagtgggcgaaaggtgg

SEQ ID NO: 72131 - DNA, 20 bp, synthetic construct
  misc_feature 1..20: note = CRISPR gRNA sequence
  source 1..20: mol_type = other DNA
gggtgcatcacttggctgga

SEQ ID NO: 72132 - DNA, 20 bp, synthetic construct
  misc_feature 1..20: note = CRISPR gRNA sequence
  source 1..20: mol_type = other DNA
ggtgcatcacttggctggat

SEQ ID NO: 72133 - DNA, 20 bp, synthetic construct
  misc_feature 1..20: note = CRISPR gRNA sequence
  source 1..20: mol_type = other DNA
ggctggattccaaaggtctt

SEQ ID NO: 72134 - DNA, 20 bp, synthetic construct
  misc_feature 1..20: note = CRISPR gRNA sequence
  source 1..20: mol_type = other DNA
gctggattccaaaggtcttg

SEQ ID NO: 72135 - DNA, 20 bp, synthetic construct
  misc_feature 1..20: note = CRISPR gRNA sequence
  source 1..20: mol_type = other DNA
gattccaaaggtcttgaggg

SEQ ID NO: 72136 - DNA, 20 bp, synthetic construct
  misc_feature 1..20: note = CRISPR gRNA sequence
  source 1..20: mol_type = other DNA
caaaggtcttgagggggcca

SEQ ID NO: 72137 - DNA, 20 bp, synthetic construct
  misc_feature 1..20: note = CRISPR gRNA sequence
  source 1..20: mol_type = other DNA
gagggggccatcaagtaccc

SEQ ID NO: 72138 - DNA, 20 bp, synthetic construct
  misc_feature 1..20: note = CRISPR gRNA sequence
  source 1..20: mol_type = other DNA
agggggccatcaagtacccc

SEQ ID NO: 72139 - DNA, 20 bp, synthetic construct
  misc_feature 1..20: note = CRISPR gRNA sequence
  source 1..20: mol_type = other DNA
gggctggttgtcaaagaagg

SEQ ID NO: 72140 - DNA, 20 bp, synthetic construct
  misc_feature 1..20: note = CRISPR gRNA sequence
  source 1..20: mol_type = other DNA
gttgtcaaagaaggcaaagt

SEQ ID NO: 72141 - DNA, 20 bp, synthetic construct
  misc_feature 1..20: note = CRISPR gRNA sequence
  source 1..20: mol_type = other DNA
tcaaagaaggcaaagtccag

SEQ ID NO: 72142 - DNA, 20 bp, synthetic construct
  misc_feature 1..20: note = CRISPR gRNA sequence
  source 1..20: mol_type = other DNA
ggctcctggctcttcaggtg

SEQ ID NO: 72143 - DNA, 20 bp, synthetic construct
  misc_feature 1..20: note = CRISPR gRNA sequence
  source 1..20: mol_type = other DNA
ctggctcttcaggtgctggg

SEQ ID NO: 72144 - DNA, 20 bp, synthetic construct
  misc_feature 1..20: note = CRISPR gRNA sequence
  source 1..20: mol_type = other DNA
gctcttcaggtgctgggcca

SEQ ID NO: 72145 - DNA, 20 bp, synthetic construct
  misc_feature 1..20: note = CRISPR gRNA sequence
  source 1..20: mol_type = other DNA
ttcaggtgctgggccatgtc

SEQ ID NO: 72146 - DNA, 20 bp, synthetic construct
  misc_feature 1..20: note = CRISPR gRNA sequence
  source 1..20: mol_type = other DNA
caggtgctgggccatgtcgc

SEQ ID NO: 72147 - DNA, 20 bp, synthetic construct
  misc_feature 1..20: note = CRISPR gRNA sequence
  source 1..20: mol_type = other DNA
aggtgctgggccatgtcgca

SEQ ID NO: 72148 - DNA, 20 bp, synthetic construct
  misc_feature 1..20: note = CRISPR gRNA sequence
  source 1..20: mol_type = other DNA
ggccatgtcgcagggaatgg

SEQ ID NO: 72149 - DNA, 20 bp, synthetic construct
  misc_feature 1..20: note = CRISPR gRNA sequence
  source 1..20: mol_type = other DNA
ttccagaggctgtggggcac

SEQ ID NO: 72150 - DNA, 20 bp, synthetic construct
  misc_feature 1..20: note = CRISPR gRNA sequence
  source 1..20: mol_type = other DNA
cagaggctgtggggcacaga

SEQ ID NO: 72151 - DNA, 20 bp, synthetic construct
  misc_feature 1..20: note = CRISPR gRNA sequence
  source 1..20: mol_type = other DNA
tggggcacagatataggcac

SEQ ID NO: 72152 - DNA, 20 bp, synthetic construct
  misc_feature 1..20: note = CRISPR gRNA sequence
  source 1..20: mol_type = other DNA
attcatcctcccatctttgc

SEQ ID NO: 72153 - DNA, 20 bp, synthetic construct
  misc_feature 1..20: note = CRISPR gRNA sequence
  source 1..20: mol_type = other DNA
atcctcccatctttgccatc

SEQ ID NO: 72154 - DNA, 20 bp, synthetic construct
  misc_feature 1..20: note = CRISPR gRNA sequence
  source 1..20: mol_type = other DNA
ccatctttgccatctgtcgt

SEQ ID NO: 72155 - DNA, 20 bp, synthetic construct
  misc_feature 1..20: note = CRISPR gRNA sequence
  source 1..20: mol_type = other DNA
tgccatctgtcgtatctgca

SEQ ID NO: 72156 - DNA, 20 bp, synthetic construct
  misc_feature 1..20: note = CRISPR gRNA sequence
  source 1..20: mol_type = other DNA
gccatctgtcgtatctgcag

SEQ ID NO: 72157 - DNA, 20 bp, synthetic construct
  misc_feature 1..20: note = CRISPR gRNA sequence
  source 1..20: mol_type = other DNA
ccatctgtcgtatctgcaga

SEQ ID NO: 72158 - DNA, 20 bp, synthetic construct
  misc_feature 1..20: note = CRISPR gRNA sequence
  source 1..20: mol_type = other DNA
tcgtatctgcagattgggag

SEQ ID NO: 72159 - DNA, 20 bp, synthetic construct
  misc_feature 1..20: note = CRISPR gRNA sequence
  source 1..20: mol_type = other DNA
cagattgggaggctgaggcc

SEQ ID NO: 72160 - DNA, 20 bp, synthetic construct
  misc_feature 1..20: note = CRISPR gRNA sequence
  source 1..20: mol_type = other DNA
ggaggctgaggcccaaaaag

SEQ ID NO: 72161 - DNA, 20 bp, synthetic construct
  misc_feature 1..20: note = CRISPR gRNA sequence
  source 1..20: mol_type = other DNA
aggcccaaaaaggtagagct

SEQ ID NO: 72162 - DNA, 20 bp, synthetic construct
  misc_feature 1..20: note = CRISPR gRNA sequence
  source 1..20: mol_type = other DNA
tgcctagagttacctggcag

SEQ ID NO: 72163 - DNA, 20 bp, synthetic construct
  misc_feature 1..20: note = CRISPR gRNA sequence
  source 1..20: mol_type = other DNA
gagttacctggcagaggcag

SEQ ID NO: 72164 - DNA, 20 bp, synthetic construct
  misc_feature 1..20: note = CRISPR gRNA sequence
  source 1..20: mol_type = other DNA
cctggcagaggcaggtgtta

SEQ ID NO: 72165 - DNA, 20 bp, synthetic construct
  misc_feature 1..20: note = CRISPR gRNA sequence
  source 1..20: mol_type = other DNA
gcagaggcaggtgttagacc

SEQ ID NO: 72166 - DNA, 20 bp, synthetic construct
  misc_feature 1..20: note = CRISPR gRNA sequence
  source 1..20: mol_type = other DNA
gaccagcatagctgacctag

SEQ ID NO: 72167 - DNA, 20 bp, synthetic construct
  misc_feature 1..20: note = CRISPR gRNA sequence
  source 1..20: mol_type = other DNA
acctagggagagggtgtacc

SEQ ID NO: 72168 - DNA, 20 bp, synthetic construct
  misc_feature 1..20: note = CRISPR gRNA sequence
  source 1..20: mol_type = other DNA
gggagagggtgtaccccaca

SEQ ID NO: 72169 - DNA, 20 bp, synthetic construct
  misc_feature 1..20: note = CRISPR gRNA sequence
  source 1..20: mol_type = other DNA
cctcctgagtcctccaactc

SEQ ID NO: 72170 - DNA, 20 bp, synthetic construct
  misc_feature 1..20: note = CRISPR gRNA sequence
  source 1..20: mol_type = other DNA
ctgagtcctccaactcaacc

SEQ ID NO: 72171 - DNA, 20 bp, synthetic construct
  misc_feature 1..20: note = CRISPR gRNA sequence
  source 1..20: mol_type = other DNA
agtcctccaactcaaccttc

SEQ ID NO: 72172 - DNA, 20 bp, synthetic construct
  misc_feature 1..20: note = CRISPR gRNA sequence
  source 1..20: mol_type = other DNA
caactcaaccttcctccctg

SEQ ID NO: 72173 - DNA, 20 bp, synthetic construct
  misc_feature 1..20: note = CRISPR gRNA sequence
  source 1..20: mol_type = other DNA
aaccttcctccctgggagat

SEQ ID NO: 72174 - DNA, 20 bp, synthetic construct
  misc_feature 1..20: note = CRISPR gRNA sequence
  source 1..20: mol_type = other DNA
cctccctgggagatagtgat

SEQ ID NO: 72175 - DNA, 20 bp, synthetic construct
  misc_feature 1..20: note = CRISPR gRNA sequence
  source 1..20: mol_type = other DNA
ctccctgggagatagtgatg

SEQ ID NO: 72176 - DNA, 20 bp, synthetic construct
  misc_feature 1..20: note = CRISPR gRNA sequence
  source 1..20: mol_type = other DNA
cctgggagatagtgatgcca

SEQ ID NO: 72177 - DNA, 20 bp, synthetic construct
  misc_feature 1..20: note = CRISPR gRNA sequence
  source 1..20: mol_type = other DNA
ggagatagtgatgccagcta

SEQ ID NO: 72178 - DNA, 20 bp, synthetic construct
  misc_feature 1..20: note = CRISPR gRNA sequence
  source 1..20: mol_type = other DNA
aggccacactcatatgacac

SEQ ID NO: 72179 - DNA, 20 bp, synthetic construct
  misc_feature 1..20: note = CRISPR gRNA sequence
  source 1..20: mol_type = other DNA
atatgacacatttgtgcaaa

SEQ ID NO: 72180 - DNA, 20 bp, synthetic construct
  misc_feature 1..20: note = CRISPR gRNA sequence
  source 1..20: mol_type = other DNA
gtgcaaataaggaaaagacc

SEQ ID NO: 72181 - DNA, 20 bp, synthetic construct
  misc_feature 1..20: note = CRISPR gRNA sequence
  source 1..20: mol_type = other DNA
tgcaaataaggaaaagaccc

SEQ ID NO: 72182 - DNA, 20 bp, synthetic construct
  misc_feature 1..20: note = CRISPR gRNA sequence
  source 1..20: mol_type = other DNA
tttcttcaagatgttttact

SEQ ID NO: 72183 - DNA, 20 bp, synthetic construct
  misc_feature 1..20: note = CRISPR gRNA sequence
  source 1..20: mol_type = other DNA
tcttcaagatgttttacttc

SEQ ID NO: 72184 - DNA, 20 bp, synthetic construct
  misc_feature 1..20: note = CRISPR gRNA sequence
  source 1..20: mol_type = other DNA
cttcaagatgttttacttcc

SEQ ID NO: 72185 - DNA, 20 bp, synthetic construct
  misc_feature 1..20: note = CRISPR gRNA sequence
  source 1..20: mol_type = other DNA
ttcaagatgttttacttcca

SEQ ID NO: 72186 - DNA, 20 bp, synthetic construct
  misc_feature 1..20: note = CRISPR gRNA sequence
  source 1..20: mol_type = other DNA
caagatgttttacttccatc

SEQ ID NO: 72187 - DNA, 20 bp, synthetic construct
  misc_feature 1..20: note = CRISPR gRNA sequence
  source 1..20: mol_type = other DNA
aagatgttttacttccatct

SEQ ID NO: 72188 - DNA, 20 bp, synthetic construct
  misc_feature 1..20: note = CRISPR gRNA sequence
  source 1..20: mol_type = other DNA
tacttccatctgtctgaaat

SEQ ID NO: 72189 - DNA, 20 bp, synthetic construct
  misc_feature 1..20: note = CRISPR gRNA sequence
  source 1..20: mol_type = other DNA
acttccatctgtctgaaatt

SEQ ID NO: 72190 - DNA, 20 bp, synthetic construct
  misc_feature 1..20: note = CRISPR gRNA sequence
  source 1..20: mol_type = other DNA
cttccatctgtctgaaattg

SEQ ID NO: 72191 - DNA, 20 bp, synthetic construct
  misc_feature 1..20: note = CRISPR gRNA sequence
  source 1..20: mol_type = other DNA
ccatctgtctgaaattgtca

SEQ ID NO: 72192 - DNA, 20 bp, synthetic construct
  misc_feature 1..20: note = CRISPR gRNA sequence
  source 1..20: mol_type = other DNA
catctgtctgaaattgtcat

SEQ ID NO: 72193 - DNA, 20 bp, synthetic construct
  misc_feature 1..20: note = CRISPR gRNA sequence
  source 1..20: mol_type = other DNA
tctgaaattgtcataatata

SEQ ID NO: 72194 - DNA, 20 bp, synthetic construct
  misc_feature 1..20: note = CRISPR gRNA sequence
  source 1..20: mol_type = other DNA
aaattgtcataatatatgat

SEQ ID NO: 72195 - DNA, 20 bp, synthetic construct
  misc_feature 1..20: note = CRISPR gRNA sequence
  source 1..20: mol_type = other DNA
tcataatatatgattttggt

SEQ ID NO: 72196 - DNA, 20 bp, synthetic construct
  misc_feature 1..20: note = CRISPR gRNA sequence
  source 1..20: mol_type = other DNA
tggtagaacaaggtacttta

SEQ ID NO: 72197 - DNA, 20 bp, synthetic construct
  misc_feature 1..20: note = CRISPR gRNA sequence
  source 1..20: mol_type = other DNA
ggtagaacaaggtactttac

SEQ ID NO: 72198 - DNA, 20 bp, synthetic construct
  misc_feature 1..20: note = CRISPR gRNA sequence
  source 1..20: mol_type = other DNA
gtagaacaaggtactttact

SEQ ID NO: 72199 - DNA, 20 bp, synthetic construct
  misc_feature 1..20: note = CRISPR gRNA sequence
  source 1..20: mol_type = other DNA
tactctcatctgctagaaat

SEQ ID NO: 72200 - DNA, 20 bp, synthetic construct
  misc_feature 1..20: note = CRISPR gRNA sequence
  source 1..20: mol_type = other DNA
actctcatctgctagaaatc

SEQ ID NO: 72201 - DNA, 20 bp, synthetic construct
  misc_feature 1..20: note = CRISPR gRNA sequence
  source 1..20: mol_type = other DNA
ctctcatctgctagaaatct

SEQ ID NO: 72202 - DNA, 20 bp, synthetic construct
  misc_feature 1..20: note = CRISPR gRNA sequence
  source 1..20: mol_type = other DNA
tcatctgctagaaatctagc

SEQ ID NO: 72203 - DNA, 20 bp, synthetic construct
  misc_feature 1..20: note = CRISPR gRNA sequence
  source 1..20: mol_type = other DNA
atctgctagaaatctagcag

SEQ ID NO: 72204 - DNA, 20 bp, synthetic construct
  misc_feature 1..20: note = CRISPR gRNA sequence
  source 1..20: mol_type = other DNA
ctagaaatctagcaggttga

SEQ ID NO: 72205 - DNA, 20 bp, synthetic construct
  misc_feature 1..20: note = CRISPR gRNA sequence
  source 1..20: mol_type = other DNA
gaaatctagcaggttgacaa

SEQ ID NO: 72206 - DNA, 20 bp, synthetic construct
  misc_feature 1..20: note = CRISPR gRNA sequence
  source 1..20: mol_type = other DNA
gcaggttgacaatgtgaatg

SEQ ID NO: 72207 - DNA, 20 bp, synthetic construct
  misc_feature 1..20: note = CRISPR gRNA sequence
  source 1..20: mol_type = other DNA
acaatgtgaatggtgcccct

SEQ ID NO: 72208 - DNA, 20 bp, synthetic construct
  misc_feature 1..20: note = CRISPR gRNA sequence
  source 1..20: mol_type = other DNA
aggtttaatgcccttgtgca

SEQ ID NO: 72209 - DNA, 20 bp, synthetic construct
  misc_feature 1..20: note = CRISPR gRNA sequence
  source 1..20: mol_type = other DNA
ggtttaatgcccttgtgcag

SEQ ID NO: 72210 - DNA, 20 bp, synthetic construct
  misc_feature 1..20: note = CRISPR gRNA sequence
  source 1..20: mol_type = other DNA
aatgcccttgtgcagtgcac

SEQ ID NO: 72211 - DNA, 20 bp, synthetic construct
  misc_feature 1..20: note = CRISPR gRNA sequence
  source 1..20: mol_type = other DNA
atgcccttgtgcagtgcaca

SEQ ID NO: 72212 - DNA, 20 bp, synthetic construct
  misc_feature 1..20: note = CRISPR gRNA sequence
  source 1..20: mol_type = other DNA
gtgcagtgcacaacctatac

SEQ ID NO: 72213 - DNA, 20 bp, synthetic construct
  misc_feature 1..20: note = CRISPR gRNA sequence
  source 1..20: mol_type = other DNA
tgcagtgcacaacctataca

SEQ ID NO: 72214 - DNA, 20 bp, synthetic construct
  misc_feature 1..20: note = CRISPR gRNA sequence
  source 1..20: mol_type = other DNA
tacaactgtatgtgatggct

SEQ ID NO: 72215 - DNA, 20 bp, synthetic construct
  misc_feature 1..20: note = CRISPR gRNA sequence
  source 1..20: mol_type = other DNA
tatgtgatggctctgattat

SEQ ID NO: 72216 - DNA, 20 bp, synthetic construct
  misc_feature 1..20: note = CRISPR gRNA sequence
  source 1..20: mol_type = other DNA
tgattatagctgccatttta

SEQ ID NO: 72217 - DNA, 20 bp, synthetic construct
  misc_feature 1..20: note = CRISPR gRNA sequence
  source 1..20: mol_type = other DNA
attatagctgccattttaag

SEQ ID NO: 72218 - DNA, 20 bp, synthetic construct
  misc_feature 1..20: note = CRISPR gRNA sequence
  source 1..20: mol_type = other DNA
tagctgccattttaagtgct

SEQ ID NO: 72219 - DNA, 20 bp, synthetic construct
  misc_feature 1..20: note = CRISPR gRNA sequence
  source 1..20: mol_type = other DNA
ccattttaagtgcttactat

SEQ ID NO: 72220 - DNA, 20 bp, synthetic construct
  misc_feature 1..20: note = CRISPR gRNA sequence
  source 1..20: mol_type = other DNA
taagtgcttactatgtgcca

SEQ ID NO: 72221 - DNA, 20 bp, synthetic construct
  misc_feature 1..20: note = CRISPR gRNA sequence
  source 1..20: mol_type = other DNA
aagtgcttactatgtgccag

SEQ ID NO: 72222 - DNA, 20 bp, synthetic construct
  misc_feature 1..20: note = CRISPR gRNA sequence
  source 1..20: mol_type = other DNA
agtgcttactatgtgccagg

SEQ ID NO: 72223 - DNA, 20 bp, synthetic construct
  misc_feature 1..20: note = CRISPR gRNA sequence
  source 1..20: mol_type = other DNA
actatgtgccaggcattggg

SEQ ID NO: 72224 - DNA, 20 bp, synthetic construct
  misc_feature 1..20: note = CRISPR gRNA sequence
  source 1..20: mol_type = other DNA
ctatgtgccaggcattgggt

SEQ ID NO: 72225 - DNA, 20 bp, synthetic construct
  misc_feature 1..20: note = CRISPR gRNA sequence
  source 1..20: mol_type = other DNA
tgtgccaggcattgggttca

SEQ ID NO: 72226 - DNA, 20 bp, synthetic construct
  misc_feature 1..20: note = CRISPR gRNA sequence
  source 1..20: mol_type = other DNA
ggttcagtgctttatatgct

SEQ ID NO: 72227 - DNA, 20 bp, synthetic construct
  misc_feature 1..20: note = CRISPR gRNA sequence
  source 1..20: mol_type = other DNA
agtgctttatatgctcattt

SEQ ID NO: 72228 - DNA, 20 bp, synthetic construct
  misc_feature 1..20: note = CRISPR gRNA sequence
  source 1..20: mol_type = other DNA
tatatgctcatttagtcttc

SEQ ID NO: 72229 - DNA, 20 bp, synthetic construct
  misc_feature 1..20: note = CRISPR gRNA sequence
  source 1..20: mol_type = other DNA
atatgctcatttagtcttca

SEQ ID NO: 72230 - DNA, 20 bp, synthetic construct
  misc_feature 1..20: note = CRISPR gRNA sequence
  source 1..20: mol_type = other DNA
tatgctcatttagtcttcac

SEQ ID NO: 72231 - DNA, 20 bp, synthetic construct
  misc_feature 1..20: note = CRISPR gRNA sequence
  source 1..20: mol_type = other DNA
atttagtcttcacaactctc

SEQ ID NO: 72232 - DNA, 20 bp, synthetic construct
  misc_feature 1..20: note = CRISPR gRNA sequence
  source 1..20: mol_type = other DNA
agtcttcacaactctctgag

SEQ ID NO: 72233 - DNA, 20 bp, synthetic construct
  misc_feature 1..20: note = CRISPR gRNA sequence
  source 1..20: mol_type = other DNA
gtcttcacaactctctgagg

SEQ ID NO: 72234 - DNA, 20 bp, synthetic construct
  misc_feature 1..20: note = CRISPR gRNA sequence
  source 1..20: mol_type = other DNA
cacaactctctgaggtagat

SEQ ID NO: 72235 - DNA, 20 bp, synthetic construct
  misc_feature 1..20: note = CRISPR gRNA sequence
  source 1..20: mol_type = other DNA
acaactctctgaggtagata

SEQ ID NO: 72236 - DNA, 20 bp, synthetic construct
  misc_feature 1..20: note = CRISPR gRNA sequence
  source 1..20: mol_type = other DNA
tctgaggtagatactatcag

SEQ ID NO: 72237 - DNA, 20 bp, synthetic construct
  misc_feature 1..20: note = CRISPR gRNA sequence
  source 1..20: mol_type = other DNA
tgaggtagatactatcagta

SEQ ID NO: 72238 - DNA, 20 bp, synthetic construct
  misc_feature 1..20: note = CRISPR gRNA sequence
  source 1..20: mol_type = other DNA
aggtagatactatcagtatc

SEQ ID NO: 72239 - DNA, 20 bp, synthetic construct
  misc_feature 1..20: note = CRISPR gRNA sequence
  source 1..20: mol_type = other DNA
tcagtatccccatttcacag

SEQ ID NO: 72240 - DNA, 20 bp, synthetic construct
  misc_feature 1..20: note = CRISPR gRNA sequence
  source 1..20: mol_type = other DNA
cacagatgagaaaattgggg

SEQ ID NO: 72241 - DNA, 20 bp, synthetic construct
  misc_feature 1..20: note = CRISPR gRNA sequence
  source 1..20: mol_type = other DNA
acagatgagaaaattggggt

SEQ ID NO: 72242 - DNA, 20 bp, synthetic construct
  misc_feature 1..20: note = CRISPR gRNA sequence
  source 1..20: mol_type = other DNA
gggttcagagaggttgagtt

SEQ ID NO: 72243 - DNA, 20 bp, synthetic construct
  misc_feature 1..20: note = CRISPR gRNA sequence
  source 1..20: mol_type = other DNA
agagaggttgagttatggct

SEQ ID NO: 72244 - DNA, 20 bp, synthetic construct
  misc_feature 1..20: note = CRISPR gRNA sequence
  source 1..20: mol_type = other DNA
agttatggctacaaagttac

SEQ ID NO: 72245 - DNA, 20 bp, synthetic construct
  misc_feature 1..20: note = CRISPR gRNA sequence
  source 1..20: mol_type = other DNA
tggctacaaagttacacagt

SEQ ID NO: 72246 - DNA, 20 bp, synthetic construct
  misc_feature 1..20: note = CRISPR gRNA sequence
  source 1..20: mol_type = other DNA
caaagttacacagttggcaa

SEQ ID NO: 72247 - DNA, 20 bp, synthetic construct
  misc_feature 1..20: note = CRISPR gRNA sequence
  source 1..20: mol_type = other DNA
cacagttggcaagtggcaga

SEQ ID NO: 72248 - DNA, 20 bp, synthetic construct
  misc_feature 1..20: note = CRISPR gRNA sequence
  source 1..20: mol_type = other DNA
gcaagtggcagagctggggt

SEQ ID NO: 72249 - DNA, 20 bp, synthetic construct
  misc_feature 1..20: note = CRISPR gRNA sequence
  source 1..20: mol_type = other DNA
gggtttgatccaagtctgct

SEQ ID NO: 72250 - DNA, 20 bp, synthetic construct
  misc_feature 1..20: note = CRISPR gRNA sequence
  source 1..20: mol_type = other DNA
gatccaagtctgcttgctgc

SEQ ID NO: 72251 - DNA, 20 bp, synthetic construct
  misc_feature 1..20: note = CRISPR gRNA sequence
  source 1..20: mol_type = other DNA
atccaagtctgcttgctgcc

SEQ ID NO: 72252 - DNA, 20 bp, synthetic construct
  misc_feature 1..20: note = CRISPR gRNA sequence
  source 1..20: mol_type = other DNA
cttgctgccaaattcttggt

SEQ ID NO: 72253 - DNA, 20 bp, synthetic construct
  misc_feature 1..20: note = CRISPR gRNA sequence
  source 1..20: mol_type = other DNA
gctgccaaattcttggtgga

SEQ ID NO: 72254 - DNA, 20 bp, synthetic construct
  misc_feature 1..20: note = CRISPR gRNA sequence
  source 1..20: mol_type = other DNA
ctgccaaattcttggtggag

SEQ ID NO: 72255 - DNA, 20 bp, synthetic construct
  misc_feature 1..20: note = CRISPR gRNA sequence
  source 1..20: mol_type = other DNA
ccaaattcttggtggagtgg

SEQ ID NO: 72256 - DNA, 20 bp, synthetic construct
  misc_feature 1..20: note = CRISPR gRNA sequence
  source 1..20: mol_type = other DNA
ttggtggagtggtccaagtc

SEQ ID NO: 72257 - DNA, 20 bp, synthetic construct
  misc_feature 1..20: note = CRISPR gRNA sequence
  source 1..20: mol_type = other DNA
ggtggagtggtccaagtctc

SEQ ID NO: 72258 - DNA, 20 bp, synthetic construct
  misc_feature 1..20: note = CRISPR gRNA sequence
  source 1..20: mol_type = other DNA
gtggagtggtccaagtctcc

SEQ ID NO: 72259 - DNA, 20 bp, synthetic construct
  misc_feature 1..20: note = CRISPR gRNA sequence
  source 1..20: mol_type = other DNA
ctttgataatccccagccca

SEQ ID NO: 72260 - DNA, 20 bp, synthetic construct
  misc_feature 1..20: note = CRISPR gRNA sequence
  source 1..20: mol_type = other DNA
tgataatccccagcccaggc

SEQ ID NO: 72261 - DNA, 20 bp, synthetic construct
  misc_feature 1..20: note = CRISPR gRNA sequence
  source 1..20: mol_type = other DNA
gataatccccagcccaggcc

SEQ ID NO: 72262 - DNA, 20 bp, synthetic construct
  misc_feature 1..20: note = CRISPR gRNA sequence
  source 1..20: mol_type = other DNA
ataatccccagcccaggccc

SEQ ID NO: 72263 - DNA, 20 bp, synthetic construct
  misc_feature 1..20: note = CRISPR gRNA sequence
  source 1..20: mol_type = other DNA
ccgcctcctccagggagtcc

SEQ ID NO: 72264 - DNA, 20 bp, synthetic construct
  misc_feature 1..20: note = CRISPR gRNA sequence
  source 1..20: mol_type = other DNA
ctccagggagtcccattaga

SEQ ID NO: 72265 - DNA, 20 bp, synthetic construct
  misc_feature 1..20: note = CRISPR gRNA sequence
  source 1..20: mol_type = other DNA
cagggagtcccattagatct

SEQ ID NO: 72266 - DNA, 20 bp, synthetic construct
  misc_feature 1..20: note = CRISPR gRNA sequence
  source 1..20: mol_type = other DNA
gatctgggggttggtgtagc

SEQ ID NO: 72267 - DNA, 20 bp, synthetic construct
  misc_feature 1..20: note = CRISPR gRNA sequence
  source 1..20: mol_type = other DNA
ggggttggtgtagcctccca

SEQ ID NO: 72268 - DNA, 20 bp, synthetic construct
  misc_feature 1..20: note = CRISPR gRNA sequence
  source 1..20: mol_type = other DNA
gtgtagcctcccacccacca

SEQ ID NO: 72269 - DNA, 20 bp, synthetic construct
  misc_feature 1..20: note = CRISPR gRNA sequence
  source 1..20: mol_type = other DNA
ccacccaccatccctgcccc

SEQ ID NO: 72270 - DNA, 20 bp, synthetic construct
  misc_feature 1..20: note = CRISPR gRNA sequence
  source 1..20: mol_type = other DNA
cccctgcaggcctctgttac

SEQ ID NO: 72271 - DNA, 20 bp, synthetic construct
  misc_feature 1..20: note = CRISPR gRNA sequence
  source 1..20: mol_type = other DNA
caggcctctgttaccggatg

SEQ ID NO: 72272 - DNA, 20 bp, synthetic construct
  misc_feature 1..20: note = CRISPR gRNA sequence
  source 1..20: mol_type = other DNA
tgttaccggatgacttggat

SEQ ID NO: 72273 - DNA, 20 bp, synthetic construct
  misc_feature 1..20: note = CRISPR gRNA sequence
  source 1..20: mol_type = other DNA
ttaccggatgacttggatgc

SEQ ID NO: 72274 - DNA, 20 bp, synthetic construct
  misc_feature 1..20: note = CRISPR gRNA sequence
  source 1..20: mol_type = other DNA
ccggatgacttggatgctag

SEQ ID NO: 72275 - DNA, 20 bp, synthetic construct
  misc_feature 1..20: note = CRISPR gRNA sequence
  source 1..20: mol_type = other DNA
ggatgctagacccctgggcc

SEQ ID NO: 72276 - DNA, 20 bp, synthetic construct
  misc_feature 1..20: note = CRISPR gRNA sequence
  source 1..20: mol_type = other DNA
gatgctagacccctgggcca

SEQ ID NO: 72277 - DNA, 20 bp, synthetic construct
  misc_feature 1..20: note = CRISPR gRNA sequence
  source 1..20: mol_type = other DNA
gacccctgggccagtccttc

SEQ ID NO: 72278 - DNA, 20 bp, synthetic construct
  misc_feature 1..20: note = CRISPR gRNA sequence
  source 1..20: mol_type = other DNA
ggccagtccttcagccagga

SEQ ID NO: 72279 - DNA, 20 bp, synthetic construct
  misc_feature 1..20: note = CRISPR gRNA sequence
  source 1..20: mol_type = other DNA
cagccaggagccaggccccc

SEQ ID NO: 72280 - DNA, 20 bp, synthetic construct
  misc_feature 1..20: note = CRISPR gRNA sequence
  source 1..20: mol_type = other DNA
agccaggagccaggccccca

SEQ ID NO: 72281 - DNA, 20 bp, synthetic construct
  misc_feature 1..20: note = CRISPR gRNA sequence
  source 1..20: mol_type = other DNA
tgatctgattcttctccagg

SEQ ID NO: 72282 - DNA, 20 bp, synthetic construct
  misc_feature 1..20: note = CRISPR gRNA sequence
  source 1..20: mol_type = other DNA
attcttctccaggcttctca

SEQ ID NO: 72283 - DNA, 20 bp, synthetic construct
  misc_feature 1..20: note = CRISPR gRNA sequence
  source 1..20: mol_type = other DNA
ttctccaggcttctcagtgg

SEQ ID NO: 72284 - DNA, 20 bp, synthetic construct
  misc_feature 1..20: note = CRISPR gRNA sequence
  source 1..20: mol_type = other DNA
ctccaggcttctcagtggac

SEQ ID NO: 72285 - DNA, 20 bp, synthetic construct
  misc_feature 1..20: note = CRISPR gRNA sequence
  source 1..20: mol_type = other DNA
tccaggcttctcagtggaca

SEQ ID NO: 72286 - DNA, 20 bp, synthetic construct
  misc_feature 1..20: note = CRISPR gRNA sequence
  source 1..20: mol_type = other DNA
caggcttctcagtggacagt

SEQ ID NO: 72287 - DNA, 20 bp, synthetic construct
  misc_feature 1..20: note = CRISPR gRNA sequence
  source 1..20: mol_type = other DNA
ctcagtggacagtgagggga

SEQ ID NO: 72288 - DNA, 20 bp, synthetic construct
  misc_feature 1..20: note = CRISPR gRNA sequence
  source 1..20: mol_type = other DNA
tcagtggacagtgaggggag

SEQ ID NO: 72289 - DNA, 20 bp, synthetic construct
  misc_feature 1..20: note = CRISPR gRNA sequence
  source 1..20: mol_type = other DNA
agtggacagtgaggggaggg

SEQ ID NO: 72290 - DNA, 20 bp, synthetic construct
  misc_feature 1..20: note = CRISPR gRNA sequence
  source 1..20: mol_type = other DNA
cctaggtcccttcctcaggc

SEQ ID NO: 72291 - DNA, 20 bp, synthetic construct
  misc_feature 1..20: note = CRISPR gRNA sequence
  source 1..20: mol_type = other DNA
ctaggtcccttcctcaggcc

SEQ ID NO: 72292 - DNA, 20 bp, synthetic construct
  misc_feature 1..20: note = CRISPR gRNA sequence
  source 1..20: mol_type = other DNA
ggtcccttcctcaggccaag

SEQ ID NO: 72293 - DNA, 20 bp, synthetic construct
  misc_feature 1..20: note = CRISPR gRNA sequence
  source 1..20: mol_type = other DNA
cctcaggccaaggtcagggg

SEQ ID NO: 72294 - DNA, 20 bp, synthetic construct
  misc_feature 1..20: note = CRISPR gRNA sequence
  source 1..20: mol_type = other DNA
ctcaggccaaggtcagggga

SEQ ID NO: 72295 - DNA, 20 bp, synthetic construct
  misc_feature 1..20: note = CRISPR gRNA sequence
  source 1..20: mol_type = other DNA
aggccaaggtcaggggacac

SEQ ID NO: 72296 - DNA, 20 bp, synthetic construct
  misc_feature 1..20: note = CRISPR gRNA sequence
  source 1..20: mol_type = other DNA
ccacactaccttctcaggga

SEQ ID NO: 72297 - DNA, 20 bp, synthetic construct
  misc_feature 1..20: note = CRISPR gRNA sequence
  source 1..20: mol_type = other DNA
ccttctcagggaacccaaaa

SEQ ID NO: 72298 - DNA, 20 bp, synthetic construct
  misc_feature 1..20: note = CRISPR gRNA sequence
  source 1..20: mol_type = other DNA
ctcagggaacccaaaagaca

SEQ ID NO: 72299 - DNA, 20 bp, synthetic construct
  misc_feature 1..20: note = CRISPR gRNA sequence
  source 1..20: mol_type = other DNA
tcagggaacccaaaagacaa

SEQ ID NO: 72300 - DNA, 20 bp, synthetic construct
  misc_feature 1..20: note = CRISPR gRNA sequence
  source 1..20: mol_type = other DNA
agggaacccaaaagacaaca

SEQ ID NO: 72301 - DNA, 20 bp, synthetic construct
  misc_feature 1..20: note = CRISPR gRNA sequence
  source 1..20: mol_type = other DNA
gtggcaggtgcagcaggaag

SEQ ID NO: 72302 - DNA, 20 bp, synthetic construct
  misc_feature 1..20: note = CRISPR gRNA sequence
  source 1..20: mol_type = other DNA
aaggctagaacccaggggga

SEQ ID NO: 72303 - DNA, 20 bp, synthetic construct
  misc_feature 1..20: note = CRISPR gRNA sequence
  source 1..20: mol_type = other DNA
gaacccagggggaactaagc

SEQ ID NO: 72304 - DNA, 20 bp, synthetic construct
  misc_feature 1..20: note = CRISPR gRNA sequence
  source 1..20: mol_type = other DNA
agcctggcaggggcttggaa

SEQ ID NO: 72305 - DNA, 20 bp, synthetic construct
  misc_feature 1..20: note = CRISPR gRNA sequence
  source 1..20: mol_type = other DNA
gcaggggcttggaacaggcc

SEQ ID NO: 72306 - DNA, 20 bp, synthetic construct
  misc_feature 1..20: note = CRISPR gRNA sequence
  source 1..20: mol_type = other DNA
ggaacaggccagagtgtgca

SEQ ID NO: 72307 - DNA, 20 bp, synthetic construct
  misc_feature 1..20: note = CRISPR gRNA sequence
  source 1..20: mol_type = other DNA
gaacaggccagagtgtgcaa

SEQ ID NO: 72308 - DNA, 20 bp, synthetic construct
  misc_feature 1..20: note = CRISPR gRNA sequence
  source 1..20: mol_type = other DNA
aaggaagggctttctgggag

SEQ ID NO: 72309 - DNA, 20 bp, synthetic construct
  misc_feature 1..20: note = CRISPR gRNA sequence
  source 1..20: mol_type = other DNA
tctgggaggcaggggactga

SEQ ID NO: 72310 - DNA, 20 bp, synthetic construct
  misc_feature 1..20: note = CRISPR gRNA sequence
  source 1..20: mol_type = other DNA
ctgggaggcaggggactgac

SEQ ID NO: 72311 - DNA, 20 bp, synthetic construct
  misc_feature 1..20: note = CRISPR gRNA sequence
  source 1..20: mol_type = other DNA
tgggaggcaggggactgacc

SEQ ID NO: 72312 - DNA, 20 bp, synthetic construct
  misc_feature 1..20: note = CRISPR gRNA sequence
  source 1..20: mol_type = other DNA
ggaggcaggggactgaccca

SEQ ID NO: 72313 - DNA, 20 bp, synthetic construct
  misc_feature 1..20: note = CRISPR gRNA sequence
  source 1..20: mol_type = other DNA
acccagtggcctcttggtgt

SEQ ID NO: 72314 - DNA, 20 bp, synthetic construct
  misc_feature 1..20: note = CRISPR gRNA sequence
  source 1..20: mol_type = other DNA
ttggtgttcccgggatgtag

SEQ ID NO: 72315 - DNA, 20 bp, synthetic construct
  misc_feature 1..20: note = CRISPR gRNA sequence
  source 1..20: mol_type = other DNA
ggtgttcccgggatgtaggt

SEQ ID NO: 72316 - DNA, 20 bp, synthetic construct
  misc_feature 1..20: note = CRISPR gRNA sequence
  source 1..20: mol_type = other DNA
gtgttcccgggatgtaggtc

SEQ ID NO: 72317 - DNA, 20 bp, synthetic construct
  misc_feature 1..20: note = CRISPR gRNA sequence
  source 1..20: mol_type = other DNA
ccgggatgtaggtccccctt

SEQ ID NO: 72318 - DNA, 20 bp, synthetic construct
  misc_feature 1..20: note = CRISPR gRNA sequence
  source 1..20: mol_type = other DNA
tagcccgtcccattcctccc

SEQ ID NO: 72319 - DNA, 20 bp, synthetic construct
  misc_feature 1..20: note = CRISPR gRNA sequence
  source 1..20: mol_type = other DNA
agcccgtcccattcctcccc

SEQ ID NO: 72320 - DNA, 20 bp, synthetic construct
  misc_feature 1..20: note = CRISPR gRNA sequence
  source 1..20: mol_type = other DNA
gcccgtcccattcctccccc

SEQ ID NO: 72321 - DNA, 20 bp, synthetic construct
  misc_feature 1..20: note = CRISPR gRNA sequence
  source 1..20: mol_type = other DNA
ctcccccggcccctcatact

SEQ ID NO: 72322 - DNA, 20 bp, synthetic construct
  misc_feature 1..20: note = CRISPR gRNA sequence
  source 1..20: mol_type = other DNA
ccccggcccctcatactcca

SEQ ID NO: 72323 - DNA, 20 bp, synthetic construct
  misc_feature 1..20: note = CRISPR gRNA sequence
  source 1..20: mol_type = other DNA
atactccactctcttcagcc

SEQ ID NO: 72324 - DNA, 20 bp, synthetic construct
  misc_feature 1..20: note = CRISPR gRNA sequence
  source 1..20: mol_type = other DNA
cactctcttcagccggccca

SEQ ID NO: 72325 - DNA, 20 bp, synthetic construct
  misc_feature 1..20: note = CRISPR gRNA sequence
  source 1..20: mol_type = other DNA
tcttcagccggcccatctgc

SEQ ID NO: 72326 - DNA, 20 bp, synthetic construct
  misc_feature 1..20: note = CRISPR gRNA sequence
  source 1..20: mol_type = other DNA
ttcagccggcccatctgcgg

SEQ ID NO: 72327 - DNA, 20 bp, synthetic construct
  misc_feature 1..20: note = CRISPR gRNA sequence
  source 1..20: mol_type = other DNA
cagccggcccatctgcggca

SEQ ID NO: 72328 - DNA, 20 bp, synthetic construct
  misc_feature 1..20: note = CRISPR gRNA sequence
  source 1..20: mol_type = other DNA
agccggcccatctgcggcag

SEQ ID NO: 72329 - DNA, 20 bp, synthetic construct
  misc_feature 1..20: note = CRISPR gRNA sequence
  source 1..20: mol_type = other DNA
cggcagcacctgggccagct

SEQ ID NO: 72330 - DNA, 20 bp, synthetic construct
  misc_feature 1..20: note = CRISPR gRNA sequence
  source 1..20: mol_type = other DNA
ggccagctcggcagctgcct

SEQ ID NO: 72331 - DNA, 20 bp, synthetic construct
  misc_feature 1..20: note = CRISPR gRNA sequence
  source 1..20: mol_type = other DNA
ggcagctgcctcatccccga

SEQ ID NO: 72332 - DNA, 20 bp, synthetic construct
  misc_feature 1..20: note = CRISPR gRNA sequence
  source 1..20: mol_type = other DNA
cctcatccccgaggagattc

SEQ ID NO: 72333 - DNA, 20 bp, synthetic construct
  misc_feature 1..20: note = CRISPR gRNA sequence
  source 1..20: mol_type = other DNA
atccccgaggagattccagg

SEQ ID NO: 72334 - DNA, 20 bp, synthetic construct
  misc_feature 1..20: note = CRISPR gRNA sequence
  source 1..20: mol_type = other DNA
caggacagcctgcagggtag

SEQ ID NO: 72335 - DNA, 20 bp, synthetic construct
  misc_feature 1..20: note = CRISPR gRNA sequence
  source 1..20: mol_type = other DNA
cagggtaggggtcccaaagt

SEQ ID NO: 72336 - DNA, 20 bp, synthetic construct
  misc_feature 1..20: note = CRISPR gRNA sequence
  source 1..20: mol_type = other DNA
tcaagagaggccacctgata

SEQ ID NO: 72337 - DNA, 20 bp, synthetic construct
  misc_feature 1..20: note = CRISPR gRNA sequence
  source 1..20: mol_type = other DNA
caagagaggccacctgatag

SEQ ID NO: 72338 - DNA, 20 bp, synthetic construct
  misc_feature 1..20: note = CRISPR gRNA sequence
  source 1..20: mol_type = other DNA
aagagaggccacctgatagg

SEQ ID NO: 72339 - DNA, 20 bp, synthetic construct
  misc_feature 1..20: note = CRISPR gRNA sequence
  source 1..20: mol_type = other DNA
atagggtgcttgtgtgtcct

SEQ ID NO: 72340 - DNA, 20 bp, synthetic construct
  misc_feature 1..20: note = CRISPR gRNA sequence
  source 1..20: mol_type = other DNA
gtgtgtcctcccctgaagac

SEQ ID NO: 72341 - DNA, 20 bp, synthetic construct
  misc_feature 1..20: note = CRISPR gRNA sequence
  source 1..20: mol_type = other DNA
tgtgtcctcccctgaagacg

SEQ ID NO: 72342 - DNA, 20 bp, synthetic construct
  misc_feature 1..20: note = CRISPR gRNA sequence
  source 1..20: mol_type = other DNA
ccctgaagacgtcagggtgc

SEQ ID NO: 72343 - DNA, 20 bp, synthetic construct
  misc_feature 1..20: note = CRISPR gRNA sequence
  source 1..20: mol_type = other DNA
aagacgtcagggtgcaggtt

SEQ ID NO: 72344 - DNA, 20 bp, synthetic construct
  misc_feature 1..20: note = CRISPR gRNA sequence
  source 1..20: mol_type = other DNA
ccttcctccctgctcccctc

SEQ ID NO: 72345 - DNA, 20 bp, synthetic construct
  misc_feature 1..20: note = CRISPR gRNA sequence
  source 1..20: mol_type = other DNA
cctccctgctcccctccccg

SEQ ID NO: 72346 - DNA, 20 bp, synthetic construct
  misc_feature 1..20: note = CRISPR gRNA sequence
  source 1..20: mol_type = other DNA
ctccctgctcccctccccgt

SEQ ID NO: 72347 - DNA, 20 bp, synthetic construct
  misc_feature 1..20: note = CRISPR gRNA sequence
  source 1..20: mol_type = other DNA
cctgctcccctccccgtcaa

SEQ ID NO: 72348 - DNA, 20 bp, synthetic construct
  misc_feature 1..20: note = CRISPR gRNA sequence
  source 1..20: mol_type = other DNA
ctcccctccccgtcaagttt

SEQ ID NO: 72349 - DNA, 20 bp, synthetic construct
  misc_feature 1..20: note = CRISPR gRNA sequence
  source 1..20: mol_type = other DNA
ccctccccgtcaagtttgaa

SEQ ID NO: 72350 - DNA, 20 bp, synthetic construct
  misc_feature 1..20: note = CRISPR gRNA sequence
  source 1..20: mol_type = other DNA
cccgtcaagtttgaatcatg

SEQ ID NO: 72351 - DNA, 20 bp, synthetic construct
  misc_feature 1..20: note = CRISPR gRNA sequence
  source 1..20: mol_type = other DNA
gaatcatgacgttgttcaca

SEQ ID NO: 72352 - DNA, 20 bp, synthetic construct
  misc_feature 1..20: note = CRISPR gRNA sequence
  source 1..20: mol_type = other DNA
aatcatgacgttgttcacaa

SEQ ID NO: 72353 - DNA, 20 bp, synthetic construct
  misc_feature 1..20: note = CRISPR gRNA sequence
  source 1..20: mol_type = other DNA
ttcacaagatgttgccattt

SEQ ID NO: 72354 - DNA, 20 bp, synthetic construct
  misc_feature 1..20: note = CRISPR gRNA sequence
  source 1..20: mol_type = other DNA
acaagatgttgccatttttg

SEQ ID NO: 72355 - DNA, 20 bp, synthetic construct
  misc_feature 1..20: note = CRISPR gRNA sequence
  source 1..20: mol_type = other DNA
ccatttttgccacatacatg

SEQ ID NO: 72356 - DNA, 20 bp, synthetic construct
  misc_feature 1..20: note = CRISPR gRNA sequence
  source 1..20: mol_type = other DNA
ttgccacatacatgtacctc

SEQ ID NO: 72357 - DNA, 20 bp, synthetic construct
  misc_feature 1..20: note = CRISPR gRNA sequence
  source 1..20: mol_type = other DNA
tgccacatacatgtacctcc

SEQ ID NO: 72358 - DNA, 20 bp, synthetic construct
  misc_feature 1..20: note = CRISPR gRNA sequence
  source 1..20: mol_type = other DNA
gccacatacatgtacctcct

SEQ ID NO: 72359 - DNA, 20 bp, synthetic construct
  misc_feature 1..20: note = CRISPR gRNA sequence
  source 1..20: mol_type = other DNA
ccacatacatgtacctcctg

SEQ ID NO: 72360 - DNA, 20 bp, synthetic construct
  misc_feature 1..20: note = CRISPR gRNA sequence
  source 1..20: mol_type = other DNA
ctgtatttaagatgcatcat

SEQ ID NO: 72361 - DNA, 20 bp, synthetic construct
  misc_feature 1..20: note = CRISPR gRNA sequence
  source 1..20: mol_type = other DNA
tatttaagatgcatcatatt

SEQ ID NO: 72362 - DNA, 20 bp, synthetic construct
  misc_feature 1..20: note = CRISPR gRNA sequence
  source 1..20: mol_type = other DNA
aagatgcatcatatttttct

SEQ ID NO: 72363 - DNA, 20 bp, synthetic construct
  misc_feature 1..20: note = CRISPR gRNA sequence
  source 1..20: mol_type = other DNA
agatgcatcatatttttctt

SEQ ID NO: 72364 - DNA, 20 bp, synthetic construct
  misc_feature 1..20: note = CRISPR gRNA sequence
  source 1..20: mol_type = other DNA
ttctttaaattggccccctc

SEQ ID NO: 72365 - DNA, 20 bp, synthetic construct
  misc_feature 1..20: note = CRISPR gRNA sequence
  source 1..20: mol_type = other DNA
tctttaaattggccccctct

SEQ ID NO: 72366 - DNA, 20 bp, synthetic construct
  misc_feature 1..20: note = CRISPR gRNA sequence
  source 1..20: mol_type = other DNA
ctttaaattggccccctctt

SEQ ID NO: 72367 - DNA, 20 bp, synthetic construct
  misc_feature 1..20: note = CRISPR gRNA sequence
  source 1..20: mol_type = other DNA
tttaaattggccccctcttt

SEQ ID NO: 72368 - DNA, 20 bp, synthetic construct
  misc_feature 1..20: note = CRISPR gRNA sequence
  source 1..20: mol_type = other DNA
taaattggccccctcttttt

SEQ ID NO: 72369 - DNA, 20 bp, synthetic construct
  misc_feature 1..20: note = CRISPR gRNA sequence
  source 1..20: mol_type = other DNA
aaattggccccctctttttt

SEQ ID NO: 72370 - DNA, 20 bp, synthetic construct
  misc_feature 1..20: note = CRISPR gRNA sequence
  source 1..20: mol_type = other DNA
aattggccccctcttttttc

SEQ ID NO: 72371 - DNA, 20 bp, synthetic construct
  misc_feature 1..20: note = CRISPR gRNA sequence
  source 1..20: mol_type = other DNA
gccccctcttttttcttact

SEQ ID NO: 72372 - DNA, 20 bp, synthetic construct
  misc_feature 1..20: note = CRISPR gRNA sequence
  source 1..20: mol_type = other DNA
ttttttcttactttaaaaaa

SEQ ID NO: 72373 - DNA, 20 bp, synthetic construct
  misc_feature 1..20: note = CRISPR gRNA sequence
  source 1..20: mol_type = other DNA
ttttcttactttaaaaaatt

SEQ ID NO: 72374 - DNA, 20 bp, synthetic construct
  misc_feature 1..20: note = CRISPR gRNA sequence
  source 1..20: mol_type = other DNA
tttcttactttaaaaaatta

SEQ ID NO: 72375 - DNA, 20 bp, synthetic construct
  misc_feature 1..20: note = CRISPR gRNA sequence
  source 1..20: mol_type = other DNA
ttcttactttaaaaaattaa

SEQ ID NO: 72376 - DNA, 20 bp, synthetic construct
  misc_feature 1..20: note = CRISPR gRNA sequence
  source 1..20: mol_type = other DNA
tcttactttaaaaaattaat

SEQ ID NO: 72377 - DNA, 20 bp, synthetic construct
  misc_feature 1..20: note = CRISPR gRNA sequence
  source 1..20: mol_type = other DNA
cttactttaaaaaattaatc

SEQ ID NO: 72378 - DNA, 20 bp, synthetic construct
  misc_feature 1..20: note = CRISPR gRNA sequence
  source 1..20: mol_type = other DNA
ttactttaaaaaattaatct

SEQ ID NO: 72379 - DNA, 20 bp, synthetic construct
  misc_feature 1..20: note = CRISPR gRNA sequence
  source 1..20: mol_type = other DNA
actttaaaaaattaatcttg

SEQ ID NO: 72380 - DNA, 20 bp, synthetic construct
  misc_feature 1..20: note = CRISPR gRNA sequence
  source 1..20: mol_type = other DNA
ctttaaaaaattaatcttgg

SEQ ID NO: 72381 - DNA, 20 bp, synthetic construct
  misc_feature 1..20: note = CRISPR gRNA sequence
  source 1..20: mol_type = other DNA
taaaaaattaatcttggctg

SEQ ID NO: 72382 - DNA, 20 bp, synthetic construct
  misc_feature 1..20: note = CRISPR gRNA sequence
  source 1..20: mol_type = other DNA
aaaaaattaatcttggctgg

SEQ ID NO: 72383 - DNA, 20 bp, synthetic construct
  misc_feature 1..20: note = CRISPR gRNA sequence
  source 1..20: mol_type = other DNA
aaaaattaatcttggctggg

SEQ ID NO: 72384 - DNA, 20 bp, synthetic construct
  misc_feature 1..20: note = CRISPR gRNA sequence
  source 1..20: mol_type = other DNA
atcttggctgggcgtggttg

SEQ ID NO: 72385 - DNA, 20 bp, synthetic construct
  misc_feature 1..20: note = CRISPR gRNA sequence
  source 1..20: mol_type = other DNA
ggctgggcgtggttgctcac

SEQ ID NO: 72386 - DNA, 20 bp, synthetic construct
  misc_feature 1..20: note = CRISPR gRNA sequence
  source 1..20: mol_type = other DNA
gctgggcgtggttgctcacg

SEQ ID NO: 72387 - DNA, 20 bp, synthetic construct
  misc_feature 1..20: note = CRISPR gRNA sequence
  source 1..20: mol_type = other DNA
ggcgtggttgctcacgcctg

SEQ ID NO: 72388 - DNA, 20 bp, synthetic construct
  misc_feature 1..20: note = CRISPR gRNA sequence
  source 1..20: mol_type = other DNA
ctcacgcctgtaatcccagc

SEQ ID NO: 72389 - DNA, 20 bp, synthetic construct
  misc_feature 1..20: note = CRISPR gRNA sequence
  source 1..20: mol_type = other DNA
acgcctgtaatcccagcact

SEQ ID NO: 72390 - DNA, 20 bp, synthetic construct
  misc_feature 1..20: note = CRISPR gRNA sequence
  source 1..20: mol_type = other DNA
taatcccagcactttgggag

SEQ ID NO: 72391 - DNA, 20 bp, synthetic construct
  misc_feature 1..20: note = CRISPR gRNA sequence
  source 1..20: mol_type = other DNA
tgggaggccaaggtcaggtg

SEQ ID NO: 72392 - DNA, 20 bp, synthetic construct
  misc_feature 1..20: note = CRISPR gRNA sequence
  source 1..20: mol_type = other DNA
gggaggccaaggtcaggtgt

SEQ ID NO: 72393 - DNA, 20 bp, synthetic construct
  misc_feature 1..20: note = CRISPR gRNA sequence
  source 1..20: mol_type = other DNA
ggaggccaaggtcaggtgtt

SEQ ID NO: 72394 - DNA, 20 bp, synthetic construct
  misc_feature 1..20: note = CRISPR gRNA sequence
  source 1..20: mol_type = other DNA
gagacgagcctaaccaacat

SEQ ID NO: 72395 - DNA, 20 bp, synthetic construct
  misc_feature 1..20: note = CRISPR gRNA sequence
  source 1..20: mol_type = other DNA
agacgagcctaaccaacatg

SEQ ID NO: 72396 - DNA, 20 bp, synthetic construct
  misc_feature 1..20: note = CRISPR gRNA sequence
  source 1..20: mol_type = other DNA
accaacatggtgaaatcctg

SEQ ID NO: 72397 - DNA, 20 bp, synthetic construct
  misc_feature 1..20: note = CRISPR gRNA sequence
  source 1..20: mol_type = other DNA
tctctactaaaaatacaaaa

SEQ ID NO: 72398 - DNA, 20 bp, synthetic construct
  misc_feature 1..20: note = CRISPR gRNA sequence
  source 1..20: mol_type = other DNA
tactaaaaatacaaaaatta

SEQ ID NO: 72399 - DNA, 20 bp, synthetic construct
  misc_feature 1..20: note = CRISPR gRNA sequence
  source 1..20: mol_type = other DNA
ctaaaaatacaaaaattagc

SEQ ID NO: 72400 - DNA, 20 bp, synthetic construct
  misc_feature 1..20: note = CRISPR gRNA sequence
  source 1..20: mol_type = other DNA
aaaatacaaaaattagctgg

SEQ ID NO: 72401 - DNA, 20 bp, synthetic construct
  misc_feature 1..20: note = CRISPR gRNA sequence
  source 1..20: mol_type = other DNA
gctgggtgtggtggtgggca

SEQ ID NO: 72402 - DNA, 20 bp, synthetic construct
  misc_feature 1..20: note = CRISPR gRNA sequence
  source 1..20: mol_type = other DNA
ggtgtggtggtgggcacttg

SEQ ID NO: 72403 - DNA, 20 bp, synthetic construct
  misc_feature 1..20: note = CRISPR gRNA sequence
  source 1..20: mol_type = other DNA
gtaatcccagctactcagga

SEQ ID NO: 72404 - DNA, 20 bp, synthetic construct
  misc_feature 1..20: note = CRISPR gRNA sequence
  source 1..20: mol_type = other DNA
taatcccagctactcaggag

SEQ ID NO: 72405 - DNA, 20 bp, synthetic construct
  misc_feature 1..20: note = CRISPR gRNA sequence
  source 1..20: mol_type = other DNA
ctcaggaggctgaggcagga

SEQ ID NO: 72406 - DNA, 20 bp, synthetic construct
  misc_feature 1..20: note = CRISPR gRNA sequence
  source 1..20: mol_type = other DNA
aggaggctgaggcaggagaa

SEQ ID NO: 72407 - DNA, 20 bp, synthetic construct
  misc_feature 1..20: note = CRISPR gRNA sequence
  source 1..20: mol_type = other DNA
aggcaggagaatctcttgaa

SEQ ID NO: 72408 - DNA, 20 bp, synthetic construct
  misc_feature 1..20: note = CRISPR gRNA sequence
  source 1..20: mol_type = other DNA
ttgaacccggcaggtggagg

SEQ ID NO: 72409 - DNA, 20 bp, synthetic construct
  misc_feature 1..20: note = CRISPR gRNA sequence
  source 1..20: mol_type = other DNA
gaacccggcaggtggaggtt

SEQ ID NO: 72410 - DNA, 20 bp, synthetic construct
  misc_feature 1..20: note = CRISPR gRNA sequence
  source 1..20: mol_type = other DNA
aacccggcaggtggaggttg

SEQ ID NO: 72411 - DNA, 20 bp, synthetic construct
  misc_feature 1..20: note = CRISPR gRNA sequence
  source 1..20: mol_type = other DNA
cagtgagccgagattgcacc

SEQ ID NO: 72412 - DNA, 20 bp, synthetic construct
  misc_feature 1..20: note = CRISPR gRNA sequence
  source 1..20: mol_type = other DNA
caccactgcactccagcctg

SEQ ID NO: 72413 - DNA, 20 bp, synthetic construct
  misc_feature 1..20: note = CRISPR gRNA sequence
  source 1..20: mol_type = other DNA
cactccagcctgggtaacag

SEQ ID NO: 72414 - DNA, 20 bp, synthetic construct
  misc_feature 1..20: note = CRISPR gRNA sequence
  source 1..20: mol_type = other DNA
cagcctgggtaacagaggga

SEQ ID NO: 72415 - DNA, 20 bp, synthetic construct
  misc_feature 1..20: note = CRISPR gRNA sequence
  source 1..20: mol_type = other DNA
ggtaacagagggagactcca

SEQ ID NO: 72416 - DNA, 20 bp, synthetic construct
  misc_feature 1..20: note = CRISPR gRNA sequence
  source 1..20: mol_type = other DNA
catctcaaaaaaaaaaaaaa

SEQ ID NO: 72417 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 72418 - DNA, 20 bp, synthetic construct
  misc_feature 1..20: note = CRISPR gRNA sequence
  source 1..20: mol_type = other DNA
gaaaggaaacttttattgct

SEQ ID NO: 72419 - DNA, 20 bp, synthetic construct
  misc_feature 1..20: note = CRISPR gRNA sequence
  source 1..20: mol_type = other DNA
aaaggaaacttttattgcta

SEQ ID NO: 72420 - DNA, 20 bp, synthetic construct
  misc_feature 1..20: note = CRISPR gRNA sequence
  source 1..20: mol_type = other DNA
ttattgctactatcaatgga

SEQ ID NO: 72421 - DNA, 20 bp, synthetic construct
  misc_feature 1..20: note = CRISPR gRNA sequence
  source 1..20: mol_type = other DNA
tattgctactatcaatggaa

SEQ ID NO: 72422 - DNA, 20 bp, synthetic construct
  misc_feature 1..20: note = CRISPR gRNA sequence
  source 1..20: mol_type = other DNA
attgctactatcaatggaaa

SEQ ID NO: 72423 - DNA, 20 bp, synthetic construct
  misc_feature 1..20: note = CRISPR gRNA sequence
  source 1..20: mol_type = other DNA
ttgctactatcaatggaaaa

SEQ ID NO: 72424 - DNA, 20 bp, synthetic construct
  misc_feature 1..20: note = CRISPR gRNA sequence
  source 1..20: mol_type = other DNA
ctactatcaatggaaaactt

SEQ ID NO: 72425 - DNA, 20 bp, synthetic construct
  misc_feature 1..20: note = CRISPR gRNA sequence
  source 1..20: mol_type = other DNA
ctatcaatggaaaacttgtg

SEQ ID NO: 72426 - DNA, 20 bp, synthetic construct
  misc_feature 1..20: note = CRISPR gRNA sequence
  source 1..20: mol_type = other DNA
tcaatggaaaacttgtgtta

SEQ ID NO: 72427 - DNA, 20 bp, synthetic construct
  misc_feature 1..20: note = CRISPR gRNA sequence
  source 1..20: mol_type = other DNA
gtgttacagactccatatag

SEQ ID NO: 72428 - DNA, 20 bp, synthetic construct
  misc_feature 1..20: note = CRISPR gRNA sequence
  source 1..20: mol_type = other DNA
tgttacagactccatataga

SEQ ID NO: 72429 - DNA, 20 bp, synthetic construct
  misc_feature 1..20: note = CRISPR gRNA sequence
  source 1..20: mol_type = other DNA
cagactccatatagaaggta

SEQ ID NO: 72430 - DNA, 20 bp, synthetic construct
  misc_feature 1..20: note = CRISPR gRNA sequence
  source 1..20: mol_type = other DNA
catatagaaggtagttacaa

SEQ ID NO: 72431 - DNA, 20 bp, synthetic construct
  misc_feature 1..20: note = CRISPR gRNA sequence
  source 1..20: mol_type = other DNA
caaaaataaatatagtacaa

SEQ ID NO: 72432 - DNA, 20 bp, synthetic construct
  misc_feature 1..20: note = CRISPR gRNA sequence
  source 1..20: mol_type = other DNA
acttctagttggaacatatg

SEQ ID NO: 72433 - DNA, 20 bp, synthetic construct
  misc_feature 1..20: note = CRISPR gRNA sequence
  source 1..20: mol_type = other DNA
ctagttggaacatatgccct

SEQ ID NO: 72434 - DNA, 20 bp, synthetic construct
  misc_feature 1..20: note = CRISPR gRNA sequence
  source 1..20: mol_type = other DNA
tagttggaacatatgccctt

SEQ ID NO: 72435 - DNA, 20 bp, synthetic construct
  misc_feature 1..20: note = CRISPR gRNA sequence
  source 1..20: mol_type = other DNA
gttggaacatatgcccttcc

SEQ ID NO: 72436 - DNA, 20 bp, synthetic construct
  misc_feature 1..20: note = CRISPR gRNA sequence
  source 1..20: mol_type = other DNA
gaacatatgcccttcctaag

SEQ ID NO: 72437 - DNA, 20 bp, synthetic construct
  misc_feature 1..20: note = CRISPR gRNA sequence
  source 1..20: mol_type = other DNA
cctaagatgttgggttttta

SEQ ID NO: 72438 - DNA, 20 bp, synthetic construct
  misc_feature 1..20: note = CRISPR gRNA sequence
  source 1..20: mol_type = other DNA
ctaagatgttgggtttttaa

SEQ ID NO: 72439 - DNA, 20 bp, synthetic construct
  misc_feature 1..20: note = CRISPR gRNA sequence
  source 1..20: mol_type = other DNA
agatgttgggtttttaaccc

SEQ ID NO: 72440 - DNA, 20 bp, synthetic construct
  misc_feature 1..20: note = CRISPR gRNA sequence
  source 1..20: mol_type = other DNA
ggtttttaacccttttggtt

SEQ ID NO: 72441 - DNA, 20 bp, synthetic construct
  misc_feature 1..20: note = CRISPR gRNA sequence
  source 1..20: mol_type = other DNA
ttaacccttttggttaaaaa

SEQ ID NO: 72442 - DNA, 20 bp, synthetic construct
  misc_feature 1..20: note = CRISPR gRNA sequence
  source 1..20: mol_type = other DNA
taacccttttggttaaaaag

SEQ ID NO: 72443 - DNA, 20 bp, synthetic construct
  misc_feature 1..20: note = CRISPR gRNA sequence
  source 1..20: mol_type = other DNA
aacccttttggttaaaaagg

SEQ ID NO: 72444 - DNA, 20 bp, synthetic construct
  misc_feature 1..20: note = CRISPR gRNA sequence
  source 1..20: mol_type = other DNA
acccttttggttaaaaaggg

SEQ ID NO: 72445 - DNA, 20 bp, synthetic construct
  misc_feature 1..20: note = CRISPR gRNA sequence
  source 1..20: mol_type = other DNA
ttggttaaaaagggagaatc

SEQ ID NO: 72446 - DNA, 20 bp, synthetic construct
  misc_feature 1..20: note = CRISPR gRNA sequence
  source 1..20: mol_type = other DNA
tggttaaaaagggagaatcc

SEQ ID NO: 72447 - DNA, 20 bp, synthetic construct
  misc_feature 1..20: note = CRISPR gRNA sequence
  source 1..20: mol_type = other DNA
ggttaaaaagggagaatcca

SEQ ID NO: 72448 - DNA, 20 bp, synthetic construct
  misc_feature 1..20: note = CRISPR gRNA sequence
  source 1..20: mol_type = other DNA
gttaaaaagggagaatccag

SEQ ID NO: 72449 - DNA, 20 bp, synthetic construct
  misc_feature 1..20: note = CRISPR gRNA sequence
  source 1..20: mol_type = other DNA
aaaagggagaatccagtgtt

SEQ ID NO: 72450 - DNA, 20 bp, synthetic construct
  misc_feature 1..20: note = CRISPR gRNA sequence
  source 1..20: mol_type = other DNA
ggtgttaaagatgaattacc

SEQ ID NO: 72451 - DNA, 20 bp, synthetic construct
  misc_feature 1..20: note = CRISPR gRNA sequence
  source 1..20: mol_type = other DNA
aagatgaattaccactgatc

SEQ ID NO: 72452 - DNA, 20 bp, synthetic construct
  misc_feature 1..20: note = CRISPR gRNA sequence
  source 1..20: mol_type = other DNA
ccactgatctgagactttcg

SEQ ID NO: 72453 - DNA, 20 bp, synthetic construct
  misc_feature 1..20: note = CRISPR gRNA sequence
  source 1..20: mol_type = other DNA
atctgagactttcgctttgg

SEQ ID NO: 72454 - DNA, 20 bp, synthetic construct
  misc_feature 1..20: note = CRISPR gRNA sequence
  source 1..20: mol_type = other DNA
agactttcgctttggtgtaa

SEQ ID NO: 72455 - DNA, 20 bp, synthetic construct
  misc_feature 1..20: note = CRISPR gRNA sequence
  source 1..20: mol_type = other DNA
tcgctttggtgtaatgagaa

SEQ ID NO: 72456 - DNA, 20 bp, synthetic construct
  misc_feature 1..20: note = CRISPR gRNA sequence
  source 1..20: mol_type = other DNA
cgctttggtgtaatgagaag

SEQ ID NO: 72457 - DNA, 20 bp, synthetic construct
  misc_feature 1..20: note = CRISPR gRNA sequence
  source 1..20: mol_type = other DNA
gctttggtgtaatgagaagg

SEQ ID NO: 72458 - DNA, 20 bp, synthetic construct
  misc_feature 1..20: note = CRISPR gRNA sequence
  source 1..20: mol_type = other DNA
tggtgtaatgagaagggtta

SEQ ID NO: 72459 - DNA, 20 bp, synthetic construct
  misc_feature 1..20: note = CRISPR gRNA sequence
  source 1..20: mol_type = other DNA
ggtgtaatgagaagggttaa

SEQ ID NO: 72460 - DNA, 20 bp, synthetic construct
  misc_feature 1..20: note = CRISPR gRNA sequence
  source 1..20: mol_type = other DNA
gtgtaatgagaagggttaag

SEQ ID NO: 72461 - DNA, 20 bp, synthetic construct
  misc_feature 1..20: note = CRISPR gRNA sequence
  source 1..20: mol_type = other DNA
agacctttaggatgcaaact

SEQ ID NO: 72462 - DNA, 20 bp, synthetic construct
  misc_feature 1..20: note = CRISPR gRNA sequence
  source 1..20: mol_type = other DNA
taggatgcaaactaaaatct

SEQ ID NO: 72463 - DNA, 20 bp, synthetic construct
  misc_feature 1..20: note = CRISPR gRNA sequence
  source 1..20: mol_type = other DNA
aggatgcaaactaaaatctt

SEQ ID NO: 72464 - DNA, 20 bp, synthetic construct
  misc_feature 1..20: note = CRISPR gRNA sequence
  source 1..20: mol_type = other DNA
ggatgcaaactaaaatcttc

SEQ ID NO: 72465 - DNA, 20 bp, synthetic construct
  misc_feature 1..20: note = CRISPR gRNA sequence
  source 1..20: mol_type = other DNA
aaatcttctcgtaatcactt

SEQ ID NO: 72466 - DNA, 20 bp, synthetic construct
  misc_feature 1..20: note = CRISPR gRNA sequence
  source 1..20: mol_type = other DNA
ctcgtaatcacttgtgtcct

SEQ ID NO: 72467 - DNA, 20 bp, synthetic construct
  misc_feature 1..20: note = CRISPR gRNA sequence
  source 1..20: mol_type = other DNA
tcgtaatcacttgtgtcctg

SEQ ID NO: 72468 - DNA, 20 bp, synthetic construct
  misc_feature 1..20: note = CRISPR gRNA sequence
  source 1..20: mol_type = other DNA
gtaatcacttgtgtcctgtt

SEQ ID NO: 72469 - DNA, 20 bp, synthetic construct
  misc_feature 1..20: note = CRISPR gRNA sequence
  source 1..20: mol_type = other DNA
gtgtcctgttctttaggaaa

SEQ ID NO: 72470 - DNA, 20 bp, synthetic construct
  misc_feature 1..20: note = CRISPR gRNA sequence
  source 1..20: mol_type = other DNA
tgtcctgttctttaggaaac

SEQ ID NO: 72471 - DNA, 20 bp, synthetic construct
  misc_feature 1..20: note = CRISPR gRNA sequence
  source 1..20: mol_type = other DNA
ttctttaggaaacagctttg

SEQ ID NO: 72472 - DNA, 20 bp, synthetic construct
  misc_feature 1..20: note = CRISPR gRNA sequence
  source 1..20: mol_type = other DNA
tttaggaaacagctttgtcc

SEQ ID NO: 72473 - DNA, 20 bp, synthetic construct
  misc_feature 1..20: note = CRISPR gRNA sequence
  source 1..20: mol_type = other DNA
taggaaacagctttgtcctc

SEQ ID NO: 72474 - DNA, 20 bp, synthetic construct
  misc_feature 1..20: note = CRISPR gRNA sequence
  source 1..20: mol_type = other DNA
aggaaacagctttgtcctcc

SEQ ID NO: 72475 - DNA, 20 bp, synthetic construct
  misc_feature 1..20: note = CRISPR gRNA sequence
  source 1..20: mol_type = other DNA
ggaaacagctttgtcctcca

SEQ ID NO: 72476 - DNA, 20 bp, synthetic construct
  misc_feature 1..20: note = CRISPR gRNA sequence
  source 1..20: mol_type = other DNA
tgtcctccataccatggtta

SEQ ID NO: 72477 - DNA, 20 bp, synthetic construct
  misc_feature 1..20: note = CRISPR gRNA sequence
  source 1..20: mol_type = other DNA
gtcctccataccatggttag

SEQ ID NO: 72478 - DNA, 20 bp, synthetic construct
  misc_feature 1..20: note = CRISPR gRNA sequence
  source 1..20: mol_type = other DNA
tcctccataccatggttagg

SEQ ID NO: 72479 - DNA, 20 bp, synthetic construct
  misc_feature 1..20: note = CRISPR gRNA sequence
  source 1..20: mol_type = other DNA
cataccatggttagggtccc

SEQ ID NO: 72480 - DNA, 20 bp, synthetic construct
  misc_feature 1..20: note = CRISPR gRNA sequence
  source 1..20: mol_type = other DNA
gggtcccaggctagtcctag

SEQ ID NO: 72481 - DNA, 20 bp, synthetic construct
  misc_feature 1..20: note = CRISPR gRNA sequence
  source 1..20: mol_type = other DNA
gtcctagaattctagtttac

SEQ ID NO: 72482 - DNA, 20 bp, synthetic construct
  misc_feature 1..20: note = CRISPR gRNA sequence
  source 1..20: mol_type = other DNA
gaattctagtttactcatga

SEQ ID NO: 72483 - DNA, 20 bp, synthetic construct
  misc_feature 1..20: note = CRISPR gRNA sequence
  source 1..20: mol_type = other DNA
tagtttactcatgaggcagc

SEQ ID NO: 72484 - DNA, 20 bp, synthetic construct
  misc_feature 1..20: note = CRISPR gRNA sequence
  source 1..20: mol_type = other DNA
gtttactcatgaggcagcac

SEQ ID NO: 72485 - DNA, 20 bp, synthetic construct
  misc_feature 1..20: note = CRISPR gRNA sequence
  source 1..20: mol_type = other DNA
actcatgaggcagcactgca

SEQ ID NO: 72486 - DNA, 20 bp, synthetic construct
  misc_feature 1..20: note = CRISPR gRNA sequence
  source 1..20: mol_type = other DNA
ctcatgaggcagcactgcaa

SEQ ID NO: 72487 - DNA, 20 bp, synthetic construct
  misc_feature 1..20: note = CRISPR gRNA sequence
  source 1..20: mol_type = other DNA
atgaggcagcactgcaaagc

SEQ ID NO: 72488 - DNA, 20 bp, synthetic construct
  misc_feature 1..20: note = CRISPR gRNA sequence
  source 1..20: mol_type = other DNA
caaagccccaaggtctgggg

SEQ ID NO: 72489 - DNA, 20 bp, synthetic construct
  misc_feature 1..20: note = CRISPR gRNA sequence
  source 1..20: mol_type = other DNA
ggggattctgattgctaaga

SEQ ID NO: 72490 - DNA, 20 bp, synthetic construct
  misc_feature 1..20: note = CRISPR gRNA sequence
  source 1..20: mol_type = other DNA
tgattgctaagagacagcca

SEQ ID NO: 72491 - DNA, 20 bp, synthetic construct
  misc_feature 1..20: note = CRISPR gRNA sequence
  source 1..20: mol_type = other DNA
attgctaagagacagccaag

SEQ ID NO: 72492 - DNA, 20 bp, synthetic construct
  misc_feature 1..20: note = CRISPR gRNA sequence
  source 1..20: mol_type = other DNA
ctaagagacagccaagcacg

SEQ ID NO: 72493 - DNA, 20 bp, synthetic construct
  misc_feature 1..20: note = CRISPR gRNA sequence
  source 1..20: mol_type = other DNA
agagacagccaagcacggcc

SEQ ID NO: 72494 - DNA, 20 bp, synthetic construct
  misc_feature 1..20: note = CRISPR gRNA sequence
  source 1..20: mol_type = other DNA
ggggtggctttctcctggct

SEQ ID NO: 72495 - DNA, 20 bp, synthetic construct
  misc_feature 1..20: note = CRISPR gRNA sequence
  source 1..20: mol_type = other DNA
tctcctggctttagccactg

SEQ ID NO: 72496 - DNA, 20 bp, synthetic construct
  misc_feature 1..20: note = CRISPR gRNA sequence
  source 1..20: mol_type = other DNA
ctcctggctttagccactgt

SEQ ID NO: 72497 - DNA, 20 bp, synthetic construct
  misc_feature 1..20: note = CRISPR gRNA sequence
  source 1..20: mol_type = other DNA
tcctggctttagccactgtt

SEQ ID NO: 72498 - DNA, 20 bp, synthetic construct
  misc_feature 1..20: note = CRISPR gRNA sequence
  source 1..20: mol_type = other DNA
ctggctttagccactgtttc

SEQ ID NO: 72499 - DNA, 20 bp, synthetic construct
  misc_feature 1..20: note = CRISPR gRNA sequence
  source 1..20: mol_type = other DNA
gctttagccactgtttctac

SEQ ID NO: 72500 - DNA, 20 bp, synthetic construct
  misc_feature 1..20: note = CRISPR gRNA sequence
  source 1..20: mol_type = other DNA
tagccactgtttctaccaac

SEQ ID NO: 72501 - DNA, 20 bp, synthetic construct
  misc_feature 1..20: note = CRISPR gRNA sequence
  source 1..20: mol_type = other DNA
agccactgtttctaccaact

SEQ ID NO: 72502 - DNA, 20 bp, synthetic construct
  misc_feature 1..20: note = CRISPR gRNA sequence
  source 1..20: mol_type = other DNA
gccactgtttctaccaactg

SEQ ID NO: 72503 - DNA, 20 bp, synthetic construct
  misc_feature 1..20: note = CRISPR gRNA sequence
  source 1..20: mol_type = other DNA
tttctaccaactgtggttca

SEQ ID NO: 72504 - DNA, 20 bp, synthetic construct
  misc_feature 1..20: note = CRISPR gRNA sequence
  source 1..20: mol_type = other DNA
ctaccaactgtggttcataa

SEQ ID NO: 72505 - DNA, 20 bp, synthetic construct
  misc_feature 1..20: note = CRISPR gRNA sequence
  source 1..20: mol_type = other DNA
taccaactgtggttcataaa

SEQ ID NO: 72506 - DNA, 20 bp, synthetic construct
  misc_feature 1..20: note = CRISPR gRNA sequence
  source 1..20: mol_type = other DNA
ccaactgtggttcataaatg

SEQ ID NO: 72507 - DNA, 20 bp, synthetic construct
  misc_feature 1..20: note = CRISPR gRNA sequence
  source 1..20: mol_type = other DNA
tggttcataaatggaggttt

SEQ ID NO: 72508 - DNA, 20 bp, synthetic construct
  misc_feature 1..20: note = CRISPR gRNA sequence
  source 1..20: mol_type = other DNA
ataaatggaggtttcatcaa

SEQ ID NO: 72509 - DNA, 20 bp, synthetic construct
  misc_feature 1..20: note = CRISPR gRNA sequence
  source 1..20: mol_type = other DNA
catcaagcaggcaaggtggt

SEQ ID NO: 72510 - DNA, 20 bp, synthetic construct
  misc_feature 1..20: note = CRISPR gRNA sequence
  source 1..20: mol_type = other DNA
atcaagcaggcaaggtggtc

SEQ ID NO: 72511 - DNA, 20 bp, synthetic construct
  misc_feature 1..20: note = CRISPR gRNA sequence
  source 1..20: mol_type = other DNA
tccagttgcctcccaaaagg

SEQ ID NO: 72512 - DNA, 20 bp, synthetic construct
  misc_feature 1..20: note = CRISPR gRNA sequence
  source 1..20: mol_type = other DNA
cctcccaaaaggaaggttgg

SEQ ID NO: 72513 - DNA, 20 bp, synthetic construct
  misc_feature 1..20: note = CRISPR gRNA sequence
  source 1..20: mol_type = other DNA
ccaaaaggaaggttggacca

SEQ ID NO: 72514 - DNA, 20 bp, synthetic construct
  misc_feature 1..20: note = CRISPR gRNA sequence
  source 1..20: mol_type = other DNA
gaccaaaaacctttaaagac

SEQ ID NO: 72515 - DNA, 20 bp, synthetic construct
  misc_feature 1..20: note = CRISPR gRNA sequence
  source 1..20: mol_type = other DNA
taaagaccatctggtccacc

SEQ ID NO: 72516 - DNA, 20 bp, synthetic construct
  misc_feature 1..20: note = CRISPR gRNA sequence
  source 1..20: mol_type = other DNA
aaagaccatctggtccacct

SEQ ID NO: 72517 - DNA, 20 bp, synthetic construct
  misc_feature 1..20: note = CRISPR gRNA sequence
  source 1..20: mol_type = other DNA
aagaccatctggtccacctc

SEQ ID NO: 72518 - DNA, 20 bp, synthetic construct
  misc_feature 1..20: note = CRISPR gRNA sequence
  source 1..20: mol_type = other DNA
gtccacctcccctcccacca

SEQ ID NO: 72519 - DNA, 20 bp, synthetic construct
  misc_feature 1..20: note = CRISPR gRNA sequence
  source 1..20: mol_type = other DNA
ccctcccaccaatctacaaa

SEQ ID NO: 72520 - DNA, 20 bp, synthetic construct
  misc_feature 1..20: note = CRISPR gRNA sequence
  source 1..20: mol_type = other DNA
ccaccaatctacaaatgggg

SEQ ID NO: 72521 - DNA, 20 bp, synthetic construct
  misc_feature 1..20: note = CRISPR gRNA sequence
  source 1..20: mol_type = other DNA
caaatggggaaaaaggcaga

SEQ ID NO: 72522 - DNA, 20 bp, synthetic construct
  misc_feature 1..20: note = CRISPR gRNA sequence
  source 1..20: mol_type = other DNA
ttttacccaacattacctgc

SEQ ID NO: 72523 - DNA, 20 bp, synthetic construct
  misc_feature 1..20: note = CRISPR gRNA sequence
  source 1..20: mol_type = other DNA
tacccaacattacctgcagc

SEQ ID NO: 72524 - DNA, 20 bp, synthetic construct
  misc_feature 1..20: note = CRISPR gRNA sequence
  source 1..20: mol_type = other DNA
acccaacattacctgcagct

SEQ ID NO: 72525 - DNA, 20 bp, synthetic construct
  misc_feature 1..20: note = CRISPR gRNA sequence
  source 1..20: mol_type = other DNA
cccaacattacctgcagctc

SEQ ID NO: 72526 - DNA, 20 bp, synthetic construct
  misc_feature 1..20: note = CRISPR gRNA sequence
  source 1..20: mol_type = other DNA
cctgcagctcaagtgttaaa

SEQ ID NO: 72527 - DNA, 20 bp, synthetic construct
  misc_feature 1..20: note = CRISPR gRNA sequence
  source 1..20: mol_type = other DNA
cagctcaagtgttaaaatgt

SEQ ID NO: 72528 - DNA, 20 bp, synthetic construct
  misc_feature 1..20: note = CRISPR gRNA sequence
  source 1..20: mol_type = other DNA
aagtgttaaaatgtctttga

SEQ ID NO: 72529 - DNA, 20 bp, synthetic construct
  misc_feature 1..20: note = CRISPR gRNA sequence
  source 1..20: mol_type = other DNA
aaatgtctttgagaggatgt

SEQ ID NO: 72530 - DNA, 20 bp, synthetic construct
  misc_feature 1..20: note = CRISPR gRNA sequence
  source 1..20: mol_type = other DNA
tgagaggatgtctgagtaag

SEQ ID NO: 72531 - DNA, 20 bp, synthetic construct
  misc_feature 1..20: note = CRISPR gRNA sequence
  source 1..20: mol_type = other DNA
gagaggatgtctgagtaagg

SEQ ID NO: 72532 - DNA, 20 bp, synthetic construct
  misc_feature 1..20: note = CRISPR gRNA sequence
  source 1..20: mol_type = other DNA
agaggatgtctgagtaagga

SEQ ID NO: 72533 - DNA, 20 bp, synthetic construct
  misc_feature 1..20: note = CRISPR gRNA sequence
  source 1..20: mol_type = other DNA
agtaaggatgatcttcccca

SEQ ID NO: 72534 - DNA, 20 bp, synthetic construct
  misc_feature 1..20: note = CRISPR gRNA sequence
  source 1..20: mol_type = other DNA
ccccatttacaaatgggagg

SEQ ID NO: 72535 - DNA, 20 bp, synthetic construct
  misc_feature 1..20: note = CRISPR gRNA sequence
  source 1..20: mol_type = other DNA
cccatttacaaatgggagga

SEQ ID NO: 72536 - DNA, 20 bp, synthetic construct
  misc_feature 1..20: note = CRISPR gRNA sequence
  source 1..20: mol_type = other DNA
acaaatgggaggactggcca

SEQ ID NO: 72537 - DNA, 20 bp, synthetic construct
  misc_feature 1..20: note = CRISPR gRNA sequence
  source 1..20: mol_type = other DNA
caaatgggaggactggccag

SEQ ID NO: 72538 - DNA, 20 bp, synthetic construct
  misc_feature 1..20: note = CRISPR gRNA sequence
  source 1..20: mol_type = other DNA
gccagagaggatgggagcag

SEQ ID NO: 72539 - DNA, 20 bp, synthetic construct
  misc_feature 1..20: note = CRISPR gRNA sequence
  source 1..20: mol_type = other DNA
caggccacacagcaggctgg

SEQ ID NO: 72540 - DNA, 20 bp, synthetic construct
  misc_feature 1..20: note = CRISPR gRNA sequence
  source 1..20: mol_type = other DNA
gagccaactcccccgacccc

SEQ ID NO: 72541 - DNA, 20 bp, synthetic construct
  misc_feature 1..20: note = CRISPR gRNA sequence
  source 1..20: mol_type = other DNA
ccccgacccctcccgacttt

SEQ ID NO: 72542 - DNA, 20 bp, synthetic construct
  misc_feature 1..20: note = CRISPR gRNA sequence
  source 1..20: mol_type = other DNA
ccgacttttccttttcccag

SEQ ID NO: 72543 - DNA, 20 bp, synthetic construct
  misc_feature 1..20: note = CRISPR gRNA sequence
  source 1..20: mol_type = other DNA
ttccttttcccagccagctc

SEQ ID NO: 72544 - DNA, 20 bp, synthetic construct
  misc_feature 1..20: note = CRISPR gRNA sequence
  source 1..20: mol_type = other DNA
tccttttcccagccagctca

SEQ ID NO: 72545 - DNA, 20 bp, synthetic construct
  misc_feature 1..20: note = CRISPR gRNA sequence
  source 1..20: mol_type = other DNA
ccttttcccagccagctcag

SEQ ID NO: 72546 - DNA, 20 bp, synthetic construct
  misc_feature 1..20: note = CRISPR gRNA sequence
  source 1..20: mol_type = other DNA
cttttcccagccagctcagg

SEQ ID NO: 72547 - DNA, 20 bp, synthetic construct
  misc_feature 1..20: note = CRISPR gRNA sequence
  source 1..20: mol_type = other DNA
ttcccagccagctcagggct

SEQ ID NO: 72548 - DNA, 20 bp, synthetic construct
  misc_feature 1..20: note = CRISPR gRNA sequence
  source 1..20: mol_type = other DNA
tcccagccagctcagggctc

SEQ ID NO: 72549 - DNA, 20 bp, synthetic construct
  misc_feature 1..20: note = CRISPR gRNA sequence
  source 1..20: mol_type = other DNA
cccagccagctcagggctct

SEQ ID NO: 72550 - DNA, 20 bp, synthetic construct
  misc_feature 1..20: note = CRISPR gRNA sequence
  source 1..20: mol_type = other DNA
ccagccagctcagggctctt

SEQ ID NO: 72551 - DNA, 20 bp, synthetic construct
  misc_feature 1..20: note = CRISPR gRNA sequence
  source 1..20: mol_type = other DNA
agggctcttccaatcactca

SEQ ID NO: 72552 - DNA, 20 bp, synthetic construct
  misc_feature 1..20: note = CRISPR gRNA sequence
  source 1..20: mol_type = other DNA
ttccaatcactcacaagatt

SEQ ID NO: 72553 - DNA, 20 bp, synthetic construct
  misc_feature 1..20: note = CRISPR gRNA sequence
  source 1..20: mol_type = other DNA
ccaatcactcacaagattac

SEQ ID NO: 72554 - DNA, 20 bp, synthetic construct
  misc_feature 1..20: note = CRISPR gRNA sequence
  source 1..20: mol_type = other DNA
caatcactcacaagattact

SEQ ID NO: 72555 - DNA, 20 bp, synthetic construct
  misc_feature 1..20: note = CRISPR gRNA sequence
  source 1..20: mol_type = other DNA
acaagattacttccagggca

SEQ ID NO: 72556 - DNA, 20 bp, synthetic construct
  misc_feature 1..20: note = CRISPR gRNA sequence
  source 1..20: mol_type = other DNA
cttccagggcagggcagctc

SEQ ID NO: 72557 - DNA, 20 bp, synthetic construct
  misc_feature 1..20: note = CRISPR gRNA sequence
  source 1..20: mol_type = other DNA
ccagggcagggcagctcgtg

SEQ ID NO: 72558 - DNA, 20 bp, synthetic construct
  misc_feature 1..20: note = CRISPR gRNA sequence
  source 1..20: mol_type = other DNA
cagggcagggcagctcgtga

SEQ ID NO: 72559 - DNA, 20 bp, synthetic construct
  misc_feature 1..20: note = CRISPR gRNA sequence
  source 1..20: mol_type = other DNA
gtgaagctggaggtgaggag

SEQ ID NO: 72560 - DNA, 20 bp, synthetic construct
  misc_feature 1..20: note = CRISPR gRNA sequence
  source 1..20: mol_type = other DNA
gaggtgaggagcttggcagt

SEQ ID NO: 72561 - DNA, 20 bp, synthetic construct
  misc_feature 1..20: note = CRISPR gRNA sequence
  source 1..20: mol_type = other DNA
ggcagtctggttgtcaatct

SEQ ID NO: 72562 - DNA, 20 bp, synthetic construct
  misc_feature 1..20: note = CRISPR gRNA sequence
  source 1..20: mol_type = other DNA
gcagtctggttgtcaatctt

SEQ ID NO: 72563 - DNA, 20 bp, synthetic construct
  misc_feature 1..20: note = CRISPR gRNA sequence
  source 1..20: mol_type = other DNA
gttgtcaatcttacaggaaa

SEQ ID NO: 72564 - DNA, 20 bp, synthetic construct
  misc_feature 1..20: note = CRISPR gRNA sequence
  source 1..20: mol_type = other DNA
tcaatcttacaggaaaccag

SEQ ID NO: 72565 - DNA, 20 bp, synthetic construct
  misc_feature 1..20: note = CRISPR gRNA sequence
  source 1..20: mol_type = other DNA
acaggaaaccaggctgggga

SEQ ID NO: 72566 - DNA, 20 bp, synthetic construct
  misc_feature 1..20: note = CRISPR gRNA sequence
  source 1..20: mol_type = other DNA
caggaaaccaggctggggat

SEQ ID NO: 72567 - DNA, 20 bp, synthetic construct
  misc_feature 1..20: note = CRISPR gRNA sequence
  source 1..20: mol_type = other DNA
gggatggagaagggcatggg

SEQ ID NO: 72568 - DNA, 20 bp, synthetic construct
  misc_feature 1..20: note = CRISPR gRNA sequence
  source 1..20: mol_type = other DNA
tttgagtcaggggatctagc

SEQ ID NO: 72569 - DNA, 20 bp, synthetic construct
  misc_feature 1..20: note = CRISPR gRNA sequence
  source 1..20: mol_type = other DNA
gagtcaggggatctagcagg

SEQ ID NO: 72570 - DNA, 20 bp, synthetic construct
  misc_feature 1..20: note = CRISPR gRNA sequence
  source 1..20: mol_type = other DNA
agtcaggggatctagcaggt

SEQ ID NO: 72571 - DNA, 20 bp, synthetic construct
  misc_feature 1..20: note = CRISPR gRNA sequence
  source 1..20: mol_type = other DNA
gcaggtcctgcctccagagc

SEQ ID NO: 72572 - DNA, 20 bp, synthetic construct
  misc_feature 1..20: note = CRISPR gRNA sequence
  source 1..20: mol_type = other DNA
cctccagagccaccagggtc

SEQ ID NO: 72573 - DNA, 20 bp, synthetic construct
  misc_feature 1..20: note = CRISPR gRNA sequence
  source 1..20: mol_type = other DNA
cagagccaccagggtctggg

SEQ ID NO: 72574 - DNA, 20 bp, synthetic construct
  misc_feature 1..20: note = CRISPR gRNA sequence
  source 1..20: mol_type = other DNA
gggtaagctaggcgttttag

SEQ ID NO: 72575 - DNA, 20 bp, synthetic construct
  misc_feature 1..20: note = CRISPR gRNA sequence
  source 1..20: mol_type = other DNA
ggcgttttaggaaagacttc

SEQ ID NO: 72576 - DNA, 20 bp, synthetic construct
  misc_feature 1..20: note = CRISPR gRNA sequence
  source 1..20: mol_type = other DNA
taggaaagacttcctttctt

SEQ ID NO: 72577 - DNA, 20 bp, synthetic construct
  misc_feature 1..20: note = CRISPR gRNA sequence
  source 1..20: mol_type = other DNA
aggaaagacttcctttcttg

SEQ ID NO: 72578 - DNA, 20 bp, synthetic construct
  misc_feature 1..20: note = CRISPR gRNA sequence
  source 1..20: mol_type = other DNA
ggaaagacttcctttcttga

SEQ ID NO: 72579 - DNA, 20 bp, synthetic construct
  misc_feature 1..20: note = CRISPR gRNA sequence
  source 1..20: mol_type = other DNA
cctttcttgagccaggcccc

SEQ ID NO: 72580 - DNA, 20 bp, synthetic construct
  misc_feature 1..20: note = CRISPR gRNA sequence
  source 1..20: mol_type = other DNA
ctttcttgagccaggccccc

SEQ ID NO: 72581 - DNA, 20 bp, synthetic construct
  misc_feature 1..20: note = CRISPR gRNA sequence
  source 1..20: mol_type = other DNA
tcttgagccaggcccccacc

SEQ ID NO: 72582 - DNA, 20 bp, synthetic construct
  misc_feature 1..20: note = CRISPR gRNA sequence
  source 1..20: mol_type = other DNA
cttgagccaggcccccacca

SEQ ID NO: 72583 - DNA, 20 bp, synthetic construct
  misc_feature 1..20: note = CRISPR gRNA sequence
  source 1..20: mol_type = other DNA
ttgagccaggcccccaccat

SEQ ID NO: 72584 - DNA, 20 bp, synthetic construct
  misc_feature 1..20: note = CRISPR gRNA sequence
  source 1..20: mol_type = other DNA
gagccaggcccccaccatcc

SEQ ID NO: 72585 - DNA, 20 bp, synthetic construct
  misc_feature 1..20: note = CRISPR gRNA sequence
  source 1..20: mol_type = other DNA
agccaggcccccaccatccc

SEQ ID NO: 72586 - DNA, 20 bp, synthetic construct
  misc_feature 1..20: note = CRISPR gRNA sequence
  source 1..20: mol_type = other DNA
gggcttctatcacttcaaag

SEQ ID NO: 72587 - DNA, 20 bp, synthetic construct
  misc_feature 1..20: note = CRISPR gRNA sequence
  source 1..20: mol_type = other DNA
ctatcacttcaaaggcctcc

SEQ ID NO: 72588 - DNA, 20 bp, synthetic construct
  misc_feature 1..20: note = CRISPR gRNA sequence
  source 1..20: mol_type = other DNA
tatcacttcaaaggcctccc

SEQ ID NO: 72589 - DNA, 20 bp, synthetic construct
  misc_feature 1..20: note = CRISPR gRNA sequence
  source 1..20: mol_type = other DNA
tcacttcaaaggcctcccca

SEQ ID NO: 72590 - DNA, 20 bp, synthetic construct
  misc_feature 1..20: note = CRISPR gRNA sequence
  source 1..20: mol_type = other DNA
caaaggcctccccaggtgtt

SEQ ID NO: 72591 - DNA, 20 bp, synthetic construct
  misc_feature 1..20: note = CRISPR gRNA sequence
  source 1..20: mol_type = other DNA
aaaggcctccccaggtgtta

SEQ ID NO: 72592 - DNA, 20 bp, synthetic construct
  misc_feature 1..20: note = CRISPR gRNA sequence
  source 1..20: mol_type = other DNA
cccaggtgttaggctcagtc

SEQ ID NO: 72593 - DNA, 20 bp, synthetic construct
  misc_feature 1..20: note = CRISPR gRNA sequence
  source 1..20: mol_type = other DNA
ggctcagtcagagaagggct

SEQ ID NO: 72594 - DNA, 20 bp, synthetic construct
  misc_feature 1..20: note = CRISPR gRNA sequence
  source 1..20: mol_type = other DNA
agtcagagaagggctgccct

SEQ ID NO: 72595 - DNA, 20 bp, synthetic construct
  misc_feature 1..20: note = CRISPR gRNA sequence
  source 1..20: mol_type = other DNA
ccctcagcctgccactggtc

SEQ ID NO: 72596 - DNA, 20 bp, synthetic construct
  misc_feature 1..20: note = CRISPR gRNA sequence
  source 1..20: mol_type = other DNA
agcctgccactggtccccta

SEQ ID NO: 72597 - DNA, 20 bp, synthetic construct
  misc_feature 1..20: note = CRISPR gRNA sequence
  source 1..20: mol_type = other DNA
ccactggtcccctaggcagg

SEQ ID NO: 72598 - DNA, 20 bp, synthetic construct
  misc_feature 1..20: note = CRISPR gRNA sequence
  source 1..20: mol_type = other DNA
gtcccctaggcaggcagggg

SEQ ID NO: 72599 - DNA, 20 bp, synthetic construct
  misc_feature 1..20: note = CRISPR gRNA sequence
  source 1..20: mol_type = other DNA
ggcaggcaggggaggctact

SEQ ID NO: 72600 - DNA, 20 bp, synthetic construct
  misc_feature 1..20: note = CRISPR gRNA sequence
  source 1..20: mol_type = other DNA
cttactctatctgtctgagc

SEQ ID NO: 72601 - DNA, 20 bp, synthetic construct
  misc_feature 1..20: note = CRISPR gRNA sequence
  source 1..20: mol_type = other DNA
actctatctgtctgagcagc

SEQ ID NO: 72602 - DNA, 20 bp, synthetic construct
  misc_feature 1..20: note = CRISPR gRNA sequence
  source 1..20: mol_type = other DNA
ctctatctgtctgagcagcg

SEQ ID NO: 72603 - DNA, 20 bp, synthetic construct
  misc_feature 1..20: note = CRISPR gRNA sequence
  source 1..20: mol_type = other DNA
tatctgtctgagcagcggga

SEQ ID NO: 72604 - DNA, 20 bp, synthetic construct
  misc_feature 1..20: note = CRISPR gRNA sequence
  source 1..20: mol_type = other DNA
tctgtctgagcagcgggagc

SEQ ID NO: 72605 - DNA, 20 bp, synthetic construct
  misc_feature 1..20: note = CRISPR gRNA sequence
  source 1..20: mol_type = other DNA
tctgagcagcgggagctcca

SEQ ID NO: 72606 - DNA, 20 bp, synthetic construct
  misc_feature 1..20: note = CRISPR gRNA sequence
  source 1..20: mol_type = other DNA
agcagcgggagctccataca

SEQ ID NO: 72607 - DNA, 20 bp, synthetic construct
  misc_feature 1..20: note = CRISPR gRNA sequence
  source 1..20: mol_type = other DNA
catacagaaacgcaggaccc

SEQ ID NO: 72608 - DNA, 20 bp, synthetic construct
  misc_feature 1..20: note = CRISPR gRNA sequence
  source 1..20: mol_type = other DNA
cagccaggttgttttccgcc

SEQ ID NO: 72609 - DNA, 20 bp, synthetic construct
  misc_feature 1..20: note = CRISPR gRNA sequence
  source 1..20: mol_type = other DNA
ttttccgccaagctgcaggg

SEQ ID NO: 72610 - DNA, 20 bp, synthetic construct
  misc_feature 1..20: note = CRISPR gRNA sequence
  source 1..20: mol_type = other DNA
tccgccaagctgcagggtag

SEQ ID NO: 72611 - DNA, 20 bp, synthetic construct
  misc_feature 1..20: note = CRISPR gRNA sequence
  source 1..20: mol_type = other DNA
ccgccaagctgcagggtagg

SEQ ID NO: 72612 - DNA, 20 bp, synthetic construct
  misc_feature 1..20: note = CRISPR gRNA sequence
  source 1..20: mol_type = other DNA
cgccaagctgcagggtaggg

SEQ ID NO: 72613 - DNA, 20 bp, synthetic construct
  misc_feature 1..20: note = CRISPR gRNA sequence
  source 1..20: mol_type = other DNA
cagggtaggggagatacctg

SEQ ID NO: 72614 - DNA, 20 bp, synthetic construct
  misc_feature 1..20: note = CRISPR gRNA sequence
  source 1..20: mol_type = other DNA
tgagaggaacccccagaccc

SEQ ID NO: 72615 - DNA, 20 bp, synthetic construct
  misc_feature 1..20: note = CRISPR gRNA sequence
  source 1..20: mol_type = other DNA
tccccgtgcctgggctgggc

SEQ ID NO: 72616 - DNA, 20 bp, synthetic construct
  misc_feature 1..20: note = CRISPR gRNA sequence
  source 1..20: mol_type = other DNA
ggctgggcagcccctactta

SEQ ID NO: 72617 - DNA, 20 bp, synthetic construct
  misc_feature 1..20: note = CRISPR gRNA sequence
  source 1..20: mol_type = other DNA
ggcagcccctacttacctga

SEQ ID NO: 72618 - DNA, 20 bp, synthetic construct
  misc_feature 1..20: note = CRISPR gRNA sequence
  source 1..20: mol_type = other DNA
cttacctgatctcttccaaa

SEQ ID NO: 72619 - DNA, 20 bp, synthetic construct
  misc_feature 1..20: note = CRISPR gRNA sequence
  source 1..20: mol_type = other DNA
acctgatctcttccaaatgg

SEQ ID NO: 72620 - DNA, 20 bp, synthetic construct
  misc_feature 1..20: note = CRISPR gRNA sequence
  source 1..20: mol_type = other DNA
cctgatctcttccaaatggg

SEQ ID NO: 72621 - DNA, 20 bp, synthetic construct
  misc_feature 1..20: note = CRISPR gRNA sequence
  source 1..20: mol_type = other DNA
atctcttccaaatgggggga

SEQ ID NO: 72622 - DNA, 20 bp, synthetic construct
  misc_feature 1..20: note = CRISPR gRNA sequence
  source 1..20: mol_type = other DNA
ttccaaatggggggatccat

SEQ ID NO: 72623 - DNA, 20 bp, synthetic construct
  misc_feature 1..20: note = CRISPR gRNA sequence
  source 1..20: mol_type = other DNA
ccaaatggggggatccatcc

SEQ ID NO: 72624 - DNA, 20 bp, synthetic construct
  misc_feature 1..20: note = CRISPR gRNA sequence
  source 1..20: mol_type = other DNA
caaatggggggatccatcca

SEQ ID NO: 72625 - DNA, 20 bp, synthetic construct
  misc_feature 1..20: note = CRISPR gRNA sequence
  source 1..20: mol_type = other DNA
ggccaggctcagggccccac

SEQ ID NO: 72626 - DNA, 20 bp, synthetic construct
  misc_feature 1..20: note = CRISPR gRNA sequence
  source 1..20: mol_type = other DNA
agggccccacctgggcccag

SEQ ID NO: 72627 - DNA, 20 bp, synthetic construct
  misc_feature 1..20: note = CRISPR gRNA sequence
  source 1..20: mol_type = other DNA
ggcccagatggctgaatggt

SEQ ID NO: 72628 - DNA, 20 bp, synthetic construct
  misc_feature 1..20: note = CRISPR gRNA sequence
  source 1..20: mol_type = other DNA
aatggtaggctggggaaaga

SEQ ID NO: 72629 - DNA, 20 bp, synthetic construct
  misc_feature 1..20: note = CRISPR gRNA sequence
  source 1..20: mol_type = other DNA
gggaaagaggagagggtgag

SEQ ID NO: 72630 - DNA, 20 bp, synthetic construct
  misc_feature 1..20: note = CRISPR gRNA sequence
  source 1..20: mol_type = other DNA
agggactggcgtttccagag

SEQ ID NO: 72631 - DNA, 20 bp, synthetic construct
  misc_feature 1..20: note = CRISPR gRNA sequence
  source 1..20: mol_type = other DNA
gcgtttccagagccccaccc

SEQ ID NO: 72632 - DNA, 20 bp, synthetic construct
  misc_feature 1..20: note = CRISPR gRNA sequence
  source 1..20: mol_type = other DNA
ccagagccccaccctcagcc

SEQ ID NO: 72633 - DNA, 20 bp, synthetic construct
  misc_feature 1..20: note = CRISPR gRNA sequence
  source 1..20: mol_type = other DNA
cagagccccaccctcagcct

SEQ ID NO: 72634 - DNA, 20 bp, synthetic construct
  misc_feature 1..20: note = CRISPR gRNA sequence
  source 1..20: mol_type = other DNA
agccttgtctcaggctgcag

SEQ ID NO: 72635 - DNA, 20 bp, synthetic construct
  misc_feature 1..20: note = CRISPR gRNA sequence
  source 1..20: mol_type = other DNA
gtctcaggctgcagtgccag

SEQ ID NO: 72636 - DNA, 20 bp, synthetic construct
  misc_feature 1..20: note = CRISPR gRNA sequence
  source 1..20: mol_type = other DNA
tctcaggctgcagtgccagc

SEQ ID NO: 72637 - DNA, 20 bp, synthetic construct
  misc_feature 1..20: note = CRISPR gRNA sequence
  source 1..20: mol_type = other DNA
aggctgcagtgccagcccgt

SEQ ID NO: 72638 - DNA, 20 bp, synthetic construct
  misc_feature 1..20: note = CRISPR gRNA sequence
  source 1..20: mol_type = other DNA
cagtgccagcccgtagacag

SEQ ID NO: 72639 - DNA, 20 bp, synthetic construct
  misc_feature 1..20: note = CRISPR gRNA sequence
  source 1..20: mol_type = other DNA
tggctaattccccatccaca

SEQ ID NO: 72640 - DNA, 20 bp, synthetic construct
  misc_feature 1..20: note = CRISPR gRNA sequence
  source 1..20: mol_type = other DNA
gctaattccccatccacaca

SEQ ID NO: 72641 - DNA, 20 bp, synthetic construct
  misc_feature 1..20: note = CRISPR gRNA sequence
  source 1..20: mol_type = other DNA
attccccatccacacaggac

SEQ ID NO: 72642 - DNA, 20 bp, synthetic construct
  misc_feature 1..20: note = CRISPR gRNA sequence
  source 1..20: mol_type = other DNA
cccatccacacaggacctgg

SEQ ID NO: 72643 - DNA, 20 bp, synthetic construct
  misc_feature 1..20: note = CRISPR gRNA sequence
  source 1..20: mol_type = other DNA
ggtaggtatcaaggaccctg

SEQ ID NO: 72644 - DNA, 20 bp, synthetic construct
  misc_feature 1..20: note = CRISPR gRNA sequence
  source 1..20: mol_type = other DNA
gctttggggtctgagatccc

SEQ ID NO: 72645 - DNA, 20 bp, synthetic construct
  misc_feature 1..20: note = CRISPR gRNA sequence
  source 1..20: mol_type = other DNA
tggggtctgagatcccaaat

SEQ ID NO: 72646 - DNA, 20 bp, synthetic construct
  misc_feature 1..20: note = CRISPR gRNA sequence
  source 1..20: mol_type = other DNA
ggggtctgagatcccaaatt

SEQ ID NO: 72647 - DNA, 20 bp, synthetic construct
  misc_feature 1..20: note = CRISPR gRNA sequence
  source 1..20: mol_type = other DNA
gggtctgagatcccaaattc

SEQ ID NO: 72648 - DNA, 20 bp, synthetic construct
  misc_feature 1..20: note = CRISPR gRNA sequence
  source 1..20: mol_type = other DNA
agatcccaaattcaacacct

SEQ ID NO: 72649 - DNA, 20 bp, synthetic construct
  misc_feature 1..20: note = CRISPR gRNA sequence
  source 1..20: mol_type = other DNA
aacacctgggtccttcgtgt

SEQ ID NO: 72650 - DNA, 20 bp, synthetic construct
  misc_feature 1..20: note = CRISPR gRNA sequence
  source 1..20: mol_type = other DNA
ggtccttcgtgtatgagtaa

SEQ ID NO: 72651 - DNA, 20 bp, synthetic construct
  misc_feature 1..20: note = CRISPR gRNA sequence
  source 1..20: mol_type = other DNA
cgtgtatgagtaaggaaaat

SEQ ID NO: 72652 - DNA, 20 bp, synthetic construct
  misc_feature 1..20: note = CRISPR gRNA sequence
  source 1..20: mol_type = other DNA
gtgtatgagtaaggaaaatt

SEQ ID NO: 72653 - DNA, 20 bp, synthetic construct
  misc_feature 1..20: note = CRISPR gRNA sequence
  source 1..20: mol_type = other DNA
tccacacctctcctggcctt

SEQ ID NO: 72654 - DNA, 20 bp, synthetic construct
  misc_feature 1..20: note = CRISPR gRNA sequence
  source 1..20: mol_type = other DNA
cacacctctcctggccttca

SEQ ID NO: 72655 - DNA, 20 bp, synthetic construct
  misc_feature 1..20: note = CRISPR gRNA sequence
  source 1..20: mol_type = other DNA
tcctggccttcattcccttg

SEQ ID NO: 72656 - DNA, 20 bp, synthetic construct
  misc_feature 1..20: note = CRISPR gRNA sequence
  source 1..20: mol_type = other DNA
ctggccttcattcccttgcc

SEQ ID NO: 72657 - DNA, 20 bp, synthetic construct
  misc_feature 1..20: note = CRISPR gRNA sequence
  source 1..20: mol_type = other DNA
gccttcattcccttgcctgg

SEQ ID NO: 72658 - DNA, 20 bp, synthetic construct
  misc_feature 1..20: note = CRISPR gRNA sequence
  source 1..20: mol_type = other DNA
cattcccttgcctggaaaag

SEQ ID NO: 72659 - DNA, 20 bp, synthetic construct
  misc_feature 1..20: note = CRISPR gRNA sequence
  source 1..20: mol_type = other DNA
attcccttgcctggaaaagg

SEQ ID NO: 72660 - DNA, 20 bp, synthetic construct
  misc_feature 1..20: note = CRISPR gRNA sequence
  source 1..20: mol_type = other DNA
ccttgcctggaaaagggagc

SEQ ID NO: 72661 - DNA, 20 bp, synthetic construct
  misc_feature 1..20: note = CRISPR gRNA sequence
  source 1..20: mol_type = other DNA
gcctggaaaagggagcacat

SEQ ID NO: 72662 - DNA, 20 bp, synthetic construct
  misc_feature 1..20: note = CRISPR gRNA sequence
  source 1..20: mol_type = other DNA
cctggaaaagggagcacata

SEQ ID NO: 72663 - DNA, 20 bp, synthetic construct
  misc_feature 1..20: note = CRISPR gRNA sequence
  source 1..20: mol_type = other DNA
gaaaagggagcacataaaag

SEQ ID NO: 72664 - DNA, 20 bp, synthetic construct
  misc_feature 1..20: note = CRISPR gRNA sequence
  source 1..20: mol_type = other DNA
acgcctgtaatcccagcact

SEQ ID NO: 72665 - DNA, 20 bp, synthetic construct
  misc_feature 1..20: note = CRISPR gRNA sequence
  source 1..20: mol_type = other DNA
taatcccagcacttttggag

SEQ ID NO: 72666 - DNA, 20 bp, synthetic construct
  misc_feature 1..20: note = CRISPR gRNA sequence
  source 1..20: mol_type = other DNA
ttggaggctgaggtgggtgg

SEQ ID NO: 72667 - DNA, 20 bp, synthetic construct
  misc_feature 1..20: note = CRISPR gRNA sequence
  source 1..20: mol_type = other DNA
tggaggctgaggtgggtgga

SEQ ID NO: 72668 - DNA, 20 bp, synthetic construct
  misc_feature 1..20: note = CRISPR gRNA sequence
  source 1..20: mol_type = other DNA
ggaggctgaggtgggtggat

SEQ ID NO: 72669 - DNA, 20 bp, synthetic construct
  misc_feature 1..20: note = CRISPR gRNA sequence
  source 1..20: mol_type = other DNA
gaggctgaggtgggtggatc

SEQ ID NO: 72670 - DNA, 20 bp, synthetic construct
  misc_feature 1..20: note = CRISPR gRNA sequence
  source 1..20: mol_type = other DNA
aggtgggtggatcacttgag

SEQ ID NO: 72671 - DNA, 20 bp, synthetic construct
  misc_feature 1..20: note = CRISPR gRNA sequence
  source 1..20: mol_type = other DNA
gaggccaggagtccaagacc

SEQ ID NO: 72672 - DNA, 20 bp, synthetic construct
  misc_feature 1..20: note = CRISPR gRNA sequence
  source 1..20: mol_type = other DNA
aggccaggagtccaagacca

SEQ ID NO: 72673 - DNA, 20 bp, synthetic construct
  misc_feature 1..20: note = CRISPR gRNA sequence
  source 1..20: mol_type = other DNA
ggcaatatggtgaaatgccg

SEQ ID NO: 72674 - DNA, 20 bp, synthetic construct
  misc_feature 1..20: note = CRISPR gRNA sequence
  source 1..20: mol_type = other DNA
tactaaaaatacaaaaatta

SEQ ID NO: 72675 - DNA, 20 bp, synthetic construct
  misc_feature 1..20: note = CRISPR gRNA sequence
  source 1..20: mol_type = other DNA
ctaaaaatacaaaaattagc

SEQ ID NO: 72676 - DNA, 20 bp, synthetic construct
  misc_feature 1..20: note = CRISPR gRNA sequence
  source 1..20: mol_type = other DNA
aaaatacaaaaattagctgg

SEQ ID NO: 72677 - DNA, 20 bp, synthetic construct
  misc_feature 1..20: note = CRISPR gRNA sequence
  source 1..20: mol_type = other DNA
gctgggcatggtgggcatgc

SEQ ID NO: 72678 - DNA, 20 bp, synthetic construct
  misc_feature 1..20: note = CRISPR gRNA sequence
  source 1..20: mol_type = other DNA
ggcatggtgggcatgctcgt

SEQ ID NO: 72679 - DNA, 20 bp, synthetic construct
  misc_feature 1..20: note = CRISPR gRNA sequence
  source 1..20: mol_type = other DNA
gtaatcccagctactctggt

SEQ ID NO: 72680 - DNA, 20 bp, synthetic construct
  misc_feature 1..20: note = CRISPR gRNA sequence
  source 1..20: mol_type = other DNA
ctctggtagctgaggcacaa

SEQ ID NO: 72681 - DNA, 20 bp, synthetic construct
  misc_feature 1..20: note = CRISPR gRNA sequence
  source 1..20: mol_type = other DNA
tggtagctgaggcacaagaa

SEQ ID NO: 72682 - DNA, 20 bp, synthetic construct
  misc_feature 1..20: note = CRISPR gRNA sequence
  source 1..20: mol_type = other DNA
gtagctgaggcacaagaatt

SEQ ID NO: 72683 - DNA, 20 bp, synthetic construct
  misc_feature 1..20: note = CRISPR gRNA sequence
  source 1..20: mol_type = other DNA
aggcacaagaattgcttgaa

SEQ ID NO: 72684 - DNA, 20 bp, synthetic construct
  misc_feature 1..20: note = CRISPR gRNA sequence
  source 1..20: mol_type = other DNA
cttgaacccgggaggtggag

SEQ ID NO: 72685 - DNA, 20 bp, synthetic construct
  misc_feature 1..20: note = CRISPR gRNA sequence
  source 1..20: mol_type = other DNA
gaacccgggaggtggaggtt

SEQ ID NO: 72686 - DNA, 20 bp, synthetic construct
  misc_feature 1..20: note = CRISPR gRNA sequence
  source 1..20: mol_type = other DNA
aacccgggaggtggaggttg

SEQ ID NO: 72687 - DNA, 20 bp, synthetic construct
  misc_feature 1..20: note = CRISPR gRNA sequence
  source 1..20: mol_type = other DNA
cagtgagccgaggttgcacc

SEQ ID NO: 72688 - DNA, 20 bp, synthetic construct
  misc_feature 1..20: note = CRISPR gRNA sequence
  source 1..20: mol_type = other DNA
caccactgcactccagcctg

SEQ ID NO: 72689 - DNA, 20 bp, synthetic construct
  misc_feature 1..20: note = CRISPR gRNA sequence
  source 1..20: mol_type = other DNA
cactccagcctgggtgacag

SEQ ID NO: 72690 - DNA, 20 bp, synthetic construct
  misc_feature 1..20: note = CRISPR gRNA sequence
  source 1..20: mol_type = other DNA
cagcctgggtgacagagaga

SEQ ID NO: 72691 - DNA, 20 bp, synthetic construct
  misc_feature 1..20: note = CRISPR gRNA sequence
  source 1..20: mol_type = other DNA
ggtgacagagagagactcca

SEQ ID NO: 72692 - DNA, 20 bp, synthetic construct
  misc_feature 1..20: note = CRISPR gRNA sequence
  source 1..20: mol_type = other DNA
catctaaaaaaaaaaaaaaa

SEQ ID NO: 72693 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 72694 - DNA, 20 bp, synthetic construct
  misc_feature 1..20: note = CRISPR gRNA sequence
  source 1..20: mol_type = other DNA
tgggactctgggggctgcca

SEQ ID NO: 72695 - DNA, 20 bp, synthetic construct
  misc_feature 1..20: note = CRISPR gRNA sequence
  source 1..20: mol_type = other DNA
ggactctgggggctgccatg

SEQ ID NO: 72696 - DNA, 20 bp, synthetic construct
  misc_feature 1..20: note = CRISPR gRNA sequence
  source 1..20: mol_type = other DNA
tgggggctgccatggggctg

SEQ ID NO: 72697 - DNA, 20 bp, synthetic construct
  misc_feature 1..20: note = CRISPR gRNA sequence
  source 1..20: mol_type = other DNA
ggggctgccatggggctgca

SEQ ID NO: 72698 - DNA, 20 bp, synthetic construct
  misc_feature 1..20: note = CRISPR gRNA sequence
  source 1..20: mol_type = other DNA
ccatggggctgcaatgaggt

SEQ ID NO: 72699 - DNA, 20 bp, synthetic construct
  misc_feature 1..20: note = CRISPR gRNA sequence
  source 1..20: mol_type = other DNA
caatgaggtcatttgtgaag

SEQ ID NO: 72700 - DNA, 20 bp, synthetic construct
  misc_feature 1..20: note = CRISPR gRNA sequence
  source 1..20: mol_type = other DNA
gtgaagtgctgaggccacgt

SEQ ID NO: 72701 - DNA, 20 bp, synthetic construct
  misc_feature 1..20: note = CRISPR gRNA sequence
  source 1..20: mol_type = other DNA
tgaagtgctgaggccacgtt

SEQ ID NO: 72702 - DNA, 20 bp, synthetic construct
  misc_feature 1..20: note = CRISPR gRNA sequence
  source 1..20: mol_type = other DNA
aggccacgttgattggcacc

SEQ ID NO: 72703 - DNA, 20 bp, synthetic construct
  misc_feature 1..20: note = CRISPR gRNA sequence
  source 1..20: mol_type = other DNA
attggcaccgtgctcctgcg

SEQ ID NO: 72704 - DNA, 20 bp, synthetic construct
  misc_feature 1..20: note = CRISPR gRNA sequence
  source 1..20: mol_type = other DNA
gcaccgtgctcctgcgaagc

SEQ ID NO: 72705 - DNA, 20 bp, synthetic construct
  misc_feature 1..20: note = CRISPR gRNA sequence
  source 1..20: mol_type = other DNA
ctgcgaagccctctgccagg

SEQ ID NO: 72706 - DNA, 20 bp, synthetic construct
  misc_feature 1..20: note = CRISPR gRNA sequence
  source 1..20: mol_type = other DNA
cgaagccctctgccaggatt

SEQ ID NO: 72707 - DNA, 20 bp, synthetic construct
  misc_feature 1..20: note = CRISPR gRNA sequence
  source 1..20: mol_type = other DNA
tgccaggatttctcattcgc

SEQ ID NO: 72708 - DNA, 20 bp, synthetic construct
  misc_feature 1..20: note = CRISPR gRNA sequence
  source 1..20: mol_type = other DNA
ccaggatttctcattcgccc

SEQ ID NO: 72709 - DNA, 20 bp, synthetic construct
  misc_feature 1..20: note = CRISPR gRNA sequence
  source 1..20: mol_type = other DNA
ctcattcgccctcagggacc

SEQ ID NO: 72710 - DNA, 20 bp, synthetic construct
  misc_feature 1..20: note = CRISPR gRNA sequence
  source 1..20: mol_type = other DNA
tcattcgccctcagggaccc

SEQ ID NO: 72711 - DNA, 20 bp, synthetic construct
  misc_feature 1..20: note = CRISPR gRNA sequence
  source 1..20: mol_type = other DNA
attcgccctcagggacccgc

SEQ ID NO: 72712 - DNA, 20 bp, synthetic construct
  misc_feature 1..20: note = CRISPR gRNA sequence
  source 1..20: mol_type = other DNA
gccctcagggacccgctcac

SEQ ID NO: 72713 - DNA, 20 bp, synthetic construct
  misc_feature 1..20: note = CRISPR gRNA sequence
  source 1..20: mol_type = other DNA
agggacccgctcacagggca

SEQ ID NO: 72714 - DNA, 20 bp, synthetic construct
  misc_feature 1..20: note = CRISPR gRNA sequence
  source 1..20: mol_type = other DNA
acagggcacaatgaactggg

SEQ ID NO: 72715 - DNA, 20 bp, synthetic construct
  misc_feature 1..20: note = CRISPR gRNA sequence
  source 1..20: mol_type = other DNA
ggatcattgtacttcttttg

SEQ ID NO: 72716 - DNA, 20 bp, synthetic construct
  misc_feature 1..20: note = CRISPR gRNA sequence
  source 1..20: mol_type = other DNA
tacttcttttgcatgtgaag

SEQ ID NO: 72717 - DNA, 20 bp, synthetic construct
  misc_feature 1..20: note = CRISPR gRNA sequence
  source 1..20: mol_type = other DNA
cttttgcatgtgaagaaact

SEQ ID NO: 72718 - DNA, 20 bp, synthetic construct
  misc_feature 1..20: note = CRISPR gRNA sequence
  source 1..20: mol_type = other DNA
ttttgcatgtgaagaaactg

SEQ ID NO: 72719 - DNA, 20 bp, synthetic construct
  misc_feature 1..20: note = CRISPR gRNA sequence
  source 1..20: mol_type = other DNA
ttgcatgtgaagaaactgag

SEQ ID NO: 72720 - DNA, 20 bp, synthetic construct
  misc_feature 1..20: note = CRISPR gRNA sequence
  source 1..20: mol_type = other DNA
tgcatgtgaagaaactgagg

SEQ ID NO: 72721 - DNA, 20 bp, synthetic construct
  misc_feature 1..20: note = CRISPR gRNA sequence
  source 1..20: mol_type = other DNA
gcatgtgaagaaactgaggc

SEQ ID NO: 72722 - DNA, 20 bp, synthetic construct
  misc_feature 1..20: note = CRISPR gRNA sequence
  source 1..20: mol_type = other DNA
catgtgaagaaactgaggct

SEQ ID NO: 72723 - DNA, 20 bp, synthetic construct
  misc_feature 1..20: note = CRISPR gRNA sequence
  source 1..20: mol_type = other DNA
aggctgagaaggggcagggg

SEQ ID NO: 72724 - DNA, 20 bp, synthetic construct
  misc_feature 1..20: note = CRISPR gRNA sequence
  source 1..20: mol_type = other DNA
agaaggggcaggggtttggc

SEQ ID NO: 72725 - DNA, 20 bp, synthetic construct
  misc_feature 1..20: note = CRISPR gRNA sequence
  source 1..20: mol_type = other DNA
ggccaaggtcaggcaggggc

SEQ ID NO: 72726 - DNA, 20 bp, synthetic construct
  misc_feature 1..20: note = CRISPR gRNA sequence
  source 1..20: mol_type = other DNA
gccaaggtcaggcaggggcc

SEQ ID NO: 72727 - DNA, 20 bp, synthetic construct
  misc_feature 1..20: note = CRISPR gRNA sequence
  source 1..20: mol_type = other DNA
ggctgggcctcctgattttc

SEQ ID NO: 72728 - DNA, 20 bp, synthetic construct
  misc_feature 1..20: note = CRISPR gRNA sequence
  source 1..20: mol_type = other DNA
ggcctcctgattttcttgct

SEQ ID NO: 72729 - DNA, 20 bp, synthetic construct
  misc_feature 1..20: note = CRISPR gRNA sequence
  source 1..20: mol_type = other DNA
ctgattttcttgctgcagac

SEQ ID NO: 72730 - DNA, 20 bp, synthetic construct
  misc_feature 1..20: note = CRISPR gRNA sequence
  source 1..20: mol_type = other DNA
attttcttgctgcagacatc

SEQ ID NO: 72731 - DNA, 20 bp, synthetic construct
  misc_feature 1..20: note = CRISPR gRNA sequence
  source 1..20: mol_type = other DNA
tcttgctgcagacatcagag

SEQ ID NO: 72732 - DNA, 20 bp, synthetic construct
  misc_feature 1..20: note = CRISPR gRNA sequence
  source 1..20: mol_type = other DNA
cttgctgcagacatcagagg

SEQ ID NO: 72733 - DNA, 20 bp, synthetic construct
  misc_feature 1..20: note = CRISPR gRNA sequence
  source 1..20: mol_type = other DNA
ttgctgcagacatcagaggc

SEQ ID NO: 72734 - DNA, 20 bp, synthetic construct
  misc_feature 1..20: note = CRISPR gRNA sequence
  source 1..20: mol_type = other DNA
gctgcagacatcagaggcag

SEQ ID NO: 72735 - DNA, 20 bp, synthetic construct
  misc_feature 1..20: note = CRISPR gRNA sequence
  source 1..20: mol_type = other DNA
ctgcagacatcagaggcagg

SEQ ID NO: 72736 - DNA, 20 bp, synthetic construct
  misc_feature 1..20: note = CRISPR gRNA sequence
  source 1..20: mol_type = other DNA
cagacatcagaggcagggaa

SEQ ID NO: 72737 - DNA, 20 bp, synthetic construct
  misc_feature 1..20: note = CRISPR gRNA sequence
  source 1..20: mol_type = other DNA
gacttggggcagggcagctc

SEQ ID NO: 72738 - DNA, 20 bp, synthetic construct
  misc_feature 1..20: note = CRISPR gRNA sequence
  source 1..20: mol_type = other DNA
acttggggcagggcagctca

SEQ ID NO: 72739 - DNA, 20 bp, synthetic construct
  misc_feature 1..20: note = CRISPR gRNA sequence
  source 1..20: mol_type = other DNA
ggggcagggcagctcaactg

SEQ ID NO: 72740 - DNA, 20 bp, synthetic construct
  misc_feature 1..20: note = CRISPR gRNA sequence
  source 1..20: mol_type = other DNA
gggcagggcagctcaactga

SEQ ID NO: 72741 - DNA, 20 bp, synthetic construct
  misc_feature 1..20: note = CRISPR gRNA sequence
  source 1..20: mol_type = other DNA
aactgatgggggcctggacc

SEQ ID NO: 72742 - DNA, 20 bp, synthetic construct
  misc_feature 1..20: note = CRISPR gRNA sequence
  source 1..20: mol_type = other DNA
atgggggcctggaccccccc

SEQ ID NO: 72743 - DNA, 20 bp, synthetic construct
  misc_feature 1..20: note = CRISPR gRNA sequence
  source 1..20: mol_type = other DNA
gacccccccactgctcccga

SEQ ID NO: 72744 - DNA, 20 bp, synthetic construct
  misc_feature 1..20: note = CRISPR gRNA sequence
  source 1..20: mol_type = other DNA
ctcccgaggaccctcctccc

SEQ ID NO: 72745 - DNA, 20 bp, synthetic construct
  misc_feature 1..20: note = CRISPR gRNA sequence
  source 1..20: mol_type = other DNA
ccgaggaccctcctccccac

SEQ ID NO: 72746 - DNA, 20 bp, synthetic construct
  misc_feature 1..20: note = CRISPR gRNA sequence
  source 1..20: mol_type = other DNA
ctccccaccagccctgcatg

SEQ ID NO: 72747 - DNA, 20 bp, synthetic construct
  misc_feature 1..20: note = CRISPR gRNA sequence
  source 1..20: mol_type = other DNA
cccaccagccctgcatggta

SEQ ID NO: 72748 - DNA, 20 bp, synthetic construct
  misc_feature 1..20: note = CRISPR gRNA sequence
  source 1..20: mol_type = other DNA
catggtatgggcagggggcc

SEQ ID NO: 72749 - DNA, 20 bp, synthetic construct
  misc_feature 1..20: note = CRISPR gRNA sequence
  source 1..20: mol_type = other DNA
actgtaggaccctcaggtgc

SEQ ID NO: 72750 - DNA, 20 bp, synthetic construct
  misc_feature 1..20: note = CRISPR gRNA sequence
  source 1..20: mol_type = other DNA
taggaccctcaggtgctggg

SEQ ID NO: 72751 - DNA, 20 bp, synthetic construct
  misc_feature 1..20: note = CRISPR gRNA sequence
  source 1..20: mol_type = other DNA
aggtgctggggcagctcctg

SEQ ID NO: 72752 - DNA, 20 bp, synthetic construct
  misc_feature 1..20: note = CRISPR gRNA sequence
  source 1..20: mol_type = other DNA
gggcagctcctgagccagcc

SEQ ID NO: 72753 - DNA, 20 bp, synthetic construct
  misc_feature 1..20: note = CRISPR gRNA sequence
  source 1..20: mol_type = other DNA
ctgagccagccccagggctg

SEQ ID NO: 72754 - DNA, 20 bp, synthetic construct
  misc_feature 1..20: note = CRISPR gRNA sequence
  source 1..20: mol_type = other DNA
agccagccccagggctgtgg

SEQ ID NO: 72755 - DNA, 20 bp, synthetic construct
  misc_feature 1..20: note = CRISPR gRNA sequence
  source 1..20: mol_type = other DNA
tgggatcccccagggcattg

SEQ ID NO: 72756 - DNA, 20 bp, synthetic construct
  misc_feature 1..20: note = CRISPR gRNA sequence
  source 1..20: mol_type = other DNA
cagccaagcctggaagagga

SEQ ID NO: 72757 - DNA, 20 bp, synthetic construct
  misc_feature 1..20: note = CRISPR gRNA sequence
  source 1..20: mol_type = other DNA
gaagaggagaggaatgagca

SEQ ID NO: 72758 - DNA, 20 bp, synthetic construct
  misc_feature 1..20: note = CRISPR gRNA sequence
  source 1..20: mol_type = other DNA
agtactgggcctgcccactc

SEQ ID NO: 72759 - DNA, 20 bp, synthetic construct
  misc_feature 1..20: note = CRISPR gRNA sequence
  source 1..20: mol_type = other DNA
ggcctgcccactcgggaccc

SEQ ID NO: 72760 - DNA, 20 bp, synthetic construct
  misc_feature 1..20: note = CRISPR gRNA sequence
  source 1..20: mol_type = other DNA
cccactcgggacccccgccc

SEQ ID NO: 72761 - DNA, 20 bp, synthetic construct
  misc_feature 1..20: note = CRISPR gRNA sequence
  source 1..20: mol_type = other DNA
gggacccccgccctgccctg

SEQ ID NO: 72762 - DNA, 20 bp, synthetic construct
  misc_feature 1..20: note = CRISPR gRNA sequence
  source 1..20: mol_type = other DNA
ccctgtgcccactgcgggag

SEQ ID NO: 72763 - DNA, 20 bp, synthetic construct
  misc_feature 1..20: note = CRISPR gRNA sequence
  source 1..20: mol_type = other DNA
tgcccactgcgggagaggag

SEQ ID NO: 72764 - DNA, 20 bp, synthetic construct
  misc_feature 1..20: note = CRISPR gRNA sequence
  source 1..20: mol_type = other DNA
cgggagaggaggccaggtgg

SEQ ID NO: 72765 - DNA, 20 bp, synthetic construct
  misc_feature 1..20: note = CRISPR gRNA sequence
  source 1..20: mol_type = other DNA
gggggcacagagggcagagg

SEQ ID NO: 72766 - DNA, 20 bp, synthetic construct
  misc_feature 1..20: note = CRISPR gRNA sequence
  source 1..20: mol_type = other DNA
ggcagacactcacatcaact

SEQ ID NO: 72767 - DNA, 20 bp, synthetic construct
  misc_feature 1..20: note = CRISPR gRNA sequence
  source 1..20: mol_type = other DNA
acatcaactcctccaggcgc

SEQ ID NO: 72768 - DNA, 20 bp, synthetic construct
  misc_feature 1..20: note = CRISPR gRNA sequence
  source 1..20: mol_type = other DNA
ctccaggcgcctgcaaagaa

SEQ ID NO: 72769 - DNA, 20 bp, synthetic construct
  misc_feature 1..20: note = CRISPR gRNA sequence
  source 1..20: mol_type = other DNA
caggcgcctgcaaagaacga

SEQ ID NO: 72770 - DNA, 20 bp, synthetic construct
  misc_feature 1..20: note = CRISPR gRNA sequence
  source 1..20: mol_type = other DNA
caaagaacgagagactctgc

SEQ ID NO: 72771 - DNA, 20 bp, synthetic construct
  misc_feature 1..20: note = CRISPR gRNA sequence
  source 1..20: mol_type = other DNA
tgccaactgcactcccccgg

SEQ ID NO: 72772 - DNA, 20 bp, synthetic construct
  misc_feature 1..20: note = CRISPR gRNA sequence
  source 1..20: mol_type = other DNA
ccaactgcactcccccggct

SEQ ID NO: 72773 - DNA, 20 bp, synthetic construct
  misc_feature 1..20: note = CRISPR gRNA sequence
  source 1..20: mol_type = other DNA
cactcccccggctgagctga

SEQ ID NO: 72774 - DNA, 20 bp, synthetic construct
  misc_feature 1..20: note = CRISPR gRNA sequence
  source 1..20: mol_type = other DNA
ccccggctgagctgatgcta

SEQ ID NO: 72775 - DNA, 20 bp, synthetic construct
  misc_feature 1..20: note = CRISPR gRNA sequence
  source 1..20: mol_type = other DNA
agctgatgctattccctgag

SEQ ID NO: 72776 - DNA, 20 bp, synthetic construct
  misc_feature 1..20: note = CRISPR gRNA sequence
  source 1..20: mol_type = other DNA
atgctattccctgagaggct

SEQ ID NO: 72777 - DNA, 20 bp, synthetic construct
  misc_feature 1..20: note = CRISPR gRNA sequence
  source 1..20: mol_type = other DNA
ttccctgagaggctgtggga

SEQ ID NO: 72778 - DNA, 20 bp, synthetic construct
  misc_feature 1..20: note = CRISPR gRNA sequence
  source 1..20: mol_type = other DNA
cctgagaggctgtgggaggg

SEQ ID NO: 72779 - DNA, 20 bp, synthetic construct
  misc_feature 1..20: note = CRISPR gRNA sequence
  source 1..20: mol_type = other DNA
agaggctgtgggaggggggc

SEQ ID NO: 72780 - DNA, 20 bp, synthetic construct
  misc_feature 1..20: note = CRISPR gRNA sequence
  source 1..20: mol_type = other DNA
tgggaggggggcagccatca

SEQ ID NO: 72781 - DNA, 20 bp, synthetic construct
  misc_feature 1..20: note = CRISPR gRNA sequence
  source 1..20: mol_type = other DNA
tgatgccccctctccccgac

SEQ ID NO: 72782 - DNA, 20 bp, synthetic construct
  misc_feature 1..20: note = CRISPR gRNA sequence
  source 1..20: mol_type = other DNA
atgccccctctccccgacac

SEQ ID NO: 72783 - DNA, 20 bp, synthetic construct
  misc_feature 1..20: note = CRISPR gRNA sequence
  source 1..20: mol_type = other DNA
tccccgacaccccagcacat

SEQ ID NO: 72784 - DNA, 20 bp, synthetic construct
  misc_feature 1..20: note = CRISPR gRNA sequence
  source 1..20: mol_type = other DNA
cccgacaccccagcacatct

SEQ ID NO: 72785 - DNA, 20 bp, synthetic construct
  misc_feature 1..20: note = CRISPR gRNA sequence
  source 1..20: mol_type = other DNA
ctgggtctgccacccctgct

SEQ ID NO: 72786 - DNA, 20 bp, synthetic construct
  misc_feature 1..20: note = CRISPR gRNA sequence
  source 1..20: mol_type = other DNA
ggtctgccacccctgcttca

SEQ ID NO: 72787 - DNA, 20 bp, synthetic construct
  misc_feature 1..20: note = CRISPR gRNA sequence
  source 1..20: mol_type = other DNA
ccacccctgcttcagggggc

SEQ ID NO: 72788 - DNA, 20 bp, synthetic construct
  misc_feature 1..20: note = CRISPR gRNA sequence
  source 1..20: mol_type = other DNA
cttcagggggcctaagagac

SEQ ID NO: 72789 - DNA, 20 bp, synthetic construct
  misc_feature 1..20: note = CRISPR gRNA sequence
  source 1..20: mol_type = other DNA
cagggggcctaagagacaac

SEQ ID NO: 72790 - DNA, 20 bp, synthetic construct
  misc_feature 1..20: note = CRISPR gRNA sequence
  source 1..20: mol_type = other DNA
agggggcctaagagacaacc

SEQ ID NO: 72791 - DNA, 20 bp, synthetic construct
  misc_feature 1..20: note = CRISPR gRNA sequence
  source 1..20: mol_type = other DNA
agagacaaccccccgacacc

SEQ ID NO: 72792 - DNA, 20 bp, synthetic construct
  misc_feature 1..20: note = CRISPR gRNA sequence
  source 1..20: mol_type = other DNA
cccagacaatgaggcagaaa

SEQ ID NO: 72793 - DNA, 20 bp, synthetic construct
  misc_feature 1..20: note = CRISPR gRNA sequence
  source 1..20: mol_type = other DNA
gggtggcttaaggtcccgca

SEQ ID NO: 72794 - DNA, 20 bp, synthetic construct
  misc_feature 1..20: note = CRISPR gRNA sequence
  source 1..20: mol_type = other DNA
aaggtcccgcagtgagggcc

SEQ ID NO: 72795 - DNA, 20 bp, synthetic construct
  misc_feature 1..20: note = CRISPR gRNA sequence
  source 1..20: mol_type = other DNA
aggtcccgcagtgagggcca

SEQ ID NO: 72796 - DNA, 20 bp, synthetic construct
  misc_feature 1..20: note = CRISPR gRNA sequence
  source 1..20: mol_type = other DNA
cctggacactgaggttggcg

SEQ ID NO: 72797 - DNA, 20 bp, synthetic construct
  misc_feature 1..20: note = CRISPR gRNA sequence
  source 1..20: mol_type = other DNA
gacactgaggttggcgcagg

SEQ ID NO: 72798 - DNA, 20 bp, synthetic construct
  misc_feature 1..20: note = CRISPR gRNA sequence
  source 1..20: mol_type = other DNA
aggttggcgcaggggagatt

SEQ ID NO: 72799 - DNA, 20 bp, synthetic construct
  misc_feature 1..20: note = CRISPR gRNA sequence
  source 1..20: mol_type = other DNA
gcgcaggggagattttacca

SEQ ID NO: 72800 - DNA, 20 bp, synthetic construct
  misc_feature 1..20: note = CRISPR gRNA sequence
  source 1..20: mol_type = other DNA
taccatgctggcctcagcta

SEQ ID NO: 72801 - DNA, 20 bp, synthetic construct
  misc_feature 1..20: note = CRISPR gRNA sequence
  source 1..20: mol_type = other DNA
accatgctggcctcagctag

SEQ ID NO: 72802 - DNA, 20 bp, synthetic construct
  misc_feature 1..20: note = CRISPR gRNA sequence
  source 1..20: mol_type = other DNA
ccatgctggcctcagctagg

SEQ ID NO: 72803 - DNA, 20 bp, synthetic construct
  misc_feature 1..20: note = CRISPR gRNA sequence
  source 1..20: mol_type = other DNA
gcctcagctaggggccagta

SEQ ID NO: 72804 - DNA, 20 bp, synthetic construct
  misc_feature 1..20: note = CRISPR gRNA sequence
  source 1..20: mol_type = other DNA
agctaggggccagtatctcc

SEQ ID NO: 72805 - DNA, 20 bp, synthetic construct
  misc_feature 1..20: note = CRISPR gRNA sequence
  source 1..20: mol_type = other DNA
ggggccagtatctcctagga

SEQ ID NO: 72806 - DNA, 20 bp, synthetic construct
  misc_feature 1..20: note = CRISPR gRNA sequence
  source 1..20: mol_type = other DNA
ctaggaccatcgtgtgaccc

SEQ ID NO: 72807 - DNA, 20 bp, synthetic construct
  misc_feature 1..20: note = CRISPR gRNA sequence
  source 1..20: mol_type = other DNA
ggaccatcgtgtgacccctg

SEQ ID NO: 72808 - DNA, 20 bp, synthetic construct
  misc_feature 1..20: note = CRISPR gRNA sequence
  source 1..20: mol_type = other DNA
tggccctcctctgtagggct

SEQ ID NO: 72809 - DNA, 20 bp, synthetic construct
  misc_feature 1..20: note = CRISPR gRNA sequence
  source 1..20: mol_type = other DNA
ctctgtagggctggctactc

SEQ ID NO: 72810 - DNA, 20 bp, synthetic construct
  misc_feature 1..20: note = CRISPR gRNA sequence
  source 1..20: mol_type = other DNA
tgtagggctggctactcact

SEQ ID NO: 72811 - DNA, 20 bp, synthetic construct
  misc_feature 1..20: note = CRISPR gRNA sequence
  source 1..20: mol_type = other DNA
tagggctggctactcactct

SEQ ID NO: 72812 - DNA, 20 bp, synthetic construct
  misc_feature 1..20: note = CRISPR gRNA sequence
  source 1..20: mol_type = other DNA
gctactcactctatcttcct

SEQ ID NO: 72813 - DNA, 20 bp, synthetic construct
  misc_feature 1..20: note = CRISPR gRNA sequence
  source 1..20: mol_type = other DNA
ctcactctatcttcctgagc

SEQ ID NO: 72814 - DNA, 20 bp, synthetic construct
  misc_feature 1..20: note = CRISPR gRNA sequence
  source 1..20: mol_type = other DNA
actctatcttcctgagctct

SEQ ID NO: 72815 - DNA, 20 bp, synthetic construct
  misc_feature 1..20: note = CRISPR gRNA sequence
  source 1..20: mol_type = other DNA
tatcttcctgagctctggca

SEQ ID NO: 72816 - DNA, 20 bp, synthetic construct
  misc_feature 1..20: note = CRISPR gRNA sequence
  source 1..20: mol_type = other DNA
tcttcctgagctctggcagc

SEQ ID NO: 72817 - DNA, 20 bp, synthetic construct
  misc_feature 1..20: note = CRISPR gRNA sequence
  source 1..20: mol_type = other DNA
cctgagctctggcagcccag

SEQ ID NO: 72818 - DNA, 20 bp, synthetic construct
  misc_feature 1..20: note = CRISPR gRNA sequence
  source 1..20: mol_type = other DNA
ctgagctctggcagcccagg

SEQ ID NO: 72819 - DNA, 20 bp, synthetic construct
  misc_feature 1..20: note = CRISPR gRNA sequence
  source 1..20: mol_type = other DNA
agctctggcagcccaggcag

SEQ ID NO: 72820 - DNA, 20 bp, synthetic construct
  misc_feature 1..20: note = CRISPR gRNA sequence
  source 1..20: mol_type = other DNA
tggcagcccaggcaggatgg

SEQ ID NO: 72821 - DNA, 20 bp, synthetic construct
  misc_feature 1..20: note = CRISPR gRNA sequence
  source 1..20: mol_type = other DNA
gcagcccaggcaggatggta

SEQ ID NO: 72822 - DNA, 20 bp, synthetic construct
  misc_feature 1..20: note = CRISPR gRNA sequence
  source 1..20: mol_type = other DNA
agtgctggacaccagcgtct

SEQ ID NO: 72823 - DNA, 20 bp, synthetic construct
  misc_feature 1..20: note = CRISPR gRNA sequence
  source 1..20: mol_type = other DNA
gacaccagcgtctccaatct

SEQ ID NO: 72824 - DNA, 20 bp, synthetic construct
  misc_feature 1..20: note = CRISPR gRNA sequence
  source 1..20: mol_type = other DNA
caatctggttgtggctcaag

SEQ ID NO: 72825 - DNA, 20 bp, synthetic construct
  misc_feature 1..20: note = CRISPR gRNA sequence
  source 1..20: mol_type = other DNA
gttgtggctcaagcttgggg

SEQ ID NO: 72826 - DNA, 20 bp, synthetic construct
  misc_feature 1..20: note = CRISPR gRNA sequence
  source 1..20: mol_type = other DNA
tggctcaagcttgggggaga

SEQ ID NO: 72827 - DNA, 20 bp, synthetic construct
  misc_feature 1..20: note = CRISPR gRNA sequence
  source 1..20: mol_type = other DNA
aagcttgggggagaaaacag

SEQ ID NO: 72828 - DNA, 20 bp, synthetic construct
  misc_feature 1..20: note = CRISPR gRNA sequence
  source 1..20: mol_type = other DNA
gggggagaaaacagcttcat

SEQ ID NO: 72829 - DNA, 20 bp, synthetic construct
  misc_feature 1..20: note = CRISPR gRNA sequence
  source 1..20: mol_type = other DNA
ggggagaaaacagcttcatc

SEQ ID NO: 72830 - DNA, 20 bp, synthetic construct
  misc_feature 1..20: note = CRISPR gRNA sequence
  source 1..20: mol_type = other DNA
catcagccttctgccgtctc

SEQ ID NO: 72831 - DNA, 20 bp, synthetic construct
  misc_feature 1..20: note = CRISPR gRNA sequence
  source 1..20: mol_type = other DNA
atcagccttctgccgtctca

SEQ ID NO: 72832 - DNA, 20 bp, synthetic construct
  misc_feature 1..20: note = CRISPR gRNA sequence
  source 1..20: mol_type = other DNA
ctgccgtctcatcttgtcca

SEQ ID NO: 72833 - DNA, 20 bp, synthetic construct
  misc_feature 1..20: note = CRISPR gRNA sequence
  source 1..20: mol_type = other DNA
tgccgtctcatcttgtccac

SEQ ID NO: 72834 - DNA, 20 bp, synthetic construct
  misc_feature 1..20: note = CRISPR gRNA sequence
  source 1..20: mol_type = other DNA
ccgtctcatcttgtccacac

SEQ ID NO: 72835 - DNA, 20 bp, synthetic construct
  misc_feature 1..20: note = CRISPR gRNA sequence
  source 1..20: mol_type = other DNA
atcttgtccacaccccactc

SEQ ID NO: 72836 - DNA, 20 bp, synthetic construct
  misc_feature 1..20: note = CRISPR gRNA sequence
  source 1..20: mol_type = other DNA
gtccacaccccactcccaga

SEQ ID NO: 72837 - DNA, 20 bp, synthetic construct
  misc_feature 1..20: note = CRISPR gRNA sequence
  source 1..20: mol_type = other DNA
tccacaccccactcccagaa

SEQ ID NO: 72838 - DNA, 20 bp, synthetic construct
  misc_feature 1..20: note = CRISPR gRNA sequence
  source 1..20: mol_type = other DNA
ccagaaaaagaaggggaggc

SEQ ID NO: 72839 - DNA, 20 bp, synthetic construct
  misc_feature 1..20: note = CRISPR gRNA sequence
  source 1..20: mol_type = other DNA
aagtcccaggaagggcctcg

SEQ ID NO: 72840 - DNA, 20 bp, synthetic construct
  misc_feature 1..20: note = CRISPR gRNA sequence
  source 1..20: mol_type = other DNA
gactcacacagagagcccca

SEQ ID NO: 72841 - DNA, 20 bp, synthetic construct
  misc_feature 1..20: note = CRISPR gRNA sequence
  source 1..20: mol_type = other DNA
acacagagagccccatcacc

SEQ ID NO: 72842 - DNA, 20 bp, synthetic construct
  misc_feature 1..20: note = CRISPR gRNA sequence
  source 1..20: mol_type = other DNA
agtgacagctcctaaccctt

SEQ ID NO: 72843 - DNA, 20 bp, synthetic construct
  misc_feature 1..20: note = CRISPR gRNA sequence
  source 1..20: mol_type = other DNA
ctaacccttggcttctgttt

SEQ ID NO: 72844 - DNA, 20 bp, synthetic construct
  misc_feature 1..20: note = CRISPR gRNA sequence
  source 1..20: mol_type = other DNA
acccttggcttctgtttagg

SEQ ID NO: 72845 - DNA, 20 bp, synthetic construct
  misc_feature 1..20: note = CRISPR gRNA sequence
  source 1..20: mol_type = other DNA
ggcttctgtttaggatgttc

SEQ ID NO: 72846 - DNA, 20 bp, synthetic construct
  misc_feature 1..20: note = CRISPR gRNA sequence
  source 1..20: mol_type = other DNA
gcttctgtttaggatgttct

SEQ ID NO: 72847 - DNA, 20 bp, synthetic construct
  misc_feature 1..20: note = CRISPR gRNA sequence
  source 1..20: mol_type = other DNA
ctgtttaggatgttctcccc

SEQ ID NO: 72848 - DNA, 20 bp, synthetic construct
  misc_feature 1..20: note = CRISPR gRNA sequence
  source 1..20: mol_type = other DNA
tgtttaggatgttctcccca

SEQ ID NO: 72849 - DNA, 20 bp, synthetic construct
  misc_feature 1..20: note = CRISPR gRNA sequence
  source 1..20: mol_type = other DNA
tttaggatgttctccccatt

SEQ ID NO: 72850 - DNA, 20 bp, synthetic construct
  misc_feature 1..20: note = CRISPR gRNA sequence
  source 1..20: mol_type = other DNA
aggatgttctccccattgtc

SEQ ID NO: 72851 - DNA, 20 bp, synthetic construct
  misc_feature 1..20: note = CRISPR gRNA sequence
  source 1..20: mol_type = other DNA
ggatgttctccccattgtct

SEQ ID NO: 72852 - DNA, 20 bp, synthetic construct
  misc_feature 1..20: note = CRISPR gRNA sequence
  source 1..20: mol_type = other DNA
tccccattgtctgacctaaa

SEQ ID NO: 72853 - DNA, 20 bp, synthetic construct
  misc_feature 1..20: note = CRISPR gRNA sequence
  source 1..20: mol_type = other DNA
cccattgtctgacctaaatc

SEQ ID NO: 72854 - DNA, 20 bp, synthetic construct
  misc_feature 1..20: note = CRISPR gRNA sequence
  source 1..20: mol_type = other DNA
tctgacctaaatccctcttg

SEQ ID NO: 72855 - DNA, 20 bp, synthetic construct
  misc_feature 1..20: note = CRISPR gRNA sequence
  source 1..20: mol_type = other DNA
acctaaatccctcttgctac

SEQ ID NO: 72856 - DNA, 20 bp, synthetic construct
  misc_feature 1..20: note = CRISPR gRNA sequence
  source 1..20: mol_type = other DNA
aatccctcttgctacaattg

SEQ ID NO: 72857 - DNA, 20 bp, synthetic construct
  misc_feature 1..20: note = CRISPR gRNA sequence
  source 1..20: mol_type = other DNA
ttgctacaattgacactctt

SEQ ID NO: 72858 - DNA, 20 bp, synthetic construct
  misc_feature 1..20: note = CRISPR gRNA sequence
  source 1..20: mol_type = other DNA
gctacaattgacactcttac

SEQ ID NO: 72859 - DNA, 20 bp, synthetic construct
  misc_feature 1..20: note = CRISPR gRNA sequence
  source 1..20: mol_type = other DNA
ctacaattgacactcttaca

SEQ ID NO: 72860 - DNA, 20 bp, synthetic construct
  misc_feature 1..20: note = CRISPR gRNA sequence
  source 1..20: mol_type = other DNA
caattgacactcttacatcc

SEQ ID NO: 72861 - DNA, 20 bp, synthetic construct
  misc_feature 1..20: note = CRISPR gRNA sequence
  source 1..20: mol_type = other DNA
acactcttacatcctgtctt

SEQ ID NO: 72862 - DNA, 20 bp, synthetic construct
  misc_feature 1..20: note = CRISPR gRNA sequence
  source 1..20: mol_type = other DNA
ttacatcctgtctttgggtc

SEQ ID NO: 72863 - DNA, 20 bp, synthetic construct
  misc_feature 1..20: note = CRISPR gRNA sequence
  source 1..20: mol_type = other DNA
acatcctgtctttgggtccc

SEQ ID NO: 72864 - DNA, 20 bp, synthetic construct
  misc_feature 1..20: note = CRISPR gRNA sequence
  source 1..20: mol_type = other DNA
catcctgtctttgggtcccc

SEQ ID NO: 72865 - DNA, 20 bp, synthetic construct
  misc_feature 1..20: note = CRISPR gRNA sequence
  source 1..20: mol_type = other DNA
tctttgggtcccccaagctt

SEQ ID NO: 72866 - DNA, 20 bp, synthetic construct
  misc_feature 1..20: note = CRISPR gRNA sequence
  source 1..20: mol_type = other DNA
tgggtcccccaagcttctag

SEQ ID NO: 72867 - DNA, 20 bp, synthetic construct
  misc_feature 1..20: note = CRISPR gRNA sequence
  source 1..20: mol_type = other DNA
gggtcccccaagcttctagg

SEQ ID NO: 72868 - DNA, 20 bp, synthetic construct
  misc_feature 1..20: note = CRISPR gRNA sequence
  source 1..20: mol_type = other DNA
ggtcccccaagcttctaggc

SEQ ID NO: 72869 - DNA, 20 bp, synthetic construct
  misc_feature 1..20: note = CRISPR gRNA sequence
  source 1..20: mol_type = other DNA
ctaggccccaggttgtttac

SEQ ID NO: 72870 - DNA, 20 bp, synthetic construct
  misc_feature 1..20: note = CRISPR gRNA sequence
  source 1..20: mol_type = other DNA
taggccccaggttgtttaca

SEQ ID NO: 72871 - DNA, 20 bp, synthetic construct
  misc_feature 1..20: note = CRISPR gRNA sequence
  source 1..20: mol_type = other DNA
ggccccaggttgtttacaca

SEQ ID NO: 72872 - DNA, 20 bp, synthetic construct
  misc_feature 1..20: note = CRISPR gRNA sequence
  source 1..20: mol_type = other DNA
tttacacagtgtagaagtgg

SEQ ID NO: 72873 - DNA, 20 bp, synthetic construct
  misc_feature 1..20: note = CRISPR gRNA sequence
  source 1..20: mol_type = other DNA
acacagtgtagaagtgggtg

SEQ ID NO: 72874 - DNA, 20 bp, synthetic construct
  misc_feature 1..20: note = CRISPR gRNA sequence
  source 1..20: mol_type = other DNA
cacagtgtagaagtgggtga

SEQ ID NO: 72875 - DNA, 20 bp, synthetic construct
  misc_feature 1..20: note = CRISPR gRNA sequence
  source 1..20: mol_type = other DNA
aggtagccccttgcccttgt

SEQ ID NO: 72876 - DNA, 20 bp, synthetic construct
  misc_feature 1..20: note = CRISPR gRNA sequence
  source 1..20: mol_type = other DNA
gcccttgtcatctttcccgg

SEQ ID NO: 72877 - DNA, 20 bp, synthetic construct
  misc_feature 1..20: note = CRISPR gRNA sequence
  source 1..20: mol_type = other DNA
cccttgtcatctttcccggc

SEQ ID NO: 72878 - DNA, 20 bp, synthetic construct
  misc_feature 1..20: note = CRISPR gRNA sequence
  source 1..20: mol_type = other DNA
gtcatctttcccggccaaaa

SEQ ID NO: 72879 - DNA, 20 bp, synthetic construct
  misc_feature 1..20: note = CRISPR gRNA sequence
  source 1..20: mol_type = other DNA
tcatctttcccggccaaaat

SEQ ID NO: 72880 - DNA, 20 bp, synthetic construct
  misc_feature 1..20: note = CRISPR gRNA sequence
  source 1..20: mol_type = other DNA
tcccggccaaaattgtcctg

SEQ ID NO: 72881 - DNA, 20 bp, synthetic construct
  misc_feature 1..20: note = CRISPR gRNA sequence
  source 1..20: mol_type = other DNA
cccggccaaaattgtcctgg

SEQ ID NO: 72882 - DNA, 20 bp, synthetic construct
  misc_feature 1..20: note = CRISPR gRNA sequence
  source 1..20: mol_type = other DNA
ccggccaaaattgtcctggg

SEQ ID NO: 72883 - DNA, 20 bp, synthetic construct
  misc_feature 1..20: note = CRISPR gRNA sequence
  source 1..20: mol_type = other DNA
tcctgggtctgggggcagaa

SEQ ID NO: 72884 - DNA, 20 bp, synthetic construct
  misc_feature 1..20: note = CRISPR gRNA sequence
  source 1..20: mol_type = other DNA
ggtctgggggcagaatgggc

SEQ ID NO: 72885 - DNA, 20 bp, synthetic construct
  misc_feature 1..20: note = CRISPR gRNA sequence
  source 1..20: mol_type = other DNA
ggggcagaatgggcaactca

SEQ ID NO: 72886 - DNA, 20 bp, synthetic construct
  misc_feature 1..20: note = CRISPR gRNA sequence
  source 1..20: mol_type = other DNA
actccagctcctctaggctg

SEQ ID NO: 72887 - DNA, 20 bp, synthetic construct
  misc_feature 1..20: note = CRISPR gRNA sequence
  source 1..20: mol_type = other DNA
cagctcctctaggctggtgg

SEQ ID NO: 72888 - DNA, 20 bp, synthetic construct
  misc_feature 1..20: note = CRISPR gRNA sequence
  source 1..20: mol_type = other DNA
ctctaggctggtggcagccc

SEQ ID NO: 72889 - DNA, 20 bp, synthetic construct
  misc_feature 1..20: note = CRISPR gRNA sequence
  source 1..20: mol_type = other DNA
taggctggtggcagccctga

SEQ ID NO: 72890 - DNA, 20 bp, synthetic construct
  misc_feature 1..20: note = CRISPR gRNA sequence
  source 1..20: mol_type = other DNA
ggctggtggcagccctgaga

SEQ ID NO: 72891 - DNA, 20 bp, synthetic construct
  misc_feature 1..20: note = CRISPR gRNA sequence
  source 1..20: mol_type = other DNA
gtggcagccctgagagcctc

SEQ ID NO: 72892 - DNA, 20 bp, synthetic construct
  misc_feature 1..20: note = CRISPR gRNA sequence
  source 1..20: mol_type = other DNA
agagcctcagaaaggtggca

SEQ ID NO: 72893 - DNA, 20 bp, synthetic construct
  misc_feature 1..20: note = CRISPR gRNA sequence
  source 1..20: mol_type = other DNA
agaaaggtggcagcaaccga

SEQ ID NO: 72894 - DNA, 20 bp, synthetic construct
  misc_feature 1..20: note = CRISPR gRNA sequence
  source 1..20: mol_type = other DNA
ttcctgttcagtctggaaaa

SEQ ID NO: 72895 - DNA, 20 bp, synthetic construct
  misc_feature 1..20: note = CRISPR gRNA sequence
  source 1..20: mol_type = other DNA
ctgttcagtctggaaaagca

SEQ ID NO: 72896 - DNA, 20 bp, synthetic construct
  misc_feature 1..20: note = CRISPR gRNA sequence
  source 1..20: mol_type = other DNA
ttcagtctggaaaagcaggg

SEQ ID NO: 72897 - DNA, 20 bp, synthetic construct
  misc_feature 1..20: note = CRISPR gRNA sequence
  source 1..20: mol_type = other DNA
agtctggaaaagcagggaat

SEQ ID NO: 72898 - DNA, 20 bp, synthetic construct
  misc_feature 1..20: note = CRISPR gRNA sequence
  source 1..20: mol_type = other DNA
gaaaagcagggaatagacca

SEQ ID NO: 72899 - DNA, 20 bp, synthetic construct
  misc_feature 1..20: note = CRISPR gRNA sequence
  source 1..20: mol_type = other DNA
tcaggagcttaaaggccttt

SEQ ID NO: 72900 - DNA, 20 bp, synthetic construct
  misc_feature 1..20: note = CRISPR gRNA sequence
  source 1..20: mol_type = other DNA
caggagcttaaaggcctttg

SEQ ID NO: 72901 - DNA, 20 bp, synthetic construct
  misc_feature 1..20: note = CRISPR gRNA sequence
  source 1..20: mol_type = other DNA
aggagcttaaaggcctttgc

SEQ ID NO: 72902 - DNA, 20 bp, synthetic construct
  misc_feature 1..20: note = CRISPR gRNA sequence
  source 1..20: mol_type = other DNA
aaaggcctttgcaggtgctg

SEQ ID NO: 72903 - DNA, 20 bp, synthetic construct
  misc_feature 1..20: note = CRISPR gRNA sequence
  source 1..20: mol_type = other DNA
aaggcctttgcaggtgctgt

SEQ ID NO: 72904 - DNA, 20 bp, synthetic construct
  misc_feature 1..20: note = CRISPR gRNA sequence
  source 1..20: mol_type = other DNA
tgcaggtgctgtgctaagaa

SEQ ID NO: 72905 - DNA, 20 bp, synthetic construct
  misc_feature 1..20: note = CRISPR gRNA sequence
  source 1..20: mol_type = other DNA
gcaggtgctgtgctaagaac

SEQ ID NO: 72906 - DNA, 20 bp, synthetic construct
  misc_feature 1..20: note = CRISPR gRNA sequence
  source 1..20: mol_type = other DNA
caggtgctgtgctaagaact

SEQ ID NO: 72907 - DNA, 20 bp, synthetic construct
  misc_feature 1..20: note = CRISPR gRNA sequence
  source 1..20: mol_type = other DNA
tgctaagaactctacagttt

SEQ ID NO: 72908 - DNA, 20 bp, synthetic construct
  misc_feature 1..20: note = CRISPR gRNA sequence
  source 1..20: mol_type = other DNA
agaactctacagtttgcaaa

SEQ ID NO: 72909 - DNA, 20 bp, synthetic construct
  misc_feature 1..20: note = CRISPR gRNA sequence
  source 1..20: mol_type = other DNA
tacagtttgcaaagccttac

SEQ ID NO: 72910 - DNA, 20 bp, synthetic construct
  misc_feature 1..20: note = CRISPR gRNA sequence
  source 1..20: mol_type = other DNA
cagtttgcaaagccttacac

SEQ ID NO: 72911 - DNA, 20 bp, synthetic construct
  misc_feature 1..20: note = CRISPR gRNA sequence
  source 1..20: mol_type = other DNA
gcaaagccttacacgcccag

SEQ ID NO: 72912 - DNA, 20 bp, synthetic construct
  misc_feature 1..20: note = CRISPR gRNA sequence
  source 1..20: mol_type = other DNA
caaagccttacacgcccagg

SEQ ID NO: 72913 - DNA, 20 bp, synthetic construct
  misc_feature 1..20: note = CRISPR gRNA sequence
  source 1..20: mol_type = other DNA
acacgcccaggaattcatat

SEQ ID NO: 72914 - DNA, 20 bp, synthetic construct
  misc_feature 1..20: note = CRISPR gRNA sequence
  source 1..20: mol_type = other DNA
cacgcccaggaattcatatg

SEQ ID NO: 72915 - DNA, 20 bp, synthetic construct
  misc_feature 1..20: note = CRISPR gRNA sequence
  source 1..20: mol_type = other DNA
atatgctggtagcaaaactt

SEQ ID NO: 72916 - DNA, 20 bp, synthetic construct
  misc_feature 1..20: note = CRISPR gRNA sequence
  source 1..20: mol_type = other DNA
gtagcaaaacttctgggggt

SEQ ID NO: 72917 - DNA, 20 bp, synthetic construct
  misc_feature 1..20: note = CRISPR gRNA sequence
  source 1..20: mol_type = other DNA
ctgggggtcatggcaggtgg

SEQ ID NO: 72918 - DNA, 20 bp, synthetic construct
  misc_feature 1..20: note = CRISPR gRNA sequence
  source 1..20: mol_type = other DNA
tgggggtcatggcaggtggg

SEQ ID NO: 72919 - DNA, 20 bp, synthetic construct
  misc_feature 1..20: note = CRISPR gRNA sequence
  source 1..20: mol_type = other DNA
ggggtcatggcaggtgggga

SEQ ID NO: 72920 - DNA, 20 bp, synthetic construct
  misc_feature 1..20: note = CRISPR gRNA sequence
  source 1..20: mol_type = other DNA
ttgtccccagtgtccaggtg

SEQ ID NO: 72921 - DNA, 20 bp, synthetic construct
  misc_feature 1..20: note = CRISPR gRNA sequence
  source 1..20: mol_type = other DNA
tccccagtgtccaggtgaga

SEQ ID NO: 72922 - DNA, 20 bp, synthetic construct
  misc_feature 1..20: note = CRISPR gRNA sequence
  source 1..20: mol_type = other DNA
gagagccagcagtgagctgt

SEQ ID NO: 72923 - DNA, 20 bp, synthetic construct
  misc_feature 1..20: note = CRISPR gRNA sequence
  source 1..20: mol_type = other DNA
agagccagcagtgagctgtg

SEQ ID NO: 72924 - DNA, 20 bp, synthetic construct
  misc_feature 1..20: note = CRISPR gRNA sequence
  source 1..20: mol_type = other DNA
tgactggccagagacttagg

SEQ ID NO: 72925 - DNA, 20 bp, synthetic construct
  misc_feature 1..20: note = CRISPR gRNA sequence
  source 1..20: mol_type = other DNA
gccagagacttagggacttg

SEQ ID NO: 72926 - DNA, 20 bp, synthetic construct
  misc_feature 1..20: note = CRISPR gRNA sequence
  source 1..20: mol_type = other DNA
agggacttgcaggctgggtg

SEQ ID NO: 72927 - DNA, 20 bp, synthetic construct
  misc_feature 1..20: note = CRISPR gRNA sequence
  source 1..20: mol_type = other DNA
gggacttgcaggctgggtgg

SEQ ID NO: 72928 - DNA, 20 bp, synthetic construct
  misc_feature 1..20: note = CRISPR gRNA sequence
  source 1..20: mol_type = other DNA
gcaggctgggtggaaacaaa

SEQ ID NO: 72929 - DNA, 20 bp, synthetic construct
  misc_feature 1..20: note = CRISPR gRNA sequence
  source 1..20: mol_type = other DNA
caggctgggtggaaacaaat

SEQ ID NO: 72930 - DNA, 20 bp, synthetic construct
  misc_feature 1..20: note = CRISPR gRNA sequence
  source 1..20: mol_type = other DNA
ggtggaaacaaatccagagc

SEQ ID NO: 72931 - DNA, 20 bp, synthetic construct
  misc_feature 1..20: note = CRISPR gRNA sequence
  source 1..20: mol_type = other DNA
gcccaggaggagtctctaca

SEQ ID NO: 72932 - DNA, 20 bp, synthetic construct
  misc_feature 1..20: note = CRISPR gRNA sequence
  source 1..20: mol_type = other DNA
tacatttctttgccaagctt

SEQ ID NO: 72933 - DNA, 20 bp, synthetic construct
  misc_feature 1..20: note = CRISPR gRNA sequence
  source 1..20: mol_type = other DNA
catttctttgccaagcttca

SEQ ID NO: 72934 - DNA, 20 bp, synthetic construct
  misc_feature 1..20: note = CRISPR gRNA sequence
  source 1..20: mol_type = other DNA
ctttgccaagcttcacctca

SEQ ID NO: 72935 - DNA, 20 bp, synthetic construct
  misc_feature 1..20: note = CRISPR gRNA sequence
  source 1..20: mol_type = other DNA
tttgccaagcttcacctcag

SEQ ID NO: 72936 - DNA, 20 bp, synthetic construct
  misc_feature 1..20: note = CRISPR gRNA sequence
  source 1..20: mol_type = other DNA
tgccaagcttcacctcagcc

SEQ ID NO: 72937 - DNA, 20 bp, synthetic construct
  misc_feature 1..20: note = CRISPR gRNA sequence
  source 1..20: mol_type = other DNA
gccaagcttcacctcagcct

SEQ ID NO: 72938 - DNA, 20 bp, synthetic construct
  misc_feature 1..20: note = CRISPR gRNA sequence
  source 1..20: mol_type = other DNA
ccaagcttcacctcagcctc

SEQ ID NO: 72939 - DNA, 20 bp, synthetic construct
  misc_feature 1..20: note = CRISPR gRNA sequence
  source 1..20: mol_type = other DNA
cacctcagcctctgtgtcag

SEQ ID NO: 72940 - DNA, 20 bp, synthetic construct
  misc_feature 1..20: note = CRISPR gRNA sequence
  source 1..20: mol_type = other DNA
acctcagcctctgtgtcagg

SEQ ID NO: 72941 - DNA, 20 bp, synthetic construct
  misc_feature 1..20: note = CRISPR gRNA sequence
  source 1..20: mol_type = other DNA
agcctctgtgtcagggatct

SEQ ID NO: 72942 - DNA, 20 bp, synthetic construct
  misc_feature 1..20: note = CRISPR gRNA sequence
  source 1..20: mol_type = other DNA
tgtgtcagggatctccgggc

SEQ ID NO: 72943 - DNA, 20 bp, synthetic construct
  misc_feature 1..20: note = CRISPR gRNA sequence
  source 1..20: mol_type = other DNA
tgtcagggatctccgggctg

SEQ ID NO: 72944 - DNA, 20 bp, synthetic construct
  misc_feature 1..20: note = CRISPR gRNA sequence
  source 1..20: mol_type = other DNA
cgggctggcccggctgaatg

SEQ ID NO: 72945 - DNA, 20 bp, synthetic construct
  misc_feature 1..20: note = CRISPR gRNA sequence
  source 1..20: mol_type = other DNA
gcccggctgaatgccacttt

SEQ ID NO: 72946 - DNA, 20 bp, synthetic construct
  misc_feature 1..20: note = CRISPR gRNA sequence
  source 1..20: mol_type = other DNA
aatgccactttcacgtggga

SEQ ID NO: 72947 - DNA, 20 bp, synthetic construct
  misc_feature 1..20: note = CRISPR gRNA sequence
  source 1..20: mol_type = other DNA
tcacgtgggattctctgatt

SEQ ID NO: 72948 - DNA, 20 bp, synthetic construct
  misc_feature 1..20: note = CRISPR gRNA sequence
  source 1..20: mol_type = other DNA
cacgtgggattctctgattc

SEQ ID NO: 72949 - DNA, 20 bp, synthetic construct
  misc_feature 1..20: note = CRISPR gRNA sequence
  source 1..20: mol_type = other DNA
acgtgggattctctgattca

SEQ ID NO: 72950 - DNA, 20 bp, synthetic construct
  misc_feature 1..20: note = CRISPR gRNA sequence
  source 1..20: mol_type = other DNA
tctgattcacgcagatcagt

SEQ ID NO: 72951 - DNA, 20 bp, synthetic construct
  misc_feature 1..20: note = CRISPR gRNA sequence
  source 1..20: mol_type = other DNA
tgattcacgcagatcagttc

SEQ ID NO: 72952 - DNA, 20 bp, synthetic construct
  misc_feature 1..20: note = CRISPR gRNA sequence
  source 1..20: mol_type = other DNA
attcacgcagatcagttctc

SEQ ID NO: 72953 - DNA, 20 bp, synthetic construct
  misc_feature 1..20: note = CRISPR gRNA sequence
  source 1..20: mol_type = other DNA
acgcagatcagttctcaggg

SEQ ID NO: 72954 - DNA, 20 bp, synthetic construct
  misc_feature 1..20: note = CRISPR gRNA sequence
  source 1..20: mol_type = other DNA
tcaggggcatatgtgttctc

SEQ ID NO: 72955 - DNA, 20 bp, synthetic construct
  misc_feature 1..20: note = CRISPR gRNA sequence
  source 1..20: mol_type = other DNA
aggggcatatgtgttctcat

SEQ ID NO: 72956 - DNA, 20 bp, synthetic construct
  misc_feature 1..20: note = CRISPR gRNA sequence
  source 1..20: mol_type = other DNA
tcatccatgcaaatggtagg

SEQ ID NO: 72957 - DNA, 20 bp, synthetic construct
  misc_feature 1..20: note = CRISPR gRNA sequence
  source 1..20: mol_type = other DNA
atccatgcaaatggtaggtt

SEQ ID NO: 72958 - DNA, 20 bp, synthetic construct
  misc_feature 1..20: note = CRISPR gRNA sequence
  source 1..20: mol_type = other DNA
ttccttaaacccagggtatt

SEQ ID NO: 72959 - DNA, 20 bp, synthetic construct
  misc_feature 1..20: note = CRISPR gRNA sequence
  source 1..20: mol_type = other DNA
tccttaaacccagggtattg

SEQ ID NO: 72960 - DNA, 20 bp, synthetic construct
  misc_feature 1..20: note = CRISPR gRNA sequence
  source 1..20: mol_type = other DNA
ccttaaacccagggtattgt

SEQ ID NO: 72961 - DNA, 20 bp, synthetic construct
  misc_feature 1..20: note = CRISPR gRNA sequence
  source 1..20: mol_type = other DNA
cttaaacccagggtattgtc

SEQ ID NO: 72962 - DNA, 20 bp, synthetic construct
  misc_feature 1..20: note = CRISPR gRNA sequence
  source 1..20: mol_type = other DNA
aaacccagggtattgtcttt

SEQ ID NO: 72963 - DNA, 20 bp, synthetic construct
  misc_feature 1..20: note = CRISPR gRNA sequence
  source 1..20: mol_type = other DNA
aacccagggtattgtcttta

SEQ ID NO: 72964 - DNA, 20 bp, synthetic construct
  misc_feature 1..20: note = CRISPR gRNA sequence
  source 1..20: mol_type = other DNA
tctttactgagccctgacct

SEQ ID NO: 72965 - DNA, 20 bp, synthetic construct
  misc_feature 1..20: note = CRISPR gRNA sequence
  source 1..20: mol_type = other DNA
tactgagccctgaccttgct

SEQ ID NO: 72966 - DNA, 20 bp, synthetic construct
  misc_feature 1..20: note = CRISPR gRNA sequence
  source 1..20: mol_type = other DNA
actgagccctgaccttgctc

SEQ ID NO: 72967 - DNA, 20 bp, synthetic construct
  misc_feature 1..20: note = CRISPR gRNA sequence
  source 1..20: mol_type = other DNA
ctgagccctgaccttgctct

SEQ ID NO: 72968 - DNA, 20 bp, synthetic construct
  misc_feature 1..20: note = CRISPR gRNA sequence
  source 1..20: mol_type = other DNA
agccctgaccttgctctgcc

SEQ ID NO: 72969 - DNA, 20 bp, synthetic construct
  misc_feature 1..20: note = CRISPR gRNA sequence
  source 1..20: mol_type = other DNA
accttgctctgcctgggtag

SEQ ID NO: 72970 - DNA, 20 bp, synthetic construct
  misc_feature 1..20: note = CRISPR gRNA sequence
  source 1..20: mol_type = other DNA
gctctgcctgggtaggaaaa

SEQ ID NO: 72971 - DNA, 20 bp, synthetic construct
  misc_feature 1..20: note = CRISPR gRNA sequence
  source 1..20: mol_type = other DNA
ctctgcctgggtaggaaaaa

SEQ ID NO: 72972 - DNA, 20 bp, synthetic construct
  misc_feature 1..20: note = CRISPR gRNA sequence
  source 1..20: mol_type = other DNA
tgcctgggtaggaaaaaaca

SEQ ID NO: 72973 - DNA, 20 bp, synthetic construct
  misc_feature 1..20: note = CRISPR gRNA sequence
  source 1..20: mol_type = other DNA
cctgggtaggaaaaaacaat

SEQ ID NO: 72974 - DNA, 20 bp, synthetic construct
  misc_feature 1..20: note = CRISPR gRNA sequence
  source 1..20: mol_type = other DNA
ggtaggaaaaaacaataaat

SEQ ID NO: 72975 - DNA, 20 bp, synthetic construct
  misc_feature 1..20: note = CRISPR gRNA sequence
  source 1..20: mol_type = other DNA
aggcaaatggtcttagcccc

SEQ ID NO: 72976 - DNA, 20 bp, synthetic construct
  misc_feature 1..20: note = CRISPR gRNA sequence
  source 1..20: mol_type = other DNA
agccccttgggaagtatttg

SEQ ID NO: 72977 - DNA, 20 bp, synthetic construct
  misc_feature 1..20: note = CRISPR gRNA sequence
  source 1..20: mol_type = other DNA
gccccttgggaagtatttgt

SEQ ID NO: 72978 - DNA, 20 bp, synthetic construct
  misc_feature 1..20: note = CRISPR gRNA sequence
  source 1..20: mol_type = other DNA
gggaagtatttgtttgcatg

SEQ ID NO: 72979 - DNA, 20 bp, synthetic construct
  misc_feature 1..20: note = CRISPR gRNA sequence
  source 1..20: mol_type = other DNA
ggaagtatttgtttgcatgt

SEQ ID NO: 72980 - DNA, 20 bp, synthetic construct
  misc_feature 1..20: note = CRISPR gRNA sequence
  source 1..20: mol_type = other DNA
gtttgcatgttgtttttact

SEQ ID NO: 72981 - DNA, 20 bp, synthetic construct
  misc_feature 1..20: note = CRISPR gRNA sequence
  source 1..20: mol_type = other DNA
tttgcatgttgtttttactt

SEQ ID NO: 72982 - DNA, 20 bp, synthetic construct
  misc_feature 1..20: note = CRISPR gRNA sequence
  source 1..20: mol_type = other DNA
gcatgttgtttttactttct

SEQ ID NO: 72983 - DNA, 20 bp, synthetic construct
  misc_feature 1..20: note = CRISPR gRNA sequence
  source 1..20: mol_type = other DNA
catgttgtttttactttctt

SEQ ID NO: 72984 - DNA, 20 bp, synthetic construct
  misc_feature 1..20: note = CRISPR gRNA sequence
  source 1..20: mol_type = other DNA
tttttactttcttttatttt

SEQ ID NO: 72985 - DNA, 20 bp, synthetic construct
  misc_feature 1..20: note = CRISPR gRNA sequence
  source 1..20: mol_type = other DNA
ttactttcttttattttgca

SEQ ID NO: 72986 - DNA, 20 bp, synthetic construct
  misc_feature 1..20: note = CRISPR gRNA sequence
  source 1..20: mol_type = other DNA
tactttcttttattttgcaa

SEQ ID NO: 72987 - DNA, 20 bp, synthetic construct
  misc_feature 1..20: note = CRISPR gRNA sequence
  source 1..20: mol_type = other DNA
actttcttttattttgcaaa

SEQ ID NO: 72988 - DNA, 20 bp, synthetic construct
  misc_feature 1..20: note = CRISPR gRNA sequence
  source 1..20: mol_type = other DNA
ctttcttttattttgcaaat

SEQ ID NO: 72989 - DNA, 20 bp, synthetic construct
  misc_feature 1..20: note = CRISPR gRNA sequence
  source 1..20: mol_type = other DNA
tcttttattttgcaaattaa

SEQ ID NO: 72990 - DNA, 20 bp, synthetic construct
  misc_feature 1..20: note = CRISPR gRNA sequence
  source 1..20: mol_type = other DNA
cttttattttgcaaattaaa

SEQ ID NO: 72991 - DNA, 20 bp, synthetic construct
  misc_feature 1..20: note = CRISPR gRNA sequence
  source 1..20: mol_type = other DNA
ttttattttgcaaattaaat

SEQ ID NO: 72992 - DNA, 20 bp, synthetic construct
  misc_feature 1..20: note = CRISPR gRNA sequence
  source 1..20: mol_type = other DNA
ttattttgcaaattaaattt

SEQ ID NO: 72993 - DNA, 20 bp, synthetic construct
  misc_feature 1..20: note = CRISPR gRNA sequence
  source 1..20: mol_type = other DNA
tattttgcaaattaaatttt

SEQ ID NO: 72994 - DNA, 20 bp, synthetic construct
  misc_feature 1..20: note = CRISPR gRNA sequence
  source 1..20: mol_type = other DNA
attttgcaaattaaatttta

SEQ ID NO: 72995 - DNA, 20 bp, synthetic construct
  misc_feature 1..20: note = CRISPR gRNA sequence
  source 1..20: mol_type = other DNA
ttttgcaaattaaattttaa

SEQ ID NO: 72996 - DNA, 20 bp, synthetic construct
  misc_feature 1..20: note = CRISPR gRNA sequence
  source 1..20: mol_type = other DNA
tgcaaattaaattttaatgg

SEQ ID NO: 72997 - DNA, 20 bp, synthetic construct
  misc_feature 1..20: note = CRISPR gRNA sequence
  source 1..20: mol_type = other DNA
gcaaattaaattttaatggg

SEQ ID NO: 72998 - DNA, 20 bp, synthetic construct
  misc_feature 1..20: note = CRISPR gRNA sequence
  source 1..20: mol_type = other DNA
caaattaaattttaatgggg

SEQ ID NO: 72999 - DNA, 20 bp, synthetic construct
  misc_feature 1..20: note = CRISPR gRNA sequence
  source 1..20: mol_type = other DNA
aattttaatggggctgggag

SEQ ID NO: 73000 - DNA, 20 bp, synthetic construct
  misc_feature 1..20: note = CRISPR gRNA sequence
  source 1..20: mol_type = other DNA
taatggggctgggagcagtg

SEQ ID NO: 73001 - DNA, 20 bp, synthetic construct
  misc_feature 1..20: note = CRISPR gRNA sequence
  source 1..20: mol_type = other DNA
aatggggctgggagcagtgg

SEQ ID NO: 73002 - DNA, 20 bp, synthetic construct
  misc_feature 1..20: note = CRISPR gRNA sequence
  source 1..20: mol_type = other DNA
atggggctgggagcagtggt

SEQ ID NO: 73003 - DNA, 20 bp, synthetic construct
  misc_feature 1..20: note = CRISPR gRNA sequence
  source 1..20: mol_type = other DNA
ggagcagtggttcacacctg

SEQ ID NO: 73004 - DNA, 20 bp, synthetic construct
  misc_feature 1..20: note = CRISPR gRNA sequence
  source 1..20: mol_type = other DNA
acacctgtattcccagcact

SEQ ID NO: 73005 - DNA, 20 bp, synthetic construct
  misc_feature 1..20: note = CRISPR gRNA sequence
  source 1..20: mol_type = other DNA
tattcccagcactttcggag

SEQ ID NO: 73006 - DNA, 20 bp, synthetic construct
  misc_feature 1..20: note = CRISPR gRNA sequence
  source 1..20: mol_type = other DNA
ccagcactttcggagtctag

SEQ ID NO: 73007 - DNA, 20 bp, synthetic construct
  misc_feature 1..20: note = CRISPR gRNA sequence
  source 1..20: mol_type = other DNA
tcggagtctaggcaggtgga

SEQ ID NO: 73008 - DNA, 20 bp, synthetic construct
  misc_feature 1..20: note = CRISPR gRNA sequence
  source 1..20: mol_type = other DNA
cggagtctaggcaggtggat

SEQ ID NO: 73009 - DNA, 20 bp, synthetic construct
  misc_feature 1..20: note = CRISPR gRNA sequence
  source 1..20: mol_type = other DNA
ggagtctaggcaggtggatc

SEQ ID NO: 73010 - DNA, 20 bp, synthetic construct
  misc_feature 1..20: note = CRISPR gRNA sequence
  source 1..20: mol_type = other DNA
ggcaggtggatcatttgagg

SEQ ID NO: 73011 - DNA, 20 bp, synthetic construct
  misc_feature 1..20: note = CRISPR gRNA sequence
  source 1..20: mol_type = other DNA
gaggtcaggggttcgagacc

SEQ ID NO: 73012 - DNA, 20 bp, synthetic construct
  misc_feature 1..20: note = CRISPR gRNA sequence
  source 1..20: mol_type = other DNA
aggtcaggggttcgagacca

SEQ ID NO: 73013 - DNA, 20 bp, synthetic construct
  misc_feature 1..20: note = CRISPR gRNA sequence
  source 1..20: mol_type = other DNA
gagaccagcccggccaacat

SEQ ID NO: 73014 - DNA, 20 bp, synthetic construct
  misc_feature 1..20: note = CRISPR gRNA sequence
  source 1..20: mol_type = other DNA
gtactaaaaatatacaaaaa

SEQ ID NO: 73015 - DNA, 20 bp, synthetic construct
  misc_feature 1..20: note = CRISPR gRNA sequence
  source 1..20: mol_type = other DNA
tactaaaaatatacaaaaat

SEQ ID NO: 73016 - DNA, 20 bp, synthetic construct
  misc_feature 1..20: note = CRISPR gRNA sequence
  source 1..20: mol_type = other DNA
aaaatatacaaaaattatct

SEQ ID NO: 73017 - DNA, 20 bp, synthetic construct
  misc_feature 1..20: note = CRISPR gRNA sequence
  source 1..20: mol_type = other DNA
tctgggcgtggtggtgcata

SEQ ID NO: 73018 - DNA, 20 bp, synthetic construct
  misc_feature 1..20: note = CRISPR gRNA sequence
  source 1..20: mol_type = other DNA
ggcgtggtggtgcatacctg

SEQ ID NO: 73019 - DNA, 20 bp, synthetic construct
  misc_feature 1..20: note = CRISPR gRNA sequence
  source 1..20: mol_type = other DNA
taatcccagctacttgggcg

SEQ ID NO: 73020 - DNA, 20 bp, synthetic construct
  misc_feature 1..20: note = CRISPR gRNA sequence
  source 1..20: mol_type = other DNA
cttgggcggctgaggcacca

SEQ ID NO: 73021 - DNA, 20 bp, synthetic construct
  misc_feature 1..20: note = CRISPR gRNA sequence
  source 1..20: mol_type = other DNA
gggcggctgaggcaccagaa

SEQ ID NO: 73022 - DNA, 20 bp, synthetic construct
  misc_feature 1..20: note = CRISPR gRNA sequence
  source 1..20: mol_type = other DNA
ggcggctgaggcaccagaat

SEQ ID NO: 73023 - DNA, 20 bp, synthetic construct
  misc_feature 1..20: note = CRISPR gRNA sequence
  source 1..20: mol_type = other DNA
aggcaccagaatcgcttgaa

SEQ ID NO: 73024 - DNA, 20 bp, synthetic construct
  misc_feature 1..20: note = CRISPR gRNA sequence
  source 1..20: mol_type = other DNA
gaacccaggaggcagaggtt

SEQ ID NO: 73025 - DNA, 20 bp, synthetic construct
  misc_feature 1..20: note = CRISPR gRNA sequence
  source 1..20: mol_type = other DNA
aacccaggaggcagaggttg

SEQ ID NO: 73026 - DNA, 20 bp, synthetic construct
  misc_feature 1..20: note = CRISPR gRNA sequence
  source 1..20: mol_type = other DNA
cagtgaagtgagatcatgcc

SEQ ID NO: 73027 - DNA, 20 bp, synthetic construct
  misc_feature 1..20: note = CRISPR gRNA sequence
  source 1..20: mol_type = other DNA
cactccagcctgggcgacag

SEQ ID NO: 73028 - DNA, 20 bp, synthetic construct
  misc_feature 1..20: note = CRISPR gRNA sequence
  source 1..20: mol_type = other DNA
cagcctgggcgacagagtga

SEQ ID NO: 73029 - DNA, 20 bp, synthetic construct
  misc_feature 1..20: note = CRISPR gRNA sequence
  source 1..20: mol_type = other DNA
ggcgacagagtgagactgtg

SEQ ID NO: 73030 - DNA, 20 bp, synthetic construct
  misc_feature 1..20: note = CRISPR gRNA sequence
  source 1..20: mol_type = other DNA
tgtctcaaaaaataaaaata

SEQ ID NO: 73031 - DNA, 20 bp, synthetic construct
  misc_feature 1..20: note = CRISPR gRNA sequence
  source 1..20: mol_type = other DNA
aaaaaataaaaataaaatag

SEQ ID NO: 73032 - DNA, 20 bp, synthetic construct
  misc_feature 1..20: note = CRISPR gRNA sequence
  source 1..20: mol_type = other DNA
taatggatcacctttcagta

SEQ ID NO: 73033 - DNA, 20 bp, synthetic construct
  misc_feature 1..20: note = CRISPR gRNA sequence
  source 1..20: mol_type = other DNA
aatggatcacctttcagtaa

SEQ ID NO: 73034 - DNA, 20 bp, synthetic construct
  misc_feature 1..20: note = CRISPR gRNA sequence
  source 1..20: mol_type = other DNA
atggatcacctttcagtaaa

SEQ ID NO: 73035 - DNA, 20 bp, synthetic construct
  misc_feature 1..20: note = CRISPR gRNA sequence
  source 1..20: mol_type = other DNA
tcagtaaattaattttgggt

SEQ ID NO: 73036 - DNA, 20 bp, synthetic construct
  misc_feature 1..20: note = CRISPR gRNA sequence
  source 1..20: mol_type = other DNA
cagtaaattaattttgggtg

SEQ ID NO: 73037 - DNA, 20 bp, synthetic construct
  misc_feature 1..20: note = CRISPR gRNA sequence
  source 1..20: mol_type = other DNA
agtaaattaattttgggtga

SEQ ID NO: 73038 - DNA, 20 bp, synthetic construct
  misc_feature 1..20: note = CRISPR gRNA sequence
  source 1..20: mol_type = other DNA
attttgggtgaaatggtcca

SEQ ID NO: 73039 - DNA, 20 bp, synthetic construct
  misc_feature 1..20: note = CRISPR gRNA sequence
  source 1..20: mol_type = other DNA
tgggtgaaatggtccaatat

SEQ ID NO: 73040 - DNA, 20 bp, synthetic construct
  misc_feature 1..20: note = CRISPR gRNA sequence
  source 1..20: mol_type = other DNA
gggtgaaatggtccaatatg

SEQ ID NO: 73041 - DNA, 20 bp, synthetic construct
  misc_feature 1..20: note = CRISPR gRNA sequence
  source 1..20: mol_type = other DNA
ggtgaaatggtccaatatga

SEQ ID NO: 73042 - DNA, 20 bp, synthetic construct
  misc_feature 1..20: note = CRISPR gRNA sequence
  source 1..20: mol_type = other DNA
ctggaactctctaacctcat

SEQ ID NO: 73043 - DNA, 20 bp, synthetic construct
  misc_feature 1..20: note = CRISPR gRNA sequence
  source 1..20: mol_type = other DNA
gaactctctaacctcatttc

SEQ ID NO: 73044 - DNA, 20 bp, synthetic construct
  misc_feature 1..20: note = CRISPR gRNA sequence
  source 1..20: mol_type = other DNA
tctaacctcatttcctacct

SEQ ID NO: 73045 - DNA, 20 bp, synthetic construct
  misc_feature 1..20: note = CRISPR gRNA sequence
  source 1..20: mol_type = other DNA
taacctcatttcctacctac

SEQ ID NO: 73046 - DNA, 20 bp, synthetic construct
  misc_feature 1..20: note = CRISPR gRNA sequence
  source 1..20: mol_type = other DNA
acctcatttcctacctactc

SEQ ID NO: 73047 - DNA, 20 bp, synthetic construct
  misc_feature 1..20: note = CRISPR gRNA sequence
  source 1..20: mol_type = other DNA
atttcctacctactctgctc

SEQ ID NO: 73048 - DNA, 20 bp, synthetic construct
  misc_feature 1..20: note = CRISPR gRNA sequence
  source 1..20: mol_type = other DNA
cctacctactctgctctgcc

SEQ ID NO: 73049 - DNA, 20 bp, synthetic construct
  misc_feature 1..20: note = CRISPR gRNA sequence
  source 1..20: mol_type = other DNA
ctacctactctgctctgccc

SEQ ID NO: 73050 - DNA, 20 bp, synthetic construct
  misc_feature 1..20: note = CRISPR gRNA sequence
  source 1..20: mol_type = other DNA
cctactctgctctgcccgag

SEQ ID NO: 73051 - DNA, 20 bp, synthetic construct
  misc_feature 1..20: note = CRISPR gRNA sequence
  source 1..20: mol_type = other DNA
ctctgctctgcccgaggtag

SEQ ID NO: 73052 - DNA, 20 bp, synthetic construct
  misc_feature 1..20: note = CRISPR gRNA sequence
  source 1..20: mol_type = other DNA
tgctctgcccgaggtagggg

SEQ ID NO: 73053 - DNA, 20 bp, synthetic construct
  misc_feature 1..20: note = CRISPR gRNA sequence
  source 1..20: mol_type = other DNA
ctctgcccgaggtagggggt

SEQ ID NO: 73054 - DNA, 20 bp, synthetic construct
  misc_feature 1..20: note = CRISPR gRNA sequence
  source 1..20: mol_type = other DNA
tgcccgaggtagggggtagg

SEQ ID NO: 73055 - DNA, 20 bp, synthetic construct
  misc_feature 1..20: note = CRISPR gRNA sequence
  source 1..20: mol_type = other DNA
cccgaggtagggggtaggag

SEQ ID NO: 73056 - DNA, 20 bp, synthetic construct
  misc_feature 1..20: note = CRISPR gRNA sequence
  source 1..20: mol_type = other DNA
ggatataaacaaagcaatgc

SEQ ID NO: 73057 - DNA, 20 bp, synthetic construct
  misc_feature 1..20: note = CRISPR gRNA sequence
  source 1..20: mol_type = other DNA
gatataaacaaagcaatgct

SEQ ID NO: 73058 - DNA, 20 bp, synthetic construct
  misc_feature 1..20: note = CRISPR gRNA sequence
  source 1..20: mol_type = other DNA
tgtgtcactgcttggatttg

SEQ ID NO: 73059 - DNA, 20 bp, synthetic construct
  misc_feature 1..20: note = CRISPR gRNA sequence
  source 1..20: mol_type = other DNA
gtgtcactgcttggatttgt

SEQ ID NO: 73060 - DNA, 20 bp, synthetic construct
  misc_feature 1..20: note = CRISPR gRNA sequence
  source 1..20: mol_type = other DNA
tgtcactgcttggatttgtt

SEQ ID NO: 73061 - DNA, 20 bp, synthetic construct
  misc_feature 1..20: note = CRISPR gRNA sequence
  source 1..20: mol_type = other DNA
cttggatttgtttttagtca

SEQ ID NO: 73062 - DNA, 20 bp, synthetic construct
  misc_feature 1..20: note = CRISPR gRNA sequence
  source 1..20: mol_type = other DNA
ggatttgtttttagtcacaa

SEQ ID NO: 73063 - DNA, 20 bp, synthetic construct
  misc_feature 1..20: note = CRISPR gRNA sequence
  source 1..20: mol_type = other DNA
gatttgtttttagtcacaag

SEQ ID NO: 73064 - DNA, 20 bp, synthetic construct
  misc_feature 1..20: note = CRISPR gRNA sequence
  source 1..20: mol_type = other DNA
gtttttagtcacaagatttc

SEQ ID NO: 73065 - DNA, 20 bp, synthetic construct
  misc_feature 1..20: note = CRISPR gRNA sequence
  source 1..20: mol_type = other DNA
tttttagtcacaagatttca

SEQ ID NO: 73066 - DNA, 20 bp, synthetic construct
  misc_feature 1..20: note = CRISPR gRNA sequence
  source 1..20: mol_type = other DNA
ttagtcacaagatttcatgt

SEQ ID NO: 73067 - DNA, 20 bp, synthetic construct
  misc_feature 1..20: note = CRISPR gRNA sequence
  source 1..20: mol_type = other DNA
tagtcacaagatttcatgtt

SEQ ID NO: 73068 - DNA, 20 bp, synthetic construct
  misc_feature 1..20: note = CRISPR gRNA sequence
  source 1..20: mol_type = other DNA
agtcacaagatttcatgttt

SEQ ID NO: 73069 - DNA, 20 bp, synthetic construct
  misc_feature 1..20: note = CRISPR gRNA sequence
  source 1..20: mol_type = other DNA
gtcacaagatttcatgtttt

SEQ ID NO: 73070 - DNA, 20 bp, synthetic construct
  misc_feature 1..20: note = CRISPR gRNA sequence
  source 1..20: mol_type = other DNA
catgttttgaaaaatcacat

SEQ ID NO: 73071 - DNA, 20 bp, synthetic construct
  misc_feature 1..20: note = CRISPR gRNA sequence
  source 1..20: mol_type = other DNA
atgttttgaaaaatcacatt

SEQ ID NO: 73072 - DNA, 20 bp, synthetic construct
  misc_feature 1..20: note = CRISPR gRNA sequence
  source 1..20: mol_type = other DNA
tgaaaaatcacattgaaagt

SEQ ID NO: 73073 - DNA, 20 bp, synthetic construct
  misc_feature 1..20: note = CRISPR gRNA sequence
  source 1..20: mol_type = other DNA
gaaaaatcacattgaaagta

SEQ ID NO: 73074 - DNA, 20 bp, synthetic construct
  misc_feature 1..20: note = CRISPR gRNA sequence
  source 1..20: mol_type = other DNA
aaaaatcacattgaaagtaa

SEQ ID NO: 73075 - DNA, 20 bp, synthetic construct
  misc_feature 1..20: note = CRISPR gRNA sequence
  source 1..20: mol_type = other DNA
aaagtaagtgtcatgtttat

SEQ ID NO: 73076 - DNA, 20 bp, synthetic construct
  misc_feature 1..20: note = CRISPR gRNA sequence
  source 1..20: mol_type = other DNA
atttatcctagcagcaggga

SEQ ID NO: 73077 - DNA, 20 bp, synthetic construct
  misc_feature 1..20: note = CRISPR gRNA sequence
  source 1..20: mol_type = other DNA
tttatcctagcagcagggag

SEQ ID NO: 73078 - DNA, 20 bp, synthetic construct
  misc_feature 1..20: note = CRISPR gRNA sequence
  source 1..20: mol_type = other DNA
atcctagcagcagggagtga

SEQ ID NO: 73079 - DNA, 20 bp, synthetic construct
  misc_feature 1..20: note = CRISPR gRNA sequence
  source 1..20: mol_type = other DNA
tcctagcagcagggagtgaa

SEQ ID NO: 73080 - DNA, 20 bp, synthetic construct
  misc_feature 1..20: note = CRISPR gRNA sequence
  source 1..20: mol_type = other DNA
gcagcagggagtgaaatcac

SEQ ID NO: 73081 - DNA, 20 bp, synthetic construct
  misc_feature 1..20: note = CRISPR gRNA sequence
  source 1..20: mol_type = other DNA
agtctagacccacactactc

SEQ ID NO: 73082 - DNA, 20 bp, synthetic construct
  misc_feature 1..20: note = CRISPR gRNA sequence
  source 1..20: mol_type = other DNA
gacccacactactcaaagtg

SEQ ID NO: 73083 - DNA, 20 bp, synthetic construct
  misc_feature 1..20: note = CRISPR gRNA sequence
  source 1..20: mol_type = other DNA
ctcaaagtgctgaccgtggc

SEQ ID NO: 73084 - DNA, 20 bp, synthetic construct
  misc_feature 1..20: note = CRISPR gRNA sequence
  source 1..20: mol_type = other DNA
aaagtgctgaccgtggcccc

SEQ ID NO: 73085 - DNA, 20 bp, synthetic construct
  misc_feature 1..20: note = CRISPR gRNA sequence
  source 1..20: mol_type = other DNA
accgtggcccccagaattga

SEQ ID NO: 73086 - DNA, 20 bp, synthetic construct
  misc_feature 1..20: note = CRISPR gRNA sequence
  source 1..20: mol_type = other DNA
ataccacccggaagcttgtt

SEQ ID NO: 73087 - DNA, 20 bp, synthetic construct
  misc_feature 1..20: note = CRISPR gRNA sequence
  source 1..20: mol_type = other DNA
gttagaaaatgcagagtctg

SEQ ID NO: 73088 - DNA, 20 bp, synthetic construct
  misc_feature 1..20: note = CRISPR gRNA sequence
  source 1..20: mol_type = other DNA
ttagaaaatgcagagtctga

SEQ ID NO: 73089 - DNA, 20 bp, synthetic construct
  misc_feature 1..20: note = CRISPR gRNA sequence
  source 1..20: mol_type = other DNA
gaaaatgcagagtctgaagc

SEQ ID NO: 73090 - DNA, 20 bp, synthetic construct
  misc_feature 1..20: note = CRISPR gRNA sequence
  source 1..20: mol_type = other DNA
aagccaggcgtggtggctca

SEQ ID NO: 73091 - DNA, 20 bp, synthetic construct
  misc_feature 1..20: note = CRISPR gRNA sequence
  source 1..20: mol_type = other DNA
acgcctgtaatcccagcact

SEQ ID NO: 73092 - DNA, 20 bp, synthetic construct
  misc_feature 1..20: note = CRISPR gRNA sequence
  source 1..20: mol_type = other DNA
taatcccagcactttgggag

SEQ ID NO: 73093 - DNA, 20 bp, synthetic construct
  misc_feature 1..20: note = CRISPR gRNA sequence
  source 1..20: mol_type = other DNA
tgggaggccgaggtgggcag

SEQ ID NO: 73094 - DNA, 20 bp, synthetic construct
  misc_feature 1..20: note = CRISPR gRNA sequence
  source 1..20: mol_type = other DNA
gggaggccgaggtgggcaga

SEQ ID NO: 73095 - DNA, 20 bp, synthetic construct
  misc_feature 1..20: note = CRISPR gRNA sequence
  source 1..20: mol_type = other DNA
ggaggccgaggtgggcagat

SEQ ID NO: 73096 - DNA, 20 bp, synthetic construct
  misc_feature 1..20: note = CRISPR gRNA sequence
  source 1..20: mol_type = other DNA
aggttggacgttcaagacca

SEQ ID NO: 73097 - DNA, 20 bp, synthetic construct
  misc_feature 1..20: note = CRISPR gRNA sequence
  source 1..20: mol_type = other DNA
gacgttcaagaccagcctga

SEQ ID NO: 73098 - DNA, 20 bp, synthetic construct
  misc_feature 1..20: note = CRISPR gRNA sequence
  source 1..20: mol_type = other DNA
aagaccagcctgaccaacat

SEQ ID NO: 73099 - DNA, 20 bp, synthetic construct
  misc_feature 1..20: note = CRISPR gRNA sequence
  source 1..20: mol_type = other DNA
accaacatggagaaacactg

SEQ ID NO: 73100 - DNA, 20 bp, synthetic construct
  misc_feature 1..20: note = CRISPR gRNA sequence
  source 1..20: mol_type = other DNA
tctctaccaaaaatacaaaa

SEQ ID NO: 73101 - DNA, 20 bp, synthetic construct
  misc_feature 1..20: note = CRISPR gRNA sequence
  source 1..20: mol_type = other DNA
taccaaaaatacaaaaatta

SEQ ID NO: 73102 - DNA, 20 bp, synthetic construct
  misc_feature 1..20: note = CRISPR gRNA sequence
  source 1..20: mol_type = other DNA
ccaaaaatacaaaaattagc

SEQ ID NO: 73103 - DNA, 20 bp, synthetic construct
  misc_feature 1..20: note = CRISPR gRNA sequence
  source 1..20: mol_type = other DNA
gccgggcgtggtggcacatg

SEQ ID NO: 73104 - DNA, 20 bp, synthetic construct
  misc_feature 1..20: note = CRISPR gRNA sequence
  source 1..20: mol_type = other DNA
taatcccggctactcgggag

SEQ ID NO: 73105 - DNA, 20 bp, synthetic construct
  misc_feature 1..20: note = CRISPR gRNA sequence
  source 1..20: mol_type = other DNA
ctcgggaggctgaggcagga

SEQ ID NO: 73106 - DNA, 20 bp, synthetic construct
  misc_feature 1..20: note = CRISPR gRNA sequence
  source 1..20: mol_type = other DNA
gggaggctgaggcaggagaa

SEQ ID NO: 73107 - DNA, 20 bp, synthetic construct
  misc_feature 1..20: note = CRISPR gRNA sequence
  source 1..20: mol_type = other DNA
aggcaggagaatcgcttgaa

SEQ ID NO: 73108 - DNA, 20 bp, synthetic construct
  misc_feature 1..20: note = CRISPR gRNA sequence
  source 1..20: mol_type = other DNA
gaacccgggaggcggaggtt

SEQ ID NO: 73109 - DNA, 20 bp, synthetic construct
  misc_feature 1..20: note = CRISPR gRNA sequence
  source 1..20: mol_type = other DNA
aacccgggaggcggaggttg

SEQ ID NO: 73110 - DNA, 20 bp, synthetic construct
  misc_feature 1..20: note = CRISPR gRNA sequence
  source 1..20: mol_type = other DNA
cagtgagctgagattgtgcc

SEQ ID NO: 73111 - DNA, 20 bp, synthetic construct
  misc_feature 1..20: note = CRISPR gRNA sequence
  source 1..20: mol_type = other DNA
agattgtgccattgcactcc

SEQ ID NO: 73112 - DNA, 20 bp, synthetic construct
  misc_feature 1..20: note = CRISPR gRNA sequence
  source 1..20: mol_type = other DNA
tgccattgcactccagcctg

SEQ ID NO: 73113 - DNA, 20 bp, synthetic construct
  misc_feature 1..20: note = CRISPR gRNA sequence
  source 1..20: mol_type = other DNA
cactccagcctgggcaacaa

SEQ ID NO: 73114 - DNA, 20 bp, synthetic construct
  misc_feature 1..20: note = CRISPR gRNA sequence
  source 1..20: mol_type = other DNA
cagcctgggcaacaagagcg

SEQ ID NO: 73115 - DNA, 20 bp, synthetic construct
  misc_feature 1..20: note = CRISPR gRNA sequence
  source 1..20: mol_type = other DNA
ggcaacaagagcgaaactct

SEQ ID NO: 73116 - DNA, 20 bp, synthetic construct
  misc_feature 1..20: note = CRISPR gRNA sequence
  source 1..20: mol_type = other DNA
tgtctcaaaaacaaacaaac

SEQ ID NO: 73117 - DNA, 20 bp, synthetic construct
  misc_feature 1..20: note = CRISPR gRNA sequence
  source 1..20: mol_type = other DNA
tctcaaaaacaaacaaacaa

SEQ ID NO: 73118 - DNA, 20 bp, synthetic construct
  misc_feature 1..20: note = CRISPR gRNA sequence
  source 1..20: mol_type = other DNA
aaaaacaaacaaacaaaaaa

SEQ ID NO: 73119 - DNA, 20 bp, synthetic construct
  misc_feature 1..20: note = CRISPR gRNA sequence
  source 1..20: mol_type = other DNA
agtttgggtgcaacgcctta

SEQ ID NO: 73120 - DNA, 20 bp, synthetic construct
  misc_feature 1..20: note = CRISPR gRNA sequence
  source 1..20: mol_type = other DNA
gggtgcaacgccttaggcct

SEQ ID NO: 73121 - DNA, 20 bp, synthetic construct
  misc_feature 1..20: note = CRISPR gRNA sequence
  source 1..20: mol_type = other DNA
ggtgcaacgccttaggcctg

SEQ ID NO: 73122 - DNA, 20 bp, synthetic construct
  misc_feature 1..20: note = CRISPR gRNA sequence
  source 1..20: mol_type = other DNA
aggcctgtagtcccagctgc

SEQ ID NO: 73123 - DNA, 20 bp, synthetic construct
  misc_feature 1..20: note = CRISPR gRNA sequence
  source 1..20: mol_type = other DNA
ggcctgtagtcccagctgct

SEQ ID NO: 73124 - DNA, 20 bp, synthetic construct
  misc_feature 1..20: note = CRISPR gRNA sequence
  source 1..20: mol_type = other DNA
tagtcccagctgcttaggag

SEQ ID NO: 73125 - DNA, 20 bp, synthetic construct
  misc_feature 1..20: note = CRISPR gRNA sequence
  source 1..20: mol_type = other DNA
cttaggagggtgaggcagga

SEQ ID NO: 73126 - DNA, 20 bp, synthetic construct
  misc_feature 1..20: note = CRISPR gRNA sequence
  source 1..20: mol_type = other DNA
aggagggtgaggcaggagga

SEQ ID NO: 73127 - DNA, 20 bp, synthetic construct
  misc_feature 1..20: note = CRISPR gRNA sequence
  source 1..20: mol_type = other DNA
ggagggtgaggcaggaggat

SEQ ID NO: 73128 - DNA, 20 bp, synthetic construct
  misc_feature 1..20: note = CRISPR gRNA sequence
  source 1..20: mol_type = other DNA
gcccaggagtttgaggctgc

SEQ ID NO: 73129 - DNA, 20 bp, synthetic construct
  misc_feature 1..20: note = CRISPR gRNA sequence
  source 1..20: mol_type = other DNA
gaggctgcagtgcaacacga

SEQ ID NO: 73130 - DNA, 20 bp, synthetic construct
  misc_feature 1..20: note = CRISPR gRNA sequence
  source 1..20: mol_type = other DNA
aggctgcagtgcaacacgat

SEQ ID NO: 73131 - DNA, 20 bp, synthetic construct
  misc_feature 1..20: note = CRISPR gRNA sequence
  source 1..20: mol_type = other DNA
cagtgcaacacgattgcacc

SEQ ID NO: 73132 - DNA, 20 bp, synthetic construct
  misc_feature 1..20: note = CRISPR gRNA sequence
  source 1..20: mol_type = other DNA
cacctgtgcattgccactgc

SEQ ID NO: 73133 - DNA, 20 bp, synthetic construct
  misc_feature 1..20: note = CRISPR gRNA sequence
  source 1..20: mol_type = other DNA
tgcattgccactgcactcca

SEQ ID NO: 73134 - DNA, 20 bp, synthetic construct
  misc_feature 1..20: note = CRISPR gRNA sequence
  source 1..20: mol_type = other DNA
ccactgcactccagcctggg

SEQ ID NO: 73135 - DNA, 20 bp, synthetic construct
  misc_feature 1..20: note = CRISPR gRNA sequence
  source 1..20: mol_type = other DNA
cactccagcctgggccacac

SEQ ID NO: 73136 - DNA, 20 bp, synthetic construct
  misc_feature 1..20: note = CRISPR gRNA sequence
  source 1..20: mol_type = other DNA
cagcctgggccacacagtga

SEQ ID NO: 73137 - DNA, 20 bp, synthetic construct
  misc_feature 1..20: note = CRISPR gRNA sequence
  source 1..20: mol_type = other DNA
ggccacacagtgaggcccca

SEQ ID NO: 73138 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 73139 - DNA, 20 bp, synthetic construct
  misc_feature 1..20: note = CRISPR gRNA sequence
  source 1..20: mol_type = other DNA
ggcagaattccagacctggg

SEQ ID NO: 73140 - DNA, 20 bp, synthetic construct
  misc_feature 1..20: note = CRISPR gRNA sequence
  source 1..20: mol_type = other DNA
cagacctggggaatcagaat

SEQ ID NO: 73141 - DNA, 20 bp, synthetic construct
  misc_feature 1..20: note = CRISPR gRNA sequence
  source 1..20: mol_type = other DNA
gggaatcagaatgagcattt

SEQ ID NO: 73142 - DNA, 20 bp, synthetic construct
  misc_feature 1..20: note = CRISPR gRNA sequence
  source 1..20: mol_type = other DNA
taacaagagcccagggtgaa

SEQ ID NO: 73143 - DNA, 20 bp, synthetic construct
  misc_feature 1..20: note = CRISPR gRNA sequence
  source 1..20: mol_type = other DNA
aacaagagcccagggtgaac

SEQ ID NO: 73144 - DNA, 20 bp, synthetic construct
  misc_feature 1..20: note = CRISPR gRNA sequence
  source 1..20: mol_type = other DNA
acaagagcccagggtgaact

SEQ ID NO: 73145 - DNA, 20 bp, synthetic construct
  misc_feature 1..20: note = CRISPR gRNA sequence
  source 1..20: mol_type = other DNA
tgtgtgtgcctcaagggttg

SEQ ID NO: 73146 - DNA, 20 bp, synthetic construct
  misc_feature 1..20: note = CRISPR gRNA sequence
  source 1..20: mol_type = other DNA
aagggttgttctacgacgtg

SEQ ID NO: 73147 - DNA, 20 bp, synthetic construct
  misc_feature 1..20: note = CRISPR gRNA sequence
  source 1..20: mol_type = other DNA
ttctacgacgtgggcctaag

SEQ ID NO: 73148 - DNA, 20 bp, synthetic construct
  misc_feature 1..20: note = CRISPR gRNA sequence
  source 1..20: mol_type = other DNA
tacgacgtgggcctaagccc

SEQ ID NO: 73149 - DNA, 20 bp, synthetic construct
  misc_feature 1..20: note = CRISPR gRNA sequence
  source 1..20: mol_type = other DNA
cgacgtgggcctaagccctt

SEQ ID NO: 73150 - DNA, 20 bp, synthetic construct
  misc_feature 1..20: note = CRISPR gRNA sequence
  source 1..20: mol_type = other DNA
agccctttaggccacttttg

SEQ ID NO: 73151 - DNA, 20 bp, synthetic construct
  misc_feature 1..20: note = CRISPR gRNA sequence
  source 1..20: mol_type = other DNA
taggccacttttgtaaccag

SEQ ID NO: 73152 - DNA, 20 bp, synthetic construct
  misc_feature 1..20: note = CRISPR gRNA sequence
  source 1..20: mol_type = other DNA
aggccacttttgtaaccagg

SEQ ID NO: 73153 - DNA, 20 bp, synthetic construct
  misc_feature 1..20: note = CRISPR gRNA sequence
  source 1..20: mol_type = other DNA
ggccacttttgtaaccagga

SEQ ID NO: 73154 - DNA, 20 bp, synthetic construct
  misc_feature 1..20: note = CRISPR gRNA sequence
  source 1..20: mol_type = other DNA
ttgtaaccaggaggaagctg

SEQ ID NO: 73155 - DNA, 20 bp, synthetic construct
  misc_feature 1..20: note = CRISPR gRNA sequence
  source 1..20: mol_type = other DNA
tgtaaccaggaggaagctga

SEQ ID NO: 73156 - DNA, 20 bp, synthetic construct
  misc_feature 1..20: note = CRISPR gRNA sequence
  source 1..20: mol_type = other DNA
gtaaccaggaggaagctgat

SEQ ID NO: 73157 - DNA, 20 bp, synthetic construct
  misc_feature 1..20: note = CRISPR gRNA sequence
  source 1..20: mol_type = other DNA
taaccaggaggaagctgatg

SEQ ID NO: 73158 - DNA, 20 bp, synthetic construct
  misc_feature 1..20: note = CRISPR gRNA sequence
  source 1..20: mol_type = other DNA
atggcattagaaggcaagag

SEQ ID NO: 73159 - DNA, 20 bp, synthetic construct
  misc_feature 1..20: note = CRISPR gRNA sequence
  source 1..20: mol_type = other DNA
gaaggcaagagcagtgggca

SEQ ID NO: 73160 - DNA, 20 bp, synthetic construct
  misc_feature 1..20: note = CRISPR gRNA sequence
  source 1..20: mol_type = other DNA
ggagggcacagggatgggcc

SEQ ID NO: 73161 - DNA, 20 bp, synthetic construct
  misc_feature 1..20: note = CRISPR gRNA sequence
  source 1..20: mol_type = other DNA
ggagggatccgcaaaggatc

SEQ ID NO: 73162 - DNA, 20 bp, synthetic construct
  misc_feature 1..20: note = CRISPR gRNA sequence
  source 1..20: mol_type = other DNA
ggaggtggcctcagtgcttc

SEQ ID NO: 73163 - DNA, 20 bp, synthetic construct
  misc_feature 1..20: note = CRISPR gRNA sequence
  source 1..20: mol_type = other DNA
agtgcttccctggatgtggt

SEQ ID NO: 73164 - DNA, 20 bp, synthetic construct
  misc_feature 1..20: note = CRISPR gRNA sequence
  source 1..20: mol_type = other DNA
ccctggatgtggtcccaact

SEQ ID NO: 73165 - DNA, 20 bp, synthetic construct
  misc_feature 1..20: note = CRISPR gRNA sequence
  source 1..20: mol_type = other DNA
cctggatgtggtcccaactg

SEQ ID NO: 73166 - DNA, 20 bp, synthetic construct
  misc_feature 1..20: note = CRISPR gRNA sequence
  source 1..20: mol_type = other DNA
gatgtggtcccaactgagtg

SEQ ID NO: 73167 - DNA, 20 bp, synthetic construct
  misc_feature 1..20: note = CRISPR gRNA sequence
  source 1..20: mol_type = other DNA
agtgggaagtgtttcttccc

SEQ ID NO: 73168 - DNA, 20 bp, synthetic construct
  misc_feature 1..20: note = CRISPR gRNA sequence
  source 1..20: mol_type = other DNA
cttcccactcattcccatgg

SEQ ID NO: 73169 - DNA, 20 bp, synthetic construct
  misc_feature 1..20: note = CRISPR gRNA sequence
  source 1..20: mol_type = other DNA
ttcccactcattcccatggg

SEQ ID NO: 73170 - DNA, 20 bp, synthetic construct
  misc_feature 1..20: note = CRISPR gRNA sequence
  source 1..20: mol_type = other DNA
cccactcattcccatggggc

SEQ ID NO: 73171 - DNA, 20 bp, synthetic construct
  misc_feature 1..20: note = CRISPR gRNA sequence
  source 1..20: mol_type = other DNA
ccactcattcccatggggcc

SEQ ID NO: 73172 - DNA, 20 bp, synthetic construct
  misc_feature 1..20: note = CRISPR gRNA sequence
  source 1..20: mol_type = other DNA
attcccatggggccgctcgg

SEQ ID NO: 73173 - DNA, 20 bp, synthetic construct
  misc_feature 1..20: note = CRISPR gRNA sequence
  source 1..20: mol_type = other DNA
ccatggggccgctcggtcac

SEQ ID NO: 73174 - DNA, 20 bp, synthetic construct
  misc_feature 1..20: note = CRISPR gRNA sequence
  source 1..20: mol_type = other DNA
ggtcactcacctgaggctct

SEQ ID NO: 73175 - DNA, 20 bp, synthetic construct
  misc_feature 1..20: note = CRISPR gRNA sequence
  source 1..20: mol_type = other DNA
acctgaggctctgcaggcag

SEQ ID NO: 73176 - DNA, 20 bp, synthetic construct
  misc_feature 1..20: note = CRISPR gRNA sequence
  source 1..20: mol_type = other DNA
aggctctgcaggcaggtcat

SEQ ID NO: 73177 - DNA, 20 bp, synthetic construct
  misc_feature 1..20: note = CRISPR gRNA sequence
  source 1..20: mol_type = other DNA
tgcaggcaggtcatctggct

SEQ ID NO: 73178 - DNA, 20 bp, synthetic construct
  misc_feature 1..20: note = CRISPR gRNA sequence
  source 1..20: mol_type = other DNA
caggcaggtcatctggctta

SEQ ID NO: 73179 - DNA, 20 bp, synthetic construct
  misc_feature 1..20: note = CRISPR gRNA sequence
  source 1..20: mol_type = other DNA
gcttagtctgtgagtaagca

SEQ ID NO: 73180 - DNA, 20 bp, synthetic construct
  misc_feature 1..20: note = CRISPR gRNA sequence
  source 1..20: mol_type = other DNA
agtctgtgagtaagcaaggc

SEQ ID NO: 73181 - DNA, 20 bp, synthetic construct
  misc_feature 1..20: note = CRISPR gRNA sequence
  source 1..20: mol_type = other DNA
gtctgtgagtaagcaaggcc

SEQ ID NO: 73182 - DNA, 20 bp, synthetic construct
  misc_feature 1..20: note = CRISPR gRNA sequence
  source 1..20: mol_type = other DNA
tgagtaagcaaggccaaggt

SEQ ID NO: 73183 - DNA, 20 bp, synthetic construct
  misc_feature 1..20: note = CRISPR gRNA sequence
  source 1..20: mol_type = other DNA
ttcagcagaaggtgactgag

SEQ ID NO: 73184 - DNA, 20 bp, synthetic construct
  misc_feature 1..20: note = CRISPR gRNA sequence
  source 1..20: mol_type = other DNA
agcagaaggtgactgaggct

SEQ ID NO: 73185 - DNA, 20 bp, synthetic construct
  misc_feature 1..20: note = CRISPR gRNA sequence
  source 1..20: mol_type = other DNA
aggctggagaagaggaggcc

SEQ ID NO: 73186 - DNA, 20 bp, synthetic construct
  misc_feature 1..20: note = CRISPR gRNA sequence
  source 1..20: mol_type = other DNA
gagaagaggaggccaggtga

SEQ ID NO: 73187 - DNA, 20 bp, synthetic construct
  misc_feature 1..20: note = CRISPR gRNA sequence
  source 1..20: mol_type = other DNA
gacatctgggggtggggcac

SEQ ID NO: 73188 - DNA, 20 bp, synthetic construct
  misc_feature 1..20: note = CRISPR gRNA sequence
  source 1..20: mol_type = other DNA
acatctgggggtggggcact

SEQ ID NO: 73189 - DNA, 20 bp, synthetic construct
  misc_feature 1..20: note = CRISPR gRNA sequence
  source 1..20: mol_type = other DNA
ggggtggggcactgtccagt

SEQ ID NO: 73190 - DNA, 20 bp, synthetic construct
  misc_feature 1..20: note = CRISPR gRNA sequence
  source 1..20: mol_type = other DNA
tccagtctgggggtctgagg

SEQ ID NO: 73191 - DNA, 20 bp, synthetic construct
  misc_feature 1..20: note = CRISPR gRNA sequence
  source 1..20: mol_type = other DNA
ggggtctgaggcctctgtgc

SEQ ID NO: 73192 - DNA, 20 bp, synthetic construct
  misc_feature 1..20: note = CRISPR gRNA sequence
  source 1..20: mol_type = other DNA
aggcctctgtgcttagcaag

SEQ ID NO: 73193 - DNA, 20 bp, synthetic construct
  misc_feature 1..20: note = CRISPR gRNA sequence
  source 1..20: mol_type = other DNA
tgtgcttagcaagcctaggg

SEQ ID NO: 73194 - DNA, 20 bp, synthetic construct
  misc_feature 1..20: note = CRISPR gRNA sequence
  source 1..20: mol_type = other DNA
tgcttagcaagcctagggac

SEQ ID NO: 73195 - DNA, 20 bp, synthetic construct
  misc_feature 1..20: note = CRISPR gRNA sequence
  source 1..20: mol_type = other DNA
agcaagcctagggacctcca

SEQ ID NO: 73196 - DNA, 20 bp, synthetic construct
  misc_feature 1..20: note = CRISPR gRNA sequence
  source 1..20: mol_type = other DNA
gcaagcctagggacctccaa

SEQ ID NO: 73197 - DNA, 20 bp, synthetic construct
  misc_feature 1..20: note = CRISPR gRNA sequence
  source 1..20: mol_type = other DNA
gggacctccaagacagccac

SEQ ID NO: 73198 - DNA, 20 bp, synthetic construct
  misc_feature 1..20: note = CRISPR gRNA sequence
  source 1..20: mol_type = other DNA
caagacagccacttatatcc

SEQ ID NO: 73199 - DNA, 20 bp, synthetic construct
  misc_feature 1..20: note = CRISPR gRNA sequence
  source 1..20: mol_type = other DNA
atatccacacagtgtaaaaa

SEQ ID NO: 73200 - DNA, 20 bp, synthetic construct
  misc_feature 1..20: note = CRISPR gRNA sequence
  source 1..20: mol_type = other DNA
tatccacacagtgtaaaaat

SEQ ID NO: 73201 - DNA, 20 bp, synthetic construct
  misc_feature 1..20: note = CRISPR gRNA sequence
  source 1..20: mol_type = other DNA
tacaaaatgaactgtactgg

SEQ ID NO: 73202 - DNA, 20 bp, synthetic construct
  misc_feature 1..20: note = CRISPR gRNA sequence
  source 1..20: mol_type = other DNA
caaaatgaactgtactggga

SEQ ID NO: 73203 - DNA, 20 bp, synthetic construct
  misc_feature 1..20: note = CRISPR gRNA sequence
  source 1..20: mol_type = other DNA
tactgggaggtccaaatgct

SEQ ID NO: 73204 - DNA, 20 bp, synthetic construct
  misc_feature 1..20: note = CRISPR gRNA sequence
  source 1..20: mol_type = other DNA
ggaggtccaaatgctgtttc

SEQ ID NO: 73205 - DNA, 20 bp, synthetic construct
  misc_feature 1..20: note = CRISPR gRNA sequence
  source 1..20: mol_type = other DNA
tttctctgcatgaattactg

SEQ ID NO: 73206 - DNA, 20 bp, synthetic construct
  misc_feature 1..20: note = CRISPR gRNA sequence
  source 1..20: mol_type = other DNA
ctctgcatgaattactgagg

SEQ ID NO: 73207 - DNA, 20 bp, synthetic construct
  misc_feature 1..20: note = CRISPR gRNA sequence
  source 1..20: mol_type = other DNA
tctgcatgaattactgaggt

SEQ ID NO: 73208 - DNA, 20 bp, synthetic construct
  misc_feature 1..20: note = CRISPR gRNA sequence
  source 1..20: mol_type = other DNA
tgcatgaattactgaggtca

SEQ ID NO: 73209 - DNA, 20 bp, synthetic construct
  misc_feature 1..20: note = CRISPR gRNA sequence
  source 1..20: mol_type = other DNA
catgaattactgaggtcagg

SEQ ID NO: 73210 - DNA, 20 bp, synthetic construct
  misc_feature 1..20: note = CRISPR gRNA sequence
  source 1..20: mol_type = other DNA
ctgaggtcaggcaggcagca

SEQ ID NO: 73211 - DNA, 20 bp, synthetic construct
  misc_feature 1..20: note = CRISPR gRNA sequence
  source 1..20: mol_type = other DNA
aggtcaggcaggcagcagtt

SEQ ID NO: 73212 - DNA, 20 bp, synthetic construct
  misc_feature 1..20: note = CRISPR gRNA sequence
  source 1..20: mol_type = other DNA
tatgttctgaaccacatgga

SEQ ID NO: 73213 - DNA, 20 bp, synthetic construct
  misc_feature 1..20: note = CRISPR gRNA sequence
  source 1..20: mol_type = other DNA
tgttctgaaccacatggacc

SEQ ID NO: 73214 - DNA, 20 bp, synthetic construct
  misc_feature 1..20: note = CRISPR gRNA sequence
  source 1..20: mol_type = other DNA
tgaaccacatggaccaagac

SEQ ID NO: 73215 - DNA, 20 bp, synthetic construct
  misc_feature 1..20: note = CRISPR gRNA sequence
  source 1..20: mol_type = other DNA
aaccacatggaccaagacta

SEQ ID NO: 73216 - DNA, 20 bp, synthetic construct
  misc_feature 1..20: note = CRISPR gRNA sequence
  source 1..20: mol_type = other DNA
atgatccgtaataatggcgg

SEQ ID NO: 73217 - DNA, 20 bp, synthetic construct
  misc_feature 1..20: note = CRISPR gRNA sequence
  source 1..20: mol_type = other DNA
atcataaaatgtgggccaaa

SEQ ID NO: 73218 - DNA, 20 bp, synthetic construct
  misc_feature 1..20: note = CRISPR gRNA sequence
  source 1..20: mol_type = other DNA
agggcttggggccatctgga

SEQ ID NO: 73219 - DNA, 20 bp, synthetic construct
  misc_feature 1..20: note = CRISPR gRNA sequence
  source 1..20: mol_type = other DNA
ggggccatctggaaaggtgg

SEQ ID NO: 73220 - DNA, 20 bp, synthetic construct
  misc_feature 1..20: note = CRISPR gRNA sequence
  source 1..20: mol_type = other DNA
gggccatctggaaaggtggg

SEQ ID NO: 73221 - DNA, 20 bp, synthetic construct
  misc_feature 1..20: note = CRISPR gRNA sequence
  source 1..20: mol_type = other DNA
gaaaggtgggtttattatcg

SEQ ID NO: 73222 - DNA, 20 bp, synthetic construct
  misc_feature 1..20: note = CRISPR gRNA sequence
  source 1..20: mol_type = other DNA
attatcgtccccattttaca

SEQ ID NO: 73223 - DNA, 20 bp, synthetic construct
  misc_feature 1..20: note = CRISPR gRNA sequence
  source 1..20: mol_type = other DNA
ttatcgtccccattttacag

SEQ ID NO: 73224 - DNA, 20 bp, synthetic construct
  misc_feature 1..20: note = CRISPR gRNA sequence
  source 1..20: mol_type = other DNA
tcgtccccattttacaggtg

SEQ ID NO: 73225 - DNA, 20 bp, synthetic construct
  misc_feature 1..20: note = CRISPR gRNA sequence
  source 1..20: mol_type = other DNA
tacaggtgaggaacaccaag

SEQ ID NO: 73226 - DNA, 20 bp, synthetic construct
  misc_feature 1..20: note = CRISPR gRNA sequence
  source 1..20: mol_type = other DNA
acaggtgaggaacaccaagg

SEQ ID NO: 73227 - DNA, 20 bp, synthetic construct
  misc_feature 1..20: note = CRISPR gRNA sequence
  source 1..20: mol_type = other DNA
caggtgaggaacaccaaggt

SEQ ID NO: 73228 - DNA, 20 bp, synthetic construct
  misc_feature 1..20: note = CRISPR gRNA sequence
  source 1..20: mol_type = other DNA
agagagttagagaacttgct

SEQ ID NO: 73229 - DNA, 20 bp, synthetic construct
  misc_feature 1..20: note = CRISPR gRNA sequence
  source 1..20: mol_type = other DNA
gagaacttgcttaaggtcat

SEQ ID NO: 73230 - DNA, 20 bp, synthetic construct
  misc_feature 1..20: note = CRISPR gRNA sequence
  source 1..20: mol_type = other DNA
gcttaaggtcatacacaaag

SEQ ID NO: 73231 - DNA, 20 bp, synthetic construct
  misc_feature 1..20: note = CRISPR gRNA sequence
  source 1..20: mol_type = other DNA
cttaaggtcatacacaaagt

SEQ ID NO: 73232 - DNA, 20 bp, synthetic construct
  misc_feature 1..20: note = CRISPR gRNA sequence
  source 1..20: mol_type = other DNA
aaggtcatacacaaagtggc

SEQ ID NO: 73233 - DNA, 20 bp, synthetic construct
  misc_feature 1..20: note = CRISPR gRNA sequence
  source 1..20: mol_type = other DNA
aggtcatacacaaagtggct

SEQ ID NO: 73234 - DNA, 20 bp, synthetic construct
  misc_feature 1..20: note = CRISPR gRNA sequence
  source 1..20: mol_type = other DNA
cttcaggaacagaaccaaaa

SEQ ID NO: 73235 - DNA, 20 bp, synthetic construct
  misc_feature 1..20: note = CRISPR gRNA sequence
  source 1..20: mol_type = other DNA
caggaacagaaccaaaaact

SEQ ID NO: 73236 - DNA, 20 bp, synthetic construct
  misc_feature 1..20: note = CRISPR gRNA sequence
  source 1..20: mol_type = other DNA
aggaacagaaccaaaaacta

SEQ ID NO: 73237 - DNA, 20 bp, synthetic construct
  misc_feature 1..20: note = CRISPR gRNA sequence
  source 1..20: mol_type = other DNA
tagaactcccattcctgagc

SEQ ID NO: 73238 - DNA, 20 bp, synthetic construct
  misc_feature 1..20: note = CRISPR gRNA sequence
  source 1..20: mol_type = other DNA
ccattcctgagccccaacca

SEQ ID NO: 73239 - DNA, 20 bp, synthetic construct
  misc_feature 1..20: note = CRISPR gRNA sequence
  source 1..20: mol_type = other DNA
ctgagccccaaccatatgtg

SEQ ID NO: 73240 - DNA, 20 bp, synthetic construct
  misc_feature 1..20: note = CRISPR gRNA sequence
  source 1..20: mol_type = other DNA
agccccaaccatatgtgacc

SEQ ID NO: 73241 - DNA, 20 bp, synthetic construct
  misc_feature 1..20: note = CRISPR gRNA sequence
  source 1..20: mol_type = other DNA
tacttctagaggcccccagc

SEQ ID NO: 73242 - DNA, 20 bp, synthetic construct
  misc_feature 1..20: note = CRISPR gRNA sequence
  source 1..20: mol_type = other DNA
ctagaggcccccagcctagg

SEQ ID NO: 73243 - DNA, 20 bp, synthetic construct
  misc_feature 1..20: note = CRISPR gRNA sequence
  source 1..20: mol_type = other DNA
tagaggcccccagcctaggc

SEQ ID NO: 73244 - DNA, 20 bp, synthetic construct
  misc_feature 1..20: note = CRISPR gRNA sequence
  source 1..20: mol_type = other DNA
gaggcccccagcctaggcag

SEQ ID NO: 73245 - DNA, 20 bp, synthetic construct
  misc_feature 1..20: note = CRISPR gRNA sequence
  source 1..20: mol_type = other DNA
ggcaggagaggagaataaca

SEQ ID NO: 73246 - DNA, 20 bp, synthetic construct
  misc_feature 1..20: note = CRISPR gRNA sequence
  source 1..20: mol_type = other DNA
gcacttgtagagtgtgaact

SEQ ID NO: 73247 - DNA, 20 bp, synthetic construct
  misc_feature 1..20: note = CRISPR gRNA sequence
  source 1..20: mol_type = other DNA
gtagagtgtgaactctgacc

SEQ ID NO: 73248 - DNA, 20 bp, synthetic construct
  misc_feature 1..20: note = CRISPR gRNA sequence
  source 1..20: mol_type = other DNA
tagagtgtgaactctgacca

SEQ ID NO: 73249 - DNA, 20 bp, synthetic construct
  misc_feature 1..20: note = CRISPR gRNA sequence
  source 1..20: mol_type = other DNA
tgaccagactctaagactgt

SEQ ID NO: 73250 - DNA, 20 bp, synthetic construct
  misc_feature 1..20: note = CRISPR gRNA sequence
  source 1..20: mol_type = other DNA
accagactctaagactgtaa

SEQ ID NO: 73251 - DNA, 20 bp, synthetic construct
  misc_feature 1..20: note = CRISPR gRNA sequence
  source 1..20: mol_type = other DNA
taagactgtaacacatatta

SEQ ID NO: 73252 - DNA, 20 bp, synthetic construct
  misc_feature 1..20: note = CRISPR gRNA sequence
  source 1..20: mol_type = other DNA
agactgtaacacatattatc

SEQ ID NO: 73253 - DNA, 20 bp, synthetic construct
  misc_feature 1..20: note = CRISPR gRNA sequence
  source 1..20: mol_type = other DNA
taacacatattatctcattt

SEQ ID NO: 73254 - DNA, 20 bp, synthetic construct
  misc_feature 1..20: note = CRISPR gRNA sequence
  source 1..20: mol_type = other DNA
tctcatttaatactcacaac

SEQ ID NO: 73255 - DNA, 20 bp, synthetic construct
  misc_feature 1..20: note = CRISPR gRNA sequence
  source 1..20: mol_type = other DNA
atttaatactcacaacaacc

SEQ ID NO: 73256 - DNA, 20 bp, synthetic construct
  misc_feature 1..20: note = CRISPR gRNA sequence
  source 1..20: mol_type = other DNA
aatactcacaacaaccgtag

SEQ ID NO: 73257 - DNA, 20 bp, synthetic construct
  misc_feature 1..20: note = CRISPR gRNA sequence
  source 1..20: mol_type = other DNA
atactcacaacaaccgtagc

SEQ ID NO: 73258 - DNA, 20 bp, synthetic construct
  misc_feature 1..20: note = CRISPR gRNA sequence
  source 1..20: mol_type = other DNA
acaacaaccgtagcagggga

SEQ ID NO: 73259 - DNA, 20 bp, synthetic construct
  misc_feature 1..20: note = CRISPR gRNA sequence
  source 1..20: mol_type = other DNA
ctcttatcctcaaagttaag

SEQ ID NO: 73260 - DNA, 20 bp, synthetic construct
  misc_feature 1..20: note = CRISPR gRNA sequence
  source 1..20: mol_type = other DNA
ttatcctcaaagttaagatg

SEQ ID NO: 73261 - DNA, 20 bp, synthetic construct
  misc_feature 1..20: note = CRISPR gRNA sequence
  source 1..20: mol_type = other DNA
atcctcaaagttaagatgag

SEQ ID NO: 73262 - DNA, 20 bp, synthetic construct
  misc_feature 1..20: note = CRISPR gRNA sequence
  source 1..20: mol_type = other DNA
tcctcaaagttaagatgagg

SEQ ID NO: 73263 - DNA, 20 bp, synthetic construct
  misc_feature 1..20: note = CRISPR gRNA sequence
  source 1..20: mol_type = other DNA
aaagttaagatgaggaggcc

SEQ ID NO: 73264 - DNA, 20 bp, synthetic construct
  misc_feature 1..20: note = CRISPR gRNA sequence
  source 1..20: mol_type = other DNA
agatgaggaggccaaagaac

SEQ ID NO: 73265 - DNA, 20 bp, synthetic construct
  misc_feature 1..20: note = CRISPR gRNA sequence
  source 1..20: mol_type = other DNA
agggactggcacgagttcac

SEQ ID NO: 73266 - DNA, 20 bp, synthetic construct
  misc_feature 1..20: note = CRISPR gRNA sequence
  source 1..20: mol_type = other DNA
gcacgagttcacacattaag

SEQ ID NO: 73267 - DNA, 20 bp, synthetic construct
  misc_feature 1..20: note = CRISPR gRNA sequence
  source 1..20: mol_type = other DNA
acacattaagaaacagaact

SEQ ID NO: 73268 - DNA, 20 bp, synthetic construct
  misc_feature 1..20: note = CRISPR gRNA sequence
  source 1..20: mol_type = other DNA
agaaacagaactggctgggc

SEQ ID NO: 73269 - DNA, 20 bp, synthetic construct
  misc_feature 1..20: note = CRISPR gRNA sequence
  source 1..20: mol_type = other DNA
gctgggcgcaatggctcatg

SEQ ID NO: 73270 - DNA, 20 bp, synthetic construct
  misc_feature 1..20: note = CRISPR gRNA sequence
  source 1..20: mol_type = other DNA
ggcgcaatggctcatgcctg

SEQ ID NO: 73271 - DNA, 20 bp, synthetic construct
  misc_feature 1..20: note = CRISPR gRNA sequence
  source 1..20: mol_type = other DNA
atgcctgtaatcccaggact

SEQ ID NO: 73272 - DNA, 20 bp, synthetic construct
  misc_feature 1..20: note = CRISPR gRNA sequence
  source 1..20: mol_type = other DNA
taatcccaggactttgtgag

SEQ ID NO: 73273 - DNA, 20 bp, synthetic construct
  misc_feature 1..20: note = CRISPR gRNA sequence
  source 1..20: mol_type = other DNA
tgtgaggccaaggcgggtga

SEQ ID NO: 73274 - DNA, 20 bp, synthetic construct
  misc_feature 1..20: note = CRISPR gRNA sequence
  source 1..20: mol_type = other DNA
gtgaggccaaggcgggtgaa

SEQ ID NO: 73275 - DNA, 20 bp, synthetic construct
  misc_feature 1..20: note = CRISPR gRNA sequence
  source 1..20: mol_type = other DNA
tgaggccaaggcgggtgaat

SEQ ID NO: 73276 - DNA, 20 bp, synthetic construct
  misc_feature 1..20: note = CRISPR gRNA sequence
  source 1..20: mol_type = other DNA
aggtcaggagttcgagacca

SEQ ID NO: 73277 - DNA, 20 bp, synthetic construct
  misc_feature 1..20: note = CRISPR gRNA sequence
  source 1..20: mol_type = other DNA
gagaccagcctggccaacaa

SEQ ID NO: 73278 - DNA, 20 bp, synthetic construct
  misc_feature 1..20: note = CRISPR gRNA sequence
  source 1..20: mol_type = other DNA
gccaacaaagtgaaacccca

SEQ ID NO: 73279 - DNA, 20 bp, synthetic construct
  misc_feature 1..20: note = CRISPR gRNA sequence
  source 1..20: mol_type = other DNA
cactaaaaatagaaaaatta

SEQ ID NO: 73280 - DNA, 20 bp, synthetic construct
  misc_feature 1..20: note = CRISPR gRNA sequence
  source 1..20: mol_type = other DNA
aaaatagaaaaattagctgg

SEQ ID NO: 73281 - DNA, 20 bp, synthetic construct
  misc_feature 1..20: note = CRISPR gRNA sequence
  source 1..20: mol_type = other DNA
gctgggcctggtggcatgtg

SEQ ID NO: 73282 - DNA, 20 bp, synthetic construct
  misc_feature 1..20: note = CRISPR gRNA sequence
  source 1..20: mol_type = other DNA
ggcctggtggcatgtgcctg

SEQ ID NO: 73283 - DNA, 20 bp, synthetic construct
  misc_feature 1..20: note = CRISPR gRNA sequence
  source 1..20: mol_type = other DNA
gtggcatgtgcctgtaatgc

SEQ ID NO: 73284 - DNA, 20 bp, synthetic construct
  misc_feature 1..20: note = CRISPR gRNA sequence
  source 1..20: mol_type = other DNA
taatgccagctacttgggag

SEQ ID NO: 73285 - DNA, 20 bp, synthetic construct
  misc_feature 1..20: note = CRISPR gRNA sequence
  source 1..20: mol_type = other DNA
cttgggaggctgaggcagga

SEQ ID NO: 73286 - DNA, 20 bp, synthetic construct
  misc_feature 1..20: note = CRISPR gRNA sequence
  source 1..20: mol_type = other DNA
gggaggctgaggcaggaggg

SEQ ID NO: 73287 - DNA, 20 bp, synthetic construct
  misc_feature 1..20: note = CRISPR gRNA sequence
  source 1..20: mol_type = other DNA
ggaggctgaggcaggagggt

SEQ ID NO: 73288 - DNA, 20 bp, synthetic construct
  misc_feature 1..20: note = CRISPR gRNA sequence
  source 1..20: mol_type = other DNA
aggcaggagggttgcttgaa

SEQ ID NO: 73289 - DNA, 20 bp, synthetic construct
  misc_feature 1..20: note = CRISPR gRNA sequence
  source 1..20: mol_type = other DNA
cttgaacccgggaggcggag

SEQ ID NO: 73290 - DNA, 20 bp, synthetic construct
  misc_feature 1..20: note = CRISPR gRNA sequence
  source 1..20: mol_type = other DNA
gaacccgggaggcggaggtt

SEQ ID NO: 73291 - DNA, 20 bp, synthetic construct
  misc_feature 1..20: note = CRISPR gRNA sequence
  source 1..20: mol_type = other DNA
aacccgggaggcggaggttg

SEQ ID NO: 73292 - DNA, 20 bp, synthetic construct
  misc_feature 1..20: note = CRISPR gRNA sequence
  source 1..20: mol_type = other DNA
cagtgagccaagactgtgcc

SEQ ID NO: 73293 - DNA, 20 bp, synthetic construct
  misc_feature 1..20: note = CRISPR gRNA sequence
  source 1..20: mol_type = other DNA
tgccactgcactccagcctg

SEQ ID NO: 73294 - DNA, 20 bp, synthetic construct
  misc_feature 1..20: note = CRISPR gRNA sequence
  source 1..20: mol_type = other DNA
cactccagcctgggcaacgg

SEQ ID NO: 73295 - DNA, 20 bp, synthetic construct
  misc_feature 1..20: note = CRISPR gRNA sequence
  source 1..20: mol_type = other DNA
cagcctgggcaacggagaga

SEQ ID NO: 73296 - DNA, 20 bp, synthetic construct
  misc_feature 1..20: note = CRISPR gRNA sequence
  source 1..20: mol_type = other DNA
ggcaacggagagagactggg

SEQ ID NO: 73297 - DNA, 20 bp, synthetic construct
  misc_feature 1..20: note = CRISPR gRNA sequence
  source 1..20: mol_type = other DNA
ggtctcaaataaataaataa

SEQ ID NO: 73298 - DNA, 20 bp, synthetic construct
  misc_feature 1..20: note = CRISPR gRNA sequence
  source 1..20: mol_type = other DNA
aaataaataaataataaaat

SEQ ID NO: 73299 - DNA, 20 bp, synthetic construct
  misc_feature 1..20: note = CRISPR gRNA sequence
  source 1..20: mol_type = other DNA
tcttggttggctcagaacag

SEQ ID NO: 73300 - DNA, 20 bp, synthetic construct
  misc_feature 1..20: note = CRISPR gRNA sequence
  source 1..20: mol_type = other DNA
ggttggctcagaacagaaga

SEQ ID NO: 73301 - DNA, 20 bp, synthetic construct
  misc_feature 1..20: note = CRISPR gRNA sequence
  source 1..20: mol_type = other DNA
gttggctcagaacagaagag

SEQ ID NO: 73302 - DNA, 20 bp, synthetic construct
  misc_feature 1..20: note = CRISPR gRNA sequence
  source 1..20: mol_type = other DNA
gctcagaacagaagagtttt

SEQ ID NO: 73303 - DNA, 20 bp, synthetic construct
  misc_feature 1..20: note = CRISPR gRNA sequence
  source 1..20: mol_type = other DNA
agaacagaagagtttttcct

SEQ ID NO: 73304 - DNA, 20 bp, synthetic construct
  misc_feature 1..20: note = CRISPR gRNA sequence
  source 1..20: mol_type = other DNA
ttcctggatgtgggactttg

SEQ ID NO: 73305 - DNA, 20 bp, synthetic construct
  misc_feature 1..20: note = CRISPR gRNA sequence
  source 1..20: mol_type = other DNA
tcctggatgtgggactttgg

SEQ ID NO: 73306 - DNA, 20 bp, synthetic construct
  misc_feature 1..20: note = CRISPR gRNA sequence
  source 1..20: mol_type = other DNA
cctggatgtgggactttggg

SEQ ID NO: 73307 - DNA, 20 bp, synthetic construct
  misc_feature 1..20: note = CRISPR gRNA sequence
  source 1..20: mol_type = other DNA
ctggatgtgggactttgggt

SEQ ID NO: 73308 - DNA, 20 bp, synthetic construct
  misc_feature 1..20: note = CRISPR gRNA sequence
  source 1..20: mol_type = other DNA
gatgtgggactttgggtgcc

SEQ ID NO: 73309 - DNA, 20 bp, synthetic construct
  misc_feature 1..20: note = CRISPR gRNA sequence
  source 1..20: mol_type = other DNA
tgggtgccaaaatggggaaa

SEQ ID NO: 73310 - DNA, 20 bp, synthetic construct
  misc_feature 1..20: note = CRISPR gRNA sequence
  source 1..20: mol_type = other DNA
gggtgccaaaatggggaaag

SEQ ID NO: 73311 - DNA, 20 bp, synthetic construct
  misc_feature 1..20: note = CRISPR gRNA sequence
  source 1..20: mol_type = other DNA
ggtgccaaaatggggaaagc

SEQ ID NO: 73312 - DNA, 20 bp, synthetic construct
  misc_feature 1..20: note = CRISPR gRNA sequence
  source 1..20: mol_type = other DNA
caagcaaactggaagtgtca

SEQ ID NO: 73313 - DNA, 20 bp, synthetic construct
  misc_feature 1..20: note = CRISPR gRNA sequence
  source 1..20: mol_type = other DNA
gaagtgtcagttaccccacc

SEQ ID NO: 73314 - DNA, 20 bp, synthetic construct
  misc_feature 1..20: note = CRISPR gRNA sequence
  source 1..20: mol_type = other DNA
ccccacccagagttgaaccc

SEQ ID NO: 73315 - DNA, 20 bp, synthetic construct
  misc_feature 1..20: note = CRISPR gRNA sequence
  source 1..20: mol_type = other DNA
aacccaggcagtgaggctcc

SEQ ID NO: 73316 - DNA, 20 bp, synthetic construct
  misc_feature 1..20: note = CRISPR gRNA sequence
  source 1..20: mol_type = other DNA
ctaactagggtccatgctcc

SEQ ID NO: 73317 - DNA, 20 bp, synthetic construct
  misc_feature 1..20: note = CRISPR gRNA sequence
  source 1..20: mol_type = other DNA
actagggtccatgctcctac

SEQ ID NO: 73318 - DNA, 20 bp, synthetic construct
  misc_feature 1..20: note = CRISPR gRNA sequence
  source 1..20: mol_type = other DNA
gggtccatgctcctacccac

SEQ ID NO: 73319 - DNA, 20 bp, synthetic construct
  misc_feature 1..20: note = CRISPR gRNA sequence
  source 1..20: mol_type = other DNA
ctacccactccatcacaggt

SEQ ID NO: 73320 - DNA, 20 bp, synthetic construct
  misc_feature 1..20: note = CRISPR gRNA sequence
  source 1..20: mol_type = other DNA
cccactccatcacaggtata

SEQ ID NO: 73321 - DNA, 20 bp, synthetic construct
  misc_feature 1..20: note = CRISPR gRNA sequence
  source 1..20: mol_type = other DNA
catcacaggtatacagctgg

SEQ ID NO: 73322 - DNA, 20 bp, synthetic construct
  misc_feature 1..20: note = CRISPR gRNA sequence
  source 1..20: mol_type = other DNA
gaagaagctgactggatttg

SEQ ID NO: 73323 - DNA, 20 bp, synthetic construct
  misc_feature 1..20: note = CRISPR gRNA sequence
  source 1..20: mol_type = other DNA
actggatttgagggtaactg

SEQ ID NO: 73324 - DNA, 20 bp, synthetic construct
  misc_feature 1..20: note = CRISPR gRNA sequence
  source 1..20: mol_type = other DNA
gatttgagggtaactgcctg

SEQ ID NO: 73325 - DNA, 20 bp, synthetic construct
  misc_feature 1..20: note = CRISPR gRNA sequence
  source 1..20: mol_type = other DNA
gagggtaactgcctgtgggg

SEQ ID NO: 73326 - DNA, 20 bp, synthetic construct
  misc_feature 1..20: note = CRISPR gRNA sequence
  source 1..20: mol_type = other DNA
agggtaactgcctgtgggga

SEQ ID NO: 73327 - DNA, 20 bp, synthetic construct
  misc_feature 1..20: note = CRISPR gRNA sequence
  source 1..20: mol_type = other DNA
cctgtggggagttacacttg

SEQ ID NO: 73328 - DNA, 20 bp, synthetic construct
  misc_feature 1..20: note = CRISPR gRNA sequence
  source 1..20: mol_type = other DNA
tggggagttacacttggaaa

SEQ ID NO: 73329 - DNA, 20 bp, synthetic construct
  misc_feature 1..20: note = CRISPR gRNA sequence
  source 1..20: mol_type = other DNA
cacttggaaatgacagatct

SEQ ID NO: 73330 - DNA, 20 bp, synthetic construct
  misc_feature 1..20: note = CRISPR gRNA sequence
  source 1..20: mol_type = other DNA
ggaaatgacagatctgagat

SEQ ID NO: 73331 - DNA, 20 bp, synthetic construct
  misc_feature 1..20: note = CRISPR gRNA sequence
  source 1..20: mol_type = other DNA
gaaatgacagatctgagatg

SEQ ID NO: 73332 - DNA, 20 bp, synthetic construct
  misc_feature 1..20: note = CRISPR gRNA sequence
  source 1..20: mol_type = other DNA
agatgggaagagacctccgg

SEQ ID NO: 73333 - DNA, 20 bp, synthetic construct
  misc_feature 1..20: note = CRISPR gRNA sequence
  source 1..20: mol_type = other DNA
cgggcactgacgatccatcc

SEQ ID NO: 73334 - DNA, 20 bp, synthetic construct
  misc_feature 1..20: note = CRISPR gRNA sequence
  source 1..20: mol_type = other DNA
acgatccatccccttccttc

SEQ ID NO: 73335 - DNA, 20 bp, synthetic construct
  misc_feature 1..20: note = CRISPR gRNA sequence
  source 1..20: mol_type = other DNA
ccttcggacagggaagatat

SEQ ID NO: 73336 - DNA, 20 bp, synthetic construct
  misc_feature 1..20: note = CRISPR gRNA sequence
  source 1..20: mol_type = other DNA
cttcggacagggaagatatt

SEQ ID NO: 73337 - DNA, 20 bp, synthetic construct
  misc_feature 1..20: note = CRISPR gRNA sequence
  source 1..20: mol_type = other DNA
cggacagggaagatattatg

SEQ ID NO: 73338 - DNA, 20 bp, synthetic construct
  misc_feature 1..20: note = CRISPR gRNA sequence
  source 1..20: mol_type = other DNA
ggacagggaagatattatgc

SEQ ID NO: 73339 - DNA, 20 bp, synthetic construct
  misc_feature 1..20: note = CRISPR gRNA sequence
  source 1..20: mol_type = other DNA
tgcccagtttacagataggg

SEQ ID NO: 73340 - DNA, 20 bp, synthetic construct
  misc_feature 1..20: note = CRISPR gRNA sequence
  source 1..20: mol_type = other DNA
acagatagggcaactaaggc

SEQ ID NO: 73341 - DNA, 20 bp, synthetic construct
  misc_feature 1..20: note = CRISPR gRNA sequence
  source 1..20: mol_type = other DNA
cagatagggcaactaaggca

SEQ ID NO: 73342 - DNA, 20 bp, synthetic construct
  misc_feature 1..20: note = CRISPR gRNA sequence
  source 1..20: mol_type = other DNA
aggcagcaggaggtaaggag

SEQ ID NO: 73343 - DNA, 20 bp, synthetic construct
  misc_feature 1..20: note = CRISPR gRNA sequence
  source 1..20: mol_type = other DNA
ggaaatcaggaggaagaaaa

SEQ ID NO: 73344 - DNA, 20 bp, synthetic construct
  misc_feature 1..20: note = CRISPR gRNA sequence
  source 1..20: mol_type = other DNA
tcctgtccccggcccaggtg

SEQ ID NO: 73345 - DNA, 20 bp, synthetic construct
  misc_feature 1..20: note = CRISPR gRNA sequence
  source 1..20: mol_type = other DNA
tccccggcccaggtgcccag

SEQ ID NO: 73346 - DNA, 20 bp, synthetic construct
  misc_feature 1..20: note = CRISPR gRNA sequence
  source 1..20: mol_type = other DNA
agtacatatttgtcgaatgc

SEQ ID NO: 73347 - DNA, 20 bp, synthetic construct
  misc_feature 1..20: note = CRISPR gRNA sequence
  source 1..20: mol_type = other DNA
gtcgaatgcatgaatgagcc

SEQ ID NO: 73348 - DNA, 20 bp, synthetic construct
  misc_feature 1..20: note = CRISPR gRNA sequence
  source 1..20: mol_type = other DNA
tcgaatgcatgaatgagcca

SEQ ID NO: 73349 - DNA, 20 bp, synthetic construct
  misc_feature 1..20: note = CRISPR gRNA sequence
  source 1..20: mol_type = other DNA
actgggcctccaatccccta

SEQ ID NO: 73350 - DNA, 20 bp, synthetic construct
  misc_feature 1..20: note = CRISPR gRNA sequence
  source 1..20: mol_type = other DNA
ggcctccaatcccctaaata

SEQ ID NO: 73351 - DNA, 20 bp, synthetic construct
  misc_feature 1..20: note = CRISPR gRNA sequence
  source 1..20: mol_type = other DNA
caatcccctaaataaaagct

SEQ ID NO: 73352 - DNA, 20 bp, synthetic construct
  misc_feature 1..20: note = CRISPR gRNA sequence
  source 1..20: mol_type = other DNA
aataaaagcttccagaaggc

SEQ ID NO: 73353 - DNA, 20 bp, synthetic construct
  misc_feature 1..20: note = CRISPR gRNA sequence
  source 1..20: mol_type = other DNA
ccagaaggctgagccgagat

SEQ ID NO: 73354 - DNA, 20 bp, synthetic construct
  misc_feature 1..20: note = CRISPR gRNA sequence
  source 1..20: mol_type = other DNA
cagaaggctgagccgagatg

SEQ ID NO: 73355 - DNA, 20 bp, synthetic construct
  misc_feature 1..20: note = CRISPR gRNA sequence
  source 1..20: mol_type = other DNA
agccgagatgcaggtacatg

SEQ ID NO: 73356 - DNA, 20 bp, synthetic construct
  misc_feature 1..20: note = CRISPR gRNA sequence
  source 1..20: mol_type = other DNA
tggtcaaaggtctctgtaat

SEQ ID NO: 73357 - DNA, 20 bp, synthetic construct
  misc_feature 1..20: note = CRISPR gRNA sequence
  source 1..20: mol_type = other DNA
tgtaatccctcttctccttt

SEQ ID NO: 73358 - DNA, 20 bp, synthetic construct
  misc_feature 1..20: note = CRISPR gRNA sequence
  source 1..20: mol_type = other DNA
taatccctcttctcctttta

SEQ ID NO: 73359 - DNA, 20 bp, synthetic construct
  misc_feature 1..20: note = CRISPR gRNA sequence
  source 1..20: mol_type = other DNA
ttctccttttacctgatcct

SEQ ID NO: 73360 - DNA, 20 bp, synthetic construct
  misc_feature 1..20: note = CRISPR gRNA sequence
  source 1..20: mol_type = other DNA
ctccttttacctgatcctct

SEQ ID NO: 73361 - DNA, 20 bp, synthetic construct
  misc_feature 1..20: note = CRISPR gRNA sequence
  source 1..20: mol_type = other DNA
tccttttacctgatcctctc

SEQ ID NO: 73362 - DNA, 20 bp, synthetic construct
  misc_feature 1..20: note = CRISPR gRNA sequence
  source 1..20: mol_type = other DNA
cttttacctgatcctctccc

SEQ ID NO: 73363 - DNA, 20 bp, synthetic construct
  misc_feature 1..20: note = CRISPR gRNA sequence
  source 1..20: mol_type = other DNA
ttacctgatcctctccccag

SEQ ID NO: 73364 - DNA, 20 bp, synthetic construct
  misc_feature 1..20: note = CRISPR gRNA sequence
  source 1..20: mol_type = other DNA
tacctgatcctctccccagg

SEQ ID NO: 73365 - DNA, 20 bp, synthetic construct
  misc_feature 1..20: note = CRISPR gRNA sequence
  source 1..20: mol_type = other DNA
acctgatcctctccccagga

SEQ ID NO: 73366 - DNA, 20 bp, synthetic construct
  misc_feature 1..20: note = CRISPR gRNA sequence
  source 1..20: mol_type = other DNA
cctgatcctctccccaggac

SEQ ID NO: 73367 - DNA, 20 bp, synthetic construct
  misc_feature 1..20: note = CRISPR gRNA sequence
  source 1..20: mol_type = other DNA
atcctctccccaggacaagc

SEQ ID NO: 73368 - DNA, 20 bp, synthetic construct
  misc_feature 1..20: note = CRISPR gRNA sequence
  source 1..20: mol_type = other DNA
tccccaggacaagcaaagag

SEQ ID NO: 73369 - DNA, 20 bp, synthetic construct
  misc_feature 1..20: note = CRISPR gRNA sequence
  source 1..20: mol_type = other DNA
cccaggacaagcaaagaggg

SEQ ID NO: 73370 - DNA, 20 bp, synthetic construct
  misc_feature 1..20: note = CRISPR gRNA sequence
  source 1..20: mol_type = other DNA
caatgttaaggggcaaaaag

SEQ ID NO: 73371 - DNA, 20 bp, synthetic construct
  misc_feature 1..20: note = CRISPR gRNA sequence
  source 1..20: mol_type = other DNA
aatgttaaggggcaaaaagt

SEQ ID NO: 73372 - DNA, 20 bp, synthetic construct
  misc_feature 1..20: note = CRISPR gRNA sequence
  source 1..20: mol_type = other DNA
aggggcaaaaagtcaaaagg

SEQ ID NO: 73373 - DNA, 20 bp, synthetic construct
  misc_feature 1..20: note = CRISPR gRNA sequence
  source 1..20: mol_type = other DNA
ctttcaagctgaattcaaaa

SEQ ID NO: 73374 - DNA, 20 bp, synthetic construct
  misc_feature 1..20: note = CRISPR gRNA sequence
  source 1..20: mol_type = other DNA
tcaagctgaattcaaaacat

SEQ ID NO: 73375 - DNA, 20 bp, synthetic construct
  misc_feature 1..20: note = CRISPR gRNA sequence
  source 1..20: mol_type = other DNA
caagctgaattcaaaacata

SEQ ID NO: 73376 - DNA, 20 bp, synthetic construct
  misc_feature 1..20: note = CRISPR gRNA sequence
  source 1..20: mol_type = other DNA
aagctgaattcaaaacatat

SEQ ID NO: 73377 - DNA, 20 bp, synthetic construct
  misc_feature 1..20: note = CRISPR gRNA sequence
  source 1..20: mol_type = other DNA
aattcaaaacatatgtagaa

SEQ ID NO: 73378 - DNA, 20 bp, synthetic construct
  misc_feature 1..20: note = CRISPR gRNA sequence
  source 1..20: mol_type = other DNA
aaaacatatgtagaaaaaaa

SEQ ID NO: 73379 - DNA, 20 bp, synthetic construct
  misc_feature 1..20: note = CRISPR gRNA sequence
  source 1..20: mol_type = other DNA
gagaaaaattcacaaaccgt

SEQ ID NO: 73380 - DNA, 20 bp, synthetic construct
  misc_feature 1..20: note = CRISPR gRNA sequence
  source 1..20: mol_type = other DNA
acaaaccgttcaacagaagt

SEQ ID NO: 73381 - DNA, 20 bp, synthetic construct
  misc_feature 1..20: note = CRISPR gRNA sequence
  source 1..20: mol_type = other DNA
aacagaagttttctcagggg

SEQ ID NO: 73382 - DNA, 20 bp, synthetic construct
  misc_feature 1..20: note = CRISPR gRNA sequence
  source 1..20: mol_type = other DNA
tctcagggggtgtcatcccc

SEQ ID NO: 73383 - DNA, 20 bp, synthetic construct
  misc_feature 1..20: note = CRISPR gRNA sequence
  source 1..20: mol_type = other DNA
ctcagggggtgtcatccccg

SEQ ID NO: 73384 - DNA, 20 bp, synthetic construct
  misc_feature 1..20: note = CRISPR gRNA sequence
  source 1..20: mol_type = other DNA
tcagggggtgtcatccccgg

SEQ ID NO: 73385 - DNA, 20 bp, synthetic construct
  misc_feature 1..20: note = CRISPR gRNA sequence
  source 1..20: mol_type = other DNA
agggggtgtcatccccgggg

SEQ ID NO: 73386 - DNA, 20 bp, synthetic construct
  misc_feature 1..20: note = CRISPR gRNA sequence
  source 1..20: mol_type = other DNA
catgttatttgttacatatt

SEQ ID NO: 73387 - DNA, 20 bp, synthetic construct
  misc_feature 1..20: note = CRISPR gRNA sequence
  source 1..20: mol_type = other DNA
atgttatttgttacatattt

SEQ ID NO: 73388 - DNA, 20 bp, synthetic construct
  misc_feature 1..20: note = CRISPR gRNA sequence
  source 1..20: mol_type = other DNA
tttgttacatatttctagaa

SEQ ID NO: 73389 - DNA, 20 bp, synthetic construct
  misc_feature 1..20: note = CRISPR gRNA sequence
  source 1..20: mol_type = other DNA
gttacatatttctagaaaga

SEQ ID NO: 73390 - DNA, 20 bp, synthetic construct
  misc_feature 1..20: note = CRISPR gRNA sequence
  source 1..20: mol_type = other DNA
ttacatatttctagaaagat

SEQ ID NO: 73391 - DNA, 20 bp, synthetic construct
  misc_feature 1..20: note = CRISPR gRNA sequence
  source 1..20: mol_type = other DNA
catatttctagaaagatgga

SEQ ID NO: 73392 - DNA, 20 bp, synthetic construct
  misc_feature 1..20: note = CRISPR gRNA sequence
  source 1..20: mol_type = other DNA
ctagaaagatggaacttttt

SEQ ID NO: 73393 - DNA, 20 bp, synthetic construct
  misc_feature 1..20: note = CRISPR gRNA sequence
  source 1..20: mol_type = other DNA
tagaaagatggaactttttt

SEQ ID NO: 73394 - DNA, 20 bp, synthetic construct
  misc_feature 1..20: note = CRISPR gRNA sequence
  source 1..20: mol_type = other DNA
gaaagatggaacttttttgg

SEQ ID NO: 73395 - DNA, 20 bp, synthetic construct
  misc_feature 1..20: note = CRISPR gRNA sequence
  source 1..20: mol_type = other DNA
ttttggtcatcagaaaaagt

SEQ ID NO: 73396 - DNA, 20 bp, synthetic construct
  misc_feature 1..20: note = CRISPR gRNA sequence
  source 1..20: mol_type = other DNA
tttggtcatcagaaaaagtt

SEQ ID NO: 73397 - DNA, 20 bp, synthetic construct
  misc_feature 1..20: note = CRISPR gRNA sequence
  source 1..20: mol_type = other DNA
ttggtcatcagaaaaagtta

SEQ ID NO: 73398 - DNA, 20 bp, synthetic construct
  misc_feature 1..20: note = CRISPR gRNA sequence
  source 1..20: mol_type = other DNA
tggtcatcagaaaaagttaa

SEQ ID NO: 73399 - DNA, 20 bp, synthetic construct
  misc_feature 1..20: note = CRISPR gRNA sequence
  source 1..20: mol_type = other DNA
ggtcatcagaaaaagttaag

SEQ ID NO: 73400 - DNA, 20 bp, synthetic construct
  misc_feature 1..20: note = CRISPR gRNA sequence
  source 1..20: mol_type = other DNA
gtcatcagaaaaagttaaga

SEQ ID NO: 73401 - DNA, 20 bp, synthetic construct
  misc_feature 1..20: note = CRISPR gRNA sequence
  source 1..20: mol_type = other DNA
agagatgaaaagcagaagat

SEQ ID NO: 73402 - DNA, 20 bp, synthetic construct
  misc_feature 1..20: note = CRISPR gRNA sequence
  source 1..20: mol_type = other DNA
tgttaaattttctgtccaga

SEQ ID NO: 73403 - DNA, 20 bp, synthetic construct
  misc_feature 1..20: note = CRISPR gRNA sequence
  source 1..20: mol_type = other DNA
ttaaattttctgtccagata

SEQ ID NO: 73404 - DNA, 20 bp, synthetic construct
  misc_feature 1..20: note = CRISPR gRNA sequence
  source 1..20: mol_type = other DNA
aattttctgtccagatactg

SEQ ID NO: 73405 - DNA, 20 bp, synthetic construct
  misc_feature 1..20: note = CRISPR gRNA sequence
  source 1..20: mol_type = other DNA
tctgtccagatactgtctaa

SEQ ID NO: 73406 - DNA, 20 bp, synthetic construct
  misc_feature 1..20: note = CRISPR gRNA sequence
  source 1..20: mol_type = other DNA
ctgtccagatactgtctaaa

SEQ ID NO: 73407 - DNA, 20 bp, synthetic construct
  misc_feature 1..20: note = CRISPR gRNA sequence
  source 1..20: mol_type = other DNA
tgtccagatactgtctaaac

SEQ ID NO: 73408 - DNA, 20 bp, synthetic construct
  misc_feature 1..20: note = CRISPR gRNA sequence
  source 1..20: mol_type = other DNA
tccagatactgtctaaacag

SEQ ID NO: 73409 - DNA, 20 bp, synthetic construct
  misc_feature 1..20: note = CRISPR gRNA sequence
  source 1..20: mol_type = other DNA
tctaaacaggaatctgtgca

SEQ ID NO: 73410 - DNA, 20 bp, synthetic construct
  misc_feature 1..20: note = CRISPR gRNA sequence
  source 1..20: mol_type = other DNA
aacaggaatctgtgcaggac

SEQ ID NO: 73411 - DNA, 20 bp, synthetic construct
  misc_feature 1..20: note = CRISPR gRNA sequence
  source 1..20: mol_type = other DNA
tgcaggacggggacctgtct

SEQ ID NO: 73412 - DNA, 20 bp, synthetic construct
  misc_feature 1..20: note = CRISPR gRNA sequence
  source 1..20: mol_type = other DNA
tcttttagactgaggctgtt

SEQ ID NO: 73413 - DNA, 20 bp, synthetic construct
  misc_feature 1..20: note = CRISPR gRNA sequence
  source 1..20: mol_type = other DNA
ttagactgaggctgtttctg

SEQ ID NO: 73414 - DNA, 20 bp, synthetic construct
  misc_feature 1..20: note = CRISPR gRNA sequence
  source 1..20: mol_type = other DNA
tagactgaggctgtttctgg

SEQ ID NO: 73415 - DNA, 20 bp, synthetic construct
  misc_feature 1..20: note = CRISPR gRNA sequence
  source 1..20: mol_type = other DNA
agactgaggctgtttctggc

SEQ ID NO: 73416 - DNA, 20 bp, synthetic construct
  misc_feature 1..20: note = CRISPR gRNA sequence
  source 1..20: mol_type = other DNA
gactgaggctgtttctggca

SEQ ID NO: 73417 - DNA, 20 bp, synthetic construct
  misc_feature 1..20: note = CRISPR gRNA sequence
  source 1..20: mol_type = other DNA
aggctgtttctggcatttct

SEQ ID NO: 73418 - DNA, 20 bp, synthetic construct
  misc_feature 1..20: note = CRISPR gRNA sequence
  source 1..20: mol_type = other DNA
tttctggcatttctaagaat

SEQ ID NO: 73419 - DNA, 20 bp, synthetic construct
  misc_feature 1..20: note = CRISPR gRNA sequence
  source 1..20: mol_type = other DNA
ctggcatttctaagaatttg

SEQ ID NO: 73420 - DNA, 20 bp, synthetic construct
  misc_feature 1..20: note = CRISPR gRNA sequence
  source 1..20: mol_type = other DNA
tggcatttctaagaatttga

SEQ ID NO: 73421 - DNA, 20 bp, synthetic construct
  misc_feature 1..20: note = CRISPR gRNA sequence
  source 1..20: mol_type = other DNA
gcatttctaagaatttgatg

SEQ ID NO: 73422 - DNA, 20 bp, synthetic construct
  misc_feature 1..20: note = CRISPR gRNA sequence
  source 1..20: mol_type = other DNA
ctaagaatttgatgacttca

SEQ ID NO: 73423 - DNA, 20 bp, synthetic construct
  misc_feature 1..20: note = CRISPR gRNA sequence
  source 1..20: mol_type = other DNA
taagaatttgatgacttcaa

SEQ ID NO: 73424 - DNA, 20 bp, synthetic construct
  misc_feature 1..20: note = CRISPR gRNA sequence
  source 1..20: mol_type = other DNA
agaatttgatgacttcaaat

SEQ ID NO: 73425 - DNA, 20 bp, synthetic construct
  misc_feature 1..20: note = CRISPR gRNA sequence
  source 1..20: mol_type = other DNA
gatgacttcaaattatgggg

SEQ ID NO: 73426 - DNA, 20 bp, synthetic construct
  misc_feature 1..20: note = CRISPR gRNA sequence
  source 1..20: mol_type = other DNA
atgacttcaaattatggggg

SEQ ID NO: 73427 - DNA, 20 bp, synthetic construct
  misc_feature 1..20: note = CRISPR gRNA sequence
  source 1..20: mol_type = other DNA
caaattatgggggagagtag

SEQ ID NO: 73428 - DNA, 20 bp, synthetic construct
  misc_feature 1..20: note = CRISPR gRNA sequence
  source 1..20: mol_type = other DNA
aaattatgggggagagtagt

SEQ ID NO: 73429 - DNA, 20 bp, synthetic construct
  misc_feature 1..20: note = CRISPR gRNA sequence
  source 1..20: mol_type = other DNA
tgggggagagtagtaaaagc

SEQ ID NO: 73430 - DNA, 20 bp, synthetic construct
  misc_feature 1..20: note = CRISPR gRNA sequence
  source 1..20: mol_type = other DNA
ccagttaccaaggaaacaac

SEQ ID NO: 73431 - DNA, 20 bp, synthetic construct
  misc_feature 1..20: note = CRISPR gRNA sequence
  source 1..20: mol_type = other DNA
ccaaggaaacaactgtagac

SEQ ID NO: 73432 - DNA, 20 bp, synthetic construct
  misc_feature 1..20: note = CRISPR gRNA sequence
  source 1..20: mol_type = other DNA
tagacaaatgtagtggacat

SEQ ID NO: 73433 - DNA, 20 bp, synthetic construct
  misc_feature 1..20: note = CRISPR gRNA sequence
  source 1..20: mol_type = other DNA
tagatttttttctgcccaga

SEQ ID NO: 73434 - DNA, 20 bp, synthetic construct
  misc_feature 1..20: note = CRISPR gRNA sequence
  source 1..20: mol_type = other DNA
ttttctgcccagagtttctt

SEQ ID NO: 73435 - DNA, 20 bp, synthetic construct
  misc_feature 1..20: note = CRISPR gRNA sequence
  source 1..20: mol_type = other DNA
tttctgcccagagtttcttt

SEQ ID NO: 73436 - DNA, 20 bp, synthetic construct
  misc_feature 1..20: note = CRISPR gRNA sequence
  source 1..20: mol_type = other DNA
ttctgcccagagtttctttc

SEQ ID NO: 73437 - DNA, 20 bp, synthetic construct
  misc_feature 1..20: note = CRISPR gRNA sequence
  source 1..20: mol_type = other DNA
tctgcccagagtttctttcc

SEQ ID NO: 73438 - DNA, 20 bp, synthetic construct
  misc_feature 1..20: note = CRISPR gRNA sequence
  source 1..20: mol_type = other DNA
ctgcccagagtttctttcct

SEQ ID NO: 73439 - DNA, 20 bp, synthetic construct
  misc_feature 1..20: note = CRISPR gRNA sequence
  source 1..20: mol_type = other DNA
tgcccagagtttctttcctc

SEQ ID NO: 73440 - DNA, 20 bp, synthetic construct
  misc_feature 1..20: note = CRISPR gRNA sequence
  source 1..20: mol_type = other DNA
cccagagtttctttcctctt

SEQ ID NO: 73441 - DNA, 20 bp, synthetic construct
  misc_feature 1..20: note = CRISPR gRNA sequence
  source 1..20: mol_type = other DNA
ctttcctcttctgttactca

SEQ ID NO: 73442 - DNA, 20 bp, synthetic construct
  misc_feature 1..20: note = CRISPR gRNA sequence
  source 1..20: mol_type = other DNA
tttcctcttctgttactcac

SEQ ID NO: 73443 - DNA, 20 bp, synthetic construct
  misc_feature 1..20: note = CRISPR gRNA sequence
  source 1..20: mol_type = other DNA
tcctcttctgttactcacat

SEQ ID NO: 73444 - DNA, 20 bp, synthetic construct
  misc_feature 1..20: note = CRISPR gRNA sequence
  source 1..20: mol_type = other DNA
cctcttctgttactcacatc

SEQ ID NO: 73445 - DNA, 20 bp, synthetic construct
  misc_feature 1..20: note = CRISPR gRNA sequence
  source 1..20: mol_type = other DNA
ctcttctgttactcacatcc

SEQ ID NO: 73446 - DNA, 20 bp, synthetic construct
  misc_feature 1..20: note = CRISPR gRNA sequence
  source 1..20: mol_type = other DNA
ttctgttactcacatcctga

SEQ ID NO: 73447 - DNA, 20 bp, synthetic construct
  misc_feature 1..20: note = CRISPR gRNA sequence
  source 1..20: mol_type = other DNA
ctgttactcacatcctgaaa

SEQ ID NO: 73448 - DNA, 20 bp, synthetic construct
  misc_feature 1..20: note = CRISPR gRNA sequence
  source 1..20: mol_type = other DNA
tgttactcacatcctgaaat

SEQ ID NO: 73449 - DNA, 20 bp, synthetic construct
  misc_feature 1..20: note = CRISPR gRNA sequence
  source 1..20: mol_type = other DNA
ttactcacatcctgaaatac

SEQ ID NO: 73450 - DNA, 20 bp, synthetic construct
  misc_feature 1..20: note = CRISPR gRNA sequence
  source 1..20: mol_type = other DNA
ctcacatcctgaaataccac

SEQ ID NO: 73451 - DNA, 20 bp, synthetic construct
  misc_feature 1..20: note = CRISPR gRNA sequence
  source 1..20: mol_type = other DNA
acatcctgaaataccacccc

SEQ ID NO: 73452 - DNA, 20 bp, synthetic construct
  misc_feature 1..20: note = CRISPR gRNA sequence
  source 1..20: mol_type = other DNA
aaataccacccctctaagtc

SEQ ID NO: 73453 - DNA, 20 bp, synthetic construct
  misc_feature 1..20: note = CRISPR gRNA sequence
  source 1..20: mol_type = other DNA
taagtccagaagatagggtg

SEQ ID NO: 73454 - DNA, 20 bp, synthetic construct
  misc_feature 1..20: note = CRISPR gRNA sequence
  source 1..20: mol_type = other DNA
agtccagaagatagggtgtg

SEQ ID NO: 73455 - DNA, 20 bp, synthetic construct
  misc_feature 1..20: note = CRISPR gRNA sequence
  source 1..20: mol_type = other DNA
gccagtgaggagaatatttt

SEQ ID NO: 73456 - DNA, 20 bp, synthetic construct
  misc_feature 1..20: note = CRISPR gRNA sequence
  source 1..20: mol_type = other DNA
tgtgctcacagccacagtga

SEQ ID NO: 73457 - DNA, 20 bp, synthetic construct
  misc_feature 1..20: note = CRISPR gRNA sequence
  source 1..20: mol_type = other DNA
gtgctcacagccacagtgat

SEQ ID NO: 73458 - DNA, 20 bp, synthetic construct
  misc_feature 1..20: note = CRISPR gRNA sequence
  source 1..20: mol_type = other DNA
tgctcacagccacagtgatt

SEQ ID NO: 73459 - DNA, 20 bp, synthetic construct
  misc_feature 1..20: note = CRISPR gRNA sequence
  source 1..20: mol_type = other DNA
acagccacagtgattgcttt

SEQ ID NO: 73460 - DNA, 20 bp, synthetic construct
  misc_feature 1..20: note = CRISPR gRNA sequence
  source 1..20: mol_type = other DNA
ctttagggtggggcaggtga

SEQ ID NO: 73461 - DNA, 20 bp, synthetic construct
  misc_feature 1..20: note = CRISPR gRNA sequence
  source 1..20: mol_type = other DNA
tagggtggggcaggtgactc

SEQ ID NO: 73462 - DNA, 20 bp, synthetic construct
  misc_feature 1..20: note = CRISPR gRNA sequence
  source 1..20: mol_type = other DNA
agggtggggcaggtgactca

SEQ ID NO: 73463 - DNA, 20 bp, synthetic construct
  misc_feature 1..20: note = CRISPR gRNA sequence
  source 1..20: mol_type = other DNA
gggtggggcaggtgactcaa

SEQ ID NO: 73464 - DNA, 20 bp, synthetic construct
  misc_feature 1..20: note = CRISPR gRNA sequence
  source 1..20: mol_type = other DNA
aagctagtccagtgagactc

SEQ ID NO: 73465 - DNA, 20 bp, synthetic construct
  misc_feature 1..20: note = CRISPR gRNA sequence
  source 1..20: mol_type = other DNA
gtccagtgagactcagtcta

SEQ ID NO: 73466 - DNA, 20 bp, synthetic construct
  misc_feature 1..20: note = CRISPR gRNA sequence
  source 1..20: mol_type = other DNA
agtctaggaccttttgttgt

SEQ ID NO: 73467 - DNA, 20 bp, synthetic construct
  misc_feature 1..20: note = CRISPR gRNA sequence
  source 1..20: mol_type = other DNA
ggaccttttgttgtaaccac

SEQ ID NO: 73468 - DNA, 20 bp, synthetic construct
  misc_feature 1..20: note = CRISPR gRNA sequence
  source 1..20: mol_type = other DNA
ttgttgtaaccacagagaga

SEQ ID NO: 73469 - DNA, 20 bp, synthetic construct
  misc_feature 1..20: note = CRISPR gRNA sequence
  source 1..20: mol_type = other DNA
tgttgtaaccacagagagaa

SEQ ID NO: 73470 - DNA, 20 bp, synthetic construct
  misc_feature 1..20: note = CRISPR gRNA sequence
  source 1..20: mol_type = other DNA
gttgtaaccacagagagaat

SEQ ID NO: 73471 - DNA, 20 bp, synthetic construct
  misc_feature 1..20: note = CRISPR gRNA sequence
  source 1..20: mol_type = other DNA
ttgtaaccacagagagaatg

SEQ ID NO: 73472 - DNA, 20 bp, synthetic construct
  misc_feature 1..20: note = CRISPR gRNA sequence
  source 1..20: mol_type = other DNA
taaccacagagagaatggta

SEQ ID NO: 73473 - DNA, 20 bp, synthetic construct
  misc_feature 1..20: note = CRISPR gRNA sequence
  source 1..20: mol_type = other DNA
cctttccactaagctgagag

SEQ ID NO: 73474 - DNA, 20 bp, synthetic construct
  misc_feature 1..20: note = CRISPR gRNA sequence
  source 1..20: mol_type = other DNA
tccactaagctgagagaaag

SEQ ID NO: 73475 - DNA, 20 bp, synthetic construct
  misc_feature 1..20: note = CRISPR gRNA sequence
  source 1..20: mol_type = other DNA
ccactaagctgagagaaagt

SEQ ID NO: 73476 - DNA, 20 bp, synthetic construct
  misc_feature 1..20: note = CRISPR gRNA sequence
  source 1..20: mol_type = other DNA
cactaagctgagagaaagta

SEQ ID NO: 73477 - DNA, 20 bp, synthetic construct
  misc_feature 1..20: note = CRISPR gRNA sequence
  source 1..20: mol_type = other DNA
agctgagagaaagtaagcct

SEQ ID NO: 73478 - DNA, 20 bp, synthetic construct
  misc_feature 1..20: note = CRISPR gRNA sequence
  source 1..20: mol_type = other DNA
agagaaagtaagcctgcagg

SEQ ID NO: 73479 - DNA, 20 bp, synthetic construct
  misc_feature 1..20: note = CRISPR gRNA sequence
  source 1..20: mol_type = other DNA
caggtgcagggatggcctgc

SEQ ID NO: 73480 - DNA, 20 bp, synthetic construct
  misc_feature 1..20: note = CRISPR gRNA sequence
  source 1..20: mol_type = other DNA
cctgagaaggaagccaaggt

SEQ ID NO: 73481 - DNA, 20 bp, synthetic construct
  misc_feature 1..20: note = CRISPR gRNA sequence
  source 1..20: mol_type = other DNA
agaaggaagccaaggtggac

SEQ ID NO: 73482 - DNA, 20 bp, synthetic construct
  misc_feature 1..20: note = CRISPR gRNA sequence
  source 1..20: mol_type = other DNA
acaaatatagaacccctgga

SEQ ID NO: 73483 - DNA, 20 bp, synthetic construct
  misc_feature 1..20: note = CRISPR gRNA sequence
  source 1..20: mol_type = other DNA
gatccagctgtgcctgaagt

SEQ ID NO: 73484 - DNA, 20 bp, synthetic construct
  misc_feature 1..20: note = CRISPR gRNA sequence
  source 1..20: mol_type = other DNA
tgcctgaagtcattggcctc

SEQ ID NO: 73485 - DNA, 20 bp, synthetic construct
  misc_feature 1..20: note = CRISPR gRNA sequence
  source 1..20: mol_type = other DNA
aagtcattggcctcgtaatt

SEQ ID NO: 73486 - DNA, 20 bp, synthetic construct
  misc_feature 1..20: note = CRISPR gRNA sequence
  source 1..20: mol_type = other DNA
gcctcgtaattttccatgac

SEQ ID NO: 73487 - DNA, 20 bp, synthetic construct
  misc_feature 1..20: note = CRISPR gRNA sequence
  source 1..20: mol_type = other DNA
gtaattttccatgacataag

SEQ ID NO: 73488 - DNA, 20 bp, synthetic construct
  misc_feature 1..20: note = CRISPR gRNA sequence
  source 1..20: mol_type = other DNA
tccatgacataagccaatat

SEQ ID NO: 73489 - DNA, 20 bp, synthetic construct
  misc_feature 1..20: note = CRISPR gRNA sequence
  source 1..20: mol_type = other DNA
ccatgacataagccaatata

SEQ ID NO: 73490 - DNA, 20 bp, synthetic construct
  misc_feature 1..20: note = CRISPR gRNA sequence
  source 1..20: mol_type = other DNA
catgacataagccaatatat

SEQ ID NO: 73491 - DNA, 20 bp, synthetic construct
  misc_feature 1..20: note = CRISPR gRNA sequence
  source 1..20: mol_type = other DNA
ctgtcttggattgctttgag

SEQ ID NO: 73492 - DNA, 20 bp, synthetic construct
  misc_feature 1..20: note = CRISPR gRNA sequence
  source 1..20: mol_type = other DNA
tgtcttggattgctttgagt

SEQ ID NO: 73493 - DNA, 20 bp, synthetic construct
  misc_feature 1..20: note = CRISPR gRNA sequence
  source 1..20: mol_type = other DNA
tcttggattgctttgagttg

SEQ ID NO: 73494 - DNA, 20 bp, synthetic construct
  misc_feature 1..20: note = CRISPR gRNA sequence
  source 1..20: mol_type = other DNA
ggattgctttgagttgtgta

SEQ ID NO: 73495 - DNA, 20 bp, synthetic construct
  misc_feature 1..20: note = CRISPR gRNA sequence
  source 1..20: mol_type = other DNA
gattgctttgagttgtgtat

SEQ ID NO: 73496 - DNA, 20 bp, synthetic construct
  misc_feature 1..20: note = CRISPR gRNA sequence
  source 1..20: mol_type = other DNA
ctttgagttgtgtattctgt

SEQ ID NO: 73497 - DNA, 20 bp, synthetic construct
  misc_feature 1..20: note = CRISPR gRNA sequence
  source 1..20: mol_type = other DNA
tgagttgtgtattctgtttc

SEQ ID NO: 73498 - DNA, 20 bp, synthetic construct
  misc_feature 1..20: note = CRISPR gRNA sequence
  source 1..20: mol_type = other DNA
gagttgtgtattctgtttcc

SEQ ID NO: 73499 - DNA, 20 bp, synthetic construct
  misc_feature 1..20: note = CRISPR gRNA sequence
  source 1..20: mol_type = other DNA
agttgtgtattctgtttcct

SEQ ID NO: 73500 - DNA, 20 bp, synthetic construct
  misc_feature 1..20: note = CRISPR gRNA sequence
  source 1..20: mol_type = other DNA
tgtattctgtttcctatgac

SEQ ID NO: 73501 - DNA, 20 bp, synthetic construct
  misc_feature 1..20: note = CRISPR gRNA sequence
  source 1..20: mol_type = other DNA
tgtttcctatgaccaaggtt

SEQ ID NO: 73502 - DNA, 20 bp, synthetic construct
  misc_feature 1..20: note = CRISPR gRNA sequence
  source 1..20: mol_type = other DNA
tttcctatgaccaaggttct

SEQ ID NO: 73503 - DNA, 20 bp, synthetic construct
  misc_feature 1..20: note = CRISPR gRNA sequence
  source 1..20: mol_type = other DNA
cctatgaccaaggttcttgc

SEQ ID NO: 73504 - DNA, 20 bp, synthetic construct
  misc_feature 1..20: note = CRISPR gRNA sequence
  source 1..20: mol_type = other DNA
ctatgaccaaggttcttgct

SEQ ID NO: 73505 - DNA, 20 bp, synthetic construct
  misc_feature 1..20: note = CRISPR gRNA sequence
  source 1..20: mol_type = other DNA
tgaccaaggttcttgctggc

SEQ ID NO: 73506 - DNA, 20 bp, synthetic construct
  misc_feature 1..20: note = CRISPR gRNA sequence
  source 1..20: mol_type = other DNA
ttgctggcactgagatccag

SEQ ID NO: 73507 - DNA, 20 bp, synthetic construct
  misc_feature 1..20: note = CRISPR gRNA sequence
  source 1..20: mol_type = other DNA
gctggcactgagatccagaa

SEQ ID NO: 73508 - DNA, 20 bp, synthetic construct
  misc_feature 1..20: note = CRISPR gRNA sequence
  source 1..20: mol_type = other DNA
ctggcactgagatccagaat

SEQ ID NO: 73509 - DNA, 20 bp, synthetic construct
  misc_feature 1..20: note = CRISPR gRNA sequence
  source 1..20: mol_type = other DNA
gcactgagatccagaataga

SEQ ID NO: 73510 - DNA, 20 bp, synthetic construct
  misc_feature 1..20: note = CRISPR gRNA sequence
  source 1..20: mol_type = other DNA
agatccagaatagaaagtaa

SEQ ID NO: 73511 - DNA, 20 bp, synthetic construct
  misc_feature 1..20: note = CRISPR gRNA sequence
  source 1..20: mol_type = other DNA
agctcacctgggtccatcca

SEQ ID NO: 73512 - DNA, 20 bp, synthetic construct
  misc_feature 1..20: note = CRISPR gRNA sequence
  source 1..20: mol_type = other DNA
acctgggtccatccagaaac

SEQ ID NO: 73513 - DNA, 20 bp, synthetic construct
  misc_feature 1..20: note = CRISPR gRNA sequence
  source 1..20: mol_type = other DNA
ggtccatccagaaacatggc

SEQ ID NO: 73514 - DNA, 20 bp, synthetic construct
  misc_feature 1..20: note = CRISPR gRNA sequence
  source 1..20: mol_type = other DNA
gtgttcacaaaacatgcaaa

SEQ ID NO: 73515 - DNA, 20 bp, synthetic construct
  misc_feature 1..20: note = CRISPR gRNA sequence
  source 1..20: mol_type = other DNA
tgttcacaaaacatgcaaag

SEQ ID NO: 73516 - DNA, 20 bp, synthetic construct
  misc_feature 1..20: note = CRISPR gRNA sequence
  source 1..20: mol_type = other DNA
acaaaacatgcaaaggttcc

SEQ ID NO: 73517 - DNA, 20 bp, synthetic construct
  misc_feature 1..20: note = CRISPR gRNA sequence
  source 1..20: mol_type = other DNA
ctaggcatgctactcactga

SEQ ID NO: 73518 - DNA, 20 bp, synthetic construct
  misc_feature 1..20: note = CRISPR gRNA sequence
  source 1..20: mol_type = other DNA
ggcatgctactcactgacca

SEQ ID NO: 73519 - DNA, 20 bp, synthetic construct
  misc_feature 1..20: note = CRISPR gRNA sequence
  source 1..20: mol_type = other DNA
ctcactgaccatgcagcact

SEQ ID NO: 73520 - DNA, 20 bp, synthetic construct
  misc_feature 1..20: note = CRISPR gRNA sequence
  source 1..20: mol_type = other DNA
actgaccatgcagcactaag

SEQ ID NO: 73521 - DNA, 20 bp, synthetic construct
  misc_feature 1..20: note = CRISPR gRNA sequence
  source 1..20: mol_type = other DNA
accatgcagcactaagcacc

SEQ ID NO: 73522 - DNA, 20 bp, synthetic construct
  misc_feature 1..20: note = CRISPR gRNA sequence
  source 1..20: mol_type = other DNA
agcaccatcacccctcactc

SEQ ID NO: 73523 - DNA, 20 bp, synthetic construct
  misc_feature 1..20: note = CRISPR gRNA sequence
  source 1..20: mol_type = other DNA
actcactcctttccccatta

SEQ ID NO: 73524 - DNA, 20 bp, synthetic construct
  misc_feature 1..20: note = CRISPR gRNA sequence
  source 1..20: mol_type = other DNA
actcctttccccattaacca

SEQ ID NO: 73525 - DNA, 20 bp, synthetic construct
  misc_feature 1..20: note = CRISPR gRNA sequence
  source 1..20: mol_type = other DNA
ctttccccattaaccactgt

SEQ ID NO: 73526 - DNA, 20 bp, synthetic construct
  misc_feature 1..20: note = CRISPR gRNA sequence
  source 1..20: mol_type = other DNA
tccccattaaccactgtcat

SEQ ID NO: 73527 - DNA, 20 bp, synthetic construct
  misc_feature 1..20: note = CRISPR gRNA sequence
  source 1..20: mol_type = other DNA
ccccattaaccactgtcatc

SEQ ID NO: 73528 - DNA, 20 bp, synthetic construct
  misc_feature 1..20: note = CRISPR gRNA sequence
  source 1..20: mol_type = other DNA
cccattaaccactgtcatcc

SEQ ID NO: 73529 - DNA, 20 bp, synthetic construct
  misc_feature 1..20: note = CRISPR gRNA sequence
  source 1..20: mol_type = other DNA
accactgtcatccctcactc

SEQ ID NO: 73530 - DNA, 20 bp, synthetic construct
  misc_feature 1..20: note = CRISPR gRNA sequence
  source 1..20: mol_type = other DNA
tcatccctcactcaccccct

SEQ ID NO: 73531 - DNA, 20 bp, synthetic construct
  misc_feature 1..20: note = CRISPR gRNA sequence
  source 1..20: mol_type = other DNA
actcacccccttccccatta

SEQ ID NO: 73532 - DNA, 20 bp, synthetic construct
  misc_feature 1..20: note = CRISPR gRNA sequence
  source 1..20: mol_type = other DNA
acccccttccccattaacca

SEQ ID NO: 73533 - DNA, 20 bp, synthetic construct
  misc_feature 1..20: note = CRISPR gRNA sequence
  source 1..20: mol_type = other DNA
ccccattaaccaaccccacc

SEQ ID NO: 73534 - DNA, 20 bp, synthetic construct
  misc_feature 1..20: note = CRISPR gRNA sequence
  source 1..20: mol_type = other DNA
cccattaaccaaccccacca

SEQ ID NO: 73535 - DNA, 20 bp, synthetic construct
  misc_feature 1..20: note = CRISPR gRNA sequence
  source 1..20: mol_type = other DNA
accaaccccaccactcactc

SEQ ID NO: 73536 - DNA, 20 bp, synthetic construct
  misc_feature 1..20: note = CRISPR gRNA sequence
  source 1..20: mol_type = other DNA
actcacaactcttccctatt

SEQ ID NO: 73537 - DNA, 20 bp, synthetic construct
  misc_feature 1..20: note = CRISPR gRNA sequence
  source 1..20: mol_type = other DNA
acaactcttccctattaacc

SEQ ID NO: 73538 - DNA, 20 bp, synthetic construct
  misc_feature 1..20: note = CRISPR gRNA sequence
  source 1..20: mol_type = other DNA
ttccctattaaccaccccca

SEQ ID NO: 73539 - DNA, 20 bp, synthetic construct
  misc_feature 1..20: note = CRISPR gRNA sequence
  source 1..20: mol_type = other DNA
ccctattaaccacccccacc

SEQ ID NO: 73540 - DNA, 20 bp, synthetic construct
  misc_feature 1..20: note = CRISPR gRNA sequence
  source 1..20: mol_type = other DNA
cctattaaccacccccaccc

SEQ ID NO: 73541 - DNA, 20 bp, synthetic construct
  misc_feature 1..20: note = CRISPR gRNA sequence
  source 1..20: mol_type = other DNA
ttaaccacccccacccctta

SEQ ID NO: 73542 - DNA, 20 bp, synthetic construct
  misc_feature 1..20: note = CRISPR gRNA sequence
  source 1..20: mol_type = other DNA
accacccccaccccttactc

SEQ ID NO: 73543 - DNA, 20 bp, synthetic construct
  misc_feature 1..20: note = CRISPR gRNA sequence
  source 1..20: mol_type = other DNA
actcacccccttccccatta

SEQ ID NO: 73544 - DNA, 20 bp, synthetic construct
  misc_feature 1..20: note = CRISPR gRNA sequence
  source 1..20: mol_type = other DNA
ctcacccccttccccattaa

SEQ ID NO: 73545 - DNA, 20 bp, synthetic construct
  misc_feature 1..20: note = CRISPR gRNA sequence
  source 1..20: mol_type = other DNA
acccccttccccattaacca

SEQ ID NO: 73546 - DNA, 20 bp, synthetic construct
  misc_feature 1..20: note = CRISPR gRNA sequence
  source 1..20: mol_type = other DNA
ccccattaaccaccatcacc

SEQ ID NO: 73547 - DNA, 20 bp, synthetic construct
  misc_feature 1..20: note = CRISPR gRNA sequence
  source 1..20: mol_type = other DNA
cccattaaccaccatcacca

SEQ ID NO: 73548 - DNA, 20 bp, synthetic construct
  misc_feature 1..20: note = CRISPR gRNA sequence
  source 1..20: mol_type = other DNA
accaccatcaccactcactc

SEQ ID NO: 73549 - DNA, 20 bp, synthetic construct
  misc_feature 1..20: note = CRISPR gRNA sequence
  source 1..20: mol_type = other DNA
actcacaacccttccccatt

SEQ ID NO: 73550 - DNA, 20 bp, synthetic construct
  misc_feature 1..20: note = CRISPR gRNA sequence
  source 1..20: mol_type = other DNA
acaacccttccccattaacc

SEQ ID NO: 73551 - DNA, 20 bp, synthetic construct
  misc_feature 1..20: note = CRISPR gRNA sequence
  source 1..20: mol_type = other DNA
ccccattaaccaccatcacc

SEQ ID NO: 73552 - DNA, 20 bp, synthetic construct
  misc_feature 1..20: note = CRISPR gRNA sequence
  source 1..20: mol_type = other DNA
cccattaaccaccatcacca

SEQ ID NO: 73553 - DNA, 20 bp, synthetic construct
  misc_feature 1..20: note = CRISPR gRNA sequence
  source 1..20: mol_type = other DNA
accaccatcaccactcactc

SEQ ID NO: 73554 - DNA, 20 bp, synthetic construct
  misc_feature 1..20: note = CRISPR gRNA sequence
  source 1..20: mol_type = other DNA
actcccttcccattaaccac

SEQ ID NO: 73555 - DNA, 20 bp, synthetic construct
  misc_feature 1..20: note = CRISPR gRNA sequence
  source 1..20: mol_type = other DNA
ccttcccattaaccaccatc

SEQ ID NO: 73556 - DNA, 20 bp, synthetic construct
  misc_feature 1..20: note = CRISPR gRNA sequence
  source 1..20: mol_type = other DNA
cccattaaccaccatcacca

SEQ ID NO: 73557 - DNA, 20 bp, synthetic construct
  misc_feature 1..20: note = CRISPR gRNA sequence
  source 1..20: mol_type = other DNA
ccattaaccaccatcaccac

SEQ ID NO: 73558 - DNA, 20 bp, synthetic construct
  misc_feature 1..20: note = CRISPR gRNA sequence
  source 1..20: mol_type = other DNA
accaccatcaccactcaccc

SEQ ID NO: 73559 - DNA, 20 bp, synthetic construct
  misc_feature 1..20: note = CRISPR gRNA sequence
  source 1..20: mol_type = other DNA
acccacccccttccccatta

SEQ ID NO: 73560 - DNA, 20 bp, synthetic construct
  misc_feature 1..20: note = CRISPR gRNA sequence
  source 1..20: mol_type = other DNA
ccccattaaccaccaacacc

SEQ ID NO: 73561 - DNA, 20 bp, synthetic construct
  misc_feature 1..20: note = CRISPR gRNA sequence
  source 1..20: mol_type = other DNA
cccattaaccaccaacacca

SEQ ID NO: 73562 - DNA, 20 bp, synthetic construct
  misc_feature 1..20: note = CRISPR gRNA sequence
  source 1..20: mol_type = other DNA
accaccaacaccactcactc

SEQ ID NO: 73563 - DNA, 20 bp, synthetic construct
  misc_feature 1..20: note = CRISPR gRNA sequence
  source 1..20: mol_type = other DNA
actcacccccttccccatta

SEQ ID NO: 73564 - DNA, 20 bp, synthetic construct
  misc_feature 1..20: note = CRISPR gRNA sequence
  source 1..20: mol_type = other DNA
acccccttccccattaacca

SEQ ID NO: 73565 - DNA, 20 bp, synthetic construct
  misc_feature 1..20: note = CRISPR gRNA sequence
  source 1..20: mol_type = other DNA
ccccattaaccaccaccacc

SEQ ID NO: 73566 - DNA, 20 bp, synthetic construct
  misc_feature 1..20: note = CRISPR gRNA sequence
  source 1..20: mol_type = other DNA
cccattaaccaccaccacca

SEQ ID NO: 73567 - DNA, 20 bp, synthetic construct
  misc_feature 1..20: note = CRISPR gRNA sequence
  source 1..20: mol_type = other DNA
accaccaccaccactcactc

SEQ ID NO: 73568 - DNA, 20 bp, synthetic construct
  misc_feature 1..20: note = CRISPR gRNA sequence
  source 1..20: mol_type = other DNA
actcacccccttccccgtta

SEQ ID NO: 73569 - DNA, 20 bp, synthetic construct
  misc_feature 1..20: note = CRISPR gRNA sequence
  source 1..20: mol_type = other DNA
acccccttccccgttaacca

SEQ ID NO: 73570 - DNA, 20 bp, synthetic construct
  misc_feature 1..20: note = CRISPR gRNA sequence
  source 1..20: mol_type = other DNA
ccccgttaaccaaccccacc

SEQ ID NO: 73571 - DNA, 20 bp, synthetic construct
  misc_feature 1..20: note = CRISPR gRNA sequence
  source 1..20: mol_type = other DNA
cccgttaaccaaccccacca

SEQ ID NO: 73572 - DNA, 20 bp, synthetic construct
  misc_feature 1..20: note = CRISPR gRNA sequence
  source 1..20: mol_type = other DNA
accaaccccaccactcactc

SEQ ID NO: 73573 - DNA, 20 bp, synthetic construct
  misc_feature 1..20: note = CRISPR gRNA sequence
  source 1..20: mol_type = other DNA
actcacaacccttccccatt

SEQ ID NO: 73574 - DNA, 20 bp, synthetic construct
  misc_feature 1..20: note = CRISPR gRNA sequence
  source 1..20: mol_type = other DNA
acaacccttccccattaacc

SEQ ID NO: 73575 - DNA, 20 bp, synthetic construct
  misc_feature 1..20: note = CRISPR gRNA sequence
  source 1..20: mol_type = other DNA
ccccattaaccaccatcatc

SEQ ID NO: 73576 - DNA, 20 bp, synthetic construct
  misc_feature 1..20: note = CRISPR gRNA sequence
  source 1..20: mol_type = other DNA
cccattaaccaccatcatcg

SEQ ID NO: 73577 - DNA, 20 bp, synthetic construct
  misc_feature 1..20: note = CRISPR gRNA sequence
  source 1..20: mol_type = other DNA
accaccatcatcgctcactc

SEQ ID NO: 73578 - DNA, 20 bp, synthetic construct
  misc_feature 1..20: note = CRISPR gRNA sequence
  source 1..20: mol_type = other DNA
actcacccccttccccatta

SEQ ID NO: 73579 - DNA, 20 bp, synthetic construct
  misc_feature 1..20: note = CRISPR gRNA sequence
  source 1..20: mol_type = other DNA
acccccttccccattaacca

SEQ ID NO: 73580 - DNA, 20 bp, synthetic construct
  misc_feature 1..20: note = CRISPR gRNA sequence
  source 1..20: mol_type = other DNA
ccccattaaccaccaacacc

SEQ ID NO: 73581 - DNA, 20 bp, synthetic construct
  misc_feature 1..20: note = CRISPR gRNA sequence
  source 1..20: mol_type = other DNA
cccattaaccaccaacacca

SEQ ID NO: 73582 - DNA, 20 bp, synthetic construct
  misc_feature 1..20: note = CRISPR gRNA sequence
  source 1..20: mol_type = other DNA
accaccaacaccactcactc

SEQ ID NO: 73583 - DNA, 20 bp, synthetic construct
  misc_feature 1..20: note = CRISPR gRNA sequence
  source 1..20: mol_type = other DNA
actcacaacccttccccatt

SEQ ID NO: 73584 - DNA, 20 bp, synthetic construct
  misc_feature 1..20: note = CRISPR gRNA sequence
  source 1..20: mol_type = other DNA
acaacccttccccattaacc

SEQ ID NO: 73585 - DNA, 20 bp, synthetic construct
  misc_feature 1..20: note = CRISPR gRNA sequence
  source 1..20: mol_type = other DNA
ccccattaaccaccatcacc

SEQ ID NO: 73586 - DNA, 20 bp, synthetic construct
  misc_feature 1..20: note = CRISPR gRNA sequence
  source 1..20: mol_type = other DNA
cccattaaccaccatcacca

SEQ ID NO: 73587 - DNA, 20 bp, synthetic construct
  misc_feature 1..20: note = CRISPR gRNA sequence
  source 1..20: mol_type = other DNA
accaccatcaccactcactc

SEQ ID NO: 73588 - DNA, 20 bp, synthetic construct
  misc_feature 1..20: note = CRISPR gRNA sequence
  source 1..20: mol_type = other DNA
actcacaacacttccccatt

SEQ ID NO: 73589 - DNA, 20 bp, synthetic construct
  misc_feature 1..20: note = CRISPR gRNA sequence
  source 1..20: mol_type = other DNA
acaacacttccccattaacc

SEQ ID NO: 73590 - DNA, 20 bp, synthetic construct
  misc_feature 1..20: note = CRISPR gRNA sequence
  source 1..20: mol_type = other DNA
ccccattaaccaccaacacc

SEQ ID NO: 73591 - DNA, 20 bp, synthetic construct
  misc_feature 1..20: note = CRISPR gRNA sequence
  source 1..20: mol_type = other DNA
cccattaaccaccaacacca

SEQ ID NO: 73592 - DNA, 20 bp, synthetic construct
  misc_feature 1..20: note = CRISPR gRNA sequence
  source 1..20: mol_type = other DNA
accaccaacaccactcactc

SEQ ID NO: 73593 - DNA, 20 bp, synthetic construct
  misc_feature 1..20: note = CRISPR gRNA sequence
  source 1..20: mol_type = other DNA
actcacccccttccccatta

SEQ ID NO: 73594 - DNA, 20 bp, synthetic construct
  misc_feature 1..20: note = CRISPR gRNA sequence
  source 1..20: mol_type = other DNA
acccccttccccattaacca

SEQ ID NO: 73595 - DNA, 20 bp, synthetic construct
  misc_feature 1..20: note = CRISPR gRNA sequence
  source 1..20: mol_type = other DNA
ccccattaaccaccatcacc

SEQ ID NO: 73596 - DNA, 20 bp, synthetic construct
  misc_feature 1..20: note = CRISPR gRNA sequence
  source 1..20: mol_type = other DNA
cccattaaccaccatcacca

SEQ ID NO: 73597 - DNA, 20 bp, synthetic construct
  misc_feature 1..20: note = CRISPR gRNA sequence
  source 1..20: mol_type = other DNA
accaccatcaccactcactc

SEQ ID NO: 73598 - DNA, 20 bp, synthetic construct
  misc_feature 1..20: note = CRISPR gRNA sequence
  source 1..20: mol_type = other DNA
actcacaacccttccccatt

SEQ ID NO: 73599 - DNA, 20 bp, synthetic construct
  misc_feature 1..20: note = CRISPR gRNA sequence
  source 1..20: mol_type = other DNA
acaacccttccccattaacc

SEQ ID NO: 73600 - DNA, 20 bp, synthetic construct
  misc_feature 1..20: note = CRISPR gRNA sequence
  source 1..20: mol_type = other DNA
ccccattaaccaaccatcac

SEQ ID NO: 73601 - DNA, 20 bp, synthetic construct
  misc_feature 1..20: note = CRISPR gRNA sequence
  source 1..20: mol_type = other DNA
cccattaaccaaccatcacc

SEQ ID NO: 73602 - DNA, 20 bp, synthetic construct
  misc_feature 1..20: note = CRISPR gRNA sequence
  source 1..20: mol_type = other DNA
accaaccatcaccactcact

SEQ ID NO: 73603 - DNA, 20 bp, synthetic construct
  misc_feature 1..20: note = CRISPR gRNA sequence
  source 1..20: mol_type = other DNA
actcacaacgcttccccatt

SEQ ID NO: 73604 - DNA, 20 bp, synthetic construct
  misc_feature 1..20: note = CRISPR gRNA sequence
  source 1..20: mol_type = other DNA
acaacgcttccccattaacc

SEQ ID NO: 73605 - DNA, 20 bp, synthetic construct
  misc_feature 1..20: note = CRISPR gRNA sequence
  source 1..20: mol_type = other DNA
ccccattaaccaaccccaca

SEQ ID NO: 73606 - DNA, 20 bp, synthetic construct
  misc_feature 1..20: note = CRISPR gRNA sequence
  source 1..20: mol_type = other DNA
cccattaaccaaccccacaa

SEQ ID NO: 73607 - DNA, 20 bp, synthetic construct
  misc_feature 1..20: note = CRISPR gRNA sequence
  source 1..20: mol_type = other DNA
accaaccccacaactcactc

SEQ ID NO: 73608 - DNA, 20 bp, synthetic construct
  misc_feature 1..20: note = CRISPR gRNA sequence
  source 1..20: mol_type = other DNA
actcacaacccttccccatt

SEQ ID NO: 73609 - DNA, 20 bp, synthetic construct
  misc_feature 1..20: note = CRISPR gRNA sequence
  source 1..20: mol_type = other DNA
acaacccttccccattaacc

SEQ ID NO: 73610 - DNA, 20 bp, synthetic construct
  misc_feature 1..20: note = CRISPR gRNA sequence
  source 1..20: mol_type = other DNA
ccccattaaccaccatcatc

SEQ ID NO: 73611 - DNA, 20 bp, synthetic construct
  misc_feature 1..20: note = CRISPR gRNA sequence
  source 1..20: mol_type = other DNA
cccattaaccaccatcatca

SEQ ID NO: 73612 - DNA, 20 bp, synthetic construct
  misc_feature 1..20: note = CRISPR gRNA sequence
  source 1..20: mol_type = other DNA
accaccatcatcactcactc

SEQ ID NO: 73613 - DNA, 20 bp, synthetic construct
  misc_feature 1..20: note = CRISPR gRNA sequence
  source 1..20: mol_type = other DNA
actccctcccttccccatta

SEQ ID NO: 73614 - DNA, 20 bp, synthetic construct
  misc_feature 1..20: note = CRISPR gRNA sequence
  source 1..20: mol_type = other DNA
cctcccttccccattaacca

SEQ ID NO: 73615 - DNA, 20 bp, synthetic construct
  misc_feature 1..20: note = CRISPR gRNA sequence
  source 1..20: mol_type = other DNA
ccttccccattaaccaccaa

SEQ ID NO: 73616 - DNA, 20 bp, synthetic construct
  misc_feature 1..20: note = CRISPR gRNA sequence
  source 1..20: mol_type = other DNA
ccccattaaccaccaacgcc

SEQ ID NO: 73617 - DNA, 20 bp, synthetic construct
  misc_feature 1..20: note = CRISPR gRNA sequence
  source 1..20: mol_type = other DNA
cccattaaccaccaacgcca

SEQ ID NO: 73618 - DNA, 20 bp, synthetic construct
  misc_feature 1..20: note = CRISPR gRNA sequence
  source 1..20: mol_type = other DNA
accaccaacgccactcactc

SEQ ID NO: 73619 - DNA, 20 bp, synthetic construct
  misc_feature 1..20: note = CRISPR gRNA sequence
  source 1..20: mol_type = other DNA
actcacaacccttccccatt

SEQ ID NO: 73620 - DNA, 20 bp, synthetic construct
  misc_feature 1..20: note = CRISPR gRNA sequence
  source 1..20: mol_type = other DNA
acaacccttccccattaatc

SEQ ID NO: 73621 - DNA, 20 bp, synthetic construct
  misc_feature 1..20: note = CRISPR gRNA sequence
  source 1..20: mol_type = other DNA
ccccattaatcaccatcacc

SEQ ID NO: 73622 - DNA, 20 bp, synthetic construct
  misc_feature 1..20: note = CRISPR gRNA sequence
  source 1..20: mol_type = other DNA
cccattaatcaccatcacca

SEQ ID NO: 73623 - DNA, 20 bp, synthetic construct
  misc_feature 1..20: note = CRISPR gRNA sequence
  source 1..20: mol_type = other DNA
atcaccatcaccactcactc

SEQ ID NO: 73624 - DNA, 20 bp, synthetic construct
  misc_feature 1..20: note = CRISPR gRNA sequence
  source 1..20: mol_type = other DNA
actcacaacacttccccatt

SEQ ID NO: 73625 - DNA, 20 bp, synthetic construct
  misc_feature 1..20: note = CRISPR gRNA sequence
  source 1..20: mol_type = other DNA
acaacacttccccattaacc

SEQ ID NO: 73626 - DNA, 20 bp, synthetic construct
  misc_feature 1..20: note = CRISPR gRNA sequence
  source 1..20: mol_type = other DNA
ccccattaaccaaccccacc

SEQ ID NO: 73627 - DNA, 20 bp, synthetic construct
  misc_feature 1..20: note = CRISPR gRNA sequence
  source 1..20: mol_type = other DNA
cccattaaccaaccccacca

SEQ ID NO: 73628 - DNA, 20 bp, synthetic construct
  misc_feature 1..20: note = CRISPR gRNA sequence
  source 1..20: mol_type = other DNA
accaaccccaccactcactc

SEQ ID NO: 73629 - DNA, 20 bp, synthetic construct
  misc_feature 1..20: note = CRISPR gRNA sequence
  source 1..20: mol_type = other DNA
actcacccccttccccatta

SEQ ID NO: 73630 - DNA, 20 bp, synthetic construct
  misc_feature 1..20: note = CRISPR gRNA sequence
  source 1..20: mol_type = other DNA
acccccttccccattaacca

SEQ ID NO: 73631 - DNA, 20 bp, synthetic construct
  misc_feature 1..20: note = CRISPR gRNA sequence
  source 1..20: mol_type = other DNA
ccccattaaccaccaacacc

SEQ ID NO: 73632 - DNA, 20 bp, synthetic construct
  misc_feature 1..20: note = CRISPR gRNA sequence
  source 1..20: mol_type = other DNA
cccattaaccaccaacacca

SEQ ID NO: 73633 - DNA, 20 bp, synthetic construct
  misc_feature 1..20: note = CRISPR gRNA sequence
  source 1..20: mol_type = other DNA
accaccaacaccactcactc

SEQ ID NO: 73634 - DNA, 20 bp, synthetic construct
  misc_feature 1..20: note = CRISPR gRNA sequence
  source 1..20: mol_type = other DNA
actcacaactcttccccatt

SEQ ID NO: 73635 - DNA, 20 bp, synthetic construct
  misc_feature 1..20: note = CRISPR gRNA sequence
  source 1..20: mol_type = other DNA
acaactcttccccattaacc

SEQ ID NO: 73636 - DNA, 20 bp, synthetic construct
  misc_feature 1..20: note = CRISPR gRNA sequence
  source 1..20: mol_type = other DNA
ttccccattaaccaccatca

SEQ ID NO: 73637 - DNA, 20 bp, synthetic construct
  misc_feature 1..20: note = CRISPR gRNA sequence
  source 1..20: mol_type = other DNA
ccccattaaccaccatcacc

SEQ ID NO: 73638 - DNA, 20 bp, synthetic construct
  misc_feature 1..20: note = CRISPR gRNA sequence
  source 1..20: mol_type = other DNA
cccattaaccaccatcacca

SEQ ID NO: 73639 - DNA, 20 bp, synthetic construct
  misc_feature 1..20: note = CRISPR gRNA sequence
  source 1..20: mol_type = other DNA
accaccatcaccactcactc

SEQ ID NO: 73640 - DNA, 20 bp, synthetic construct
  misc_feature 1..20: note = CRISPR gRNA sequence
  source 1..20: mol_type = other DNA
actcacccccttccccatta

SEQ ID NO: 73641 - DNA, 20 bp, synthetic construct
  misc_feature 1..20: note = CRISPR gRNA sequence
  source 1..20: mol_type = other DNA
acccccttccccattaacca

SEQ ID NO: 73642 - DNA, 20 bp, synthetic construct
  misc_feature 1..20: note = CRISPR gRNA sequence
  source 1..20: mol_type = other DNA
ccccattaaccaacgccacc

SEQ ID NO: 73643 - DNA, 20 bp, synthetic construct
  misc_feature 1..20: note = CRISPR gRNA sequence
  source 1..20: mol_type = other DNA
cccattaaccaacgccacca

SEQ ID NO: 73644 - DNA, 20 bp, synthetic construct
  misc_feature 1..20: note = CRISPR gRNA sequence
  source 1..20: mol_type = other DNA
accaacgccaccactcactc

SEQ ID NO: 73645 - DNA, 20 bp, synthetic construct
  misc_feature 1..20: note = CRISPR gRNA sequence
  source 1..20: mol_type = other DNA
actcacaacccttccccatt

SEQ ID NO: 73646 - DNA, 20 bp, synthetic construct
  misc_feature 1..20: note = CRISPR gRNA sequence
  source 1..20: mol_type = other DNA
acaacccttccccattaacc

SEQ ID NO: 73647 - DNA, 20 bp, synthetic construct
  misc_feature 1..20: note = CRISPR gRNA sequence
  source 1..20: mol_type = other DNA
ccccattaaccaccaacacc

SEQ ID NO: 73648 - DNA, 20 bp, synthetic construct
  misc_feature 1..20: note = CRISPR gRNA sequence
  source 1..20: mol_type = other DNA
cccattaaccaccaacacca

SEQ ID NO: 73649 - DNA, 20 bp, synthetic construct
  misc_feature 1..20: note = CRISPR gRNA sequence
  source 1..20: mol_type = other DNA
accaccaacaccactcactc

SEQ ID NO: 73650 - DNA, 20 bp, synthetic construct
  misc_feature 1..20: note = CRISPR gRNA sequence
  source 1..20: mol_type = other DNA
actcatctccttccccatta

SEQ ID NO: 73651 - DNA, 20 bp, synthetic construct
  misc_feature 1..20: note = CRISPR gRNA sequence
  source 1..20: mol_type = other DNA
atctccttccccattaacca

SEQ ID NO: 73652 - DNA, 20 bp, synthetic construct
  misc_feature 1..20: note = CRISPR gRNA sequence
  source 1..20: mol_type = other DNA
cttccccattaaccaccaac

SEQ ID NO: 73653 - DNA, 20 bp, synthetic construct
  misc_feature 1..20: note = CRISPR gRNA sequence
  source 1..20: mol_type = other DNA
ccccattaaccaccaacaca

SEQ ID NO: 73654 - DNA, 20 bp, synthetic construct
  misc_feature 1..20: note = CRISPR gRNA sequence
  source 1..20: mol_type = other DNA
cccattaaccaccaacacaa

SEQ ID NO: 73655 - DNA, 20 bp, synthetic construct
  misc_feature 1..20: note = CRISPR gRNA sequence
  source 1..20: mol_type = other DNA
accaccaacacaactcactc

SEQ ID NO: 73656 - DNA, 20 bp, synthetic construct
  misc_feature 1..20: note = CRISPR gRNA sequence
  source 1..20: mol_type = other DNA
actcacaacacttccccatt

SEQ ID NO: 73657 - DNA, 20 bp, synthetic construct
  misc_feature 1..20: note = CRISPR gRNA sequence
  source 1..20: mol_type = other DNA
acaacacttccccattaacc

SEQ ID NO: 73658 - DNA, 20 bp, synthetic construct
  misc_feature 1..20: note = CRISPR gRNA sequence
  source 1..20: mol_type = other DNA
ccccattaaccaccatcacc

SEQ ID NO: 73659 - DNA, 20 bp, synthetic construct
  misc_feature 1..20: note = CRISPR gRNA sequence
  source 1..20: mol_type = other DNA
cccattaaccaccatcacca

SEQ ID NO: 73660 - DNA, 20 bp, synthetic construct
  misc_feature 1..20: note = CRISPR gRNA sequence
  source 1..20: mol_type = other DNA
accaccatcaccactcactc

SEQ ID NO: 73661 - DNA, 20 bp, synthetic construct
  misc_feature 1..20: note = CRISPR gRNA sequence
  source 1..20: mol_type = other DNA
actcacccccttccccatta

SEQ ID NO: 73662 - DNA, 20 bp, synthetic construct
  misc_feature 1..20: note = CRISPR gRNA sequence
  source 1..20: mol_type = other DNA
acccccttccccattaacca

SEQ ID NO: 73663 - DNA, 20 bp, synthetic construct
  misc_feature 1..20: note = CRISPR gRNA sequence
  source 1..20: mol_type = other DNA
ccccattaaccaccatcacc

SEQ ID NO: 73664 - DNA, 20 bp, synthetic construct
  misc_feature 1..20: note = CRISPR gRNA sequence
  source 1..20: mol_type = other DNA
cccattaaccaccatcacca

SEQ ID NO: 73665 - DNA, 20 bp, synthetic construct
  misc_feature 1..20: note = CRISPR gRNA sequence
  source 1..20: mol_type = other DNA
accaccatcaccactctcac

SEQ ID NO: 73666 - DNA, 20 bp, synthetic construct
  misc_feature 1..20: note = CRISPR gRNA sequence
  source 1..20: mol_type = other DNA
tcacacccttccccattaac

SEQ ID NO: 73667 - DNA, 20 bp, synthetic construct
  misc_feature 1..20: note = CRISPR gRNA sequence
  source 1..20: mol_type = other DNA
acacccttccccattaacca

SEQ ID NO: 73668 - DNA, 20 bp, synthetic construct
  misc_feature 1..20: note = CRISPR gRNA sequence
  source 1..20: mol_type = other DNA
ccccattaaccaccatcacc

SEQ ID NO: 73669 - DNA, 20 bp, synthetic construct
  misc_feature 1..20: note = CRISPR gRNA sequence
  source 1..20: mol_type = other DNA
cccattaaccaccatcacca

SEQ ID NO: 73670 - DNA, 20 bp, synthetic construct
  misc_feature 1..20: note = CRISPR gRNA sequence
  source 1..20: mol_type = other DNA
accaccatcaccactcactc

SEQ ID NO: 73671 - DNA, 20 bp, synthetic construct
  misc_feature 1..20: note = CRISPR gRNA sequence
  source 1..20: mol_type = other DNA
actcaccccattccccatta

SEQ ID NO: 73672 - DNA, 20 bp, synthetic construct
  misc_feature 1..20: note = CRISPR gRNA sequence
  source 1..20: mol_type = other DNA
accccattccccattaacca

SEQ ID NO: 73673 - DNA, 20 bp, synthetic construct
  misc_feature 1..20: note = CRISPR gRNA sequence
  source 1..20: mol_type = other DNA
cccattaaccactcccacca

SEQ ID NO: 73674 - DNA, 20 bp, synthetic construct
  misc_feature 1..20: note = CRISPR gRNA sequence
  source 1..20: mol_type = other DNA
accactcccaccactcactc

SEQ ID NO: 73675 - DNA, 20 bp, synthetic construct
  misc_feature 1..20: note = CRISPR gRNA sequence
  source 1..20: mol_type = other DNA
ccaccactcactcagcccat

SEQ ID NO: 73676 - DNA, 20 bp, synthetic construct
  misc_feature 1..20: note = CRISPR gRNA sequence
  source 1..20: mol_type = other DNA
actcagcccattccccatta

SEQ ID NO: 73677 - DNA, 20 bp, synthetic construct
  misc_feature 1..20: note = CRISPR gRNA sequence
  source 1..20: mol_type = other DNA
agcccattccccattaacca

SEQ ID NO: 73678 - DNA, 20 bp, synthetic construct
  misc_feature 1..20: note = CRISPR gRNA sequence
  source 1..20: mol_type = other DNA
cccattaaccactcccacca

SEQ ID NO: 73679 - DNA, 20 bp, synthetic construct
  misc_feature 1..20: note = CRISPR gRNA sequence
  source 1..20: mol_type = other DNA
accactcccaccactcactc

SEQ ID NO: 73680 - DNA, 20 bp, synthetic construct
  misc_feature 1..20: note = CRISPR gRNA sequence
  source 1..20: mol_type = other DNA
ccaccactcactcaccccat

SEQ ID NO: 73681 - DNA, 20 bp, synthetic construct
  misc_feature 1..20: note = CRISPR gRNA sequence
  source 1..20: mol_type = other DNA
actcaccccattccccatta

SEQ ID NO: 73682 - DNA, 20 bp, synthetic construct
  misc_feature 1..20: note = CRISPR gRNA sequence
  source 1..20: mol_type = other DNA
accccattccccattaacca

SEQ ID NO: 73683 - DNA, 20 bp, synthetic construct
  misc_feature 1..20: note = CRISPR gRNA sequence
  source 1..20: mol_type = other DNA
cccattaaccaaccccacca

SEQ ID NO: 73684 - DNA, 20 bp, synthetic construct
  misc_feature 1..20: note = CRISPR gRNA sequence
  source 1..20: mol_type = other DNA
accaaccccaccactcaccc

SEQ ID NO: 73685 - DNA, 20 bp, synthetic construct
  misc_feature 1..20: note = CRISPR gRNA sequence
  source 1..20: mol_type = other DNA
acccacttccaccatccatt

SEQ ID NO: 73686 - DNA, 20 bp, synthetic construct
  misc_feature 1..20: note = CRISPR gRNA sequence
  source 1..20: mol_type = other DNA
ccaccatccattaaccaacc

SEQ ID NO: 73687 - DNA, 20 bp, synthetic construct
  misc_feature 1..20: note = CRISPR gRNA sequence
  source 1..20: mol_type = other DNA
caccatccattaaccaaccc

SEQ ID NO: 73688 - DNA, 20 bp, synthetic construct
  misc_feature 1..20: note = CRISPR gRNA sequence
  source 1..20: mol_type = other DNA
accaaccccaccactcaccc

SEQ ID NO: 73689 - DNA, 20 bp, synthetic construct
  misc_feature 1..20: note = CRISPR gRNA sequence
  source 1..20: mol_type = other DNA
acccacttccaccatccatt

SEQ ID NO: 73690 - DNA, 20 bp, synthetic construct
  misc_feature 1..20: note = CRISPR gRNA sequence
  source 1..20: mol_type = other DNA
ccaccatccattaaccaccc

SEQ ID NO: 73691 - DNA, 20 bp, synthetic construct
  misc_feature 1..20: note = CRISPR gRNA sequence
  source 1..20: mol_type = other DNA
caccatccattaaccacccc

SEQ ID NO: 73692 - DNA, 20 bp, synthetic construct
  misc_feature 1..20: note = CRISPR gRNA sequence
  source 1..20: mol_type = other DNA
accacccccaccactcactc

SEQ ID NO: 73693 - DNA, 20 bp, synthetic construct
  misc_feature 1..20: note = CRISPR gRNA sequence
  source 1..20: mol_type = other DNA
actcacccacaaccaccatc

SEQ ID NO: 73694 - DNA, 20 bp, synthetic construct
  misc_feature 1..20: note = CRISPR gRNA sequence
  source 1..20: mol_type = other DNA
acccacaaccaccatcacta

SEQ ID NO: 73695 - DNA, 20 bp, synthetic construct
  misc_feature 1..20: note = CRISPR gRNA sequence
  source 1..20: mol_type = other DNA
cttactccagcctctttagc

SEQ ID NO: 73696 - DNA, 20 bp, synthetic construct
  misc_feature 1..20: note = CRISPR gRNA sequence
  source 1..20: mol_type = other DNA
actccagcctctttagcatc

SEQ ID NO: 73697 - DNA, 20 bp, synthetic construct
  misc_feature 1..20: note = CRISPR gRNA sequence
  source 1..20: mol_type = other DNA
ctccagcctctttagcatcc

SEQ ID NO: 73698 - DNA, 20 bp, synthetic construct
  misc_feature 1..20: note = CRISPR gRNA sequence
  source 1..20: mol_type = other DNA
cagcctctttagcatccatt

SEQ ID NO: 73699 - DNA, 20 bp, synthetic construct
  misc_feature 1..20: note = CRISPR gRNA sequence
  source 1..20: mol_type = other DNA
tttagcatccatttcccctc

SEQ ID NO: 73700 - DNA, 20 bp, synthetic construct
  misc_feature 1..20: note = CRISPR gRNA sequence
  source 1..20: mol_type = other DNA
tagcatccatttcccctcaa

SEQ ID NO: 73701 - DNA, 20 bp, synthetic construct
  misc_feature 1..20: note = CRISPR gRNA sequence
  source 1..20: mol_type = other DNA
agcatccatttcccctcaag

SEQ ID NO: 73702 - DNA, 20 bp, synthetic construct
  misc_feature 1..20: note = CRISPR gRNA sequence
  source 1..20: mol_type = other DNA
gcatccatttcccctcaagg

SEQ ID NO: 73703 - DNA, 20 bp, synthetic construct
  misc_feature 1..20: note = CRISPR gRNA sequence
  source 1..20: mol_type = other DNA
cccctcaagggccctcatca

SEQ ID NO: 73704 - DNA, 20 bp, synthetic construct
  misc_feature 1..20: note = CRISPR gRNA sequence
  source 1..20: mol_type = other DNA
ccctcaagggccctcatcag

SEQ ID NO: 73705 - DNA, 20 bp, synthetic construct
  misc_feature 1..20: note = CRISPR gRNA sequence
  source 1..20: mol_type = other DNA
aagggccctcatcagcgcct

SEQ ID NO: 73706 - DNA, 20 bp, synthetic construct
  misc_feature 1..20: note = CRISPR gRNA sequence
  source 1..20: mol_type = other DNA
atcagcgccttggtgccctc

SEQ ID NO: 73707 - DNA, 20 bp, synthetic construct
  misc_feature 1..20: note = CRISPR gRNA sequence
  source 1..20: mol_type = other DNA
ggtgccctcctcatcaaatt

SEQ ID NO: 73708 - DNA, 20 bp, synthetic construct
  misc_feature 1..20: note = CRISPR gRNA sequence
  source 1..20: mol_type = other DNA
gtgccctcctcatcaaattg

SEQ ID NO: 73709 - DNA, 20 bp, synthetic construct
  misc_feature 1..20: note = CRISPR gRNA sequence
  source 1..20: mol_type = other DNA
ctcatcaaattgattgttag

SEQ ID NO: 73710 - DNA, 20 bp, synthetic construct
  misc_feature 1..20: note = CRISPR gRNA sequence
  source 1..20: mol_type = other DNA
atcaaattgattgttagaca

SEQ ID NO: 73711 - DNA, 20 bp, synthetic construct
  misc_feature 1..20: note = CRISPR gRNA sequence
  source 1..20: mol_type = other DNA
attgttagacaagctgcaga

SEQ ID NO: 73712 - DNA, 20 bp, synthetic construct
  misc_feature 1..20: note = CRISPR gRNA sequence
  source 1..20: mol_type = other DNA
ttagacaagctgcagaagac

SEQ ID NO: 73713 - DNA, 20 bp, synthetic construct
  misc_feature 1..20: note = CRISPR gRNA sequence
  source 1..20: mol_type = other DNA
gacaagctgcagaagaccag

SEQ ID NO: 73714 - DNA, 20 bp, synthetic construct
  misc_feature 1..20: note = CRISPR gRNA sequence
  source 1..20: mol_type = other DNA
cagaagaccaggcagaggca

SEQ ID NO: 73715 - DNA, 20 bp, synthetic construct
  misc_feature 1..20: note = CRISPR gRNA sequence
  source 1..20: mol_type = other DNA
gcgcagcctgcccagccctg

SEQ ID NO: 73716 - DNA, 20 bp, synthetic construct
  misc_feature 1..20: note = CRISPR gRNA sequence
  source 1..20: mol_type = other DNA
cccagccctggagctgagct

SEQ ID NO: 73717 - DNA, 20 bp, synthetic construct
  misc_feature 1..20: note = CRISPR gRNA sequence
  source 1..20: mol_type = other DNA
gagctgagctgtcctgtcag

SEQ ID NO: 73718 - DNA, 20 bp, synthetic construct
  misc_feature 1..20: note = CRISPR gRNA sequence
  source 1..20: mol_type = other DNA
agctgtcctgtcagctcccc

SEQ ID NO: 73719 - DNA, 20 bp, synthetic construct
  misc_feature 1..20: note = CRISPR gRNA sequence
  source 1..20: mol_type = other DNA
tcctgtcagctcccctctcc

SEQ ID NO: 73720 - DNA, 20 bp, synthetic construct
  misc_feature 1..20: note = CRISPR gRNA sequence
  source 1..20: mol_type = other DNA
tcagctcccctctcctgctc

SEQ ID NO: 73721 - DNA, 20 bp, synthetic construct
  misc_feature 1..20: note = CRISPR gRNA sequence
  source 1..20: mol_type = other DNA
ccctctcctgctctgtcccc

SEQ ID NO: 73722 - DNA, 20 bp, synthetic construct
  misc_feature 1..20: note = CRISPR gRNA sequence
  source 1..20: mol_type = other DNA
tcctgctctgtcccctggga

SEQ ID NO: 73723 - DNA, 20 bp, synthetic construct
  misc_feature 1..20: note = CRISPR gRNA sequence
  source 1..20: mol_type = other DNA
ctgctctgtcccctgggagg

SEQ ID NO: 73724 - DNA, 20 bp, synthetic construct
  misc_feature 1..20: note = CRISPR gRNA sequence
  source 1..20: mol_type = other DNA
ctctgtcccctgggaggcca

SEQ ID NO: 73725 - DNA, 20 bp, synthetic construct
  misc_feature 1..20: note = CRISPR gRNA sequence
  source 1..20: mol_type = other DNA
tgtcccctgggaggccaact

SEQ ID NO: 73726 - DNA, 20 bp, synthetic construct
  misc_feature 1..20: note = CRISPR gRNA sequence
  source 1..20: mol_type = other DNA
tcccctgggaggccaactct

SEQ ID NO: 73727 - DNA, 20 bp, synthetic construct
  misc_feature 1..20: note = CRISPR gRNA sequence
  source 1..20: mol_type = other DNA
ggaggccaactctgcatctg

SEQ ID NO: 73728 - DNA, 20 bp, synthetic construct
  misc_feature 1..20: note = CRISPR gRNA sequence
  source 1..20: mol_type = other DNA
tgcatctgcatgccctgggc

SEQ ID NO: 73729 - DNA, 20 bp, synthetic construct
  misc_feature 1..20: note = CRISPR gRNA sequence
  source 1..20: mol_type = other DNA
catctgcatgccctgggcca

SEQ ID NO: 73730 - DNA, 20 bp, synthetic construct
  misc_feature 1..20: note = CRISPR gRNA sequence
  source 1..20: mol_type = other DNA
catgccctgggccaccctcg

SEQ ID NO: 73731 - DNA, 20 bp, synthetic construct
  misc_feature 1..20: note = CRISPR gRNA sequence
  source 1..20: mol_type = other DNA
ggccaccctcgctgtccagg

SEQ ID NO: 73732 - DNA, 20 bp, synthetic construct
  misc_feature 1..20: note = CRISPR gRNA sequence
  source 1..20: mol_type = other DNA
gctgtccaggttccccatgg

SEQ ID NO: 73733 - DNA, 20 bp, synthetic construct
  misc_feature 1..20: note = CRISPR gRNA sequence
  source 1..20: mol_type = other DNA
tccaggttccccatgggtat

SEQ ID NO: 73734 - DNA, 20 bp, synthetic construct
  misc_feature 1..20: note = CRISPR gRNA sequence
  source 1..20: mol_type = other DNA
cccatgggtatccctagctc

SEQ ID NO: 73735 - DNA, 20 bp, synthetic construct
  misc_feature 1..20: note = CRISPR gRNA sequence
  source 1..20: mol_type = other DNA
gctccagggctcaggctctg

SEQ ID NO: 73736 - DNA, 20 bp, synthetic construct
  misc_feature 1..20: note = CRISPR gRNA sequence
  source 1..20: mol_type = other DNA
cagggctcaggctctgggta

SEQ ID NO: 73737 - DNA, 20 bp, synthetic construct
  misc_feature 1..20: note = CRISPR gRNA sequence
  source 1..20: mol_type = other DNA
aggctctgggtaggcatgat

SEQ ID NO: 73738 - DNA, 20 bp, synthetic construct
  misc_feature 1..20: note = CRISPR gRNA sequence
  source 1..20: mol_type = other DNA
tgggtaggcatgatagtcac

SEQ ID NO: 73739 - DNA, 20 bp, synthetic construct
  misc_feature 1..20: note = CRISPR gRNA sequence
  source 1..20: mol_type = other DNA
ggtaggcatgatagtcacag

SEQ ID NO: 73740 - DNA, 20 bp, synthetic construct
  misc_feature 1..20: note = CRISPR gRNA sequence
  source 1..20: mol_type = other DNA
gcccagctgagaaactatgc

SEQ ID NO: 73741 - DNA, 20 bp, synthetic construct
  misc_feature 1..20: note = CRISPR gRNA sequence
  source 1..20: mol_type = other DNA
agaaactatgccctggatga

SEQ ID NO: 73742 - DNA, 20 bp, synthetic construct
  misc_feature 1..20: note = CRISPR gRNA sequence
  source 1..20: mol_type = other DNA
tgccctggatgaaggctgca

SEQ ID NO: 73743 - DNA, 20 bp, synthetic construct
  misc_feature 1..20: note = CRISPR gRNA sequence
  source 1..20: mol_type = other DNA
gatgaaggctgcagagagga

SEQ ID NO: 73744 - DNA, 20 bp, synthetic construct
  misc_feature 1..20: note = CRISPR gRNA sequence
  source 1..20: mol_type = other DNA
cagagaggaagctgggggac

SEQ ID NO: 73745 - DNA, 20 bp, synthetic construct
  misc_feature 1..20: note = CRISPR gRNA sequence
  source 1..20: mol_type = other DNA
ggggactagggacacacaca

SEQ ID NO: 73746 - DNA, 20 bp, synthetic construct
  misc_feature 1..20: note = CRISPR gRNA sequence
  source 1..20: mol_type = other DNA
gggacacacacacacacaca

SEQ ID NO: 73747 - DNA, 20 bp, synthetic construct
  misc_feature 1..20: note = CRISPR gRNA sequence
  source 1..20: mol_type = other DNA
ttgttcttcagccctctccg

SEQ ID NO: 73748 - DNA, 20 bp, synthetic construct
  misc_feature 1..20: note = CRISPR gRNA sequence
  source 1..20: mol_type = other DNA
gttcttcagccctctccgta

SEQ ID NO: 73749 - DNA, 20 bp, synthetic construct
  misc_feature 1..20: note = CRISPR gRNA sequence
  source 1..20: mol_type = other DNA
ttcttcagccctctccgtag

SEQ ID NO: 73750 - DNA, 20 bp, synthetic construct
  misc_feature 1..20: note = CRISPR gRNA sequence
  source 1..20: mol_type = other DNA
ttcagccctctccgtagcct

SEQ ID NO: 73751 - DNA, 20 bp, synthetic construct
  misc_feature 1..20: note = CRISPR gRNA sequence
  source 1..20: mol_type = other DNA
cagccctctccgtagcctga

SEQ ID NO: 73752 - DNA, 20 bp, synthetic construct
  misc_feature 1..20: note = CRISPR gRNA sequence
  source 1..20: mol_type = other DNA
agccctctccgtagcctgac

SEQ ID NO: 73753 - DNA, 20 bp, synthetic construct
  misc_feature 1..20: note = CRISPR gRNA sequence
  source 1..20: mol_type = other DNA
tccgtagcctgactcccaca

SEQ ID NO: 73754 - DNA, 20 bp, synthetic construct
  misc_feature 1..20: note = CRISPR gRNA sequence
  source 1..20: mol_type = other DNA
cgtagcctgactcccacagc

SEQ ID NO: 73755 - DNA, 20 bp, synthetic construct
  misc_feature 1..20: note = CRISPR gRNA sequence
  source 1..20: mol_type = other DNA
actcccacagccagcccagc

SEQ ID NO: 73756 - DNA, 20 bp, synthetic construct
  misc_feature 1..20: note = CRISPR gRNA sequence
  source 1..20: mol_type = other DNA
ccacagccagcccagcagag

SEQ ID NO: 73757 - DNA, 20 bp, synthetic construct
  misc_feature 1..20: note = CRISPR gRNA sequence
  source 1..20: mol_type = other DNA
atgagccccattttcataga

SEQ ID NO: 73758 - DNA, 20 bp, synthetic construct
  misc_feature 1..20: note = CRISPR gRNA sequence
  source 1..20: mol_type = other DNA
tcatagataaggcaatcaaa

SEQ ID NO: 73759 - DNA, 20 bp, synthetic construct
  misc_feature 1..20: note = CRISPR gRNA sequence
  source 1..20: mol_type = other DNA
catagataaggcaatcaaag

SEQ ID NO: 73760 - DNA, 20 bp, synthetic construct
  misc_feature 1..20: note = CRISPR gRNA sequence
  source 1..20: mol_type = other DNA
atagataaggcaatcaaagc

SEQ ID NO: 73761 - DNA, 20 bp, synthetic construct
  misc_feature 1..20: note = CRISPR gRNA sequence
  source 1..20: mol_type = other DNA
tgtgagtcagtggcgaaatt

SEQ ID NO: 73762 - DNA, 20 bp, synthetic construct
  misc_feature 1..20: note = CRISPR gRNA sequence
  source 1..20: mol_type = other DNA
tgagtcagtggcgaaattca

SEQ ID NO: 73763 - DNA, 20 bp, synthetic construct
  misc_feature 1..20: note = CRISPR gRNA sequence
  source 1..20: mol_type = other DNA
agaccaaaactgtggtgctc

SEQ ID NO: 73764 - DNA, 20 bp, synthetic construct
  misc_feature 1..20: note = CRISPR gRNA sequence
  source 1..20: mol_type = other DNA
tggtgctcttccttccccag

SEQ ID NO: 73765 - DNA, 20 bp, synthetic construct
  misc_feature 1..20: note = CRISPR gRNA sequence
  source 1..20: mol_type = other DNA
ttccttccccaggccacacc

SEQ ID NO: 73766 - DNA, 20 bp, synthetic construct
  misc_feature 1..20: note = CRISPR gRNA sequence
  source 1..20: mol_type = other DNA
ccttccccaggccacaccca

SEQ ID NO: 73767 - DNA, 20 bp, synthetic construct
  misc_feature 1..20: note = CRISPR gRNA sequence
  source 1..20: mol_type = other DNA
cttccccaggccacacccag

SEQ ID NO: 73768 - DNA, 20 bp, synthetic construct
  misc_feature 1..20: note = CRISPR gRNA sequence
  source 1..20: mol_type = other DNA
ccccaggccacacccagaac

SEQ ID NO: 73769 - DNA, 20 bp, synthetic construct
  misc_feature 1..20: note = CRISPR gRNA sequence
  source 1..20: mol_type = other DNA
cccaggccacacccagaact

SEQ ID NO: 73770 - DNA, 20 bp, synthetic construct
  misc_feature 1..20: note = CRISPR gRNA sequence
  source 1..20: mol_type = other DNA
ctgcacttcatcaggggaag

SEQ ID NO: 73771 - DNA, 20 bp, synthetic construct
  misc_feature 1..20: note = CRISPR gRNA sequence
  source 1..20: mol_type = other DNA
cacttcatcaggggaagggt

SEQ ID NO: 73772 - DNA, 20 bp, synthetic construct
  misc_feature 1..20: note = CRISPR gRNA sequence
  source 1..20: mol_type = other DNA
catcaggggaagggtcattg

SEQ ID NO: 73773 - DNA, 20 bp, synthetic construct
  misc_feature 1..20: note = CRISPR gRNA sequence
  source 1..20: mol_type = other DNA
atcaggggaagggtcattgg

SEQ ID NO: 73774 - DNA, 20 bp, synthetic construct
  misc_feature 1..20: note = CRISPR gRNA sequence
  source 1..20: mol_type = other DNA
gttgaagtctcattgcctgc

SEQ ID NO: 73775 - DNA, 20 bp, synthetic construct
  misc_feature 1..20: note = CRISPR gRNA sequence
  source 1..20: mol_type = other DNA
aagtctcattgcctgccctc

SEQ ID NO: 73776 - DNA, 20 bp, synthetic construct
  misc_feature 1..20: note = CRISPR gRNA sequence
  source 1..20: mol_type = other DNA
attgcctgccctcccaaacg

SEQ ID NO: 73777 - DNA, 20 bp, synthetic construct
  misc_feature 1..20: note = CRISPR gRNA sequence
  source 1..20: mol_type = other DNA
cctgccctcccaaacgccct

SEQ ID NO: 73778 - DNA, 20 bp, synthetic construct
  misc_feature 1..20: note = CRISPR gRNA sequence
  source 1..20: mol_type = other DNA
ccctcccaaacgccctgctc

SEQ ID NO: 73779 - DNA, 20 bp, synthetic construct
  misc_feature 1..20: note = CRISPR gRNA sequence
  source 1..20: mol_type = other DNA
ccaaacgccctgctctcttc

SEQ ID NO: 73780 - DNA, 20 bp, synthetic construct
  misc_feature 1..20: note = CRISPR gRNA sequence
  source 1..20: mol_type = other DNA
ctctcttctccacccctcac

SEQ ID NO: 73781 - DNA, 20 bp, synthetic construct
  misc_feature 1..20: note = CRISPR gRNA sequence
  source 1..20: mol_type = other DNA
tcttctccacccctcaccct

SEQ ID NO: 73782 - DNA, 20 bp, synthetic construct
  misc_feature 1..20: note = CRISPR gRNA sequence
  source 1..20: mol_type = other DNA
ttctccacccctcaccctca

SEQ ID NO: 73783 - DNA, 20 bp, synthetic construct
  misc_feature 1..20: note = CRISPR gRNA sequence
  source 1..20: mol_type = other DNA
ctccacccctcaccctcagc

SEQ ID NO: 73784 - DNA, 20 bp, synthetic construct
  misc_feature 1..20: note = CRISPR gRNA sequence
  source 1..20: mol_type = other DNA
tccacccctcaccctcagct

SEQ ID NO: 73785 - DNA, 20 bp, synthetic construct
  misc_feature 1..20: note = CRISPR gRNA sequence
  source 1..20: mol_type = other DNA
cacccctcaccctcagctgg

SEQ ID NO: 73786 - DNA, 20 bp, synthetic construct
  misc_feature 1..20: note = CRISPR gRNA sequence
  source 1..20: mol_type = other DNA
accctcagctgggccacttg

SEQ ID NO: 73787 - DNA, 20 bp, synthetic construct
  misc_feature 1..20: note = CRISPR gRNA sequence
  source 1..20: mol_type = other DNA
agctgggccacttgtcccca

SEQ ID NO: 73788 - DNA, 20 bp, synthetic construct
  misc_feature 1..20: note = CRISPR gRNA sequence
  source 1..20: mol_type = other DNA
ggccacttgtccccaatccc

SEQ ID NO: 73789 - DNA, 20 bp, synthetic construct
  misc_feature 1..20: note = CRISPR gRNA sequence
  source 1..20: mol_type = other DNA
gtccccaatccctccactct

SEQ ID NO: 73790 - DNA, 20 bp, synthetic construct
  misc_feature 1..20: note = CRISPR gRNA sequence
  source 1..20: mol_type = other DNA
tccccaatccctccactctg

SEQ ID NO: 73791 - DNA, 20 bp, synthetic construct
  misc_feature 1..20: note = CRISPR gRNA sequence
  source 1..20: mol_type = other DNA
cactctgcaactcactccag

SEQ ID NO: 73792 - DNA, 20 bp, synthetic construct
  misc_feature 1..20: note = CRISPR gRNA sequence
  source 1..20: mol_type = other DNA
tgcaactcactccagctcct

SEQ ID NO: 73793 - DNA, 20 bp, synthetic construct
  misc_feature 1..20: note = CRISPR gRNA sequence
  source 1..20: mol_type = other DNA
caactcactccagctcctcc

SEQ ID NO: 73794 - DNA, 20 bp, synthetic construct
  misc_feature 1..20: note = CRISPR gRNA sequence
  source 1..20: mol_type = other DNA
actccagctcctccaagtgg

SEQ ID NO: 73795 - DNA, 20 bp, synthetic construct
  misc_feature 1..20: note = CRISPR gRNA sequence
  source 1..20: mol_type = other DNA
cagctcctccaagtggtggc

SEQ ID NO: 73796 - DNA, 20 bp, synthetic construct
  misc_feature 1..20: note = CRISPR gRNA sequence
  source 1..20: mol_type = other DNA
ctccaagtggtggcagtggc

SEQ ID NO: 73797 - DNA, 20 bp, synthetic construct
  misc_feature 1..20: note = CRISPR gRNA sequence
  source 1..20: mol_type = other DNA
caagtggtggcagtggccca

SEQ ID NO: 73798 - DNA, 20 bp, synthetic construct
  misc_feature 1..20: note = CRISPR gRNA sequence
  source 1..20: mol_type = other DNA
ggtgctcacacagctggagg

SEQ ID NO: 73799 - DNA, 20 bp, synthetic construct
  misc_feature 1..20: note = CRISPR gRNA sequence
  source 1..20: mol_type = other DNA
acacagctggaggtcagcct

SEQ ID NO: 73800 - DNA, 20 bp, synthetic construct
  misc_feature 1..20: note = CRISPR gRNA sequence
  source 1..20: mol_type = other DNA
gaggtcagcctggtgggggt

SEQ ID NO: 73801 - DNA, 20 bp, synthetic construct
  misc_feature 1..20: note = CRISPR gRNA sequence
  source 1..20: mol_type = other DNA
gtgggggtcaaagggcaaca

SEQ ID NO: 73802 - DNA, 20 bp, synthetic construct
  misc_feature 1..20: note = CRISPR gRNA sequence
  source 1..20: mol_type = other DNA
ggtcttgggagctctgaatg

SEQ ID NO: 73803 - DNA, 20 bp, synthetic construct
  misc_feature 1..20: note = CRISPR gRNA sequence
  source 1..20: mol_type = other DNA
gggagctctgaatgctggtg

SEQ ID NO: 73804 - DNA, 20 bp, synthetic construct
  misc_feature 1..20: note = CRISPR gRNA sequence
  source 1..20: mol_type = other DNA
ggagctctgaatgctggtgg

SEQ ID NO: 73805 - DNA, 20 bp, synthetic construct
  misc_feature 1..20: note = CRISPR gRNA sequence
  source 1..20: mol_type = other DNA
tgaatgctggtggcagaggg

SEQ ID NO: 73806 - DNA, 20 bp, synthetic construct
  misc_feature 1..20: note = CRISPR gRNA sequence
  source 1..20: mol_type = other DNA
aatgctggtggcagagggca

SEQ ID NO: 73807 - DNA, 20 bp, synthetic construct
  misc_feature 1..20: note = CRISPR gRNA sequence
  source 1..20: mol_type = other DNA
gtggcagagggcaaggatgt

SEQ ID NO: 73808 - DNA, 20 bp, synthetic construct
  misc_feature 1..20: note = CRISPR gRNA sequence
  source 1..20: mol_type = other DNA
cttcccttcgtaaatctctt

SEQ ID NO: 73809 - DNA, 20 bp, synthetic construct
  misc_feature 1..20: note = CRISPR gRNA sequence
  source 1..20: mol_type = other DNA
cccttcgtaaatctcttcca

SEQ ID NO: 73810 - DNA, 20 bp, synthetic construct
  misc_feature 1..20: note = CRISPR gRNA sequence
  source 1..20: mol_type = other DNA
ccttcgtaaatctcttccac

SEQ ID NO: 73811 - DNA, 20 bp, synthetic construct
  misc_feature 1..20: note = CRISPR gRNA sequence
  source 1..20: mol_type = other DNA
cgtaaatctcttccaccatg

SEQ ID NO: 73812 - DNA, 20 bp, synthetic construct
  misc_feature 1..20: note = CRISPR gRNA sequence
  source 1..20: mol_type = other DNA
gtaaatctcttccaccatga

SEQ ID NO: 73813 - DNA, 20 bp, synthetic construct
  misc_feature 1..20: note = CRISPR gRNA sequence
  source 1..20: mol_type = other DNA
ttccaccatgaactcattaa

SEQ ID NO: 73814 - DNA, 20 bp, synthetic construct
  misc_feature 1..20: note = CRISPR gRNA sequence
  source 1..20: mol_type = other DNA
ccaccatgaactcattaagc

SEQ ID NO: 73815 - DNA, 20 bp, synthetic construct
  misc_feature 1..20: note = CRISPR gRNA sequence
  source 1..20: mol_type = other DNA
caccatgaactcattaagcc

SEQ ID NO: 73816 - DNA, 20 bp, synthetic construct
  misc_feature 1..20: note = CRISPR gRNA sequence
  source 1..20: mol_type = other DNA
attaagccaccacagagctt

SEQ ID NO: 73817 - DNA, 20 bp, synthetic construct
  misc_feature 1..20: note = CRISPR gRNA sequence
  source 1..20: mol_type = other DNA
agccaccacagagcttggaa

SEQ ID NO: 73818 - DNA, 20 bp, synthetic construct
  misc_feature 1..20: note = CRISPR gRNA sequence
  source 1..20: mol_type = other DNA
ggaagcagaagcatggacta

SEQ ID NO: 73819 - DNA, 20 bp, synthetic construct
  misc_feature 1..20: note = CRISPR gRNA sequence
  source 1..20: mol_type = other DNA
gaagcagaagcatggactag

SEQ ID NO: 73820 - DNA, 20 bp, synthetic construct
  misc_feature 1..20: note = CRISPR gRNA sequence
  source 1..20: mol_type = other DNA
gttcagtatttcctaaaccg

SEQ ID NO: 73821 - DNA, 20 bp, synthetic construct
  misc_feature 1..20: note = CRISPR gRNA sequence
  source 1..20: mol_type = other DNA
agtatttcctaaaccgcagt

SEQ ID NO: 73822 - DNA, 20 bp, synthetic construct
  misc_feature 1..20: note = CRISPR gRNA sequence
  source 1..20: mol_type = other DNA
cctaaaccgcagtcattcag

SEQ ID NO: 73823 - DNA, 20 bp, synthetic construct
  misc_feature 1..20: note = CRISPR gRNA sequence
  source 1..20: mol_type = other DNA
ctaaaccgcagtcattcagg

SEQ ID NO: 73824 - DNA, 20 bp, synthetic construct
  misc_feature 1..20: note = CRISPR gRNA sequence
  source 1..20: mol_type = other DNA
aaccgcagtcattcaggtag

SEQ ID NO: 73825 - DNA, 20 bp, synthetic construct
  misc_feature 1..20: note = CRISPR gRNA sequence
  source 1..20: mol_type = other DNA
aggtagcaacttcacaactt

SEQ ID NO: 73826 - DNA, 20 bp, synthetic construct
  misc_feature 1..20: note = CRISPR gRNA sequence
  source 1..20: mol_type = other DNA
cacaacttaagccaggatta

SEQ ID NO: 73827 - DNA, 20 bp, synthetic construct
  misc_feature 1..20: note = CRISPR gRNA sequence
  source 1..20: mol_type = other DNA
acaacttaagccaggattag

SEQ ID NO: 73828 - DNA, 20 bp, synthetic construct
  misc_feature 1..20: note = CRISPR gRNA sequence
  source 1..20: mol_type = other DNA
aagccaggattaggtatcac

SEQ ID NO: 73829 - DNA, 20 bp, synthetic construct
  misc_feature 1..20: note = CRISPR gRNA sequence
  source 1..20: mol_type = other DNA
agccaggattaggtatcact

SEQ ID NO: 73830 - DNA, 20 bp, synthetic construct
  misc_feature 1..20: note = CRISPR gRNA sequence
  source 1..20: mol_type = other DNA
ggtatcactgtagtttagct

SEQ ID NO: 73831 - DNA, 20 bp, synthetic construct
  misc_feature 1..20: note = CRISPR gRNA sequence
  source 1..20: mol_type = other DNA
tagtttagctagttactgtt

SEQ ID NO: 73832 - DNA, 20 bp, synthetic construct
  misc_feature 1..20: note = CRISPR gRNA sequence
  source 1..20: mol_type = other DNA
agctagttactgttgtttat

SEQ ID NO: 73833 - DNA, 20 bp, synthetic construct
  misc_feature 1..20: note = CRISPR gRNA sequence
  source 1..20: mol_type = other DNA
gctagttactgttgtttatt

SEQ ID NO: 73834 - DNA, 20 bp, synthetic construct
  misc_feature 1..20: note = CRISPR gRNA sequence
  source 1..20: mol_type = other DNA
gttactgttgtttattacaa

SEQ ID NO: 73835 - DNA, 20 bp, synthetic construct
  misc_feature 1..20: note = CRISPR gRNA sequence
  source 1..20: mol_type = other DNA
ctgttgtttattacaaactc

SEQ ID NO: 73836 - DNA, 20 bp, synthetic construct
  misc_feature 1..20: note = CRISPR gRNA sequence
  source 1..20: mol_type = other DNA
ttgtttattacaaactctgc

SEQ ID NO: 73837 - DNA, 20 bp, synthetic construct
  misc_feature 1..20: note = CRISPR gRNA sequence
  source 1..20: mol_type = other DNA
tttattacaaactctgcatc

SEQ ID NO: 73838 - DNA, 20 bp, synthetic construct
  misc_feature 1..20: note = CRISPR gRNA sequence
  source 1..20: mol_type = other DNA
attacaaactctgcatcttt

SEQ ID NO: 73839 - DNA, 20 bp, synthetic construct
  misc_feature 1..20: note = CRISPR gRNA sequence
  source 1..20: mol_type = other DNA
ttacaaactctgcatcttta

SEQ ID NO: 73840 - DNA, 20 bp, synthetic construct
  misc_feature 1..20: note = CRISPR gRNA sequence
  source 1..20: mol_type = other DNA
caaactctgcatctttaaag

SEQ ID NO: 73841 - DNA, 20 bp, synthetic construct
  misc_feature 1..20: note = CRISPR gRNA sequence
  source 1..20: mol_type = other DNA
tgcatctttaaagcaaatac

SEQ ID NO: 73842 - DNA, 20 bp, synthetic construct
  misc_feature 1..20: note = CRISPR gRNA sequence
  source 1..20: mol_type = other DNA
catctttaaagcaaatactg

SEQ ID NO: 73843 - DNA, 20 bp, synthetic construct
  misc_feature 1..20: note = CRISPR gRNA sequence
  source 1..20: mol_type = other DNA
taaagcaaatactgaagaag

SEQ ID NO: 73844 - DNA, 20 bp, synthetic construct
  misc_feature 1..20: note = CRISPR gRNA sequence
  source 1..20: mol_type = other DNA
aaagcaaatactgaagaagt

SEQ ID NO: 73845 - DNA, 20 bp, synthetic construct
  misc_feature 1..20: note = CRISPR gRNA sequence
  source 1..20: mol_type = other DNA
aagcaaatactgaagaagtg

SEQ ID NO: 73846 - DNA, 20 bp, synthetic construct
  misc_feature 1..20: note = CRISPR gRNA sequence
  source 1..20: mol_type = other DNA
aagaagtgtcaaagatctct

SEQ ID NO: 73847 - DNA, 20 bp, synthetic construct
  misc_feature 1..20: note = CRISPR gRNA sequence
  source 1..20: mol_type = other DNA
tctgtcctaaagagtttctt

SEQ ID NO: 73848 - DNA, 20 bp, synthetic construct
  misc_feature 1..20: note = CRISPR gRNA sequence
  source 1..20: mol_type = other DNA
tgtcctaaagagtttcttcc

SEQ ID NO: 73849 - DNA, 20 bp, synthetic construct
  misc_feature 1..20: note = CRISPR gRNA sequence
  source 1..20: mol_type = other DNA
tcctaaagagtttcttcctt

SEQ ID NO: 73850 - DNA, 20 bp, synthetic construct
  misc_feature 1..20: note = CRISPR gRNA sequence
  source 1..20: mol_type = other DNA
aagagtttcttcctttttaa

SEQ ID NO: 73851 - DNA, 20 bp, synthetic construct
  misc_feature 1..20: note = CRISPR gRNA sequence
  source 1..20: mol_type = other DNA
cttcctttttaaacatttat

SEQ ID NO: 73852 - DNA, 20 bp, synthetic construct
  misc_feature 1..20: note = CRISPR gRNA sequence
  source 1..20: mol_type = other DNA
ttcctttttaaacatttatt

SEQ ID NO: 73853 - DNA, 20 bp, synthetic construct
  misc_feature 1..20: note = CRISPR gRNA sequence
  source 1..20: mol_type = other DNA
cctttttaaacatttatttt

SEQ ID NO: 73854 - DNA, 20 bp, synthetic construct
  misc_feature 1..20: note = CRISPR gRNA sequence
  source 1..20: mol_type = other DNA
ctttttaaacatttatttta

SEQ ID NO: 73855 - DNA, 20 bp, synthetic construct
  misc_feature 1..20: note = CRISPR gRNA sequence
  source 1..20: mol_type = other DNA
tttaaacatttattttattt

SEQ ID NO: 73856 - DNA, 20 bp, synthetic construct
  misc_feature 1..20: note = CRISPR gRNA sequence
  source 1..20: mol_type = other DNA
ttaaacatttattttattta

SEQ ID NO: 73857 - DNA, 20 bp, synthetic construct
  misc_feature 1..20: note = CRISPR gRNA sequence
  source 1..20: mol_type = other DNA
taaacatttattttatttat

SEQ ID NO: 73858 - DNA, 20 bp, synthetic construct
  misc_feature 1..20: note = CRISPR gRNA sequence
  source 1..20: mol_type = other DNA
aaacatttattttatttatt

SEQ ID NO: 73859 - DNA, 20 bp, synthetic construct
  misc_feature 1..20: note = CRISPR gRNA sequence
  source 1..20: mol_type = other DNA
aacatttattttatttattt

SEQ ID NO: 73860 - DNA, 20 bp, synthetic construct
  misc_feature 1..20: note = CRISPR gRNA sequence
  source 1..20: mol_type = other DNA
attttatttatttatttttt

SEQ ID NO: 73861 - DNA, 20 bp, synthetic construct
  misc_feature 1..20: note = CRISPR gRNA sequence
  source 1..20: mol_type = other DNA
ttttatttatttattttttg

SEQ ID NO: 73862 - DNA, 20 bp, synthetic construct
  misc_feature 1..20: note = CRISPR gRNA sequence
  source 1..20: mol_type = other DNA
tatttatttattttttgtag

SEQ ID NO: 73863 - DNA, 20 bp, synthetic construct
  misc_feature 1..20: note = CRISPR gRNA sequence
  source 1..20: mol_type = other DNA
atttatttattttttgtaga

SEQ ID NO: 73864 - DNA, 20 bp, synthetic construct
  misc_feature 1..20: note = CRISPR gRNA sequence
  source 1..20: mol_type = other DNA
tttatttattttttgtagag

SEQ ID NO: 73865 - DNA, 20 bp, synthetic construct
  misc_feature 1..20: note = CRISPR gRNA sequence
  source 1..20: mol_type = other DNA
atttattttttgtagagatg

SEQ ID NO: 73866 - DNA, 20 bp, synthetic construct
  misc_feature 1..20: note = CRISPR gRNA sequence
  source 1..20: mol_type = other DNA
tttattttttgtagagatgg

SEQ ID NO: 73867 - DNA, 20 bp, synthetic construct
  misc_feature 1..20: note = CRISPR gRNA sequence
  source 1..20: mol_type = other DNA
attttttgtagagatggggg

SEQ ID NO: 73868 - DNA, 20 bp, synthetic construct
  misc_feature 1..20: note = CRISPR gRNA sequence
  source 1..20: mol_type = other DNA
ttttttgtagagatgggggt

SEQ ID NO: 73869 - DNA, 20 bp, synthetic construct
  misc_feature 1..20: note = CRISPR gRNA sequence
  source 1..20: mol_type = other DNA
tttgtagagatgggggtggt

SEQ ID NO: 73870 - DNA, 20 bp, synthetic construct
  misc_feature 1..20: note = CRISPR gRNA sequence
  source 1..20: mol_type = other DNA
ttgtagagatgggggtggtc

SEQ ID NO: 73871 - DNA, 20 bp, synthetic construct
  misc_feature 1..20: note = CRISPR gRNA sequence
  source 1..20: mol_type = other DNA
tgtagagatgggggtggtct

SEQ ID NO: 73872 - DNA, 20 bp, synthetic construct
  misc_feature 1..20: note = CRISPR gRNA sequence
  source 1..20: mol_type = other DNA
gtagagatgggggtggtctc

SEQ ID NO: 73873 - DNA, 20 bp, synthetic construct
  misc_feature 1..20: note = CRISPR gRNA sequence
  source 1..20: mol_type = other DNA
tagagatgggggtggtctcg

SEQ ID NO: 73874 - DNA, 20 bp, synthetic construct
  misc_feature 1..20: note = CRISPR gRNA sequence
  source 1..20: mol_type = other DNA
gctatgttgctcaggctggt

SEQ ID NO: 73875 - DNA, 20 bp, synthetic construct
  misc_feature 1..20: note = CRISPR gRNA sequence
  source 1..20: mol_type = other DNA
tgttgctcaggctggtgtcg

SEQ ID NO: 73876 - DNA, 20 bp, synthetic construct
  misc_feature 1..20: note = CRISPR gRNA sequence
  source 1..20: mol_type = other DNA
ctcaggctggtgtcgaactc

SEQ ID NO: 73877 - DNA, 20 bp, synthetic construct
  misc_feature 1..20: note = CRISPR gRNA sequence
  source 1..20: mol_type = other DNA
aggctggtgtcgaactcccg

SEQ ID NO: 73878 - DNA, 20 bp, synthetic construct
  misc_feature 1..20: note = CRISPR gRNA sequence
  source 1..20: mol_type = other DNA
gtgtcgaactcccgggctca

SEQ ID NO: 73879 - DNA, 20 bp, synthetic construct
  misc_feature 1..20: note = CRISPR gRNA sequence
  source 1..20: mol_type = other DNA
ccgggctcaagcgatttttc

SEQ ID NO: 73880 - DNA, 20 bp, synthetic construct
  misc_feature 1..20: note = CRISPR gRNA sequence
  source 1..20: mol_type = other DNA
aagcgatttttcctcctcgg

SEQ ID NO: 73881 - DNA, 20 bp, synthetic construct
  misc_feature 1..20: note = CRISPR gRNA sequence
  source 1..20: mol_type = other DNA
ttcctcctcggcctcccaga

SEQ ID NO: 73882 - DNA, 20 bp, synthetic construct
  misc_feature 1..20: note = CRISPR gRNA sequence
  source 1..20: mol_type = other DNA
tcctcctcggcctcccagag

SEQ ID NO: 73883 - DNA, 20 bp, synthetic construct
  misc_feature 1..20: note = CRISPR gRNA sequence
  source 1..20: mol_type = other DNA
cctcctcggcctcccagagt

SEQ ID NO: 73884 - DNA, 20 bp, synthetic construct
  misc_feature 1..20: note = CRISPR gRNA sequence
  source 1..20: mol_type = other DNA
ctcctcggcctcccagagtg

SEQ ID NO: 73885 - DNA, 20 bp, synthetic construct
  misc_feature 1..20: note = CRISPR gRNA sequence
  source 1..20: mol_type = other DNA
ctcggcctcccagagtgctg

SEQ ID NO: 73886 - DNA, 20 bp, synthetic construct
  misc_feature 1..20: note = CRISPR gRNA sequence
  source 1..20: mol_type = other DNA
ggcctcccagagtgctggga

SEQ ID NO: 73887 - DNA, 20 bp, synthetic construct
  misc_feature 1..20: note = CRISPR gRNA sequence
  source 1..20: mol_type = other DNA
ccagagtgctgggattacaa

SEQ ID NO: 73888 - DNA, 20 bp, synthetic construct
  misc_feature 1..20: note = CRISPR gRNA sequence
  source 1..20: mol_type = other DNA
ggattacaagcttgagccac

SEQ ID NO: 73889 - DNA, 20 bp, synthetic construct
  misc_feature 1..20: note = CRISPR gRNA sequence
  source 1..20: mol_type = other DNA
caagcttgagccactgttcc

SEQ ID NO: 73890 - DNA, 20 bp, synthetic construct
  misc_feature 1..20: note = CRISPR gRNA sequence
  source 1..20: mol_type = other DNA
gagccactgttcccagccca

SEQ ID NO: 73891 - DNA, 20 bp, synthetic construct
  misc_feature 1..20: note = CRISPR gRNA sequence
  source 1..20: mol_type = other DNA
agccactgttcccagcccaa

SEQ ID NO: 73892 - DNA, 20 bp, synthetic construct
  misc_feature 1..20: note = CRISPR gRNA sequence
  source 1..20: mol_type = other DNA
ttcccagcccaagagtttct

SEQ ID NO: 73893 - DNA, 20 bp, synthetic construct
  misc_feature 1..20: note = CRISPR gRNA sequence
  source 1..20: mol_type = other DNA
ccagcccaagagtttcttct

SEQ ID NO: 73894 - DNA, 20 bp, synthetic construct
  misc_feature 1..20: note = CRISPR gRNA sequence
  source 1..20: mol_type = other DNA
cttcttggtgtaatcagtta

SEQ ID NO: 73895 - DNA, 20 bp, synthetic construct
  misc_feature 1..20: note = CRISPR gRNA sequence
  source 1..20: mol_type = other DNA
ttcttggtgtaatcagttag

SEQ ID NO: 73896 - DNA, 20 bp, synthetic construct
  misc_feature 1..20: note = CRISPR gRNA sequence
  source 1..20: mol_type = other DNA
cttggtgtaatcagttagat

SEQ ID NO: 73897 - DNA, 20 bp, synthetic construct
  misc_feature 1..20: note = CRISPR gRNA sequence
  source 1..20: mol_type = other DNA
ttggtgtaatcagttagatg

SEQ ID NO: 73898 - DNA, 20 bp, synthetic construct
  misc_feature 1..20: note = CRISPR gRNA sequence
  source 1..20: mol_type = other DNA
ggtgtaatcagttagatgga

SEQ ID NO: 73899 - DNA, 20 bp, synthetic construct
  misc_feature 1..20: note = CRISPR gRNA sequence
  source 1..20: mol_type = other DNA
gtgtaatcagttagatggaa

SEQ ID NO: 73900 - DNA, 20 bp, synthetic construct
  misc_feature 1..20: note = CRISPR gRNA sequence
  source 1..20: mol_type = other DNA
gatggaaataaaatgtaaag

SEQ ID NO: 73901 - DNA, 20 bp, synthetic construct
  misc_feature 1..20: note = CRISPR gRNA sequence
  source 1..20: mol_type = other DNA
ggaaagctacattttgcaac

SEQ ID NO: 73902 - DNA, 20 bp, synthetic construct
  misc_feature 1..20: note = CRISPR gRNA sequence
  source 1..20: mol_type = other DNA
cattttgcaactgtcatgct

SEQ ID NO: 73903 - DNA, 20 bp, synthetic construct
  misc_feature 1..20: note = CRISPR gRNA sequence
  source 1..20: mol_type = other DNA
tgcaactgtcatgctgattc

SEQ ID NO: 73904 - DNA, 20 bp, synthetic construct
  misc_feature 1..20: note = CRISPR gRNA sequence
  source 1..20: mol_type = other DNA
gcaactgtcatgctgattca

SEQ ID NO: 73905 - DNA, 20 bp, synthetic construct
  misc_feature 1..20: note = CRISPR gRNA sequence
  source 1..20: mol_type = other DNA
caactgtcatgctgattcat

SEQ ID NO: 73906 - DNA, 20 bp, synthetic construct
  misc_feature 1..20: note = CRISPR gRNA sequence
  source 1..20: mol_type = other DNA
tcatgctgattcatcgattt

SEQ ID NO: 73907 - DNA, 20 bp, synthetic construct
  misc_feature 1..20: note = CRISPR gRNA sequence
  source 1..20: mol_type = other DNA
attcatcgatttaagtaaga

SEQ ID NO: 73908 - DNA, 20 bp, synthetic construct
  misc_feature 1..20: note = CRISPR gRNA sequence
  source 1..20: mol_type = other DNA
atcgatttaagtaagattta

SEQ ID NO: 73909 - DNA, 20 bp, synthetic construct
  misc_feature 1..20: note = CRISPR gRNA sequence
  source 1..20: mol_type = other DNA
aagtaagatttattaacggc

SEQ ID NO: 73910 - DNA, 20 bp, synthetic construct
  misc_feature 1..20: note = CRISPR gRNA sequence
  source 1..20: mol_type = other DNA
agtaagatttattaacggct

SEQ ID NO: 73911 - DNA, 20 bp, synthetic construct
  misc_feature 1..20: note = CRISPR gRNA sequence
  source 1..20: mol_type = other DNA
attaacggctgctaaaattt

SEQ ID NO: 73912 - DNA, 20 bp, synthetic construct
  misc_feature 1..20: note = CRISPR gRNA sequence
  source 1..20: mol_type = other DNA
ttaacggctgctaaaatttg

SEQ ID NO: 73913 - DNA, 20 bp, synthetic construct
  misc_feature 1..20: note = CRISPR gRNA sequence
  source 1..20: mol_type = other DNA
acggctgctaaaatttgcca

SEQ ID NO: 73914 - DNA, 20 bp, synthetic construct
  misc_feature 1..20: note = CRISPR gRNA sequence
  source 1..20: mol_type = other DNA
ctaaaatttgccaatgagag

SEQ ID NO: 73915 - DNA, 20 bp, synthetic construct
  misc_feature 1..20: note = CRISPR gRNA sequence
  source 1..20: mol_type = other DNA
aaatttgccaatgagagttt

SEQ ID NO: 73916 - DNA, 20 bp, synthetic construct
  misc_feature 1..20: note = CRISPR gRNA sequence
  source 1..20: mol_type = other DNA
gccaatgagagtttgaggaa

SEQ ID NO: 73917 - DNA, 20 bp, synthetic construct
  misc_feature 1..20: note = CRISPR gRNA sequence
  source 1..20: mol_type = other DNA
ccaatgagagtttgaggaag

SEQ ID NO: 73918 - DNA, 20 bp, synthetic construct
  misc_feature 1..20: note = CRISPR gRNA sequence
  source 1..20: mol_type = other DNA
gaggaagacttaatacataa

SEQ ID NO: 73919 - DNA, 20 bp, synthetic construct
  misc_feature 1..20: note = CRISPR gRNA sequence
  source 1..20: mol_type = other DNA
aggaagacttaatacataat

SEQ ID NO: 73920 - DNA, 20 bp, synthetic construct
  misc_feature 1..20: note = CRISPR gRNA sequence
  source 1..20: mol_type = other DNA
aatacataatcttaaagtat

SEQ ID NO: 73921 - DNA, 20 bp, synthetic construct
  misc_feature 1..20: note = CRISPR gRNA sequence
  source 1..20: mol_type = other DNA
atacataatcttaaagtatc

SEQ ID NO: 73922 - DNA, 20 bp, synthetic construct
  misc_feature 1..20: note = CRISPR gRNA sequence
  source 1..20: mol_type = other DNA
aaagtatctccccacataat

SEQ ID NO: 73923 - DNA, 20 bp, synthetic construct
  misc_feature 1..20: note = CRISPR gRNA sequence
  source 1..20: mol_type = other DNA
aagtatctccccacataatc

SEQ ID NO: 73924 - DNA, 20 bp, synthetic construct
  misc_feature 1..20: note = CRISPR gRNA sequence
  source 1..20: mol_type = other DNA
cccacataatctatgttgat

SEQ ID NO: 73925 - DNA, 20 bp, synthetic construct
  misc_feature 1..20: note = CRISPR gRNA sequence
  source 1..20: mol_type = other DNA
tgttgattacaaagggaaag

SEQ ID NO: 73926 - DNA, 20 bp, synthetic construct
  misc_feature 1..20: note = CRISPR gRNA sequence
  source 1..20: mol_type = other DNA
attacaaagggaaagttagt

SEQ ID NO: 73927 - DNA, 20 bp, synthetic construct
  misc_feature 1..20: note = CRISPR gRNA sequence
  source 1..20: mol_type = other DNA
caaagggaaagttagtaaat

SEQ ID NO: 73928 - DNA, 20 bp, synthetic construct
  misc_feature 1..20: note = CRISPR gRNA sequence
  source 1..20: mol_type = other DNA
gtaaatttgcaagtggagag

SEQ ID NO: 73929 - DNA, 20 bp, synthetic construct
  misc_feature 1..20: note = CRISPR gRNA sequence
  source 1..20: mol_type = other DNA
gcaagtggagagacctggca

SEQ ID NO: 73930 - DNA, 20 bp, synthetic construct
  misc_feature 1..20: note = CRISPR gRNA sequence
  source 1..20: mol_type = other DNA
caagtggagagacctggcag

SEQ ID NO: 73931 - DNA, 20 bp, synthetic construct
  misc_feature 1..20: note = CRISPR gRNA sequence
  source 1..20: mol_type = other DNA
gcagacaccactgtcacagg

SEQ ID NO: 73932 - DNA, 20 bp, synthetic construct
  misc_feature 1..20: note = CRISPR gRNA sequence
  source 1..20: mol_type = other DNA
tcacaggtgatcacagttaa

SEQ ID NO: 73933 - DNA, 20 bp, synthetic construct
  misc_feature 1..20: note = CRISPR gRNA sequence
  source 1..20: mol_type = other DNA
acatcactagcccgaggact

SEQ ID NO: 73934 - DNA, 20 bp, synthetic construct
  misc_feature 1..20: note = CRISPR gRNA sequence
  source 1..20: mol_type = other DNA
gcccgaggactctgacacat

SEQ ID NO: 73935 - DNA, 20 bp, synthetic construct
  misc_feature 1..20: note = CRISPR gRNA sequence
  source 1..20: mol_type = other DNA
tgacacatcatgtgccccga

SEQ ID NO: 73936 - DNA, 20 bp, synthetic construct
  misc_feature 1..20: note = CRISPR gRNA sequence
  source 1..20: mol_type = other DNA
acacatcatgtgccccgatg

SEQ ID NO: 73937 - DNA, 20 bp, synthetic construct
  misc_feature 1..20: note = CRISPR gRNA sequence
  source 1..20: mol_type = other DNA
tgtgatattcctgcccaaag

SEQ ID NO: 73938 - DNA, 20 bp, synthetic construct
  misc_feature 1..20: note = CRISPR gRNA sequence
  source 1..20: mol_type = other DNA
ctgcccaaagggcagactct

SEQ ID NO: 73939 - DNA, 20 bp, synthetic construct
  misc_feature 1..20: note = CRISPR gRNA sequence
  source 1..20: mol_type = other DNA
cccaaagggcagactctaac

SEQ ID NO: 73940 - DNA, 20 bp, synthetic construct
  misc_feature 1..20: note = CRISPR gRNA sequence
  source 1..20: mol_type = other DNA
taactctaaacatgaggaaa

SEQ ID NO: 73941 - DNA, 20 bp, synthetic construct
  misc_feature 1..20: note = CRISPR gRNA sequence
  source 1..20: mol_type = other DNA
actctaaacatgaggaaaca

SEQ ID NO: 73942 - DNA, 20 bp, synthetic construct
  misc_feature 1..20: note = CRISPR gRNA sequence
  source 1..20: mol_type = other DNA
taaacatgaggaaacattgg

SEQ ID NO: 73943 - DNA, 20 bp, synthetic construct
  misc_feature 1..20: note = CRISPR gRNA sequence
  source 1..20: mol_type = other DNA
aacatgaggaaacattggac

SEQ ID NO: 73944 - DNA, 20 bp, synthetic construct
  misc_feature 1..20: note = CRISPR gRNA sequence
  source 1..20: mol_type = other DNA
gacaaacccaagtggaagga

SEQ ID NO: 73945 - DNA, 20 bp, synthetic construct
  misc_feature 1..20: note = CRISPR gRNA sequence
  source 1..20: mol_type = other DNA
tataaaataactggcctgta

SEQ ID NO: 73946 - DNA, 20 bp, synthetic construct
  misc_feature 1..20: note = CRISPR gRNA sequence
  source 1..20: mol_type = other DNA
taaaataactggcctgtaaa

SEQ ID NO: 73947 - DNA, 20 bp, synthetic construct
  misc_feature 1..20: note = CRISPR gRNA sequence
  source 1..20: mol_type = other DNA
gcctgtaaatgtcagagaca

SEQ ID NO: 73948 - DNA, 20 bp, synthetic construct
  misc_feature 1..20: note = CRISPR gRNA sequence
  source 1..20: mol_type = other DNA
taaatgtcagagacaatgct

SEQ ID NO: 73949 - DNA, 20 bp, synthetic construct
  misc_feature 1..20: note = CRISPR gRNA sequence
  source 1..20: mol_type = other DNA
tgaaagacaaagaagggcca

SEQ ID NO: 73950 - DNA, 20 bp, synthetic construct
  misc_feature 1..20: note = CRISPR gRNA sequence
  source 1..20: mol_type = other DNA
cagattgaaggagacactaa

SEQ ID NO: 73951 - DNA, 20 bp, synthetic construct
  misc_feature 1..20: note = CRISPR gRNA sequence
  source 1..20: mol_type = other DNA
aaggagacactaaagagatg

SEQ ID NO: 73952 - DNA, 20 bp, synthetic construct
  misc_feature 1..20: note = CRISPR gRNA sequence
  source 1..20: mol_type = other DNA
aagagatgacactaaatgag

SEQ ID NO: 73953 - DNA, 20 bp, synthetic construct
  misc_feature 1..20: note = CRISPR gRNA sequence
  source 1..20: mol_type = other DNA
aatgagacgtgtgatcctgg

SEQ ID NO: 73954 - DNA, 20 bp, synthetic construct
  misc_feature 1..20: note = CRISPR gRNA sequence
  source 1..20: mol_type = other DNA
gattggatccacaactggga

SEQ ID NO: 73955 - DNA, 20 bp, synthetic construct
  misc_feature 1..20: note = CRISPR gRNA sequence
  source 1..20: mol_type = other DNA
gatccacaactgggaaaaaa

SEQ ID NO: 73956 - DNA, 20 bp, synthetic construct
  misc_feature 1..20: note = CRISPR gRNA sequence
  source 1..20: mol_type = other DNA
ggaaaaaaatgcaataagca

SEQ ID NO: 73957 - DNA, 20 bp, synthetic construct
  misc_feature 1..20: note = CRISPR gRNA sequence
  source 1..20: mol_type = other DNA
ttgggagaactggtgagatt

SEQ ID NO: 73958 - DNA, 20 bp, synthetic construct
  misc_feature 1..20: note = CRISPR gRNA sequence
  source 1..20: mol_type = other DNA
ggagaactggtgagattgga

SEQ ID NO: 73959 - DNA, 20 bp, synthetic construct
  misc_feature 1..20: note = CRISPR gRNA sequence
  source 1..20: mol_type = other DNA
gtgagattggagtataaact

SEQ ID NO: 73960 - DNA, 20 bp, synthetic construct
  misc_feature 1..20: note = CRISPR gRNA sequence
  source 1..20: mol_type = other DNA
gagtataaactgtagttgag

SEQ ID NO: 73961 - DNA, 20 bp, synthetic construct
  misc_feature 1..20: note = CRISPR gRNA sequence
  source 1..20: mol_type = other DNA
tagttgagataatagtagtg

SEQ ID NO: 73962 - DNA, 20 bp, synthetic construct
  misc_feature 1..20: note = CRISPR gRNA sequence
  source 1..20: mol_type = other DNA
agataatagtagtgtatcaa

SEQ ID NO: 73963 - DNA, 20 bp, synthetic construct
  misc_feature 1..20: note = CRISPR gRNA sequence
  source 1..20: mol_type = other DNA
cctggattttataattttac

SEQ ID NO: 73964 - DNA, 20 bp, synthetic construct
  misc_feature 1..20: note = CRISPR gRNA sequence
  source 1..20: mol_type = other DNA
ctggattttataattttact

SEQ ID NO: 73965 - DNA, 20 bp, synthetic construct
  misc_feature 1..20: note = CRISPR gRNA sequence
  source 1..20: mol_type = other DNA
gattttataattttactgga

SEQ ID NO: 73966 - DNA, 20 bp, synthetic construct
  misc_feature 1..20: note = CRISPR gRNA sequence
  source 1..20: mol_type = other DNA
tataattttactggattatg

SEQ ID NO: 73967 - DNA, 20 bp, synthetic construct
  misc_feature 1..20: note = CRISPR gRNA sequence
  source 1..20: mol_type = other DNA
ataattttactggattatgg

SEQ ID NO: 73968 - DNA, 20 bp, synthetic construct
  misc_feature 1..20: note = CRISPR gRNA sequence
  source 1..20: mol_type = other DNA
taattttactggattatgga

SEQ ID NO: 73969 - DNA, 20 bp, synthetic construct
  misc_feature 1..20: note = CRISPR gRNA sequence
  source 1..20: mol_type = other DNA
tactggattatggaagagaa

SEQ ID NO: 73970 - DNA, 20 bp, synthetic construct
  misc_feature 1..20: note = CRISPR gRNA sequence
  source 1..20: mol_type = other DNA
actggattatggaagagaat

SEQ ID NO: 73971 - DNA, 20 bp, synthetic construct
  misc_feature 1..20: note = CRISPR gRNA sequence
  source 1..20: mol_type = other DNA
ctggattatggaagagaatg

SEQ ID NO: 73972 - DNA, 20 bp, synthetic construct
  misc_feature 1..20: note = CRISPR gRNA sequence
  source 1..20: mol_type = other DNA
gattatggaagagaatgtcc

SEQ ID NO: 73973 - DNA, 20 bp, synthetic construct
  misc_feature 1..20: note = CRISPR gRNA sequence
  source 1..20: mol_type = other DNA
tggaagagaatgtccttatt

SEQ ID NO: 73974 - DNA, 20 bp, synthetic construct
  misc_feature 1..20: note = CRISPR gRNA sequence
  source 1..20: mol_type = other DNA
atttctagcaaattcgctga

SEQ ID NO: 73975 - DNA, 20 bp, synthetic construct
  misc_feature 1..20: note = CRISPR gRNA sequence
  source 1..20: mol_type = other DNA
tttctagcaaattcgctgaa

SEQ ID NO: 73976 - DNA, 20 bp, synthetic construct
  misc_feature 1..20: note = CRISPR gRNA sequence
  source 1..20: mol_type = other DNA
ctagcaaattcgctgaaatg

SEQ ID NO: 73977 - DNA, 20 bp, synthetic construct
  misc_feature 1..20: note = CRISPR gRNA sequence
  source 1..20: mol_type = other DNA
tagcaaattcgctgaaatgt

SEQ ID NO: 73978 - DNA, 20 bp, synthetic construct
  misc_feature 1..20: note = CRISPR gRNA sequence
  source 1..20: mol_type = other DNA
gcaaattcgctgaaatgtta

SEQ ID NO: 73979 - DNA, 20 bp, synthetic construct
  misc_feature 1..20: note = CRISPR gRNA sequence
  source 1..20: mol_type = other DNA
gctgaaatgttaacgggtaa

SEQ ID NO: 73980 - DNA, 20 bp, synthetic construct
  misc_feature 1..20: note = CRISPR gRNA sequence
  source 1..20: mol_type = other DNA
aaatgttaacgggtaaaggg

SEQ ID NO: 73981 - DNA, 20 bp, synthetic construct
  misc_feature 1..20: note = CRISPR gRNA sequence
  source 1..20: mol_type = other DNA
acgggtaaagggacatgatt

SEQ ID NO: 73982 - DNA, 20 bp, synthetic construct
  misc_feature 1..20: note = CRISPR gRNA sequence
  source 1..20: mol_type = other DNA
caacttacttctaaatggtt

SEQ ID NO: 73983 - DNA, 20 bp, synthetic construct
  misc_feature 1..20: note = CRISPR gRNA sequence
  source 1..20: mol_type = other DNA
acttctaaatggttcagaaa

SEQ ID NO: 73984 - DNA, 20 bp, synthetic construct
  misc_feature 1..20: note = CRISPR gRNA sequence
  source 1..20: mol_type = other DNA
cttctaaatggttcagaaaa

SEQ ID NO: 73985 - DNA, 20 bp, synthetic construct
  misc_feature 1..20: note = CRISPR gRNA sequence
  source 1..20: mol_type = other DNA
ctaaatggttcagaaaagga

SEQ ID NO: 73986 - DNA, 20 bp, synthetic construct
  misc_feature 1..20: note = CRISPR gRNA sequence
  source 1..20: mol_type = other DNA
taaatggttcagaaaaggag

SEQ ID NO: 73987 - DNA, 20 bp, synthetic construct
  misc_feature 1..20: note = CRISPR gRNA sequence
  source 1..20: mol_type = other DNA
aatggttcagaaaaggagag

SEQ ID NO: 73988 - DNA, 20 bp, synthetic construct
  misc_feature 1..20: note = CRISPR gRNA sequence
  source 1..20: mol_type = other DNA
agaaaaggagagagggagag

SEQ ID NO: 73989 - DNA, 20 bp, synthetic construct
  misc_feature 1..20: note = CRISPR gRNA sequence
  source 1..20: mol_type = other DNA
gcaaagggtgaatttgttct

SEQ ID NO: 73990 - DNA, 20 bp, synthetic construct
  misc_feature 1..20: note = CRISPR gRNA sequence
  source 1..20: mol_type = other DNA
gttcttttttttttttttcg

SEQ ID NO: 73991 - DNA, 20 bp, synthetic construct
  misc_feature 1..20: note = CRISPR gRNA sequence
  source 1..20: mol_type = other DNA
ttcttttttttttttttcgg

SEQ ID NO: 73992 - DNA, 20 bp, synthetic construct
  misc_feature 1..20: note = CRISPR gRNA sequence
  source 1..20: mol_type = other DNA
ttttttttttttttcggaaa

SEQ ID NO: 73993 - DNA, 20 bp, synthetic construct
  misc_feature 1..20: note = CRISPR gRNA sequence
  source 1..20: mol_type = other DNA
ttttttttttttcggaaacc

SEQ ID NO: 73994 - DNA, 20 bp, synthetic construct
  misc_feature 1..20: note = CRISPR gRNA sequence
  source 1..20: mol_type = other DNA
tttttttttttcggaaaccg

SEQ ID NO: 73995 - DNA, 20 bp, synthetic construct
  misc_feature 1..20: note = CRISPR gRNA sequence
  source 1..20: mol_type = other DNA
ttttttttttcggaaaccga

SEQ ID NO: 73996 - DNA, 20 bp, synthetic construct
  misc_feature 1..20: note = CRISPR gRNA sequence
  source 1..20: mol_type = other DNA
tttttttttcggaaaccgag

SEQ ID NO: 73997 - DNA, 20 bp, synthetic construct
  misc_feature 1..20: note = CRISPR gRNA sequence
  source 1..20: mol_type = other DNA
ttttttttcggaaaccgagc

SEQ ID NO: 73998 - DNA, 20 bp, synthetic construct
  misc_feature 1..20: note = CRISPR gRNA sequence
  source 1..20: mol_type = other DNA
tttttttcggaaaccgagcc

SEQ ID NO: 73999 - DNA, 20 bp, synthetic construct
  misc_feature 1..20: note = CRISPR gRNA sequence
  source 1..20: mol_type = other DNA
ttttttcggaaaccgagcct

SEQ ID NO: 74000 - DNA, 20 bp, synthetic construct
  misc_feature 1..20: note = CRISPR gRNA sequence
  source 1..20: mol_type = other DNA
tttttcggaaaccgagcctc

SEQ ID NO: 74001 - DNA, 20 bp, synthetic construct
  misc_feature 1..20: note = CRISPR gRNA sequence
  source 1..20: mol_type = other DNA
ttttcggaaaccgagcctcg

SEQ ID NO: 74002 - DNA, 20 bp, synthetic construct
  misc_feature 1..20: note = CRISPR gRNA sequence
  source 1..20: mol_type = other DNA
tttcggaaaccgagcctcgc

SEQ ID NO: 74003 - DNA, 20 bp, synthetic construct
  misc_feature 1..20: note = CRISPR gRNA sequence
  source 1..20: mol_type = other DNA
ttcggaaaccgagcctcgct

SEQ ID NO: 74004 - DNA, 20 bp, synthetic construct
  misc_feature 1..20: note = CRISPR gRNA sequence
  source 1..20: mol_type = other DNA
tcggaaaccgagcctcgctc

SEQ ID NO: 74005 - DNA, 20 bp, synthetic construct
  misc_feature 1..20: note = CRISPR gRNA sequence
  source 1..20: mol_type = other DNA
cggaaaccgagcctcgctct

SEQ ID NO: 74006 - DNA, 20 bp, synthetic construct
  misc_feature 1..20: note = CRISPR gRNA sequence
  source 1..20: mol_type = other DNA
ggaaaccgagcctcgctctg

SEQ ID NO: 74007 - DNA, 20 bp, synthetic construct
  misc_feature 1..20: note = CRISPR gRNA sequence
  source 1..20: mol_type = other DNA
gctctgtcacctaggctaga

SEQ ID NO: 74008 - DNA, 20 bp, synthetic construct
  misc_feature 1..20: note = CRISPR gRNA sequence
  source 1..20: mol_type = other DNA
tgtcacctaggctagagtgc

SEQ ID NO: 74009 - DNA, 20 bp, synthetic construct
  misc_feature 1..20: note = CRISPR gRNA sequence
  source 1..20: mol_type = other DNA
tcacctaggctagagtgcag

SEQ ID NO: 74010 - DNA, 20 bp, synthetic construct
  misc_feature 1..20: note = CRISPR gRNA sequence
  source 1..20: mol_type = other DNA
ggctagagtgcagtggcaca

SEQ ID NO: 74011 - DNA, 20 bp, synthetic construct
  misc_feature 1..20: note = CRISPR gRNA sequence
  source 1..20: mol_type = other DNA
gagtgcagtggcacaatctt

SEQ ID NO: 74012 - DNA, 20 bp, synthetic construct
  misc_feature 1..20: note = CRISPR gRNA sequence
  source 1..20: mol_type = other DNA
ggctcactgtaacctcagcc

SEQ ID NO: 74013 - DNA, 20 bp, synthetic construct
  misc_feature 1..20: note = CRISPR gRNA sequence
  source 1..20: mol_type = other DNA
gctcactgtaacctcagcct

SEQ ID NO: 74014 - DNA, 20 bp, synthetic construct
  misc_feature 1..20: note = CRISPR gRNA sequence
  source 1..20: mol_type = other DNA
actgtaacctcagcctcccg

SEQ ID NO: 74015 - DNA, 20 bp, synthetic construct
  misc_feature 1..20: note = CRISPR gRNA sequence
  source 1..20: mol_type = other DNA
taacctcagcctcccgggtt

SEQ ID NO: 74016 - DNA, 20 bp, synthetic construct
  misc_feature 1..20: note = CRISPR gRNA sequence
  source 1..20: mol_type = other DNA
agcctcccgggttcaagcaa

SEQ ID NO: 74017 - DNA, 20 bp, synthetic construct
  misc_feature 1..20: note = CRISPR gRNA sequence
  source 1..20: mol_type = other DNA
ccgggttcaagcaattcttg

SEQ ID NO: 74018 - DNA, 20 bp, synthetic construct
  misc_feature 1..20: note = CRISPR gRNA sequence
  source 1..20: mol_type = other DNA
aagcaattcttgtgcctcag

SEQ ID NO: 74019 - DNA, 20 bp, synthetic construct
  misc_feature 1..20: note = CRISPR gRNA sequence
  source 1..20: mol_type = other DNA
ttgtgcctcagcctcccaat

SEQ ID NO: 74020 - DNA, 20 bp, synthetic construct
  misc_feature 1..20: note = CRISPR gRNA sequence
  source 1..20: mol_type = other DNA
gtgcctcagcctcccaatta

SEQ ID NO: 74021 - DNA, 20 bp, synthetic construct
  misc_feature 1..20: note = CRISPR gRNA sequence
  source 1..20: mol_type = other DNA
tgcctcagcctcccaattag

SEQ ID NO: 74022 - DNA, 20 bp, synthetic construct
  misc_feature 1..20: note = CRISPR gRNA sequence
  source 1..20: mol_type = other DNA
agcctcccaattagctggga

SEQ ID NO: 74023 - DNA, 20 bp, synthetic construct
  misc_feature 1..20: note = CRISPR gRNA sequence
  source 1..20: mol_type = other DNA
ccaattagctgggattacag

SEQ ID NO: 74024 - DNA, 20 bp, synthetic construct
  misc_feature 1..20: note = CRISPR gRNA sequence
  source 1..20: mol_type = other DNA
gctgggattacaggcatgca

SEQ ID NO: 74025 - DNA, 20 bp, synthetic construct
  misc_feature 1..20: note = CRISPR gRNA sequence
  source 1..20: mol_type = other DNA
ggattacaggcatgcaccac

SEQ ID NO: 74026 - DNA, 20 bp, synthetic construct
  misc_feature 1..20: note = CRISPR gRNA sequence
  source 1..20: mol_type = other DNA
caggcatgcaccaccatgcc

SEQ ID NO: 74027 - DNA, 20 bp, synthetic construct
  misc_feature 1..20: note = CRISPR gRNA sequence
  source 1..20: mol_type = other DNA
atttttttgtattttagtag

SEQ ID NO: 74028 - DNA, 20 bp, synthetic construct
  misc_feature 1..20: note = CRISPR gRNA sequence
  source 1..20: mol_type = other DNA
ttttgtattttagtagagac

SEQ ID NO: 74029 - DNA, 20 bp, synthetic construct
  misc_feature 1..20: note = CRISPR gRNA sequence
  source 1..20: mol_type = other DNA
tttgtattttagtagagacg

SEQ ID NO: 74030 - DNA, 20 bp, synthetic construct
  misc_feature 1..20: note = CRISPR gRNA sequence
  source 1..20: mol_type = other DNA
ttgtattttagtagagacgg

SEQ ID NO: 74031 - DNA, 20 bp, synthetic construct
  misc_feature 1..20: note = CRISPR gRNA sequence
  source 1..20: mol_type = other DNA
tgtattttagtagagacggg

SEQ ID NO: 74032 - DNA, 20 bp, synthetic construct
  misc_feature 1..20: note = CRISPR gRNA sequence
  source 1..20: mol_type = other DNA
gtattttagtagagacgggg

SEQ ID NO: 74033 - DNA, 20 bp, synthetic construct
  misc_feature 1..20: note = CRISPR gRNA sequence
  source 1..20: mol_type = other DNA
tattttagtagagacggggt

SEQ ID NO: 74034 - DNA, 20 bp, synthetic construct
  misc_feature 1..20: note = CRISPR gRNA sequence
  source 1..20: mol_type = other DNA
tagtagagacggggtttcac

SEQ ID NO: 74035 - DNA, 20 bp, synthetic construct
  misc_feature 1..20: note = CRISPR gRNA sequence
  source 1..20: mol_type = other DNA
agtagagacggggtttcacc

SEQ ID NO: 74036 - DNA, 20 bp, synthetic construct
  misc_feature 1..20: note = CRISPR gRNA sequence
  source 1..20: mol_type = other DNA
gtagagacggggtttcaccg

SEQ ID NO: 74037 - DNA, 20 bp, synthetic construct
  misc_feature 1..20: note = CRISPR gRNA sequence
  source 1..20: mol_type = other DNA
caccgtgttgtccagggtgg

SEQ ID NO: 74038 - DNA, 20 bp, synthetic construct
  misc_feature 1..20: note = CRISPR gRNA sequence
  source 1..20: mol_type = other DNA
accgtgttgtccagggtggt

SEQ ID NO: 74039 - DNA, 20 bp, synthetic construct
  misc_feature 1..20: note = CRISPR gRNA sequence
  source 1..20: mol_type = other DNA
tccagggtggtctcgaattc

SEQ ID NO: 74040 - DNA, 20 bp, synthetic construct
  misc_feature 1..20: note = CRISPR gRNA sequence
  source 1..20: mol_type = other DNA
gaattcctgagctcaggcaa

SEQ ID NO: 74041 - DNA, 20 bp, synthetic construct
  misc_feature 1..20: note = CRISPR gRNA sequence
  source 1..20: mol_type = other DNA
ctgagctcaggcaatccacc

SEQ ID NO: 74042 - DNA, 20 bp, synthetic construct
  misc_feature 1..20: note = CRISPR gRNA sequence
  source 1..20: mol_type = other DNA
agctcaggcaatccacctgc

SEQ ID NO: 74043 - DNA, 20 bp, synthetic construct
  misc_feature 1..20: note = CRISPR gRNA sequence
  source 1..20: mol_type = other DNA
aggcaatccacctgcctcgg

SEQ ID NO: 74044 - DNA, 20 bp, synthetic construct
  misc_feature 1..20: note = CRISPR gRNA sequence
  source 1..20: mol_type = other DNA
cctcggcctcccaaagtgct

SEQ ID NO: 74045 - DNA, 20 bp, synthetic construct
  misc_feature 1..20: note = CRISPR gRNA sequence
  source 1..20: mol_type = other DNA
ggcctcccaaagtgctagga

SEQ ID NO: 74046 - DNA, 20 bp, synthetic construct
  misc_feature 1..20: note = CRISPR gRNA sequence
  source 1..20: mol_type = other DNA
ccaaagtgctaggattacag

SEQ ID NO: 74047 - DNA, 20 bp, synthetic construct
  misc_feature 1..20: note = CRISPR gRNA sequence
  source 1..20: mol_type = other DNA
ggattacagacatgagccac

SEQ ID NO: 74048 - DNA, 20 bp, synthetic construct
  misc_feature 1..20: note = CRISPR gRNA sequence
  source 1..20: mol_type = other DNA
cagacatgagccaccacgcc

SEQ ID NO: 74049 - DNA, 20 bp, synthetic construct
  misc_feature 1..20: note = CRISPR gRNA sequence
  source 1..20: mol_type = other DNA
taagggtgaatttgggtaaa

SEQ ID NO: 74050 - DNA, 20 bp, synthetic construct
  misc_feature 1..20: note = CRISPR gRNA sequence
  source 1..20: mol_type = other DNA
agggtgaatttgggtaaatg

SEQ ID NO: 74051 - DNA, 20 bp, synthetic construct
  misc_feature 1..20: note = CRISPR gRNA sequence
  source 1..20: mol_type = other DNA
gggtaaatggcacacagcag

SEQ ID NO: 74052 - DNA, 20 bp, synthetic construct
  misc_feature 1..20: note = CRISPR gRNA sequence
  source 1..20: mol_type = other DNA
ggtaaatggcacacagcagt

SEQ ID NO: 74053 - DNA, 20 bp, synthetic construct
  misc_feature 1..20: note = CRISPR gRNA sequence
  source 1..20: mol_type = other DNA
tcagtcttcttgaaactttg

SEQ ID NO: 74054 - DNA, 20 bp, synthetic construct
  misc_feature 1..20: note = CRISPR gRNA sequence
  source 1..20: mol_type = other DNA
agtcttcttgaaactttgtg

SEQ ID NO: 74055 - DNA, 20 bp, synthetic construct
  misc_feature 1..20: note = CRISPR gRNA sequence
  source 1..20: mol_type = other DNA
cttgaaactttgtgttagtt

SEQ ID NO: 74056 - DNA, 20 bp, synthetic construct
  misc_feature 1..20: note = CRISPR gRNA sequence
  source 1..20: mol_type = other DNA
ttgaaactttgtgttagttc

SEQ ID NO: 74057 - DNA, 20 bp, synthetic construct
  misc_feature 1..20: note = CRISPR gRNA sequence
  source 1..20: mol_type = other DNA
gaaactttgtgttagttcgc

SEQ ID NO: 74058 - DNA, 20 bp, synthetic construct
  misc_feature 1..20: note = CRISPR gRNA sequence
  source 1..20: mol_type = other DNA
aaactttgtgttagttcgca

SEQ ID NO: 74059 - DNA, 20 bp, synthetic construct
  misc_feature 1..20: note = CRISPR gRNA sequence
  source 1..20: mol_type = other DNA
tgtgttagttcgcagttatt

SEQ ID NO: 74060 - DNA, 20 bp, synthetic construct
  misc_feature 1..20: note = CRISPR gRNA sequence
  source 1..20: mol_type = other DNA
gtgttagttcgcagttattt

SEQ ID NO: 74061 - DNA, 20 bp, synthetic construct
  misc_feature 1..20: note = CRISPR gRNA sequence
  source 1..20: mol_type = other DNA
tgttagttcgcagttatttt

SEQ ID NO: 74062 - DNA, 20 bp, synthetic construct
  misc_feature 1..20: note = CRISPR gRNA sequence
  source 1..20: mol_type = other DNA
gttcgcagttattttaaaag

SEQ ID NO: 74063 - DNA, 20 bp, synthetic construct
  misc_feature 1..20: note = CRISPR gRNA sequence
  source 1..20: mol_type = other DNA
gcagttattttaaaagaaaa

SEQ ID NO: 74064 - DNA, 20 bp, synthetic construct
  misc_feature 1..20: note = CRISPR gRNA sequence
  source 1..20: mol_type = other DNA
ttttaaaagaaaaacaatga

SEQ ID NO: 74065 - DNA, 20 bp, synthetic construct
  misc_feature 1..20: note = CRISPR gRNA sequence
  source 1..20: mol_type = other DNA
taaaagaaaaacaatgaaag

SEQ ID NO: 74066 - DNA, 20 bp, synthetic construct
  misc_feature 1..20: note = CRISPR gRNA sequence
  source 1..20: mol_type = other DNA
aaaagaaaaacaatgaaaga

SEQ ID NO: 74067 - DNA, 20 bp, synthetic construct
  misc_feature 1..20: note = CRISPR gRNA sequence
  source 1..20: mol_type = other DNA
aaagaaaaacaatgaaagag

SEQ ID NO: 74068 - DNA, 20 bp, synthetic construct
  misc_feature 1..20: note = CRISPR gRNA sequence
  source 1..20: mol_type = other DNA
aaaagggaacaactttcttg

SEQ ID NO: 74069 - DNA, 20 bp, synthetic construct
  misc_feature 1..20: note = CRISPR gRNA sequence
  source 1..20: mol_type = other DNA
tcttgccatgtggctcaatg

SEQ ID NO: 74070 - DNA, 20 bp, synthetic construct
  misc_feature 1..20: note = CRISPR gRNA sequence
  source 1..20: mol_type = other DNA
cttgccatgtggctcaatgt

SEQ ID NO: 74071 - DNA, 20 bp, synthetic construct
  misc_feature 1..20: note = CRISPR gRNA sequence
  source 1..20: mol_type = other DNA
ttgccatgtggctcaatgtt

SEQ ID NO: 74072 - DNA, 20 bp, synthetic construct
  misc_feature 1..20: note = CRISPR gRNA sequence
  source 1..20: mol_type = other DNA
gccatgtggctcaatgttcc

SEQ ID NO: 74073 - DNA, 20 bp, synthetic construct
  misc_feature 1..20: note = CRISPR gRNA sequence
  source 1..20: mol_type = other DNA
ccatgtggctcaatgttcct

SEQ ID NO: 74074 - DNA, 20 bp, synthetic construct
  misc_feature 1..20: note = CRISPR gRNA sequence
  source 1..20: mol_type = other DNA
aatgttcctaaggtcatgtt

SEQ ID NO: 74075 - DNA, 20 bp, synthetic construct
  misc_feature 1..20: note = CRISPR gRNA sequence
  source 1..20: mol_type = other DNA
ctaaggtcatgtttacgact

SEQ ID NO: 74076 - DNA, 20 bp, synthetic construct
  misc_feature 1..20: note = CRISPR gRNA sequence
  source 1..20: mol_type = other DNA
aggtcatgtttacgactagg

SEQ ID NO: 74077 - DNA, 20 bp, synthetic construct
  misc_feature 1..20: note = CRISPR gRNA sequence
  source 1..20: mol_type = other DNA
acgactaggtacccctaaaa

SEQ ID NO: 74078 - DNA, 20 bp, synthetic construct
  misc_feature 1..20: note = CRISPR gRNA sequence
  source 1..20: mol_type = other DNA
cgactaggtacccctaaaaa

SEQ ID NO: 74079 - DNA, 20 bp, synthetic construct
  misc_feature 1..20: note = CRISPR gRNA sequence
  source 1..20: mol_type = other DNA
ggtacccctaaaaatcatct

SEQ ID NO: 74080 - DNA, 20 bp, synthetic construct
  misc_feature 1..20: note = CRISPR gRNA sequence
  source 1..20: mol_type = other DNA
aaaatcatctccagggccac

SEQ ID NO: 74081 - DNA, 20 bp, synthetic construct
  misc_feature 1..20: note = CRISPR gRNA sequence
  source 1..20: mol_type = other DNA
cagggccacctgtggtttgt

SEQ ID NO: 74082 - DNA, 20 bp, synthetic construct
  misc_feature 1..20: note = CRISPR gRNA sequence
  source 1..20: mol_type = other DNA
tggtttgtgtccacagagta

SEQ ID NO: 74083 - DNA, 20 bp, synthetic construct
  misc_feature 1..20: note = CRISPR gRNA sequence
  source 1..20: mol_type = other DNA
gtgtccacagagtaagacac

SEQ ID NO: 74084 - DNA, 20 bp, synthetic construct
  misc_feature 1..20: note = CRISPR gRNA sequence
  source 1..20: mol_type = other DNA
tgtccacagagtaagacaca

SEQ ID NO: 74085 - DNA, 20 bp, synthetic construct
  misc_feature 1..20: note = CRISPR gRNA sequence
  source 1..20: mol_type = other DNA
tgagcccagggctgggaata

SEQ ID NO: 74086 - DNA, 20 bp, synthetic construct
  misc_feature 1..20: note = CRISPR gRNA sequence
  source 1..20: mol_type = other DNA
agcccagggctgggaataac

SEQ ID NO: 74087 - DNA, 20 bp, synthetic construct
  misc_feature 1..20: note = CRISPR gRNA sequence
  source 1..20: mol_type = other DNA
ggaataacgggaggtgtcag

SEQ ID NO: 74088 - DNA, 20 bp, synthetic construct
  misc_feature 1..20: note = CRISPR gRNA sequence
  source 1..20: mol_type = other DNA
caaaggggactgagtgaatg

SEQ ID NO: 74089 - DNA, 20 bp, synthetic construct
  misc_feature 1..20: note = CRISPR gRNA sequence
  source 1..20: mol_type = other DNA
agtgaatgtcttgtctacat

SEQ ID NO: 74090 - DNA, 20 bp, synthetic construct
  misc_feature 1..20: note = CRISPR gRNA sequence
  source 1..20: mol_type = other DNA
gtctacataccgaaatgtct

SEQ ID NO: 74091 - DNA, 20 bp, synthetic construct
  misc_feature 1..20: note = CRISPR gRNA sequence
  source 1..20: mol_type = other DNA
tctacataccgaaatgtctt

SEQ ID NO: 74092 - DNA, 20 bp, synthetic construct
  misc_feature 1..20: note = CRISPR gRNA sequence
  source 1..20: mol_type = other DNA
cataccgaaatgtcttcagc

SEQ ID NO: 74093 - DNA, 20 bp, synthetic construct
  misc_feature 1..20: note = CRISPR gRNA sequence
  source 1..20: mol_type = other DNA
cagctcagagagggacagca

SEQ ID NO: 74094 - DNA, 20 bp, synthetic construct
  misc_feature 1..20: note = CRISPR gRNA sequence
  source 1..20: mol_type = other DNA
agctcagagagggacagcag

SEQ ID NO: 74095 - DNA, 20 bp, synthetic construct
  misc_feature 1..20: note = CRISPR gRNA sequence
  source 1..20: mol_type = other DNA
agagagggacagcaggaggc

SEQ ID NO: 74096 - DNA, 20 bp, synthetic construct
  misc_feature 1..20: note = CRISPR gRNA sequence
  source 1..20: mol_type = other DNA
tgcagcagcagggaactggc

SEQ ID NO: 74097 - DNA, 20 bp, synthetic construct
  misc_feature 1..20: note = CRISPR gRNA sequence
  source 1..20: mol_type = other DNA
cagcagcagggaactggcat

SEQ ID NO: 74098 - DNA, 20 bp, synthetic construct
  misc_feature 1..20: note = CRISPR gRNA sequence
  source 1..20: mol_type = other DNA
gcatcatcgtcctcacagag

SEQ ID NO: 74099 - DNA, 20 bp, synthetic construct
  misc_feature 1..20: note = CRISPR gRNA sequence
  source 1..20: mol_type = other DNA
acagaggttaacctgagaca

SEQ ID NO: 74100 - DNA, 20 bp, synthetic construct
  misc_feature 1..20: note = CRISPR gRNA sequence
  source 1..20: mol_type = other DNA
acctgagacaagctgaaaag

SEQ ID NO: 74101 - DNA, 20 bp, synthetic construct
  misc_feature 1..20: note = CRISPR gRNA sequence
  source 1..20: mol_type = other DNA
agacaagctgaaaaggtcca

SEQ ID NO: 74102 - DNA, 20 bp, synthetic construct
  misc_feature 1..20: note = CRISPR gRNA sequence
  source 1..20: mol_type = other DNA
aaaaggtccaaggatattct

SEQ ID NO: 74103 - DNA, 20 bp, synthetic construct
  misc_feature 1..20: note = CRISPR gRNA sequence
  source 1..20: mol_type = other DNA
tagaggatttcaggctggac

SEQ ID NO: 74104 - DNA, 20 bp, synthetic construct
  misc_feature 1..20: note = CRISPR gRNA sequence
  source 1..20: mol_type = other DNA
gaggatttcaggctggacac

SEQ ID NO: 74105 - DNA, 20 bp, synthetic construct
  misc_feature 1..20: note = CRISPR gRNA sequence
  source 1..20: mol_type = other DNA
caggctggacacacctcaga

SEQ ID NO: 74106 - DNA, 20 bp, synthetic construct
  misc_feature 1..20: note = CRISPR gRNA sequence
  source 1..20: mol_type = other DNA
aggctggacacacctcagag

SEQ ID NO: 74107 - DNA, 20 bp, synthetic construct
  misc_feature 1..20: note = CRISPR gRNA sequence
  source 1..20: mol_type = other DNA
gacacacctcagaggtcatc

SEQ ID NO: 74108 - DNA, 20 bp, synthetic construct
  misc_feature 1..20: note = CRISPR gRNA sequence
  source 1..20: mol_type = other DNA
agaggtcatcacatccagaa

SEQ ID NO: 74109 - DNA, 20 bp, synthetic construct
  misc_feature 1..20: note = CRISPR gRNA sequence
  source 1..20: mol_type = other DNA
ccctgagccaccctggggct

SEQ ID NO: 74110 - DNA, 20 bp, synthetic construct
  misc_feature 1..20: note = CRISPR gRNA sequence
  source 1..20: mol_type = other DNA
agccaccctggggctctccc

SEQ ID NO: 74111 - DNA, 20 bp, synthetic construct
  misc_feature 1..20: note = CRISPR gRNA sequence
  source 1..20: mol_type = other DNA
gggctctccctcccctccac

SEQ ID NO: 74112 - DNA, 20 bp, synthetic construct
  misc_feature 1..20: note = CRISPR gRNA sequence
  source 1..20: mol_type = other DNA
tccctcccctccactggcca

SEQ ID NO: 74113 - DNA, 20 bp, synthetic construct
  misc_feature 1..20: note = CRISPR gRNA sequence
  source 1..20: mol_type = other DNA
cctcccctccactggccaag

SEQ ID NO: 74114 - DNA, 20 bp, synthetic construct
  misc_feature 1..20: note = CRISPR gRNA sequence
  source 1..20: mol_type = other DNA
ccctccactggccaagtgtg

SEQ ID NO: 74115 - DNA, 20 bp, synthetic construct
  misc_feature 1..20: note = CRISPR gRNA sequence
  source 1..20: mol_type = other DNA
cactggccaagtgtgatttt

SEQ ID NO: 74116 - DNA, 20 bp, synthetic construct
  misc_feature 1..20: note = CRISPR gRNA sequence
  source 1..20: mol_type = other DNA
gccaagtgtgattttctcct

SEQ ID NO: 74117 - DNA, 20 bp, synthetic construct
  misc_feature 1..20: note = CRISPR gRNA sequence
  source 1..20: mol_type = other DNA
tctcctgcacaaggaagtga

SEQ ID NO: 74118 - DNA, 20 bp, synthetic construct
  misc_feature 1..20: note = CRISPR gRNA sequence
  source 1..20: mol_type = other DNA
ctcctgcacaaggaagtgag

SEQ ID NO: 74119 - DNA, 20 bp, synthetic construct
  misc_feature 1..20: note = CRISPR gRNA sequence
  source 1..20: mol_type = other DNA
tcctgcacaaggaagtgaga

SEQ ID NO: 74120 - DNA, 20 bp, synthetic construct
  misc_feature 1..20: note = CRISPR gRNA sequence
  source 1..20: mol_type = other DNA
ctgcacaaggaagtgagaat

SEQ ID NO: 74121 - DNA, 20 bp, synthetic construct
  misc_feature 1..20: note = CRISPR gRNA sequence
  source 1..20: mol_type = other DNA
cacaaggaagtgagaatgcc

SEQ ID NO: 74122 - DNA, 20 bp, synthetic construct
  misc_feature 1..20: note = CRISPR gRNA sequence
  source 1..20: mol_type = other DNA
gagtaggtaccagggtcaac

SEQ ID NO: 74123 - DNA, 20 bp, synthetic construct
  misc_feature 1..20: note = CRISPR gRNA sequence
  source 1..20: mol_type = other DNA
agggccccacacagagtttc

SEQ ID NO: 74124 - DNA, 20 bp, synthetic construct
  misc_feature 1..20: note = CRISPR gRNA sequence
  source 1..20: mol_type = other DNA
ccaggcgctgacctgagctg

SEQ ID NO: 74125 - DNA, 20 bp, synthetic construct
  misc_feature 1..20: note = CRISPR gRNA sequence
  source 1..20: mol_type = other DNA
caggcgctgacctgagctgc

SEQ ID NO: 74126 - DNA, 20 bp, synthetic construct
  misc_feature 1..20: note = CRISPR gRNA sequence
  source 1..20: mol_type = other DNA
acctgagctgctgcagcctg

SEQ ID NO: 74127 - DNA, 20 bp, synthetic construct
  misc_feature 1..20: note = CRISPR gRNA sequence
  source 1..20: mol_type = other DNA
agctgctgcagcctggcaca

SEQ ID NO: 74128 - DNA, 20 bp, synthetic construct
  misc_feature 1..20: note = CRISPR gRNA sequence
  source 1..20: mol_type = other DNA
ctgcagcctggcacatgtct

SEQ ID NO: 74129 - DNA, 20 bp, synthetic construct
  misc_feature 1..20: note = CRISPR gRNA sequence
  source 1..20: mol_type = other DNA
cagcctggcacatgtctcca

SEQ ID NO: 74130 - DNA, 20 bp, synthetic construct
  misc_feature 1..20: note = CRISPR gRNA sequence
  source 1..20: mol_type = other DNA
gcacatgtctccatcagctg

SEQ ID NO: 74131 - DNA, 20 bp, synthetic construct
  misc_feature 1..20: note = CRISPR gRNA sequence
  source 1..20: mol_type = other DNA
catcagctgcccgacaagaa

SEQ ID NO: 74132 - DNA, 20 bp, synthetic construct
  misc_feature 1..20: note = CRISPR gRNA sequence
  source 1..20: mol_type = other DNA
cccgacaagaaggctgtggt

SEQ ID NO: 74133 - DNA, 20 bp, synthetic construct
  misc_feature 1..20: note = CRISPR gRNA sequence
  source 1..20: mol_type = other DNA
tggtgggctccaaggtcaca

SEQ ID NO: 74134 - DNA, 20 bp, synthetic construct
  misc_feature 1..20: note = CRISPR gRNA sequence
  source 1..20: mol_type = other DNA
caaggtcacagtgagccaac

SEQ ID NO: 74135 - DNA, 20 bp, synthetic construct
  misc_feature 1..20: note = CRISPR gRNA sequence
  source 1..20: mol_type = other DNA
gacacagacagggagacgac

SEQ ID NO: 74136 - DNA, 20 bp, synthetic construct
  misc_feature 1..20: note = CRISPR gRNA sequence
  source 1..20: mol_type = other DNA
tggaacatctagtccagtat

SEQ ID NO: 74137 - DNA, 20 bp, synthetic construct
  misc_feature 1..20: note = CRISPR gRNA sequence
  source 1..20: mol_type = other DNA
ggaacatctagtccagtatg

SEQ ID NO: 74138 - DNA, 20 bp, synthetic construct
  misc_feature 1..20: note = CRISPR gRNA sequence
  source 1..20: mol_type = other DNA
gaacatctagtccagtatgt

SEQ ID NO: 74139 - DNA, 20 bp, synthetic construct
  misc_feature 1..20: note = CRISPR gRNA sequence
  source 1..20: mol_type = other DNA
gtccagtatgtgggattcag

SEQ ID NO: 74140 - DNA, 20 bp, synthetic construct
  misc_feature 1..20: note = CRISPR gRNA sequence
  source 1..20: mol_type = other DNA
agtatctgcctgcaaggagc

SEQ ID NO: 74141 - DNA, 20 bp, synthetic construct
  misc_feature 1..20: note = CRISPR gRNA sequence
  source 1..20: mol_type = other DNA
cctgcaaggagcttatggtg

SEQ ID NO: 74142 - DNA, 20 bp, synthetic construct
  misc_feature 1..20: note = CRISPR gRNA sequence
  source 1..20: mol_type = other DNA
caaggagcttatggtgtagg

SEQ ID NO: 74143 - DNA, 20 bp, synthetic construct
  misc_feature 1..20: note = CRISPR gRNA sequence
  source 1..20: mol_type = other DNA
atggtgtaggggtaaataaa

SEQ ID NO: 74144 - DNA, 20 bp, synthetic construct
  misc_feature 1..20: note = CRISPR gRNA sequence
  source 1..20: mol_type = other DNA
tggtgtaggggtaaataaat

SEQ ID NO: 74145 - DNA, 20 bp, synthetic construct
  misc_feature 1..20: note = CRISPR gRNA sequence
  source 1..20: mol_type = other DNA
atcaaatgaagtcctacagt

SEQ ID NO: 74146 - DNA, 20 bp, synthetic construct
  misc_feature 1..20: note = CRISPR gRNA sequence
  source 1..20: mol_type = other DNA
cagtttgctattcacttatg

SEQ ID NO: 74147 - DNA, 20 bp, synthetic construct
  misc_feature 1..20: note = CRISPR gRNA sequence
  source 1..20: mol_type = other DNA
gctattcacttatgagaagt

SEQ ID NO: 74148 - DNA, 20 bp, synthetic construct
  misc_feature 1..20: note = CRISPR gRNA sequence
  source 1..20: mol_type = other DNA
ctattcacttatgagaagtg

SEQ ID NO: 74149 - DNA, 20 bp, synthetic construct
  misc_feature 1..20: note = CRISPR gRNA sequence
  source 1..20: mol_type = other DNA
ttcacttatgagaagtgcta

SEQ ID NO: 74150 - DNA, 20 bp, synthetic construct
  misc_feature 1..20: note = CRISPR gRNA sequence
  source 1..20: mol_type = other DNA
acttatgagaagtgctagga

SEQ ID NO: 74151 - DNA, 20 bp, synthetic construct
  misc_feature 1..20: note = CRISPR gRNA sequence
  source 1..20: mol_type = other DNA
atgagaagtgctaggaagca

SEQ ID NO: 74152 - DNA, 20 bp, synthetic construct
  misc_feature 1..20: note = CRISPR gRNA sequence
  source 1..20: mol_type = other DNA
tgagaagtgctaggaagcag

SEQ ID NO: 74153 - DNA, 20 bp, synthetic construct
  misc_feature 1..20: note = CRISPR gRNA sequence
  source 1..20: mol_type = other DNA
ggaagcaggagtccagatgg

SEQ ID NO: 74154 - DNA, 20 bp, synthetic construct
  misc_feature 1..20: note = CRISPR gRNA sequence
  source 1..20: mol_type = other DNA
gtatggttgtgcaggttgtt

SEQ ID NO: 74155 - DNA, 20 bp, synthetic construct
  misc_feature 1..20: note = CRISPR gRNA sequence
  source 1..20: mol_type = other DNA
tgcaggttgttcaccgcaca

SEQ ID NO: 74156 - DNA, 20 bp, synthetic construct
  misc_feature 1..20: note = CRISPR gRNA sequence
  source 1..20: mol_type = other DNA
ttcaccgcacaaggacacac

SEQ ID NO: 74157 - DNA, 20 bp, synthetic construct
  misc_feature 1..20: note = CRISPR gRNA sequence
  source 1..20: mol_type = other DNA
accgcacaaggacacacagc

SEQ ID NO: 74158 - DNA, 20 bp, synthetic construct
  misc_feature 1..20: note = CRISPR gRNA sequence
  source 1..20: mol_type = other DNA
agatcctaccatgctctatt

SEQ ID NO: 74159 - DNA, 20 bp, synthetic construct
  misc_feature 1..20: note = CRISPR gRNA sequence
  source 1..20: mol_type = other DNA
ccatgctctatttcccagaa

SEQ ID NO: 74160 - DNA, 20 bp, synthetic construct
  misc_feature 1..20: note = CRISPR gRNA sequence
  source 1..20: mol_type = other DNA
tatttcccagaatgtacaca

SEQ ID NO: 74161 - DNA, 20 bp, synthetic construct
  misc_feature 1..20: note = CRISPR gRNA sequence
  source 1..20: mol_type = other DNA
tttcccagaatgtacacatg

SEQ ID NO: 74162 - DNA, 20 bp, synthetic construct
  misc_feature 1..20: note = CRISPR gRNA sequence
  source 1..20: mol_type = other DNA
cccagaatgtacacatgcag

SEQ ID NO: 74163 - DNA, 20 bp, synthetic construct
  misc_feature 1..20: note = CRISPR gRNA sequence
  source 1..20: mol_type = other DNA
ccagaatgtacacatgcagg

SEQ ID NO: 74164 - DNA, 20 bp, synthetic construct
  misc_feature 1..20: note = CRISPR gRNA sequence
  source 1..20: mol_type = other DNA
catccactcaaaagggtgac

SEQ ID NO: 74165 - DNA, 20 bp, synthetic construct
  misc_feature 1..20: note = CRISPR gRNA sequence
  source 1..20: mol_type = other DNA
aaaagggtgacattttaatt

SEQ ID NO: 74166 - DNA, 20 bp, synthetic construct
  misc_feature 1..20: note = CRISPR gRNA sequence
  source 1..20: mol_type = other DNA
taatttcccaaactgtgcca

SEQ ID NO: 74167 - DNA, 20 bp, synthetic construct
  misc_feature 1..20: note = CRISPR gRNA sequence
  source 1..20: mol_type = other DNA
aatttcccaaactgtgccat

SEQ ID NO: 74168 - DNA, 20 bp, synthetic construct
  misc_feature 1..20: note = CRISPR gRNA sequence
  source 1..20: mol_type = other DNA
atttcccaaactgtgccata

SEQ ID NO: 74169 - DNA, 20 bp, synthetic construct
  misc_feature 1..20: note = CRISPR gRNA sequence
  source 1..20: mol_type = other DNA
cccaaactgtgccatatgga

SEQ ID NO: 74170 - DNA, 20 bp, synthetic construct
  misc_feature 1..20: note = CRISPR gRNA sequence
  source 1..20: mol_type = other DNA
ccaaactgtgccatatggat

SEQ ID NO: 74171 - DNA, 20 bp, synthetic construct
  misc_feature 1..20: note = CRISPR gRNA sequence
  source 1..20: mol_type = other DNA
tgccatatggatttagaggt

SEQ ID NO: 74172 - DNA, 20 bp, synthetic construct
  misc_feature 1..20: note = CRISPR gRNA sequence
  source 1..20: mol_type = other DNA
agaggtgctgtgaatccagg

SEQ ID NO: 74173 - DNA, 20 bp, synthetic construct
  misc_feature 1..20: note = CRISPR gRNA sequence
  source 1..20: mol_type = other DNA
gaggtgctgtgaatccaggg

SEQ ID NO: 74174 - DNA, 20 bp, synthetic construct
  misc_feature 1..20: note = CRISPR gRNA sequence
  source 1..20: mol_type = other DNA
tgaatccagggatctataag

SEQ ID NO: 74175 - DNA, 20 bp, synthetic construct
  misc_feature 1..20: note = CRISPR gRNA sequence
  source 1..20: mol_type = other DNA
taagagtggataatggaagt

SEQ ID NO: 74176 - DNA, 20 bp, synthetic construct
  misc_feature 1..20: note = CRISPR gRNA sequence
  source 1..20: mol_type = other DNA
gactaagccttggggtccag

SEQ ID NO: 74177 - DNA, 20 bp, synthetic construct
  misc_feature 1..20: note = CRISPR gRNA sequence
  source 1..20: mol_type = other DNA
actaagccttggggtccagg

SEQ ID NO: 74178 - DNA, 20 bp, synthetic construct
  misc_feature 1..20: note = CRISPR gRNA sequence
  source 1..20: mol_type = other DNA
agccttggggtccagggggc

SEQ ID NO: 74179 - DNA, 20 bp, synthetic construct
  misc_feature 1..20: note = CRISPR gRNA sequence
  source 1..20: mol_type = other DNA
ggggtccagggggcctccct

SEQ ID NO: 74180 - DNA, 20 bp, synthetic construct
  misc_feature 1..20: note = CRISPR gRNA sequence
  source 1..20: mol_type = other DNA
gggtccagggggcctccctg

SEQ ID NO: 74181 - DNA, 20 bp, synthetic construct
  misc_feature 1..20: note = CRISPR gRNA sequence
  source 1..20: mol_type = other DNA
cctgaggtggtggcatttaa

SEQ ID NO: 74182 - DNA, 20 bp, synthetic construct
  misc_feature 1..20: note = CRISPR gRNA sequence
  source 1..20: mol_type = other DNA
aggtggtggcatttaagctg

SEQ ID NO: 74183 - DNA, 20 bp, synthetic construct
  misc_feature 1..20: note = CRISPR gRNA sequence
  source 1..20: mol_type = other DNA
aagctgagacctgagggatg

SEQ ID NO: 74184 - DNA, 20 bp, synthetic construct
  misc_feature 1..20: note = CRISPR gRNA sequence
  source 1..20: mol_type = other DNA
agctgagacctgagggatga

SEQ ID NO: 74185 - DNA, 20 bp, synthetic construct
  misc_feature 1..20: note = CRISPR gRNA sequence
  source 1..20: mol_type = other DNA
agacctgagggatgaggagg

SEQ ID NO: 74186 - DNA, 20 bp, synthetic construct
  misc_feature 1..20: note = CRISPR gRNA sequence
  source 1..20: mol_type = other DNA
agggatgaggaggagttagg

SEQ ID NO: 74187 - DNA, 20 bp, synthetic construct
  misc_feature 1..20: note = CRISPR gRNA sequence
  source 1..20: mol_type = other DNA
ggcaggtgaagcaggtaggc

SEQ ID NO: 74188 - DNA, 20 bp, synthetic construct
  misc_feature 1..20: note = CRISPR gRNA sequence
  source 1..20: mol_type = other DNA
tgggcagagagcacagcctg

SEQ ID NO: 74189 - DNA, 20 bp, synthetic construct
  misc_feature 1..20: note = CRISPR gRNA sequence
  source 1..20: mol_type = other DNA
ggcagagagcacagcctgtg

SEQ ID NO: 74190 - DNA, 20 bp, synthetic construct
  misc_feature 1..20: note = CRISPR gRNA sequence
  source 1..20: mol_type = other DNA
tgcaaatgccctaaggtcta

SEQ ID NO: 74191 - DNA, 20 bp, synthetic construct
  misc_feature 1..20: note = CRISPR gRNA sequence
  source 1..20: mol_type = other DNA
aggtctaagcaagatggtgt

SEQ ID NO: 74192 - DNA, 20 bp, synthetic construct
  misc_feature 1..20: note = CRISPR gRNA sequence
  source 1..20: mol_type = other DNA
agcaagatggtgttcgggga

SEQ ID NO: 74193 - DNA, 20 bp, synthetic construct
  misc_feature 1..20: note = CRISPR gRNA sequence
  source 1..20: mol_type = other DNA
ggggaactgaaagttcatgg

SEQ ID NO: 74194 - DNA, 20 bp, synthetic construct
  misc_feature 1..20: note = CRISPR gRNA sequence
  source 1..20: mol_type = other DNA
aaagttcatgggggtgactg

SEQ ID NO: 74195 - DNA, 20 bp, synthetic construct
  misc_feature 1..20: note = CRISPR gRNA sequence
  source 1..20: mol_type = other DNA
atgggggtgactggagctga

SEQ ID NO: 74196 - DNA, 20 bp, synthetic construct
  misc_feature 1..20: note = CRISPR gRNA sequence
  source 1..20: mol_type = other DNA
gagctgagactggggcctgg

SEQ ID NO: 74197 - DNA, 20 bp, synthetic construct
  misc_feature 1..20: note = CRISPR gRNA sequence
  source 1..20: mol_type = other DNA
agactggggcctggagtggg

SEQ ID NO: 74198 - DNA, 20 bp, synthetic construct
  misc_feature 1..20: note = CRISPR gRNA sequence
  source 1..20: mol_type = other DNA
gggcctggagtggggctgaa

SEQ ID NO: 74199 - DNA, 20 bp, synthetic construct
  misc_feature 1..20: note = CRISPR gRNA sequence
  source 1..20: mol_type = other DNA
gagtggggctgaaacgcctc

SEQ ID NO: 74200 - DNA, 20 bp, synthetic construct
  misc_feature 1..20: note = CRISPR gRNA sequence
  source 1..20: mol_type = other DNA
aaacgcctcagaagtgggtt

SEQ ID NO: 74201 - DNA, 20 bp, synthetic construct
  misc_feature 1..20: note = CRISPR gRNA sequence
  source 1..20: mol_type = other DNA
agaagtgggttggtcagacc

SEQ ID NO: 74202 - DNA, 20 bp, synthetic construct
  misc_feature 1..20: note = CRISPR gRNA sequence
  source 1..20: mol_type = other DNA
gtcagacctctgtagcctgt

SEQ ID NO: 74203 - DNA, 20 bp, synthetic construct
  misc_feature 1..20: note = CRISPR gRNA sequence
  source 1..20: mol_type = other DNA
tgtagcctgtgtaaagactt

SEQ ID NO: 74204 - DNA, 20 bp, synthetic construct
  misc_feature 1..20: note = CRISPR gRNA sequence
  source 1..20: mol_type = other DNA
tagcctgtgtaaagacttcg

SEQ ID NO: 74205 - DNA, 20 bp, synthetic construct
  misc_feature 1..20: note = CRISPR gRNA sequence
  source 1..20: mol_type = other DNA
tgtaaagacttcgaacccct

SEQ ID NO: 74206 - DNA, 20 bp, synthetic construct
  misc_feature 1..20: note = CRISPR gRNA sequence
  source 1..20: mol_type = other DNA
cgaacccctaaggtctctgg

SEQ ID NO: 74207 - DNA, 20 bp, synthetic construct
  misc_feature 1..20: note = CRISPR gRNA sequence
  source 1..20: mol_type = other DNA
gaacccctaaggtctctggg

SEQ ID NO: 74208 - DNA, 20 bp, synthetic construct
  misc_feature 1..20: note = CRISPR gRNA sequence
  source 1..20: mol_type = other DNA
aggtctctgggcagggtggt

SEQ ID NO: 74209 - DNA, 20 bp, synthetic construct
  misc_feature 1..20: note = CRISPR gRNA sequence
  source 1..20: mol_type = other DNA
tgggcagggtggtgaatatt

SEQ ID NO: 74210 - DNA, 20 bp, synthetic construct
  misc_feature 1..20: note = CRISPR gRNA sequence
  source 1..20: mol_type = other DNA
ggcagggtggtgaatattgg

SEQ ID NO: 74211 - DNA, 20 bp, synthetic construct
  misc_feature 1..20: note = CRISPR gRNA sequence
  source 1..20: mol_type = other DNA
gtcagaagcagccctgcccc

SEQ ID NO: 74212 - DNA, 20 bp, synthetic construct
  misc_feature 1..20: note = CRISPR gRNA sequence
  source 1..20: mol_type = other DNA
ccccctccccaacaccagcc

SEQ ID NO: 74213 - DNA, 20 bp, synthetic construct
  misc_feature 1..20: note = CRISPR gRNA sequence
  source 1..20: mol_type = other DNA
cccaacaccagcccctgcct

SEQ ID NO: 74214 - DNA, 20 bp, synthetic construct
  misc_feature 1..20: note = CRISPR gRNA sequence
  source 1..20: mol_type = other DNA
ccttggggtccctggtgctg

SEQ ID NO: 74215 - DNA, 20 bp, synthetic construct
  misc_feature 1..20: note = CRISPR gRNA sequence
  source 1..20: mol_type = other DNA
ggggtccctggtgctgggtc

SEQ ID NO: 74216 - DNA, 20 bp, synthetic construct
  misc_feature 1..20: note = CRISPR gRNA sequence
  source 1..20: mol_type = other DNA
gggtccctggtgctgggtcc

SEQ ID NO: 74217 - DNA, 20 bp, synthetic construct
  misc_feature 1..20: note = CRISPR gRNA sequence
  source 1..20: mol_type = other DNA
gtgctgggtcccacctgagt

SEQ ID NO: 74218 - DNA, 20 bp, synthetic construct
  misc_feature 1..20: note = CRISPR gRNA sequence
  source 1..20: mol_type = other DNA
ggtcccacctgagtgccaca

SEQ ID NO: 74219 - DNA, 20 bp, synthetic construct
  misc_feature 1..20: note = CRISPR gRNA sequence
  source 1..20: mol_type = other DNA
agtgccacagcttctggatt

SEQ ID NO: 74220 - DNA, 20 bp, synthetic construct
  misc_feature 1..20: note = CRISPR gRNA sequence
  source 1..20: mol_type = other DNA
ctggattctcttcctggcga

SEQ ID NO: 74221 - DNA, 20 bp, synthetic construct
  misc_feature 1..20: note = CRISPR gRNA sequence
  source 1..20: mol_type = other DNA
tggattctcttcctggcgag

SEQ ID NO: 74222 - DNA, 20 bp, synthetic construct
  misc_feature 1..20: note = CRISPR gRNA sequence
  source 1..20: mol_type = other DNA
gattctcttcctggcgagga

SEQ ID NO: 74223 - DNA, 20 bp, synthetic construct
  misc_feature 1..20: note = CRISPR gRNA sequence
  source 1..20: mol_type = other DNA
tcttcctggcgaggaaattc

SEQ ID NO: 74224 - DNA, 20 bp, synthetic construct
  misc_feature 1..20: note = CRISPR gRNA sequence
  source 1..20: mol_type = other DNA
ttcctggcgaggaaattcca

SEQ ID NO: 74225 - DNA, 20 bp, synthetic construct
  misc_feature 1..20: note = CRISPR gRNA sequence
  source 1..20: mol_type = other DNA
cctggcgaggaaattccagc

SEQ ID NO: 74226 - DNA, 20 bp, synthetic construct
  misc_feature 1..20: note = CRISPR gRNA sequence
  source 1..20: mol_type = other DNA
ctggcgaggaaattccagct

SEQ ID NO: 74227 - DNA, 20 bp, synthetic construct
  misc_feature 1..20: note = CRISPR gRNA sequence
  source 1..20: mol_type = other DNA
gcgaggaaattccagctgga

SEQ ID NO: 74228 - DNA, 20 bp, synthetic construct
  misc_feature 1..20: note = CRISPR gRNA sequence
  source 1..20: mol_type = other DNA
cagctggacacagagctgct

SEQ ID NO: 74229 - DNA, 20 bp, synthetic construct
  misc_feature 1..20: note = CRISPR gRNA sequence
  source 1..20: mol_type = other DNA
gacacagagctgctgctggg

SEQ ID NO: 74230 - DNA, 20 bp, synthetic construct
  misc_feature 1..20: note = CRISPR gRNA sequence
  source 1..20: mol_type = other DNA
ctgctgggtctcggagatgc

SEQ ID NO: 74231 - DNA, 20 bp, synthetic construct
  misc_feature 1..20: note = CRISPR gRNA sequence
  source 1..20: mol_type = other DNA
ctgggtctcggagatgctga

SEQ ID NO: 74232 - DNA, 20 bp, synthetic construct
  misc_feature 1..20: note = CRISPR gRNA sequence
  source 1..20: mol_type = other DNA
ggtctcggagatgctgagga

SEQ ID NO: 74233 - DNA, 20 bp, synthetic construct
  misc_feature 1..20: note = CRISPR gRNA sequence
  source 1..20: mol_type = other DNA
ggagatgctgaggagtgagc

SEQ ID NO: 74234 - DNA, 20 bp, synthetic construct
  misc_feature 1..20: note = CRISPR gRNA sequence
  source 1..20: mol_type = other DNA
aggagtgagcagtaaccaac

SEQ ID NO: 74235 - DNA, 20 bp, synthetic construct
  misc_feature 1..20: note = CRISPR gRNA sequence
  source 1..20: mol_type = other DNA
ccccggagggcctagctggc

SEQ ID NO: 74236 - DNA, 20 bp, synthetic construct
  misc_feature 1..20: note = CRISPR gRNA sequence
  source 1..20: mol_type = other DNA
cccggagggcctagctggca

SEQ ID NO: 74237 - DNA, 20 bp, synthetic construct
  misc_feature 1..20: note = CRISPR gRNA sequence
  source 1..20: mol_type = other DNA
gctggcacctgggctgcccg

SEQ ID NO: 74238 - DNA, 20 bp, synthetic construct
  misc_feature 1..20: note = CRISPR gRNA sequence
  source 1..20: mol_type = other DNA
gcacctgggctgcccggctc

SEQ ID NO: 74239 - DNA, 20 bp, synthetic construct
  misc_feature 1..20: note = CRISPR gRNA sequence
  source 1..20: mol_type = other DNA
ggctgcccggctccaactct

SEQ ID NO: 74240 - DNA, 20 bp, synthetic construct
  misc_feature 1..20: note = CRISPR gRNA sequence
  source 1..20: mol_type = other DNA
cccggctccaactctgaact

SEQ ID NO: 74241 - DNA, 20 bp, synthetic construct
  misc_feature 1..20: note = CRISPR gRNA sequence
  source 1..20: mol_type = other DNA
caactctgaactctcacttt

SEQ ID NO: 74242 - DNA, 20 bp, synthetic construct
  misc_feature 1..20: note = CRISPR gRNA sequence
  source 1..20: mol_type = other DNA
tgaactctcactttgcctgg

SEQ ID NO: 74243 - DNA, 20 bp, synthetic construct
  misc_feature 1..20: note = CRISPR gRNA sequence
  source 1..20: mol_type = other DNA
aactctcactttgcctgggt

SEQ ID NO: 74244 - DNA, 20 bp, synthetic construct
  misc_feature 1..20: note = CRISPR gRNA sequence
  source 1..20: mol_type = other DNA
tcactttgcctgggtcccct

SEQ ID NO: 74245 - DNA, 20 bp, synthetic construct
  misc_feature 1..20: note = CRISPR gRNA sequence
  source 1..20: mol_type = other DNA
actttgcctgggtccccttc

SEQ ID NO: 74246 - DNA, 20 bp, synthetic construct
  misc_feature 1..20: note = CRISPR gRNA sequence
  source 1..20: mol_type = other DNA
tgcctgggtccccttctccc

SEQ ID NO: 74247 - DNA, 20 bp, synthetic construct
  misc_feature 1..20: note = CRISPR gRNA sequence
  source 1..20: mol_type = other DNA
gcctgggtccccttctcccc

SEQ ID NO: 74248 - DNA, 20 bp, synthetic construct
  misc_feature 1..20: note = CRISPR gRNA sequence
  source 1..20: mol_type = other DNA
cctgggtccccttctcccct

SEQ ID NO: 74249 - DNA, 20 bp, synthetic construct
  misc_feature 1..20: note = CRISPR gRNA sequence
  source 1..20: mol_type = other DNA
ggtccccttctcccctgcca

SEQ ID NO: 74250 - DNA, 20 bp, synthetic construct
  misc_feature 1..20: note = CRISPR gRNA sequence
  source 1..20: mol_type = other DNA
ctcccctgccagggaccagc

SEQ ID NO: 74251 - DNA, 20 bp, synthetic construct
  misc_feature 1..20: note = CRISPR gRNA sequence
  source 1..20: mol_type = other DNA
tcccctgccagggaccagct

SEQ ID NO: 74252 - DNA, 20 bp, synthetic construct
  misc_feature 1..20: note = CRISPR gRNA sequence
  source 1..20: mol_type = other DNA
ccctgccagggaccagctta

SEQ ID NO: 74253 - DNA, 20 bp, synthetic construct
  misc_feature 1..20: note = CRISPR gRNA sequence
  source 1..20: mol_type = other DNA
ccagggaccagcttaggact

SEQ ID NO: 74254 - DNA, 20 bp, synthetic construct
  misc_feature 1..20: note = CRISPR gRNA sequence
  source 1..20: mol_type = other DNA
aggactggaaagtaggtgct

SEQ ID NO: 74255 - DNA, 20 bp, synthetic construct
  misc_feature 1..20: note = CRISPR gRNA sequence
  source 1..20: mol_type = other DNA
ggactggaaagtaggtgctt

SEQ ID NO: 74256 - DNA, 20 bp, synthetic construct
  misc_feature 1..20: note = CRISPR gRNA sequence
  source 1..20: mol_type = other DNA
gaaagtaggtgcttccgtga

SEQ ID NO: 74257 - DNA, 20 bp, synthetic construct
  misc_feature 1..20: note = CRISPR gRNA sequence
  source 1..20: mol_type = other DNA
ccgtgagtcacacacaatac

SEQ ID NO: 74258 - DNA, 20 bp, synthetic construct
  misc_feature 1..20: note = CRISPR gRNA sequence
  source 1..20: mol_type = other DNA
cgtgagtcacacacaatacc

SEQ ID NO: 74259 - DNA, 20 bp, synthetic construct
  misc_feature 1..20: note = CRISPR gRNA sequence
  source 1..20: mol_type = other DNA
ttcaacaatttttctctttc

SEQ ID NO: 74260 - DNA, 20 bp, synthetic construct
  misc_feature 1..20: note = CRISPR gRNA sequence
  source 1..20: mol_type = other DNA
tcaacaatttttctctttct

SEQ ID NO: 74261 - DNA, 20 bp, synthetic construct
  misc_feature 1..20: note = CRISPR gRNA sequence
  source 1..20: mol_type = other DNA
caacaatttttctctttctt

SEQ ID NO: 74262 - DNA, 20 bp, synthetic construct
  misc_feature 1..20: note = CRISPR gRNA sequence
  source 1..20: mol_type = other DNA
aacaatttttctctttcttt

SEQ ID NO: 74263 - DNA, 20 bp, synthetic construct
  misc_feature 1..20: note = CRISPR gRNA sequence
  source 1..20: mol_type = other DNA
ttctctttcttttttttttt

SEQ ID NO: 74264 - DNA, 20 bp, synthetic construct
  misc_feature 1..20: note = CRISPR gRNA sequence
  source 1..20: mol_type = other DNA
tctctttctttttttttttt

SEQ ID NO: 74265 - DNA, 20 bp, synthetic construct
  misc_feature 1..20: note = CRISPR gRNA sequence
  source 1..20: mol_type = other DNA
ctctttcttttttttttttt

SEQ ID NO: 74266 - DNA, 20 bp, synthetic construct
  misc_feature 1..20: note = CRISPR gRNA sequence
  source 1..20: mol_type = other DNA
tctttctttttttttttttt

SEQ ID NO: 74267 - DNA, 20 bp, synthetic construct
  misc_feature 1..20: note = CRISPR gRNA sequence
  source 1..20: mol_type = other DNA
tttcttttttttttttttta

SEQ ID NO: 74268 - DNA, 20 bp, synthetic construct
  misc_feature 1..20: note = CRISPR gRNA sequence
  source 1..20: mol_type = other DNA
tctttttttttttttttaaa

SEQ ID NO: 74269 - DNA, 20 bp, synthetic construct
  misc_feature 1..20: note = CRISPR gRNA sequence
  source 1..20: mol_type = other DNA
ctttttttttttttttaaag

SEQ ID NO: 74270 - DNA, 20 bp, synthetic construct
  misc_feature 1..20: note = CRISPR gRNA sequence
  source 1..20: mol_type = other DNA
tttttttttttttttaaaga

SEQ ID NO: 74271 - DNA, 20 bp, synthetic construct
  misc_feature 1..20: note = CRISPR gRNA sequence
  source 1..20: mol_type = other DNA
tttttttttttttaaagaga

SEQ ID NO: 74272 - DNA, 20 bp, synthetic construct
  misc_feature 1..20: note = CRISPR gRNA sequence
  source 1..20: mol_type = other DNA
ttttttttttttaaagagac

SEQ ID NO: 74273 - DNA, 20 bp, synthetic construct
  misc_feature 1..20: note = CRISPR gRNA sequence
  source 1..20: mol_type = other DNA
tttttttttttaaagagaca

SEQ ID NO: 74274 - DNA, 20 bp, synthetic construct
  misc_feature 1..20: note = CRISPR gRNA sequence
  source 1..20: mol_type = other DNA
ttttttttttaaagagacag

SEQ ID NO: 74275 - DNA, 20 bp, synthetic construct
  misc_feature 1..20: note = CRISPR gRNA sequence
  source 1..20: mol_type = other DNA
tttttttttaaagagacagg

SEQ ID NO: 74276 - DNA, 20 bp, synthetic construct
  misc_feature 1..20: note = CRISPR gRNA sequence
  source 1..20: mol_type = other DNA
ttttttttaaagagacaggg

SEQ ID NO: 74277 - DNA, 20 bp, synthetic construct
  misc_feature 1..20: note = CRISPR gRNA sequence
  source 1..20: mol_type = other DNA
tttttttaaagagacagggt

SEQ ID NO: 74278 - DNA, 20 bp, synthetic construct
  misc_feature 1..20: note = CRISPR gRNA sequence
  source 1..20: mol_type = other DNA
ttttttaaagagacagggtc

SEQ ID NO: 74279 - DNA, 20 bp, synthetic construct
  misc_feature 1..20: note = CRISPR gRNA sequence
  source 1..20: mol_type = other DNA
tttttaaagagacagggtct

SEQ ID NO: 74280 - DNA, 20 bp, synthetic construct
  misc_feature 1..20: note = CRISPR gRNA sequence
  source 1..20: mol_type = other DNA
ttttaaagagacagggtctt

SEQ ID NO: 74281 - DNA, 20 bp, synthetic construct
  misc_feature 1..20: note = CRISPR gRNA sequence
  source 1..20: mol_type = other DNA
tttaaagagacagggtcttg

SEQ ID NO: 74282 - DNA, 20 bp, synthetic construct
  misc_feature 1..20: note = CRISPR gRNA sequence
  source 1..20: mol_type = other DNA
ttaaagagacagggtcttgc

SEQ ID NO: 74283 - DNA, 20 bp, synthetic construct
  misc_feature 1..20: note = CRISPR gRNA sequence
  source 1..20: mol_type = other DNA
taaagagacagggtcttgct

SEQ ID NO: 74284 - DNA, 20 bp, synthetic construct
  misc_feature 1..20: note = CRISPR gRNA sequence
  source 1..20: mol_type = other DNA
aaagagacagggtcttgctc

SEQ ID NO: 74285 - DNA, 20 bp, synthetic construct
  misc_feature 1..20: note = CRISPR gRNA sequence
  source 1..20: mol_type = other DNA
aagagacagggtcttgctct

SEQ ID NO: 74286 - DNA, 20 bp, synthetic construct
  misc_feature 1..20: note = CRISPR gRNA sequence
  source 1..20: mol_type = other DNA
gctctgtagcccaggctgaa

SEQ ID NO: 74287 - DNA, 20 bp, synthetic construct
  misc_feature 1..20: note = CRISPR gRNA sequence
  source 1..20: mol_type = other DNA
ctctgtagcccaggctgaag

SEQ ID NO: 74288 - DNA, 20 bp, synthetic construct
  misc_feature 1..20: note = CRISPR gRNA sequence
  source 1..20: mol_type = other DNA
tgtagcccaggctgaagtgc

SEQ ID NO: 74289 - DNA, 20 bp, synthetic construct
  misc_feature 1..20: note = CRISPR gRNA sequence
  source 1..20: mol_type = other DNA
tagcccaggctgaagtgcag

SEQ ID NO: 74290 - DNA, 20 bp, synthetic construct
  misc_feature 1..20: note = CRISPR gRNA sequence
  source 1..20: mol_type = other DNA
aagtgcagtggtgggcacga

SEQ ID NO: 74291 - DNA, 20 bp, synthetic construct
  misc_feature 1..20: note = CRISPR gRNA sequence
  source 1..20: mol_type = other DNA
actgcagccttgaactctgg

SEQ ID NO: 74292 - DNA, 20 bp, synthetic construct
  misc_feature 1..20: note = CRISPR gRNA sequence
  source 1..20: mol_type = other DNA
cagccttgaactctgggctt

SEQ ID NO: 74293 - DNA, 20 bp, synthetic construct
  misc_feature 1..20: note = CRISPR gRNA sequence
  source 1..20: mol_type = other DNA
gaactctgggcttcagtgat

SEQ ID NO: 74294 - DNA, 20 bp, synthetic construct
  misc_feature 1..20: note = CRISPR gRNA sequence
  source 1..20: mol_type = other DNA
aactctgggcttcagtgatc

SEQ ID NO: 74295 - DNA, 20 bp, synthetic construct
  misc_feature 1..20: note = CRISPR gRNA sequence
  source 1..20: mol_type = other DNA
tgggcttcagtgatcctcct

SEQ ID NO: 74296 - DNA, 20 bp, synthetic construct
  misc_feature 1..20: note = CRISPR gRNA sequence
  source 1..20: mol_type = other DNA
ggcttcagtgatcctcctgc

SEQ ID NO: 74297 - DNA, 20 bp, synthetic construct
  misc_feature 1..20: note = CRISPR gRNA sequence
  source 1..20: mol_type = other DNA
cagtgatcctcctgcctcgg

SEQ ID NO: 74298 - DNA, 20 bp, synthetic construct
  misc_feature 1..20: note = CRISPR gRNA sequence
  source 1..20: mol_type = other DNA
agtgatcctcctgcctcggc

SEQ ID NO: 74299 - DNA, 20 bp, synthetic construct
  misc_feature 1..20: note = CRISPR gRNA sequence
  source 1..20: mol_type = other DNA
ctgcctcggcctcccaaagt

SEQ ID NO: 74300 - DNA, 20 bp, synthetic construct
  misc_feature 1..20: note = CRISPR gRNA sequence
  source 1..20: mol_type = other DNA
cctcggcctcccaaagtgct

SEQ ID NO: 74301 - DNA, 20 bp, synthetic construct
  misc_feature 1..20: note = CRISPR gRNA sequence
  source 1..20: mol_type = other DNA
ggcctcccaaagtgctgggg

SEQ ID NO: 74302 - DNA, 20 bp, synthetic construct
  misc_feature 1..20: note = CRISPR gRNA sequence
  source 1..20: mol_type = other DNA
ccaaagtgctggggttacag

SEQ ID NO: 74303 - DNA, 20 bp, synthetic construct
  misc_feature 1..20: note = CRISPR gRNA sequence
  source 1..20: mol_type = other DNA
gggttacaggcgtgagccac

SEQ ID NO: 74304 - DNA, 20 bp, synthetic construct
  misc_feature 1..20: note = CRISPR gRNA sequence
  source 1..20: mol_type = other DNA
caggcgtgagccaccgcgcc

SEQ ID NO: 74305 - DNA, 20 bp, synthetic construct
  misc_feature 1..20: note = CRISPR gRNA sequence
  source 1..20: mol_type = other DNA
gcccttttcaacaatttaaa

SEQ ID NO: 74306 - DNA, 20 bp, synthetic construct
  misc_feature 1..20: note = CRISPR gRNA sequence
  source 1..20: mol_type = other DNA
ttcaacaatttaaagttaat

SEQ ID NO: 74307 - DNA, 20 bp, synthetic construct
  misc_feature 1..20: note = CRISPR gRNA sequence
  source 1..20: mol_type = other DNA
tcaacaatttaaagttaata

SEQ ID NO: 74308 - DNA, 20 bp, synthetic construct
  misc_feature 1..20: note = CRISPR gRNA sequence
  source 1..20: mol_type = other DNA
caacaatttaaagttaataa

SEQ ID NO: 74309 - DNA, 20 bp, synthetic construct
  misc_feature 1..20: note = CRISPR gRNA sequence
  source 1..20: mol_type = other DNA
aacaatttaaagttaataag

SEQ ID NO: 74310 - DNA, 20 bp, synthetic construct
  misc_feature 1..20: note = CRISPR gRNA sequence
  source 1..20: mol_type = other DNA
aaagttaataagttgataag

SEQ ID NO: 74311 - DNA, 20 bp, synthetic construct
  misc_feature 1..20: note = CRISPR gRNA sequence
  source 1..20: mol_type = other DNA
aagttaataagttgataagc

SEQ ID NO: 74312 - DNA, 20 bp, synthetic construct
  misc_feature 1..20: note = CRISPR gRNA sequence
  source 1..20: mol_type = other DNA
ataagttgataagccttttc

SEQ ID NO: 74313 - DNA, 20 bp, synthetic construct
  misc_feature 1..20: note = CRISPR gRNA sequence
  source 1..20: mol_type = other DNA
ataagccttttcagaccatg

SEQ ID NO: 74314 - DNA, 20 bp, synthetic construct
  misc_feature 1..20: note = CRISPR gRNA sequence
  source 1..20: mol_type = other DNA
ttcagaccatgacagaaagc

SEQ ID NO: 74315 - DNA, 20 bp, synthetic construct
  misc_feature 1..20: note = CRISPR gRNA sequence
  source 1..20: mol_type = other DNA
tcagaccatgacagaaagcc

SEQ ID NO: 74316 - DNA, 20 bp, synthetic construct
  misc_feature 1..20: note = CRISPR gRNA sequence
  source 1..20: mol_type = other DNA
cagaccatgacagaaagcca

SEQ ID NO: 74317 - DNA, 20 bp, synthetic construct
  misc_feature 1..20: note = CRISPR gRNA sequence
  source 1..20: mol_type = other DNA
agaccatgacagaaagccat

SEQ ID NO: 74318 - DNA, 20 bp, synthetic construct
  misc_feature 1..20: note = CRISPR gRNA sequence
  source 1..20: mol_type = other DNA
gagggatccaagggcagttc

SEQ ID NO: 74319 - DNA, 20 bp, synthetic construct
  misc_feature 1..20: note = CRISPR gRNA sequence
  source 1..20: mol_type = other DNA
cagaattttctgagggaggg

SEQ ID NO: 74320 - DNA, 20 bp, synthetic construct
  misc_feature 1..20: note = CRISPR gRNA sequence
  source 1..20: mol_type = other DNA
tctgagggaggggcacaagg

SEQ ID NO: 74321 - DNA, 20 bp, synthetic construct
  misc_feature 1..20: note = CRISPR gRNA sequence
  source 1..20: mol_type = other DNA
ctgagggaggggcacaagga

SEQ ID NO: 74322 - DNA, 20 bp, synthetic construct
  misc_feature 1..20: note = CRISPR gRNA sequence
  source 1..20: mol_type = other DNA
tgagggaggggcacaaggac

SEQ ID NO: 74323 - DNA, 20 bp, synthetic construct
  misc_feature 1..20: note = CRISPR gRNA sequence
  source 1..20: mol_type = other DNA
agggaggggcacaaggacca

SEQ ID NO: 74324 - DNA, 20 bp, synthetic construct
  misc_feature 1..20: note = CRISPR gRNA sequence
  source 1..20: mol_type = other DNA
gagtctgcatttgcgctcta

SEQ ID NO: 74325 - DNA, 20 bp, synthetic construct
  misc_feature 1..20: note = CRISPR gRNA sequence
  source 1..20: mol_type = other DNA
catttgcgctctaagctcac

SEQ ID NO: 74326 - DNA, 20 bp, synthetic construct
  misc_feature 1..20: note = CRISPR gRNA sequence
  source 1..20: mol_type = other DNA
gcgctctaagctcactgcct

SEQ ID NO: 74327 - DNA, 20 bp, synthetic construct
  misc_feature 1..20: note = CRISPR gRNA sequence
  source 1..20: mol_type = other DNA
cgctctaagctcactgcctt

SEQ ID NO: 74328 - DNA, 20 bp, synthetic construct
  misc_feature 1..20: note = CRISPR gRNA sequence
  source 1..20: mol_type = other DNA
taagctcactgccttcactt

SEQ ID NO: 74329 - DNA, 20 bp, synthetic construct
  misc_feature 1..20: note = CRISPR gRNA sequence
  source 1..20: mol_type = other DNA
agctcactgccttcacttga

SEQ ID NO: 74330 - DNA, 20 bp, synthetic construct
  misc_feature 1..20: note = CRISPR gRNA sequence
  source 1..20: mol_type = other DNA
actgccttcacttgaatgtt

SEQ ID NO: 74331 - DNA, 20 bp, synthetic construct
  misc_feature 1..20: note = CRISPR gRNA sequence
  source 1..20: mol_type = other DNA
ccttcacttgaatgttatgt

SEQ ID NO: 74332 - DNA, 20 bp, synthetic construct
  misc_feature 1..20: note = CRISPR gRNA sequence
  source 1..20: mol_type = other DNA
cacttgaatgttatgttcat

SEQ ID NO: 74333 - DNA, 20 bp, synthetic construct
  misc_feature 1..20: note = CRISPR gRNA sequence
  source 1..20: mol_type = other DNA
acttgaatgttatgttcatg

SEQ ID NO: 74334 - DNA, 20 bp, synthetic construct
  misc_feature 1..20: note = CRISPR gRNA sequence
  source 1..20: mol_type = other DNA
gaatgttatgttcatggggt

SEQ ID NO: 74335 - DNA, 20 bp, synthetic construct
  misc_feature 1..20: note = CRISPR gRNA sequence
  source 1..20: mol_type = other DNA
aatgttatgttcatggggtg

SEQ ID NO: 74336 - DNA, 20 bp, synthetic construct
  misc_feature 1..20: note = CRISPR gRNA sequence
  source 1..20: mol_type = other DNA
tgttcatggggtgcttatgg

SEQ ID NO: 74337 - DNA, 20 bp, synthetic construct
  misc_feature 1..20: note = CRISPR gRNA sequence
  source 1..20: mol_type = other DNA
atggggtgcttatggggaga

SEQ ID NO: 74338 - DNA, 20 bp, synthetic construct
  misc_feature 1..20: note = CRISPR gRNA sequence
  source 1..20: mol_type = other DNA
atggggagagggctatggga

SEQ ID NO: 74339 - DNA, 20 bp, synthetic construct
  misc_feature 1..20: note = CRISPR gRNA sequence
  source 1..20: mol_type = other DNA
tggggagagggctatgggag

SEQ ID NO: 74340 - DNA, 20 bp, synthetic construct
  misc_feature 1..20: note = CRISPR gRNA sequence
  source 1..20: mol_type = other DNA
tgggagattataaagtcccc

SEQ ID NO: 74341 - DNA, 20 bp, synthetic construct
  misc_feature 1..20: note = CRISPR gRNA sequence
  source 1..20: mol_type = other DNA
taaagtccccagagcatccc

SEQ ID NO: 74342 - DNA, 20 bp, synthetic construct
  misc_feature 1..20: note = CRISPR gRNA sequence
  source 1..20: mol_type = other DNA
gctcactcctggaggagaga

SEQ ID NO: 74343 - DNA, 20 bp, synthetic construct
  misc_feature 1..20: note = CRISPR gRNA sequence
  source 1..20: mol_type = other DNA
ctcactcctggaggagagaa

SEQ ID NO: 74344 - DNA, 20 bp, synthetic construct
  misc_feature 1..20: note = CRISPR gRNA sequence
  source 1..20: mol_type = other DNA
actcctggaggagagaagga

SEQ ID NO: 74345 - DNA, 20 bp, synthetic construct
  misc_feature 1..20: note = CRISPR gRNA sequence
  source 1..20: mol_type = other DNA
ctggaggagagaaggaagaa

SEQ ID NO: 74346 - DNA, 20 bp, synthetic construct
  misc_feature 1..20: note = CRISPR gRNA sequence
  source 1..20: mol_type = other DNA
gaggagagaaggaagaagca

SEQ ID NO: 74347 - DNA, 20 bp, synthetic construct
  misc_feature 1..20: note = CRISPR gRNA sequence
  source 1..20: mol_type = other DNA
tgtggctggtgacagtacag

SEQ ID NO: 74348 - DNA, 20 bp, synthetic construct
  misc_feature 1..20: note = CRISPR gRNA sequence
  source 1..20: mol_type = other DNA
gtgacagtacagcagacatc

SEQ ID NO: 74349 - DNA, 20 bp, synthetic construct
  misc_feature 1..20: note = CRISPR gRNA sequence
  source 1..20: mol_type = other DNA
tacaggctccagttcttgta

SEQ ID NO: 74350 - DNA, 20 bp, synthetic construct
  misc_feature 1..20: note = CRISPR gRNA sequence
  source 1..20: mol_type = other DNA
acaggctccagttcttgtaa

SEQ ID NO: 74351 - DNA, 20 bp, synthetic construct
  misc_feature 1..20: note = CRISPR gRNA sequence
  source 1..20: mol_type = other DNA
caggctccagttcttgtaat

SEQ ID NO: 74352 - DNA, 20 bp, synthetic construct
  misc_feature 1..20: note = CRISPR gRNA sequence
  source 1..20: mol_type = other DNA
cagttcttgtaatcctccca

SEQ ID NO: 74353 - DNA, 20 bp, synthetic construct
  misc_feature 1..20: note = CRISPR gRNA sequence
  source 1..20: mol_type = other DNA
ttgtaatcctcccagccctg

SEQ ID NO: 74354 - DNA, 20 bp, synthetic construct
  misc_feature 1..20: note = CRISPR gRNA sequence
  source 1..20: mol_type = other DNA
gtaatcctcccagccctgca

SEQ ID NO: 74355 - DNA, 20 bp, synthetic construct
  misc_feature 1..20: note = CRISPR gRNA sequence
  source 1..20: mol_type = other DNA
taatcctcccagccctgcaa

SEQ ID NO: 74356 - DNA, 20 bp, synthetic construct
  misc_feature 1..20: note = CRISPR gRNA sequence
  source 1..20: mol_type = other DNA
ccagccctgcaaagggccgt

SEQ ID NO: 74357 - DNA, 20 bp, synthetic construct
  misc_feature 1..20: note = CRISPR gRNA sequence
  source 1..20: mol_type = other DNA
caaagggccgtaattagact

SEQ ID NO: 74358 - DNA, 20 bp, synthetic construct
  misc_feature 1..20: note = CRISPR gRNA sequence
  source 1..20: mol_type = other DNA
gactcttttaagagcaggag

SEQ ID NO: 74359 - DNA, 20 bp, synthetic construct
  misc_feature 1..20: note = CRISPR gRNA sequence
  source 1..20: mol_type = other DNA
ttttaagagcaggaggttga

SEQ ID NO: 74360 - DNA, 20 bp, synthetic construct
  misc_feature 1..20: note = CRISPR gRNA sequence
  source 1..20: mol_type = other DNA
ttaagagcaggaggttgagg

SEQ ID NO: 74361 - DNA, 20 bp, synthetic construct
  misc_feature 1..20: note = CRISPR gRNA sequence
  source 1..20: mol_type = other DNA
taagagcaggaggttgaggt

SEQ ID NO: 74362 - DNA, 20 bp, synthetic construct
  misc_feature 1..20: note = CRISPR gRNA sequence
  source 1..20: mol_type = other DNA
aagagcaggaggttgaggtc

SEQ ID NO: 74363 - DNA, 20 bp, synthetic construct
  misc_feature 1..20: note = CRISPR gRNA sequence
  source 1..20: mol_type = other DNA
agagcaggaggttgaggtca

SEQ ID NO: 74364 - DNA, 20 bp, synthetic construct
  misc_feature 1..20: note = CRISPR gRNA sequence
  source 1..20: mol_type = other DNA
aggtcagagagacacagtaa

SEQ ID NO: 74365 - DNA, 20 bp, synthetic construct
  misc_feature 1..20: note = CRISPR gRNA sequence
  source 1..20: mol_type = other DNA
caaccagtaagtgactgagt

SEQ ID NO: 74366 - DNA, 20 bp, synthetic construct
  misc_feature 1..20: note = CRISPR gRNA sequence
  source 1..20: mol_type = other DNA
agttgggatctgaacatagc

SEQ ID NO: 74367 - DNA, 20 bp, synthetic construct
  misc_feature 1..20: note = CRISPR gRNA sequence
  source 1..20: mol_type = other DNA
ggatctgaacatagctgagt

SEQ ID NO: 74368 - DNA, 20 bp, synthetic construct
  misc_feature 1..20: note = CRISPR gRNA sequence
  source 1..20: mol_type = other DNA
aacatagctgagtgggatgc

SEQ ID NO: 74369 - DNA, 20 bp, synthetic construct
  misc_feature 1..20: note = CRISPR gRNA sequence
  source 1..20: mol_type = other DNA
agtgggatgctaaaaccttt

SEQ ID NO: 74370 - DNA, 20 bp, synthetic construct
  misc_feature 1..20: note = CRISPR gRNA sequence
  source 1..20: mol_type = other DNA
aaacctttgctataagctac

SEQ ID NO: 74371 - DNA, 20 bp, synthetic construct
  misc_feature 1..20: note = CRISPR gRNA sequence
  source 1..20: mol_type = other DNA
tgctataagctactctgtgt

SEQ ID NO: 74372 - DNA, 20 bp, synthetic construct
  misc_feature 1..20: note = CRISPR gRNA sequence
  source 1..20: mol_type = other DNA
gctataagctactctgtgtg

SEQ ID NO: 74373 - DNA, 20 bp, synthetic construct
  misc_feature 1..20: note = CRISPR gRNA sequence
  source 1..20: mol_type = other DNA
ctataagctactctgtgtgt

SEQ ID NO: 74374 - DNA, 20 bp, synthetic construct
  misc_feature 1..20: note = CRISPR gRNA sequence
  source 1..20: mol_type = other DNA
taagctactctgtgtgtcat

SEQ ID NO: 74375 - DNA, 20 bp, synthetic construct
  misc_feature 1..20: note = CRISPR gRNA sequence
  source 1..20: mol_type = other DNA
ctctgtgtgtcattgtgtta

SEQ ID NO: 74376 - DNA, 20 bp, synthetic construct
  misc_feature 1..20: note = CRISPR gRNA sequence
  source 1..20: mol_type = other DNA
tgtgtgtcattgtgttattt

SEQ ID NO: 74377 - DNA, 20 bp, synthetic construct
  misc_feature 1..20: note = CRISPR gRNA sequence
  source 1..20: mol_type = other DNA
tgtgtcattgtgttatttct

SEQ ID NO: 74378 - DNA, 20 bp, synthetic construct
  misc_feature 1..20: note = CRISPR gRNA sequence
  source 1..20: mol_type = other DNA
tgttatttctggttgaagag

SEQ ID NO: 74379 - DNA, 20 bp, synthetic construct
  misc_feature 1..20: note = CRISPR gRNA sequence
  source 1..20: mol_type = other DNA
tttctggttgaagagccata

SEQ ID NO: 74380 - DNA, 20 bp, synthetic construct
  misc_feature 1..20: note = CRISPR gRNA sequence
  source 1..20: mol_type = other DNA
ctggttgaagagccataatg

SEQ ID NO: 74381 - DNA, 20 bp, synthetic construct
  misc_feature 1..20: note = CRISPR gRNA sequence
  source 1..20: mol_type = other DNA
tggttgaagagccataatgt

SEQ ID NO: 74382 - DNA, 20 bp, synthetic construct
  misc_feature 1..20: note = CRISPR gRNA sequence
  source 1..20: mol_type = other DNA
gttgaagagccataatgtgt

SEQ ID NO: 74383 - DNA, 20 bp, synthetic construct
  misc_feature 1..20: note = CRISPR gRNA sequence
  source 1..20: mol_type = other DNA
aagagccataatgtgtgtta

SEQ ID NO: 74384 - DNA, 20 bp, synthetic construct
  misc_feature 1..20: note = CRISPR gRNA sequence
  source 1..20: mol_type = other DNA
ctgcatctggggggccactt

SEQ ID NO: 74385 - DNA, 20 bp, synthetic construct
  misc_feature 1..20: note = CRISPR gRNA sequence
  source 1..20: mol_type = other DNA
catctggggggccacttcca

SEQ ID NO: 74386 - DNA, 20 bp, synthetic construct
  misc_feature 1..20: note = CRISPR gRNA sequence
  source 1..20: mol_type = other DNA
gggggccacttccaagcaac

SEQ ID NO: 74387 - DNA, 20 bp, synthetic construct
  misc_feature 1..20: note = CRISPR gRNA sequence
  source 1..20: mol_type = other DNA
ccaagcaaccagcgtggact

SEQ ID NO: 74388 - DNA, 20 bp, synthetic construct
  misc_feature 1..20: note = CRISPR gRNA sequence
  source 1..20: mol_type = other DNA
caagcaaccagcgtggactc

SEQ ID NO: 74389 - DNA, 20 bp, synthetic construct
  misc_feature 1..20: note = CRISPR gRNA sequence
  source 1..20: mol_type = other DNA
ccagccatgtctgcctggat

SEQ ID NO: 74390 - DNA, 20 bp, synthetic construct
  misc_feature 1..20: note = CRISPR gRNA sequence
  source 1..20: mol_type = other DNA
cctggatccaatagcccttt

SEQ ID NO: 74391 - DNA, 20 bp, synthetic construct
  misc_feature 1..20: note = CRISPR gRNA sequence
  source 1..20: mol_type = other DNA
gatccaatagccctttgttt

SEQ ID NO: 74392 - DNA, 20 bp, synthetic construct
  misc_feature 1..20: note = CRISPR gRNA sequence
  source 1..20: mol_type = other DNA
tgttttgattctggggatgt

SEQ ID NO: 74393 - DNA, 20 bp, synthetic construct
  misc_feature 1..20: note = CRISPR gRNA sequence
  source 1..20: mol_type = other DNA
gttttgattctggggatgtc

SEQ ID NO: 74394 - DNA, 20 bp, synthetic construct
  misc_feature 1..20: note = CRISPR gRNA sequence
  source 1..20: mol_type = other DNA
ttttgattctggggatgtct

SEQ ID NO: 74395 - DNA, 20 bp, synthetic construct
  misc_feature 1..20: note = CRISPR gRNA sequence
  source 1..20: mol_type = other DNA
tgattctggggatgtcttcc

SEQ ID NO: 74396 - DNA, 20 bp, synthetic construct
  misc_feature 1..20: note = CRISPR gRNA sequence
  source 1..20: mol_type = other DNA
gattctggggatgtcttcct

SEQ ID NO: 74397 - DNA, 20 bp, synthetic construct
  misc_feature 1..20: note = CRISPR gRNA sequence
  source 1..20: mol_type = other DNA
attctggggatgtcttcctc

SEQ ID NO: 74398 - DNA, 20 bp, synthetic construct
  misc_feature 1..20: note = CRISPR gRNA sequence
  source 1..20: mol_type = other DNA
tggggatgtcttcctctgac

SEQ ID NO: 74399 - DNA, 20 bp, synthetic construct
  misc_feature 1..20: note = CRISPR gRNA sequence
  source 1..20: mol_type = other DNA
gggatgtcttcctctgacac

SEQ ID NO: 74400 - DNA, 20 bp, synthetic construct
  misc_feature 1..20: note = CRISPR gRNA sequence
  source 1..20: mol_type = other DNA
cctctgacactgtggcttga

SEQ ID NO: 74401 - DNA, 20 bp, synthetic construct
  misc_feature 1..20: note = CRISPR gRNA sequence
  source 1..20: mol_type = other DNA
ctctgacactgtggcttgac

SEQ ID NO: 74402 - DNA, 20 bp, synthetic construct
  misc_feature 1..20: note = CRISPR gRNA sequence
  source 1..20: mol_type = other DNA
tgacactgtggcttgactac

SEQ ID NO: 74403 - DNA, 20 bp, synthetic construct
  misc_feature 1..20: note = CRISPR gRNA sequence
  source 1..20: mol_type = other DNA
acactgtggcttgactactg

SEQ ID NO: 74404 - DNA, 20 bp, synthetic construct
  misc_feature 1..20: note = CRISPR gRNA sequence
  source 1..20: mol_type = other DNA
tggcttgactactgcactag

SEQ ID NO: 74405 - DNA, 20 bp, synthetic construct
  misc_feature 1..20: note = CRISPR gRNA sequence
  source 1..20: mol_type = other DNA
gactactgcactagtcccaa

SEQ ID NO: 74406 - DNA, 20 bp, synthetic construct
  misc_feature 1..20: note = CRISPR gRNA sequence
  source 1..20: mol_type = other DNA
actactgcactagtcccaac

SEQ ID NO: 74407 - DNA, 20 bp, synthetic construct
  misc_feature 1..20: note = CRISPR gRNA sequence
  source 1..20: mol_type = other DNA
ctgcactagtcccaacaaat

SEQ ID NO: 74408 - DNA, 20 bp, synthetic construct
  misc_feature 1..20: note = CRISPR gRNA sequence
  source 1..20: mol_type = other DNA
cactagtcccaacaaatgtg

SEQ ID NO: 74409 - DNA, 20 bp, synthetic construct
  misc_feature 1..20: note = CRISPR gRNA sequence
  source 1..20: mol_type = other DNA
gtcccaacaaatgtgtagcc

SEQ ID NO: 74410 - DNA, 20 bp, synthetic construct
  misc_feature 1..20: note = CRISPR gRNA sequence
  source 1..20: mol_type = other DNA
acatatgccccaggagctcc

SEQ ID NO: 74411 - DNA, 20 bp, synthetic construct
  misc_feature 1..20: note = CRISPR gRNA sequence
  source 1..20: mol_type = other DNA
ctgctaccctggggacatgg

SEQ ID NO: 74412 - DNA, 20 bp, synthetic construct
  misc_feature 1..20: note = CRISPR gRNA sequence
  source 1..20: mol_type = other DNA
ctaccctggggacatggaaa

SEQ ID NO: 74413 - DNA, 20 bp, synthetic construct
  misc_feature 1..20: note = CRISPR gRNA sequence
  source 1..20: mol_type = other DNA
ccctggggacatggaaaact

SEQ ID NO: 74414 - DNA, 20 bp, synthetic construct
  misc_feature 1..20: note = CRISPR gRNA sequence
  source 1..20: mol_type = other DNA
gggacatggaaaactagctg

SEQ ID NO: 74415 - DNA, 20 bp, synthetic construct
  misc_feature 1..20: note = CRISPR gRNA sequence
  source 1..20: mol_type = other DNA
gctggtgacacagctattac

SEQ ID NO: 74416 - DNA, 20 bp, synthetic construct
  misc_feature 1..20: note = CRISPR gRNA sequence
  source 1..20: mol_type = other DNA
gtgacacagctattacccca

SEQ ID NO: 74417 - DNA, 20 bp, synthetic construct
  misc_feature 1..20: note = CRISPR gRNA sequence
  source 1..20: mol_type = other DNA
ttaccccacaggatgaggga

SEQ ID NO: 74418 - DNA, 20 bp, synthetic construct
  misc_feature 1..20: note = CRISPR gRNA sequence
  source 1..20: mol_type = other DNA
ccccacaggatgagggaagg

SEQ ID NO: 74419 - DNA, 20 bp, synthetic construct
  misc_feature 1..20: note = CRISPR gRNA sequence
  source 1..20: mol_type = other DNA
atgaaagatgaagaattcca

SEQ ID NO: 74420 - DNA, 20 bp, synthetic construct
  misc_feature 1..20: note = CRISPR gRNA sequence
  source 1..20: mol_type = other DNA
tgaaagatgaagaattccaa

SEQ ID NO: 74421 - DNA, 20 bp, synthetic construct
  misc_feature 1..20: note = CRISPR gRNA sequence
  source 1..20: mol_type = other DNA
caaaggggcctcttctctgg

SEQ ID NO: 74422 - DNA, 20 bp, synthetic construct
  misc_feature 1..20: note = CRISPR gRNA sequence
  source 1..20: mol_type = other DNA
ttctctggactcacctgatt

SEQ ID NO: 74423 - DNA, 20 bp, synthetic construct
  misc_feature 1..20: note = CRISPR gRNA sequence
  source 1..20: mol_type = other DNA
ctctggactcacctgatttc

SEQ ID NO: 74424 - DNA, 20 bp, synthetic construct
  misc_feature 1..20: note = CRISPR gRNA sequence
  source 1..20: mol_type = other DNA
tctggactcacctgatttca

SEQ ID NO: 74425 - DNA, 20 bp, synthetic construct
  misc_feature 1..20: note = CRISPR gRNA sequence
  source 1..20: mol_type = other DNA
tggactcacctgatttcagt

SEQ ID NO: 74426 - DNA, 20 bp, synthetic construct
  misc_feature 1..20: note = CRISPR gRNA sequence
  source 1..20: mol_type = other DNA
gactcacctgatttcagtga

SEQ ID NO: 74427 - DNA, 20 bp, synthetic construct
  misc_feature 1..20: note = CRISPR gRNA sequence
  source 1..20: mol_type = other DNA
acctgatttcagtgacactg

SEQ ID NO: 74428 - DNA, 20 bp, synthetic construct
  misc_feature 1..20: note = CRISPR gRNA sequence
  source 1..20: mol_type = other DNA
atttcagtgacactgcctga

SEQ ID NO: 74429 - DNA, 20 bp, synthetic construct
  misc_feature 1..20: note = CRISPR gRNA sequence
  source 1..20: mol_type = other DNA
cagtgacactgcctgaggcc

SEQ ID NO: 74430 - DNA, 20 bp, synthetic construct
  misc_feature 1..20: note = CRISPR gRNA sequence
  source 1..20: mol_type = other DNA
agtgacactgcctgaggcct

SEQ ID NO: 74431 - DNA, 20 bp, synthetic construct
  misc_feature 1..20: note = CRISPR gRNA sequence
  source 1..20: mol_type = other DNA
cctgaggcctgggcgcagac

SEQ ID NO: 74432 - DNA, 20 bp, synthetic construct
  misc_feature 1..20: note = CRISPR gRNA sequence
  source 1..20: mol_type = other DNA
aggcctgggcgcagacttct

SEQ ID NO: 74433 - DNA, 20 bp, synthetic construct
  misc_feature 1..20: note = CRISPR gRNA sequence
  source 1..20: mol_type = other DNA
ggcgcagacttctaacaggg

SEQ ID NO: 74434 - DNA, 20 bp, synthetic construct
  misc_feature 1..20: note = CRISPR gRNA sequence
  source 1..20: mol_type = other DNA
ctaacagggagagaaccctg

SEQ ID NO: 74435 - DNA, 20 bp, synthetic construct
  misc_feature 1..20: note = CRISPR gRNA sequence
  source 1..20: mol_type = other DNA
taacagggagagaaccctgg

SEQ ID NO: 74436 - DNA, 20 bp, synthetic construct
  misc_feature 1..20: note = CRISPR gRNA sequence
  source 1..20: mol_type = other DNA
acagggagagaaccctggct

SEQ ID NO: 74437 - DNA, 20 bp, synthetic construct
  misc_feature 1..20: note = CRISPR gRNA sequence
  source 1..20: mol_type = other DNA
gctctgtccgcccacggctc

SEQ ID NO: 74438 - DNA, 20 bp, synthetic construct
  misc_feature 1..20: note = CRISPR gRNA sequence
  source 1..20: mol_type = other DNA
tgtccgcccacggctcctgc

SEQ ID NO: 74439 - DNA, 20 bp, synthetic construct
  misc_feature 1..20: note = CRISPR gRNA sequence
  source 1..20: mol_type = other DNA
tccgcccacggctcctgcac

SEQ ID NO: 74440 - DNA, 20 bp, synthetic construct
  misc_feature 1..20: note = CRISPR gRNA sequence
  source 1..20: mol_type = other DNA
ctgcaccctgtcacagaagg

SEQ ID NO: 74441 - DNA, 20 bp, synthetic construct
  misc_feature 1..20: note = CRISPR gRNA sequence
  source 1..20: mol_type = other DNA
caccctgtcacagaagggga

SEQ ID NO: 74442 - DNA, 20 bp, synthetic construct
  misc_feature 1..20: note = CRISPR gRNA sequence
  source 1..20: mol_type = other DNA
tcacagaaggggacacagat

SEQ ID NO: 74443 - DNA, 20 bp, synthetic construct
  misc_feature 1..20: note = CRISPR gRNA sequence
  source 1..20: mol_type = other DNA
gaggctttttgagttttttt

SEQ ID NO: 74444 - DNA, 20 bp, synthetic construct
  misc_feature 1..20: note = CRISPR gRNA sequence
  source 1..20: mol_type = other DNA
tttgagttttttttgctcat

SEQ ID NO: 74445 - DNA, 20 bp, synthetic construct
  misc_feature 1..20: note = CRISPR gRNA sequence
  source 1..20: mol_type = other DNA
ttgagttttttttgctcatt

SEQ ID NO: 74446 - DNA, 20 bp, synthetic construct
  misc_feature 1..20: note = CRISPR gRNA sequence
  source 1..20: mol_type = other DNA
tgagttttttttgctcattt

SEQ ID NO: 74447 - DNA, 20 bp, synthetic construct
  misc_feature 1..20: note = CRISPR gRNA sequence
  source 1..20: mol_type = other DNA
gagttttttttgctcatttt

SEQ ID NO: 74448 - DNA, 20 bp, synthetic construct
  misc_feature 1..20: note = CRISPR gRNA sequence
  source 1..20: mol_type = other DNA
agttttttttgctcatttta

SEQ ID NO: 74449 - DNA, 20 bp, synthetic construct
  misc_feature 1..20: note = CRISPR gRNA sequence
  source 1..20: mol_type = other DNA
tttttgctcattttaaaact

SEQ ID NO: 74450 - DNA, 20 bp, synthetic construct
  misc_feature 1..20: note = CRISPR gRNA sequence
  source 1..20: mol_type = other DNA
ttttgctcattttaaaacta

SEQ ID NO: 74451 - DNA, 20 bp, synthetic construct
  misc_feature 1..20: note = CRISPR gRNA sequence
  source 1..20: mol_type = other DNA
tttgctcattttaaaactat

SEQ ID NO: 74452 - DNA, 20 bp, synthetic construct
  misc_feature 1..20: note = CRISPR gRNA sequence
  source 1..20: mol_type = other DNA
ttgctcattttaaaactata

SEQ ID NO: 74453 - DNA, 20 bp, synthetic construct
  misc_feature 1..20: note = CRISPR gRNA sequence
  source 1..20: mol_type = other DNA
tgctcattttaaaactataa

SEQ ID NO: 74454 - DNA, 20 bp, synthetic construct
  misc_feature 1..20: note = CRISPR gRNA sequence
  source 1..20: mol_type = other DNA
gctcattttaaaactataaa

SEQ ID NO: 74455 - DNA, 20 bp, synthetic construct
  misc_feature 1..20: note = CRISPR gRNA sequence
  source 1..20: mol_type = other DNA
ctcattttaaaactataaaa

SEQ ID NO: 74456 - DNA, 20 bp, synthetic construct
  misc_feature 1..20: note = CRISPR gRNA sequence
  source 1..20: mol_type = other DNA
attttaaaactataaaatta

SEQ ID NO: 74457 - DNA, 20 bp, synthetic construct
  misc_feature 1..20: note = CRISPR gRNA sequence
  source 1..20: mol_type = other DNA
taaaactataaaattataca

SEQ ID NO: 74458 - DNA, 20 bp, synthetic construct
  misc_feature 1..20: note = CRISPR gRNA sequence
  source 1..20: mol_type = other DNA
aaaactataaaattatacaa

SEQ ID NO: 74459 - DNA, 20 bp, synthetic construct
  misc_feature 1..20: note = CRISPR gRNA sequence
  source 1..20: mol_type = other DNA
aaactataaaattatacaag

SEQ ID NO: 74460 - DNA, 20 bp, synthetic construct
  misc_feature 1..20: note = CRISPR gRNA sequence
  source 1..20: mol_type = other DNA
taaaattatacaagtaggca

SEQ ID NO: 74461 - DNA, 20 bp, synthetic construct
  misc_feature 1..20: note = CRISPR gRNA sequence
  source 1..20: mol_type = other DNA
tacaagtaggcatcaatcta

SEQ ID NO: 74462 - DNA, 20 bp, synthetic construct
  misc_feature 1..20: note = CRISPR gRNA sequence
  source 1..20: mol_type = other DNA
aaaaaggaaattaacatcac

SEQ ID NO: 74463 - DNA, 20 bp, synthetic construct
  misc_feature 1..20: note = CRISPR gRNA sequence
  source 1..20: mol_type = other DNA
acatcacccttattccaaca

SEQ ID NO: 74464 - DNA, 20 bp, synthetic construct
  misc_feature 1..20: note = CRISPR gRNA sequence
  source 1..20: mol_type = other DNA
attccaacaactattgttgt

SEQ ID NO: 74465 - DNA, 20 bp, synthetic construct
  misc_feature 1..20: note = CRISPR gRNA sequence
  source 1..20: mol_type = other DNA
ttccaacaactattgttgtg

SEQ ID NO: 74466 - DNA, 20 bp, synthetic construct
  misc_feature 1..20: note = CRISPR gRNA sequence
  source 1..20: mol_type = other DNA
caacaactattgttgtgaca

SEQ ID NO: 74467 - DNA, 20 bp, synthetic construct
  misc_feature 1..20: note = CRISPR gRNA sequence
  source 1..20: mol_type = other DNA
ttgttgtgacaatccaaaca

SEQ ID NO: 74468 - DNA, 20 bp, synthetic construct
  misc_feature 1..20: note = CRISPR gRNA sequence
  source 1..20: mol_type = other DNA
ttgtgacaatccaaacagaa

SEQ ID NO: 74469 - DNA, 20 bp, synthetic construct
  misc_feature 1..20: note = CRISPR gRNA sequence
  source 1..20: mol_type = other DNA
tgacaatccaaacagaaaat

SEQ ID NO: 74470 - DNA, 20 bp, synthetic construct
  misc_feature 1..20: note = CRISPR gRNA sequence
  source 1..20: mol_type = other DNA
ttttttaaatgatattttta

SEQ ID NO: 74471 - DNA, 20 bp, synthetic construct
  misc_feature 1..20: note = CRISPR gRNA sequence
  source 1..20: mol_type = other DNA
tttaaatgatatttttatat

SEQ ID NO: 74472 - DNA, 20 bp, synthetic construct
  misc_feature 1..20: note = CRISPR gRNA sequence
  source 1..20: mol_type = other DNA
ttaaatgatatttttatatt

SEQ ID NO: 74473 - DNA, 20 bp, synthetic construct
  misc_feature 1..20: note = CRISPR gRNA sequence
  source 1..20: mol_type = other DNA
taaatgatatttttatattt

SEQ ID NO: 74474 - DNA, 20 bp, synthetic construct
  misc_feature 1..20: note = CRISPR gRNA sequence
  source 1..20: mol_type = other DNA
aaatgatatttttatatttt

SEQ ID NO: 74475 - DNA, 20 bp, synthetic construct
  misc_feature 1..20: note = CRISPR gRNA sequence
  source 1..20: mol_type = other DNA
aatgatatttttatatttta

SEQ ID NO: 74476 - DNA, 20 bp, synthetic construct
  misc_feature 1..20: note = CRISPR gRNA sequence
  source 1..20: mol_type = other DNA
ttatattttatttttttatc

SEQ ID NO: 74477 - DNA, 20 bp, synthetic construct
  misc_feature 1..20: note = CRISPR gRNA sequence
  source 1..20: mol_type = other DNA
tatattttatttttttatct

SEQ ID NO: 74478 - DNA, 20 bp, synthetic construct
  misc_feature 1..20: note = CRISPR gRNA sequence
  source 1..20: mol_type = other DNA
atattttatttttttatctt

SEQ ID NO: 74479 - DNA, 20 bp, synthetic construct
  misc_feature 1..20: note = CRISPR gRNA sequence
  source 1..20: mol_type = other DNA
tattttatttttttatctta

SEQ ID NO: 74480 - DNA, 20 bp, synthetic construct
  misc_feature 1..20: note = CRISPR gRNA sequence
  source 1..20: mol_type = other DNA
tatttttttatcttatctta

SEQ ID NO: 74481 - DNA, 20 bp, synthetic construct
  misc_feature 1..20: note = CRISPR gRNA sequence
  source 1..20: mol_type = other DNA
atttttttatcttatcttat

SEQ ID NO: 74482 - DNA, 20 bp, synthetic construct
  misc_feature 1..20: note = CRISPR gRNA sequence
  source 1..20: mol_type = other DNA
tttttttatcttatcttatt

SEQ ID NO: 74483 - DNA, 20 bp, synthetic construct
  misc_feature 1..20: note = CRISPR gRNA sequence
  source 1..20: mol_type = other DNA
ttttatcttatcttatttta

SEQ ID NO: 74484 - DNA, 20 bp, synthetic construct
  misc_feature 1..20: note = CRISPR gRNA sequence
  source 1..20: mol_type = other DNA
tttatcttatcttattttat

SEQ ID NO: 74485 - DNA, 20 bp, synthetic construct
  misc_feature 1..20: note = CRISPR gRNA sequence
  source 1..20: mol_type = other DNA
ttatcttatcttattttatt

SEQ ID NO: 74486 - DNA, 20 bp, synthetic construct
  misc_feature 1..20: note = CRISPR gRNA sequence
  source 1..20: mol_type = other DNA
tatcttatcttattttattt

SEQ ID NO: 74487 - DNA, 20 bp, synthetic construct
  misc_feature 1..20: note = CRISPR gRNA sequence
  source 1..20: mol_type = other DNA
atcttatcttattttatttt

SEQ ID NO: 74488 - DNA, 20 bp, synthetic construct
  misc_feature 1..20: note = CRISPR gRNA sequence
  source 1..20: mol_type = other DNA
tcttatcttattttattttt

SEQ ID NO: 74489 - DNA, 20 bp, synthetic construct
  misc_feature 1..20: note = CRISPR gRNA sequence
  source 1..20: mol_type = other DNA
atcttattttatttttgaga

SEQ ID NO: 74490 - DNA, 20 bp, synthetic construct
  misc_feature 1..20: note = CRISPR gRNA sequence
  source 1..20: mol_type = other DNA
tcttattttatttttgagac

SEQ ID NO: 74491 - DNA, 20 bp, synthetic construct
  misc_feature 1..20: note = CRISPR gRNA sequence
  source 1..20: mol_type = other DNA
attttatttttgagacagag

SEQ ID NO: 74492 - DNA, 20 bp, synthetic construct
  misc_feature 1..20: note = CRISPR gRNA sequence
  source 1..20: mol_type = other DNA
ttttatttttgagacagagt

SEQ ID NO: 74493 - DNA, 20 bp, synthetic construct
  misc_feature 1..20: note = CRISPR gRNA sequence
  source 1..20: mol_type = other DNA
tatttttgagacagagtttt

SEQ ID NO: 74494 - DNA, 20 bp, synthetic construct
  misc_feature 1..20: note = CRISPR gRNA sequence
  source 1..20: mol_type = other DNA
atttttgagacagagttttg

SEQ ID NO: 74495 - DNA, 20 bp, synthetic construct
  misc_feature 1..20: note = CRISPR gRNA sequence
  source 1..20: mol_type = other DNA
tttttgagacagagttttgc

SEQ ID NO: 74496 - DNA, 20 bp, synthetic construct
  misc_feature 1..20: note = CRISPR gRNA sequence
  source 1..20: mol_type = other DNA
ttgagacagagttttgctct

SEQ ID NO: 74497 - DNA, 20 bp, synthetic construct
  misc_feature 1..20: note = CRISPR gRNA sequence
  source 1..20: mol_type = other DNA
tgagacagagttttgctctt

SEQ ID NO: 74498 - DNA, 20 bp, synthetic construct
  misc_feature 1..20: note = CRISPR gRNA sequence
  source 1..20: mol_type = other DNA
gagacagagttttgctcttg

SEQ ID NO: 74499 - DNA, 20 bp, synthetic construct
  misc_feature 1..20: note = CRISPR gRNA sequence
  source 1..20: mol_type = other DNA
agacagagttttgctcttgt

SEQ ID NO: 74500 - DNA, 20 bp, synthetic construct
  misc_feature 1..20: note = CRISPR gRNA sequence
  source 1..20: mol_type = other DNA
tgctcttgttgcccagactg

SEQ ID NO: 74501 - DNA, 20 bp, synthetic construct
  misc_feature 1..20: note = CRISPR gRNA sequence
  source 1..20: mol_type = other DNA
gctcttgttgcccagactgg

SEQ ID NO: 74502 - DNA, 20 bp, synthetic construct
  misc_feature 1..20: note = CRISPR gRNA sequence
  source 1..20: mol_type = other DNA
ctcttgttgcccagactgga

SEQ ID NO: 74503 - DNA, 20 bp, synthetic construct
  misc_feature 1..20: note = CRISPR gRNA sequence
  source 1..20: mol_type = other DNA
ttgttgcccagactggagtg

SEQ ID NO: 74504 - DNA, 20 bp, synthetic construct
  misc_feature 1..20: note = CRISPR gRNA sequence
  source 1..20: mol_type = other DNA
gttgcccagactggagtgca

SEQ ID NO: 74505 - DNA, 20 bp, synthetic construct
  misc_feature 1..20: note = CRISPR gRNA sequence
  source 1..20: mol_type = other DNA
ttgcccagactggagtgcaa

SEQ ID NO: 74506 - DNA, 20 bp, synthetic construct
  misc_feature 1..20: note = CRISPR gRNA sequence
  source 1..20: mol_type = other DNA
cccagactggagtgcaatgg

SEQ ID NO: 74507 - DNA, 20 bp, synthetic construct
  misc_feature 1..20: note = CRISPR gRNA sequence
  source 1..20: mol_type = other DNA
gagtgcaatggcatgatctc

SEQ ID NO: 74508 - DNA, 20 bp, synthetic construct
  misc_feature 1..20: note = CRISPR gRNA sequence
  source 1..20: mol_type = other DNA
agatcactgcaacctctgcc

SEQ ID NO: 74509 - DNA, 20 bp, synthetic construct
  misc_feature 1..20: note = CRISPR gRNA sequence
  source 1..20: mol_type = other DNA
caacctctgcctcctgggtt

SEQ ID NO: 74510 - DNA, 20 bp, synthetic construct
  misc_feature 1..20: note = CRISPR gRNA sequence
  source 1..20: mol_type = other DNA
tgcctcctgggttcaagcga

SEQ ID NO: 74511 - DNA, 20 bp, synthetic construct
  misc_feature 1..20: note = CRISPR gRNA sequence
  source 1..20: mol_type = other DNA
cctcctgggttcaagcgatt

SEQ ID NO: 74512 - DNA, 20 bp, synthetic construct
  misc_feature 1..20: note = CRISPR gRNA sequence
  source 1..20: mol_type = other DNA
ctgggttcaagcgattctcc

SEQ ID NO: 74513 - DNA, 20 bp, synthetic construct
  misc_feature 1..20: note = CRISPR gRNA sequence
  source 1..20: mol_type = other DNA
ggttcaagcgattctcctgc

SEQ ID NO: 74514 - DNA, 20 bp, synthetic construct
  misc_feature 1..20: note = CRISPR gRNA sequence
  source 1..20: mol_type = other DNA
aagcgattctcctgcctcag

SEQ ID NO: 74515 - DNA, 20 bp, synthetic construct
  misc_feature 1..20: note = CRISPR gRNA sequence
  source 1..20: mol_type = other DNA
tcctgcctcagcctcccaag

SEQ ID NO: 74516 - DNA, 20 bp, synthetic construct
  misc_feature 1..20: note = CRISPR gRNA sequence
  source 1..20: mol_type = other DNA
ctgcctcagcctcccaagta

SEQ ID NO: 74517 - DNA, 20 bp, synthetic construct
  misc_feature 1..20: note = CRISPR gRNA sequence
  source 1..20: mol_type = other DNA
cctcagcctcccaagtagct

SEQ ID NO: 74518 - DNA, 20 bp, synthetic construct
  misc_feature 1..20: note = CRISPR gRNA sequence
  source 1..20: mol_type = other DNA
agcctcccaagtagctggga

SEQ ID NO: 74519 - DNA, 20 bp, synthetic construct
  misc_feature 1..20: note = CRISPR gRNA sequence
  source 1..20: mol_type = other DNA
ccaagtagctgggattacag

SEQ ID NO: 74520 - DNA, 20 bp, synthetic construct
  misc_feature 1..20: note = CRISPR gRNA sequence
  source 1..20: mol_type = other DNA
ggattacaggcatgcgccac

SEQ ID NO: 74521 - DNA, 20 bp, synthetic construct
  misc_feature 1..20: note = CRISPR gRNA sequence
  source 1..20: mol_type = other DNA
caggcatgcgccaccacgcc

SEQ ID NO: 74522 - DNA, 20 bp, synthetic construct
  misc_feature 1..20: note = CRISPR gRNA sequence
  source 1..20: mol_type = other DNA
gctaatttttgtatttttag

SEQ ID NO: 74523 - DNA, 20 bp, synthetic construct
  misc_feature 1..20: note = CRISPR gRNA sequence
  source 1..20: mol_type = other DNA
atttttgtatttttagtaga

SEQ ID NO: 74524 - DNA, 20 bp, synthetic construct
  misc_feature 1..20: note = CRISPR gRNA sequence
  source 1..20: mol_type = other DNA
ttgtatttttagtagagatg

SEQ ID NO: 74525 - DNA, 20 bp, synthetic construct
  misc_feature 1..20: note = CRISPR gRNA sequence
  source 1..20: mol_type = other DNA
tgtatttttagtagagatgg

SEQ ID NO: 74526 - DNA, 20 bp, synthetic construct
  misc_feature 1..20: note = CRISPR gRNA sequence
  source 1..20: mol_type = other DNA
gtatttttagtagagatggg

SEQ ID NO: 74527 - DNA, 20 bp, synthetic construct
  misc_feature 1..20: note = CRISPR gRNA sequence
  source 1..20: mol_type = other DNA
tatttttagtagagatgggg

SEQ ID NO: 74528 - DNA, 20 bp, synthetic construct
  misc_feature 1..20: note = CRISPR gRNA sequence
  source 1..20: mol_type = other DNA
ttagtagagatggggtttca

SEQ ID NO: 74529 - DNA, 20 bp, synthetic construct
  misc_feature 1..20: note = CRISPR gRNA sequence
  source 1..20: mol_type = other DNA
tagtagagatggggtttcac

SEQ ID NO: 74530 - DNA, 20 bp, synthetic construct
  misc_feature 1..20: note = CRISPR gRNA sequence
  source 1..20: mol_type = other DNA
agtagagatggggtttcacc

SEQ ID NO: 74531 - DNA, 20 bp, synthetic construct
  misc_feature 1..20: note = CRISPR gRNA sequence
  source 1..20: mol_type = other DNA
gtagagatggggtttcacca

SEQ ID NO: 74532 - DNA, 20 bp, synthetic construct
  misc_feature 1..20: note = CRISPR gRNA sequence
  source 1..20: mol_type = other DNA
caccatgttggtcaggctgg

SEQ ID NO: 74533 - DNA, 20 bp, synthetic construct
  misc_feature 1..20: note = CRISPR gRNA sequence
  source 1..20: mol_type = other DNA
accatgttggtcaggctggt

SEQ ID NO: 74534 - DNA, 20 bp, synthetic construct
  misc_feature 1..20: note = CRISPR gRNA sequence
  source 1..20: mol_type = other DNA
gtcaggctggtcttgaactc

SEQ ID NO: 74535 - DNA, 20 bp, synthetic construct
  misc_feature 1..20: note = CRISPR gRNA sequence
  source 1..20: mol_type = other DNA
gtcttgaactcctgacctca

SEQ ID NO: 74536 - DNA, 20 bp, synthetic construct
  misc_feature 1..20: note = CRISPR gRNA sequence
  source 1..20: mol_type = other DNA
gaactcctgacctcaagtga

SEQ ID NO: 74537 - DNA, 20 bp, synthetic construct
  misc_feature 1..20: note = CRISPR gRNA sequence
  source 1..20: mol_type = other DNA
aactcctgacctcaagtgat

SEQ ID NO: 74538 - DNA, 20 bp, synthetic construct
  misc_feature 1..20: note = CRISPR gRNA sequence
  source 1..20: mol_type = other DNA
ctgacctcaagtgatccacc

SEQ ID NO: 74539 - DNA, 20 bp, synthetic construct
  misc_feature 1..20: note = CRISPR gRNA sequence
  source 1..20: mol_type = other DNA
acctcaagtgatccacctgc

SEQ ID NO: 74540 - DNA, 20 bp, synthetic construct
  misc_feature 1..20: note = CRISPR gRNA sequence
  source 1..20: mol_type = other DNA
aagtgatccacctgcctcgg

SEQ ID NO: 74541 - DNA, 20 bp, synthetic construct
  misc_feature 1..20: note = CRISPR gRNA sequence
  source 1..20: mol_type = other DNA
cctcggcctcccaaagtgct

SEQ ID NO: 74542 - DNA, 20 bp, synthetic construct
  misc_feature 1..20: note = CRISPR gRNA sequence
  source 1..20: mol_type = other DNA
ggcctcccaaagtgctggga

SEQ ID NO: 74543 - DNA, 20 bp, synthetic construct
  misc_feature 1..20: note = CRISPR gRNA sequence
  source 1..20: mol_type = other DNA
ccaaagtgctgggattacag

SEQ ID NO: 74544 - DNA, 20 bp, synthetic construct
  misc_feature 1..20: note = CRISPR gRNA sequence
  source 1..20: mol_type = other DNA
ggattacaggcgtgagccac

SEQ ID NO: 74545 - DNA, 20 bp, synthetic construct
  misc_feature 1..20: note = CRISPR gRNA sequence
  source 1..20: mol_type = other DNA
caggcgtgagccactgcact

SEQ ID NO: 74546 - DNA, 20 bp, synthetic construct
  misc_feature 1..20: note = CRISPR gRNA sequence
  source 1..20: mol_type = other DNA
cactgggccactgatatttt

SEQ ID NO: 74547 - DNA, 20 bp, synthetic construct
  misc_feature 1..20: note = CRISPR gRNA sequence
  source 1..20: mol_type = other DNA
ggccactgatatttttagat

SEQ ID NO: 74548 - DNA, 20 bp, synthetic construct
  misc_feature 1..20: note = CRISPR gRNA sequence
  source 1..20: mol_type = other DNA
atatttttagatttaagaaa

SEQ ID NO: 74549 - DNA, 20 bp, synthetic construct
  misc_feature 1..20: note = CRISPR gRNA sequence
  source 1..20: mol_type = other DNA
ttagatttaagaaaagattc

SEQ ID NO: 74550 - DNA, 20 bp, synthetic construct
  misc_feature 1..20: note = CRISPR gRNA sequence
  source 1..20: mol_type = other DNA
tagatttaagaaaagattca

SEQ ID NO: 74551 - DNA, 20 bp, synthetic construct
  misc_feature 1..20: note = CRISPR gRNA sequence
  source 1..20: mol_type = other DNA
agatttaagaaaagattcac

SEQ ID NO: 74552 - DNA, 20 bp, synthetic construct
  misc_feature 1..20: note = CRISPR gRNA sequence
  source 1..20: mol_type = other DNA
gatttaagaaaagattcaca

SEQ ID NO: 74553 - DNA, 20 bp, synthetic construct
  misc_feature 1..20: note = CRISPR gRNA sequence
  source 1..20: mol_type = other DNA
aagaaaagattcacataatg

SEQ ID NO: 74554 - DNA, 20 bp, synthetic construct
  misc_feature 1..20: note = CRISPR gRNA sequence
  source 1..20: mol_type = other DNA
agaaaagattcacataatgt

SEQ ID NO: 74555 - DNA, 20 bp, synthetic construct
  misc_feature 1..20: note = CRISPR gRNA sequence
  source 1..20: mol_type = other DNA
acataatgttacatcacaaa

SEQ ID NO: 74556 - DNA, 20 bp, synthetic construct
  misc_feature 1..20: note = CRISPR gRNA sequence
  source 1..20: mol_type = other DNA
catcacaaaggtaaggaaac

SEQ ID NO: 74557 - DNA, 20 bp, synthetic construct
  misc_feature 1..20: note = CRISPR gRNA sequence
  source 1..20: mol_type = other DNA
tatataaaacatgatcccaa

SEQ ID NO: 74558 - DNA, 20 bp, synthetic construct
  misc_feature 1..20: note = CRISPR gRNA sequence
  source 1..20: mol_type = other DNA
tgcatttcaaaaaaaggaaa

SEQ ID NO: 74559 - DNA, 20 bp, synthetic construct
  misc_feature 1..20: note = CRISPR gRNA sequence
  source 1..20: mol_type = other DNA
gcatttcaaaaaaaggaaag

SEQ ID NO: 74560 - DNA, 20 bp, synthetic construct
  misc_feature 1..20: note = CRISPR gRNA sequence
  source 1..20: mol_type = other DNA
catttcaaaaaaaggaaagt

SEQ ID NO: 74561 - DNA, 20 bp, synthetic construct
  misc_feature 1..20: note = CRISPR gRNA sequence
  source 1..20: mol_type = other DNA
caaaaaaaggaaagtatttg

SEQ ID NO: 74562 - DNA, 20 bp, synthetic construct
  misc_feature 1..20: note = CRISPR gRNA sequence
  source 1..20: mol_type = other DNA
aaaaaaaggaaagtatttgg

SEQ ID NO: 74563 - DNA, 20 bp, synthetic construct
  misc_feature 1..20: note = CRISPR gRNA sequence
  source 1..20: mol_type = other DNA
ggagaaaaaaagtgtggaaa

SEQ ID NO: 74564 - DNA, 20 bp, synthetic construct
  misc_feature 1..20: note = CRISPR gRNA sequence
  source 1..20: mol_type = other DNA
gagaaaaaaagtgtggaaag

SEQ ID NO: 74565 - DNA, 20 bp, synthetic construct
  misc_feature 1..20: note = CRISPR gRNA sequence
  source 1..20: mol_type = other DNA
aatgttcatggtggttgttt

SEQ ID NO: 74566 - DNA, 20 bp, synthetic construct
  misc_feature 1..20: note = CRISPR gRNA sequence
  source 1..20: mol_type = other DNA
atggtggttgtttaagatga

SEQ ID NO: 74567 - DNA, 20 bp, synthetic construct
  misc_feature 1..20: note = CRISPR gRNA sequence
  source 1..20: mol_type = other DNA
tttaagatgatagaattctc

SEQ ID NO: 74568 - DNA, 20 bp, synthetic construct
  misc_feature 1..20: note = CRISPR gRNA sequence
  source 1..20: mol_type = other DNA
aagatgatagaattctcatg

SEQ ID NO: 74569 - DNA, 20 bp, synthetic construct
  misc_feature 1..20: note = CRISPR gRNA sequence
  source 1..20: mol_type = other DNA
agatgatagaattctcatga

SEQ ID NO: 74570 - DNA, 20 bp, synthetic construct
  misc_feature 1..20: note = CRISPR gRNA sequence
  source 1..20: mol_type = other DNA
tcatgagtgatttttatttt

SEQ ID NO: 74571 - DNA, 20 bp, synthetic construct
  misc_feature 1..20: note = CRISPR gRNA sequence
  source 1..20: mol_type = other DNA
atgagtgatttttattttat

SEQ ID NO: 74572 - DNA, 20 bp, synthetic construct
  misc_feature 1..20: note = CRISPR gRNA sequence
  source 1..20: mol_type = other DNA
ttattttatgtcttctttaa

SEQ ID NO: 74573 - DNA, 20 bp, synthetic construct
  misc_feature 1..20: note = CRISPR gRNA sequence
  source 1..20: mol_type = other DNA
tattttatgtcttctttaat

SEQ ID NO: 74574 - DNA, 20 bp, synthetic construct
  misc_feature 1..20: note = CRISPR gRNA sequence
  source 1..20: mol_type = other DNA
attttatgtcttctttaatt

SEQ ID NO: 74575 - DNA, 20 bp, synthetic construct
  misc_feature 1..20: note = CRISPR gRNA sequence
  source 1..20: mol_type = other DNA
ttttatgtcttctttaattt

SEQ ID NO: 74576 - DNA, 20 bp, synthetic construct
  misc_feature 1..20: note = CRISPR gRNA sequence
  source 1..20: mol_type = other DNA
tatgtcttctttaattttct

SEQ ID NO: 74577 - DNA, 20 bp, synthetic construct
  misc_feature 1..20: note = CRISPR gRNA sequence
  source 1..20: mol_type = other DNA
atgtcttctttaattttcta

SEQ ID NO: 74578 - DNA, 20 bp, synthetic construct
  misc_feature 1..20: note = CRISPR gRNA sequence
  source 1..20: mol_type = other DNA
tgtcttctttaattttctat

SEQ ID NO: 74579 - DNA, 20 bp, synthetic construct
  misc_feature 1..20: note = CRISPR gRNA sequence
  source 1..20: mol_type = other DNA
ctttaattttctatattttc

SEQ ID NO: 74580 - DNA, 20 bp, synthetic construct
  misc_feature 1..20: note = CRISPR gRNA sequence
  source 1..20: mol_type = other DNA
tttaattttctatattttct

SEQ ID NO: 74581 - DNA, 20 bp, synthetic construct
  misc_feature 1..20: note = CRISPR gRNA sequence
  source 1..20: mol_type = other DNA
taattttctatattttctaa

SEQ ID NO: 74582 - DNA, 20 bp, synthetic construct
  misc_feature 1..20: note = CRISPR gRNA sequence
  source 1..20: mol_type = other DNA
aattttctatattttctaaa

SEQ ID NO: 74583 - DNA, 20 bp, synthetic construct
  misc_feature 1..20: note = CRISPR gRNA sequence
  source 1..20: mol_type = other DNA
attttctatattttctaaac

SEQ ID NO: 74584 - DNA, 20 bp, synthetic construct
  misc_feature 1..20: note = CRISPR gRNA sequence
  source 1..20: mol_type = other DNA
tctatattttctaaactttc

SEQ ID NO: 74585 - DNA, 20 bp, synthetic construct
  misc_feature 1..20: note = CRISPR gRNA sequence
  source 1..20: mol_type = other DNA
ctatattttctaaactttct

SEQ ID NO: 74586 - DNA, 20 bp, synthetic construct
  misc_feature 1..20: note = CRISPR gRNA sequence
  source 1..20: mol_type = other DNA
tatattttctaaactttcta

SEQ ID NO: 74587 - DNA, 20 bp, synthetic construct
  misc_feature 1..20: note = CRISPR gRNA sequence
  source 1..20: mol_type = other DNA
tattttctaaactttctaca

SEQ ID NO: 74588 - DNA, 20 bp, synthetic construct
  misc_feature 1..20: note = CRISPR gRNA sequence
  source 1..20: mol_type = other DNA
tctaaactttctacaatgca

SEQ ID NO: 74589 - DNA, 20 bp, synthetic construct
  misc_feature 1..20: note = CRISPR gRNA sequence
  source 1..20: mol_type = other DNA
ctaaactttctacaatgcat

SEQ ID NO: 74590 - DNA, 20 bp, synthetic construct
  misc_feature 1..20: note = CRISPR gRNA sequence
  source 1..20: mol_type = other DNA
taaactttctacaatgcatg

SEQ ID NO: 74591 - DNA, 20 bp, synthetic construct
  misc_feature 1..20: note = CRISPR gRNA sequence
  source 1..20: mol_type = other DNA
aactttctacaatgcatgtg

SEQ ID NO: 74592 - DNA, 20 bp, synthetic construct
  misc_feature 1..20: note = CRISPR gRNA sequence
  source 1..20: mol_type = other DNA
tctacaatgcatgtgcatta

SEQ ID NO: 74593 - DNA, 20 bp, synthetic construct
  misc_feature 1..20: note = CRISPR gRNA sequence
  source 1..20: mol_type = other DNA
ctacaatgcatgtgcattaa

SEQ ID NO: 74594 - DNA, 20 bp, synthetic construct
  misc_feature 1..20: note = CRISPR gRNA sequence
  source 1..20: mol_type = other DNA
tacaatgcatgtgcattaat

SEQ ID NO: 74595 - DNA, 20 bp, synthetic construct
  misc_feature 1..20: note = CRISPR gRNA sequence
  source 1..20: mol_type = other DNA
caatgcatgtgcattaattt

SEQ ID NO: 74596 - DNA, 20 bp, synthetic construct
  misc_feature 1..20: note = CRISPR gRNA sequence
  source 1..20: mol_type = other DNA
atttgaaagtaggaaaaaag

SEQ ID NO: 74597 - DNA, 20 bp, synthetic construct
  misc_feature 1..20: note = CRISPR gRNA sequence
  source 1..20: mol_type = other DNA
gaaagtaggaaaaaagagaa

SEQ ID NO: 74598 - DNA, 20 bp, synthetic construct
  misc_feature 1..20: note = CRISPR gRNA sequence
  source 1..20: mol_type = other DNA
aaagtaggaaaaaagagaat

SEQ ID NO: 74599 - DNA, 20 bp, synthetic construct
  misc_feature 1..20: note = CRISPR gRNA sequence
  source 1..20: mol_type = other DNA
agtcaaatattactgcttta

SEQ ID NO: 74600 - DNA, 20 bp, synthetic construct
  misc_feature 1..20: note = CRISPR gRNA sequence
  source 1..20: mol_type = other DNA
ctgctttaaagttatgctga

SEQ ID NO: 74601 - DNA, 20 bp, synthetic construct
  misc_feature 1..20: note = CRISPR gRNA sequence
  source 1..20: mol_type = other DNA
ctttaaagttatgctgaatt

SEQ ID NO: 74602 - DNA, 20 bp, synthetic construct
  misc_feature 1..20: note = CRISPR gRNA sequence
  source 1..20: mol_type = other DNA
taaagttatgctgaattttt

SEQ ID NO: 74603 - DNA, 20 bp, synthetic construct
  misc_feature 1..20: note = CRISPR gRNA sequence
  source 1..20: mol_type = other DNA
aaagttatgctgaattttta

SEQ ID NO: 74604 - DNA, 20 bp, synthetic construct
  misc_feature 1..20: note = CRISPR gRNA sequence
  source 1..20: mol_type = other DNA
aagttatgctgaatttttaa

SEQ ID NO: 74605 - DNA, 20 bp, synthetic construct
  misc_feature 1..20: note = CRISPR gRNA sequence
  source 1..20: mol_type = other DNA
tgctgaatttttaaagcact

SEQ ID NO: 74606 - DNA, 20 bp, synthetic construct
  misc_feature 1..20: note = CRISPR gRNA sequence
  source 1..20: mol_type = other DNA
aatttttaaagcactatttt

SEQ ID NO: 74607 - DNA, 20 bp, synthetic construct
  misc_feature 1..20: note = CRISPR gRNA sequence
  source 1..20: mol_type = other DNA
ttaaagcactattttcttta

SEQ ID NO: 74608 - DNA, 20 bp, synthetic construct
  misc_feature 1..20: note = CRISPR gRNA sequence
  source 1..20: mol_type = other DNA
taaagcactattttctttat

SEQ ID NO: 74609 - DNA, 20 bp, synthetic construct
  misc_feature 1..20: note = CRISPR gRNA sequence
  source 1..20: mol_type = other DNA
aaagcactattttctttatg

SEQ ID NO: 74610 - DNA, 20 bp, synthetic construct
  misc_feature 1..20: note = CRISPR gRNA sequence
  source 1..20: mol_type = other DNA
aagcactattttctttatgt

SEQ ID NO: 74611 - DNA, 20 bp, synthetic construct
  misc_feature 1..20: note = CRISPR gRNA sequence
  source 1..20: mol_type = other DNA
ttttctttatgtatttctgg

SEQ ID NO: 74612 - DNA, 20 bp, synthetic construct
  misc_feature 1..20: note = CRISPR gRNA sequence
  source 1..20: mol_type = other DNA
tctttatgtatttctggatt

SEQ ID NO: 74613 - DNA, 20 bp, synthetic construct
  misc_feature 1..20: note = CRISPR gRNA sequence
  source 1..20: mol_type = other DNA
ctttatgtatttctggattt

SEQ ID NO: 74614 - DNA, 20 bp, synthetic construct
  misc_feature 1..20: note = CRISPR gRNA sequence
  source 1..20: mol_type = other DNA
tttatgtatttctggatttt

SEQ ID NO: 74615 - DNA, 20 bp, synthetic construct
  misc_feature 1..20: note = CRISPR gRNA sequence
  source 1..20: mol_type = other DNA
tatgtatttctggattttct

SEQ ID NO: 74616 - DNA, 20 bp, synthetic construct
  misc_feature 1..20: note = CRISPR gRNA sequence
  source 1..20: mol_type = other DNA
atgtatttctggattttctg

SEQ ID NO: 74617 - DNA, 20 bp, synthetic construct
  misc_feature 1..20: note = CRISPR gRNA sequence
  source 1..20: mol_type = other DNA
tgtatttctggattttctgc

SEQ ID NO: 74618 - DNA, 20 bp, synthetic construct
  misc_feature 1..20: note = CRISPR gRNA sequence
  source 1..20: mol_type = other DNA
ctggattttctgcacatttc

SEQ ID NO: 74619 - DNA, 20 bp, synthetic construct
  misc_feature 1..20: note = CRISPR gRNA sequence
  source 1..20: mol_type = other DNA
tggattttctgcacatttca

SEQ ID NO: 74620 - DNA, 20 bp, synthetic construct
  misc_feature 1..20: note = CRISPR gRNA sequence
  source 1..20: mol_type = other DNA
gattttctgcacatttcaac

SEQ ID NO: 74621 - DNA, 20 bp, synthetic construct
  misc_feature 1..20: note = CRISPR gRNA sequence
  source 1..20: mol_type = other DNA
tctgcacatttcaacaatga

SEQ ID NO: 74622 - DNA, 20 bp, synthetic construct
  misc_feature 1..20: note = CRISPR gRNA sequence
  source 1..20: mol_type = other DNA
ctgcacatttcaacaatgat

SEQ ID NO: 74623 - DNA, 20 bp, synthetic construct
  misc_feature 1..20: note = CRISPR gRNA sequence
  source 1..20: mol_type = other DNA
tgcacatttcaacaatgatt

SEQ ID NO: 74624 - DNA, 20 bp, synthetic construct
  misc_feature 1..20: note = CRISPR gRNA sequence
  source 1..20: mol_type = other DNA
cacatttcaacaatgattaa

SEQ ID NO: 74625 - DNA, 20 bp, synthetic construct
  misc_feature 1..20: note = CRISPR gRNA sequence
  source 1..20: mol_type = other DNA
caacaatgattaaatattat

SEQ ID NO: 74626 - DNA, 20 bp, synthetic construct
  misc_feature 1..20: note = CRISPR gRNA sequence
  source 1..20: mol_type = other DNA
aacaatgattaaatattatt

SEQ ID NO: 74627 - DNA, 20 bp, synthetic construct
  misc_feature 1..20: note = CRISPR gRNA sequence
  source 1..20: mol_type = other DNA
aatattatttttttattttt

SEQ ID NO: 74628 - DNA, 20 bp, synthetic construct
  misc_feature 1..20: note = CRISPR gRNA sequence
  source 1..20: mol_type = other DNA
tttttttatttttatttttt

SEQ ID NO: 74629 - DNA, 20 bp, synthetic construct
  misc_feature 1..20: note = CRISPR gRNA sequence
  source 1..20: mol_type = other DNA
ttttatttttattttttgta

SEQ ID NO: 74630 - DNA, 20 bp, synthetic construct
  misc_feature 1..20: note = CRISPR gRNA sequence
  source 1..20: mol_type = other DNA
tttatttttattttttgtag

SEQ ID NO: 74631 - DNA, 20 bp, synthetic construct
  misc_feature 1..20: note = CRISPR gRNA sequence
  source 1..20: mol_type = other DNA
ttatttttattttttgtaga

SEQ ID NO: 74632 - DNA, 20 bp, synthetic construct
  misc_feature 1..20: note = CRISPR gRNA sequence
  source 1..20: mol_type = other DNA
tatttttattttttgtagat

SEQ ID NO: 74633 - DNA, 20 bp, synthetic construct
  misc_feature 1..20: note = CRISPR gRNA sequence
  source 1..20: mol_type = other DNA
atttttattttttgtagata

SEQ ID NO: 74634 - DNA, 20 bp, synthetic construct
  misc_feature 1..20: note = CRISPR gRNA sequence
  source 1..20: mol_type = other DNA
tttttattttttgtagatat

SEQ ID NO: 74635 - DNA, 20 bp, synthetic construct
  misc_feature 1..20: note = CRISPR gRNA sequence
  source 1..20: mol_type = other DNA
ttattttttgtagatatggg

SEQ ID NO: 74636 - DNA, 20 bp, synthetic construct
  misc_feature 1..20: note = CRISPR gRNA sequence
  source 1..20: mol_type = other DNA
tattttttgtagatatgggg

SEQ ID NO: 74637 - DNA, 20 bp, synthetic construct
  misc_feature 1..20: note = CRISPR gRNA sequence
  source 1..20: mol_type = other DNA
attttttgtagatatggggt

SEQ ID NO: 74638 - DNA, 20 bp, synthetic construct
  misc_feature 1..20: note = CRISPR gRNA sequence
  source 1..20: mol_type = other DNA
ttttttgtagatatggggtt

SEQ ID NO: 74639 - DNA, 20 bp, synthetic construct
  misc_feature 1..20: note = CRISPR gRNA sequence
  source 1..20: mol_type = other DNA
tttgtagatatggggttttg

SEQ ID NO: 74640 - DNA, 20 bp, synthetic construct
  misc_feature 1..20: note = CRISPR gRNA sequence
  source 1..20: mol_type = other DNA
ttgtagatatggggttttgc

SEQ ID NO: 74641 - DNA, 20 bp, synthetic construct
  misc_feature 1..20: note = CRISPR gRNA sequence
  source 1..20: mol_type = other DNA
tgtagatatggggttttgcc

SEQ ID NO: 74642 - DNA, 20 bp, synthetic construct
  misc_feature 1..20: note = CRISPR gRNA sequence
  source 1..20: mol_type = other DNA
gtagatatggggttttgcca

SEQ ID NO: 74643 - DNA, 20 bp, synthetic construct
  misc_feature 1..20: note = CRISPR gRNA sequence
  source 1..20: mol_type = other DNA
tagatatggggttttgccat

SEQ ID NO: 74644 - DNA, 20 bp, synthetic construct
  misc_feature 1..20: note = CRISPR gRNA sequence
  source 1..20: mol_type = other DNA
tgccatgttgtccaggctgg

SEQ ID NO: 74645 - DNA, 20 bp, synthetic construct
  misc_feature 1..20: note = CRISPR gRNA sequence
  source 1..20: mol_type = other DNA
gccatgttgtccaggctggt

SEQ ID NO: 74646 - DNA, 20 bp, synthetic construct
  misc_feature 1..20: note = CRISPR gRNA sequence
  source 1..20: mol_type = other DNA
ccatgttgtccaggctggtc

SEQ ID NO: 74647 - DNA, 20 bp, synthetic construct
  misc_feature 1..20: note = CRISPR gRNA sequence
  source 1..20: mol_type = other DNA
tccaggctggtcttgaacgc

SEQ ID NO: 74648 - DNA, 20 bp, synthetic construct
  misc_feature 1..20: note = CRISPR gRNA sequence
  source 1..20: mol_type = other DNA
gtcttgaacgcctgagctca

SEQ ID NO: 74649 - DNA, 20 bp, synthetic construct
  misc_feature 1..20: note = CRISPR gRNA sequence
  source 1..20: mol_type = other DNA
gaacgcctgagctcaaacaa

SEQ ID NO: 74650 - DNA, 20 bp, synthetic construct
  misc_feature 1..20: note = CRISPR gRNA sequence
  source 1..20: mol_type = other DNA
aacgcctgagctcaaacaat

SEQ ID NO: 74651 - DNA, 20 bp, synthetic construct
  misc_feature 1..20: note = CRISPR gRNA sequence
  source 1..20: mol_type = other DNA
agctcaaacaatctgcccac

SEQ ID NO: 74652 - DNA, 20 bp, synthetic construct
  misc_feature 1..20: note = CRISPR gRNA sequence
  source 1..20: mol_type = other DNA
aaacaatctgcccacctcag

SEQ ID NO: 74653 - DNA, 20 bp, synthetic construct
  misc_feature 1..20: note = CRISPR gRNA sequence
  source 1..20: mol_type = other DNA
cccacctcagcctcccaaag

SEQ ID NO: 74654 - DNA, 20 bp, synthetic construct
  misc_feature 1..20: note = CRISPR gRNA sequence
  source 1..20: mol_type = other DNA
agcctcccaaagtgttggga

SEQ ID NO: 74655 - DNA, 20 bp, synthetic construct
  misc_feature 1..20: note = CRISPR gRNA sequence
  source 1..20: mol_type = other DNA
ccaaagtgttgggattacag

SEQ ID NO: 74656 - DNA, 20 bp, synthetic construct
  misc_feature 1..20: note = CRISPR gRNA sequence
  source 1..20: mol_type = other DNA
ggattacaggcgtgtgccac

SEQ ID NO: 74657 - DNA, 20 bp, synthetic construct
  misc_feature 1..20: note = CRISPR gRNA sequence
  source 1..20: mol_type = other DNA
caggcgtgtgccacttcccc

SEQ ID NO: 74658 - DNA, 20 bp, synthetic construct
  misc_feature 1..20: note = CRISPR gRNA sequence
  source 1..20: mol_type = other DNA
cccccaaccaatattatttt

SEQ ID NO: 74659 - DNA, 20 bp, synthetic construct
  misc_feature 1..20: note = CRISPR gRNA sequence
  source 1..20: mol_type = other DNA
ccccaaccaatattattttt

SEQ ID NO: 74660 - DNA, 20 bp, synthetic construct
  misc_feature 1..20: note = CRISPR gRNA sequence
  source 1..20: mol_type = other DNA
tttttagactaagaaaagtt

SEQ ID NO: 74661 - DNA, 20 bp, synthetic construct
  misc_feature 1..20: note = CRISPR gRNA sequence
  source 1..20: mol_type = other DNA
ttagactaagaaaagtttta

SEQ ID NO: 74662 - DNA, 20 bp, synthetic construct
  misc_feature 1..20: note = CRISPR gRNA sequence
  source 1..20: mol_type = other DNA
tagactaagaaaagttttat

SEQ ID NO: 74663 - DNA, 20 bp, synthetic construct
  misc_feature 1..20: note = CRISPR gRNA sequence
  source 1..20: mol_type = other DNA
agactaagaaaagttttatt

SEQ ID NO: 74664 - DNA, 20 bp, synthetic construct
  misc_feature 1..20: note = CRISPR gRNA sequence
  source 1..20: mol_type = other DNA
gactaagaaaagttttattt

SEQ ID NO: 74665 - DNA, 20 bp, synthetic construct
  misc_feature 1..20: note = CRISPR gRNA sequence
  source 1..20: mol_type = other DNA
agaaaagttttatttgaaaa

SEQ ID NO: 74666 - DNA, 20 bp, synthetic construct
  misc_feature 1..20: note = CRISPR gRNA sequence
  source 1..20: mol_type = other DNA
tatttgaaaatgttattttg

SEQ ID NO: 74667 - DNA, 20 bp, synthetic construct
  misc_feature 1..20: note = CRISPR gRNA sequence
  source 1..20: mol_type = other DNA
atttgaaaatgttattttgg

SEQ ID NO: 74668 - DNA, 20 bp, synthetic construct
  misc_feature 1..20: note = CRISPR gRNA sequence
  source 1..20: mol_type = other DNA
tttgaaaatgttattttggc

SEQ ID NO: 74669 - DNA, 20 bp, synthetic construct
  misc_feature 1..20: note = CRISPR gRNA sequence
  source 1..20: mol_type = other DNA
gaaaatgttattttggctgg

SEQ ID NO: 74670 - DNA, 20 bp, synthetic construct
  misc_feature 1..20: note = CRISPR gRNA sequence
  source 1..20: mol_type = other DNA
aaaatgttattttggctggg

SEQ ID NO: 74671 - DNA, 20 bp, synthetic construct
  misc_feature 1..20: note = CRISPR gRNA sequence
  source 1..20: mol_type = other DNA
ttttggctgggtgcagtggc

SEQ ID NO: 74672 - DNA, 20 bp, synthetic construct
  misc_feature 1..20: note = CRISPR gRNA sequence
  source 1..20: mol_type = other DNA
tggctgggtgcagtggctca

SEQ ID NO: 74673 - DNA, 20 bp, synthetic construct
  misc_feature 1..20: note = CRISPR gRNA sequence
  source 1..20: mol_type = other DNA
ggctgggtgcagtggctcac

SEQ ID NO: 74674 - DNA, 20 bp, synthetic construct
  misc_feature 1..20: note = CRISPR gRNA sequence
  source 1..20: mol_type = other DNA
gctgggtgcagtggctcaca

SEQ ID NO: 74675 - DNA, 20 bp, synthetic construct
  misc_feature 1..20: note = CRISPR gRNA sequence
  source 1..20: mol_type = other DNA
ggtgcagtggctcacacctg

SEQ ID NO: 74676 - DNA, 20 bp, synthetic construct
  misc_feature 1..20: note = CRISPR gRNA sequence
  source 1..20: mol_type = other DNA
acacctgtaatcccagcact

SEQ ID NO: 74677 - DNA, 20 bp, synthetic construct
  misc_feature 1..20: note = CRISPR gRNA sequence
  source 1..20: mol_type = other DNA
taatcccagcactttgggag

SEQ ID NO: 74678 - DNA, 20 bp, synthetic construct
  misc_feature 1..20: note = CRISPR gRNA sequence
  source 1..20: mol_type = other DNA
tgggaggctgaggtgggggg

SEQ ID NO: 74679 - DNA, 20 bp, synthetic construct
  misc_feature 1..20: note = CRISPR gRNA sequence
  source 1..20: mol_type = other DNA
gggaggctgaggtgggggga

SEQ ID NO: 74680 - DNA, 20 bp, synthetic construct
  misc_feature 1..20: note = CRISPR gRNA sequence
  source 1..20: mol_type = other DNA
ggaggctgaggtggggggat

SEQ ID NO: 74681 - DNA, 20 bp, synthetic construct
  misc_feature 1..20: note = CRISPR gRNA sequence
  source 1..20: mol_type = other DNA
aggtggggggatcacgaggt

SEQ ID NO: 74682 - DNA, 20 bp, synthetic construct
  misc_feature 1..20: note = CRISPR gRNA sequence
  source 1..20: mol_type = other DNA
gctaacatggtgaaaccccg

SEQ ID NO: 74683 - DNA, 20 bp, synthetic construct
  misc_feature 1..20: note = CRISPR gRNA sequence
  source 1..20: mol_type = other DNA
acatggtgaaaccccgtctc

SEQ ID NO: 74684 - DNA, 20 bp, synthetic construct
  misc_feature 1..20: note = CRISPR gRNA sequence
  source 1..20: mol_type = other DNA
tactaaaaatacaaaacatt

SEQ ID NO: 74685 - DNA, 20 bp, synthetic construct
  misc_feature 1..20: note = CRISPR gRNA sequence
  source 1..20: mol_type = other DNA
ctaaaaatacaaaacattag

SEQ ID NO: 74686 - DNA, 20 bp, synthetic construct
  misc_feature 1..20: note = CRISPR gRNA sequence
  source 1..20: mol_type = other DNA
aaaatacaaaacattagtca

SEQ ID NO: 74687 - DNA, 20 bp, synthetic construct
  misc_feature 1..20: note = CRISPR gRNA sequence
  source 1..20: mol_type = other DNA
gtcaggcgtggtggcgggca

SEQ ID NO: 74688 - DNA, 20 bp, synthetic construct
  misc_feature 1..20: note = CRISPR gRNA sequence
  source 1..20: mol_type = other DNA
tagtcccagctactctggag

SEQ ID NO: 74689 - DNA, 20 bp, synthetic construct
  misc_feature 1..20: note = CRISPR gRNA sequence
  source 1..20: mol_type = other DNA
ctctggaggctgaggcagga

SEQ ID NO: 74690 - DNA, 20 bp, synthetic construct
  misc_feature 1..20: note = CRISPR gRNA sequence
  source 1..20: mol_type = other DNA
tggaggctgaggcaggagaa

SEQ ID NO: 74691 - DNA, 20 bp, synthetic construct
  misc_feature 1..20: note = CRISPR gRNA sequence
  source 1..20: mol_type = other DNA
gaggctgaggcaggagaatg

SEQ ID NO: 74692 - DNA, 20 bp, synthetic construct
  misc_feature 1..20: note = CRISPR gRNA sequence
  source 1..20: mol_type = other DNA
aggcaggagaatggcgtgaa

SEQ ID NO: 74693 - DNA, 20 bp, synthetic construct
  misc_feature 1..20: note = CRISPR gRNA sequence
  source 1..20: mol_type = other DNA
gcagtgagccgagatcgcac

SEQ ID NO: 74694 - DNA, 20 bp, synthetic construct
  misc_feature 1..20: note = CRISPR gRNA sequence
  source 1..20: mol_type = other DNA
cagtgagccgagatcgcacc

SEQ ID NO: 74695 - DNA, 20 bp, synthetic construct
  misc_feature 1..20: note = CRISPR gRNA sequence
  source 1..20: mol_type = other DNA
cactccaacctgggcaacag

SEQ ID NO: 74696 - DNA, 20 bp, synthetic construct
  misc_feature 1..20: note = CRISPR gRNA sequence
  source 1..20: mol_type = other DNA
caacctgggcaacagagcga

SEQ ID NO: 74697 - DNA, 20 bp, synthetic construct
  misc_feature 1..20: note = CRISPR gRNA sequence
  source 1..20: mol_type = other DNA
ggcaacagagcgagactccg

SEQ ID NO: 74698 - DNA, 20 bp, synthetic construct
  misc_feature 1..20: note = CRISPR gRNA sequence
  source 1..20: mol_type = other DNA
cgtctcaaaaaaaaaaagtt

SEQ ID NO: 74699 - DNA, 20 bp, synthetic construct
  misc_feature 1..20: note = CRISPR gRNA sequence
  source 1..20: mol_type = other DNA
aaaaaaaaaaagttattttg

SEQ ID NO: 74700 - DNA, 20 bp, synthetic construct
  misc_feature 1..20: note = CRISPR gRNA sequence
  source 1..20: mol_type = other DNA
ttttgggtgctctagcaatt

SEQ ID NO: 74701 - DNA, 20 bp, synthetic construct
  misc_feature 1..20: note = CRISPR gRNA sequence
  source 1..20: mol_type = other DNA
tgggtgctctagcaattctg

SEQ ID NO: 74702 - DNA, 20 bp, synthetic construct
  misc_feature 1..20: note = CRISPR gRNA sequence
  source 1..20: mol_type = other DNA
gggtgctctagcaattctgg

SEQ ID NO: 74703 - DNA, 20 bp, synthetic construct
  misc_feature 1..20: note = CRISPR gRNA sequence
  source 1..20: mol_type = other DNA
ggtgctctagcaattctgga

SEQ ID NO: 74704 - DNA, 20 bp, synthetic construct
  misc_feature 1..20: note = CRISPR gRNA sequence
  source 1..20: mol_type = other DNA
tagcaattctggatatataa

SEQ ID NO: 74705 - DNA, 20 bp, synthetic construct
  misc_feature 1..20: note = CRISPR gRNA sequence
  source 1..20: mol_type = other DNA
gcaattctggatatataacc

SEQ ID NO: 74706 - DNA, 20 bp, synthetic construct
  misc_feature 1..20: note = CRISPR gRNA sequence
  source 1..20: mol_type = other DNA
tggatatataaccaaaataa

SEQ ID NO: 74707 - DNA, 20 bp, synthetic construct
  misc_feature 1..20: note = CRISPR gRNA sequence
  source 1..20: mol_type = other DNA
gatatataaccaaaataatt

SEQ ID NO: 74708 - DNA, 20 bp, synthetic construct
  misc_feature 1..20: note = CRISPR gRNA sequence
  source 1..20: mol_type = other DNA
aaagctgggactttctggct

SEQ ID NO: 74709 - DNA, 20 bp, synthetic construct
  misc_feature 1..20: note = CRISPR gRNA sequence
  source 1..20: mol_type = other DNA
ggactttctggctgggcatg

SEQ ID NO: 74710 - DNA, 20 bp, synthetic construct
  misc_feature 1..20: note = CRISPR gRNA sequence
  source 1..20: mol_type = other DNA
tctggctgggcatggtggct

SEQ ID NO: 74711 - DNA, 20 bp, synthetic construct
  misc_feature 1..20: note = CRISPR gRNA sequence
  source 1..20: mol_type = other DNA
ctggctgggcatggtggctc

SEQ ID NO: 74712 - DNA, 20 bp, synthetic construct
  misc_feature 1..20: note = CRISPR gRNA sequence
  source 1..20: mol_type = other DNA
tggctgggcatggtggctca

SEQ ID NO: 74713 - DNA, 20 bp, synthetic construct
  misc_feature 1..20: note = CRISPR gRNA sequence
  source 1..20: mol_type = other DNA
gctgggcatggtggctcacg

SEQ ID NO: 74714 - DNA, 20 bp, synthetic construct
  misc_feature 1..20: note = CRISPR gRNA sequence
  source 1..20: mol_type = other DNA
ggcatggtggctcacgccta

SEQ ID NO: 74715 - DNA, 20 bp, synthetic construct
  misc_feature 1..20: note = CRISPR gRNA sequence
  source 1..20: mol_type = other DNA
acgcctagcactttgggagg

SEQ ID NO: 74716 - DNA, 20 bp, synthetic construct
  misc_feature 1..20: note = CRISPR gRNA sequence
  source 1..20: mol_type = other DNA
gcactttgggaggctgaggt

SEQ ID NO: 74717 - DNA, 20 bp, synthetic construct
  misc_feature 1..20: note = CRISPR gRNA sequence
  source 1..20: mol_type = other DNA
tgggaggctgaggtgggagg

SEQ ID NO: 74718 - DNA, 20 bp, synthetic construct
  misc_feature 1..20: note = CRISPR gRNA sequence
  source 1..20: mol_type = other DNA
gggaggctgaggtgggagga

SEQ ID NO: 74719 - DNA, 20 bp, synthetic construct
  misc_feature 1..20: note = CRISPR gRNA sequence
  source 1..20: mol_type = other DNA
ggaggctgaggtgggaggat

SEQ ID NO: 74720 - DNA, 20 bp, synthetic construct
  misc_feature 1..20: note = CRISPR gRNA sequence
  source 1..20: mol_type = other DNA
aggtgggaggatcacttgag

SEQ ID NO: 74721 - DNA, 20 bp, synthetic construct
  misc_feature 1..20: note = CRISPR gRNA sequence
  source 1..20: mol_type = other DNA
gagctcaggagatcaagatc

SEQ ID NO: 74722 - DNA, 20 bp, synthetic construct
  misc_feature 1..20: note = CRISPR gRNA sequence
  source 1..20: mol_type = other DNA
agctcaggagatcaagatca

SEQ ID NO: 74723 - DNA, 20 bp, synthetic construct
  misc_feature 1..20: note = CRISPR gRNA sequence
  source 1..20: mol_type = other DNA
aggagatcaagatcatcctg

SEQ ID NO: 74724 - DNA, 20 bp, synthetic construct
  misc_feature 1..20: note = CRISPR gRNA sequence
  source 1..20: mol_type = other DNA
ggcaaaacagtgagacctca

SEQ ID NO: 74725 - DNA, 20 bp, synthetic construct
  misc_feature 1..20: note = CRISPR gRNA sequence
  source 1..20: mol_type = other DNA
atctctattgtttttgaaat

SEQ ID NO: 74726 - DNA, 20 bp, synthetic construct
  misc_feature 1..20: note = CRISPR gRNA sequence
  source 1..20: mol_type = other DNA
tattgtttttgaaataaaat

SEQ ID NO: 74727 - DNA, 20 bp, synthetic construct
  misc_feature 1..20: note = CRISPR gRNA sequence
  source 1..20: mol_type = other DNA
ttgtttttgaaataaaataa

SEQ ID NO: 74728 - DNA, 20 bp, synthetic construct
  misc_feature 1..20: note = CRISPR gRNA sequence
  source 1..20: mol_type = other DNA
tttttgaaataaaataatat

SEQ ID NO: 74729 - DNA, 20 bp, synthetic construct
  misc_feature 1..20: note = CRISPR gRNA sequence
  source 1..20: mol_type = other DNA
ttgaaataaaataatattta

SEQ ID NO: 74730 - DNA, 20 bp, synthetic construct
  misc_feature 1..20: note = CRISPR gRNA sequence
  source 1..20: mol_type = other DNA
tgaaataaaataatatttaa

SEQ ID NO: 74731 - DNA, 20 bp, synthetic construct
  misc_feature 1..20: note = CRISPR gRNA sequence
  source 1..20: mol_type = other DNA
gaaataaaataatatttaaa

SEQ ID NO: 74732 - DNA, 20 bp, synthetic construct
  misc_feature 1..20: note = CRISPR gRNA sequence
  source 1..20: mol_type = other DNA
aaataaaataatatttaaaa

SEQ ID NO: 74733 - DNA, 20 bp, synthetic construct
  misc_feature 1..20: note = CRISPR gRNA sequence
  source 1..20: mol_type = other DNA
aaaaaaagaaagcagggact

SEQ ID NO: 74734 - DNA, 20 bp, synthetic construct
  misc_feature 1..20: note = CRISPR gRNA sequence
  source 1..20: mol_type = other DNA
aaaaaagaaagcagggactg

SEQ ID NO: 74735 - DNA, 20 bp, synthetic construct
  misc_feature 1..20: note = CRISPR gRNA sequence
  source 1..20: mol_type = other DNA
tcaattgggcacttgaatgg

SEQ ID NO: 74736 - DNA, 20 bp, synthetic construct
  misc_feature 1..20: note = CRISPR gRNA sequence
  source 1..20: mol_type = other DNA
ggcacttgaatggacaaccc

SEQ ID NO: 74737 - DNA, 20 bp, synthetic construct
  misc_feature 1..20: note = CRISPR gRNA sequence
  source 1..20: mol_type = other DNA
gaatggacaacccaagtgtc

SEQ ID NO: 74738 - DNA, 20 bp, synthetic construct
  misc_feature 1..20: note = CRISPR gRNA sequence
  source 1..20: mol_type = other DNA
aatggacaacccaagtgtca

SEQ ID NO: 74739 - DNA, 20 bp, synthetic construct
  misc_feature 1..20: note = CRISPR gRNA sequence
  source 1..20: mol_type = other DNA
atggataagtggatacacaa

SEQ ID NO: 74740 - DNA, 20 bp, synthetic construct
  misc_feature 1..20: note = CRISPR gRNA sequence
  source 1..20: mol_type = other DNA
tgcagccttaaaaaaggaaa

SEQ ID NO: 74741 - DNA, 20 bp, synthetic construct
  misc_feature 1..20: note = CRISPR gRNA sequence
  source 1..20: mol_type = other DNA
aaaaaaggaaagggctgggt

SEQ ID NO: 74742 - DNA, 20 bp, synthetic construct
  misc_feature 1..20: note = CRISPR gRNA sequence
  source 1..20: mol_type = other DNA
aaaaaggaaagggctgggtg

SEQ ID NO: 74743 - DNA, 20 bp, synthetic construct
  misc_feature 1..20: note = CRISPR gRNA sequence
  source 1..20: mol_type = other DNA
ggtgtggtggctcatgcctg

SEQ ID NO: 74744 - DNA, 20 bp, synthetic construct
  misc_feature 1..20: note = CRISPR gRNA sequence
  source 1..20: mol_type = other DNA
atgcctgtaatcccagcact

SEQ ID NO: 74745 - DNA, 20 bp, synthetic construct
  misc_feature 1..20: note = CRISPR gRNA sequence
  source 1..20: mol_type = other DNA
taatcccagcactttggaag

SEQ ID NO: 74746 - DNA, 20 bp, synthetic construct
  misc_feature 1..20: note = CRISPR gRNA sequence
  source 1..20: mol_type = other DNA
tggaaggccgaaacgggcag

SEQ ID NO: 74747 - DNA, 20 bp, synthetic construct
  misc_feature 1..20: note = CRISPR gRNA sequence
  source 1..20: mol_type = other DNA
ggaaggccgaaacgggcaga

SEQ ID NO: 74748 - DNA, 20 bp, synthetic construct
  misc_feature 1..20: note = CRISPR gRNA sequence
  source 1..20: mol_type = other DNA
gaaggccgaaacgggcagat

SEQ ID NO: 74749 - DNA, 20 bp, synthetic construct
  misc_feature 1..20: note = CRISPR gRNA sequence
  source 1..20: mol_type = other DNA
aggtcaggagttcgagacca

SEQ ID NO: 74750 - DNA, 20 bp, synthetic construct
  misc_feature 1..20: note = CRISPR gRNA sequence
  source 1..20: mol_type = other DNA
gagaccagcctcgccaacat

SEQ ID NO: 74751 - DNA, 20 bp, synthetic construct
  misc_feature 1..20: note = CRISPR gRNA sequence
  source 1..20: mol_type = other DNA
gccaacatggtgaaaccctg

SEQ ID NO: 74752 - DNA, 20 bp, synthetic construct
  misc_feature 1..20: note = CRISPR gRNA sequence
  source 1..20: mol_type = other DNA
tctctacaaaaatacaaaaa

SEQ ID NO: 74753 - DNA, 20 bp, synthetic construct
  misc_feature 1..20: note = CRISPR gRNA sequence
  source 1..20: mol_type = other DNA
tacaaaaatacaaaaaaaaa

SEQ ID NO: 74754 - DNA, 20 bp, synthetic construct
  misc_feature 1..20: note = CRISPR gRNA sequence
  source 1..20: mol_type = other DNA
caaaaatacaaaaaaaaatt

SEQ ID NO: 74755 - DNA, 20 bp, synthetic construct
  misc_feature 1..20: note = CRISPR gRNA sequence
  source 1..20: mol_type = other DNA
gctgggtgtggtggcgggcg

SEQ ID NO: 74756 - DNA, 20 bp, synthetic construct
  misc_feature 1..20: note = CRISPR gRNA sequence
  source 1..20: mol_type = other DNA
ggtgtggtggcgggcgcctg

SEQ ID NO: 74757 - DNA, 20 bp, synthetic construct
  misc_feature 1..20: note = CRISPR gRNA sequence
  source 1..20: mol_type = other DNA
taatcccagctactccggag

SEQ ID NO: 74758 - DNA, 20 bp, synthetic construct
  misc_feature 1..20: note = CRISPR gRNA sequence
  source 1..20: mol_type = other DNA
ctccggaggctgaggcagga

SEQ ID NO: 74759 - DNA, 20 bp, synthetic construct
  misc_feature 1..20: note = CRISPR gRNA sequence
  source 1..20: mol_type = other DNA
cggaggctgaggcaggagaa

SEQ ID NO: 74760 - DNA, 20 bp, synthetic construct
  misc_feature 1..20: note = CRISPR gRNA sequence
  source 1..20: mol_type = other DNA
aggcaggagaatcgcttgaa

SEQ ID NO: 74761 - DNA, 20 bp, synthetic construct
  misc_feature 1..20: note = CRISPR gRNA sequence
  source 1..20: mol_type = other DNA
gaacccaagaggtggagggt

SEQ ID NO: 74762 - DNA, 20 bp, synthetic construct
  misc_feature 1..20: note = CRISPR gRNA sequence
  source 1..20: mol_type = other DNA
aacccaagaggtggagggtg

SEQ ID NO: 74763 - DNA, 20 bp, synthetic construct
  misc_feature 1..20: note = CRISPR gRNA sequence
  source 1..20: mol_type = other DNA
agatcgagccagtgcactcc

SEQ ID NO: 74764 - DNA, 20 bp, synthetic construct
  misc_feature 1..20: note = CRISPR gRNA sequence
  source 1..20: mol_type = other DNA
cagcccaggtgacaagagtg

SEQ ID NO: 74765 - DNA, 20 bp, synthetic construct
  misc_feature 1..20: note = CRISPR gRNA sequence
  source 1..20: mol_type = other DNA
tgtctcaaaaaaaaaaaaaa

SEQ ID NO: 74766 - DNA, 20 bp, synthetic construct
  misc_feature 1..20: note = CRISPR gRNA sequence
  source 1..20: mol_type = other DNA
tctcaaaaaaaaaaaaaaaa

SEQ ID NO: 74767 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 74768 - DNA, 20 bp, synthetic construct
  misc_feature 1..20: note = CRISPR gRNA sequence
  source 1..20: mol_type = other DNA
acacagtgacacacgctgca

SEQ ID NO: 74769 - DNA, 20 bp, synthetic construct
  misc_feature 1..20: note = CRISPR gRNA sequence
  source 1..20: mol_type = other DNA
caacatgaatgaaccagagg

SEQ ID NO: 74770 - DNA, 20 bp, synthetic construct
  misc_feature 1..20: note = CRISPR gRNA sequence
  source 1..20: mol_type = other DNA
tgcccaatgaaatgagccag

SEQ ID NO: 74771 - DNA, 20 bp, synthetic construct
  misc_feature 1..20: note = CRISPR gRNA sequence
  source 1..20: mol_type = other DNA
cactcatataaactatttag

SEQ ID NO: 74772 - DNA, 20 bp, synthetic construct
  misc_feature 1..20: note = CRISPR gRNA sequence
  source 1..20: mol_type = other DNA
atataaactatttagagcag

SEQ ID NO: 74773 - DNA, 20 bp, synthetic construct
  misc_feature 1..20: note = CRISPR gRNA sequence
  source 1..20: mol_type = other DNA
tttagagcagtccaattcat

SEQ ID NO: 74774 - DNA, 20 bp, synthetic construct
  misc_feature 1..20: note = CRISPR gRNA sequence
  source 1..20: mol_type = other DNA
agagcagtccaattcataga

SEQ ID NO: 74775 - DNA, 20 bp, synthetic construct
  misc_feature 1..20: note = CRISPR gRNA sequence
  source 1..20: mol_type = other DNA
gagcagtccaattcatagag

SEQ ID NO: 74776 - DNA, 20 bp, synthetic construct
  misc_feature 1..20: note = CRISPR gRNA sequence
  source 1..20: mol_type = other DNA
atagagacagaaagcagaat

SEQ ID NO: 74777 - DNA, 20 bp, synthetic construct
  misc_feature 1..20: note = CRISPR gRNA sequence
  source 1..20: mol_type = other DNA
ccaggggctggggtaggggg

SEQ ID NO: 74778 - DNA, 20 bp, synthetic construct
  misc_feature 1..20: note = CRISPR gRNA sequence
  source 1..20: mol_type = other DNA
gggtaggggggaaatggggt

SEQ ID NO: 74779 - DNA, 20 bp, synthetic construct
  misc_feature 1..20: note = CRISPR gRNA sequence
  source 1..20: mol_type = other DNA
tttaatggggatagagattc

SEQ ID NO: 74780 - DNA, 20 bp, synthetic construct
  misc_feature 1..20: note = CRISPR gRNA sequence
  source 1..20: mol_type = other DNA
aatggggatagagattcagt

SEQ ID NO: 74781 - DNA, 20 bp, synthetic construct
  misc_feature 1..20: note = CRISPR gRNA sequence
  source 1..20: mol_type = other DNA
atggggatagagattcagtt

SEQ ID NO: 74782 - DNA, 20 bp, synthetic construct
  misc_feature 1..20: note = CRISPR gRNA sequence
  source 1..20: mol_type = other DNA
agttttgcaagaggaaaaga

SEQ ID NO: 74783 - DNA, 20 bp, synthetic construct
  misc_feature 1..20: note = CRISPR gRNA sequence
  source 1..20: mol_type = other DNA
tgcaagaggaaaagagttcc

SEQ ID NO: 74784 - DNA, 20 bp, synthetic construct
  misc_feature 1..20: note = CRISPR gRNA sequence
  source 1..20: mol_type = other DNA
gcaagaggaaaagagttccg

SEQ ID NO: 74785 - DNA, 20 bp, synthetic construct
  misc_feature 1..20: note = CRISPR gRNA sequence
  source 1..20: mol_type = other DNA
caagaggaaaagagttccgg

SEQ ID NO: 74786 - DNA, 20 bp, synthetic construct
  misc_feature 1..20: note = CRISPR gRNA sequence
  source 1..20: mol_type = other DNA
cggagattggccgtacaaaa

SEQ ID NO: 74787 - DNA, 20 bp, synthetic construct
  misc_feature 1..20: note = CRISPR gRNA sequence
  source 1..20: mol_type = other DNA
gccgtacaaaaaagtggatg

SEQ ID NO: 74788 - DNA, 20 bp, synthetic construct
  misc_feature 1..20: note = CRISPR gRNA sequence
  source 1..20: mol_type = other DNA
aacactcctgaatggtacac

SEQ ID NO: 74789 - DNA, 20 bp, synthetic construct
  misc_feature 1..20: note = CRISPR gRNA sequence
  source 1..20: mol_type = other DNA
acactcctgaatggtacact

SEQ ID NO: 74790 - DNA, 20 bp, synthetic construct
  misc_feature 1..20: note = CRISPR gRNA sequence
  source 1..20: mol_type = other DNA
ctgaatggtacacttagaaa

SEQ ID NO: 74791 - DNA, 20 bp, synthetic construct
  misc_feature 1..20: note = CRISPR gRNA sequence
  source 1..20: mol_type = other DNA
aatggtacacttagaaatga

SEQ ID NO: 74792 - DNA, 20 bp, synthetic construct
  misc_feature 1..20: note = CRISPR gRNA sequence
  source 1..20: mol_type = other DNA
agaaatgattaagatggcaa

SEQ ID NO: 74793 - DNA, 20 bp, synthetic construct
  misc_feature 1..20: note = CRISPR gRNA sequence
  source 1..20: mol_type = other DNA
gaaatgattaagatggcaaa

SEQ ID NO: 74794 - DNA, 20 bp, synthetic construct
  misc_feature 1..20: note = CRISPR gRNA sequence
  source 1..20: mol_type = other DNA
agatggcaaattttgttatg

SEQ ID NO: 74795 - DNA, 20 bp, synthetic construct
  misc_feature 1..20: note = CRISPR gRNA sequence
  source 1..20: mol_type = other DNA
tgttatgtgtattttataat

SEQ ID NO: 74796 - DNA, 20 bp, synthetic construct
  misc_feature 1..20: note = CRISPR gRNA sequence
  source 1..20: mol_type = other DNA
gttatgtgtattttataata

SEQ ID NO: 74797 - DNA, 20 bp, synthetic construct
  misc_feature 1..20: note = CRISPR gRNA sequence
  source 1..20: mol_type = other DNA
ttatgtgtattttataataa

SEQ ID NO: 74798 - DNA, 20 bp, synthetic construct
  misc_feature 1..20: note = CRISPR gRNA sequence
  source 1..20: mol_type = other DNA
tgtgtattttataataattt

SEQ ID NO: 74799 - DNA, 20 bp, synthetic construct
  misc_feature 1..20: note = CRISPR gRNA sequence
  source 1..20: mol_type = other DNA
tataataatttttacaggtt

SEQ ID NO: 74800 - DNA, 20 bp, synthetic construct
  misc_feature 1..20: note = CRISPR gRNA sequence
  source 1..20: mol_type = other DNA
ataataatttttacaggtta

SEQ ID NO: 74801 - DNA, 20 bp, synthetic construct
  misc_feature 1..20: note = CRISPR gRNA sequence
  source 1..20: mol_type = other DNA
taataatttttacaggttat

SEQ ID NO: 74802 - DNA, 20 bp, synthetic construct
  misc_feature 1..20: note = CRISPR gRNA sequence
  source 1..20: mol_type = other DNA
ttacaggttattttggggaa

SEQ ID NO: 74803 - DNA, 20 bp, synthetic construct
  misc_feature 1..20: note = CRISPR gRNA sequence
  source 1..20: mol_type = other DNA
tacaggttattttggggaac

SEQ ID NO: 74804 - DNA, 20 bp, synthetic construct
  misc_feature 1..20: note = CRISPR gRNA sequence
  source 1..20: mol_type = other DNA
acaggttattttggggaaca

SEQ ID NO: 74805 - DNA, 20 bp, synthetic construct
  misc_feature 1..20: note = CRISPR gRNA sequence
  source 1..20: mol_type = other DNA
caggttattttggggaacag

SEQ ID NO: 74806 - DNA, 20 bp, synthetic construct
  misc_feature 1..20: note = CRISPR gRNA sequence
  source 1..20: mol_type = other DNA
ttttggggaacagtcagttc

SEQ ID NO: 74807 - DNA, 20 bp, synthetic construct
  misc_feature 1..20: note = CRISPR gRNA sequence
  source 1..20: mol_type = other DNA
tggggaacagtcagttctta

SEQ ID NO: 74808 - DNA, 20 bp, synthetic construct
  misc_feature 1..20: note = CRISPR gRNA sequence
  source 1..20: mol_type = other DNA
ggggaacagtcagttcttag

SEQ ID NO: 74809 - DNA, 20 bp, synthetic construct
  misc_feature 1..20: note = CRISPR gRNA sequence
  source 1..20: mol_type = other DNA
gggaacagtcagttcttagg

SEQ ID NO: 74810 - DNA, 20 bp, synthetic construct
  misc_feature 1..20: note = CRISPR gRNA sequence
  source 1..20: mol_type = other DNA
ttaggtgccttgtcacaggc

SEQ ID NO: 74811 - DNA, 20 bp, synthetic construct
  misc_feature 1..20: note = CRISPR gRNA sequence
  source 1..20: mol_type = other DNA
aggtgccttgtcacaggctg

SEQ ID NO: 74812 - DNA, 20 bp, synthetic construct
  misc_feature 1..20: note = CRISPR gRNA sequence
  source 1..20: mol_type = other DNA
ggtgccttgtcacaggctgc

SEQ ID NO: 74813 - DNA, 20 bp, synthetic construct
  misc_feature 1..20: note = CRISPR gRNA sequence
  source 1..20: mol_type = other DNA
gtcacaggctgcaatgagaa

SEQ ID NO: 74814 - DNA, 20 bp, synthetic construct
  misc_feature 1..20: note = CRISPR gRNA sequence
  source 1..20: mol_type = other DNA
tcacaggctgcaatgagaag

SEQ ID NO: 74815 - DNA, 20 bp, synthetic construct
  misc_feature 1..20: note = CRISPR gRNA sequence
  source 1..20: mol_type = other DNA
caatgagaagtgcacagctc

SEQ ID NO: 74816 - DNA, 20 bp, synthetic construct
  misc_feature 1..20: note = CRISPR gRNA sequence
  source 1..20: mol_type = other DNA
tgtcggtgacgtaagttttt

SEQ ID NO: 74817 - DNA, 20 bp, synthetic construct
  misc_feature 1..20: note = CRISPR gRNA sequence
  source 1..20: mol_type = other DNA
tcggtgacgtaagttttttg

SEQ ID NO: 74818 - DNA, 20 bp, synthetic construct
  misc_feature 1..20: note = CRISPR gRNA sequence
  source 1..20: mol_type = other DNA
tttgggcacaaacatgaaac

SEQ ID NO: 74819 - DNA, 20 bp, synthetic construct
  misc_feature 1..20: note = CRISPR gRNA sequence
  source 1..20: mol_type = other DNA
ttgggcacaaacatgaaact

SEQ ID NO: 74820 - DNA, 20 bp, synthetic construct
  misc_feature 1..20: note = CRISPR gRNA sequence
  source 1..20: mol_type = other DNA
tgggcacaaacatgaaactg

SEQ ID NO: 74821 - DNA, 20 bp, synthetic construct
  misc_feature 1..20: note = CRISPR gRNA sequence
  source 1..20: mol_type = other DNA
gggcacaaacatgaaactga

SEQ ID NO: 74822 - DNA, 20 bp, synthetic construct
  misc_feature 1..20: note = CRISPR gRNA sequence
  source 1..20: mol_type = other DNA
ggcacaaacatgaaactgaa

SEQ ID NO: 74823 - DNA, 20 bp, synthetic construct
  misc_feature 1..20: note = CRISPR gRNA sequence
  source 1..20: mol_type = other DNA
aatgtcatggagccttttga

SEQ ID NO: 74824 - DNA, 20 bp, synthetic construct
  misc_feature 1..20: note = CRISPR gRNA sequence
  source 1..20: mol_type = other DNA
ttgatctaacgtccagtttc

SEQ ID NO: 74825 - DNA, 20 bp, synthetic construct
  misc_feature 1..20: note = CRISPR gRNA sequence
  source 1..20: mol_type = other DNA
tgatctaacgtccagtttcc

SEQ ID NO: 74826 - DNA, 20 bp, synthetic construct
  misc_feature 1..20: note = CRISPR gRNA sequence
  source 1..20: mol_type = other DNA
gatctaacgtccagtttcca

SEQ ID NO: 74827 - DNA, 20 bp, synthetic construct
  misc_feature 1..20: note = CRISPR gRNA sequence
  source 1..20: mol_type = other DNA
atctaacgtccagtttccag

SEQ ID NO: 74828 - DNA, 20 bp, synthetic construct
  misc_feature 1..20: note = CRISPR gRNA sequence
  source 1..20: mol_type = other DNA
acgtccagtttccaggaaag

SEQ ID NO: 74829 - DNA, 20 bp, synthetic construct
  misc_feature 1..20: note = CRISPR gRNA sequence
  source 1..20: mol_type = other DNA
ccaggaaagtcggggttaga

SEQ ID NO: 74830 - DNA, 20 bp, synthetic construct
  misc_feature 1..20: note = CRISPR gRNA sequence
  source 1..20: mol_type = other DNA
caggaaagtcggggttagag

SEQ ID NO: 74831 - DNA, 20 bp, synthetic construct
  misc_feature 1..20: note = CRISPR gRNA sequence
  source 1..20: mol_type = other DNA
gaggaacacgtgccatgaca

SEQ ID NO: 74832 - DNA, 20 bp, synthetic construct
  misc_feature 1..20: note = CRISPR gRNA sequence
  source 1..20: mol_type = other DNA
cagtacacacagttgctgat

SEQ ID NO: 74833 - DNA, 20 bp, synthetic construct
  misc_feature 1..20: note = CRISPR gRNA sequence
  source 1..20: mol_type = other DNA
ctgattttgtcaacagacac

SEQ ID NO: 74834 - DNA, 20 bp, synthetic construct
  misc_feature 1..20: note = CRISPR gRNA sequence
  source 1..20: mol_type = other DNA
attttgtcaacagacactga

SEQ ID NO: 74835 - DNA, 20 bp, synthetic construct
  misc_feature 1..20: note = CRISPR gRNA sequence
  source 1..20: mol_type = other DNA
tgtcaacagacactgacatg

SEQ ID NO: 74836 - DNA, 20 bp, synthetic construct
  misc_feature 1..20: note = CRISPR gRNA sequence
  source 1..20: mol_type = other DNA
gtcaacagacactgacatga

SEQ ID NO: 74837 - DNA, 20 bp, synthetic construct
  misc_feature 1..20: note = CRISPR gRNA sequence
  source 1..20: mol_type = other DNA
tcaacagacactgacatgaa

SEQ ID NO: 74838 - DNA, 20 bp, synthetic construct
  misc_feature 1..20: note = CRISPR gRNA sequence
  source 1..20: mol_type = other DNA
acatgaaacagaaagctgtg

SEQ ID NO: 74839 - DNA, 20 bp, synthetic construct
  misc_feature 1..20: note = CRISPR gRNA sequence
  source 1..20: mol_type = other DNA
tggtgaggggatgggggcag

SEQ ID NO: 74840 - DNA, 20 bp, synthetic construct
  misc_feature 1..20: note = CRISPR gRNA sequence
  source 1..20: mol_type = other DNA
gaagagtcagaagaccatcg

SEQ ID NO: 74841 - DNA, 20 bp, synthetic construct
  misc_feature 1..20: note = CRISPR gRNA sequence
  source 1..20: mol_type = other DNA
gatcccaaaagccagctgtc

SEQ ID NO: 74842 - DNA, 20 bp, synthetic construct
  misc_feature 1..20: note = CRISPR gRNA sequence
  source 1..20: mol_type = other DNA
tcttatctgggggacaatgg

SEQ ID NO: 74843 - DNA, 20 bp, synthetic construct
  misc_feature 1..20: note = CRISPR gRNA sequence
  source 1..20: mol_type = other DNA
atctgggggacaatggggac

SEQ ID NO: 74844 - DNA, 20 bp, synthetic construct
  misc_feature 1..20: note = CRISPR gRNA sequence
  source 1..20: mol_type = other DNA
tctgggggacaatggggaca

SEQ ID NO: 74845 - DNA, 20 bp, synthetic construct
  misc_feature 1..20: note = CRISPR gRNA sequence
  source 1..20: mol_type = other DNA
ggggacaatggggacatttt

SEQ ID NO: 74846 - DNA, 20 bp, synthetic construct
  misc_feature 1..20: note = CRISPR gRNA sequence
  source 1..20: mol_type = other DNA
tagattagactaggtagtac

SEQ ID NO: 74847 - DNA, 20 bp, synthetic construct
  misc_feature 1..20: note = CRISPR gRNA sequence
  source 1..20: mol_type = other DNA
agattagactaggtagtacc

SEQ ID NO: 74848 - DNA, 20 bp, synthetic construct
  misc_feature 1..20: note = CRISPR gRNA sequence
  source 1..20: mol_type = other DNA
gattagactaggtagtaccc

SEQ ID NO: 74849 - DNA, 20 bp, synthetic construct
  misc_feature 1..20: note = CRISPR gRNA sequence
  source 1..20: mol_type = other DNA
gactaggtagtacccgacac

SEQ ID NO: 74850 - DNA, 20 bp, synthetic construct
  misc_feature 1..20: note = CRISPR gRNA sequence
  source 1..20: mol_type = other DNA
ggtagtacccgacactaagg

SEQ ID NO: 74851 - DNA, 20 bp, synthetic construct
  misc_feature 1..20: note = CRISPR gRNA sequence
  source 1..20: mol_type = other DNA
aggaatcgctaactgagttt

SEQ ID NO: 74852 - DNA, 20 bp, synthetic construct
  misc_feature 1..20: note = CRISPR gRNA sequence
  source 1..20: mol_type = other DNA
actgagtttcttaggtgtcc

SEQ ID NO: 74853 - DNA, 20 bp, synthetic construct
  misc_feature 1..20: note = CRISPR gRNA sequence
  source 1..20: mol_type = other DNA
agtttcttaggtgtcctgat

SEQ ID NO: 74854 - DNA, 20 bp, synthetic construct
  misc_feature 1..20: note = CRISPR gRNA sequence
  source 1..20: mol_type = other DNA
cttaggtgtcctgatggaac

SEQ ID NO: 74855 - DNA, 20 bp, synthetic construct
  misc_feature 1..20: note = CRISPR gRNA sequence
  source 1..20: mol_type = other DNA
ttaggtgtcctgatggaact

SEQ ID NO: 74856 - DNA, 20 bp, synthetic construct
  misc_feature 1..20: note = CRISPR gRNA sequence
  source 1..20: mol_type = other DNA
aggtgtcctgatggaactgt

SEQ ID NO: 74857 - DNA, 20 bp, synthetic construct
  misc_feature 1..20: note = CRISPR gRNA sequence
  source 1..20: mol_type = other DNA
ggtgtcctgatggaactgtg

SEQ ID NO: 74858 - DNA, 20 bp, synthetic construct
  misc_feature 1..20: note = CRISPR gRNA sequence
  source 1..20: mol_type = other DNA
atggaactgtgattactgaa

SEQ ID NO: 74859 - DNA, 20 bp, synthetic construct
  misc_feature 1..20: note = CRISPR gRNA sequence
  source 1..20: mol_type = other DNA
tgattactgaaaaaaatgtc

SEQ ID NO: 74860 - DNA, 20 bp, synthetic construct
  misc_feature 1..20: note = CRISPR gRNA sequence
  source 1..20: mol_type = other DNA
ctgaaaaaaatgtccttatt

SEQ ID NO: 74861 - DNA, 20 bp, synthetic construct
  misc_feature 1..20: note = CRISPR gRNA sequence
  source 1..20: mol_type = other DNA
aaaaaaatgtccttattttt

SEQ ID NO: 74862 - DNA, 20 bp, synthetic construct
  misc_feature 1..20: note = CRISPR gRNA sequence
  source 1..20: mol_type = other DNA
attttttggagcttcacggt

SEQ ID NO: 74863 - DNA, 20 bp, synthetic construct
  misc_feature 1..20: note = CRISPR gRNA sequence
  source 1..20: mol_type = other DNA
ttttttggagcttcacggtg

SEQ ID NO: 74864 - DNA, 20 bp, synthetic construct
  misc_feature 1..20: note = CRISPR gRNA sequence
  source 1..20: mol_type = other DNA
tttggagcttcacggtgaaa

SEQ ID NO: 74865 - DNA, 20 bp, synthetic construct
  misc_feature 1..20: note = CRISPR gRNA sequence
  source 1..20: mol_type = other DNA
ttggagcttcacggtgaaat

SEQ ID NO: 74866 - DNA, 20 bp, synthetic construct
  misc_feature 1..20: note = CRISPR gRNA sequence
  source 1..20: mol_type = other DNA
tggagcttcacggtgaaata

SEQ ID NO: 74867 - DNA, 20 bp, synthetic construct
  misc_feature 1..20: note = CRISPR gRNA sequence
  source 1..20: mol_type = other DNA
ggagcttcacggtgaaatat

SEQ ID NO: 74868 - DNA, 20 bp, synthetic construct
  misc_feature 1..20: note = CRISPR gRNA sequence
  source 1..20: mol_type = other DNA
gagcttcacggtgaaatatt

SEQ ID NO: 74869 - DNA, 20 bp, synthetic construct
  misc_feature 1..20: note = CRISPR gRNA sequence
  source 1..20: mol_type = other DNA
cacggtgaaatatttaggag

SEQ ID NO: 74870 - DNA, 20 bp, synthetic construct
  misc_feature 1..20: note = CRISPR gRNA sequence
  source 1..20: mol_type = other DNA
acggtgaaatatttaggagt

SEQ ID NO: 74871 - DNA, 20 bp, synthetic construct
  misc_feature 1..20: note = CRISPR gRNA sequence
  source 1..20: mol_type = other DNA
aggagtgatggattatgagg

SEQ ID NO: 74872 - DNA, 20 bp, synthetic construct
  misc_feature 1..20: note = CRISPR gRNA sequence
  source 1..20: mol_type = other DNA
ggagtgatggattatgaggt

SEQ ID NO: 74873 - DNA, 20 bp, synthetic construct
  misc_feature 1..20: note = CRISPR gRNA sequence
  source 1..20: mol_type = other DNA
tgaggtctataacttacttg

SEQ ID NO: 74874 - DNA, 20 bp, synthetic construct
  misc_feature 1..20: note = CRISPR gRNA sequence
  source 1..20: mol_type = other DNA
taacttacttgaaaccgctt

SEQ ID NO: 74875 - DNA, 20 bp, synthetic construct
  misc_feature 1..20: note = CRISPR gRNA sequence
  source 1..20: mol_type = other DNA
acttgaaaccgcttcagctg

SEQ ID NO: 74876 - DNA, 20 bp, synthetic construct
  misc_feature 1..20: note = CRISPR gRNA sequence
  source 1..20: mol_type = other DNA
cttgaaaccgcttcagctga

SEQ ID NO: 74877 - DNA, 20 bp, synthetic construct
  misc_feature 1..20: note = CRISPR gRNA sequence
  source 1..20: mol_type = other DNA
gaaaccgcttcagctgaaat

SEQ ID NO: 74878 - DNA, 20 bp, synthetic construct
  misc_feature 1..20: note = CRISPR gRNA sequence
  source 1..20: mol_type = other DNA
aaaccgcttcagctgaaata

SEQ ID NO: 74879 - DNA, 20 bp, synthetic construct
  misc_feature 1..20: note = CRISPR gRNA sequence
  source 1..20: mol_type = other DNA
cagctgaaataaaaataaaa

SEQ ID NO: 74880 - DNA, 20 bp, synthetic construct
  misc_feature 1..20: note = CRISPR gRNA sequence
  source 1..20: mol_type = other DNA
agctgaaataaaaataaaaa

SEQ ID NO: 74881 - DNA, 20 bp, synthetic construct
  misc_feature 1..20: note = CRISPR gRNA sequence
  source 1..20: mol_type = other DNA
aaataaaaataaaaatagaa

SEQ ID NO: 74882 - DNA, 20 bp, synthetic construct
  misc_feature 1..20: note = CRISPR gRNA sequence
  source 1..20: mol_type = other DNA
tcaaacctaggttctgggaa

SEQ ID NO: 74883 - DNA, 20 bp, synthetic construct
  misc_feature 1..20: note = CRISPR gRNA sequence
  source 1..20: mol_type = other DNA
ggttctgggaataggagttt

SEQ ID NO: 74884 - DNA, 20 bp, synthetic construct
  misc_feature 1..20: note = CRISPR gRNA sequence
  source 1..20: mol_type = other DNA
tgggaataggagttttaaaa

SEQ ID NO: 74885 - DNA, 20 bp, synthetic construct
  misc_feature 1..20: note = CRISPR gRNA sequence
  source 1..20: mol_type = other DNA
ggaataggagttttaaaaaa

SEQ ID NO: 74886 - DNA, 20 bp, synthetic construct
  misc_feature 1..20: note = CRISPR gRNA sequence
  source 1..20: mol_type = other DNA
taaaaaattattctttctac

SEQ ID NO: 74887 - DNA, 20 bp, synthetic construct
  misc_feature 1..20: note = CRISPR gRNA sequence
  source 1..20: mol_type = other DNA
aaaaaattattctttctact

SEQ ID NO: 74888 - DNA, 20 bp, synthetic construct
  misc_feature 1..20: note = CRISPR gRNA sequence
  source 1..20: mol_type = other DNA
aaaaattattctttctactt

SEQ ID NO: 74889 - DNA, 20 bp, synthetic construct
  misc_feature 1..20: note = CRISPR gRNA sequence
  source 1..20: mol_type = other DNA
ttctttctacttcggtatct

SEQ ID NO: 74890 - DNA, 20 bp, synthetic construct
  misc_feature 1..20: note = CRISPR gRNA sequence
  source 1..20: mol_type = other DNA
tttctacttcggtatcttct

SEQ ID NO: 74891 - DNA, 20 bp, synthetic construct
  misc_feature 1..20: note = CRISPR gRNA sequence
  source 1..20: mol_type = other DNA
tctacttcggtatcttcttt

SEQ ID NO: 74892 - DNA, 20 bp, synthetic construct
  misc_feature 1..20: note = CRISPR gRNA sequence
  source 1..20: mol_type = other DNA
ctacttcggtatcttctttt

SEQ ID NO: 74893 - DNA, 20 bp, synthetic construct
  misc_feature 1..20: note = CRISPR gRNA sequence
  source 1..20: mol_type = other DNA
tacttcggtatcttcttttt

SEQ ID NO: 74894 - DNA, 20 bp, synthetic construct
  misc_feature 1..20: note = CRISPR gRNA sequence
  source 1..20: mol_type = other DNA
cttcggtatcttctttttct

SEQ ID NO: 74895 - DNA, 20 bp, synthetic construct
  misc_feature 1..20: note = CRISPR gRNA sequence
  source 1..20: mol_type = other DNA
cggtatcttctttttctgag

SEQ ID NO: 74896 - DNA, 20 bp, synthetic construct
  misc_feature 1..20: note = CRISPR gRNA sequence
  source 1..20: mol_type = other DNA
ggtatcttctttttctgagt

SEQ ID NO: 74897 - DNA, 20 bp, synthetic construct
  misc_feature 1..20: note = CRISPR gRNA sequence
  source 1..20: mol_type = other DNA
ctttttctgagtgttttaaa

SEQ ID NO: 74898 - DNA, 20 bp, synthetic construct
  misc_feature 1..20: note = CRISPR gRNA sequence
  source 1..20: mol_type = other DNA
tttttctgagtgttttaaaa

SEQ ID NO: 74899 - DNA, 20 bp, synthetic construct
  misc_feature 1..20: note = CRISPR gRNA sequence
  source 1..20: mol_type = other DNA
tttctgagtgttttaaaatg

SEQ ID NO: 74900 - DNA, 20 bp, synthetic construct
  misc_feature 1..20: note = CRISPR gRNA sequence
  source 1..20: mol_type = other DNA
ttctgagtgttttaaaatga

SEQ ID NO: 74901 - DNA, 20 bp, synthetic construct
  misc_feature 1..20: note = CRISPR gRNA sequence
  source 1..20: mol_type = other DNA
tctgagtgttttaaaatgat

SEQ ID NO: 74902 - DNA, 20 bp, synthetic construct
  misc_feature 1..20: note = CRISPR gRNA sequence
  source 1..20: mol_type = other DNA
ctgagtgttttaaaatgatc

SEQ ID NO: 74903 - DNA, 20 bp, synthetic construct
  misc_feature 1..20: note = CRISPR gRNA sequence
  source 1..20: mol_type = other DNA
tgagtgttttaaaatgatca

SEQ ID NO: 74904 - DNA, 20 bp, synthetic construct
  misc_feature 1..20: note = CRISPR gRNA sequence
  source 1..20: mol_type = other DNA
agtgttttaaaatgatcata

SEQ ID NO: 74905 - DNA, 20 bp, synthetic construct
  misc_feature 1..20: note = CRISPR gRNA sequence
  source 1..20: mol_type = other DNA
taaaatgatcatagtgaaca

SEQ ID NO: 74906 - DNA, 20 bp, synthetic construct
  misc_feature 1..20: note = CRISPR gRNA sequence
  source 1..20: mol_type = other DNA
aaaatgatcatagtgaacag

SEQ ID NO: 74907 - DNA, 20 bp, synthetic construct
  misc_feature 1..20: note = CRISPR gRNA sequence
  source 1..20: mol_type = other DNA
aaatgatcatagtgaacaga

SEQ ID NO: 74908 - DNA, 20 bp, synthetic construct
  misc_feature 1..20: note = CRISPR gRNA sequence
  source 1..20: mol_type = other DNA
cgtttcagtttatttttgtc

SEQ ID NO: 74909 - DNA, 20 bp, synthetic construct
  misc_feature 1..20: note = CRISPR gRNA sequence
  source 1..20: mol_type = other DNA
gtttcagtttatttttgtcc

SEQ ID NO: 74910 - DNA, 20 bp, synthetic construct
  misc_feature 1..20: note = CRISPR gRNA sequence
  source 1..20: mol_type = other DNA
cagtttatttttgtcctcag

SEQ ID NO: 74911 - DNA, 20 bp, synthetic construct
  misc_feature 1..20: note = CRISPR gRNA sequence
  source 1..20: mol_type = other DNA
agtttatttttgtcctcagt

SEQ ID NO: 74912 - DNA, 20 bp, synthetic construct
  misc_feature 1..20: note = CRISPR gRNA sequence
  source 1..20: mol_type = other DNA
atttttgtcctcagttcagt

SEQ ID NO: 74913 - DNA, 20 bp, synthetic construct
  misc_feature 1..20: note = CRISPR gRNA sequence
  source 1..20: mol_type = other DNA
tttttgtcctcagttcagta

SEQ ID NO: 74914 - DNA, 20 bp, synthetic construct
  misc_feature 1..20: note = CRISPR gRNA sequence
  source 1..20: mol_type = other DNA
ttgtcctcagttcagtatcc

SEQ ID NO: 74915 - DNA, 20 bp, synthetic construct
  misc_feature 1..20: note = CRISPR gRNA sequence
  source 1..20: mol_type = other DNA
tgtcctcagttcagtatcct

SEQ ID NO: 74916 - DNA, 20 bp, synthetic construct
  misc_feature 1..20: note = CRISPR gRNA sequence
  source 1..20: mol_type = other DNA
gtcctcagttcagtatcctc

SEQ ID NO: 74917 - DNA, 20 bp, synthetic construct
  misc_feature 1..20: note = CRISPR gRNA sequence
  source 1..20: mol_type = other DNA
tcctcagttcagtatcctct

SEQ ID NO: 74918 - DNA, 20 bp, synthetic construct
  misc_feature 1..20: note = CRISPR gRNA sequence
  source 1..20: mol_type = other DNA
agttcagtatcctctgaaac

SEQ ID NO: 74919 - DNA, 20 bp, synthetic construct
  misc_feature 1..20: note = CRISPR gRNA sequence
  source 1..20: mol_type = other DNA
agtatcctctgaaaccttct

SEQ ID NO: 74920 - DNA, 20 bp, synthetic construct
  misc_feature 1..20: note = CRISPR gRNA sequence
  source 1..20: mol_type = other DNA
tgaaaccttctttctttctt

SEQ ID NO: 74921 - DNA, 20 bp, synthetic construct
  misc_feature 1..20: note = CRISPR gRNA sequence
  source 1..20: mol_type = other DNA
aaaccttctttctttctttc

SEQ ID NO: 74922 - DNA, 20 bp, synthetic construct
  misc_feature 1..20: note = CRISPR gRNA sequence
  source 1..20: mol_type = other DNA
ctttctttctttctttcttt

SEQ ID NO: 74923 - DNA, 20 bp, synthetic construct
  misc_feature 1..20: note = CRISPR gRNA sequence
  source 1..20: mol_type = other DNA
tttctttctttctttctttt

SEQ ID NO: 74924 - DNA, 20 bp, synthetic construct
  misc_feature 1..20: note = CRISPR gRNA sequence
  source 1..20: mol_type = other DNA
tctttctttctttctttttt

SEQ ID NO: 74925 - DNA, 20 bp, synthetic construct
  misc_feature 1..20: note = CRISPR gRNA sequence
  source 1..20: mol_type = other DNA
ctttctttctttcttttttt

SEQ ID NO: 74926 - DNA, 20 bp, synthetic construct
  misc_feature 1..20: note = CRISPR gRNA sequence
  source 1..20: mol_type = other DNA
tttctttctttctttttttc

SEQ ID NO: 74927 - DNA, 20 bp, synthetic construct
  misc_feature 1..20: note = CRISPR gRNA sequence
  source 1..20: mol_type = other DNA
tctttctttctttttttctt

SEQ ID NO: 74928 - DNA, 20 bp, synthetic construct
  misc_feature 1..20: note = CRISPR gRNA sequence
  source 1..20: mol_type = other DNA
ctttctttctttttttctta

SEQ ID NO: 74929 - DNA, 20 bp, synthetic construct
  misc_feature 1..20: note = CRISPR gRNA sequence
  source 1..20: mol_type = other DNA
tttctttctttttttcttaa

SEQ ID NO: 74930 - DNA, 20 bp, synthetic construct
  misc_feature 1..20: note = CRISPR gRNA sequence
  source 1..20: mol_type = other DNA
tctttctttttttcttaaat

SEQ ID NO: 74931 - DNA, 20 bp, synthetic construct
  misc_feature 1..20: note = CRISPR gRNA sequence
  source 1..20: mol_type = other DNA
ctttctttttttcttaaatc

SEQ ID NO: 74932 - DNA, 20 bp, synthetic construct
  misc_feature 1..20: note = CRISPR gRNA sequence
  source 1..20: mol_type = other DNA
tttctttttttcttaaatcc

SEQ ID NO: 74933 - DNA, 20 bp, synthetic construct
  misc_feature 1..20: note = CRISPR gRNA sequence
  source 1..20: mol_type = other DNA
tctttttttcttaaatccca

SEQ ID NO: 74934 - DNA, 20 bp, synthetic construct
  misc_feature 1..20: note = CRISPR gRNA sequence
  source 1..20: mol_type = other DNA
ctttttttcttaaatcccaa

SEQ ID NO: 74935 - DNA, 20 bp, synthetic construct
  misc_feature 1..20: note = CRISPR gRNA sequence
  source 1..20: mol_type = other DNA
tttttttcttaaatcccaaa

SEQ ID NO: 74936 - DNA, 20 bp, synthetic construct
  misc_feature 1..20: note = CRISPR gRNA sequence
  source 1..20: mol_type = other DNA
tttttcttaaatcccaaagc

SEQ ID NO: 74937 - DNA, 20 bp, synthetic construct
  misc_feature 1..20: note = CRISPR gRNA sequence
  source 1..20: mol_type = other DNA
ttttcttaaatcccaaagca

SEQ ID NO: 74938 - DNA, 20 bp, synthetic construct
  misc_feature 1..20: note = CRISPR gRNA sequence
  source 1..20: mol_type = other DNA
tttcttaaatcccaaagcac

SEQ ID NO: 74939 - DNA, 20 bp, synthetic construct
  misc_feature 1..20: note = CRISPR gRNA sequence
  source 1..20: mol_type = other DNA
ttcttaaatcccaaagcaca

SEQ ID NO: 74940 - DNA, 20 bp, synthetic construct
  misc_feature 1..20: note = CRISPR gRNA sequence
  source 1..20: mol_type = other DNA
tcttaaatcccaaagcacag

SEQ ID NO: 74941 - DNA, 20 bp, synthetic construct
  misc_feature 1..20: note = CRISPR gRNA sequence
  source 1..20: mol_type = other DNA
cttaaatcccaaagcacagg

SEQ ID NO: 74942 - DNA, 20 bp, synthetic construct
  misc_feature 1..20: note = CRISPR gRNA sequence
  source 1..20: mol_type = other DNA
ttaaatcccaaagcacaggc

SEQ ID NO: 74943 - DNA, 20 bp, synthetic construct
  misc_feature 1..20: note = CRISPR gRNA sequence
  source 1..20: mol_type = other DNA
aaatcccaaagcacaggcct

SEQ ID NO: 74944 - DNA, 20 bp, synthetic construct
  misc_feature 1..20: note = CRISPR gRNA sequence
  source 1..20: mol_type = other DNA
aatcccaaagcacaggcctc

SEQ ID NO: 74945 - DNA, 20 bp, synthetic construct
  misc_feature 1..20: note = CRISPR gRNA sequence
  source 1..20: mol_type = other DNA
cagtgtggggaaggacagtt

SEQ ID NO: 74946 - DNA, 20 bp, synthetic construct
  misc_feature 1..20: note = CRISPR gRNA sequence
  source 1..20: mol_type = other DNA
ctctgtgtgccttgtggagt

SEQ ID NO: 74947 - DNA, 20 bp, synthetic construct
  misc_feature 1..20: note = CRISPR gRNA sequence
  source 1..20: mol_type = other DNA
tctgtgtgccttgtggagtc

SEQ ID NO: 74948 - DNA, 20 bp, synthetic construct
  misc_feature 1..20: note = CRISPR gRNA sequence
  source 1..20: mol_type = other DNA
tgtgtgccttgtggagtctc

SEQ ID NO: 74949 - DNA, 20 bp, synthetic construct
  misc_feature 1..20: note = CRISPR gRNA sequence
  source 1..20: mol_type = other DNA
tgtgccttgtggagtctctg

SEQ ID NO: 74950 - DNA, 20 bp, synthetic construct
  misc_feature 1..20: note = CRISPR gRNA sequence
  source 1..20: mol_type = other DNA
gtggagtctctgggacagat

SEQ ID NO: 74951 - DNA, 20 bp, synthetic construct
  misc_feature 1..20: note = CRISPR gRNA sequence
  source 1..20: mol_type = other DNA
tggagtctctgggacagatg

SEQ ID NO: 74952 - DNA, 20 bp, synthetic construct
  misc_feature 1..20: note = CRISPR gRNA sequence
  source 1..20: mol_type = other DNA
tgggacagatggacagggtt

SEQ ID NO: 74953 - DNA, 20 bp, synthetic construct
  misc_feature 1..20: note = CRISPR gRNA sequence
  source 1..20: mol_type = other DNA
ggacagatggacagggtttg

SEQ ID NO: 74954 - DNA, 20 bp, synthetic construct
  misc_feature 1..20: note = CRISPR gRNA sequence
  source 1..20: mol_type = other DNA
gctcagggtccagatggcag

SEQ ID NO: 74955 - DNA, 20 bp, synthetic construct
  misc_feature 1..20: note = CRISPR gRNA sequence
  source 1..20: mol_type = other DNA
ctcagggtccagatggcagg

SEQ ID NO: 74956 - DNA, 20 bp, synthetic construct
  misc_feature 1..20: note = CRISPR gRNA sequence
  source 1..20: mol_type = other DNA
agggtccagatggcagggtt

SEQ ID NO: 74957 - DNA, 20 bp, synthetic construct
  misc_feature 1..20: note = CRISPR gRNA sequence
  source 1..20: mol_type = other DNA
tgggtacaggaaatgactgg

SEQ ID NO: 74958 - DNA, 20 bp, synthetic construct
  misc_feature 1..20: note = CRISPR gRNA sequence
  source 1..20: mol_type = other DNA
gggccatgatcctgggggcc

SEQ ID NO: 74959 - DNA, 20 bp, synthetic construct
  misc_feature 1..20: note = CRISPR gRNA sequence
  source 1..20: mol_type = other DNA
ggggcctcttactccagtgc

SEQ ID NO: 74960 - DNA, 20 bp, synthetic construct
  misc_feature 1..20: note = CRISPR gRNA sequence
  source 1..20: mol_type = other DNA
ttactccagtgcccacccct

SEQ ID NO: 74961 - DNA, 20 bp, synthetic construct
  misc_feature 1..20: note = CRISPR gRNA sequence
  source 1..20: mol_type = other DNA
actccagtgcccacccctgc

SEQ ID NO: 74962 - DNA, 20 bp, synthetic construct
  misc_feature 1..20: note = CRISPR gRNA sequence
  source 1..20: mol_type = other DNA
ctccagtgcccacccctgct

SEQ ID NO: 74963 - DNA, 20 bp, synthetic construct
  misc_feature 1..20: note = CRISPR gRNA sequence
  source 1..20: mol_type = other DNA
cagtgcccacccctgctccc

SEQ ID NO: 74964 - DNA, 20 bp, synthetic construct
  misc_feature 1..20: note = CRISPR gRNA sequence
  source 1..20: mol_type = other DNA
ctcccattcatgccatggcc

SEQ ID NO: 74965 - DNA, 20 bp, synthetic construct
  misc_feature 1..20: note = CRISPR gRNA sequence
  source 1..20: mol_type = other DNA
ccattcatgccatggcccct

SEQ ID NO: 74966 - DNA, 20 bp, synthetic construct
  misc_feature 1..20: note = CRISPR gRNA sequence
  source 1..20: mol_type = other DNA
atgccatggcccctcccgga

SEQ ID NO: 74967 - DNA, 20 bp, synthetic construct
  misc_feature 1..20: note = CRISPR gRNA sequence
  source 1..20: mol_type = other DNA
ccggaggcagcgggggagga

SEQ ID NO: 74968 - DNA, 20 bp, synthetic construct
  misc_feature 1..20: note = CRISPR gRNA sequence
  source 1..20: mol_type = other DNA
aggctgaacagccctgcggg

SEQ ID NO: 74969 - DNA, 20 bp, synthetic construct
  misc_feature 1..20: note = CRISPR gRNA sequence
  source 1..20: mol_type = other DNA
aacagccctgcgggtcgccc

SEQ ID NO: 74970 - DNA, 20 bp, synthetic construct
  misc_feature 1..20: note = CRISPR gRNA sequence
  source 1..20: mol_type = other DNA
cgggtcgccccaccaagctc

SEQ ID NO: 74971 - DNA, 20 bp, synthetic construct
  misc_feature 1..20: note = CRISPR gRNA sequence
  source 1..20: mol_type = other DNA
aggaggatggccagctgctt

SEQ ID NO: 74972 - DNA, 20 bp, synthetic construct
  misc_feature 1..20: note = CRISPR gRNA sequence
  source 1..20: mol_type = other DNA
cttctggcccaggcagcact

SEQ ID NO: 74973 - DNA, 20 bp, synthetic construct
  misc_feature 1..20: note = CRISPR gRNA sequence
  source 1..20: mol_type = other DNA
ctggcccaggcagcactggg

SEQ ID NO: 74974 - DNA, 20 bp, synthetic construct
  misc_feature 1..20: note = CRISPR gRNA sequence
  source 1..20: mol_type = other DNA
tggcccaggcagcactgggt

SEQ ID NO: 74975 - DNA, 20 bp, synthetic construct
  misc_feature 1..20: note = CRISPR gRNA sequence
  source 1..20: mol_type = other DNA
gcccaggcagcactgggtca

SEQ ID NO: 74976 - DNA, 20 bp, synthetic construct
  misc_feature 1..20: note = CRISPR gRNA sequence
  source 1..20: mol_type = other DNA
ggtcagcctggagacagagg

SEQ ID NO: 74977 - DNA, 20 bp, synthetic construct
  misc_feature 1..20: note = CRISPR gRNA sequence
  source 1..20: mol_type = other DNA
gagacagaggtcagtcactg

SEQ ID NO: 74978 - DNA, 20 bp, synthetic construct
  misc_feature 1..20: note = CRISPR gRNA sequence
  source 1..20: mol_type = other DNA
aggtggctctggcagggtgc

SEQ ID NO: 74979 - DNA, 20 bp, synthetic construct
  misc_feature 1..20: note = CRISPR gRNA sequence
  source 1..20: mol_type = other DNA
tggcagggtgcccccacccc

SEQ ID NO: 74980 - DNA, 20 bp, synthetic construct
  misc_feature 1..20: note = CRISPR gRNA sequence
  source 1..20: mol_type = other DNA
gcagggtgcccccacccctc

SEQ ID NO: 74981 - DNA, 20 bp, synthetic construct
  misc_feature 1..20: note = CRISPR gRNA sequence
  source 1..20: mol_type = other DNA
tgctgtcctcacgggctggg

SEQ ID NO: 74982 - DNA, 20 bp, synthetic construct
  misc_feature 1..20: note = CRISPR gRNA sequence
  source 1..20: mol_type = other DNA
ctgtcctcacgggctgggtg

SEQ ID NO: 74983 - DNA, 20 bp, synthetic construct
  misc_feature 1..20: note = CRISPR gRNA sequence
  source 1..20: mol_type = other DNA
tcctcacgggctgggtgggt

SEQ ID NO: 74984 - DNA, 20 bp, synthetic construct
  misc_feature 1..20: note = CRISPR gRNA sequence
  source 1..20: mol_type = other DNA
acgggctgggtgggtcactc

SEQ ID NO: 74985 - DNA, 20 bp, synthetic construct
  misc_feature 1..20: note = CRISPR gRNA sequence
  source 1..20: mol_type = other DNA
ggtgggtcactcacgtgagc

SEQ ID NO: 74986 - DNA, 20 bp, synthetic construct
  misc_feature 1..20: note = CRISPR gRNA sequence
  source 1..20: mol_type = other DNA
acgtgagctccgtcagctgc

SEQ ID NO: 74987 - DNA, 20 bp, synthetic construct
  misc_feature 1..20: note = CRISPR gRNA sequence
  source 1..20: mol_type = other DNA
cgtcagctgcagggacttgc

SEQ ID NO: 74988 - DNA, 20 bp, synthetic construct
  misc_feature 1..20: note = CRISPR gRNA sequence
  source 1..20: mol_type = other DNA
cagggacttgctcaagccgg

SEQ ID NO: 74989 - DNA, 20 bp, synthetic construct
  misc_feature 1..20: note = CRISPR gRNA sequence
  source 1..20: mol_type = other DNA
gctcaagccggtggccagcc

SEQ ID NO: 74990 - DNA, 20 bp, synthetic construct
  misc_feature 1..20: note = CRISPR gRNA sequence
  source 1..20: mol_type = other DNA
ctcaagccggtggccagcct

SEQ ID NO: 74991 - DNA, 20 bp, synthetic construct
  misc_feature 1..20: note = CRISPR gRNA sequence
  source 1..20: mol_type = other DNA
aagccggtggccagcctgga

SEQ ID NO: 74992 - DNA, 20 bp, synthetic construct
  misc_feature 1..20: note = CRISPR gRNA sequence
  source 1..20: mol_type = other DNA
gacacgtgctctggccggaa

SEQ ID NO: 74993 - DNA, 20 bp, synthetic construct
  misc_feature 1..20: note = CRISPR gRNA sequence
  source 1..20: mol_type = other DNA
tggccggaagctgcactcac

SEQ ID NO: 74994 - DNA, 20 bp, synthetic construct
  misc_feature 1..20: note = CRISPR gRNA sequence
  source 1..20: mol_type = other DNA
gccggaagctgcactcactt

SEQ ID NO: 74995 - DNA, 20 bp, synthetic construct
  misc_feature 1..20: note = CRISPR gRNA sequence
  source 1..20: mol_type = other DNA
cactcacttagcctgagggc

SEQ ID NO: 74996 - DNA, 20 bp, synthetic construct
  misc_feature 1..20: note = CRISPR gRNA sequence
  source 1..20: mol_type = other DNA
acttagcctgagggcagaaa

SEQ ID NO: 74997 - DNA, 20 bp, synthetic construct
  misc_feature 1..20: note = CRISPR gRNA sequence
  source 1..20: mol_type = other DNA
agcctgagggcagaaagcca

SEQ ID NO: 74998 - DNA, 20 bp, synthetic construct
  misc_feature 1..20: note = CRISPR gRNA sequence
  source 1..20: mol_type = other DNA
gcctgagggcagaaagccag

SEQ ID NO: 74999 - DNA, 20 bp, synthetic construct
  misc_feature 1..20: note = CRISPR gRNA sequence
  source 1..20: mol_type = other DNA
agggcagaaagccagggcag

SEQ ID NO: 75000 - DNA, 20 bp, synthetic construct
  misc_feature 1..20: note = CRISPR gRNA sequence
  source 1..20: mol_type = other DNA
ggtgaggcctgtgggcactg

SEQ ID NO: 75001 - DNA, 20 bp, synthetic construct
  misc_feature 1..20: note = CRISPR gRNA sequence
  source 1..20: mol_type = other DNA
tgggcactgctgctcagctt

SEQ ID NO: 75002 - DNA, 20 bp, synthetic construct
  misc_feature 1..20: note = CRISPR gRNA sequence
  source 1..20: mol_type = other DNA
ctgctcagcttcatctcagc

SEQ ID NO: 75003 - DNA, 20 bp, synthetic construct
  misc_feature 1..20: note = CRISPR gRNA sequence
  source 1..20: mol_type = other DNA
ctcagcttcatctcagcctc

SEQ ID NO: 75004 - DNA, 20 bp, synthetic construct
  misc_feature 1..20: note = CRISPR gRNA sequence
  source 1..20: mol_type = other DNA
agcttcatctcagcctccct

SEQ ID NO: 75005 - DNA, 20 bp, synthetic construct
  misc_feature 1..20: note = CRISPR gRNA sequence
  source 1..20: mol_type = other DNA
catctcagcctccctgaggg

SEQ ID NO: 75006 - DNA, 20 bp, synthetic construct
  misc_feature 1..20: note = CRISPR gRNA sequence
  source 1..20: mol_type = other DNA
atctcagcctccctgagggc

SEQ ID NO: 75007 - DNA, 20 bp, synthetic construct
  misc_feature 1..20: note = CRISPR gRNA sequence
  source 1..20: mol_type = other DNA
agcctccctgagggcctatt

SEQ ID NO: 75008 - DNA, 20 bp, synthetic construct
  misc_feature 1..20: note = CRISPR gRNA sequence
  source 1..20: mol_type = other DNA
cctgagggcctattggggga

SEQ ID NO: 75009 - DNA, 20 bp, synthetic construct
  misc_feature 1..20: note = CRISPR gRNA sequence
  source 1..20: mol_type = other DNA
agggcctattgggggagcat

SEQ ID NO: 75010 - DNA, 20 bp, synthetic construct
  misc_feature 1..20: note = CRISPR gRNA sequence
  source 1..20: mol_type = other DNA
ttgggggagcatcccacctc

SEQ ID NO: 75011 - DNA, 20 bp, synthetic construct
  misc_feature 1..20: note = CRISPR gRNA sequence
  source 1..20: mol_type = other DNA
ggggagcatcccacctctga

SEQ ID NO: 75012 - DNA, 20 bp, synthetic construct
  misc_feature 1..20: note = CRISPR gRNA sequence
  source 1..20: mol_type = other DNA
tgagggcaaaggcctggagc

SEQ ID NO: 75013 - DNA, 20 bp, synthetic construct
  misc_feature 1..20: note = CRISPR gRNA sequence
  source 1..20: mol_type = other DNA
agggcaaaggcctggagcag

SEQ ID NO: 75014 - DNA, 20 bp, synthetic construct
  misc_feature 1..20: note = CRISPR gRNA sequence
  source 1..20: mol_type = other DNA
gagcagggcctgagaggcca

SEQ ID NO: 75015 - DNA, 20 bp, synthetic construct
  misc_feature 1..20: note = CRISPR gRNA sequence
  source 1..20: mol_type = other DNA
agaggccaaatatgcagctc

SEQ ID NO: 75016 - DNA, 20 bp, synthetic construct
  misc_feature 1..20: note = CRISPR gRNA sequence
  source 1..20: mol_type = other DNA
ctgctctgggagcttcctgt

SEQ ID NO: 75017 - DNA, 20 bp, synthetic construct
  misc_feature 1..20: note = CRISPR gRNA sequence
  source 1..20: mol_type = other DNA
ctctgggagcttcctgtctc

SEQ ID NO: 75018 - DNA, 20 bp, synthetic construct
  misc_feature 1..20: note = CRISPR gRNA sequence
  source 1..20: mol_type = other DNA
tgggagcttcctgtctcttt

SEQ ID NO: 75019 - DNA, 20 bp, synthetic construct
  misc_feature 1..20: note = CRISPR gRNA sequence
  source 1..20: mol_type = other DNA
ggagcttcctgtctctttgg

SEQ ID NO: 75020 - DNA, 20 bp, synthetic construct
  misc_feature 1..20: note = CRISPR gRNA sequence
  source 1..20: mol_type = other DNA
cctgtctctttggggaggaa

SEQ ID NO: 75021 - DNA, 20 bp, synthetic construct
  misc_feature 1..20: note = CRISPR gRNA sequence
  source 1..20: mol_type = other DNA
ctgtctctttggggaggaac

SEQ ID NO: 75022 - DNA, 20 bp, synthetic construct
  misc_feature 1..20: note = CRISPR gRNA sequence
  source 1..20: mol_type = other DNA
tctctttggggaggaacctc

SEQ ID NO: 75023 - DNA, 20 bp, synthetic construct
  misc_feature 1..20: note = CRISPR gRNA sequence
  source 1..20: mol_type = other DNA
tttggggaggaacctcccac

SEQ ID NO: 75024 - DNA, 20 bp, synthetic construct
  misc_feature 1..20: note = CRISPR gRNA sequence
  source 1..20: mol_type = other DNA
tggggaggaacctcccacac

SEQ ID NO: 75025 - DNA, 20 bp, synthetic construct
  misc_feature 1..20: note = CRISPR gRNA sequence
  source 1..20: mol_type = other DNA
ggggaggaacctcccacacc

SEQ ID NO: 75026 - DNA, 20 bp, synthetic construct
  misc_feature 1..20: note = CRISPR gRNA sequence
  source 1..20: mol_type = other DNA
gggaggaacctcccacaccc

SEQ ID NO: 75027 - DNA, 20 bp, synthetic construct
  misc_feature 1..20: note = CRISPR gRNA sequence
  source 1..20: mol_type = other DNA
ccacaccccctgtaagaaag

SEQ ID NO: 75028 - DNA, 20 bp, synthetic construct
  misc_feature 1..20: note = CRISPR gRNA sequence
  source 1..20: mol_type = other DNA
taagaaagtattaggagtaa

SEQ ID NO: 75029 - DNA, 20 bp, synthetic construct
  misc_feature 1..20: note = CRISPR gRNA sequence
  source 1..20: mol_type = other DNA
ggagtaagttatttagggag

SEQ ID NO: 75030 - DNA, 20 bp, synthetic construct
  misc_feature 1..20: note = CRISPR gRNA sequence
  source 1..20: mol_type = other DNA
tttagggaggctgactctag

SEQ ID NO: 75031 - DNA, 20 bp, synthetic construct
  misc_feature 1..20: note = CRISPR gRNA sequence
  source 1..20: mol_type = other DNA
agggaggctgactctaggtc

SEQ ID NO: 75032 - DNA, 20 bp, synthetic construct
  misc_feature 1..20: note = CRISPR gRNA sequence
  source 1..20: mol_type = other DNA
gggaggctgactctaggtca

SEQ ID NO: 75033 - DNA, 20 bp, synthetic construct
  misc_feature 1..20: note = CRISPR gRNA sequence
  source 1..20: mol_type = other DNA
actctaggtcaggcactgtg

SEQ ID NO: 75034 - DNA, 20 bp, synthetic construct
  misc_feature 1..20: note = CRISPR gRNA sequence
  source 1..20: mol_type = other DNA
taggtcaggcactgtgccag

SEQ ID NO: 75035 - DNA, 20 bp, synthetic construct
  misc_feature 1..20: note = CRISPR gRNA sequence
  source 1..20: mol_type = other DNA
ggtcaggcactgtgccagcc

SEQ ID NO: 75036 - DNA, 20 bp, synthetic construct
  misc_feature 1..20: note = CRISPR gRNA sequence
  source 1..20: mol_type = other DNA
tgccagcctctgggtgcatg

SEQ ID NO: 75037 - DNA, 20 bp, synthetic construct
  misc_feature 1..20: note = CRISPR gRNA sequence
  source 1..20: mol_type = other DNA
tgggtgcatgggacttcctg

SEQ ID NO: 75038 - DNA, 20 bp, synthetic construct
  misc_feature 1..20: note = CRISPR gRNA sequence
  source 1..20: mol_type = other DNA
ggtgcatgggacttcctgcc

SEQ ID NO: 75039 - DNA, 20 bp, synthetic construct
  misc_feature 1..20: note = CRISPR gRNA sequence
  source 1..20: mol_type = other DNA
cctgccttacccgcagggtc

SEQ ID NO: 75040 - DNA, 20 bp, synthetic construct
  misc_feature 1..20: note = CRISPR gRNA sequence
  source 1..20: mol_type = other DNA
ctgccttacccgcagggtct

SEQ ID NO: 75041 - DNA, 20 bp, synthetic construct
  misc_feature 1..20: note = CRISPR gRNA sequence
  source 1..20: mol_type = other DNA
ccttacccgcagggtctcct

SEQ ID NO: 75042 - DNA, 20 bp, synthetic construct
  misc_feature 1..20: note = CRISPR gRNA sequence
  source 1..20: mol_type = other DNA
acccgcagggtctcctttaa

SEQ ID NO: 75043 - DNA, 20 bp, synthetic construct
  misc_feature 1..20: note = CRISPR gRNA sequence
  source 1..20: mol_type = other DNA
cccgcagggtctcctttaat

SEQ ID NO: 75044 - DNA, 20 bp, synthetic construct
  misc_feature 1..20: note = CRISPR gRNA sequence
  source 1..20: mol_type = other DNA
ctttaattctcatagcacca

SEQ ID NO: 75045 - DNA, 20 bp, synthetic construct
  misc_feature 1..20: note = CRISPR gRNA sequence
  source 1..20: mol_type = other DNA
taattctcatagcaccaatt

SEQ ID NO: 75046 - DNA, 20 bp, synthetic construct
  misc_feature 1..20: note = CRISPR gRNA sequence
  source 1..20: mol_type = other DNA
aattctcatagcaccaatta

SEQ ID NO: 75047 - DNA, 20 bp, synthetic construct
  misc_feature 1..20: note = CRISPR gRNA sequence
  source 1..20: mol_type = other DNA
attctcatagcaccaattag

SEQ ID NO: 75048 - DNA, 20 bp, synthetic construct
  misc_feature 1..20: note = CRISPR gRNA sequence
  source 1..20: mol_type = other DNA
tcatagcaccaattagaggt

SEQ ID NO: 75049 - DNA, 20 bp, synthetic construct
  misc_feature 1..20: note = CRISPR gRNA sequence
  source 1..20: mol_type = other DNA
atagcaccaattagaggtgg

SEQ ID NO: 75050 - DNA, 20 bp, synthetic construct
  misc_feature 1..20: note = CRISPR gRNA sequence
  source 1..20: mol_type = other DNA
gaggtggggaaactgactaa

SEQ ID NO: 75051 - DNA, 20 bp, synthetic construct
  misc_feature 1..20: note = CRISPR gRNA sequence
  source 1..20: mol_type = other DNA
actaacccaaggacacacag

SEQ ID NO: 75052 - DNA, 20 bp, synthetic construct
  misc_feature 1..20: note = CRISPR gRNA sequence
  source 1..20: mol_type = other DNA
acccaaggacacacagcaga

SEQ ID NO: 75053 - DNA, 20 bp, synthetic construct
  misc_feature 1..20: note = CRISPR gRNA sequence
  source 1..20: mol_type = other DNA
gtttccatccaggtcagtct

SEQ ID NO: 75054 - DNA, 20 bp, synthetic construct
  misc_feature 1..20: note = CRISPR gRNA sequence
  source 1..20: mol_type = other DNA
ccatccaggtcagtctgact

SEQ ID NO: 75055 - DNA, 20 bp, synthetic construct
  misc_feature 1..20: note = CRISPR gRNA sequence
  source 1..20: mol_type = other DNA
catccaggtcagtctgactg

SEQ ID NO: 75056 - DNA, 20 bp, synthetic construct
  misc_feature 1..20: note = CRISPR gRNA sequence
  source 1..20: mol_type = other DNA
actgcagaccccaagctctt

SEQ ID NO: 75057 - DNA, 20 bp, synthetic construct
  misc_feature 1..20: note = CRISPR gRNA sequence
  source 1..20: mol_type = other DNA
cagaccccaagctcttaacc

SEQ ID NO: 75058 - DNA, 20 bp, synthetic construct
  misc_feature 1..20: note = CRISPR gRNA sequence
  source 1..20: mol_type = other DNA
ttaaccactgccttactctc

SEQ ID NO: 75059 - DNA, 20 bp, synthetic construct
  misc_feature 1..20: note = CRISPR gRNA sequence
  source 1..20: mol_type = other DNA
aaccactgccttactctccc

SEQ ID NO: 75060 - DNA, 20 bp, synthetic construct
  misc_feature 1..20: note = CRISPR gRNA sequence
  source 1..20: mol_type = other DNA
accactgccttactctcccg

SEQ ID NO: 75061 - DNA, 20 bp, synthetic construct
  misc_feature 1..20: note = CRISPR gRNA sequence
  source 1..20: mol_type = other DNA
ccttactctcccggaccagc

SEQ ID NO: 75062 - DNA, 20 bp, synthetic construct
  misc_feature 1..20: note = CRISPR gRNA sequence
  source 1..20: mol_type = other DNA
actctcccggaccagcactg

SEQ ID NO: 75063 - DNA, 20 bp, synthetic construct
  misc_feature 1..20: note = CRISPR gRNA sequence
  source 1..20: mol_type = other DNA
ctctcccggaccagcactgg

SEQ ID NO: 75064 - DNA, 20 bp, synthetic construct
  misc_feature 1..20: note = CRISPR gRNA sequence
  source 1..20: mol_type = other DNA
tcccggaccagcactggctg

SEQ ID NO: 75065 - DNA, 20 bp, synthetic construct
  misc_feature 1..20: note = CRISPR gRNA sequence
  source 1..20: mol_type = other DNA
ccggaccagcactggctgag

SEQ ID NO: 75066 - DNA, 20 bp, synthetic construct
  misc_feature 1..20: note = CRISPR gRNA sequence
  source 1..20: mol_type = other DNA
gctgagctccctggggaggg

SEQ ID NO: 75067 - DNA, 20 bp, synthetic construct
  misc_feature 1..20: note = CRISPR gRNA sequence
  source 1..20: mol_type = other DNA
agctccctggggagggaggt

SEQ ID NO: 75068 - DNA, 20 bp, synthetic construct
  misc_feature 1..20: note = CRISPR gRNA sequence
  source 1..20: mol_type = other DNA
cctggggagggaggtgtgcc

SEQ ID NO: 75069 - DNA, 20 bp, synthetic construct
  misc_feature 1..20: note = CRISPR gRNA sequence
  source 1..20: mol_type = other DNA
gggagggaggtgtgcctggg

SEQ ID NO: 75070 - DNA, 20 bp, synthetic construct
  misc_feature 1..20: note = CRISPR gRNA sequence
  source 1..20: mol_type = other DNA
ggattctccgtggggctctg

SEQ ID NO: 75071 - DNA, 20 bp, synthetic construct
  misc_feature 1..20: note = CRISPR gRNA sequence
  source 1..20: mol_type = other DNA
tccgtggggctctgctgtcc

SEQ ID NO: 75072 - DNA, 20 bp, synthetic construct
  misc_feature 1..20: note = CRISPR gRNA sequence
  source 1..20: mol_type = other DNA
cgtggggctctgctgtccag

SEQ ID NO: 75073 - DNA, 20 bp, synthetic construct
  misc_feature 1..20: note = CRISPR gRNA sequence
  source 1..20: mol_type = other DNA
tgctgtccaggcatctcagc

SEQ ID NO: 75074 - DNA, 20 bp, synthetic construct
  misc_feature 1..20: note = CRISPR gRNA sequence
  source 1..20: mol_type = other DNA
ctgtccaggcatctcagccc

SEQ ID NO: 75075 - DNA, 20 bp, synthetic construct
  misc_feature 1..20: note = CRISPR gRNA sequence
  source 1..20: mol_type = other DNA
tccaggcatctcagccctgg

SEQ ID NO: 75076 - DNA, 20 bp, synthetic construct
  misc_feature 1..20: note = CRISPR gRNA sequence
  source 1..20: mol_type = other DNA
agccctgggtggccagcaga

SEQ ID NO: 75077 - DNA, 20 bp, synthetic construct
  misc_feature 1..20: note = CRISPR gRNA sequence
  source 1..20: mol_type = other DNA
ggtggccagcagacgggccc

SEQ ID NO: 75078 - DNA, 20 bp, synthetic construct
  misc_feature 1..20: note = CRISPR gRNA sequence
  source 1..20: mol_type = other DNA
ggggcagttcactctgatga

SEQ ID NO: 75079 - DNA, 20 bp, synthetic construct
  misc_feature 1..20: note = CRISPR gRNA sequence
  source 1..20: mol_type = other DNA
actctgatgaggcagggctg

SEQ ID NO: 75080 - DNA, 20 bp, synthetic construct
  misc_feature 1..20: note = CRISPR gRNA sequence
  source 1..20: mol_type = other DNA
tgatgaggcagggctgctgg

SEQ ID NO: 75081 - DNA, 20 bp, synthetic construct
  misc_feature 1..20: note = CRISPR gRNA sequence
  source 1..20: mol_type = other DNA
atgaggcagggctgctggga

SEQ ID NO: 75082 - DNA, 20 bp, synthetic construct
  misc_feature 1..20: note = CRISPR gRNA sequence
  source 1..20: mol_type = other DNA
ctgggatacttccaggaggg

SEQ ID NO: 75083 - DNA, 20 bp, synthetic construct
  misc_feature 1..20: note = CRISPR gRNA sequence
  source 1..20: mol_type = other DNA
ggatacttccaggaggggct

SEQ ID NO: 75084 - DNA, 20 bp, synthetic construct
  misc_feature 1..20: note = CRISPR gRNA sequence
  source 1..20: mol_type = other DNA
ccaggaggggctgatgtttg

SEQ ID NO: 75085 - DNA, 20 bp, synthetic construct
  misc_feature 1..20: note = CRISPR gRNA sequence
  source 1..20: mol_type = other DNA
caggaggggctgatgtttga

SEQ ID NO: 75086 - DNA, 20 bp, synthetic construct
  misc_feature 1..20: note = CRISPR gRNA sequence
  source 1..20: mol_type = other DNA
atgtttgagctgggtgttaa

SEQ ID NO: 75087 - DNA, 20 bp, synthetic construct
  misc_feature 1..20: note = CRISPR gRNA sequence
  source 1..20: mol_type = other DNA
gagctgggtgttaaaggatt

SEQ ID NO: 75088 - DNA, 20 bp, synthetic construct
  misc_feature 1..20: note = CRISPR gRNA sequence
  source 1..20: mol_type = other DNA
agctgggtgttaaaggattg

SEQ ID NO: 75089 - DNA, 20 bp, synthetic construct
  misc_feature 1..20: note = CRISPR gRNA sequence
  source 1..20: mol_type = other DNA
ggtgttaaaggattgggaga

SEQ ID NO: 75090 - DNA, 20 bp, synthetic construct
  misc_feature 1..20: note = CRISPR gRNA sequence
  source 1..20: mol_type = other DNA
aaggattgggagaattttat

SEQ ID NO: 75091 - DNA, 20 bp, synthetic construct
  misc_feature 1..20: note = CRISPR gRNA sequence
  source 1..20: mol_type = other DNA
ggagaattttatctcagaaa

SEQ ID NO: 75092 - DNA, 20 bp, synthetic construct
  misc_feature 1..20: note = CRISPR gRNA sequence
  source 1..20: mol_type = other DNA
tatctcagaaaaggcaagga

SEQ ID NO: 75093 - DNA, 20 bp, synthetic construct
  misc_feature 1..20: note = CRISPR gRNA sequence
  source 1..20: mol_type = other DNA
atctcagaaaaggcaaggaa

SEQ ID NO: 75094 - DNA, 20 bp, synthetic construct
  misc_feature 1..20: note = CRISPR gRNA sequence
  source 1..20: mol_type = other DNA
tctcagaaaaggcaaggaag

SEQ ID NO: 75095 - DNA, 20 bp, synthetic construct
  misc_feature 1..20: note = CRISPR gRNA sequence
  source 1..20: mol_type = other DNA
agaaaaggcaaggaagagaa

SEQ ID NO: 75096 - DNA, 20 bp, synthetic construct
  misc_feature 1..20: note = CRISPR gRNA sequence
  source 1..20: mol_type = other DNA
agctgagtgcggtgtgagca

SEQ ID NO: 75097 - DNA, 20 bp, synthetic construct
  misc_feature 1..20: note = CRISPR gRNA sequence
  source 1..20: mol_type = other DNA
agtgcggtgtgagcagaggc

SEQ ID NO: 75098 - DNA, 20 bp, synthetic construct
  misc_feature 1..20: note = CRISPR gRNA sequence
  source 1..20: mol_type = other DNA
caggcagggcttgatctagg

SEQ ID NO: 75099 - DNA, 20 bp, synthetic construct
  misc_feature 1..20: note = CRISPR gRNA sequence
  source 1..20: mol_type = other DNA
aggcagggcttgatctagga

SEQ ID NO: 75100 - DNA, 20 bp, synthetic construct
  misc_feature 1..20: note = CRISPR gRNA sequence
  source 1..20: mol_type = other DNA
gatctaggagcaaatagtga

SEQ ID NO: 75101 - DNA, 20 bp, synthetic construct
  misc_feature 1..20: note = CRISPR gRNA sequence
  source 1..20: mol_type = other DNA
atctaggagcaaatagtgaa

SEQ ID NO: 75102 - DNA, 20 bp, synthetic construct
  misc_feature 1..20: note = CRISPR gRNA sequence
  source 1..20: mol_type = other DNA
ggagcaaatagtgaaggtta

SEQ ID NO: 75103 - DNA, 20 bp, synthetic construct
  misc_feature 1..20: note = CRISPR gRNA sequence
  source 1..20: mol_type = other DNA
tggctgaactgtgtgtgtgt

SEQ ID NO: 75104 - DNA, 20 bp, synthetic construct
  misc_feature 1..20: note = CRISPR gRNA sequence
  source 1..20: mol_type = other DNA
aactgtgtgtgtgtgtgtgt

SEQ ID NO: 75105 - DNA, 20 bp, synthetic construct
  misc_feature 1..20: note = CRISPR gRNA sequence
  source 1..20: mol_type = other DNA
tgtgtgtgtgtgtgtgttgt

SEQ ID NO: 75106 - DNA, 20 bp, synthetic construct
  misc_feature 1..20: note = CRISPR gRNA sequence
  source 1..20: mol_type = other DNA
tgtatgtggtatttgtaggt

SEQ ID NO: 75107 - DNA, 20 bp, synthetic construct
  misc_feature 1..20: note = CRISPR gRNA sequence
  source 1..20: mol_type = other DNA
gtaggtattatgtggtgtgt

SEQ ID NO: 75108 - DNA, 20 bp, synthetic construct
  misc_feature 1..20: note = CRISPR gRNA sequence
  source 1..20: mol_type = other DNA
taggtattatgtggtgtgtg

SEQ ID NO: 75109 - DNA, 20 bp, synthetic construct
  misc_feature 1..20: note = CRISPR gRNA sequence
  source 1..20: mol_type = other DNA
tgtggtgtgtgtgctgtatt

SEQ ID NO: 75110 - DNA, 20 bp, synthetic construct
  misc_feature 1..20: note = CRISPR gRNA sequence
  source 1..20: mol_type = other DNA
tatttgtaatgtgccaggta

SEQ ID NO: 75111 - DNA, 20 bp, synthetic construct
  misc_feature 1..20: note = CRISPR gRNA sequence
  source 1..20: mol_type = other DNA
gtaatgtgccaggtatgtat

SEQ ID NO: 75112 - DNA, 20 bp, synthetic construct
  misc_feature 1..20: note = CRISPR gRNA sequence
  source 1..20: mol_type = other DNA
taatgtgccaggtatgtatg

SEQ ID NO: 75113 - DNA, 20 bp, synthetic construct
  misc_feature 1..20: note = CRISPR gRNA sequence
  source 1..20: mol_type = other DNA
gtttttgtggggtgtgtgta

SEQ ID NO: 75114 - DNA, 20 bp, synthetic construct
  misc_feature 1..20: note = CRISPR gRNA sequence
  source 1..20: mol_type = other DNA
tttttgtggggtgtgtgtat

SEQ ID NO: 75115 - DNA, 20 bp, synthetic construct
  misc_feature 1..20: note = CRISPR gRNA sequence
  source 1..20: mol_type = other DNA
ttgtggggtgtgtgtattgt

SEQ ID NO: 75116 - DNA, 20 bp, synthetic construct
  misc_feature 1..20: note = CRISPR gRNA sequence
  source 1..20: mol_type = other DNA
tgtggggtgtgtgtattgtg

SEQ ID NO: 75117 - DNA, 20 bp, synthetic construct
  misc_feature 1..20: note = CRISPR gRNA sequence
  source 1..20: mol_type = other DNA
gtggggtgtgtgtattgtgt

SEQ ID NO: 75118 - DNA, 20 bp, synthetic construct
  misc_feature 1..20: note = CRISPR gRNA sequence
  source 1..20: mol_type = other DNA
tggggtgtgtgtattgtgtg

SEQ ID NO: 75119 - DNA, 20 bp, synthetic construct
  misc_feature 1..20: note = CRISPR gRNA sequence
  source 1..20: mol_type = other DNA
tgtggtgtgtgtggtgtatg

SEQ ID NO: 75120 - DNA, 20 bp, synthetic construct
  misc_feature 1..20: note = CRISPR gRNA sequence
  source 1..20: mol_type = other DNA
gtgtgttgtgtgtgctgtgt

SEQ ID NO: 75121 - DNA, 20 bp, synthetic construct
  misc_feature 1..20: note = CRISPR gRNA sequence
  source 1..20: mol_type = other DNA
tgtgttgtgtgtgctgtgtg

SEQ ID NO: 75122 - DNA, 20 bp, synthetic construct
  misc_feature 1..20: note = CRISPR gRNA sequence
  source 1..20: mol_type = other DNA
tgtgtgctgtgtggtgtgcg

SEQ ID NO: 75123 - DNA, 20 bp, synthetic construct
  misc_feature 1..20: note = CRISPR gRNA sequence
  source 1..20: mol_type = other DNA
tgtggtgtgcgtgtgttgtg

SEQ ID NO: 75124 - DNA, 20 bp, synthetic construct
  misc_feature 1..20: note = CRISPR gRNA sequence
  source 1..20: mol_type = other DNA
tgtgtgctgcgtgctgtgtg

SEQ ID NO: 75125 - DNA, 20 bp, synthetic construct
  misc_feature 1..20: note = CRISPR gRNA sequence
  source 1..20: mol_type = other DNA
cgtgctgtgtggtgtgtttg

SEQ ID NO: 75126 - DNA, 20 bp, synthetic construct
  misc_feature 1..20: note = CRISPR gRNA sequence
  source 1..20: mol_type = other DNA
tgtggtgtgtttgggtgtgc

SEQ ID NO: 75127 - DNA, 20 bp, synthetic construct
  misc_feature 1..20: note = CRISPR gRNA sequence
  source 1..20: mol_type = other DNA
gggtgtgcttggtgtatctg

SEQ ID NO: 75128 - DNA, 20 bp, synthetic construct
  misc_feature 1..20: note = CRISPR gRNA sequence
  source 1..20: mol_type = other DNA
ggtgtgcttggtgtatctgt

SEQ ID NO: 75129 - DNA, 20 bp, synthetic construct
  misc_feature 1..20: note = CRISPR gRNA sequence
  source 1..20: mol_type = other DNA
ggtgtatctgtggtatatgg

SEQ ID NO: 75130 - DNA, 20 bp, synthetic construct
  misc_feature 1..20: note = CRISPR gRNA sequence
  source 1..20: mol_type = other DNA
gtgtatctgtggtatatggg

SEQ ID NO: 75131 - DNA, 20 bp, synthetic construct
  misc_feature 1..20: note = CRISPR gRNA sequence
  source 1..20: mol_type = other DNA
tggtatatgggttggtgtgt

SEQ ID NO: 75132 - DNA, 20 bp, synthetic construct
  misc_feature 1..20: note = CRISPR gRNA sequence
  source 1..20: mol_type = other DNA
gtgtgtagggcgtgtgtgtg

SEQ ID NO: 75133 - DNA, 20 bp, synthetic construct
  misc_feature 1..20: note = CRISPR gRNA sequence
  source 1..20: mol_type = other DNA
gatcagactgtgagggagaa

SEQ ID NO: 75134 - DNA, 20 bp, synthetic construct
  misc_feature 1..20: note = CRISPR gRNA sequence
  source 1..20: mol_type = other DNA
tgagggagaagatgctaggg

SEQ ID NO: 75135 - DNA, 20 bp, synthetic construct
  misc_feature 1..20: note = CRISPR gRNA sequence
  source 1..20: mol_type = other DNA
gggactttgaacttcaccct

SEQ ID NO: 75136 - DNA, 20 bp, synthetic construct
  misc_feature 1..20: note = CRISPR gRNA sequence
  source 1..20: mol_type = other DNA
tgaacttcaccctggggtta

SEQ ID NO: 75137 - DNA, 20 bp, synthetic construct
  misc_feature 1..20: note = CRISPR gRNA sequence
  source 1..20: mol_type = other DNA
gaacttcaccctggggttaa

SEQ ID NO: 75138 - DNA, 20 bp, synthetic construct
  misc_feature 1..20: note = CRISPR gRNA sequence
  source 1..20: mol_type = other DNA
aacttcaccctggggttaat

SEQ ID NO: 75139 - DNA, 20 bp, synthetic construct
  misc_feature 1..20: note = CRISPR gRNA sequence
  source 1..20: mol_type = other DNA
caccctggggttaatgggga

SEQ ID NO: 75140 - DNA, 20 bp, synthetic construct
  misc_feature 1..20: note = CRISPR gRNA sequence
  source 1..20: mol_type = other DNA
accctggggttaatggggag

SEQ ID NO: 75141 - DNA, 20 bp, synthetic construct
  misc_feature 1..20: note = CRISPR gRNA sequence
  source 1..20: mol_type = other DNA
gggttaatggggagccactg

SEQ ID NO: 75142 - DNA, 20 bp, synthetic construct
  misc_feature 1..20: note = CRISPR gRNA sequence
  source 1..20: mol_type = other DNA
atggggagccactgaggggc

SEQ ID NO: 75143 - DNA, 20 bp, synthetic construct
  misc_feature 1..20: note = CRISPR gRNA sequence
  source 1..20: mol_type = other DNA
aggggcacagagtagcagag

SEQ ID NO: 75144 - DNA, 20 bp, synthetic construct
  misc_feature 1..20: note = CRISPR gRNA sequence
  source 1..20: mol_type = other DNA
tcagatgtgtgttgtgaaga

SEQ ID NO: 75145 - DNA, 20 bp, synthetic construct
  misc_feature 1..20: note = CRISPR gRNA sequence
  source 1..20: mol_type = other DNA
tgaagatccctctgggggct

SEQ ID NO: 75146 - DNA, 20 bp, synthetic construct
  misc_feature 1..20: note = CRISPR gRNA sequence
  source 1..20: mol_type = other DNA
tgggggctgtggagtgaatg

SEQ ID NO: 75147 - DNA, 20 bp, synthetic construct
  misc_feature 1..20: note = CRISPR gRNA sequence
  source 1..20: mol_type = other DNA
ggggctgtggagtgaatgga

SEQ ID NO: 75148 - DNA, 20 bp, synthetic construct
  misc_feature 1..20: note = CRISPR gRNA sequence
  source 1..20: mol_type = other DNA
tggagtgaatggaggggagg

SEQ ID NO: 75149 - DNA, 20 bp, synthetic construct
  misc_feature 1..20: note = CRISPR gRNA sequence
  source 1..20: mol_type = other DNA
ataagatgcagggatcagtt

SEQ ID NO: 75150 - DNA, 20 bp, synthetic construct
  misc_feature 1..20: note = CRISPR gRNA sequence
  source 1..20: mol_type = other DNA
ggaggccctgttcacagctg

SEQ ID NO: 75151 - DNA, 20 bp, synthetic construct
  misc_feature 1..20: note = CRISPR gRNA sequence
  source 1..20: mol_type = other DNA
gaggccctgttcacagctga

SEQ ID NO: 75152 - DNA, 20 bp, synthetic construct
  misc_feature 1..20: note = CRISPR gRNA sequence
  source 1..20: mol_type = other DNA
ttcacagctgaagtaagaca

SEQ ID NO: 75153 - DNA, 20 bp, synthetic construct
  misc_feature 1..20: note = CRISPR gRNA sequence
  source 1..20: mol_type = other DNA
acagctgaagtaagacatgt

SEQ ID NO: 75154 - DNA, 20 bp, synthetic construct
  misc_feature 1..20: note = CRISPR gRNA sequence
  source 1..20: mol_type = other DNA
aagtaagacatgtaaaggaa

SEQ ID NO: 75155 - DNA, 20 bp, synthetic construct
  misc_feature 1..20: note = CRISPR gRNA sequence
  source 1..20: mol_type = other DNA
gccgtggcagtgagtcaggg

SEQ ID NO: 75156 - DNA, 20 bp, synthetic construct
  misc_feature 1..20: note = CRISPR gRNA sequence
  source 1..20: mol_type = other DNA
ccaggggtaatgataatgat

SEQ ID NO: 75157 - DNA, 20 bp, synthetic construct
  misc_feature 1..20: note = CRISPR gRNA sequence
  source 1..20: mol_type = other DNA
caataactgctgacagcact

SEQ ID NO: 75158 - DNA, 20 bp, synthetic construct
  misc_feature 1..20: note = CRISPR gRNA sequence
  source 1..20: mol_type = other DNA
ctgacagcactcccatgagc

SEQ ID NO: 75159 - DNA, 20 bp, synthetic construct
  misc_feature 1..20: note = CRISPR gRNA sequence
  source 1..20: mol_type = other DNA
acagcactcccatgagccag

SEQ ID NO: 75160 - DNA, 20 bp, synthetic construct
  misc_feature 1..20: note = CRISPR gRNA sequence
  source 1..20: mol_type = other DNA
ccatgagccagaccttttcc

SEQ ID NO: 75161 - DNA, 20 bp, synthetic construct
  misc_feature 1..20: note = CRISPR gRNA sequence
  source 1..20: mol_type = other DNA
ttcctggcactttatactta

SEQ ID NO: 75162 - DNA, 20 bp, synthetic construct
  misc_feature 1..20: note = CRISPR gRNA sequence
  source 1..20: mol_type = other DNA
tcctggcactttatacttat

SEQ ID NO: 75163 - DNA, 20 bp, synthetic construct
  misc_feature 1..20: note = CRISPR gRNA sequence
  source 1..20: mol_type = other DNA
cctggcactttatacttatt

SEQ ID NO: 75164 - DNA, 20 bp, synthetic construct
  misc_feature 1..20: note = CRISPR gRNA sequence
  source 1..20: mol_type = other DNA
ctggcactttatacttatta

SEQ ID NO: 75165 - DNA, 20 bp, synthetic construct
  misc_feature 1..20: note = CRISPR gRNA sequence
  source 1..20: mol_type = other DNA
gcactttatacttattaact

SEQ ID NO: 75166 - DNA, 20 bp, synthetic construct
  misc_feature 1..20: note = CRISPR gRNA sequence
  source 1..20: mol_type = other DNA
tatacttattaactcattta

SEQ ID NO: 75167 - DNA, 20 bp, synthetic construct
  misc_feature 1..20: note = CRISPR gRNA sequence
  source 1..20: mol_type = other DNA
atacttattaactcatttaa

SEQ ID NO: 75168 - DNA, 20 bp, synthetic construct
  misc_feature 1..20: note = CRISPR gRNA sequence
  source 1..20: mol_type = other DNA
tacttattaactcatttaat

SEQ ID NO: 75169 - DNA, 20 bp, synthetic construct
  misc_feature 1..20: note = CRISPR gRNA sequence
  source 1..20: mol_type = other DNA
attaactcatttaatcctca

SEQ ID NO: 75170 - DNA, 20 bp, synthetic construct
  misc_feature 1..20: note = CRISPR gRNA sequence
  source 1..20: mol_type = other DNA
ttaactcatttaatcctcac

SEQ ID NO: 75171 - DNA, 20 bp, synthetic construct
  misc_feature 1..20: note = CRISPR gRNA sequence
  source 1..20: mol_type = other DNA
actcatttaatcctcacaat

SEQ ID NO: 75172 - DNA, 20 bp, synthetic construct
  misc_feature 1..20: note = CRISPR gRNA sequence
  source 1..20: mol_type = other DNA
atttaatcctcacaataacc

SEQ ID NO: 75173 - DNA, 20 bp, synthetic construct
  misc_feature 1..20: note = CRISPR gRNA sequence
  source 1..20: mol_type = other DNA
aatcctcacaataaccctaa

SEQ ID NO: 75174 - DNA, 20 bp, synthetic construct
  misc_feature 1..20: note = CRISPR gRNA sequence
  source 1..20: mol_type = other DNA
atcctcacaataaccctaag

SEQ ID NO: 75175 - DNA, 20 bp, synthetic construct
  misc_feature 1..20: note = CRISPR gRNA sequence
  source 1..20: mol_type = other DNA
acaataaccctaaggggtag

SEQ ID NO: 75176 - DNA, 20 bp, synthetic construct
  misc_feature 1..20: note = CRISPR gRNA sequence
  source 1..20: mol_type = other DNA
aggggtaggttgtgttatta

SEQ ID NO: 75177 - DNA, 20 bp, synthetic construct
  misc_feature 1..20: note = CRISPR gRNA sequence
  source 1..20: mol_type = other DNA
tgttattatccccattttac

SEQ ID NO: 75178 - DNA, 20 bp, synthetic construct
  misc_feature 1..20: note = CRISPR gRNA sequence
  source 1..20: mol_type = other DNA
ttatccccattttacttgtc

SEQ ID NO: 75179 - DNA, 20 bp, synthetic construct
  misc_feature 1..20: note = CRISPR gRNA sequence
  source 1..20: mol_type = other DNA
tccccattttacttgtccag

SEQ ID NO: 75180 - DNA, 20 bp, synthetic construct
  misc_feature 1..20: note = CRISPR gRNA sequence
  source 1..20: mol_type = other DNA
tacttgtccagggccacata

SEQ ID NO: 75181 - DNA, 20 bp, synthetic construct
  misc_feature 1..20: note = CRISPR gRNA sequence
  source 1..20: mol_type = other DNA
acttgtccagggccacatag

SEQ ID NO: 75182 - DNA, 20 bp, synthetic construct
  misc_feature 1..20: note = CRISPR gRNA sequence
  source 1..20: mol_type = other DNA
cttgtccagggccacatagc

SEQ ID NO: 75183 - DNA, 20 bp, synthetic construct
  misc_feature 1..20: note = CRISPR gRNA sequence
  source 1..20: mol_type = other DNA
gtccagggccacatagctgg

SEQ ID NO: 75184 - DNA, 20 bp, synthetic construct
  misc_feature 1..20: note = CRISPR gRNA sequence
  source 1..20: mol_type = other DNA
tccagggccacatagctggt

SEQ ID NO: 75185 - DNA, 20 bp, synthetic construct
  misc_feature 1..20: note = CRISPR gRNA sequence
  source 1..20: mol_type = other DNA
gtaagtggcagatcagggat

SEQ ID NO: 75186 - DNA, 20 bp, synthetic construct
  misc_feature 1..20: note = CRISPR gRNA sequence
  source 1..20: mol_type = other DNA
attttcagttggcttcaaaa

SEQ ID NO: 75187 - DNA, 20 bp, synthetic construct
  misc_feature 1..20: note = CRISPR gRNA sequence
  source 1..20: mol_type = other DNA
ttttcagttggcttcaaaat

SEQ ID NO: 75188 - DNA, 20 bp, synthetic construct
  misc_feature 1..20: note = CRISPR gRNA sequence
  source 1..20: mol_type = other DNA
tcagttggcttcaaaatctt

SEQ ID NO: 75189 - DNA, 20 bp, synthetic construct
  misc_feature 1..20: note = CRISPR gRNA sequence
  source 1..20: mol_type = other DNA
cagttggcttcaaaatcttt

SEQ ID NO: 75190 - DNA, 20 bp, synthetic construct
  misc_feature 1..20: note = CRISPR gRNA sequence
  source 1..20: mol_type = other DNA
agttggcttcaaaatcttta

SEQ ID NO: 75191 - DNA, 20 bp, synthetic construct
  misc_feature 1..20: note = CRISPR gRNA sequence
  source 1..20: mol_type = other DNA
gcttcaaaatctttaaccgt

SEQ ID NO: 75192 - DNA, 20 bp, synthetic construct
  misc_feature 1..20: note = CRISPR gRNA sequence
  source 1..20: mol_type = other DNA
caaaatctttaaccgtgaca

SEQ ID NO: 75193 - DNA, 20 bp, synthetic construct
  misc_feature 1..20: note = CRISPR gRNA sequence
  source 1..20: mol_type = other DNA
aaaatctttaaccgtgacac

SEQ ID NO: 75194 - DNA, 20 bp, synthetic construct
  misc_feature 1..20: note = CRISPR gRNA sequence
  source 1..20: mol_type = other DNA
taaccgtgacactcagaagc

SEQ ID NO: 75195 - DNA, 20 bp, synthetic construct
  misc_feature 1..20: note = CRISPR gRNA sequence
  source 1..20: mol_type = other DNA
aaccgtgacactcagaagcc

SEQ ID NO: 75196 - DNA, 20 bp, synthetic construct
  misc_feature 1..20: note = CRISPR gRNA sequence
  source 1..20: mol_type = other DNA
accgtgacactcagaagcct

SEQ ID NO: 75197 - DNA, 20 bp, synthetic construct
  misc_feature 1..20: note = CRISPR gRNA sequence
  source 1..20: mol_type = other DNA
agaagcctcaaggcctgtag

SEQ ID NO: 75198 - DNA, 20 bp, synthetic construct
  misc_feature 1..20: note = CRISPR gRNA sequence
  source 1..20: mol_type = other DNA
aaggcctgtagtcaggacat

SEQ ID NO: 75199 - DNA, 20 bp, synthetic construct
  misc_feature 1..20: note = CRISPR gRNA sequence
  source 1..20: mol_type = other DNA
tagtcaggacatggcaagga

SEQ ID NO: 75200 - DNA, 20 bp, synthetic construct
  misc_feature 1..20: note = CRISPR gRNA sequence
  source 1..20: mol_type = other DNA
ggctgagttgggcttaggat

SEQ ID NO: 75201 - DNA, 20 bp, synthetic construct
  misc_feature 1..20: note = CRISPR gRNA sequence
  source 1..20: mol_type = other DNA
agttgggcttaggatggtgg

SEQ ID NO: 75202 - DNA, 20 bp, synthetic construct
  misc_feature 1..20: note = CRISPR gRNA sequence
  source 1..20: mol_type = other DNA
ggcttaggatggtgggctaa

SEQ ID NO: 75203 - DNA, 20 bp, synthetic construct
  misc_feature 1..20: note = CRISPR gRNA sequence
  source 1..20: mol_type = other DNA
aggatggtgggctaagaggc

SEQ ID NO: 75204 - DNA, 20 bp, synthetic construct
  misc_feature 1..20: note = CRISPR gRNA sequence
  source 1..20: mol_type = other DNA
ggatggtgggctaagaggca

SEQ ID NO: 75205 - DNA, 20 bp, synthetic construct
  misc_feature 1..20: note = CRISPR gRNA sequence
  source 1..20: mol_type = other DNA
agaggcacaagttcaatgcc

SEQ ID NO: 75206 - DNA, 20 bp, synthetic construct
  misc_feature 1..20: note = CRISPR gRNA sequence
  source 1..20: mol_type = other DNA
aatgccaaggccctggctga

SEQ ID NO: 75207 - DNA, 20 bp, synthetic construct
  misc_feature 1..20: note = CRISPR gRNA sequence
  source 1..20: mol_type = other DNA
gctgagactggagttaccag

SEQ ID NO: 75208 - DNA, 20 bp, synthetic construct
  misc_feature 1..20: note = CRISPR gRNA sequence
  source 1..20: mol_type = other DNA
agactggagttaccagggca

SEQ ID NO: 75209 - DNA, 20 bp, synthetic construct
  misc_feature 1..20: note = CRISPR gRNA sequence
  source 1..20: mol_type = other DNA
gagttaccagggcatcgggg

SEQ ID NO: 75210 - DNA, 20 bp, synthetic construct
  misc_feature 1..20: note = CRISPR gRNA sequence
  source 1..20: mol_type = other DNA
ccagggcatcgggggcagat

SEQ ID NO: 75211 - DNA, 20 bp, synthetic construct
  misc_feature 1..20: note = CRISPR gRNA sequence
  source 1..20: mol_type = other DNA
gaggaacagacccaggcagt

SEQ ID NO: 75212 - DNA, 20 bp, synthetic construct
  misc_feature 1..20: note = CRISPR gRNA sequence
  source 1..20: mol_type = other DNA
gaagctgctctctaaaggag

SEQ ID NO: 75213 - DNA, 20 bp, synthetic construct
  misc_feature 1..20: note = CRISPR gRNA sequence
  source 1..20: mol_type = other DNA
aagctgctctctaaaggagg

SEQ ID NO: 75214 - DNA, 20 bp, synthetic construct
  misc_feature 1..20: note = CRISPR gRNA sequence
  source 1..20: mol_type = other DNA
ctctctaaaggaggagaggg

SEQ ID NO: 75215 - DNA, 20 bp, synthetic construct
  misc_feature 1..20: note = CRISPR gRNA sequence
  source 1..20: mol_type = other DNA
tctaaaggaggagagggccc

SEQ ID NO: 75216 - DNA, 20 bp, synthetic construct
  misc_feature 1..20: note = CRISPR gRNA sequence
  source 1..20: mol_type = other DNA
taaaggaggagagggcccag

SEQ ID NO: 75217 - DNA, 20 bp, synthetic construct
  misc_feature 1..20: note = CRISPR gRNA sequence
  source 1..20: mol_type = other DNA
aaggaggagagggcccaggg

SEQ ID NO: 75218 - DNA, 20 bp, synthetic construct
  misc_feature 1..20: note = CRISPR gRNA sequence
  source 1..20: mol_type = other DNA
ctctcccctctctgtcccct

SEQ ID NO: 75219 - DNA, 20 bp, synthetic construct
  misc_feature 1..20: note = CRISPR gRNA sequence
  source 1..20: mol_type = other DNA
tcccctctctgtcccctgtc

SEQ ID NO: 75220 - DNA, 20 bp, synthetic construct
  misc_feature 1..20: note = CRISPR gRNA sequence
  source 1..20: mol_type = other DNA
ccctctctgtcccctgtccc

SEQ ID NO: 75221 - DNA, 20 bp, synthetic construct
  misc_feature 1..20: note = CRISPR gRNA sequence
  source 1..20: mol_type = other DNA
tctgtcccctgtcccatcac

SEQ ID NO: 75222 - DNA, 20 bp, synthetic construct
  misc_feature 1..20: note = CRISPR gRNA sequence
  source 1..20: mol_type = other DNA
tgtcccctgtcccatcaccc

SEQ ID NO: 75223 - DNA, 20 bp, synthetic construct
  misc_feature 1..20: note = CRISPR gRNA sequence
  source 1..20: mol_type = other DNA
tcccctgtcccatcaccctg

SEQ ID NO: 75224 - DNA, 20 bp, synthetic construct
  misc_feature 1..20: note = CRISPR gRNA sequence
  source 1..20: mol_type = other DNA
tcccatcaccctgcagggat

SEQ ID NO: 75225 - DNA, 20 bp, synthetic construct
  misc_feature 1..20: note = CRISPR gRNA sequence
  source 1..20: mol_type = other DNA
cagggattacctgagtgtct

SEQ ID NO: 75226 - DNA, 20 bp, synthetic construct
  misc_feature 1..20: note = CRISPR gRNA sequence
  source 1..20: mol_type = other DNA
cctgagtgtcttcccagcct

SEQ ID NO: 75227 - DNA, 20 bp, synthetic construct
  misc_feature 1..20: note = CRISPR gRNA sequence
  source 1..20: mol_type = other DNA
agtgtcttcccagcctggtc

SEQ ID NO: 75228 - DNA, 20 bp, synthetic construct
  misc_feature 1..20: note = CRISPR gRNA sequence
  source 1..20: mol_type = other DNA
cccagcctggtcctctctgg

SEQ ID NO: 75229 - DNA, 20 bp, synthetic construct
  misc_feature 1..20: note = CRISPR gRNA sequence
  source 1..20: mol_type = other DNA
ccagcctggtcctctctgga

SEQ ID NO: 75230 - DNA, 20 bp, synthetic construct
  misc_feature 1..20: note = CRISPR gRNA sequence
  source 1..20: mol_type = other DNA
gtcctctctggagaagtgaa

SEQ ID NO: 75231 - DNA, 20 bp, synthetic construct
  misc_feature 1..20: note = CRISPR gRNA sequence
  source 1..20: mol_type = other DNA
tctggagaagtgaatccgga

SEQ ID NO: 75232 - DNA, 20 bp, synthetic construct
  misc_feature 1..20: note = CRISPR gRNA sequence
  source 1..20: mol_type = other DNA
tggagaagtgaatccggaag

SEQ ID NO: 75233 - DNA, 20 bp, synthetic construct
  misc_feature 1..20: note = CRISPR gRNA sequence
  source 1..20: mol_type = other DNA
gagaagtgaatccggaagct

SEQ ID NO: 75234 - DNA, 20 bp, synthetic construct
  misc_feature 1..20: note = CRISPR gRNA sequence
  source 1..20: mol_type = other DNA
tgctcagagcccaggctgca

SEQ ID NO: 75235 - DNA, 20 bp, synthetic construct
  misc_feature 1..20: note = CRISPR gRNA sequence
  source 1..20: mol_type = other DNA
ctcagagcccaggctgcaga

SEQ ID NO: 75236 - DNA, 20 bp, synthetic construct
  misc_feature 1..20: note = CRISPR gRNA sequence
  source 1..20: mol_type = other DNA
agagcccaggctgcagagag

SEQ ID NO: 75237 - DNA, 20 bp, synthetic construct
  misc_feature 1..20: note = CRISPR gRNA sequence
  source 1..20: mol_type = other DNA
cagagagaagggcctgggga

SEQ ID NO: 75238 - DNA, 20 bp, synthetic construct
  misc_feature 1..20: note = CRISPR gRNA sequence
  source 1..20: mol_type = other DNA
gggaagcacggtgcccagac

SEQ ID NO: 75239 - DNA, 20 bp, synthetic construct
  misc_feature 1..20: note = CRISPR gRNA sequence
  source 1..20: mol_type = other DNA
cctaggcacctagggcaccc

SEQ ID NO: 75240 - DNA, 20 bp, synthetic construct
  misc_feature 1..20: note = CRISPR gRNA sequence
  source 1..20: mol_type = other DNA
ctaggcacctagggcaccca

SEQ ID NO: 75241 - DNA, 20 bp, synthetic construct
  misc_feature 1..20: note = CRISPR gRNA sequence
  source 1..20: mol_type = other DNA
ggcacctagggcacccacag

SEQ ID NO: 75242 - DNA, 20 bp, synthetic construct
  misc_feature 1..20: note = CRISPR gRNA sequence
  source 1..20: mol_type = other DNA
gggcacccacagggcacaga

SEQ ID NO: 75243 - DNA, 20 bp, synthetic construct
  misc_feature 1..20: note = CRISPR gRNA sequence
  source 1..20: mol_type = other DNA
cacccacaaggacaagggag

SEQ ID NO: 75244 - DNA, 20 bp, synthetic construct
  misc_feature 1..20: note = CRISPR gRNA sequence
  source 1..20: mol_type = other DNA
agaaccagaggagaccccca

SEQ ID NO: 75245 - DNA, 20 bp, synthetic construct
  misc_feature 1..20: note = CRISPR gRNA sequence
  source 1..20: mol_type = other DNA
attctgtgagcatggcaata

SEQ ID NO: 75246 - DNA, 20 bp, synthetic construct
  misc_feature 1..20: note = CRISPR gRNA sequence
  source 1..20: mol_type = other DNA
tgtgagcatggcaatacctg

SEQ ID NO: 75247 - DNA, 20 bp, synthetic construct
  misc_feature 1..20: note = CRISPR gRNA sequence
  source 1..20: mol_type = other DNA
tgagcatggcaatacctggc

SEQ ID NO: 75248 - DNA, 20 bp, synthetic construct
  misc_feature 1..20: note = CRISPR gRNA sequence
  source 1..20: mol_type = other DNA
gccttcccaccccatggcct

SEQ ID NO: 75249 - DNA, 20 bp, synthetic construct
  misc_feature 1..20: note = CRISPR gRNA sequence
  source 1..20: mol_type = other DNA
cccaccccatggcctccatg

SEQ ID NO: 75250 - DNA, 20 bp, synthetic construct
  misc_feature 1..20: note = CRISPR gRNA sequence
  source 1..20: mol_type = other DNA
ccaccccatggcctccatgg

SEQ ID NO: 75251 - DNA, 20 bp, synthetic construct
  misc_feature 1..20: note = CRISPR gRNA sequence
  source 1..20: mol_type = other DNA
catggtccccatggcacccg

SEQ ID NO: 75252 - DNA, 20 bp, synthetic construct
  misc_feature 1..20: note = CRISPR gRNA sequence
  source 1..20: mol_type = other DNA
tgatcccatgcccaggaaac

SEQ ID NO: 75253 - DNA, 20 bp, synthetic construct
  misc_feature 1..20: note = CRISPR gRNA sequence
  source 1..20: mol_type = other DNA
agattcagagaaaggcagag

SEQ ID NO: 75254 - DNA, 20 bp, synthetic construct
  misc_feature 1..20: note = CRISPR gRNA sequence
  source 1..20: mol_type = other DNA
agagaaaggcagaggttgct

SEQ ID NO: 75255 - DNA, 20 bp, synthetic construct
  misc_feature 1..20: note = CRISPR gRNA sequence
  source 1..20: mol_type = other DNA
ctccaagccacccagatgga

SEQ ID NO: 75256 - DNA, 20 bp, synthetic construct
  misc_feature 1..20: note = CRISPR gRNA sequence
  source 1..20: mol_type = other DNA
caagccacccagatggaagg

SEQ ID NO: 75257 - DNA, 20 bp, synthetic construct
  misc_feature 1..20: note = CRISPR gRNA sequence
  source 1..20: mol_type = other DNA
gcttctcccatcatcagcca

SEQ ID NO: 75258 - DNA, 20 bp, synthetic construct
  misc_feature 1..20: note = CRISPR gRNA sequence
  source 1..20: mol_type = other DNA
cttctcccatcatcagccag

SEQ ID NO: 75259 - DNA, 20 bp, synthetic construct
  misc_feature 1..20: note = CRISPR gRNA sequence
  source 1..20: mol_type = other DNA
ctcccatcatcagccagggg

SEQ ID NO: 75260 - DNA, 20 bp, synthetic construct
  misc_feature 1..20: note = CRISPR gRNA sequence
  source 1..20: mol_type = other DNA
tcccatcatcagccaggggc

SEQ ID NO: 75261 - DNA, 20 bp, synthetic construct
  misc_feature 1..20: note = CRISPR gRNA sequence
  source 1..20: mol_type = other DNA
ccatcatcagccaggggcac

SEQ ID NO: 75262 - DNA, 20 bp, synthetic construct
  misc_feature 1..20: note = CRISPR gRNA sequence
  source 1..20: mol_type = other DNA
ttggccagcagaaaggggct

SEQ ID NO: 75263 - DNA, 20 bp, synthetic construct
  misc_feature 1..20: note = CRISPR gRNA sequence
  source 1..20: mol_type = other DNA
gccagcagaaaggggctttt

SEQ ID NO: 75264 - DNA, 20 bp, synthetic construct
  misc_feature 1..20: note = CRISPR gRNA sequence
  source 1..20: mol_type = other DNA
ttcggggaccaacatcccct

SEQ ID NO: 75265 - DNA, 20 bp, synthetic construct
  misc_feature 1..20: note = CRISPR gRNA sequence
  source 1..20: mol_type = other DNA
tcggggaccaacatcccctt

SEQ ID NO: 75266 - DNA, 20 bp, synthetic construct
  misc_feature 1..20: note = CRISPR gRNA sequence
  source 1..20: mol_type = other DNA
cggggaccaacatcccctta

SEQ ID NO: 75267 - DNA, 20 bp, synthetic construct
  misc_feature 1..20: note = CRISPR gRNA sequence
  source 1..20: mol_type = other DNA
ggggaccaacatccccttac

SEQ ID NO: 75268 - DNA, 20 bp, synthetic construct
  misc_feature 1..20: note = CRISPR gRNA sequence
  source 1..20: mol_type = other DNA
acttcactgaggcctcccgg

SEQ ID NO: 75269 - DNA, 20 bp, synthetic construct
  misc_feature 1..20: note = CRISPR gRNA sequence
  source 1..20: mol_type = other DNA
cttcactgaggcctcccgga

SEQ ID NO: 75270 - DNA, 20 bp, synthetic construct
  misc_feature 1..20: note = CRISPR gRNA sequence
  source 1..20: mol_type = other DNA
cactgaggcctcccggacac

SEQ ID NO: 75271 - DNA, 20 bp, synthetic construct
  misc_feature 1..20: note = CRISPR gRNA sequence
  source 1..20: mol_type = other DNA
actgaggcctcccggacacg

SEQ ID NO: 75272 - DNA, 20 bp, synthetic construct
  misc_feature 1..20: note = CRISPR gRNA sequence
  source 1..20: mol_type = other DNA
aggcctcccggacacgtggg

SEQ ID NO: 75273 - DNA, 20 bp, synthetic construct
  misc_feature 1..20: note = CRISPR gRNA sequence
  source 1..20: mol_type = other DNA
ccggacacgtgggcaggagg

SEQ ID NO: 75274 - DNA, 20 bp, synthetic construct
  misc_feature 1..20: note = CRISPR gRNA sequence
  source 1..20: mol_type = other DNA
cagcaggtacagggcacttt

SEQ ID NO: 75275 - DNA, 20 bp, synthetic construct
  misc_feature 1..20: note = CRISPR gRNA sequence
  source 1..20: mol_type = other DNA
tcctgagaaatgctgttgtg

SEQ ID NO: 75276 - DNA, 20 bp, synthetic construct
  misc_feature 1..20: note = CRISPR gRNA sequence
  source 1..20: mol_type = other DNA
cctgagaaatgctgttgtga

SEQ ID NO: 75277 - DNA, 20 bp, synthetic construct
  misc_feature 1..20: note = CRISPR gRNA sequence
  source 1..20: mol_type = other DNA
ctgagaaatgctgttgtgac

SEQ ID NO: 75278 - DNA, 20 bp, synthetic construct
  misc_feature 1..20: note = CRISPR gRNA sequence
  source 1..20: mol_type = other DNA
agaaatgctgttgtgactca

SEQ ID NO: 75279 - DNA, 20 bp, synthetic construct
  misc_feature 1..20: note = CRISPR gRNA sequence
  source 1..20: mol_type = other DNA
ttgtgactcagactagaagg

SEQ ID NO: 75280 - DNA, 20 bp, synthetic construct
  misc_feature 1..20: note = CRISPR gRNA sequence
  source 1..20: mol_type = other DNA
tgactcagactagaagggaa

SEQ ID NO: 75281 - DNA, 20 bp, synthetic construct
  misc_feature 1..20: note = CRISPR gRNA sequence
  source 1..20: mol_type = other DNA
agactagaagggaaatggag

SEQ ID NO: 75282 - DNA, 20 bp, synthetic construct
  misc_feature 1..20: note = CRISPR gRNA sequence
  source 1..20: mol_type = other DNA
gaagggaaatggagatgaga

SEQ ID NO: 75283 - DNA, 20 bp, synthetic construct
  misc_feature 1..20: note = CRISPR gRNA sequence
  source 1..20: mol_type = other DNA
cttggagccctgcccagccc

SEQ ID NO: 75284 - DNA, 20 bp, synthetic construct
  misc_feature 1..20: note = CRISPR gRNA sequence
  source 1..20: mol_type = other DNA
ggagccctgcccagccccct

SEQ ID NO: 75285 - DNA, 20 bp, synthetic construct
  misc_feature 1..20: note = CRISPR gRNA sequence
  source 1..20: mol_type = other DNA
gagccctgcccagccccctc

SEQ ID NO: 75286 - DNA, 20 bp, synthetic construct
  misc_feature 1..20: note = CRISPR gRNA sequence
  source 1..20: mol_type = other DNA
cccagccccctccatctccc

SEQ ID NO: 75287 - DNA, 20 bp, synthetic construct
  misc_feature 1..20: note = CRISPR gRNA sequence
  source 1..20: mol_type = other DNA
catctcccttccagctgtca

SEQ ID NO: 75288 - DNA, 20 bp, synthetic construct
  misc_feature 1..20: note = CRISPR gRNA sequence
  source 1..20: mol_type = other DNA
ccttccagctgtcatttcca

SEQ ID NO: 75289 - DNA, 20 bp, synthetic construct
  misc_feature 1..20: note = CRISPR gRNA sequence
  source 1..20: mol_type = other DNA
ccagctgtcatttccaagaa

SEQ ID NO: 75290 - DNA, 20 bp, synthetic construct
  misc_feature 1..20: note = CRISPR gRNA sequence
  source 1..20: mol_type = other DNA
cagctgtcatttccaagaag

SEQ ID NO: 75291 - DNA, 20 bp, synthetic construct
  misc_feature 1..20: note = CRISPR gRNA sequence
  source 1..20: mol_type = other DNA
tcatttccaagaagagaagc

SEQ ID NO: 75292 - DNA, 20 bp, synthetic construct
  misc_feature 1..20: note = CRISPR gRNA sequence
  source 1..20: mol_type = other DNA
ccaagaagagaagcctccat

SEQ ID NO: 75293 - DNA, 20 bp, synthetic construct
  misc_feature 1..20: note = CRISPR gRNA sequence
  source 1..20: mol_type = other DNA
caagaagagaagcctccatg

SEQ ID NO: 75294 - DNA, 20 bp, synthetic construct
  misc_feature 1..20: note = CRISPR gRNA sequence
  source 1..20: mol_type = other DNA
catgtctaagcatctattct

SEQ ID NO: 75295 - DNA, 20 bp, synthetic construct
  misc_feature 1..20: note = CRISPR gRNA sequence
  source 1..20: mol_type = other DNA
agcatctattctccagatgg

SEQ ID NO: 75296 - DNA, 20 bp, synthetic construct
  misc_feature 1..20: note = CRISPR gRNA sequence
  source 1..20: mol_type = other DNA
ttctccagatggacacactg

SEQ ID NO: 75297 - DNA, 20 bp, synthetic construct
  misc_feature 1..20: note = CRISPR gRNA sequence
  source 1..20: mol_type = other DNA
tccagatggacacactgagg

SEQ ID NO: 75298 - DNA, 20 bp, synthetic construct
  misc_feature 1..20: note = CRISPR gRNA sequence
  source 1..20: mol_type = other DNA
cagatggacacactgaggcc

SEQ ID NO: 75299 - DNA, 20 bp, synthetic construct
  misc_feature 1..20: note = CRISPR gRNA sequence
  source 1..20: mol_type = other DNA
aggcccagaaggataccatc

SEQ ID NO: 75300 - DNA, 20 bp, synthetic construct
  misc_feature 1..20: note = CRISPR gRNA sequence
  source 1..20: mol_type = other DNA
gcaccagaccctgagtcctt

SEQ ID NO: 75301 - DNA, 20 bp, synthetic construct
  misc_feature 1..20: note = CRISPR gRNA sequence
  source 1..20: mol_type = other DNA
agtccttgagcgctgcactc

SEQ ID NO: 75302 - DNA, 20 bp, synthetic construct
  misc_feature 1..20: note = CRISPR gRNA sequence
  source 1..20: mol_type = other DNA
gagcgctgcactcaccctgc

SEQ ID NO: 75303 - DNA, 20 bp, synthetic construct
  misc_feature 1..20: note = CRISPR gRNA sequence
  source 1..20: mol_type = other DNA
agcgctgcactcaccctgcc

SEQ ID NO: 75304 - DNA, 20 bp, synthetic construct
  misc_feature 1..20: note = CRISPR gRNA sequence
  source 1..20: mol_type = other DNA
cactcaccctgcccgctgcc

SEQ ID NO: 75305 - DNA, 20 bp, synthetic construct
  misc_feature 1..20: note = CRISPR gRNA sequence
  source 1..20: mol_type = other DNA
accctgcccgctgcccctgt

SEQ ID NO: 75306 - DNA, 20 bp, synthetic construct
  misc_feature 1..20: note = CRISPR gRNA sequence
  source 1..20: mol_type = other DNA
cccgctgcccctgtggtctg

SEQ ID NO: 75307 - DNA, 20 bp, synthetic construct
  misc_feature 1..20: note = CRISPR gRNA sequence
  source 1..20: mol_type = other DNA
cccctgtggtctggggtctg

SEQ ID NO: 75308 - DNA, 20 bp, synthetic construct
  misc_feature 1..20: note = CRISPR gRNA sequence
  source 1..20: mol_type = other DNA
tggtctggggtctgggcact

SEQ ID NO: 75309 - DNA, 20 bp, synthetic construct
  misc_feature 1..20: note = CRISPR gRNA sequence
  source 1..20: mol_type = other DNA
gggtctgggcactggcaagg

SEQ ID NO: 75310 - DNA, 20 bp, synthetic construct
  misc_feature 1..20: note = CRISPR gRNA sequence
  source 1..20: mol_type = other DNA
ggcactggcaaggccaggct

SEQ ID NO: 75311 - DNA, 20 bp, synthetic construct
  misc_feature 1..20: note = CRISPR gRNA sequence
  source 1..20: mol_type = other DNA
gcaaggccaggctggcagct

SEQ ID NO: 75312 - DNA, 20 bp, synthetic construct
  misc_feature 1..20: note = CRISPR gRNA sequence
  source 1..20: mol_type = other DNA
gcagctctagccccgcatgg

SEQ ID NO: 75313 - DNA, 20 bp, synthetic construct
  misc_feature 1..20: note = CRISPR gRNA sequence
  source 1..20: mol_type = other DNA
tagccccgcatgggtcaagg

SEQ ID NO: 75314 - DNA, 20 bp, synthetic construct
  misc_feature 1..20: note = CRISPR gRNA sequence
  source 1..20: mol_type = other DNA
gccccgcatgggtcaaggac

SEQ ID NO: 75315 - DNA, 20 bp, synthetic construct
  misc_feature 1..20: note = CRISPR gRNA sequence
  source 1..20: mol_type = other DNA
ccgagcacgaagctcagttg

SEQ ID NO: 75316 - DNA, 20 bp, synthetic construct
  misc_feature 1..20: note = CRISPR gRNA sequence
  source 1..20: mol_type = other DNA
agttgcctagcaacaagtgg

SEQ ID NO: 75317 - DNA, 20 bp, synthetic construct
  misc_feature 1..20: note = CRISPR gRNA sequence
  source 1..20: mol_type = other DNA
cctagcaacaagtggtgtcc

SEQ ID NO: 75318 - DNA, 20 bp, synthetic construct
  misc_feature 1..20: note = CRISPR gRNA sequence
  source 1..20: mol_type = other DNA
gcaacaagtggtgtcctgga

SEQ ID NO: 75319 - DNA, 20 bp, synthetic construct
  misc_feature 1..20: note = CRISPR gRNA sequence
  source 1..20: mol_type = other DNA
gagctggctgtcactccagc

SEQ ID NO: 75320 - DNA, 20 bp, synthetic construct
  misc_feature 1..20: note = CRISPR gRNA sequence
  source 1..20: mol_type = other DNA
gctgtcactccagcaggtca

SEQ ID NO: 75321 - DNA, 20 bp, synthetic construct
  misc_feature 1..20: note = CRISPR gRNA sequence
  source 1..20: mol_type = other DNA
tcactccagcaggtcacggg

SEQ ID NO: 75322 - DNA, 20 bp, synthetic construct
  misc_feature 1..20: note = CRISPR gRNA sequence
  source 1..20: mol_type = other DNA
cagcaggtcacgggagagat

SEQ ID NO: 75323 - DNA, 20 bp, synthetic construct
  misc_feature 1..20: note = CRISPR gRNA sequence
  source 1..20: mol_type = other DNA
cctaaggccccttgcctgcc

SEQ ID NO: 75324 - DNA, 20 bp, synthetic construct
  misc_feature 1..20: note = CRISPR gRNA sequence
  source 1..20: mol_type = other DNA
ctaaggccccttgcctgcca

SEQ ID NO: 75325 - DNA, 20 bp, synthetic construct
  misc_feature 1..20: note = CRISPR gRNA sequence
  source 1..20: mol_type = other DNA
aggccccttgcctgccacag

SEQ ID NO: 75326 - DNA, 20 bp, synthetic construct
  misc_feature 1..20: note = CRISPR gRNA sequence
  source 1..20: mol_type = other DNA
gcctgccacagggacatctc

SEQ ID NO: 75327 - DNA, 20 bp, synthetic construct
  misc_feature 1..20: note = CRISPR gRNA sequence
  source 1..20: mol_type = other DNA
cctgccacagggacatctcc

SEQ ID NO: 75328 - DNA, 20 bp, synthetic construct
  misc_feature 1..20: note = CRISPR gRNA sequence
  source 1..20: mol_type = other DNA
ccacagggacatctccacat

SEQ ID NO: 75329 - DNA, 20 bp, synthetic construct
  misc_feature 1..20: note = CRISPR gRNA sequence
  source 1..20: mol_type = other DNA
cacatttatgttccacagat

SEQ ID NO: 75330 - DNA, 20 bp, synthetic construct
  misc_feature 1..20: note = CRISPR gRNA sequence
  source 1..20: mol_type = other DNA
atgttccacagattgggtca

SEQ ID NO: 75331 - DNA, 20 bp, synthetic construct
  misc_feature 1..20: note = CRISPR gRNA sequence
  source 1..20: mol_type = other DNA
tgttccacagattgggtcag

SEQ ID NO: 75332 - DNA, 20 bp, synthetic construct
  misc_feature 1..20: note = CRISPR gRNA sequence
  source 1..20: mol_type = other DNA
cacagattgggtcagaagaa

SEQ ID NO: 75333 - DNA, 20 bp, synthetic construct
  misc_feature 1..20: note = CRISPR gRNA sequence
  source 1..20: mol_type = other DNA
ggtcagaagaatttcaggga

SEQ ID NO: 75334 - DNA, 20 bp, synthetic construct
  misc_feature 1..20: note = CRISPR gRNA sequence
  source 1..20: mol_type = other DNA
cagggacgggatggaccagg

SEQ ID NO: 75335 - DNA, 20 bp, synthetic construct
  misc_feature 1..20: note = CRISPR gRNA sequence
  source 1..20: mol_type = other DNA
agggacgggatggaccagga

SEQ ID NO: 75336 - DNA, 20 bp, synthetic construct
  misc_feature 1..20: note = CRISPR gRNA sequence
  source 1..20: mol_type = other DNA
caatcccgcatcagctggtt

SEQ ID NO: 75337 - DNA, 20 bp, synthetic construct
  misc_feature 1..20: note = CRISPR gRNA sequence
  source 1..20: mol_type = other DNA
gttggggatggaatgttgct

SEQ ID NO: 75338 - DNA, 20 bp, synthetic construct
  misc_feature 1..20: note = CRISPR gRNA sequence
  source 1..20: mol_type = other DNA
gggatggaatgttgcttccc

SEQ ID NO: 75339 - DNA, 20 bp, synthetic construct
  misc_feature 1..20: note = CRISPR gRNA sequence
  source 1..20: mol_type = other DNA
cttccctgtccccaggtcag

SEQ ID NO: 75340 - DNA, 20 bp, synthetic construct
  misc_feature 1..20: note = CRISPR gRNA sequence
  source 1..20: mol_type = other DNA
ccctgtccccaggtcagttt

SEQ ID NO: 75341 - DNA, 20 bp, synthetic construct
  misc_feature 1..20: note = CRISPR gRNA sequence
  source 1..20: mol_type = other DNA
cctgtccccaggtcagtttg

SEQ ID NO: 75342 - DNA, 20 bp, synthetic construct
  misc_feature 1..20: note = CRISPR gRNA sequence
  source 1..20: mol_type = other DNA
tccccaggtcagtttggctg

SEQ ID NO: 75343 - DNA, 20 bp, synthetic construct
  misc_feature 1..20: note = CRISPR gRNA sequence
  source 1..20: mol_type = other DNA
ggctgtaggggtgtgtcacc

SEQ ID NO: 75344 - DNA, 20 bp, synthetic construct
  misc_feature 1..20: note = CRISPR gRNA sequence
  source 1..20: mol_type = other DNA
gctgtaggggtgtgtcaccc

SEQ ID NO: 75345 - DNA, 20 bp, synthetic construct
  misc_feature 1..20: note = CRISPR gRNA sequence
  source 1..20: mol_type = other DNA
taggggtgtgtcaccctgcc

SEQ ID NO: 75346 - DNA, 20 bp, synthetic construct
  misc_feature 1..20: note = CRISPR gRNA sequence
  source 1..20: mol_type = other DNA
ccacgaatcacagcctctct

SEQ ID NO: 75347 - DNA, 20 bp, synthetic construct
  misc_feature 1..20: note = CRISPR gRNA sequence
  source 1..20: mol_type = other DNA
tcttgggtgtttggtggagg

SEQ ID NO: 75348 - DNA, 20 bp, synthetic construct
  misc_feature 1..20: note = CRISPR gRNA sequence
  source 1..20: mol_type = other DNA
ttgggtgtttggtggaggat

SEQ ID NO: 75349 - DNA, 20 bp, synthetic construct
  misc_feature 1..20: note = CRISPR gRNA sequence
  source 1..20: mol_type = other DNA
gggtgtttggtggaggatct

SEQ ID NO: 75350 - DNA, 20 bp, synthetic construct
  misc_feature 1..20: note = CRISPR gRNA sequence
  source 1..20: mol_type = other DNA
ggtgtttggtggaggatctg

SEQ ID NO: 75351 - DNA, 20 bp, synthetic construct
  misc_feature 1..20: note = CRISPR gRNA sequence
  source 1..20: mol_type = other DNA
ggtggaggatctgcccatgg

SEQ ID NO: 75352 - DNA, 20 bp, synthetic construct
  misc_feature 1..20: note = CRISPR gRNA sequence
  source 1..20: mol_type = other DNA
gtggaggatctgcccatggt

SEQ ID NO: 75353 - DNA, 20 bp, synthetic construct
  misc_feature 1..20: note = CRISPR gRNA sequence
  source 1..20: mol_type = other DNA
cccatggtgggtgtgaggga

SEQ ID NO: 75354 - DNA, 20 bp, synthetic construct
  misc_feature 1..20: note = CRISPR gRNA sequence
  source 1..20: mol_type = other DNA
ccccttgccctccacagtcc

SEQ ID NO: 75355 - DNA, 20 bp, synthetic construct
  misc_feature 1..20: note = CRISPR gRNA sequence
  source 1..20: mol_type = other DNA
gccctccacagtccttgtcc

SEQ ID NO: 75356 - DNA, 20 bp, synthetic construct
  misc_feature 1..20: note = CRISPR gRNA sequence
  source 1..20: mol_type = other DNA
ccctccacagtccttgtcct

SEQ ID NO: 75357 - DNA, 20 bp, synthetic construct
  misc_feature 1..20: note = CRISPR gRNA sequence
  source 1..20: mol_type = other DNA
cacagtccttgtcctctggt

SEQ ID NO: 75358 - DNA, 20 bp, synthetic construct
  misc_feature 1..20: note = CRISPR gRNA sequence
  source 1..20: mol_type = other DNA
gtcctctggtgctctggggg

SEQ ID NO: 75359 - DNA, 20 bp, synthetic construct
  misc_feature 1..20: note = CRISPR gRNA sequence
  source 1..20: mol_type = other DNA
tcctctggtgctctggggga

SEQ ID NO: 75360 - DNA, 20 bp, synthetic construct
  misc_feature 1..20: note = CRISPR gRNA sequence
  source 1..20: mol_type = other DNA
tggtgctctgggggatgccc

SEQ ID NO: 75361 - DNA, 20 bp, synthetic construct
  misc_feature 1..20: note = CRISPR gRNA sequence
  source 1..20: mol_type = other DNA
gtgctctgggggatgccctc

SEQ ID NO: 75362 - DNA, 20 bp, synthetic construct
  misc_feature 1..20: note = CRISPR gRNA sequence
  source 1..20: mol_type = other DNA
tgggggatgccctcagaagg

SEQ ID NO: 75363 - DNA, 20 bp, synthetic construct
  misc_feature 1..20: note = CRISPR gRNA sequence
  source 1..20: mol_type = other DNA
ggggatgccctcagaaggag

SEQ ID NO: 75364 - DNA, 20 bp, synthetic construct
  misc_feature 1..20: note = CRISPR gRNA sequence
  source 1..20: mol_type = other DNA
agaaggagcccccatcatgc

SEQ ID NO: 75365 - DNA, 20 bp, synthetic construct
  misc_feature 1..20: note = CRISPR gRNA sequence
  source 1..20: mol_type = other DNA
ttggcctaggggagccttcc

SEQ ID NO: 75366 - DNA, 20 bp, synthetic construct
  misc_feature 1..20: note = CRISPR gRNA sequence
  source 1..20: mol_type = other DNA
tggcctaggggagccttcct

SEQ ID NO: 75367 - DNA, 20 bp, synthetic construct
  misc_feature 1..20: note = CRISPR gRNA sequence
  source 1..20: mol_type = other DNA
ggcctaggggagccttcctc

SEQ ID NO: 75368 - DNA, 20 bp, synthetic construct
  misc_feature 1..20: note = CRISPR gRNA sequence
  source 1..20: mol_type = other DNA
gcctaggggagccttcctcc

SEQ ID NO: 75369 - DNA, 20 bp, synthetic construct
  misc_feature 1..20: note = CRISPR gRNA sequence
  source 1..20: mol_type = other DNA
ggggagccttcctccttgct

SEQ ID NO: 75370 - DNA, 20 bp, synthetic construct
  misc_feature 1..20: note = CRISPR gRNA sequence
  source 1..20: mol_type = other DNA
cctccttgctatctgtcctt

SEQ ID NO: 75371 - DNA, 20 bp, synthetic construct
  misc_feature 1..20: note = CRISPR gRNA sequence
  source 1..20: mol_type = other DNA
ctccttgctatctgtccttt

SEQ ID NO: 75372 - DNA, 20 bp, synthetic construct
  misc_feature 1..20: note = CRISPR gRNA sequence
  source 1..20: mol_type = other DNA
cttgctatctgtcctttatg

SEQ ID NO: 75373 - DNA, 20 bp, synthetic construct
  misc_feature 1..20: note = CRISPR gRNA sequence
  source 1..20: mol_type = other DNA
gctatctgtcctttatgctg

SEQ ID NO: 75374 - DNA, 20 bp, synthetic construct
  misc_feature 1..20: note = CRISPR gRNA sequence
  source 1..20: mol_type = other DNA
ctatctgtcctttatgctgc

SEQ ID NO: 75375 - DNA, 20 bp, synthetic construct
  misc_feature 1..20: note = CRISPR gRNA sequence
  source 1..20: mol_type = other DNA
tctgtcctttatgctgcttt

SEQ ID NO: 75376 - DNA, 20 bp, synthetic construct
  misc_feature 1..20: note = CRISPR gRNA sequence
  source 1..20: mol_type = other DNA
tcctttatgctgctttccac

SEQ ID NO: 75377 - DNA, 20 bp, synthetic construct
  misc_feature 1..20: note = CRISPR gRNA sequence
  source 1..20: mol_type = other DNA
tatgctgctttccacttact

SEQ ID NO: 75378 - DNA, 20 bp, synthetic construct
  misc_feature 1..20: note = CRISPR gRNA sequence
  source 1..20: mol_type = other DNA
atgctgctttccacttactc

SEQ ID NO: 75379 - DNA, 20 bp, synthetic construct
  misc_feature 1..20: note = CRISPR gRNA sequence
  source 1..20: mol_type = other DNA
tgctgctttccacttactca

SEQ ID NO: 75380 - DNA, 20 bp, synthetic construct
  misc_feature 1..20: note = CRISPR gRNA sequence
  source 1..20: mol_type = other DNA
ctttccacttactcaagcaa

SEQ ID NO: 75381 - DNA, 20 bp, synthetic construct
  misc_feature 1..20: note = CRISPR gRNA sequence
  source 1..20: mol_type = other DNA
tccacttactcaagcaaacc

SEQ ID NO: 75382 - DNA, 20 bp, synthetic construct
  misc_feature 1..20: note = CRISPR gRNA sequence
  source 1..20: mol_type = other DNA
ccacttactcaagcaaaccg

SEQ ID NO: 75383 - DNA, 20 bp, synthetic construct
  misc_feature 1..20: note = CRISPR gRNA sequence
  source 1..20: mol_type = other DNA
cacttactcaagcaaaccgg

SEQ ID NO: 75384 - DNA, 20 bp, synthetic construct
  misc_feature 1..20: note = CRISPR gRNA sequence
  source 1..20: mol_type = other DNA
actcaagcaaaccggagatg

SEQ ID NO: 75385 - DNA, 20 bp, synthetic construct
  misc_feature 1..20: note = CRISPR gRNA sequence
  source 1..20: mol_type = other DNA
ctcaagcaaaccggagatgg

SEQ ID NO: 75386 - DNA, 20 bp, synthetic construct
  misc_feature 1..20: note = CRISPR gRNA sequence
  source 1..20: mol_type = other DNA
aagcaaaccggagatgggca

SEQ ID NO: 75387 - DNA, 20 bp, synthetic construct
  misc_feature 1..20: note = CRISPR gRNA sequence
  source 1..20: mol_type = other DNA
cggcagacattccagaaggc

SEQ ID NO: 75388 - DNA, 20 bp, synthetic construct
  misc_feature 1..20: note = CRISPR gRNA sequence
  source 1..20: mol_type = other DNA
cagaaggcatctgagtccgc

SEQ ID NO: 75389 - DNA, 20 bp, synthetic construct
  misc_feature 1..20: note = CRISPR gRNA sequence
  source 1..20: mol_type = other DNA
agtccgctgtcgcccagcag

SEQ ID NO: 75390 - DNA, 20 bp, synthetic construct
  misc_feature 1..20: note = CRISPR gRNA sequence
  source 1..20: mol_type = other DNA
tcgcccagcaggtttgctga

SEQ ID NO: 75391 - DNA, 20 bp, synthetic construct
  misc_feature 1..20: note = CRISPR gRNA sequence
  source 1..20: mol_type = other DNA
gctgagagactgtagggggt

SEQ ID NO: 75392 - DNA, 20 bp, synthetic construct
  misc_feature 1..20: note = CRISPR gRNA sequence
  source 1..20: mol_type = other DNA
ctgagagactgtagggggta

SEQ ID NO: 75393 - DNA, 20 bp, synthetic construct
  misc_feature 1..20: note = CRISPR gRNA sequence
  source 1..20: mol_type = other DNA
agagactgtagggggtaagg

SEQ ID NO: 75394 - DNA, 20 bp, synthetic construct
  misc_feature 1..20: note = CRISPR gRNA sequence
  source 1..20: mol_type = other DNA
tagggggtaaggagcagtgg

SEQ ID NO: 75395 - DNA, 20 bp, synthetic construct
  misc_feature 1..20: note = CRISPR gRNA sequence
  source 1..20: mol_type = other DNA
ctcagcctgagatgctcctc

SEQ ID NO: 75396 - DNA, 20 bp, synthetic construct
  misc_feature 1..20: note = CRISPR gRNA sequence
  source 1..20: mol_type = other DNA
agcctgagatgctcctcagt

SEQ ID NO: 75397 - DNA, 20 bp, synthetic construct
  misc_feature 1..20: note = CRISPR gRNA sequence
  source 1..20: mol_type = other DNA
agatgctcctcagtcaccag

SEQ ID NO: 75398 - DNA, 20 bp, synthetic construct
  misc_feature 1..20: note = CRISPR gRNA sequence
  source 1..20: mol_type = other DNA
ctcagtcaccaggagcctgc

SEQ ID NO: 75399 - DNA, 20 bp, synthetic construct
  misc_feature 1..20: note = CRISPR gRNA sequence
  source 1..20: mol_type = other DNA
agtcaccaggagcctgcatc

SEQ ID NO: 75400 - DNA, 20 bp, synthetic construct
  misc_feature 1..20: note = CRISPR gRNA sequence
  source 1..20: mol_type = other DNA
catccactgtcactgctact

SEQ ID NO: 75401 - DNA, 20 bp, synthetic construct
  misc_feature 1..20: note = CRISPR gRNA sequence
  source 1..20: mol_type = other DNA
tcactgctactggaccccat

SEQ ID NO: 75402 - DNA, 20 bp, synthetic construct
  misc_feature 1..20: note = CRISPR gRNA sequence
  source 1..20: mol_type = other DNA
ctactggaccccatgtcagg

SEQ ID NO: 75403 - DNA, 20 bp, synthetic construct
  misc_feature 1..20: note = CRISPR gRNA sequence
  source 1..20: mol_type = other DNA
ctggaccccatgtcagggtc

SEQ ID NO: 75404 - DNA, 20 bp, synthetic construct
  misc_feature 1..20: note = CRISPR gRNA sequence
  source 1..20: mol_type = other DNA
gaccccatgtcagggtcacc

SEQ ID NO: 75405 - DNA, 20 bp, synthetic construct
  misc_feature 1..20: note = CRISPR gRNA sequence
  source 1..20: mol_type = other DNA
ccaccatcaccaccaccact

SEQ ID NO: 75406 - DNA, 20 bp, synthetic construct
  misc_feature 1..20: note = CRISPR gRNA sequence
  source 1..20: mol_type = other DNA
tcattatcaccacaattcta

SEQ ID NO: 75407 - DNA, 20 bp, synthetic construct
  misc_feature 1..20: note = CRISPR gRNA sequence
  source 1..20: mol_type = other DNA
cattatcaccacaattctac

SEQ ID NO: 75408 - DNA, 20 bp, synthetic construct
  misc_feature 1..20: note = CRISPR gRNA sequence
  source 1..20: mol_type = other DNA
attatcaccacaattctaca

SEQ ID NO: 75409 - DNA, 20 bp, synthetic construct
  misc_feature 1..20: note = CRISPR gRNA sequence
  source 1..20: mol_type = other DNA
tcaccacaattctacaccac

SEQ ID NO: 75410 - DNA, 20 bp, synthetic construct
  misc_feature 1..20: note = CRISPR gRNA sequence
  source 1..20: mol_type = other DNA
tacaccaccaagcccagtac

SEQ ID NO: 75411 - DNA, 20 bp, synthetic construct
  misc_feature 1..20: note = CRISPR gRNA sequence
  source 1..20: mol_type = other DNA
caccaccaagcccagtacca

SEQ ID NO: 75412 - DNA, 20 bp, synthetic construct
  misc_feature 1..20: note = CRISPR gRNA sequence
  source 1..20: mol_type = other DNA
ccatcaccactagaatgacc

SEQ ID NO: 75413 - DNA, 20 bp, synthetic construct
  misc_feature 1..20: note = CRISPR gRNA sequence
  source 1..20: mol_type = other DNA
catcaccactagaatgacca

SEQ ID NO: 75414 - DNA, 20 bp, synthetic construct
  misc_feature 1..20: note = CRISPR gRNA sequence
  source 1..20: mol_type = other DNA
gaatgaccagcaactcctac

SEQ ID NO: 75415 - DNA, 20 bp, synthetic construct
  misc_feature 1..20: note = CRISPR gRNA sequence
  source 1..20: mol_type = other DNA
ctacgttctctgctactatc

SEQ ID NO: 75416 - DNA, 20 bp, synthetic construct
  misc_feature 1..20: note = CRISPR gRNA sequence
  source 1..20: mol_type = other DNA
cgttctctgctactatcccc

SEQ ID NO: 75417 - DNA, 20 bp, synthetic construct
  misc_feature 1..20: note = CRISPR gRNA sequence
  source 1..20: mol_type = other DNA
tctgctactatcccctcccc

SEQ ID NO: 75418 - DNA, 20 bp, synthetic construct
  misc_feature 1..20: note = CRISPR gRNA sequence
  source 1..20: mol_type = other DNA
tgctactatcccctccccag

SEQ ID NO: 75419 - DNA, 20 bp, synthetic construct
  misc_feature 1..20: note = CRISPR gRNA sequence
  source 1..20: mol_type = other DNA
ctactatcccctccccagca

SEQ ID NO: 75420 - DNA, 20 bp, synthetic construct
  misc_feature 1..20: note = CRISPR gRNA sequence
  source 1..20: mol_type = other DNA
ctatcccctccccagcacca

SEQ ID NO: 75421 - DNA, 20 bp, synthetic construct
  misc_feature 1..20: note = CRISPR gRNA sequence
  source 1..20: mol_type = other DNA
tcccctccccagcaccacag

SEQ ID NO: 75422 - DNA, 20 bp, synthetic construct
  misc_feature 1..20: note = CRISPR gRNA sequence
  source 1..20: mol_type = other DNA
cccagcaccacagtaaaccc

SEQ ID NO: 75423 - DNA, 20 bp, synthetic construct
  misc_feature 1..20: note = CRISPR gRNA sequence
  source 1..20: mol_type = other DNA
ttggtcctcttccatatcgg

SEQ ID NO: 75424 - DNA, 20 bp, synthetic construct
  misc_feature 1..20: note = CRISPR gRNA sequence
  source 1..20: mol_type = other DNA
ggtcctcttccatatcgggt

SEQ ID NO: 75425 - DNA, 20 bp, synthetic construct
  misc_feature 1..20: note = CRISPR gRNA sequence
  source 1..20: mol_type = other DNA
gtcctcttccatatcgggtg

SEQ ID NO: 75426 - DNA, 20 bp, synthetic construct
  misc_feature 1..20: note = CRISPR gRNA sequence
  source 1..20: mol_type = other DNA
ttccatatcgggtgaccact

SEQ ID NO: 75427 - DNA, 20 bp, synthetic construct
  misc_feature 1..20: note = CRISPR gRNA sequence
  source 1..20: mol_type = other DNA
ccatatcgggtgaccactca

SEQ ID NO: 75428 - DNA, 20 bp, synthetic construct
  misc_feature 1..20: note = CRISPR gRNA sequence
  source 1..20: mol_type = other DNA
catatcgggtgaccactcat

SEQ ID NO: 75429 - DNA, 20 bp, synthetic construct
  misc_feature 1..20: note = CRISPR gRNA sequence
  source 1..20: mol_type = other DNA
atagctcaggtgcctccagc

SEQ ID NO: 75430 - DNA, 20 bp, synthetic construct
  misc_feature 1..20: note = CRISPR gRNA sequence
  source 1..20: mol_type = other DNA
aggtgcctccagcaggcttt

SEQ ID NO: 75431 - DNA, 20 bp, synthetic construct
  misc_feature 1..20: note = CRISPR gRNA sequence
  source 1..20: mol_type = other DNA
cagcaggctttcaagggtta

SEQ ID NO: 75432 - DNA, 20 bp, synthetic construct
  misc_feature 1..20: note = CRISPR gRNA sequence
  source 1..20: mol_type = other DNA
tcaagggttaaagaaaaacc

SEQ ID NO: 75433 - DNA, 20 bp, synthetic construct
  misc_feature 1..20: note = CRISPR gRNA sequence
  source 1..20: mol_type = other DNA
caagggttaaagaaaaacca

SEQ ID NO: 75434 - DNA, 20 bp, synthetic construct
  misc_feature 1..20: note = CRISPR gRNA sequence
  source 1..20: mol_type = other DNA
aagggttaaagaaaaaccaa

SEQ ID NO: 75435 - DNA, 20 bp, synthetic construct
  misc_feature 1..20: note = CRISPR gRNA sequence
  source 1..20: mol_type = other DNA
aagaaaaaccaatttgcctt

SEQ ID NO: 75436 - DNA, 20 bp, synthetic construct
  misc_feature 1..20: note = CRISPR gRNA sequence
  source 1..20: mol_type = other DNA
gccttcaccacgcccttggc

SEQ ID NO: 75437 - DNA, 20 bp, synthetic construct
  misc_feature 1..20: note = CRISPR gRNA sequence
  source 1..20: mol_type = other DNA
ccttcaccacgcccttggcc

SEQ ID NO: 75438 - DNA, 20 bp, synthetic construct
  misc_feature 1..20: note = CRISPR gRNA sequence
  source 1..20: mol_type = other DNA
caccacgcccttggccggca

SEQ ID NO: 75439 - DNA, 20 bp, synthetic construct
  misc_feature 1..20: note = CRISPR gRNA sequence
  source 1..20: mol_type = other DNA
accacgcccttggccggcat

SEQ ID NO: 75440 - DNA, 20 bp, synthetic construct
  misc_feature 1..20: note = CRISPR gRNA sequence
  source 1..20: mol_type = other DNA
ggccggcatcatttgggatc

SEQ ID NO: 75441 - DNA, 20 bp, synthetic construct
  misc_feature 1..20: note = CRISPR gRNA sequence
  source 1..20: mol_type = other DNA
gccggcatcatttgggatcc

SEQ ID NO: 75442 - DNA, 20 bp, synthetic construct
  misc_feature 1..20: note = CRISPR gRNA sequence
  source 1..20: mol_type = other DNA
gggatccacagtttttgaat

SEQ ID NO: 75443 - DNA, 20 bp, synthetic construct
  misc_feature 1..20: note = CRISPR gRNA sequence
  source 1..20: mol_type = other DNA
ggatccacagtttttgaatg

SEQ ID NO: 75444 - DNA, 20 bp, synthetic construct
  misc_feature 1..20: note = CRISPR gRNA sequence
  source 1..20: mol_type = other DNA
ttgaatgagaggaaattcag

SEQ ID NO: 75445 - DNA, 20 bp, synthetic construct
  misc_feature 1..20: note = CRISPR gRNA sequence
  source 1..20: mol_type = other DNA
tgaatgagaggaaattcagg

SEQ ID NO: 75446 - DNA, 20 bp, synthetic construct
  misc_feature 1..20: note = CRISPR gRNA sequence
  source 1..20: mol_type = other DNA
gaatgagaggaaattcagga

SEQ ID NO: 75447 - DNA, 20 bp, synthetic construct
  misc_feature 1..20: note = CRISPR gRNA sequence
  source 1..20: mol_type = other DNA
aatgagaggaaattcaggaa

SEQ ID NO: 75448 - DNA, 20 bp, synthetic construct
  misc_feature 1..20: note = CRISPR gRNA sequence
  source 1..20: mol_type = other DNA
aggaaaaaaaaatgtttgca

SEQ ID NO: 75449 - DNA, 20 bp, synthetic construct
  misc_feature 1..20: note = CRISPR gRNA sequence
  source 1..20: mol_type = other DNA
gcaggatgcattaaacccat

SEQ ID NO: 75450 - DNA, 20 bp, synthetic construct
  misc_feature 1..20: note = CRISPR gRNA sequence
  source 1..20: mol_type = other DNA
caggatgcattaaacccata

SEQ ID NO: 75451 - DNA, 20 bp, synthetic construct
  misc_feature 1..20: note = CRISPR gRNA sequence
  source 1..20: mol_type = other DNA
aacccatagatttcttcttt

SEQ ID NO: 75452 - DNA, 20 bp, synthetic construct
  misc_feature 1..20: note = CRISPR gRNA sequence
  source 1..20: mol_type = other DNA
cttcttttaatctgggaatg

SEQ ID NO: 75453 - DNA, 20 bp, synthetic construct
  misc_feature 1..20: note = CRISPR gRNA sequence
  source 1..20: mol_type = other DNA
ttcttttaatctgggaatgc

SEQ ID NO: 75454 - DNA, 20 bp, synthetic construct
  misc_feature 1..20: note = CRISPR gRNA sequence
  source 1..20: mol_type = other DNA
cttttaatctgggaatgcaa

SEQ ID NO: 75455 - DNA, 20 bp, synthetic construct
  misc_feature 1..20: note = CRISPR gRNA sequence
  source 1..20: mol_type = other DNA
ttttaatctgggaatgcaat

SEQ ID NO: 75456 - DNA, 20 bp, synthetic construct
  misc_feature 1..20: note = CRISPR gRNA sequence
  source 1..20: mol_type = other DNA
ttaatctgggaatgcaatat

SEQ ID NO: 75457 - DNA, 20 bp, synthetic construct
  misc_feature 1..20: note = CRISPR gRNA sequence
  source 1..20: mol_type = other DNA
taatctgggaatgcaatatc

SEQ ID NO: 75458 - DNA, 20 bp, synthetic construct
  misc_feature 1..20: note = CRISPR gRNA sequence
  source 1..20: mol_type = other DNA
aatctgggaatgcaatatca

SEQ ID NO: 75459 - DNA, 20 bp, synthetic construct
  misc_feature 1..20: note = CRISPR gRNA sequence
  source 1..20: mol_type = other DNA
atctgggaatgcaatatcaa

SEQ ID NO: 75460 - DNA, 20 bp, synthetic construct
  misc_feature 1..20: note = CRISPR gRNA sequence
  source 1..20: mol_type = other DNA
ggaatgcaatatcaatattg

SEQ ID NO: 75461 - DNA, 20 bp, synthetic construct
  misc_feature 1..20: note = CRISPR gRNA sequence
  source 1..20: mol_type = other DNA
gaaacctcacctgaagtttc

SEQ ID NO: 75462 - DNA, 20 bp, synthetic construct
  misc_feature 1..20: note = CRISPR gRNA sequence
  source 1..20: mol_type = other DNA
acctgaagtttcttacttcc

SEQ ID NO: 75463 - DNA, 20 bp, synthetic construct
  misc_feature 1..20: note = CRISPR gRNA sequence
  source 1..20: mol_type = other DNA
aagtttcttacttcccttca

SEQ ID NO: 75464 - DNA, 20 bp, synthetic construct
  misc_feature 1..20: note = CRISPR gRNA sequence
  source 1..20: mol_type = other DNA
cttacttcccttcattgcag

SEQ ID NO: 75465 - DNA, 20 bp, synthetic construct
  misc_feature 1..20: note = CRISPR gRNA sequence
  source 1..20: mol_type = other DNA
ttacttcccttcattgcagc

SEQ ID NO: 75466 - DNA, 20 bp, synthetic construct
  misc_feature 1..20: note = CRISPR gRNA sequence
  source 1..20: mol_type = other DNA
acttcccttcattgcagcat

SEQ ID NO: 75467 - DNA, 20 bp, synthetic construct
  misc_feature 1..20: note = CRISPR gRNA sequence
  source 1..20: mol_type = other DNA
cttcccttcattgcagcatt

SEQ ID NO: 75468 - DNA, 20 bp, synthetic construct
  misc_feature 1..20: note = CRISPR gRNA sequence
  source 1..20: mol_type = other DNA
cccttcattgcagcattctg

SEQ ID NO: 75469 - DNA, 20 bp, synthetic construct
  misc_feature 1..20: note = CRISPR gRNA sequence
  source 1..20: mol_type = other DNA
ccttcattgcagcattctgt

SEQ ID NO: 75470 - DNA, 20 bp, synthetic construct
  misc_feature 1..20: note = CRISPR gRNA sequence
  source 1..20: mol_type = other DNA
cattgcagcattctgtggtt

SEQ ID NO: 75471 - DNA, 20 bp, synthetic construct
  misc_feature 1..20: note = CRISPR gRNA sequence
  source 1..20: mol_type = other DNA
attgcagcattctgtggttt

SEQ ID NO: 75472 - DNA, 20 bp, synthetic construct
  misc_feature 1..20: note = CRISPR gRNA sequence
  source 1..20: mol_type = other DNA
cagcattctgtggttttatt

SEQ ID NO: 75473 - DNA, 20 bp, synthetic construct
  misc_feature 1..20: note = CRISPR gRNA sequence
  source 1..20: mol_type = other DNA
tgtggttttatttatttatt

SEQ ID NO: 75474 - DNA, 20 bp, synthetic construct
  misc_feature 1..20: note = CRISPR gRNA sequence
  source 1..20: mol_type = other DNA
tggttttatttatttattta

SEQ ID NO: 75475 - DNA, 20 bp, synthetic construct
  misc_feature 1..20: note = CRISPR gRNA sequence
  source 1..20: mol_type = other DNA
tatttatttatttattttga

SEQ ID NO: 75476 - DNA, 20 bp, synthetic construct
  misc_feature 1..20: note = CRISPR gRNA sequence
  source 1..20: mol_type = other DNA
atttatttatttattttgag

SEQ ID NO: 75477 - DNA, 20 bp, synthetic construct
  misc_feature 1..20: note = CRISPR gRNA sequence
  source 1..20: mol_type = other DNA
tttatttatttattttgaga

SEQ ID NO: 75478 - DNA, 20 bp, synthetic construct
  misc_feature 1..20: note = CRISPR gRNA sequence
  source 1..20: mol_type = other DNA
atttatttattttgagatgg

SEQ ID NO: 75479 - DNA, 20 bp, synthetic construct
  misc_feature 1..20: note = CRISPR gRNA sequence
  source 1..20: mol_type = other DNA
tttatttattttgagatgga

SEQ ID NO: 75480 - DNA, 20 bp, synthetic construct
  misc_feature 1..20: note = CRISPR gRNA sequence
  source 1..20: mol_type = other DNA
atttattttgagatggagtc

SEQ ID NO: 75481 - DNA, 20 bp, synthetic construct
  misc_feature 1..20: note = CRISPR gRNA sequence
  source 1..20: mol_type = other DNA
tttattttgagatggagtct

SEQ ID NO: 75482 - DNA, 20 bp, synthetic construct
  misc_feature 1..20: note = CRISPR gRNA sequence
  source 1..20: mol_type = other DNA
attttgagatggagtcttgc

SEQ ID NO: 75483 - DNA, 20 bp, synthetic construct
  misc_feature 1..20: note = CRISPR gRNA sequence
  source 1..20: mol_type = other DNA
ttttgagatggagtcttgct

SEQ ID NO: 75484 - DNA, 20 bp, synthetic construct
  misc_feature 1..20: note = CRISPR gRNA sequence
  source 1..20: mol_type = other DNA
tgagatggagtcttgctctg

SEQ ID NO: 75485 - DNA, 20 bp, synthetic construct
  misc_feature 1..20: note = CRISPR gRNA sequence
  source 1..20: mol_type = other DNA
gagatggagtcttgctctgt

SEQ ID NO: 75486 - DNA, 20 bp, synthetic construct
  misc_feature 1..20: note = CRISPR gRNA sequence
  source 1..20: mol_type = other DNA
agatggagtcttgctctgtt

SEQ ID NO: 75487 - DNA, 20 bp, synthetic construct
  misc_feature 1..20: note = CRISPR gRNA sequence
  source 1..20: mol_type = other DNA
gctctgttgcccaggctgga

SEQ ID NO: 75488 - DNA, 20 bp, synthetic construct
  misc_feature 1..20: note = CRISPR gRNA sequence
  source 1..20: mol_type = other DNA
ctctgttgcccaggctggag

SEQ ID NO: 75489 - DNA, 20 bp, synthetic construct
  misc_feature 1..20: note = CRISPR gRNA sequence
  source 1..20: mol_type = other DNA
tgttgcccaggctggagtgc

SEQ ID NO: 75490 - DNA, 20 bp, synthetic construct
  misc_feature 1..20: note = CRISPR gRNA sequence
  source 1..20: mol_type = other DNA
ttgcccaggctggagtgcaa

SEQ ID NO: 75491 - DNA, 20 bp, synthetic construct
  misc_feature 1..20: note = CRISPR gRNA sequence
  source 1..20: mol_type = other DNA
cccaggctggagtgcaatgg

SEQ ID NO: 75492 - DNA, 20 bp, synthetic construct
  misc_feature 1..20: note = CRISPR gRNA sequence
  source 1..20: mol_type = other DNA
gagtgcaatggcacgatctt

SEQ ID NO: 75493 - DNA, 20 bp, synthetic construct
  misc_feature 1..20: note = CRISPR gRNA sequence
  source 1..20: mol_type = other DNA
ggctcactgcgacctctgtc

SEQ ID NO: 75494 - DNA, 20 bp, synthetic construct
  misc_feature 1..20: note = CRISPR gRNA sequence
  source 1..20: mol_type = other DNA
gctcactgcgacctctgtct

SEQ ID NO: 75495 - DNA, 20 bp, synthetic construct
  misc_feature 1..20: note = CRISPR gRNA sequence
  source 1..20: mol_type = other DNA
actgcgacctctgtctccca

SEQ ID NO: 75496 - DNA, 20 bp, synthetic construct
  misc_feature 1..20: note = CRISPR gRNA sequence
  source 1..20: mol_type = other DNA
cgacctctgtctcccaggtt

SEQ ID NO: 75497 - DNA, 20 bp, synthetic construct
  misc_feature 1..20: note = CRISPR gRNA sequence
  source 1..20: mol_type = other DNA
tgtctcccaggttcaagaga

SEQ ID NO: 75498 - DNA, 20 bp, synthetic construct
  misc_feature 1..20: note = CRISPR gRNA sequence
  source 1..20: mol_type = other DNA
tctcccaggttcaagagatt

SEQ ID NO: 75499 - DNA, 20 bp, synthetic construct
  misc_feature 1..20: note = CRISPR gRNA sequence
  source 1..20: mol_type = other DNA
ccaggttcaagagattctcc

SEQ ID NO: 75500 - DNA, 20 bp, synthetic construct
  misc_feature 1..20: note = CRISPR gRNA sequence
  source 1..20: mol_type = other DNA
aagagattctcctgcctcag

SEQ ID NO: 75501 - DNA, 20 bp, synthetic construct
  misc_feature 1..20: note = CRISPR gRNA sequence
  source 1..20: mol_type = other DNA
tcctgcctcagcctcccaag

SEQ ID NO: 75502 - DNA, 20 bp, synthetic construct
  misc_feature 1..20: note = CRISPR gRNA sequence
  source 1..20: mol_type = other DNA
ctgcctcagcctcccaagta

SEQ ID NO: 75503 - DNA, 20 bp, synthetic construct
  misc_feature 1..20: note = CRISPR gRNA sequence
  source 1..20: mol_type = other DNA
cctcagcctcccaagtagct

SEQ ID NO: 75504 - DNA, 20 bp, synthetic construct
  misc_feature 1..20: note = CRISPR gRNA sequence
  source 1..20: mol_type = other DNA
agcctcccaagtagctggga

SEQ ID NO: 75505 - DNA, 20 bp, synthetic construct
  misc_feature 1..20: note = CRISPR gRNA sequence
  source 1..20: mol_type = other DNA
ccaagtagctgggattacag

SEQ ID NO: 75506 - DNA, 20 bp, synthetic construct
  misc_feature 1..20: note = CRISPR gRNA sequence
  source 1..20: mol_type = other DNA
ggattacaggcatgtgccac

SEQ ID NO: 75507 - DNA, 20 bp, synthetic construct
  misc_feature 1..20: note = CRISPR gRNA sequence
  source 1..20: mol_type = other DNA
caggcatgtgccactatgcc

SEQ ID NO: 75508 - DNA, 20 bp, synthetic construct
  misc_feature 1..20: note = CRISPR gRNA sequence
  source 1..20: mol_type = other DNA
tgcctggctaattatttttg

SEQ ID NO: 75509 - DNA, 20 bp, synthetic construct
  misc_feature 1..20: note = CRISPR gRNA sequence
  source 1..20: mol_type = other DNA
gctaattatttttgtatttt

SEQ ID NO: 75510 - DNA, 20 bp, synthetic construct
  misc_feature 1..20: note = CRISPR gRNA sequence
  source 1..20: mol_type = other DNA
attatttttgtatttttagt

SEQ ID NO: 75511 - DNA, 20 bp, synthetic construct
  misc_feature 1..20: note = CRISPR gRNA sequence
  source 1..20: mol_type = other DNA
tttttgtatttttagtagag

SEQ ID NO: 75512 - DNA, 20 bp, synthetic construct
  misc_feature 1..20: note = CRISPR gRNA sequence
  source 1..20: mol_type = other DNA
ttgtatttttagtagagacg

SEQ ID NO: 75513 - DNA, 20 bp, synthetic construct
  misc_feature 1..20: note = CRISPR gRNA sequence
  source 1..20: mol_type = other DNA
tgtatttttagtagagacgg

SEQ ID NO: 75514 - DNA, 20 bp, synthetic construct
  misc_feature 1..20: note = CRISPR gRNA sequence
  source 1..20: mol_type = other DNA
gtatttttagtagagacggg

SEQ ID NO: 75515 - DNA, 20 bp, synthetic construct
  misc_feature 1..20: note = CRISPR gRNA sequence
  source 1..20: mol_type = other DNA
tatttttagtagagacgggt

SEQ ID NO: 75516 - DNA, 20 bp, synthetic construct
  misc_feature 1..20: note = CRISPR gRNA sequence
  source 1..20: mol_type = other DNA
ttagtagagacgggttttca

SEQ ID NO: 75517 - DNA, 20 bp, synthetic construct
  misc_feature 1..20: note = CRISPR gRNA sequence
  source 1..20: mol_type = other DNA
tagtagagacgggttttcac

SEQ ID NO: 75518 - DNA, 20 bp, synthetic construct
  misc_feature 1..20: note = CRISPR gRNA sequence
  source 1..20: mol_type = other DNA
agtagagacgggttttcacc

SEQ ID NO: 75519 - DNA, 20 bp, synthetic construct
  misc_feature 1..20: note = CRISPR gRNA sequence
  source 1..20: mol_type = other DNA
gtagagacgggttttcacca

SEQ ID NO: 75520 - DNA, 20 bp, synthetic construct
  misc_feature 1..20: note = CRISPR gRNA sequence
  source 1..20: mol_type = other DNA
tcaccatgttgatcaggctg

SEQ ID NO: 75521 - DNA, 20 bp, synthetic construct
  misc_feature 1..20: note = CRISPR gRNA sequence
  source 1..20: mol_type = other DNA
caccatgttgatcaggctgg

SEQ ID NO: 75522 - DNA, 20 bp, synthetic construct
  misc_feature 1..20: note = CRISPR gRNA sequence
  source 1..20: mol_type = other DNA
accatgttgatcaggctggt

SEQ ID NO: 75523 - DNA, 20 bp, synthetic construct
  misc_feature 1..20: note = CRISPR gRNA sequence
  source 1..20: mol_type = other DNA
atcaggctggtctcaaactc

SEQ ID NO: 75524 - DNA, 20 bp, synthetic construct
  misc_feature 1..20: note = CRISPR gRNA sequence
  source 1..20: mol_type = other DNA
gtctcaaactcctgacctca

SEQ ID NO: 75525 - DNA, 20 bp, synthetic construct
  misc_feature 1..20: note = CRISPR gRNA sequence
  source 1..20: mol_type = other DNA
aaactcctgacctcaggtga

SEQ ID NO: 75526 - DNA, 20 bp, synthetic construct
  misc_feature 1..20: note = CRISPR gRNA sequence
  source 1..20: mol_type = other DNA
ctgacctcaggtgatccacc

SEQ ID NO: 75527 - DNA, 20 bp, synthetic construct
  misc_feature 1..20: note = CRISPR gRNA sequence
  source 1..20: mol_type = other DNA
acctcaggtgatccacccgc

SEQ ID NO: 75528 - DNA, 20 bp, synthetic construct
  misc_feature 1..20: note = CRISPR gRNA sequence
  source 1..20: mol_type = other DNA
aggtgatccacccgctttgg

SEQ ID NO: 75529 - DNA, 20 bp, synthetic construct
  misc_feature 1..20: note = CRISPR gRNA sequence
  source 1..20: mol_type = other DNA
tggcctcccaaagtgctggg

SEQ ID NO: 75530 - DNA, 20 bp, synthetic construct
  misc_feature 1..20: note = CRISPR gRNA sequence
  source 1..20: mol_type = other DNA
ggcctcccaaagtgctggga

SEQ ID NO: 75531 - DNA, 20 bp, synthetic construct
  misc_feature 1..20: note = CRISPR gRNA sequence
  source 1..20: mol_type = other DNA
gcctcccaaagtgctgggat

SEQ ID NO: 75532 - DNA, 20 bp, synthetic construct
  misc_feature 1..20: note = CRISPR gRNA sequence
  source 1..20: mol_type = other DNA
ccaaagtgctgggattacag

SEQ ID NO: 75533 - DNA, 20 bp, synthetic construct
  misc_feature 1..20: note = CRISPR gRNA sequence
  source 1..20: mol_type = other DNA
ggattacaggcgtgagccac

SEQ ID NO: 75534 - DNA, 20 bp, synthetic construct
  misc_feature 1..20: note = CRISPR gRNA sequence
  source 1..20: mol_type = other DNA
caggcgtgagccaccacgcc

SEQ ID NO: 75535 - DNA, 20 bp, synthetic construct
  misc_feature 1..20: note = CRISPR gRNA sequence
  source 1..20: mol_type = other DNA
gttttaactacagtttcaga

SEQ ID NO: 75536 - DNA, 20 bp, synthetic construct
  misc_feature 1..20: note = CRISPR gRNA sequence
  source 1..20: mol_type = other DNA
taactacagtttcagaaata

SEQ ID NO: 75537 - DNA, 20 bp, synthetic construct
  misc_feature 1..20: note = CRISPR gRNA sequence
  source 1..20: mol_type = other DNA
aactacagtttcagaaataa

SEQ ID NO: 75538 - DNA, 20 bp, synthetic construct
  misc_feature 1..20: note = CRISPR gRNA sequence
  source 1..20: mol_type = other DNA
actacagtttcagaaataat

SEQ ID NO: 75539 - DNA, 20 bp, synthetic construct
  misc_feature 1..20: note = CRISPR gRNA sequence
  source 1..20: mol_type = other DNA
cagtttcagaaataatataa

SEQ ID NO: 75540 - DNA, 20 bp, synthetic construct
  misc_feature 1..20: note = CRISPR gRNA sequence
  source 1..20: mol_type = other DNA
cagaaataatataaccagtg

SEQ ID NO: 75541 - DNA, 20 bp, synthetic construct
  misc_feature 1..20: note = CRISPR gRNA sequence
  source 1..20: mol_type = other DNA
agaaataatataaccagtgt

SEQ ID NO: 75542 - DNA, 20 bp, synthetic construct
  misc_feature 1..20: note = CRISPR gRNA sequence
  source 1..20: mol_type = other DNA
attttcctcctaggtctgtg

SEQ ID NO: 75543 - DNA, 20 bp, synthetic construct
  misc_feature 1..20: note = CRISPR gRNA sequence
  source 1..20: mol_type = other DNA
tcctcctaggtctgtgacat

SEQ ID NO: 75544 - DNA, 20 bp, synthetic construct
  misc_feature 1..20: note = CRISPR gRNA sequence
  source 1..20: mol_type = other DNA
cctcctaggtctgtgacatt

SEQ ID NO: 75545 - DNA, 20 bp, synthetic construct
  misc_feature 1..20: note = CRISPR gRNA sequence
  source 1..20: mol_type = other DNA
ctcctaggtctgtgacattt

SEQ ID NO: 75546 - DNA, 20 bp, synthetic construct
  misc_feature 1..20: note = CRISPR gRNA sequence
  source 1..20: mol_type = other DNA
ctaggtctgtgacatttttg

SEQ ID NO: 75547 - DNA, 20 bp, synthetic construct
  misc_feature 1..20: note = CRISPR gRNA sequence
  source 1..20: mol_type = other DNA
ggtctgtgacatttttgatg

SEQ ID NO: 75548 - DNA, 20 bp, synthetic construct
  misc_feature 1..20: note = CRISPR gRNA sequence
  source 1..20: mol_type = other DNA
tgacatttttgatgtttgtt

SEQ ID NO: 75549 - DNA, 20 bp, synthetic construct
  misc_feature 1..20: note = CRISPR gRNA sequence
  source 1..20: mol_type = other DNA
ttgatgtttgttaatttcat

SEQ ID NO: 75550 - DNA, 20 bp, synthetic construct
  misc_feature 1..20: note = CRISPR gRNA sequence
  source 1..20: mol_type = other DNA
tgatgtttgttaatttcatc

SEQ ID NO: 75551 - DNA, 20 bp, synthetic construct
  misc_feature 1..20: note = CRISPR gRNA sequence
  source 1..20: mol_type = other DNA
gatgtttgttaatttcatct

SEQ ID NO: 75552 - DNA, 20 bp, synthetic construct
  misc_feature 1..20: note = CRISPR gRNA sequence
  source 1..20: mol_type = other DNA
atgtttgttaatttcatctt

SEQ ID NO: 75553 - DNA, 20 bp, synthetic construct
  misc_feature 1..20: note = CRISPR gRNA sequence
  source 1..20: mol_type = other DNA
gttaatttcatcttttcctg

SEQ ID NO: 75554 - DNA, 20 bp, synthetic construct
  misc_feature 1..20: note = CRISPR gRNA sequence
  source 1..20: mol_type = other DNA
ttaatttcatcttttcctga

SEQ ID NO: 75555 - DNA, 20 bp, synthetic construct
  misc_feature 1..20: note = CRISPR gRNA sequence
  source 1..20: mol_type = other DNA
atttcatcttttcctgagaa

SEQ ID NO: 75556 - DNA, 20 bp, synthetic construct
  misc_feature 1..20: note = CRISPR gRNA sequence
  source 1..20: mol_type = other DNA
catcttttcctgagaaacgt

SEQ ID NO: 75557 - DNA, 20 bp, synthetic construct
  misc_feature 1..20: note = CRISPR gRNA sequence
  source 1..20: mol_type = other DNA
atcttttcctgagaaacgtc

SEQ ID NO: 75558 - DNA, 20 bp, synthetic construct
  misc_feature 1..20: note = CRISPR gRNA sequence
  source 1..20: mol_type = other DNA
ttcctgagaaacgtcattta

SEQ ID NO: 75559 - DNA, 20 bp, synthetic construct
  misc_feature 1..20: note = CRISPR gRNA sequence
  source 1..20: mol_type = other DNA
tcctgagaaacgtcatttaa

SEQ ID NO: 75560 - DNA, 20 bp, synthetic construct
  misc_feature 1..20: note = CRISPR gRNA sequence
  source 1..20: mol_type = other DNA
cctgagaaacgtcatttaaa

SEQ ID NO: 75561 - DNA, 20 bp, synthetic construct
  misc_feature 1..20: note = CRISPR gRNA sequence
  source 1..20: mol_type = other DNA
ctgagaaacgtcatttaaaa

SEQ ID NO: 75562 - DNA, 20 bp, synthetic construct
  misc_feature 1..20: note = CRISPR gRNA sequence
  source 1..20: mol_type = other DNA
agaaacgtcatttaaaaatt

SEQ ID NO: 75563 - DNA, 20 bp, synthetic construct
  misc_feature 1..20: note = CRISPR gRNA sequence
  source 1..20: mol_type = other DNA
aaaaattggtctgtcttatg

SEQ ID NO: 75564 - DNA, 20 bp, synthetic construct
  misc_feature 1..20: note = CRISPR gRNA sequence
  source 1..20: mol_type = other DNA
aaaattggtctgtcttatga

SEQ ID NO: 75565 - DNA, 20 bp, synthetic construct
  misc_feature 1..20: note = CRISPR gRNA sequence
  source 1..20: mol_type = other DNA
gtctgtcttatgaagccact

SEQ ID NO: 75566 - DNA, 20 bp, synthetic construct
  misc_feature 1..20: note = CRISPR gRNA sequence
  source 1..20: mol_type = other DNA
tcttatgaagccacttaata

SEQ ID NO: 75567 - DNA, 20 bp, synthetic construct
  misc_feature 1..20: note = CRISPR gRNA sequence
  source 1..20: mol_type = other DNA
atgaagccacttaataaaat

SEQ ID NO: 75568 - DNA, 20 bp, synthetic construct
  misc_feature 1..20: note = CRISPR gRNA sequence
  source 1..20: mol_type = other DNA
tgaagccacttaataaaata

SEQ ID NO: 75569 - DNA, 20 bp, synthetic construct
  misc_feature 1..20: note = CRISPR gRNA sequence
  source 1..20: mol_type = other DNA
aataaaatagtctttaaaat

SEQ ID NO: 75570 - DNA, 20 bp, synthetic construct
  misc_feature 1..20: note = CRISPR gRNA sequence
  source 1..20: mol_type = other DNA
ataaaatagtctttaaaata

SEQ ID NO: 75571 - DNA, 20 bp, synthetic construct
  misc_feature 1..20: note = CRISPR gRNA sequence
  source 1..20: mol_type = other DNA
taaaataagaaaaattggct

SEQ ID NO: 75572 - DNA, 20 bp, synthetic construct
  misc_feature 1..20: note = CRISPR gRNA sequence
  source 1..20: mol_type = other DNA
aaaataagaaaaattggctg

SEQ ID NO: 75573 - DNA, 20 bp, synthetic construct
  misc_feature 1..20: note = CRISPR gRNA sequence
  source 1..20: mol_type = other DNA
aaataagaaaaattggctgg

SEQ ID NO: 75574 - DNA, 20 bp, synthetic construct
  misc_feature 1..20: note = CRISPR gRNA sequence
  source 1..20: mol_type = other DNA
gctgggtgcggtggctcaag

SEQ ID NO: 75575 - DNA, 20 bp, synthetic construct
  misc_feature 1..20: note = CRISPR gRNA sequence
  source 1..20: mol_type = other DNA
ggtgcggtggctcaaggctg

SEQ ID NO: 75576 - DNA, 20 bp, synthetic construct
  misc_feature 1..20: note = CRISPR gRNA sequence
  source 1..20: mol_type = other DNA
aaggctgtaatcccagcact

SEQ ID NO: 75577 - DNA, 20 bp, synthetic construct
  misc_feature 1..20: note = CRISPR gRNA sequence
  source 1..20: mol_type = other DNA
taatcccagcactttgggag

SEQ ID NO: 75578 - DNA, 20 bp, synthetic construct
  misc_feature 1..20: note = CRISPR gRNA sequence
  source 1..20: mol_type = other DNA
tgggagggcgaggcaggcgg

SEQ ID NO: 75579 - DNA, 20 bp, synthetic construct
  misc_feature 1..20: note = CRISPR gRNA sequence
  source 1..20: mol_type = other DNA
gggagggcgaggcaggcgga

SEQ ID NO: 75580 - DNA, 20 bp, synthetic construct
  misc_feature 1..20: note = CRISPR gRNA sequence
  source 1..20: mol_type = other DNA
ggagggcgaggcaggcggat

SEQ ID NO: 75581 - DNA, 20 bp, synthetic construct
  misc_feature 1..20: note = CRISPR gRNA sequence
  source 1..20: mol_type = other DNA
aggtcaggagttcaagacca

SEQ ID NO: 75582 - DNA, 20 bp, synthetic construct
  misc_feature 1..20: note = CRISPR gRNA sequence
  source 1..20: mol_type = other DNA
aagaccagcctggccaacat

SEQ ID NO: 75583 - DNA, 20 bp, synthetic construct
  misc_feature 1..20: note = CRISPR gRNA sequence
  source 1..20: mol_type = other DNA
gccaacatggtgaaaccccg

SEQ ID NO: 75584 - DNA, 20 bp, synthetic construct
  misc_feature 1..20: note = CRISPR gRNA sequence
  source 1..20: mol_type = other DNA
tactaaaaataccaaaatta

SEQ ID NO: 75585 - DNA, 20 bp, synthetic construct
  misc_feature 1..20: note = CRISPR gRNA sequence
  source 1..20: mol_type = other DNA
ctaaaaataccaaaattagc

SEQ ID NO: 75586 - DNA, 20 bp, synthetic construct
  misc_feature 1..20: note = CRISPR gRNA sequence
  source 1..20: mol_type = other DNA
aaaataccaaaattagccag

SEQ ID NO: 75587 - DNA, 20 bp, synthetic construct
  misc_feature 1..20: note = CRISPR gRNA sequence
  source 1..20: mol_type = other DNA
gccaggcatggtggctcatg

SEQ ID NO: 75588 - DNA, 20 bp, synthetic construct
  misc_feature 1..20: note = CRISPR gRNA sequence
  source 1..20: mol_type = other DNA
atgcctgtaatctcagctcc

SEQ ID NO: 75589 - DNA, 20 bp, synthetic construct
  misc_feature 1..20: note = CRISPR gRNA sequence
  source 1..20: mol_type = other DNA
taatctcagctccttgggag

SEQ ID NO: 75590 - DNA, 20 bp, synthetic construct
  misc_feature 1..20: note = CRISPR gRNA sequence
  source 1..20: mol_type = other DNA
agctccttgggaggctgagg

SEQ ID NO: 75591 - DNA, 20 bp, synthetic construct
  misc_feature 1..20: note = CRISPR gRNA sequence
  source 1..20: mol_type = other DNA
cttgggaggctgaggcagga

SEQ ID NO: 75592 - DNA, 20 bp, synthetic construct
  misc_feature 1..20: note = CRISPR gRNA sequence
  source 1..20: mol_type = other DNA
gggaggctgaggcaggagaa

SEQ ID NO: 75593 - DNA, 20 bp, synthetic construct
  misc_feature 1..20: note = CRISPR gRNA sequence
  source 1..20: mol_type = other DNA
ggaggctgaggcaggagaat

SEQ ID NO: 75594 - DNA, 20 bp, synthetic construct
  misc_feature 1..20: note = CRISPR gRNA sequence
  source 1..20: mol_type = other DNA
aggcaggagaattgcttgaa

SEQ ID NO: 75595 - DNA, 20 bp, synthetic construct
  misc_feature 1..20: note = CRISPR gRNA sequence
  source 1..20: mol_type = other DNA
cttgaacctgggaggcggaa

SEQ ID NO: 75596 - DNA, 20 bp, synthetic construct
  misc_feature 1..20: note = CRISPR gRNA sequence
  source 1..20: mol_type = other DNA
gaacctgggaggcggaagtt

SEQ ID NO: 75597 - DNA, 20 bp, synthetic construct
  misc_feature 1..20: note = CRISPR gRNA sequence
  source 1..20: mol_type = other DNA
aacctgggaggcggaagttg

SEQ ID NO: 75598 - DNA, 20 bp, synthetic construct
  misc_feature 1..20: note = CRISPR gRNA sequence
  source 1..20: mol_type = other DNA
ggaggcggaagttgcagtga

SEQ ID NO: 75599 - DNA, 20 bp, synthetic construct
  misc_feature 1..20: note = CRISPR gRNA sequence
  source 1..20: mol_type = other DNA
cagtgagccgaaattgcgcc

SEQ ID NO: 75600 - DNA, 20 bp, synthetic construct
  misc_feature 1..20: note = CRISPR gRNA sequence
  source 1..20: mol_type = other DNA
cgccactgcattccagcctg

SEQ ID NO: 75601 - DNA, 20 bp, synthetic construct
  misc_feature 1..20: note = CRISPR gRNA sequence
  source 1..20: mol_type = other DNA
cattccagcctgggcagcag

SEQ ID NO: 75602 - DNA, 20 bp, synthetic construct
  misc_feature 1..20: note = CRISPR gRNA sequence
  source 1..20: mol_type = other DNA
cagcctgggcagcagagaaa

SEQ ID NO: 75603 - DNA, 20 bp, synthetic construct
  misc_feature 1..20: note = CRISPR gRNA sequence
  source 1..20: mol_type = other DNA
ggcagcagagaaagactcca

SEQ ID NO: 75604 - DNA, 20 bp, synthetic construct
  misc_feature 1..20: note = CRISPR gRNA sequence
  source 1..20: mol_type = other DNA
catctaaaaaaaaagaaaga

SEQ ID NO: 75605 - DNA, 20 bp, synthetic construct
  misc_feature 1..20: note = CRISPR gRNA sequence
  source 1..20: mol_type = other DNA
aaaaaaaagaaagaaagaaa

SEQ ID NO: 75606 - DNA, 20 bp, synthetic construct
  misc_feature 1..20: note = CRISPR gRNA sequence
  source 1..20: mol_type = other DNA
ccctctataatgaaaaacaa

SEQ ID NO: 75607 - DNA, 20 bp, synthetic construct
  misc_feature 1..20: note = CRISPR gRNA sequence
  source 1..20: mol_type = other DNA
cctctataatgaaaaacaaa

SEQ ID NO: 75608 - DNA, 20 bp, synthetic construct
  misc_feature 1..20: note = CRISPR gRNA sequence
  source 1..20: mol_type = other DNA
tataatgaaaaacaaaaaac

SEQ ID NO: 75609 - DNA, 20 bp, synthetic construct
  misc_feature 1..20: note = CRISPR gRNA sequence
  source 1..20: mol_type = other DNA
taatgaaaaacaaaaaactc

SEQ ID NO: 75610 - DNA, 20 bp, synthetic construct
  misc_feature 1..20: note = CRISPR gRNA sequence
  source 1..20: mol_type = other DNA
aaagacatatttcttattca

SEQ ID NO: 75611 - DNA, 20 bp, synthetic construct
  misc_feature 1..20: note = CRISPR gRNA sequence
  source 1..20: mol_type = other DNA
cttattcatatctgtttaaa

SEQ ID NO: 75612 - DNA, 20 bp, synthetic construct
  misc_feature 1..20: note = CRISPR gRNA sequence
  source 1..20: mol_type = other DNA
ttattcatatctgtttaaaa

SEQ ID NO: 75613 - DNA, 20 bp, synthetic construct
  misc_feature 1..20: note = CRISPR gRNA sequence
  source 1..20: mol_type = other DNA
attcatatctgtttaaaata

SEQ ID NO: 75614 - DNA, 20 bp, synthetic construct
  misc_feature 1..20: note = CRISPR gRNA sequence
  source 1..20: mol_type = other DNA
ttcatatctgtttaaaatac

SEQ ID NO: 75615 - DNA, 20 bp, synthetic construct
  misc_feature 1..20: note = CRISPR gRNA sequence
  source 1..20: mol_type = other DNA
atatctgtttaaaatacatt

SEQ ID NO: 75616 - DNA, 20 bp, synthetic construct
  misc_feature 1..20: note = CRISPR gRNA sequence
  source 1..20: mol_type = other DNA
tttaaaatacattccaagca

SEQ ID NO: 75617 - DNA, 20 bp, synthetic construct
  misc_feature 1..20: note = CRISPR gRNA sequence
  source 1..20: mol_type = other DNA
aaaatacattccaagcacag

SEQ ID NO: 75618 - DNA, 20 bp, synthetic construct
  misc_feature 1..20: note = CRISPR gRNA sequence
  source 1..20: mol_type = other DNA
aaatacattccaagcacagc

SEQ ID NO: 75619 - DNA, 20 bp, synthetic construct
  misc_feature 1..20: note = CRISPR gRNA sequence
  source 1..20: mol_type = other DNA
caagcacagcggctcatgcc

SEQ ID NO: 75620 - DNA, 20 bp, synthetic construct
  misc_feature 1..20: note = CRISPR gRNA sequence
  source 1..20: mol_type = other DNA
atgcctgtaatctcagcaac

SEQ ID NO: 75621 - DNA, 20 bp, synthetic construct
  misc_feature 1..20: note = CRISPR gRNA sequence
  source 1..20: mol_type = other DNA
taatctcagcaacctgggag

SEQ ID NO: 75622 - DNA, 20 bp, synthetic construct
  misc_feature 1..20: note = CRISPR gRNA sequence
  source 1..20: mol_type = other DNA
agcaacctgggaggctgagg

SEQ ID NO: 75623 - DNA, 20 bp, synthetic construct
  misc_feature 1..20: note = CRISPR gRNA sequence
  source 1..20: mol_type = other DNA
ggaggctgaggatcacctga

SEQ ID NO: 75624 - DNA, 20 bp, synthetic construct
  misc_feature 1..20: note = CRISPR gRNA sequence
  source 1..20: mol_type = other DNA
aggatcacctgagctcagaa

SEQ ID NO: 75625 - DNA, 20 bp, synthetic construct
  misc_feature 1..20: note = CRISPR gRNA sequence
  source 1..20: mol_type = other DNA
agctcagaagtttgagacca

SEQ ID NO: 75626 - DNA, 20 bp, synthetic construct
  misc_feature 1..20: note = CRISPR gRNA sequence
  source 1..20: mol_type = other DNA
agaagtttgagaccaacctg

SEQ ID NO: 75627 - DNA, 20 bp, synthetic construct
  misc_feature 1..20: note = CRISPR gRNA sequence
  source 1..20: mol_type = other DNA
gagaccaacctggggaacat

SEQ ID NO: 75628 - DNA, 20 bp, synthetic construct
  misc_feature 1..20: note = CRISPR gRNA sequence
  source 1..20: mol_type = other DNA
agaccaacctggggaacatg

SEQ ID NO: 75629 - DNA, 20 bp, synthetic construct
  misc_feature 1..20: note = CRISPR gRNA sequence
  source 1..20: mol_type = other DNA
gggaacatggtgagacttca

SEQ ID NO: 75630 - DNA, 20 bp, synthetic construct
  misc_feature 1..20: note = CRISPR gRNA sequence
  source 1..20: mol_type = other DNA
catctcttacaaaactaaac

SEQ ID NO: 75631 - DNA, 20 bp, synthetic construct
  misc_feature 1..20: note = CRISPR gRNA sequence
  source 1..20: mol_type = other DNA
atctcttacaaaactaaact

SEQ ID NO: 75632 - DNA, 20 bp, synthetic construct
  misc_feature 1..20: note = CRISPR gRNA sequence
  source 1..20: mol_type = other DNA
ttacaaaactaaactattag

SEQ ID NO: 75633 - DNA, 20 bp, synthetic construct
  misc_feature 1..20: note = CRISPR gRNA sequence
  source 1..20: mol_type = other DNA
acaaaactaaactattagcc

SEQ ID NO: 75634 - DNA, 20 bp, synthetic construct
  misc_feature 1..20: note = CRISPR gRNA sequence
  source 1..20: mol_type = other DNA
caaaactaaactattagcca

SEQ ID NO: 75635 - DNA, 20 bp, synthetic construct
  misc_feature 1..20: note = CRISPR gRNA sequence
  source 1..20: mol_type = other DNA
aactattagccaggcatgtt

SEQ ID NO: 75636 - DNA, 20 bp, synthetic construct
  misc_feature 1..20: note = CRISPR gRNA sequence
  source 1..20: mol_type = other DNA
ttagccaggcatgttggtgt

SEQ ID NO: 75637 - DNA, 20 bp, synthetic construct
  misc_feature 1..20: note = CRISPR gRNA sequence
  source 1..20: mol_type = other DNA
gccaggcatgttggtgtgtg

SEQ ID NO: 75638 - DNA, 20 bp, synthetic construct
  misc_feature 1..20: note = CRISPR gRNA sequence
  source 1..20: mol_type = other DNA
gtgtgtgcctgtagtcccag

SEQ ID NO: 75639 - DNA, 20 bp, synthetic construct
  misc_feature 1..20: note = CRISPR gRNA sequence
  source 1..20: mol_type = other DNA
tagtcccagctactccagag

SEQ ID NO: 75640 - DNA, 20 bp, synthetic construct
  misc_feature 1..20: note = CRISPR gRNA sequence
  source 1..20: mol_type = other DNA
ctccagaggctgaggtggga

SEQ ID NO: 75641 - DNA, 20 bp, synthetic construct
  misc_feature 1..20: note = CRISPR gRNA sequence
  source 1..20: mol_type = other DNA
cagaggctgaggtgggagga

SEQ ID NO: 75642 - DNA, 20 bp, synthetic construct
  misc_feature 1..20: note = CRISPR gRNA sequence
  source 1..20: mol_type = other DNA
aggtgggaggatcgcttgag

SEQ ID NO: 75643 - DNA, 20 bp, synthetic construct
  misc_feature 1..20: note = CRISPR gRNA sequence
  source 1..20: mol_type = other DNA
gagcccaggagttggaggct

SEQ ID NO: 75644 - DNA, 20 bp, synthetic construct
  misc_feature 1..20: note = CRISPR gRNA sequence
  source 1..20: mol_type = other DNA
agcccaggagttggaggctg

SEQ ID NO: 75645 - DNA, 20 bp, synthetic construct
  misc_feature 1..20: note = CRISPR gRNA sequence
  source 1..20: mol_type = other DNA
gaggctgcagtgacctatca

SEQ ID NO: 75646 - DNA, 20 bp, synthetic construct
  misc_feature 1..20: note = CRISPR gRNA sequence
  source 1..20: mol_type = other DNA
cagtgacctatcattgcacc

SEQ ID NO: 75647 - DNA, 20 bp, synthetic construct
  misc_feature 1..20: note = CRISPR gRNA sequence
  source 1..20: mol_type = other DNA
tcattgcaccactgcactcc

SEQ ID NO: 75648 - DNA, 20 bp, synthetic construct
  misc_feature 1..20: note = CRISPR gRNA sequence
  source 1..20: mol_type = other DNA
caccactgcactccagcctg

SEQ ID NO: 75649 - DNA, 20 bp, synthetic construct
  misc_feature 1..20: note = CRISPR gRNA sequence
  source 1..20: mol_type = other DNA
cactccagcctgggcaacag

SEQ ID NO: 75650 - DNA, 20 bp, synthetic construct
  misc_feature 1..20: note = CRISPR gRNA sequence
  source 1..20: mol_type = other DNA
cagcctgggcaacagagtga

SEQ ID NO: 75651 - DNA, 20 bp, synthetic construct
  misc_feature 1..20: note = CRISPR gRNA sequence
  source 1..20: mol_type = other DNA
ggcaacagagtgagacccca

SEQ ID NO: 75652 - DNA, 20 bp, synthetic construct
  misc_feature 1..20: note = CRISPR gRNA sequence
  source 1..20: mol_type = other DNA
aaaaaaaaaagaaatccatg

SEQ ID NO: 75653 - DNA, 20 bp, synthetic construct
  misc_feature 1..20: note = CRISPR gRNA sequence
  source 1..20: mol_type = other DNA
aaaaaaaaagaaatccatga

SEQ ID NO: 75654 - DNA, 20 bp, synthetic construct
  misc_feature 1..20: note = CRISPR gRNA sequence
  source 1..20: mol_type = other DNA
tatcagtcacatttttcttc

SEQ ID NO: 75655 - DNA, 20 bp, synthetic construct
  misc_feature 1..20: note = CRISPR gRNA sequence
  source 1..20: mol_type = other DNA
atcagtcacatttttcttct

SEQ ID NO: 75656 - DNA, 20 bp, synthetic construct
  misc_feature 1..20: note = CRISPR gRNA sequence
  source 1..20: mol_type = other DNA
tcagtcacatttttcttctc

SEQ ID NO: 75657 - DNA, 20 bp, synthetic construct
  misc_feature 1..20: note = CRISPR gRNA sequence
  source 1..20: mol_type = other DNA
ttcttctctgccacatcaca

SEQ ID NO: 75658 - DNA, 20 bp, synthetic construct
  misc_feature 1..20: note = CRISPR gRNA sequence
  source 1..20: mol_type = other DNA
tcttctctgccacatcacaa

SEQ ID NO: 75659 - DNA, 20 bp, synthetic construct
  misc_feature 1..20: note = CRISPR gRNA sequence
  source 1..20: mol_type = other DNA
cttctctgccacatcacaac

SEQ ID NO: 75660 - DNA, 20 bp, synthetic construct
  misc_feature 1..20: note = CRISPR gRNA sequence
  source 1..20: mol_type = other DNA
ttctctgccacatcacaaca

SEQ ID NO: 75661 - DNA, 20 bp, synthetic construct
  misc_feature 1..20: note = CRISPR gRNA sequence
  source 1..20: mol_type = other DNA
ctctgccacatcacaacaga

SEQ ID NO: 75662 - DNA, 20 bp, synthetic construct
  misc_feature 1..20: note = CRISPR gRNA sequence
  source 1..20: mol_type = other DNA
tctgccacatcacaacagaa

SEQ ID NO: 75663 - DNA, 20 bp, synthetic construct
  misc_feature 1..20: note = CRISPR gRNA sequence
  source 1..20: mol_type = other DNA
tgccacatcacaacagaaat

SEQ ID NO: 75664 - DNA, 20 bp, synthetic construct
  misc_feature 1..20: note = CRISPR gRNA sequence
  source 1..20: mol_type = other DNA
ccacatcacaacagaaatga

SEQ ID NO: 75665 - DNA, 20 bp, synthetic construct
  misc_feature 1..20: note = CRISPR gRNA sequence
  source 1..20: mol_type = other DNA
tgtggcatttttggcggact

SEQ ID NO: 75666 - DNA, 20 bp, synthetic construct
  misc_feature 1..20: note = CRISPR gRNA sequence
  source 1..20: mol_type = other DNA
ttggcggactgctctctcta

SEQ ID NO: 75667 - DNA, 20 bp, synthetic construct
  misc_feature 1..20: note = CRISPR gRNA sequence
  source 1..20: mol_type = other DNA
tggcggactgctctctctat

SEQ ID NO: 75668 - DNA, 20 bp, synthetic construct
  misc_feature 1..20: note = CRISPR gRNA sequence
  source 1..20: mol_type = other DNA
ggcggactgctctctctatt

SEQ ID NO: 75669 - DNA, 20 bp, synthetic construct
  misc_feature 1..20: note = CRISPR gRNA sequence
  source 1..20: mol_type = other DNA
gcggactgctctctctattt

SEQ ID NO: 75670 - DNA, 20 bp, synthetic construct
  misc_feature 1..20: note = CRISPR gRNA sequence
  source 1..20: mol_type = other DNA
ctctctctatttcccactgg

SEQ ID NO: 75671 - DNA, 20 bp, synthetic construct
  misc_feature 1..20: note = CRISPR gRNA sequence
  source 1..20: mol_type = other DNA
tctctatttcccactggtcc

SEQ ID NO: 75672 - DNA, 20 bp, synthetic construct
  misc_feature 1..20: note = CRISPR gRNA sequence
  source 1..20: mol_type = other DNA
tctatttcccactggtccta

SEQ ID NO: 75673 - DNA, 20 bp, synthetic construct
  misc_feature 1..20: note = CRISPR gRNA sequence
  source 1..20: mol_type = other DNA
tatttcccactggtcctagg

SEQ ID NO: 75674 - DNA, 20 bp, synthetic construct
  misc_feature 1..20: note = CRISPR gRNA sequence
  source 1..20: mol_type = other DNA
tttcccactggtcctaggct

SEQ ID NO: 75675 - DNA, 20 bp, synthetic construct
  misc_feature 1..20: note = CRISPR gRNA sequence
  source 1..20: mol_type = other DNA
cccactggtcctaggctgga

SEQ ID NO: 75676 - DNA, 20 bp, synthetic construct
  misc_feature 1..20: note = CRISPR gRNA sequence
  source 1..20: mol_type = other DNA
ccactggtcctaggctggat

SEQ ID NO: 75677 - DNA, 20 bp, synthetic construct
  misc_feature 1..20: note = CRISPR gRNA sequence
  source 1..20: mol_type = other DNA
gtcctaggctggattcccaa

SEQ ID NO: 75678 - DNA, 20 bp, synthetic construct
  misc_feature 1..20: note = CRISPR gRNA sequence
  source 1..20: mol_type = other DNA
ggctggattcccaatgcgtc

SEQ ID NO: 75679 - DNA, 20 bp, synthetic construct
  misc_feature 1..20: note = CRISPR gRNA sequence
  source 1..20: mol_type = other DNA
gattcccaatgcgtctgagc

SEQ ID NO: 75680 - DNA, 20 bp, synthetic construct
  misc_feature 1..20: note = CRISPR gRNA sequence
  source 1..20: mol_type = other DNA
ccaatgcgtctgagcaggga

SEQ ID NO: 75681 - DNA, 20 bp, synthetic construct
  misc_feature 1..20: note = CRISPR gRNA sequence
  source 1..20: mol_type = other DNA
agcagggactctgcatttta

SEQ ID NO: 75682 - DNA, 20 bp, synthetic construct
  misc_feature 1..20: note = CRISPR gRNA sequence
  source 1..20: mol_type = other DNA
tgcattttactagctgtgtg

SEQ ID NO: 75683 - DNA, 20 bp, synthetic construct
  misc_feature 1..20: note = CRISPR gRNA sequence
  source 1..20: mol_type = other DNA
cattttactagctgtgtgac

SEQ ID NO: 75684 - DNA, 20 bp, synthetic construct
  misc_feature 1..20: note = CRISPR gRNA sequence
  source 1..20: mol_type = other DNA
tactagctgtgtgaccttgg

SEQ ID NO: 75685 - DNA, 20 bp, synthetic construct
  misc_feature 1..20: note = CRISPR gRNA sequence
  source 1..20: mol_type = other DNA
actagctgtgtgaccttggg

SEQ ID NO: 75686 - DNA, 20 bp, synthetic construct
  misc_feature 1..20: note = CRISPR gRNA sequence
  source 1..20: mol_type = other DNA
ctagctgtgtgaccttgggc

SEQ ID NO: 75687 - DNA, 20 bp, synthetic construct
  misc_feature 1..20: note = CRISPR gRNA sequence
  source 1..20: mol_type = other DNA
gctgtgtgaccttgggcaag

SEQ ID NO: 75688 - DNA, 20 bp, synthetic construct
  misc_feature 1..20: note = CRISPR gRNA sequence
  source 1..20: mol_type = other DNA
tgtgaccttgggcaagttct

SEQ ID NO: 75689 - DNA, 20 bp, synthetic construct
  misc_feature 1..20: note = CRISPR gRNA sequence
  source 1..20: mol_type = other DNA
gggcaagttcttacaccctc

SEQ ID NO: 75690 - DNA, 20 bp, synthetic construct
  misc_feature 1..20: note = CRISPR gRNA sequence
  source 1..20: mol_type = other DNA
ggcaagttcttacaccctct

SEQ ID NO: 75691 - DNA, 20 bp, synthetic construct
  misc_feature 1..20: note = CRISPR gRNA sequence
  source 1..20: mol_type = other DNA
ttacaccctctgtgtctcag

SEQ ID NO: 75692 - DNA, 20 bp, synthetic construct
  misc_feature 1..20: note = CRISPR gRNA sequence
  source 1..20: mol_type = other DNA
acaccctctgtgtctcagtt

SEQ ID NO: 75693 - DNA, 20 bp, synthetic construct
  misc_feature 1..20: note = CRISPR gRNA sequence
  source 1..20: mol_type = other DNA
caccctctgtgtctcagttc

SEQ ID NO: 75694 - DNA, 20 bp, synthetic construct
  misc_feature 1..20: note = CRISPR gRNA sequence
  source 1..20: mol_type = other DNA
tgtgtctcagttccctcatc

SEQ ID NO: 75695 - DNA, 20 bp, synthetic construct
  misc_feature 1..20: note = CRISPR gRNA sequence
  source 1..20: mol_type = other DNA
tgtctcagttccctcatctg

SEQ ID NO: 75696 - DNA, 20 bp, synthetic construct
  misc_feature 1..20: note = CRISPR gRNA sequence
  source 1..20: mol_type = other DNA
agttccctcatctgtaaaat

SEQ ID NO: 75697 - DNA, 20 bp, synthetic construct
  misc_feature 1..20: note = CRISPR gRNA sequence
  source 1..20: mol_type = other DNA
cctcatctgtaaaatgagaa

SEQ ID NO: 75698 - DNA, 20 bp, synthetic construct
  misc_feature 1..20: note = CRISPR gRNA sequence
  source 1..20: mol_type = other DNA
atctgtaaaatgagaacaat

SEQ ID NO: 75699 - DNA, 20 bp, synthetic construct
  misc_feature 1..20: note = CRISPR gRNA sequence
  source 1..20: mol_type = other DNA
taaaatgagaacaatactag

SEQ ID NO: 75700 - DNA, 20 bp, synthetic construct
  misc_feature 1..20: note = CRISPR gRNA sequence
  source 1..20: mol_type = other DNA
gtatccagggatatgggaaa

SEQ ID NO: 75701 - DNA, 20 bp, synthetic construct
  misc_feature 1..20: note = CRISPR gRNA sequence
  source 1..20: mol_type = other DNA
agaacagtggagaaagtgct

SEQ ID NO: 75702 - DNA, 20 bp, synthetic construct
  misc_feature 1..20: note = CRISPR gRNA sequence
  source 1..20: mol_type = other DNA
gaacagtggagaaagtgctc

SEQ ID NO: 75703 - DNA, 20 bp, synthetic construct
  misc_feature 1..20: note = CRISPR gRNA sequence
  source 1..20: mol_type = other DNA
agtagctgttagctattatt

SEQ ID NO: 75704 - DNA, 20 bp, synthetic construct
  misc_feature 1..20: note = CRISPR gRNA sequence
  source 1..20: mol_type = other DNA
ttagctattattattccacc

SEQ ID NO: 75705 - DNA, 20 bp, synthetic construct
  misc_feature 1..20: note = CRISPR gRNA sequence
  source 1..20: mol_type = other DNA
gctattattattccacccat

SEQ ID NO: 75706 - DNA, 20 bp, synthetic construct
  misc_feature 1..20: note = CRISPR gRNA sequence
  source 1..20: mol_type = other DNA
ttattattccacccatgcag

SEQ ID NO: 75707 - DNA, 20 bp, synthetic construct
  misc_feature 1..20: note = CRISPR gRNA sequence
  source 1..20: mol_type = other DNA
ttattccacccatgcagggg

SEQ ID NO: 75708 - DNA, 20 bp, synthetic construct
  misc_feature 1..20: note = CRISPR gRNA sequence
  source 1..20: mol_type = other DNA
ttccacccatgcaggggctg

SEQ ID NO: 75709 - DNA, 20 bp, synthetic construct
  misc_feature 1..20: note = CRISPR gRNA sequence
  source 1..20: mol_type = other DNA
cacccatgcaggggctgact

SEQ ID NO: 75710 - DNA, 20 bp, synthetic construct
  misc_feature 1..20: note = CRISPR gRNA sequence
  source 1..20: mol_type = other DNA
actatttgaatatccaagac

SEQ ID NO: 75711 - DNA, 20 bp, synthetic construct
  misc_feature 1..20: note = CRISPR gRNA sequence
  source 1..20: mol_type = other DNA
tttgaatatccaagacaggc

SEQ ID NO: 75712 - DNA, 20 bp, synthetic construct
  misc_feature 1..20: note = CRISPR gRNA sequence
  source 1..20: mol_type = other DNA
gaatatccaagacaggccac

SEQ ID NO: 75713 - DNA, 20 bp, synthetic construct
  misc_feature 1..20: note = CRISPR gRNA sequence
  source 1..20: mol_type = other DNA
aatatccaagacaggccacg

SEQ ID NO: 75714 - DNA, 20 bp, synthetic construct
  misc_feature 1..20: note = CRISPR gRNA sequence
  source 1..20: mol_type = other DNA
aacaatacaagagactgcaa

SEQ ID NO: 75715 - DNA, 20 bp, synthetic construct
  misc_feature 1..20: note = CRISPR gRNA sequence
  source 1..20: mol_type = other DNA
caagaccccaccctggctgg

SEQ ID NO: 75716 - DNA, 20 bp, synthetic construct
  misc_feature 1..20: note = CRISPR gRNA sequence
  source 1..20: mol_type = other DNA
gctggctctgcgtccctcct

SEQ ID NO: 75717 - DNA, 20 bp, synthetic construct
  misc_feature 1..20: note = CRISPR gRNA sequence
  source 1..20: mol_type = other DNA
gctctgcgtccctcctcagg

SEQ ID NO: 75718 - DNA, 20 bp, synthetic construct
  misc_feature 1..20: note = CRISPR gRNA sequence
  source 1..20: mol_type = other DNA
tgcgtccctcctcaggcaga

SEQ ID NO: 75719 - DNA, 20 bp, synthetic construct
  misc_feature 1..20: note = CRISPR gRNA sequence
  source 1..20: mol_type = other DNA
cgtccctcctcaggcagagt

SEQ ID NO: 75720 - DNA, 20 bp, synthetic construct
  misc_feature 1..20: note = CRISPR gRNA sequence
  source 1..20: mol_type = other DNA
ctcaggcagagtcatccggt

SEQ ID NO: 75721 - DNA, 20 bp, synthetic construct
  misc_feature 1..20: note = CRISPR gRNA sequence
  source 1..20: mol_type = other DNA
aggcagagtcatccggtact

SEQ ID NO: 75722 - DNA, 20 bp, synthetic construct
  misc_feature 1..20: note = CRISPR gRNA sequence
  source 1..20: mol_type = other DNA
ttaaccacctgctgggccaa

SEQ ID NO: 75723 - DNA, 20 bp, synthetic construct
  misc_feature 1..20: note = CRISPR gRNA sequence
  source 1..20: mol_type = other DNA
taaccacctgctgggccaac

SEQ ID NO: 75724 - DNA, 20 bp, synthetic construct
  misc_feature 1..20: note = CRISPR gRNA sequence
  source 1..20: mol_type = other DNA
aaccacctgctgggccaaca

SEQ ID NO: 75725 - DNA, 20 bp, synthetic construct
  misc_feature 1..20: note = CRISPR gRNA sequence
  source 1..20: mol_type = other DNA
accacctgctgggccaacaa

SEQ ID NO: 75726 - DNA, 20 bp, synthetic construct
  misc_feature 1..20: note = CRISPR gRNA sequence
  source 1..20: mol_type = other DNA
ctgggccaacaatgaatcct

SEQ ID NO: 75727 - DNA, 20 bp, synthetic construct
  misc_feature 1..20: note = CRISPR gRNA sequence
  source 1..20: mol_type = other DNA
ggccaacaatgaatcctgcg

SEQ ID NO: 75728 - DNA, 20 bp, synthetic construct
  misc_feature 1..20: note = CRISPR gRNA sequence
  source 1..20: mol_type = other DNA
cgttttagcccccatctgcc

SEQ ID NO: 75729 - DNA, 20 bp, synthetic construct
  misc_feature 1..20: note = CRISPR gRNA sequence
  source 1..20: mol_type = other DNA
tagcccccatctgccagcag

SEQ ID NO: 75730 - DNA, 20 bp, synthetic construct
  misc_feature 1..20: note = CRISPR gRNA sequence
  source 1..20: mol_type = other DNA
agcccccatctgccagcaga

SEQ ID NO: 75731 - DNA, 20 bp, synthetic construct
  misc_feature 1..20: note = CRISPR gRNA sequence
  source 1..20: mol_type = other DNA
gcccccatctgccagcagag

SEQ ID NO: 75732 - DNA, 20 bp, synthetic construct
  misc_feature 1..20: note = CRISPR gRNA sequence
  source 1..20: mol_type = other DNA
ccagcagagcttgcacatac

SEQ ID NO: 75733 - DNA, 20 bp, synthetic construct
  misc_feature 1..20: note = CRISPR gRNA sequence
  source 1..20: mol_type = other DNA
gcacatacttgaggctgagg

SEQ ID NO: 75734 - DNA, 20 bp, synthetic construct
  misc_feature 1..20: note = CRISPR gRNA sequence
  source 1..20: mol_type = other DNA
cacatacttgaggctgaggg

SEQ ID NO: 75735 - DNA, 20 bp, synthetic construct
  misc_feature 1..20: note = CRISPR gRNA sequence
  source 1..20: mol_type = other DNA
gaggctgagggctgcccaag

SEQ ID NO: 75736 - DNA, 20 bp, synthetic construct
  misc_feature 1..20: note = CRISPR gRNA sequence
  source 1..20: mol_type = other DNA
aggctgagggctgcccaagt

SEQ ID NO: 75737 - DNA, 20 bp, synthetic construct
  misc_feature 1..20: note = CRISPR gRNA sequence
  source 1..20: mol_type = other DNA
agggctgcccaagtcagagg

SEQ ID NO: 75738 - DNA, 20 bp, synthetic construct
  misc_feature 1..20: note = CRISPR gRNA sequence
  source 1..20: mol_type = other DNA
cccaagtcagagggcacacc

SEQ ID NO: 75739 - DNA, 20 bp, synthetic construct
  misc_feature 1..20: note = CRISPR gRNA sequence
  source 1..20: mol_type = other DNA
gctccaccatggcgagagtg

SEQ ID NO: 75740 - DNA, 20 bp, synthetic construct
  misc_feature 1..20: note = CRISPR gRNA sequence
  source 1..20: mol_type = other DNA
caccatggcgagagtggggg

SEQ ID NO: 75741 - DNA, 20 bp, synthetic construct
  misc_feature 1..20: note = CRISPR gRNA sequence
  source 1..20: mol_type = other DNA
attcagggaagctttgggta

SEQ ID NO: 75742 - DNA, 20 bp, synthetic construct
  misc_feature 1..20: note = CRISPR gRNA sequence
  source 1..20: mol_type = other DNA
agggaagctttgggtatgtg

SEQ ID NO: 75743 - DNA, 20 bp, synthetic construct
  misc_feature 1..20: note = CRISPR gRNA sequence
  source 1..20: mol_type = other DNA
tgggtatgtgacccaggcat

SEQ ID NO: 75744 - DNA, 20 bp, synthetic construct
  misc_feature 1..20: note = CRISPR gRNA sequence
  source 1..20: mol_type = other DNA
gggtatgtgacccaggcatc

SEQ ID NO: 75745 - DNA, 20 bp, synthetic construct
  misc_feature 1..20: note = CRISPR gRNA sequence
  source 1..20: mol_type = other DNA
ggtatgtgacccaggcatcc

SEQ ID NO: 75746 - DNA, 20 bp, synthetic construct
  misc_feature 1..20: note = CRISPR gRNA sequence
  source 1..20: mol_type = other DNA
acagctggtcctgagaggtg

SEQ ID NO: 75747 - DNA, 20 bp, synthetic construct
  misc_feature 1..20: note = CRISPR gRNA sequence
  source 1..20: mol_type = other DNA
gtcctgagaggtgtaggcag

SEQ ID NO: 75748 - DNA, 20 bp, synthetic construct
  misc_feature 1..20: note = CRISPR gRNA sequence
  source 1..20: mol_type = other DNA
agaggtgtaggcaggcacac

SEQ ID NO: 75749 - DNA, 20 bp, synthetic construct
  misc_feature 1..20: note = CRISPR gRNA sequence
  source 1..20: mol_type = other DNA
atacccccttcagtgcccct

SEQ ID NO: 75750 - DNA, 20 bp, synthetic construct
  misc_feature 1..20: note = CRISPR gRNA sequence
  source 1..20: mol_type = other DNA
cagtgcccctcaggcatgcg

SEQ ID NO: 75751 - DNA, 20 bp, synthetic construct
  misc_feature 1..20: note = CRISPR gRNA sequence
  source 1..20: mol_type = other DNA
agtgcccctcaggcatgcgt

SEQ ID NO: 75752 - DNA, 20 bp, synthetic construct
  misc_feature 1..20: note = CRISPR gRNA sequence
  source 1..20: mol_type = other DNA
aggcatgcgtccatgctcct

SEQ ID NO: 75753 - DNA, 20 bp, synthetic construct
  misc_feature 1..20: note = CRISPR gRNA sequence
  source 1..20: mol_type = other DNA
ctctccttcctcctcctccc

SEQ ID NO: 75754 - DNA, 20 bp, synthetic construct
  misc_feature 1..20: note = CRISPR gRNA sequence
  source 1..20: mol_type = other DNA
tccttcctcctcctccctca

SEQ ID NO: 75755 - DNA, 20 bp, synthetic construct
  misc_feature 1..20: note = CRISPR gRNA sequence
  source 1..20: mol_type = other DNA
cttcctcctcctccctcaac

SEQ ID NO: 75756 - DNA, 20 bp, synthetic construct
  misc_feature 1..20: note = CRISPR gRNA sequence
  source 1..20: mol_type = other DNA
cctcctcctccctcaactta

SEQ ID NO: 75757 - DNA, 20 bp, synthetic construct
  misc_feature 1..20: note = CRISPR gRNA sequence
  source 1..20: mol_type = other DNA
ctcctcctccctcaacttac

SEQ ID NO: 75758 - DNA, 20 bp, synthetic construct
  misc_feature 1..20: note = CRISPR gRNA sequence
  source 1..20: mol_type = other DNA
ctcctccctcaacttactcc

SEQ ID NO: 75759 - DNA, 20 bp, synthetic construct
  misc_feature 1..20: note = CRISPR gRNA sequence
  source 1..20: mol_type = other DNA
ctccctcaacttactccacc

SEQ ID NO: 75760 - DNA, 20 bp, synthetic construct
  misc_feature 1..20: note = CRISPR gRNA sequence
  source 1..20: mol_type = other DNA
cctcaacttactccacctgg

SEQ ID NO: 75761 - DNA, 20 bp, synthetic construct
  misc_feature 1..20: note = CRISPR gRNA sequence
  source 1..20: mol_type = other DNA
aacttactccacctggctga

SEQ ID NO: 75762 - DNA, 20 bp, synthetic construct
  misc_feature 1..20: note = CRISPR gRNA sequence
  source 1..20: mol_type = other DNA
actccacctggctgaggtct

SEQ ID NO: 75763 - DNA, 20 bp, synthetic construct
  misc_feature 1..20: note = CRISPR gRNA sequence
  source 1..20: mol_type = other DNA
ctccacctggctgaggtctt

SEQ ID NO: 75764 - DNA, 20 bp, synthetic construct
  misc_feature 1..20: note = CRISPR gRNA sequence
  source 1..20: mol_type = other DNA
cacctggctgaggtctttac

SEQ ID NO: 75765 - DNA, 20 bp, synthetic construct
  misc_feature 1..20: note = CRISPR gRNA sequence
  source 1..20: mol_type = other DNA
gctgaggtctttacacttgc

SEQ ID NO: 75766 - DNA, 20 bp, synthetic construct
  misc_feature 1..20: note = CRISPR gRNA sequence
  source 1..20: mol_type = other DNA
aggtctttacacttgctcag

SEQ ID NO: 75767 - DNA, 20 bp, synthetic construct
  misc_feature 1..20: note = CRISPR gRNA sequence
  source 1..20: mol_type = other DNA
tacacttgctcagcaaccag

SEQ ID NO: 75768 - DNA, 20 bp, synthetic construct
  misc_feature 1..20: note = CRISPR gRNA sequence
  source 1..20: mol_type = other DNA
acacttgctcagcaaccagc

SEQ ID NO: 75769 - DNA, 20 bp, synthetic construct
  misc_feature 1..20: note = CRISPR gRNA sequence
  source 1..20: mol_type = other DNA
cacttgctcagcaaccagca

SEQ ID NO: 75770 - DNA, 20 bp, synthetic construct
  misc_feature 1..20: note = CRISPR gRNA sequence
  source 1..20: mol_type = other DNA
gctcagcaaccagcagagtg

SEQ ID NO: 75771 - DNA, 20 bp, synthetic construct
  misc_feature 1..20: note = CRISPR gRNA sequence
  source 1..20: mol_type = other DNA
ctcagcaaccagcagagtga

SEQ ID NO: 75772 - DNA, 20 bp, synthetic construct
  misc_feature 1..20: note = CRISPR gRNA sequence
  source 1..20: mol_type = other DNA
agcaaccagcagagtgactc

SEQ ID NO: 75773 - DNA, 20 bp, synthetic construct
  misc_feature 1..20: note = CRISPR gRNA sequence
  source 1..20: mol_type = other DNA
tacgtgctcctggctgaggc

SEQ ID NO: 75774 - DNA, 20 bp, synthetic construct
  misc_feature 1..20: note = CRISPR gRNA sequence
  source 1..20: mol_type = other DNA
cgtgctcctggctgaggctg

SEQ ID NO: 75775 - DNA, 20 bp, synthetic construct
  misc_feature 1..20: note = CRISPR gRNA sequence
  source 1..20: mol_type = other DNA
ctggctgaggctgcagcctg

SEQ ID NO: 75776 - DNA, 20 bp, synthetic construct
  misc_feature 1..20: note = CRISPR gRNA sequence
  source 1..20: mol_type = other DNA
gctgaggctgcagcctgtga

SEQ ID NO: 75777 - DNA, 20 bp, synthetic construct
  misc_feature 1..20: note = CRISPR gRNA sequence
  source 1..20: mol_type = other DNA
aggctgcagcctgtgaacct

SEQ ID NO: 75778 - DNA, 20 bp, synthetic construct
  misc_feature 1..20: note = CRISPR gRNA sequence
  source 1..20: mol_type = other DNA
cagcctgtgaacctgctgga

SEQ ID NO: 75779 - DNA, 20 bp, synthetic construct
  misc_feature 1..20: note = CRISPR gRNA sequence
  source 1..20: mol_type = other DNA
tgaacctgctggacggaggt

SEQ ID NO: 75780 - DNA, 20 bp, synthetic construct
  misc_feature 1..20: note = CRISPR gRNA sequence
  source 1..20: mol_type = other DNA
ctggacggaggtaaagggga

SEQ ID NO: 75781 - DNA, 20 bp, synthetic construct
  misc_feature 1..20: note = CRISPR gRNA sequence
  source 1..20: mol_type = other DNA
gacggaggtaaaggggacaa

SEQ ID NO: 75782 - DNA, 20 bp, synthetic construct
  misc_feature 1..20: note = CRISPR gRNA sequence
  source 1..20: mol_type = other DNA
ggccactgagaccccctccg

SEQ ID NO: 75783 - DNA, 20 bp, synthetic construct
  misc_feature 1..20: note = CRISPR gRNA sequence
  source 1..20: mol_type = other DNA
gccactgagaccccctccgg

SEQ ID NO: 75784 - DNA, 20 bp, synthetic construct
  misc_feature 1..20: note = CRISPR gRNA sequence
  source 1..20: mol_type = other DNA
agaccccctccggcctggct

SEQ ID NO: 75785 - DNA, 20 bp, synthetic construct
  misc_feature 1..20: note = CRISPR gRNA sequence
  source 1..20: mol_type = other DNA
cggcctggctagcccagggc

SEQ ID NO: 75786 - DNA, 20 bp, synthetic construct
  misc_feature 1..20: note = CRISPR gRNA sequence
  source 1..20: mol_type = other DNA
gctagcccagggcacagcct

SEQ ID NO: 75787 - DNA, 20 bp, synthetic construct
  misc_feature 1..20: note = CRISPR gRNA sequence
  source 1..20: mol_type = other DNA
gcccagggcacagcctctgg

SEQ ID NO: 75788 - DNA, 20 bp, synthetic construct
  misc_feature 1..20: note = CRISPR gRNA sequence
  source 1..20: mol_type = other DNA
tgggctccaggtgggtctcc

SEQ ID NO: 75789 - DNA, 20 bp, synthetic construct
  misc_feature 1..20: note = CRISPR gRNA sequence
  source 1..20: mol_type = other DNA
ggctccaggtgggtctccac

SEQ ID NO: 75790 - DNA, 20 bp, synthetic construct
  misc_feature 1..20: note = CRISPR gRNA sequence
  source 1..20: mol_type = other DNA
caggtgggtctccactcaag

SEQ ID NO: 75791 - DNA, 20 bp, synthetic construct
  misc_feature 1..20: note = CRISPR gRNA sequence
  source 1..20: mol_type = other DNA
cactcaagcttggaccctct

SEQ ID NO: 75792 - DNA, 20 bp, synthetic construct
  misc_feature 1..20: note = CRISPR gRNA sequence
  source 1..20: mol_type = other DNA
aagcttggaccctctggaag

SEQ ID NO: 75793 - DNA, 20 bp, synthetic construct
  misc_feature 1..20: note = CRISPR gRNA sequence
  source 1..20: mol_type = other DNA
ggaccctctggaagtgtcca

SEQ ID NO: 75794 - DNA, 20 bp, synthetic construct
  misc_feature 1..20: note = CRISPR gRNA sequence
  source 1..20: mol_type = other DNA
gaccctctggaagtgtccag

SEQ ID NO: 75795 - DNA, 20 bp, synthetic construct
  misc_feature 1..20: note = CRISPR gRNA sequence
  source 1..20: mol_type = other DNA
tggaagtgtccagaatccac

SEQ ID NO: 75796 - DNA, 20 bp, synthetic construct
  misc_feature 1..20: note = CRISPR gRNA sequence
  source 1..20: mol_type = other DNA
gaagtgtccagaatccactg

SEQ ID NO: 75797 - DNA, 20 bp, synthetic construct
  misc_feature 1..20: note = CRISPR gRNA sequence
  source 1..20: mol_type = other DNA
ctcccacccccacagtagat

SEQ ID NO: 75798 - DNA, 20 bp, synthetic construct
  misc_feature 1..20: note = CRISPR gRNA sequence
  source 1..20: mol_type = other DNA
ccacccccacagtagatccc

SEQ ID NO: 75799 - DNA, 20 bp, synthetic construct
  misc_feature 1..20: note = CRISPR gRNA sequence
  source 1..20: mol_type = other DNA
tgtttcttcatgctgggtga

SEQ ID NO: 75800 - DNA, 20 bp, synthetic construct
  misc_feature 1..20: note = CRISPR gRNA sequence
  source 1..20: mol_type = other DNA
cttcatgctgggtgaaacaa

SEQ ID NO: 75801 - DNA, 20 bp, synthetic construct
  misc_feature 1..20: note = CRISPR gRNA sequence
  source 1..20: mol_type = other DNA
ttcatgctgggtgaaacaag

SEQ ID NO: 75802 - DNA, 20 bp, synthetic construct
  misc_feature 1..20: note = CRISPR gRNA sequence
  source 1..20: mol_type = other DNA
catgctgggtgaaacaagtc

SEQ ID NO: 75803 - DNA, 20 bp, synthetic construct
  misc_feature 1..20: note = CRISPR gRNA sequence
  source 1..20: mol_type = other DNA
atgctgggtgaaacaagtcc

SEQ ID NO: 75804 - DNA, 20 bp, synthetic construct
  misc_feature 1..20: note = CRISPR gRNA sequence
  source 1..20: mol_type = other DNA
ggtgaaacaagtccctctgc

SEQ ID NO: 75805 - DNA, 20 bp, synthetic construct
  misc_feature 1..20: note = CRISPR gRNA sequence
  source 1..20: mol_type = other DNA
tgcagggttgttccagggga

SEQ ID NO: 75806 - DNA, 20 bp, synthetic construct
  misc_feature 1..20: note = CRISPR gRNA sequence
  source 1..20: mol_type = other DNA
cagggttgttccaggggaat

SEQ ID NO: 75807 - DNA, 20 bp, synthetic construct
  misc_feature 1..20: note = CRISPR gRNA sequence
  source 1..20: mol_type = other DNA
ttccaggggaatgttttgtg

SEQ ID NO: 75808 - DNA, 20 bp, synthetic construct
  misc_feature 1..20: note = CRISPR gRNA sequence
  source 1..20: mol_type = other DNA
caggggaatgttttgtggta

SEQ ID NO: 75809 - DNA, 20 bp, synthetic construct
  misc_feature 1..20: note = CRISPR gRNA sequence
  source 1..20: mol_type = other DNA
tgtggtaggcagtctgcata

SEQ ID NO: 75810 - DNA, 20 bp, synthetic construct
  misc_feature 1..20: note = CRISPR gRNA sequence
  source 1..20: mol_type = other DNA
gtggtaggcagtctgcatac

SEQ ID NO: 75811 - DNA, 20 bp, synthetic construct
  misc_feature 1..20: note = CRISPR gRNA sequence
  source 1..20: mol_type = other DNA
tggtaggcagtctgcatact

SEQ ID NO: 75812 - DNA, 20 bp, synthetic construct
  misc_feature 1..20: note = CRISPR gRNA sequence
  source 1..20: mol_type = other DNA
catactgctctggccaccca

SEQ ID NO: 75813 - DNA, 20 bp, synthetic construct
  misc_feature 1..20: note = CRISPR gRNA sequence
  source 1..20: mol_type = other DNA
ctctggccacccaggaggca

SEQ ID NO: 75814 - DNA, 20 bp, synthetic construct
  misc_feature 1..20: note = CRISPR gRNA sequence
  source 1..20: mol_type = other DNA
tggccacccaggaggcagat

SEQ ID NO: 75815 - DNA, 20 bp, synthetic construct
  misc_feature 1..20: note = CRISPR gRNA sequence
  source 1..20: mol_type = other DNA
gccacccaggaggcagatct

SEQ ID NO: 75816 - DNA, 20 bp, synthetic construct
  misc_feature 1..20: note = CRISPR gRNA sequence
  source 1..20: mol_type = other DNA
ctggtccccaacatcaacta

SEQ ID NO: 75817 - DNA, 20 bp, synthetic construct
  misc_feature 1..20: note = CRISPR gRNA sequence
  source 1..20: mol_type = other DNA
gtccccaacatcaactagct

SEQ ID NO: 75818 - DNA, 20 bp, synthetic construct
  misc_feature 1..20: note = CRISPR gRNA sequence
  source 1..20: mol_type = other DNA
gctgcctaggcatggttcaa

SEQ ID NO: 75819 - DNA, 20 bp, synthetic construct
  misc_feature 1..20: note = CRISPR gRNA sequence
  source 1..20: mol_type = other DNA
cctaggcatggttcaagggg

SEQ ID NO: 75820 - DNA, 20 bp, synthetic construct
  misc_feature 1..20: note = CRISPR gRNA sequence
  source 1..20: mol_type = other DNA
ggcatggttcaagggggctt

SEQ ID NO: 75821 - DNA, 20 bp, synthetic construct
  misc_feature 1..20: note = CRISPR gRNA sequence
  source 1..20: mol_type = other DNA
aagggggcttacccacagca

SEQ ID NO: 75822 - DNA, 20 bp, synthetic construct
  misc_feature 1..20: note = CRISPR gRNA sequence
  source 1..20: mol_type = other DNA
acccacagcacacgccttcc

SEQ ID NO: 75823 - DNA, 20 bp, synthetic construct
  misc_feature 1..20: note = CRISPR gRNA sequence
  source 1..20: mol_type = other DNA
cccacagcacacgccttcct

SEQ ID NO: 75824 - DNA, 20 bp, synthetic construct
  misc_feature 1..20: note = CRISPR gRNA sequence
  source 1..20: mol_type = other DNA
cctcctcctcgttggatctg

SEQ ID NO: 75825 - DNA, 20 bp, synthetic construct
  misc_feature 1..20: note = CRISPR gRNA sequence
  source 1..20: mol_type = other DNA
ctcctcctcgttggatctga

SEQ ID NO: 75826 - DNA, 20 bp, synthetic construct
  misc_feature 1..20: note = CRISPR gRNA sequence
  source 1..20: mol_type = other DNA
ctcctcgttggatctgaagt

SEQ ID NO: 75827 - DNA, 20 bp, synthetic construct
  misc_feature 1..20: note = CRISPR gRNA sequence
  source 1..20: mol_type = other DNA
ctcgttggatctgaagtgca

SEQ ID NO: 75828 - DNA, 20 bp, synthetic construct
  misc_feature 1..20: note = CRISPR gRNA sequence
  source 1..20: mol_type = other DNA
gttggatctgaagtgcaaag

SEQ ID NO: 75829 - DNA, 20 bp, synthetic construct
  misc_feature 1..20: note = CRISPR gRNA sequence
  source 1..20: mol_type = other DNA
gatctgaagtgcaaagttgc

SEQ ID NO: 75830 - DNA, 20 bp, synthetic construct
  misc_feature 1..20: note = CRISPR gRNA sequence
  source 1..20: mol_type = other DNA
aagtgcaaagttgcatggtg

SEQ ID NO: 75831 - DNA, 20 bp, synthetic construct
  misc_feature 1..20: note = CRISPR gRNA sequence
  source 1..20: mol_type = other DNA
catggtgcagggacctggat

SEQ ID NO: 75832 - DNA, 20 bp, synthetic construct
  misc_feature 1..20: note = CRISPR gRNA sequence
  source 1..20: mol_type = other DNA
gatcagacaggacctgggtc

SEQ ID NO: 75833 - DNA, 20 bp, synthetic construct
  misc_feature 1..20: note = CRISPR gRNA sequence
  source 1..20: mol_type = other DNA
ggtcagacagctgtggccac

SEQ ID NO: 75834 - DNA, 20 bp, synthetic construct
  misc_feature 1..20: note = CRISPR gRNA sequence
  source 1..20: mol_type = other DNA
tggccacagcctcaggatgc

SEQ ID NO: 75835 - DNA, 20 bp, synthetic construct
  misc_feature 1..20: note = CRISPR gRNA sequence
  source 1..20: mol_type = other DNA
aggatgcccccacggggcca

SEQ ID NO: 75836 - DNA, 20 bp, synthetic construct
  misc_feature 1..20: note = CRISPR gRNA sequence
  source 1..20: mol_type = other DNA
ctccggaagcccagcctcta

SEQ ID NO: 75837 - DNA, 20 bp, synthetic construct
  misc_feature 1..20: note = CRISPR gRNA sequence
  source 1..20: mol_type = other DNA
cggaagcccagcctctagtt

SEQ ID NO: 75838 - DNA, 20 bp, synthetic construct
  misc_feature 1..20: note = CRISPR gRNA sequence
  source 1..20: mol_type = other DNA
tagttgggtcctactgtctt

SEQ ID NO: 75839 - DNA, 20 bp, synthetic construct
  misc_feature 1..20: note = CRISPR gRNA sequence
  source 1..20: mol_type = other DNA
gttgggtcctactgtcttca

SEQ ID NO: 75840 - DNA, 20 bp, synthetic construct
  misc_feature 1..20: note = CRISPR gRNA sequence
  source 1..20: mol_type = other DNA
ggtcctactgtcttcatcct

SEQ ID NO: 75841 - DNA, 20 bp, synthetic construct
  misc_feature 1..20: note = CRISPR gRNA sequence
  source 1..20: mol_type = other DNA
ctgtcttcatcctaccccct

SEQ ID NO: 75842 - DNA, 20 bp, synthetic construct
  misc_feature 1..20: note = CRISPR gRNA sequence
  source 1..20: mol_type = other DNA
tcttcatcctaccccctcat

SEQ ID NO: 75843 - DNA, 20 bp, synthetic construct
  misc_feature 1..20: note = CRISPR gRNA sequence
  source 1..20: mol_type = other DNA
catcctaccccctcataccc

SEQ ID NO: 75844 - DNA, 20 bp, synthetic construct
  misc_feature 1..20: note = CRISPR gRNA sequence
  source 1..20: mol_type = other DNA
atcctaccccctcataccca

SEQ ID NO: 75845 - DNA, 20 bp, synthetic construct
  misc_feature 1..20: note = CRISPR gRNA sequence
  source 1..20: mol_type = other DNA
ccccctcatacccaccagac

SEQ ID NO: 75846 - DNA, 20 bp, synthetic construct
  misc_feature 1..20: note = CRISPR gRNA sequence
  source 1..20: mol_type = other DNA
atacccaccagactccaggc

SEQ ID NO: 75847 - DNA, 20 bp, synthetic construct
  misc_feature 1..20: note = CRISPR gRNA sequence
  source 1..20: mol_type = other DNA
caggcacaacccttcaggac

SEQ ID NO: 75848 - DNA, 20 bp, synthetic construct
  misc_feature 1..20: note = CRISPR gRNA sequence
  source 1..20: mol_type = other DNA
caggacgagtcctggctgtc

SEQ ID NO: 75849 - DNA, 20 bp, synthetic construct
  misc_feature 1..20: note = CRISPR gRNA sequence
  source 1..20: mol_type = other DNA
aggacgagtcctggctgtcc

SEQ ID NO: 75850 - DNA, 20 bp, synthetic construct
  misc_feature 1..20: note = CRISPR gRNA sequence
  source 1..20: mol_type = other DNA
gctgtcccaggggaatgccc

SEQ ID NO: 75851 - DNA, 20 bp, synthetic construct
  misc_feature 1..20: note = CRISPR gRNA sequence
  source 1..20: mol_type = other DNA
tcccaggggaatgcccacct

SEQ ID NO: 75852 - DNA, 20 bp, synthetic construct
  misc_feature 1..20: note = CRISPR gRNA sequence
  source 1..20: mol_type = other DNA
agatccacctttttaacccg

SEQ ID NO: 75853 - DNA, 20 bp, synthetic construct
  misc_feature 1..20: note = CRISPR gRNA sequence
  source 1..20: mol_type = other DNA
tttaacccgtggacacaggc

SEQ ID NO: 75854 - DNA, 20 bp, synthetic construct
  misc_feature 1..20: note = CRISPR gRNA sequence
  source 1..20: mol_type = other DNA
ttaacccgtggacacaggct

SEQ ID NO: 75855 - DNA, 20 bp, synthetic construct
  misc_feature 1..20: note = CRISPR gRNA sequence
  source 1..20: mol_type = other DNA
taacccgtggacacaggctt

SEQ ID NO: 75856 - DNA, 20 bp, synthetic construct
  misc_feature 1..20: note = CRISPR gRNA sequence
  source 1..20: mol_type = other DNA
aacccgtggacacaggctta

SEQ ID NO: 75857 - DNA, 20 bp, synthetic construct
  misc_feature 1..20: note = CRISPR gRNA sequence
  source 1..20: mol_type = other DNA
acccgtggacacaggcttaa

SEQ ID NO: 75858 - DNA, 20 bp, synthetic construct
  misc_feature 1..20: note = CRISPR gRNA sequence
  source 1..20: mol_type = other DNA
aaggtgttggccagcaggaa

SEQ ID NO: 75859 - DNA, 20 bp, synthetic construct
  misc_feature 1..20: note = CRISPR gRNA sequence
  source 1..20: mol_type = other DNA
aggtgttggccagcaggaag

SEQ ID NO: 75860 - DNA, 20 bp, synthetic construct
  misc_feature 1..20: note = CRISPR gRNA sequence
  source 1..20: mol_type = other DNA
gccagcaggaaggggctttt

SEQ ID NO: 75861 - DNA, 20 bp, synthetic construct
  misc_feature 1..20: note = CRISPR gRNA sequence
  source 1..20: mol_type = other DNA
ttcggggacagtcccgtctg

SEQ ID NO: 75862 - DNA, 20 bp, synthetic construct
  misc_feature 1..20: note = CRISPR gRNA sequence
  source 1..20: mol_type = other DNA
tcggggacagtcccgtctgg

SEQ ID NO: 75863 - DNA, 20 bp, synthetic construct
  misc_feature 1..20: note = CRISPR gRNA sequence
  source 1..20: mol_type = other DNA
cggggacagtcccgtctggc

SEQ ID NO: 75864 - DNA, 20 bp, synthetic construct
  misc_feature 1..20: note = CRISPR gRNA sequence
  source 1..20: mol_type = other DNA
ggggacagtcccgtctggct

SEQ ID NO: 75865 - DNA, 20 bp, synthetic construct
  misc_feature 1..20: note = CRISPR gRNA sequence
  source 1..20: mol_type = other DNA
gctcagcctgaaaaggaaag

SEQ ID NO: 75866 - DNA, 20 bp, synthetic construct
  misc_feature 1..20: note = CRISPR gRNA sequence
  source 1..20: mol_type = other DNA
agcctgaaaaggaaaggggg

SEQ ID NO: 75867 - DNA, 20 bp, synthetic construct
  misc_feature 1..20: note = CRISPR gRNA sequence
  source 1..20: mol_type = other DNA
aaaaggaaagggggtagatc

SEQ ID NO: 75868 - DNA, 20 bp, synthetic construct
  misc_feature 1..20: note = CRISPR gRNA sequence
  source 1..20: mol_type = other DNA
gctagcctggagggtaagga

SEQ ID NO: 75869 - DNA, 20 bp, synthetic construct
  misc_feature 1..20: note = CRISPR gRNA sequence
  source 1..20: mol_type = other DNA
gcctggagggtaaggaaagg

SEQ ID NO: 75870 - DNA, 20 bp, synthetic construct
  misc_feature 1..20: note = CRISPR gRNA sequence
  source 1..20: mol_type = other DNA
gagggtaaggaaagggaggg

SEQ ID NO: 75871 - DNA, 20 bp, synthetic construct
  misc_feature 1..20: note = CRISPR gRNA sequence
  source 1..20: mol_type = other DNA
gcagctcagcaaggcaatag

SEQ ID NO: 75872 - DNA, 20 bp, synthetic construct
  misc_feature 1..20: note = CRISPR gRNA sequence
  source 1..20: mol_type = other DNA
agcaaggcaatagggaagca

SEQ ID NO: 75873 - DNA, 20 bp, synthetic construct
  misc_feature 1..20: note = CRISPR gRNA sequence
  source 1..20: mol_type = other DNA
agggacaggcagatttggat

SEQ ID NO: 75874 - DNA, 20 bp, synthetic construct
  misc_feature 1..20: note = CRISPR gRNA sequence
  source 1..20: mol_type = other DNA
ggatttgagtcccagttctg

SEQ ID NO: 75875 - DNA, 20 bp, synthetic construct
  misc_feature 1..20: note = CRISPR gRNA sequence
  source 1..20: mol_type = other DNA
gatttgagtcccagttctgc

SEQ ID NO: 75876 - DNA, 20 bp, synthetic construct
  misc_feature 1..20: note = CRISPR gRNA sequence
  source 1..20: mol_type = other DNA
gagtcccagttctgcttatt

SEQ ID NO: 75877 - DNA, 20 bp, synthetic construct
  misc_feature 1..20: note = CRISPR gRNA sequence
  source 1..20: mol_type = other DNA
agtcccagttctgcttattg

SEQ ID NO: 75878 - DNA, 20 bp, synthetic construct
  misc_feature 1..20: note = CRISPR gRNA sequence
  source 1..20: mol_type = other DNA
tgcttattggctgtgtgacc

SEQ ID NO: 75879 - DNA, 20 bp, synthetic construct
  misc_feature 1..20: note = CRISPR gRNA sequence
  source 1..20: mol_type = other DNA
cttattggctgtgtgacctt

SEQ ID NO: 75880 - DNA, 20 bp, synthetic construct
  misc_feature 1..20: note = CRISPR gRNA sequence
  source 1..20: mol_type = other DNA
attggctgtgtgaccttgga

SEQ ID NO: 75881 - DNA, 20 bp, synthetic construct
  misc_feature 1..20: note = CRISPR gRNA sequence
  source 1..20: mol_type = other DNA
ttggctgtgtgaccttggag

SEQ ID NO: 75882 - DNA, 20 bp, synthetic construct
  misc_feature 1..20: note = CRISPR gRNA sequence
  source 1..20: mol_type = other DNA
gctgtgtgaccttggagaag

SEQ ID NO: 75883 - DNA, 20 bp, synthetic construct
  misc_feature 1..20: note = CRISPR gRNA sequence
  source 1..20: mol_type = other DNA
tgtgaccttggagaagtgac

SEQ ID NO: 75884 - DNA, 20 bp, synthetic construct
  misc_feature 1..20: note = CRISPR gRNA sequence
  source 1..20: mol_type = other DNA
ggagaagtgacttcacctct

SEQ ID NO: 75885 - DNA, 20 bp, synthetic construct
  misc_feature 1..20: note = CRISPR gRNA sequence
  source 1..20: mol_type = other DNA
gagaagtgacttcacctctc

SEQ ID NO: 75886 - DNA, 20 bp, synthetic construct
  misc_feature 1..20: note = CRISPR gRNA sequence
  source 1..20: mol_type = other DNA
cacctctctgagcttcagtt

SEQ ID NO: 75887 - DNA, 20 bp, synthetic construct
  misc_feature 1..20: note = CRISPR gRNA sequence
  source 1..20: mol_type = other DNA
acctctctgagcttcagttt

SEQ ID NO: 75888 - DNA, 20 bp, synthetic construct
  misc_feature 1..20: note = CRISPR gRNA sequence
  source 1..20: mol_type = other DNA
tctgagcttcagtttcctta

SEQ ID NO: 75889 - DNA, 20 bp, synthetic construct
  misc_feature 1..20: note = CRISPR gRNA sequence
  source 1..20: mol_type = other DNA
tgagcttcagtttccttatc

SEQ ID NO: 75890 - DNA, 20 bp, synthetic construct
  misc_feature 1..20: note = CRISPR gRNA sequence
  source 1..20: mol_type = other DNA
agcttcagtttccttatctg

SEQ ID NO: 75891 - DNA, 20 bp, synthetic construct
  misc_feature 1..20: note = CRISPR gRNA sequence
  source 1..20: mol_type = other DNA
cagtttccttatctggaaat

SEQ ID NO: 75892 - DNA, 20 bp, synthetic construct
  misc_feature 1..20: note = CRISPR gRNA sequence
  source 1..20: mol_type = other DNA
agtttccttatctggaaatc

SEQ ID NO: 75893 - DNA, 20 bp, synthetic construct
  misc_feature 1..20: note = CRISPR gRNA sequence
  source 1..20: mol_type = other DNA
ccttatctggaaatcaagac

SEQ ID NO: 75894 - DNA, 20 bp, synthetic construct
  misc_feature 1..20: note = CRISPR gRNA sequence
  source 1..20: mol_type = other DNA
cttatctggaaatcaagact

SEQ ID NO: 75895 - DNA, 20 bp, synthetic construct
  misc_feature 1..20: note = CRISPR gRNA sequence
  source 1..20: mol_type = other DNA
atctggaaatcaagactcgt

SEQ ID NO: 75896 - DNA, 20 bp, synthetic construct
  misc_feature 1..20: note = CRISPR gRNA sequence
  source 1..20: mol_type = other DNA
tctggaaatcaagactcgtc

SEQ ID NO: 75897 - DNA, 20 bp, synthetic construct
  misc_feature 1..20: note = CRISPR gRNA sequence
  source 1..20: mol_type = other DNA
gaaatcaagactcgtcatgt

SEQ ID NO: 75898 - DNA, 20 bp, synthetic construct
  misc_feature 1..20: note = CRISPR gRNA sequence
  source 1..20: mol_type = other DNA
gtcatgtatgactctcgagg

SEQ ID NO: 75899 - DNA, 20 bp, synthetic construct
  misc_feature 1..20: note = CRISPR gRNA sequence
  source 1..20: mol_type = other DNA
tcgaggtatatgaggattta

SEQ ID NO: 75900 - DNA, 20 bp, synthetic construct
  misc_feature 1..20: note = CRISPR gRNA sequence
  source 1..20: mol_type = other DNA
gaggtatatgaggatttaat

SEQ ID NO: 75901 - DNA, 20 bp, synthetic construct
  misc_feature 1..20: note = CRISPR gRNA sequence
  source 1..20: mol_type = other DNA
aattacatcatgcaggtgca

SEQ ID NO: 75902 - DNA, 20 bp, synthetic construct
  misc_feature 1..20: note = CRISPR gRNA sequence
  source 1..20: mol_type = other DNA
attacatcatgcaggtgcac

SEQ ID NO: 75903 - DNA, 20 bp, synthetic construct
  misc_feature 1..20: note = CRISPR gRNA sequence
  source 1..20: mol_type = other DNA
catcatgcaggtgcactgcc

SEQ ID NO: 75904 - DNA, 20 bp, synthetic construct
  misc_feature 1..20: note = CRISPR gRNA sequence
  source 1..20: mol_type = other DNA
ccgggcatgggacctgtgct

SEQ ID NO: 75905 - DNA, 20 bp, synthetic construct
  misc_feature 1..20: note = CRISPR gRNA sequence
  source 1..20: mol_type = other DNA
tgcttgctgttattattact

SEQ ID NO: 75906 - DNA, 20 bp, synthetic construct
  misc_feature 1..20: note = CRISPR gRNA sequence
  source 1..20: mol_type = other DNA
gctgttattattactattgt

SEQ ID NO: 75907 - DNA, 20 bp, synthetic construct
  misc_feature 1..20: note = CRISPR gRNA sequence
  source 1..20: mol_type = other DNA
ctgttattattactattgtt

SEQ ID NO: 75908 - DNA, 20 bp, synthetic construct
  misc_feature 1..20: note = CRISPR gRNA sequence
  source 1..20: mol_type = other DNA
ttattattactattgttttt

SEQ ID NO: 75909 - DNA, 20 bp, synthetic construct
  misc_feature 1..20: note = CRISPR gRNA sequence
  source 1..20: mol_type = other DNA
ttattactattgtttttacc

SEQ ID NO: 75910 - DNA, 20 bp, synthetic construct
  misc_feature 1..20: note = CRISPR gRNA sequence
  source 1..20: mol_type = other DNA
ttactattgtttttacctgc

SEQ ID NO: 75911 - DNA, 20 bp, synthetic construct
  misc_feature 1..20: note = CRISPR gRNA sequence
  source 1..20: mol_type = other DNA
ctattgtttttacctgcaag

SEQ ID NO: 75912 - DNA, 20 bp, synthetic construct
  misc_feature 1..20: note = CRISPR gRNA sequence
  source 1..20: mol_type = other DNA
ttgtttttacctgcaagcac

SEQ ID NO: 75913 - DNA, 20 bp, synthetic construct
  misc_feature 1..20: note = CRISPR gRNA sequence
  source 1..20: mol_type = other DNA
tttttacctgcaagcacaga

SEQ ID NO: 75914 - DNA, 20 bp, synthetic construct
  misc_feature 1..20: note = CRISPR gRNA sequence
  source 1..20: mol_type = other DNA
ttacctgcaagcacagattt

SEQ ID NO: 75915 - DNA, 20 bp, synthetic construct
  misc_feature 1..20: note = CRISPR gRNA sequence
  source 1..20: mol_type = other DNA
tacctgcaagcacagatttc

SEQ ID NO: 75916 - DNA, 20 bp, synthetic construct
  misc_feature 1..20: note = CRISPR gRNA sequence
  source 1..20: mol_type = other DNA
acctgcaagcacagatttca

SEQ ID NO: 75917 - DNA, 20 bp, synthetic construct
  misc_feature 1..20: note = CRISPR gRNA sequence
  source 1..20: mol_type = other DNA
cctgcaagcacagatttcac

SEQ ID NO: 75918 - DNA, 20 bp, synthetic construct
  misc_feature 1..20: note = CRISPR gRNA sequence
  source 1..20: mol_type = other DNA
caagcacagatttcacaggc

SEQ ID NO: 75919 - DNA, 20 bp, synthetic construct
  misc_feature 1..20: note = CRISPR gRNA sequence
  source 1..20: mol_type = other DNA
cacaggcgagtccttgctca

SEQ ID NO: 75920 - DNA, 20 bp, synthetic construct
  misc_feature 1..20: note = CRISPR gRNA sequence
  source 1..20: mol_type = other DNA
acaggcgagtccttgctcac

SEQ ID NO: 75921 - DNA, 20 bp, synthetic construct
  misc_feature 1..20: note = CRISPR gRNA sequence
  source 1..20: mol_type = other DNA
gctcacagagagtgggaagc

SEQ ID NO: 75922 - DNA, 20 bp, synthetic construct
  misc_feature 1..20: note = CRISPR gRNA sequence
  source 1..20: mol_type = other DNA
ctcacagagagtgggaagct

SEQ ID NO: 75923 - DNA, 20 bp, synthetic construct
  misc_feature 1..20: note = CRISPR gRNA sequence
  source 1..20: mol_type = other DNA
acagagagtgggaagcttca

SEQ ID NO: 75924 - DNA, 20 bp, synthetic construct
  misc_feature 1..20: note = CRISPR gRNA sequence
  source 1..20: mol_type = other DNA
caggcccttcagacacagtt

SEQ ID NO: 75925 - DNA, 20 bp, synthetic construct
  misc_feature 1..20: note = CRISPR gRNA sequence
  source 1..20: mol_type = other DNA
aggcccttcagacacagttt

SEQ ID NO: 75926 - DNA, 20 bp, synthetic construct
  misc_feature 1..20: note = CRISPR gRNA sequence
  source 1..20: mol_type = other DNA
cagacacagtttttaaacct

SEQ ID NO: 75927 - DNA, 20 bp, synthetic construct
  misc_feature 1..20: note = CRISPR gRNA sequence
  source 1..20: mol_type = other DNA
agacacagtttttaaacctt

SEQ ID NO: 75928 - DNA, 20 bp, synthetic construct
  misc_feature 1..20: note = CRISPR gRNA sequence
  source 1..20: mol_type = other DNA
ttaaaccttagcactattga

SEQ ID NO: 75929 - DNA, 20 bp, synthetic construct
  misc_feature 1..20: note = CRISPR gRNA sequence
  source 1..20: mol_type = other DNA
taaaccttagcactattgag

SEQ ID NO: 75930 - DNA, 20 bp, synthetic construct
  misc_feature 1..20: note = CRISPR gRNA sequence
  source 1..20: mol_type = other DNA
aaaccttagcactattgaga

SEQ ID NO: 75931 - DNA, 20 bp, synthetic construct
  misc_feature 1..20: note = CRISPR gRNA sequence
  source 1..20: mol_type = other DNA
aaccttagcactattgagat

SEQ ID NO: 75932 - DNA, 20 bp, synthetic construct
  misc_feature 1..20: note = CRISPR gRNA sequence
  source 1..20: mol_type = other DNA
agcactattgagatgtgagg

SEQ ID NO: 75933 - DNA, 20 bp, synthetic construct
  misc_feature 1..20: note = CRISPR gRNA sequence
  source 1..20: mol_type = other DNA
gcactattgagatgtgaggt

SEQ ID NO: 75934 - DNA, 20 bp, synthetic construct
  misc_feature 1..20: note = CRISPR gRNA sequence
  source 1..20: mol_type = other DNA
ttgagatgtgaggtccaata

SEQ ID NO: 75935 - DNA, 20 bp, synthetic construct
  misc_feature 1..20: note = CRISPR gRNA sequence
  source 1..20: mol_type = other DNA
agatgtgaggtccaataatt

SEQ ID NO: 75936 - DNA, 20 bp, synthetic construct
  misc_feature 1..20: note = CRISPR gRNA sequence
  source 1..20: mol_type = other DNA
tttgttgtgggctctcctgt

SEQ ID NO: 75937 - DNA, 20 bp, synthetic construct
  misc_feature 1..20: note = CRISPR gRNA sequence
  source 1..20: mol_type = other DNA
tgttgtgggctctcctgtgc

SEQ ID NO: 75938 - DNA, 20 bp, synthetic construct
  misc_feature 1..20: note = CRISPR gRNA sequence
  source 1..20: mol_type = other DNA
gttgtgggctctcctgtgcc

SEQ ID NO: 75939 - DNA, 20 bp, synthetic construct
  misc_feature 1..20: note = CRISPR gRNA sequence
  source 1..20: mol_type = other DNA
ttgtgggctctcctgtgccc

SEQ ID NO: 75940 - DNA, 20 bp, synthetic construct
  misc_feature 1..20: note = CRISPR gRNA sequence
  source 1..20: mol_type = other DNA
tgggctctcctgtgccctat

SEQ ID NO: 75941 - DNA, 20 bp, synthetic construct
  misc_feature 1..20: note = CRISPR gRNA sequence
  source 1..20: mol_type = other DNA
tcctgtgccctataggatgt

SEQ ID NO: 75942 - DNA, 20 bp, synthetic construct
  misc_feature 1..20: note = CRISPR gRNA sequence
  source 1..20: mol_type = other DNA
ctgtgccctataggatgttc

SEQ ID NO: 75943 - DNA, 20 bp, synthetic construct
  misc_feature 1..20: note = CRISPR gRNA sequence
  source 1..20: mol_type = other DNA
tgccctataggatgttcagc

SEQ ID NO: 75944 - DNA, 20 bp, synthetic construct
  misc_feature 1..20: note = CRISPR gRNA sequence
  source 1..20: mol_type = other DNA
taggatgttcagcagcatcc

SEQ ID NO: 75945 - DNA, 20 bp, synthetic construct
  misc_feature 1..20: note = CRISPR gRNA sequence
  source 1..20: mol_type = other DNA
agcagcatcccagatctcta

SEQ ID NO: 75946 - DNA, 20 bp, synthetic construct
  misc_feature 1..20: note = CRISPR gRNA sequence
  source 1..20: mol_type = other DNA
tattcattcgatgccagtag

SEQ ID NO: 75947 - DNA, 20 bp, synthetic construct
  misc_feature 1..20: note = CRISPR gRNA sequence
  source 1..20: mol_type = other DNA
ttcattcgatgccagtagca

SEQ ID NO: 75948 - DNA, 20 bp, synthetic construct
  misc_feature 1..20: note = CRISPR gRNA sequence
  source 1..20: mol_type = other DNA
attcgatgccagtagcagca

SEQ ID NO: 75949 - DNA, 20 bp, synthetic construct
  misc_feature 1..20: note = CRISPR gRNA sequence
  source 1..20: mol_type = other DNA
gatgccagtagcagcacccc

SEQ ID NO: 75950 - DNA, 20 bp, synthetic construct
  misc_feature 1..20: note = CRISPR gRNA sequence
  source 1..20: mol_type = other DNA
acccgcagtcatgaccacca

SEQ ID NO: 75951 - DNA, 20 bp, synthetic construct
  misc_feature 1..20: note = CRISPR gRNA sequence
  source 1..20: mol_type = other DNA
cagatatttccaaatgactc

SEQ ID NO: 75952 - DNA, 20 bp, synthetic construct
  misc_feature 1..20: note = CRISPR gRNA sequence
  source 1..20: mol_type = other DNA
ccaaatgactcccaagggtg

SEQ ID NO: 75953 - DNA, 20 bp, synthetic construct
  misc_feature 1..20: note = CRISPR gRNA sequence
  source 1..20: mol_type = other DNA
caaatgactcccaagggtga

SEQ ID NO: 75954 - DNA, 20 bp, synthetic construct
  misc_feature 1..20: note = CRISPR gRNA sequence
  source 1..20: mol_type = other DNA
ccaagggtgaaaatcacccc

SEQ ID NO: 75955 - DNA, 20 bp, synthetic construct
  misc_feature 1..20: note = CRISPR gRNA sequence
  source 1..20: mol_type = other DNA
gaaaccactgccttagagaa

SEQ ID NO: 75956 - DNA, 20 bp, synthetic construct
  misc_feature 1..20: note = CRISPR gRNA sequence
  source 1..20: mol_type = other DNA
ccttagagaaagtgagatgg

SEQ ID NO: 75957 - DNA, 20 bp, synthetic construct
  misc_feature 1..20: note = CRISPR gRNA sequence
  source 1..20: mol_type = other DNA
agagaaagtgagatgggtcc

SEQ ID NO: 75958 - DNA, 20 bp, synthetic construct
  misc_feature 1..20: note = CRISPR gRNA sequence
  source 1..20: mol_type = other DNA
gagaaagtgagatgggtcca

SEQ ID NO: 75959 - DNA, 20 bp, synthetic construct
  misc_feature 1..20: note = CRISPR gRNA sequence
  source 1..20: mol_type = other DNA
tgccctcagaggcagcctca

SEQ ID NO: 75960 - DNA, 20 bp, synthetic construct
  misc_feature 1..20: note = CRISPR gRNA sequence
  source 1..20: mol_type = other DNA
ccctcagaggcagcctcagc

SEQ ID NO: 75961 - DNA, 20 bp, synthetic construct
  misc_feature 1..20: note = CRISPR gRNA sequence
  source 1..20: mol_type = other DNA
agaggcagcctcagcacctc

SEQ ID NO: 75962 - DNA, 20 bp, synthetic construct
  misc_feature 1..20: note = CRISPR gRNA sequence
  source 1..20: mol_type = other DNA
agcacctccatttgcctcat

SEQ ID NO: 75963 - DNA, 20 bp, synthetic construct
  misc_feature 1..20: note = CRISPR gRNA sequence
  source 1..20: mol_type = other DNA
catttgcctcatccagtaat

SEQ ID NO: 75964 - DNA, 20 bp, synthetic construct
  misc_feature 1..20: note = CRISPR gRNA sequence
  source 1..20: mol_type = other DNA
gcctcatccagtaatccccc

SEQ ID NO: 75965 - DNA, 20 bp, synthetic construct
  misc_feature 1..20: note = CRISPR gRNA sequence
  source 1..20: mol_type = other DNA
cctcatccagtaatccccct

SEQ ID NO: 75966 - DNA, 20 bp, synthetic construct
  misc_feature 1..20: note = CRISPR gRNA sequence
  source 1..20: mol_type = other DNA
atccagtaatccccctatca

SEQ ID NO: 75967 - DNA, 20 bp, synthetic construct
  misc_feature 1..20: note = CRISPR gRNA sequence
  source 1..20: mol_type = other DNA
tcagcttgtctgtaaattcc

SEQ ID NO: 75968 - DNA, 20 bp, synthetic construct
  misc_feature 1..20: note = CRISPR gRNA sequence
  source 1..20: mol_type = other DNA
gtctgtaaattccactctca

SEQ ID NO: 75969 - DNA, 20 bp, synthetic construct
  misc_feature 1..20: note = CRISPR gRNA sequence
  source 1..20: mol_type = other DNA
tctgtaaattccactctcaa

SEQ ID NO: 75970 - DNA, 20 bp, synthetic construct
  misc_feature 1..20: note = CRISPR gRNA sequence
  source 1..20: mol_type = other DNA
taaattccactctcaagatc

SEQ ID NO: 75971 - DNA, 20 bp, synthetic construct
  misc_feature 1..20: note = CRISPR gRNA sequence
  source 1..20: mol_type = other DNA
cactctcaagatccaccctg

SEQ ID NO: 75972 - DNA, 20 bp, synthetic construct
  misc_feature 1..20: note = CRISPR gRNA sequence
  source 1..20: mol_type = other DNA
tcaagatccaccctgagtct

SEQ ID NO: 75973 - DNA, 20 bp, synthetic construct
  misc_feature 1..20: note = CRISPR gRNA sequence
  source 1..20: mol_type = other DNA
aagatccaccctgagtctac

SEQ ID NO: 75974 - DNA, 20 bp, synthetic construct
  misc_feature 1..20: note = CRISPR gRNA sequence
  source 1..20: mol_type = other DNA
agtctaccaacttctatccc

SEQ ID NO: 75975 - DNA, 20 bp, synthetic construct
  misc_feature 1..20: note = CRISPR gRNA sequence
  source 1..20: mol_type = other DNA
ccaacttctatcccacccca

SEQ ID NO: 75976 - DNA, 20 bp, synthetic construct
  misc_feature 1..20: note = CRISPR gRNA sequence
  source 1..20: mol_type = other DNA
ctatcccaccccagcagtga

SEQ ID NO: 75977 - DNA, 20 bp, synthetic construct
  misc_feature 1..20: note = CRISPR gRNA sequence
  source 1..20: mol_type = other DNA
tatcccaccccagcagtgat

SEQ ID NO: 75978 - DNA, 20 bp, synthetic construct
  misc_feature 1..20: note = CRISPR gRNA sequence
  source 1..20: mol_type = other DNA
tcccaccccagcagtgatca

SEQ ID NO: 75979 - DNA, 20 bp, synthetic construct
  misc_feature 1..20: note = CRISPR gRNA sequence
  source 1..20: mol_type = other DNA
caccctgctgcacacatctc

SEQ ID NO: 75980 - DNA, 20 bp, synthetic construct
  misc_feature 1..20: note = CRISPR gRNA sequence
  source 1..20: mol_type = other DNA
accctgctgcacacatctct

SEQ ID NO: 75981 - DNA, 20 bp, synthetic construct
  misc_feature 1..20: note = CRISPR gRNA sequence
  source 1..20: mol_type = other DNA
ctgcacacatctcttcccac

SEQ ID NO: 75982 - DNA, 20 bp, synthetic construct
  misc_feature 1..20: note = CRISPR gRNA sequence
  source 1..20: mol_type = other DNA
cacacatctcttcccactct

SEQ ID NO: 75983 - DNA, 20 bp, synthetic construct
  misc_feature 1..20: note = CRISPR gRNA sequence
  source 1..20: mol_type = other DNA
ttcccactctcatttccact

SEQ ID NO: 75984 - DNA, 20 bp, synthetic construct
  misc_feature 1..20: note = CRISPR gRNA sequence
  source 1..20: mol_type = other DNA
cccactctcatttccactcg

SEQ ID NO: 75985 - DNA, 20 bp, synthetic construct
  misc_feature 1..20: note = CRISPR gRNA sequence
  source 1..20: mol_type = other DNA
ccactctcatttccactcgt

SEQ ID NO: 75986 - DNA, 20 bp, synthetic construct
  misc_feature 1..20: note = CRISPR gRNA sequence
  source 1..20: mol_type = other DNA
tcatttccactcgtatctcc

SEQ ID NO: 75987 - DNA, 20 bp, synthetic construct
  misc_feature 1..20: note = CRISPR gRNA sequence
  source 1..20: mol_type = other DNA
atttccactcgtatctccca

SEQ ID NO: 75988 - DNA, 20 bp, synthetic construct
  misc_feature 1..20: note = CRISPR gRNA sequence
  source 1..20: mol_type = other DNA
ccactcgtatctcccaatcc

SEQ ID NO: 75989 - DNA, 20 bp, synthetic construct
  misc_feature 1..20: note = CRISPR gRNA sequence
  source 1..20: mol_type = other DNA
cactcgtatctcccaatcca

SEQ ID NO: 75990 - DNA, 20 bp, synthetic construct
  misc_feature 1..20: note = CRISPR gRNA sequence
  source 1..20: mol_type = other DNA
gtatctcccaatccattctc

SEQ ID NO: 75991 - DNA, 20 bp, synthetic construct
  misc_feature 1..20: note = CRISPR gRNA sequence
  source 1..20: mol_type = other DNA
ccaatccattctctacccag

SEQ ID NO: 75992 - DNA, 20 bp, synthetic construct
  misc_feature 1..20: note = CRISPR gRNA sequence
  source 1..20: mol_type = other DNA
tctacccagcactcagtctg

SEQ ID NO: 75993 - DNA, 20 bp, synthetic construct
  misc_feature 1..20: note = CRISPR gRNA sequence
  source 1..20: mol_type = other DNA
tacccagcactcagtctgaa

SEQ ID NO: 75994 - DNA, 20 bp, synthetic construct
  misc_feature 1..20: note = CRISPR gRNA sequence
  source 1..20: mol_type = other DNA
cccagcactcagtctgaact

SEQ ID NO: 75995 - DNA, 20 bp, synthetic construct
  misc_feature 1..20: note = CRISPR gRNA sequence
  source 1..20: mol_type = other DNA
agtctgaacttttgaaaacc

SEQ ID NO: 75996 - DNA, 20 bp, synthetic construct
  misc_feature 1..20: note = CRISPR gRNA sequence
  source 1..20: mol_type = other DNA
aacttttgaaaacccaaatg

SEQ ID NO: 75997 - DNA, 20 bp, synthetic construct
  misc_feature 1..20: note = CRISPR gRNA sequence
  source 1..20: mol_type = other DNA
ttgaaaacccaaatgaggaa

SEQ ID NO: 75998 - DNA, 20 bp, synthetic construct
  misc_feature 1..20: note = CRISPR gRNA sequence
  source 1..20: mol_type = other DNA
tgaaaacccaaatgaggaac

SEQ ID NO: 75999 - DNA, 20 bp, synthetic construct
  misc_feature 1..20: note = CRISPR gRNA sequence
  source 1..20: mol_type = other DNA
gaaaacccaaatgaggaacg

SEQ ID NO: 76000 - DNA, 20 bp, synthetic construct
  misc_feature 1..20: note = CRISPR gRNA sequence
  source 1..20: mol_type = other DNA
aaaacccaaatgaggaacgg

SEQ ID NO: 76001 - DNA, 20 bp, synthetic construct
  misc_feature 1..20: note = CRISPR gRNA sequence
  source 1..20: mol_type = other DNA
ctgcctgtaatctcagtact

SEQ ID NO: 76002 - DNA, 20 bp, synthetic construct
  misc_feature 1..20: note = CRISPR gRNA sequence
  source 1..20: mol_type = other DNA
cctgtaatctcagtactttg

SEQ ID NO: 76003 - DNA, 20 bp, synthetic construct
  misc_feature 1..20: note = CRISPR gRNA sequence
  source 1..20: mol_type = other DNA
taatctcagtactttgggaa

SEQ ID NO: 76004 - DNA, 20 bp, synthetic construct
  misc_feature 1..20: note = CRISPR gRNA sequence
  source 1..20: mol_type = other DNA
agtactttgggaagccgagg

SEQ ID NO: 76005 - DNA, 20 bp, synthetic construct
  misc_feature 1..20: note = CRISPR gRNA sequence
  source 1..20: mol_type = other DNA
tgggaagccgaggcgggcgg

SEQ ID NO: 76006 - DNA, 20 bp, synthetic construct
  misc_feature 1..20: note = CRISPR gRNA sequence
  source 1..20: mol_type = other DNA
gggaagccgaggcgggcgga

SEQ ID NO: 76007 - DNA, 20 bp, synthetic construct
  misc_feature 1..20: note = CRISPR gRNA sequence
  source 1..20: mol_type = other DNA
ggaagccgaggcgggcggat

SEQ ID NO: 76008 - DNA, 20 bp, synthetic construct
  misc_feature 1..20: note = CRISPR gRNA sequence
  source 1..20: mol_type = other DNA
gaggtcgggagtttgagacc

SEQ ID NO: 76009 - DNA, 20 bp, synthetic construct
  misc_feature 1..20: note = CRISPR gRNA sequence
  source 1..20: mol_type = other DNA
aggtcgggagtttgagacca

SEQ ID NO: 76010 - DNA, 20 bp, synthetic construct
  misc_feature 1..20: note = CRISPR gRNA sequence
  source 1..20: mol_type = other DNA
gagaccagcatggtcaacat

SEQ ID NO: 76011 - DNA, 20 bp, synthetic construct
  misc_feature 1..20: note = CRISPR gRNA sequence
  source 1..20: mol_type = other DNA
agaccagcatggtcaacatg

SEQ ID NO: 76012 - DNA, 20 bp, synthetic construct
  misc_feature 1..20: note = CRISPR gRNA sequence
  source 1..20: mol_type = other DNA
aactctgtctctactaaaaa

SEQ ID NO: 76013 - DNA, 20 bp, synthetic construct
  misc_feature 1..20: note = CRISPR gRNA sequence
  source 1..20: mol_type = other DNA
tgtctctactaaaaatacaa

SEQ ID NO: 76014 - DNA, 20 bp, synthetic construct
  misc_feature 1..20: note = CRISPR gRNA sequence
  source 1..20: mol_type = other DNA
tctctactaaaaatacaaaa

SEQ ID NO: 76015 - DNA, 20 bp, synthetic construct
  misc_feature 1..20: note = CRISPR gRNA sequence
  source 1..20: mol_type = other DNA
tactaaaaatacaaaaatta

SEQ ID NO: 76016 - DNA, 20 bp, synthetic construct
  misc_feature 1..20: note = CRISPR gRNA sequence
  source 1..20: mol_type = other DNA
ctaaaaatacaaaaattagc

SEQ ID NO: 76017 - DNA, 20 bp, synthetic construct
  misc_feature 1..20: note = CRISPR gRNA sequence
  source 1..20: mol_type = other DNA
aaaatacaaaaattagctgg

SEQ ID NO: 76018 - DNA, 20 bp, synthetic construct
  misc_feature 1..20: note = CRISPR gRNA sequence
  source 1..20: mol_type = other DNA
gctgggcatgatggtgcacg

SEQ ID NO: 76019 - DNA, 20 bp, synthetic construct
  misc_feature 1..20: note = CRISPR gRNA sequence
  source 1..20: mol_type = other DNA
ggcatgatggtgcacgcctg

SEQ ID NO: 76020 - DNA, 20 bp, synthetic construct
  misc_feature 1..20: note = CRISPR gRNA sequence
  source 1..20: mol_type = other DNA
taatcccagctacttgggag

SEQ ID NO: 76021 - DNA, 20 bp, synthetic construct
  misc_feature 1..20: note = CRISPR gRNA sequence
  source 1..20: mol_type = other DNA
cttgggaggctgaggcacaa

SEQ ID NO: 76022 - DNA, 20 bp, synthetic construct
  misc_feature 1..20: note = CRISPR gRNA sequence
  source 1..20: mol_type = other DNA
gggaggctgaggcacaagaa

SEQ ID NO: 76023 - DNA, 20 bp, synthetic construct
  misc_feature 1..20: note = CRISPR gRNA sequence
  source 1..20: mol_type = other DNA
ggaggctgaggcacaagaat

SEQ ID NO: 76024 - DNA, 20 bp, synthetic construct
  misc_feature 1..20: note = CRISPR gRNA sequence
  source 1..20: mol_type = other DNA
aggcacaagaattgcctgaa

SEQ ID NO: 76025 - DNA, 20 bp, synthetic construct
  misc_feature 1..20: note = CRISPR gRNA sequence
  source 1..20: mol_type = other DNA
cctgaacctgggaggcggag

SEQ ID NO: 76026 - DNA, 20 bp, synthetic construct
  misc_feature 1..20: note = CRISPR gRNA sequence
  source 1..20: mol_type = other DNA
aacctgggaggcggaggttg

SEQ ID NO: 76027 - DNA, 20 bp, synthetic construct
  misc_feature 1..20: note = CRISPR gRNA sequence
  source 1..20: mol_type = other DNA
ggaggcggaggttgcagtga

SEQ ID NO: 76028 - DNA, 20 bp, synthetic construct
  misc_feature 1..20: note = CRISPR gRNA sequence
  source 1..20: mol_type = other DNA
cagtgagccgagattgcgcc

SEQ ID NO: 76029 - DNA, 20 bp, synthetic construct
  misc_feature 1..20: note = CRISPR gRNA sequence
  source 1..20: mol_type = other DNA
cgccattgcactccagcctg

SEQ ID NO: 76030 - DNA, 20 bp, synthetic construct
  misc_feature 1..20: note = CRISPR gRNA sequence
  source 1..20: mol_type = other DNA
cactccagcctgtgtgacag

SEQ ID NO: 76031 - DNA, 20 bp, synthetic construct
  misc_feature 1..20: note = CRISPR gRNA sequence
  source 1..20: mol_type = other DNA
cagcctgtgtgacagagcga

SEQ ID NO: 76032 - DNA, 20 bp, synthetic construct
  misc_feature 1..20: note = CRISPR gRNA sequence
  source 1..20: mol_type = other DNA
tgtgacagagcgagaccctc

SEQ ID NO: 76033 - DNA, 20 bp, synthetic construct
  misc_feature 1..20: note = CRISPR gRNA sequence
  source 1..20: mol_type = other DNA
ccccacaaaaaagaaagaaa

SEQ ID NO: 76034 - DNA, 20 bp, synthetic construct
  misc_feature 1..20: note = CRISPR gRNA sequence
  source 1..20: mol_type = other DNA
ttcctctccctttcatgttc

SEQ ID NO: 76035 - DNA, 20 bp, synthetic construct
  misc_feature 1..20: note = CRISPR gRNA sequence
  source 1..20: mol_type = other DNA
ctctccctttcatgttccca

SEQ ID NO: 76036 - DNA, 20 bp, synthetic construct
  misc_feature 1..20: note = CRISPR gRNA sequence
  source 1..20: mol_type = other DNA
tccctttcatgttcccagga

SEQ ID NO: 76037 - DNA, 20 bp, synthetic construct
  misc_feature 1..20: note = CRISPR gRNA sequence
  source 1..20: mol_type = other DNA
cctttcatgttcccaggaac

SEQ ID NO: 76038 - DNA, 20 bp, synthetic construct
  misc_feature 1..20: note = CRISPR gRNA sequence
  source 1..20: mol_type = other DNA
tcatgttcccaggaacaaaa

SEQ ID NO: 76039 - DNA, 20 bp, synthetic construct
  misc_feature 1..20: note = CRISPR gRNA sequence
  source 1..20: mol_type = other DNA
catgttcccaggaacaaaag

SEQ ID NO: 76040 - DNA, 20 bp, synthetic construct
  misc_feature 1..20: note = CRISPR gRNA sequence
  source 1..20: mol_type = other DNA
atgttcccaggaacaaaagt

SEQ ID NO: 76041 - DNA, 20 bp, synthetic construct
  misc_feature 1..20: note = CRISPR gRNA sequence
  source 1..20: mol_type = other DNA
ccaggaacaaaagtctaaac

SEQ ID NO: 76042 - DNA, 20 bp, synthetic construct
  misc_feature 1..20: note = CRISPR gRNA sequence
  source 1..20: mol_type = other DNA
aactctccccatgggtgcca

SEQ ID NO: 76043 - DNA, 20 bp, synthetic construct
  misc_feature 1..20: note = CRISPR gRNA sequence
  source 1..20: mol_type = other DNA
tccccatgggtgccaggccc

SEQ ID NO: 76044 - DNA, 20 bp, synthetic construct
  misc_feature 1..20: note = CRISPR gRNA sequence
  source 1..20: mol_type = other DNA
cccatgggtgccaggcccca

SEQ ID NO: 76045 - DNA, 20 bp, synthetic construct
  misc_feature 1..20: note = CRISPR gRNA sequence
  source 1..20: mol_type = other DNA
tctcttcctcctctcctagg

SEQ ID NO: 76046 - DNA, 20 bp, synthetic construct
  misc_feature 1..20: note = CRISPR gRNA sequence
  source 1..20: mol_type = other DNA
tcttcctcctctcctaggac

SEQ ID NO: 76047 - DNA, 20 bp, synthetic construct
  misc_feature 1..20: note = CRISPR gRNA sequence
  source 1..20: mol_type = other DNA
ttcctcctctcctaggactg

SEQ ID NO: 76048 - DNA, 20 bp, synthetic construct
  misc_feature 1..20: note = CRISPR gRNA sequence
  source 1..20: mol_type = other DNA
cctcctctcctaggactgtc

SEQ ID NO: 76049 - DNA, 20 bp, synthetic construct
  misc_feature 1..20: note = CRISPR gRNA sequence
  source 1..20: mol_type = other DNA
ctcctctcctaggactgtcc

SEQ ID NO: 76050 - DNA, 20 bp, synthetic construct
  misc_feature 1..20: note = CRISPR gRNA sequence
  source 1..20: mol_type = other DNA
ctctcctaggactgtccctg

SEQ ID NO: 76051 - DNA, 20 bp, synthetic construct
  misc_feature 1..20: note = CRISPR gRNA sequence
  source 1..20: mol_type = other DNA
tcctaggactgtccctgcca

SEQ ID NO: 76052 - DNA, 20 bp, synthetic construct
  misc_feature 1..20: note = CRISPR gRNA sequence
  source 1..20: mol_type = other DNA
ctaggactgtccctgccagt

SEQ ID NO: 76053 - DNA, 20 bp, synthetic construct
  misc_feature 1..20: note = CRISPR gRNA sequence
  source 1..20: mol_type = other DNA
ggactgtccctgccagtcac

SEQ ID NO: 76054 - DNA, 20 bp, synthetic construct
  misc_feature 1..20: note = CRISPR gRNA sequence
  source 1..20: mol_type = other DNA
tccctgccagtcactgtgct

SEQ ID NO: 76055 - DNA, 20 bp, synthetic construct
  misc_feature 1..20: note = CRISPR gRNA sequence
  source 1..20: mol_type = other DNA
ccagtcactgtgctctggct

SEQ ID NO: 76056 - DNA, 20 bp, synthetic construct
  misc_feature 1..20: note = CRISPR gRNA sequence
  source 1..20: mol_type = other DNA
tgctctggctgtctcggttc

SEQ ID NO: 76057 - DNA, 20 bp, synthetic construct
  misc_feature 1..20: note = CRISPR gRNA sequence
  source 1..20: mol_type = other DNA
tggctgtctcggttccgcgc

SEQ ID NO: 76058 - DNA, 20 bp, synthetic construct
  misc_feature 1..20: note = CRISPR gRNA sequence
  source 1..20: mol_type = other DNA
gctgtctcggttccgcgctg

SEQ ID NO: 76059 - DNA, 20 bp, synthetic construct
  misc_feature 1..20: note = CRISPR gRNA sequence
  source 1..20: mol_type = other DNA
tctcggttccgcgctgttcc

SEQ ID NO: 76060 - DNA, 20 bp, synthetic construct
  misc_feature 1..20: note = CRISPR gRNA sequence
  source 1..20: mol_type = other DNA
ggttccgcgctgttcctgga

SEQ ID NO: 76061 - DNA, 20 bp, synthetic construct
  misc_feature 1..20: note = CRISPR gRNA sequence
  source 1..20: mol_type = other DNA
cgcgctgttcctggagccca

SEQ ID NO: 76062 - DNA, 20 bp, synthetic construct
  misc_feature 1..20: note = CRISPR gRNA sequence
  source 1..20: mol_type = other DNA
ttcctggagcccaccaagct

SEQ ID NO: 76063 - DNA, 20 bp, synthetic construct
  misc_feature 1..20: note = CRISPR gRNA sequence
  source 1..20: mol_type = other DNA
ctggagcccaccaagcttaa

SEQ ID NO: 76064 - DNA, 20 bp, synthetic construct
  misc_feature 1..20: note = CRISPR gRNA sequence
  source 1..20: mol_type = other DNA
gagcccaccaagcttaatca

SEQ ID NO: 76065 - DNA, 20 bp, synthetic construct
  misc_feature 1..20: note = CRISPR gRNA sequence
  source 1..20: mol_type = other DNA
aatcatgcctcagggcctca

SEQ ID NO: 76066 - DNA, 20 bp, synthetic construct
  misc_feature 1..20: note = CRISPR gRNA sequence
  source 1..20: mol_type = other DNA
atcatgcctcagggcctcac

SEQ ID NO: 76067 - DNA, 20 bp, synthetic construct
  misc_feature 1..20: note = CRISPR gRNA sequence
  source 1..20: mol_type = other DNA
agggcctcacacatgccgtt

SEQ ID NO: 76068 - DNA, 20 bp, synthetic construct
  misc_feature 1..20: note = CRISPR gRNA sequence
  source 1..20: mol_type = other DNA
acacatgccgttccctctgc

SEQ ID NO: 76069 - DNA, 20 bp, synthetic construct
  misc_feature 1..20: note = CRISPR gRNA sequence
  source 1..20: mol_type = other DNA
cctctgcctggaatgcagtt

SEQ ID NO: 76070 - DNA, 20 bp, synthetic construct
  misc_feature 1..20: note = CRISPR gRNA sequence
  source 1..20: mol_type = other DNA
tgcctggaatgcagttccct

SEQ ID NO: 76071 - DNA, 20 bp, synthetic construct
  misc_feature 1..20: note = CRISPR gRNA sequence
  source 1..20: mol_type = other DNA
cctggaatgcagttccctgc

SEQ ID NO: 76072 - DNA, 20 bp, synthetic construct
  misc_feature 1..20: note = CRISPR gRNA sequence
  source 1..20: mol_type = other DNA
gaatgcagttccctgctctt

SEQ ID NO: 76073 - DNA, 20 bp, synthetic construct
  misc_feature 1..20: note = CRISPR gRNA sequence
  source 1..20: mol_type = other DNA
cctgctcttcacaaggcgag

SEQ ID NO: 76074 - DNA, 20 bp, synthetic construct
  misc_feature 1..20: note = CRISPR gRNA sequence
  source 1..20: mol_type = other DNA
ctcttcacaaggcgagctct

SEQ ID NO: 76075 - DNA, 20 bp, synthetic construct
  misc_feature 1..20: note = CRISPR gRNA sequence
  source 1..20: mol_type = other DNA
ttcacaaggcgagctctctc

SEQ ID NO: 76076 - DNA, 20 bp, synthetic construct
  misc_feature 1..20: note = CRISPR gRNA sequence
  source 1..20: mol_type = other DNA
cacaaggcgagctctctctc

SEQ ID NO: 76077 - DNA, 20 bp, synthetic construct
  misc_feature 1..20: note = CRISPR gRNA sequence
  source 1..20: mol_type = other DNA
acaaggcgagctctctctct

SEQ ID NO: 76078 - DNA, 20 bp, synthetic construct
  misc_feature 1..20: note = CRISPR gRNA sequence
  source 1..20: mol_type = other DNA
tctctcttcctttaggtccc

SEQ ID NO: 76079 - DNA, 20 bp, synthetic construct
  misc_feature 1..20: note = CRISPR gRNA sequence
  source 1..20: mol_type = other DNA
tctcttcctttaggtcccag

SEQ ID NO: 76080 - DNA, 20 bp, synthetic construct
  misc_feature 1..20: note = CRISPR gRNA sequence
  source 1..20: mol_type = other DNA
tcttcctttaggtcccagct

SEQ ID NO: 76081 - DNA, 20 bp, synthetic construct
  misc_feature 1..20: note = CRISPR gRNA sequence
  source 1..20: mol_type = other DNA
ttcctttaggtcccagctca

SEQ ID NO: 76082 - DNA, 20 bp, synthetic construct
  misc_feature 1..20: note = CRISPR gRNA sequence
  source 1..20: mol_type = other DNA
cctttaggtcccagctcagc

SEQ ID NO: 76083 - DNA, 20 bp, synthetic construct
  misc_feature 1..20: note = CRISPR gRNA sequence
  source 1..20: mol_type = other DNA
ctttaggtcccagctcagca

SEQ ID NO: 76084 - DNA, 20 bp, synthetic construct
  misc_feature 1..20: note = CRISPR gRNA sequence
  source 1..20: mol_type = other DNA
taggtcccagctcagcatcc

SEQ ID NO: 76085 - DNA, 20 bp, synthetic construct
  misc_feature 1..20: note = CRISPR gRNA sequence
  source 1..20: mol_type = other DNA
aggtcccagctcagcatccc

SEQ ID NO: 76086 - DNA, 20 bp, synthetic construct
  misc_feature 1..20: note = CRISPR gRNA sequence
  source 1..20: mol_type = other DNA
ggtcccagctcagcatccct

SEQ ID NO: 76087 - DNA, 20 bp, synthetic construct
  misc_feature 1..20: note = CRISPR gRNA sequence
  source 1..20: mol_type = other DNA
agcatccctcctcagagatg

SEQ ID NO: 76088 - DNA, 20 bp, synthetic construct
  misc_feature 1..20: note = CRISPR gRNA sequence
  source 1..20: mol_type = other DNA
ctcagagatgttccctgatg

SEQ ID NO: 76089 - DNA, 20 bp, synthetic construct
  misc_feature 1..20: note = CRISPR gRNA sequence
  source 1..20: mol_type = other DNA
agagatgttccctgatggct

SEQ ID NO: 76090 - DNA, 20 bp, synthetic construct
  misc_feature 1..20: note = CRISPR gRNA sequence
  source 1..20: mol_type = other DNA
cctgatggcttctgccacat

SEQ ID NO: 76091 - DNA, 20 bp, synthetic construct
  misc_feature 1..20: note = CRISPR gRNA sequence
  source 1..20: mol_type = other DNA
atggcttctgccacatctaa

SEQ ID NO: 76092 - DNA, 20 bp, synthetic construct
  misc_feature 1..20: note = CRISPR gRNA sequence
  source 1..20: mol_type = other DNA
ctgccacatctaaatcacct

SEQ ID NO: 76093 - DNA, 20 bp, synthetic construct
  misc_feature 1..20: note = CRISPR gRNA sequence
  source 1..20: mol_type = other DNA
tgccacatctaaatcacctc

SEQ ID NO: 76094 - DNA, 20 bp, synthetic construct
  misc_feature 1..20: note = CRISPR gRNA sequence
  source 1..20: mol_type = other DNA
ccacatctaaatcacctctc

SEQ ID NO: 76095 - DNA, 20 bp, synthetic construct
  misc_feature 1..20: note = CRISPR gRNA sequence
  source 1..20: mol_type = other DNA
aatcacctctccagccactc

SEQ ID NO: 76096 - DNA, 20 bp, synthetic construct
  misc_feature 1..20: note = CRISPR gRNA sequence
  source 1..20: mol_type = other DNA
tccagccactcttcaccaca

SEQ ID NO: 76097 - DNA, 20 bp, synthetic construct
  misc_feature 1..20: note = CRISPR gRNA sequence
  source 1..20: mol_type = other DNA
cagccactcttcaccacatc

SEQ ID NO: 76098 - DNA, 20 bp, synthetic construct
  misc_feature 1..20: note = CRISPR gRNA sequence
  source 1..20: mol_type = other DNA
ttcaccacatcccgagaaaa

SEQ ID NO: 76099 - DNA, 20 bp, synthetic construct
  misc_feature 1..20: note = CRISPR gRNA sequence
  source 1..20: mol_type = other DNA
caccacatcccgagaaaatt

SEQ ID NO: 76100 - DNA, 20 bp, synthetic construct
  misc_feature 1..20: note = CRISPR gRNA sequence
  source 1..20: mol_type = other DNA
accacatcccgagaaaattc

SEQ ID NO: 76101 - DNA, 20 bp, synthetic construct
  misc_feature 1..20: note = CRISPR gRNA sequence
  source 1..20: mol_type = other DNA
tcttatcactggctaagttc

SEQ ID NO: 76102 - DNA, 20 bp, synthetic construct
  misc_feature 1..20: note = CRISPR gRNA sequence
  source 1..20: mol_type = other DNA
ttatcactggctaagttcat

SEQ ID NO: 76103 - DNA, 20 bp, synthetic construct
  misc_feature 1..20: note = CRISPR gRNA sequence
  source 1..20: mol_type = other DNA
atcactggctaagttcatct

SEQ ID NO: 76104 - DNA, 20 bp, synthetic construct
  misc_feature 1..20: note = CRISPR gRNA sequence
  source 1..20: mol_type = other DNA
tcactggctaagttcatctt

SEQ ID NO: 76105 - DNA, 20 bp, synthetic construct
  misc_feature 1..20: note = CRISPR gRNA sequence
  source 1..20: mol_type = other DNA
gctaagttcatcttatttga

SEQ ID NO: 76106 - DNA, 20 bp, synthetic construct
  misc_feature 1..20: note = CRISPR gRNA sequence
  source 1..20: mol_type = other DNA
agttcatcttatttgatttt

SEQ ID NO: 76107 - DNA, 20 bp, synthetic construct
  misc_feature 1..20: note = CRISPR gRNA sequence
  source 1..20: mol_type = other DNA
atcttatttgattttacttt

SEQ ID NO: 76108 - DNA, 20 bp, synthetic construct
  misc_feature 1..20: note = CRISPR gRNA sequence
  source 1..20: mol_type = other DNA
atttgattttactttactta

SEQ ID NO: 76109 - DNA, 20 bp, synthetic construct
  misc_feature 1..20: note = CRISPR gRNA sequence
  source 1..20: mol_type = other DNA
tttgattttactttacttat

SEQ ID NO: 76110 - DNA, 20 bp, synthetic construct
  misc_feature 1..20: note = CRISPR gRNA sequence
  source 1..20: mol_type = other DNA
gattttactttacttatttt

SEQ ID NO: 76111 - DNA, 20 bp, synthetic construct
  misc_feature 1..20: note = CRISPR gRNA sequence
  source 1..20: mol_type = other DNA
attttactttacttattttt

SEQ ID NO: 76112 - DNA, 20 bp, synthetic construct
  misc_feature 1..20: note = CRISPR gRNA sequence
  source 1..20: mol_type = other DNA
tactttacttatttttcagc

SEQ ID NO: 76113 - DNA, 20 bp, synthetic construct
  misc_feature 1..20: note = CRISPR gRNA sequence
  source 1..20: mol_type = other DNA
actttacttatttttcagct

SEQ ID NO: 76114 - DNA, 20 bp, synthetic construct
  misc_feature 1..20: note = CRISPR gRNA sequence
  source 1..20: mol_type = other DNA
ctttacttatttttcagctc

SEQ ID NO: 76115 - DNA, 20 bp, synthetic construct
  misc_feature 1..20: note = CRISPR gRNA sequence
  source 1..20: mol_type = other DNA
tacttatttttcagctccca

SEQ ID NO: 76116 - DNA, 20 bp, synthetic construct
  misc_feature 1..20: note = CRISPR gRNA sequence
  source 1..20: mol_type = other DNA
acttatttttcagctcccac

SEQ ID NO: 76117 - DNA, 20 bp, synthetic construct
  misc_feature 1..20: note = CRISPR gRNA sequence
  source 1..20: mol_type = other DNA
cttatttttcagctcccact

SEQ ID NO: 76118 - DNA, 20 bp, synthetic construct
  misc_feature 1..20: note = CRISPR gRNA sequence
  source 1..20: mol_type = other DNA
atttttcagctcccactatt

SEQ ID NO: 76119 - DNA, 20 bp, synthetic construct
  misc_feature 1..20: note = CRISPR gRNA sequence
  source 1..20: mol_type = other DNA
tttttcagctcccactattg

SEQ ID NO: 76120 - DNA, 20 bp, synthetic construct
  misc_feature 1..20: note = CRISPR gRNA sequence
  source 1..20: mol_type = other DNA
ttcagctcccactattgtaa

SEQ ID NO: 76121 - DNA, 20 bp, synthetic construct
  misc_feature 1..20: note = CRISPR gRNA sequence
  source 1..20: mol_type = other DNA
tcagctcccactattgtaag

SEQ ID NO: 76122 - DNA, 20 bp, synthetic construct
  misc_feature 1..20: note = CRISPR gRNA sequence
  source 1..20: mol_type = other DNA
cagctcccactattgtaaga

SEQ ID NO: 76123 - DNA, 20 bp, synthetic construct
  misc_feature 1..20: note = CRISPR gRNA sequence
  source 1..20: mol_type = other DNA
agctcccactattgtaagag

SEQ ID NO: 76124 - DNA, 20 bp, synthetic construct
  misc_feature 1..20: note = CRISPR gRNA sequence
  source 1..20: mol_type = other DNA
ccactattgtaagaggagct

SEQ ID NO: 76125 - DNA, 20 bp, synthetic construct
  misc_feature 1..20: note = CRISPR gRNA sequence
  source 1..20: mol_type = other DNA
ttgtaagaggagctccaaga

SEQ ID NO: 76126 - DNA, 20 bp, synthetic construct
  misc_feature 1..20: note = CRISPR gRNA sequence
  source 1..20: mol_type = other DNA
taagaggagctccaagaaga

SEQ ID NO: 76127 - DNA, 20 bp, synthetic construct
  misc_feature 1..20: note = CRISPR gRNA sequence
  source 1..20: mol_type = other DNA
caagaagataaggacatggt

SEQ ID NO: 76128 - DNA, 20 bp, synthetic construct
  misc_feature 1..20: note = CRISPR gRNA sequence
  source 1..20: mol_type = other DNA
tttctgctgtgtcgtcacac

SEQ ID NO: 76129 - DNA, 20 bp, synthetic construct
  misc_feature 1..20: note = CRISPR gRNA sequence
  source 1..20: mol_type = other DNA
ttctgctgtgtcgtcacaca

SEQ ID NO: 76130 - DNA, 20 bp, synthetic construct
  misc_feature 1..20: note = CRISPR gRNA sequence
  source 1..20: mol_type = other DNA
tctgctgtgtcgtcacacaa

SEQ ID NO: 76131 - DNA, 20 bp, synthetic construct
  misc_feature 1..20: note = CRISPR gRNA sequence
  source 1..20: mol_type = other DNA
ctgctgtgtcgtcacacaat

SEQ ID NO: 76132 - DNA, 20 bp, synthetic construct
  misc_feature 1..20: note = CRISPR gRNA sequence
  source 1..20: mol_type = other DNA
tgctgtgtcgtcacacaatg

SEQ ID NO: 76133 - DNA, 20 bp, synthetic construct
  misc_feature 1..20: note = CRISPR gRNA sequence
  source 1..20: mol_type = other DNA
ctgtgtcgtcacacaatgcc

SEQ ID NO: 76134 - DNA, 20 bp, synthetic construct
  misc_feature 1..20: note = CRISPR gRNA sequence
  source 1..20: mol_type = other DNA
tgtcgtcacacaatgcctgg

SEQ ID NO: 76135 - DNA, 20 bp, synthetic construct
  misc_feature 1..20: note = CRISPR gRNA sequence
  source 1..20: mol_type = other DNA
gcccacagtagggccacaag

SEQ ID NO: 76136 - DNA, 20 bp, synthetic construct
  misc_feature 1..20: note = CRISPR gRNA sequence
  source 1..20: mol_type = other DNA
cacgttgagtactacaaagt

SEQ ID NO: 76137 - DNA, 20 bp, synthetic construct
  misc_feature 1..20: note = CRISPR gRNA sequence
  source 1..20: mol_type = other DNA
agtactacaaagtttaaacc

SEQ ID NO: 76138 - DNA, 20 bp, synthetic construct
  misc_feature 1..20: note = CRISPR gRNA sequence
  source 1..20: mol_type = other DNA
caaagtttaaaccctggcaa

SEQ ID NO: 76139 - DNA, 20 bp, synthetic construct
  misc_feature 1..20: note = CRISPR gRNA sequence
  source 1..20: mol_type = other DNA
aaaccctggcaaggggtcag

SEQ ID NO: 76140 - DNA, 20 bp, synthetic construct
  misc_feature 1..20: note = CRISPR gRNA sequence
  source 1..20: mol_type = other DNA
aaccctggcaaggggtcagg

SEQ ID NO: 76141 - DNA, 20 bp, synthetic construct
  misc_feature 1..20: note = CRISPR gRNA sequence
  source 1..20: mol_type = other DNA
gcaaggggtcaggctggcca

SEQ ID NO: 76142 - DNA, 20 bp, synthetic construct
  misc_feature 1..20: note = CRISPR gRNA sequence
  source 1..20: mol_type = other DNA
gccacgccactccaaaggcg

SEQ ID NO: 76143 - DNA, 20 bp, synthetic construct
  misc_feature 1..20: note = CRISPR gRNA sequence
  source 1..20: mol_type = other DNA
caaaggcggacgaggagtca

SEQ ID NO: 76144 - DNA, 20 bp, synthetic construct
  misc_feature 1..20: note = CRISPR gRNA sequence
  source 1..20: mol_type = other DNA
tgtgatttaggcaaagagaa

SEQ ID NO: 76145 - DNA, 20 bp, synthetic construct
  misc_feature 1..20: note = CRISPR gRNA sequence
  source 1..20: mol_type = other DNA
aggcaaagagaagttcctct

SEQ ID NO: 76146 - DNA, 20 bp, synthetic construct
  misc_feature 1..20: note = CRISPR gRNA sequence
  source 1..20: mol_type = other DNA
ggcaaagagaagttcctctc

SEQ ID NO: 76147 - DNA, 20 bp, synthetic construct
  misc_feature 1..20: note = CRISPR gRNA sequence
  source 1..20: mol_type = other DNA
ctctccggtctgaggtttcc

SEQ ID NO: 76148 - DNA, 20 bp, synthetic construct
  misc_feature 1..20: note = CRISPR gRNA sequence
  source 1..20: mol_type = other DNA
tccggtctgaggtttccaac

SEQ ID NO: 76149 - DNA, 20 bp, synthetic construct
  misc_feature 1..20: note = CRISPR gRNA sequence
  source 1..20: mol_type = other DNA
cggtctgaggtttccaacct

SEQ ID NO: 76150 - DNA, 20 bp, synthetic construct
  misc_feature 1..20: note = CRISPR gRNA sequence
  source 1..20: mol_type = other DNA
aggtttccaacctgttcaat

SEQ ID NO: 76151 - DNA, 20 bp, synthetic construct
  misc_feature 1..20: note = CRISPR gRNA sequence
  source 1..20: mol_type = other DNA
ccaacctgttcaattttaac

SEQ ID NO: 76152 - DNA, 20 bp, synthetic construct
  misc_feature 1..20: note = CRISPR gRNA sequence
  source 1..20: mol_type = other DNA
caacctgttcaattttaacc

SEQ ID NO: 76153 - DNA, 20 bp, synthetic construct
  misc_feature 1..20: note = CRISPR gRNA sequence
  source 1..20: mol_type = other DNA
ttcaattttaacctgccacc

SEQ ID NO: 76154 - DNA, 20 bp, synthetic construct
  misc_feature 1..20: note = CRISPR gRNA sequence
  source 1..20: mol_type = other DNA
aattttaacctgccaccttt

SEQ ID NO: 76155 - DNA, 20 bp, synthetic construct
  misc_feature 1..20: note = CRISPR gRNA sequence
  source 1..20: mol_type = other DNA
taacctgccaccttttatgt

SEQ ID NO: 76156 - DNA, 20 bp, synthetic construct
  misc_feature 1..20: note = CRISPR gRNA sequence
  source 1..20: mol_type = other DNA
aacctgccaccttttatgtc

SEQ ID NO: 76157 - DNA, 20 bp, synthetic construct
  misc_feature 1..20: note = CRISPR gRNA sequence
  source 1..20: mol_type = other DNA
acctgccaccttttatgtcc

SEQ ID NO: 76158 - DNA, 20 bp, synthetic construct
  misc_feature 1..20: note = CRISPR gRNA sequence
  source 1..20: mol_type = other DNA
ccaccttttatgtccaaagg

SEQ ID NO: 76159 - DNA, 20 bp, synthetic construct
  misc_feature 1..20: note = CRISPR gRNA sequence
  source 1..20: mol_type = other DNA
ttatgtccaaaggagtcctt

SEQ ID NO: 76160 - DNA, 20 bp, synthetic construct
  misc_feature 1..20: note = CRISPR gRNA sequence
  source 1..20: mol_type = other DNA
tatgtccaaaggagtccttt

SEQ ID NO: 76161 - DNA, 20 bp, synthetic construct
  misc_feature 1..20: note = CRISPR gRNA sequence
  source 1..20: mol_type = other DNA
atgtccaaaggagtcctttc

SEQ ID NO: 76162 - DNA, 20 bp, synthetic construct
  misc_feature 1..20: note = CRISPR gRNA sequence
  source 1..20: mol_type = other DNA
tgtccaaaggagtcctttct

SEQ ID NO: 76163 - DNA, 20 bp, synthetic construct
  misc_feature 1..20: note = CRISPR gRNA sequence
  source 1..20: mol_type = other DNA
tctgactcattatctccggg

SEQ ID NO: 76164 - DNA, 20 bp, synthetic construct
  misc_feature 1..20: note = CRISPR gRNA sequence
  source 1..20: mol_type = other DNA
ctgactcattatctccgggc

SEQ ID NO: 76165 - DNA, 20 bp, synthetic construct
  misc_feature 1..20: note = CRISPR gRNA sequence
  source 1..20: mol_type = other DNA
tgactcattatctccgggca

SEQ ID NO: 76166 - DNA, 20 bp, synthetic construct
  misc_feature 1..20: note = CRISPR gRNA sequence
  source 1..20: mol_type = other DNA
actcattatctccgggcagg

SEQ ID NO: 76167 - DNA, 20 bp, synthetic construct
  misc_feature 1..20: note = CRISPR gRNA sequence
  source 1..20: mol_type = other DNA
attatctccgggcagggtgg

SEQ ID NO: 76168 - DNA, 20 bp, synthetic construct
  misc_feature 1..20: note = CRISPR gRNA sequence
  source 1..20: mol_type = other DNA
tctccgggcagggtgggact

SEQ ID NO: 76169 - DNA, 20 bp, synthetic construct
  misc_feature 1..20: note = CRISPR gRNA sequence
  source 1..20: mol_type = other DNA
cgggcagggtgggactatta

SEQ ID NO: 76170 - DNA, 20 bp, synthetic construct
  misc_feature 1..20: note = CRISPR gRNA sequence
  source 1..20: mol_type = other DNA
ttacagggtgccatggggtg

SEQ ID NO: 76171 - DNA, 20 bp, synthetic construct
  misc_feature 1..20: note = CRISPR gRNA sequence
  source 1..20: mol_type = other DNA
cagggtgccatggggtgctg

SEQ ID NO: 76172 - DNA, 20 bp, synthetic construct
  misc_feature 1..20: note = CRISPR gRNA sequence
  source 1..20: mol_type = other DNA
tgagctgggctgtacttgcc

SEQ ID NO: 76173 - DNA, 20 bp, synthetic construct
  misc_feature 1..20: note = CRISPR gRNA sequence
  source 1..20: mol_type = other DNA
ggctgtacttgcccctggaa

SEQ ID NO: 76174 - DNA, 20 bp, synthetic construct
  misc_feature 1..20: note = CRISPR gRNA sequence
  source 1..20: mol_type = other DNA
tacttgcccctggaatgttg

SEQ ID NO: 76175 - DNA, 20 bp, synthetic construct
  misc_feature 1..20: note = CRISPR gRNA sequence
  source 1..20: mol_type = other DNA
gcccctggaatgttgtcacg

SEQ ID NO: 76176 - DNA, 20 bp, synthetic construct
  misc_feature 1..20: note = CRISPR gRNA sequence
  source 1..20: mol_type = other DNA
cccctggaatgttgtcacgt

SEQ ID NO: 76177 - DNA, 20 bp, synthetic construct
  misc_feature 1..20: note = CRISPR gRNA sequence
  source 1..20: mol_type = other DNA
gaatgttgtcacgtctcctc

SEQ ID NO: 76178 - DNA, 20 bp, synthetic construct
  misc_feature 1..20: note = CRISPR gRNA sequence
  source 1..20: mol_type = other DNA
tcacgtctcctccctccctc

SEQ ID NO: 76179 - DNA, 20 bp, synthetic construct
  misc_feature 1..20: note = CRISPR gRNA sequence
  source 1..20: mol_type = other DNA
ctccctccctcccagataaa

SEQ ID NO: 76180 - DNA, 20 bp, synthetic construct
  misc_feature 1..20: note = CRISPR gRNA sequence
  source 1..20: mol_type = other DNA
cctccctcccagataaaacc

SEQ ID NO: 76181 - DNA, 20 bp, synthetic construct
  misc_feature 1..20: note = CRISPR gRNA sequence
  source 1..20: mol_type = other DNA
cctcccagataaaacccaag

SEQ ID NO: 76182 - DNA, 20 bp, synthetic construct
  misc_feature 1..20: note = CRISPR gRNA sequence
  source 1..20: mol_type = other DNA
ccagataaaacccaagcata

SEQ ID NO: 76183 - DNA, 20 bp, synthetic construct
  misc_feature 1..20: note = CRISPR gRNA sequence
  source 1..20: mol_type = other DNA
gaggtgatgcgagccatctt

SEQ ID NO: 76184 - DNA, 20 bp, synthetic construct
  misc_feature 1..20: note = CRISPR gRNA sequence
  source 1..20: mol_type = other DNA
agacatcccagagagcccca

SEQ ID NO: 76185 - DNA, 20 bp, synthetic construct
  misc_feature 1..20: note = CRISPR gRNA sequence
  source 1..20: mol_type = other DNA
gacatcccagagagccccag

SEQ ID NO: 76186 - DNA, 20 bp, synthetic construct
  misc_feature 1..20: note = CRISPR gRNA sequence
  source 1..20: mol_type = other DNA
tgcaccgatgttattaacat

SEQ ID NO: 76187 - DNA, 20 bp, synthetic construct
  misc_feature 1..20: note = CRISPR gRNA sequence
  source 1..20: mol_type = other DNA
gcaccgatgttattaacatt

SEQ ID NO: 76188 - DNA, 20 bp, synthetic construct
  misc_feature 1..20: note = CRISPR gRNA sequence
  source 1..20: mol_type = other DNA
caccgatgttattaacatta

SEQ ID NO: 76189 - DNA, 20 bp, synthetic construct
  misc_feature 1..20: note = CRISPR gRNA sequence
  source 1..20: mol_type = other DNA
ttaacattatgatttacttt

SEQ ID NO: 76190 - DNA, 20 bp, synthetic construct
  misc_feature 1..20: note = CRISPR gRNA sequence
  source 1..20: mol_type = other DNA
acattatgatttactttcct

SEQ ID NO: 76191 - DNA, 20 bp, synthetic construct
  misc_feature 1..20: note = CRISPR gRNA sequence
  source 1..20: mol_type = other DNA
tgatttactttcctgctgta

SEQ ID NO: 76192 - DNA, 20 bp, synthetic construct
  misc_feature 1..20: note = CRISPR gRNA sequence
  source 1..20: mol_type = other DNA
actttcctgctgtatttttt

SEQ ID NO: 76193 - DNA, 20 bp, synthetic construct
  misc_feature 1..20: note = CRISPR gRNA sequence
  source 1..20: mol_type = other DNA
ctttcctgctgtattttttc

SEQ ID NO: 76194 - DNA, 20 bp, synthetic construct
  misc_feature 1..20: note = CRISPR gRNA sequence
  source 1..20: mol_type = other DNA
tcctgctgtattttttcatc

SEQ ID NO: 76195 - DNA, 20 bp, synthetic construct
  misc_feature 1..20: note = CRISPR gRNA sequence
  source 1..20: mol_type = other DNA
cctgctgtattttttcatct

SEQ ID NO: 76196 - DNA, 20 bp, synthetic construct
  misc_feature 1..20: note = CRISPR gRNA sequence
  source 1..20: mol_type = other DNA
ctgctgtattttttcatctt

SEQ ID NO: 76197 - DNA, 20 bp, synthetic construct
  misc_feature 1..20: note = CRISPR gRNA sequence
  source 1..20: mol_type = other DNA
ctgtattttttcatcttagc

SEQ ID NO: 76198 - DNA, 20 bp, synthetic construct
  misc_feature 1..20: note = CRISPR gRNA sequence
  source 1..20: mol_type = other DNA
tattttttcatcttagctgc

SEQ ID NO: 76199 - DNA, 20 bp, synthetic construct
  misc_feature 1..20: note = CRISPR gRNA sequence
  source 1..20: mol_type = other DNA
tttcatcttagctgcagctg

SEQ ID NO: 76200 - DNA, 20 bp, synthetic construct
  misc_feature 1..20: note = CRISPR gRNA sequence
  source 1..20: mol_type = other DNA
ttcatcttagctgcagctgc

SEQ ID NO: 76201 - DNA, 20 bp, synthetic construct
  misc_feature 1..20: note = CRISPR gRNA sequence
  source 1..20: mol_type = other DNA
tcatcttagctgcagctgct

SEQ ID NO: 76202 - DNA, 20 bp, synthetic construct
  misc_feature 1..20: note = CRISPR gRNA sequence
  source 1..20: mol_type = other DNA
catcttagctgcagctgctt

SEQ ID NO: 76203 - DNA, 20 bp, synthetic construct
  misc_feature 1..20: note = CRISPR gRNA sequence
  source 1..20: mol_type = other DNA
atcttagctgcagctgcttc

SEQ ID NO: 76204 - DNA, 20 bp, synthetic construct
  misc_feature 1..20: note = CRISPR gRNA sequence
  source 1..20: mol_type = other DNA
agctgcagctgcttcccacc

SEQ ID NO: 76205 - DNA, 20 bp, synthetic construct
  misc_feature 1..20: note = CRISPR gRNA sequence
  source 1..20: mol_type = other DNA
gctgcagctgcttcccaccc

SEQ ID NO: 76206 - DNA, 20 bp, synthetic construct
  misc_feature 1..20: note = CRISPR gRNA sequence
  source 1..20: mol_type = other DNA
cagctgcttcccaccccgcc

SEQ ID NO: 76207 - DNA, 20 bp, synthetic construct
  misc_feature 1..20: note = CRISPR gRNA sequence
  source 1..20: mol_type = other DNA
cttcccaccccgcctcccac

SEQ ID NO: 76208 - DNA, 20 bp, synthetic construct
  misc_feature 1..20: note = CRISPR gRNA sequence
  source 1..20: mol_type = other DNA
cccaccccgcctcccaccac

SEQ ID NO: 76209 - DNA, 20 bp, synthetic construct
  misc_feature 1..20: note = CRISPR gRNA sequence
  source 1..20: mol_type = other DNA
ccaccccgcctcccaccact

SEQ ID NO: 76210 - DNA, 20 bp, synthetic construct
  misc_feature 1..20: note = CRISPR gRNA sequence
  source 1..20: mol_type = other DNA
ccaccactagaagactgttt

SEQ ID NO: 76211 - DNA, 20 bp, synthetic construct
  misc_feature 1..20: note = CRISPR gRNA sequence
  source 1..20: mol_type = other DNA
gaagactgtttaaagtaaat

SEQ ID NO: 76212 - DNA, 20 bp, synthetic construct
  misc_feature 1..20: note = CRISPR gRNA sequence
  source 1..20: mol_type = other DNA
tttaaagtaaatccttctaa

SEQ ID NO: 76213 - DNA, 20 bp, synthetic construct
  misc_feature 1..20: note = CRISPR gRNA sequence
  source 1..20: mol_type = other DNA
aaagtaaatccttctaaaat

SEQ ID NO: 76214 - DNA, 20 bp, synthetic construct
  misc_feature 1..20: note = CRISPR gRNA sequence
  source 1..20: mol_type = other DNA
aagtaaatccttctaaaatt

SEQ ID NO: 76215 - DNA, 20 bp, synthetic construct
  misc_feature 1..20: note = CRISPR gRNA sequence
  source 1..20: mol_type = other DNA
ctaaaattctttctttttct

SEQ ID NO: 76216 - DNA, 20 bp, synthetic construct
  misc_feature 1..20: note = CRISPR gRNA sequence
  source 1..20: mol_type = other DNA
taaaattctttctttttctt

SEQ ID NO: 76217 - DNA, 20 bp, synthetic construct
  misc_feature 1..20: note = CRISPR gRNA sequence
  source 1..20: mol_type = other DNA
aaattctttctttttctttt

SEQ ID NO: 76218 - DNA, 20 bp, synthetic construct
  misc_feature 1..20: note = CRISPR gRNA sequence
  source 1..20: mol_type = other DNA
tttctttttctttttttctt

SEQ ID NO: 76219 - DNA, 20 bp, synthetic construct
  misc_feature 1..20: note = CRISPR gRNA sequence
  source 1..20: mol_type = other DNA
tctttttctttttttctttt

SEQ ID NO: 76220 - DNA, 20 bp, synthetic construct
  misc_feature 1..20: note = CRISPR gRNA sequence
  source 1..20: mol_type = other DNA
ctttttctttttttcttttt

SEQ ID NO: 76221 - DNA, 20 bp, synthetic construct
  misc_feature 1..20: note = CRISPR gRNA sequence
  source 1..20: mol_type = other DNA
tttttctttttttctttttt

SEQ ID NO: 76222 - DNA, 20 bp, synthetic construct
  misc_feature 1..20: note = CRISPR gRNA sequence
  source 1..20: mol_type = other DNA
tttctttttttctttttttt

SEQ ID NO: 76223 - DNA, 20 bp, synthetic construct
  misc_feature 1..20: note = CRISPR gRNA sequence
  source 1..20: mol_type = other DNA
ttctttttttcttttttttt

SEQ ID NO: 76224 - DNA, 20 bp, synthetic construct
  misc_feature 1..20: note = CRISPR gRNA sequence
  source 1..20: mol_type = other DNA
tctttttttctttttttttt

SEQ ID NO: 76225 - DNA, 20 bp, synthetic construct
  misc_feature 1..20: note = CRISPR gRNA sequence
  source 1..20: mol_type = other DNA
ctttttttcttttttttttt

SEQ ID NO: 76226 - DNA, 20 bp, synthetic construct
  misc_feature 1..20: note = CRISPR gRNA sequence
  source 1..20: mol_type = other DNA
tttttttctttttttttttc

SEQ ID NO: 76227 - DNA, 20 bp, synthetic construct
  misc_feature 1..20: note = CRISPR gRNA sequence
  source 1..20: mol_type = other DNA
tttttctttttttttttctg

SEQ ID NO: 76228 - DNA, 20 bp, synthetic construct
  misc_feature 1..20: note = CRISPR gRNA sequence
  source 1..20: mol_type = other DNA
ttttctttttttttttctga

SEQ ID NO: 76229 - DNA, 20 bp, synthetic construct
  misc_feature 1..20: note = CRISPR gRNA sequence
  source 1..20: mol_type = other DNA
tttctttttttttttctgag

SEQ ID NO: 76230 - DNA, 20 bp, synthetic construct
  misc_feature 1..20: note = CRISPR gRNA sequence
  source 1..20: mol_type = other DNA
ttctttttttttttctgaga

SEQ ID NO: 76231 - DNA, 20 bp, synthetic construct
  misc_feature 1..20: note = CRISPR gRNA sequence
  source 1..20: mol_type = other DNA
tctttttttttttctgagat

SEQ ID NO: 76232 - DNA, 20 bp, synthetic construct
  misc_feature 1..20: note = CRISPR gRNA sequence
  source 1..20: mol_type = other DNA
ctttttttttttctgagatg

SEQ ID NO: 76233 - DNA, 20 bp, synthetic construct
  misc_feature 1..20: note = CRISPR gRNA sequence
  source 1..20: mol_type = other DNA
tttttttttttctgagatgg

SEQ ID NO: 76234 - DNA, 20 bp, synthetic construct
  misc_feature 1..20: note = CRISPR gRNA sequence
  source 1..20: mol_type = other DNA
tttttttttctgagatggag

SEQ ID NO: 76235 - DNA, 20 bp, synthetic construct
  misc_feature 1..20: note = CRISPR gRNA sequence
  source 1..20: mol_type = other DNA
ttttttttctgagatggagt

SEQ ID NO: 76236 - DNA, 20 bp, synthetic construct
  misc_feature 1..20: note = CRISPR gRNA sequence
  source 1..20: mol_type = other DNA
tttttttctgagatggagtt

SEQ ID NO: 76237 - DNA, 20 bp, synthetic construct
  misc_feature 1..20: note = CRISPR gRNA sequence
  source 1..20: mol_type = other DNA
ttttttctgagatggagttt

SEQ ID NO: 76238 - DNA, 20 bp, synthetic construct
  misc_feature 1..20: note = CRISPR gRNA sequence
  source 1..20: mol_type = other DNA
tttttctgagatggagtttc

SEQ ID NO: 76239 - DNA, 20 bp, synthetic construct
  misc_feature 1..20: note = CRISPR gRNA sequence
  source 1..20: mol_type = other DNA
ttttctgagatggagtttca

SEQ ID NO: 76240 - DNA, 20 bp, synthetic construct
  misc_feature 1..20: note = CRISPR gRNA sequence
  source 1..20: mol_type = other DNA
tttctgagatggagtttcac

SEQ ID NO: 76241 - DNA, 20 bp, synthetic construct
  misc_feature 1..20: note = CRISPR gRNA sequence
  source 1..20: mol_type = other DNA
ttctgagatggagtttcact

SEQ ID NO: 76242 - DNA, 20 bp, synthetic construct
  misc_feature 1..20: note = CRISPR gRNA sequence
  source 1..20: mol_type = other DNA
tctgagatggagtttcactc

SEQ ID NO: 76243 - DNA, 20 bp, synthetic construct
  misc_feature 1..20: note = CRISPR gRNA sequence
  source 1..20: mol_type = other DNA
ctgagatggagtttcactct

SEQ ID NO: 76244 - DNA, 20 bp, synthetic construct
  misc_feature 1..20: note = CRISPR gRNA sequence
  source 1..20: mol_type = other DNA
tgagatggagtttcactctt

SEQ ID NO: 76245 - DNA, 20 bp, synthetic construct
  misc_feature 1..20: note = CRISPR gRNA sequence
  source 1..20: mol_type = other DNA
agatggagtttcactcttgt

SEQ ID NO: 76246 - DNA, 20 bp, synthetic construct
  misc_feature 1..20: note = CRISPR gRNA sequence
  source 1..20: mol_type = other DNA
cactcttgtcgcccaagctg

SEQ ID NO: 76247 - DNA, 20 bp, synthetic construct
  misc_feature 1..20: note = CRISPR gRNA sequence
  source 1..20: mol_type = other DNA
actcttgtcgcccaagctgg

SEQ ID NO: 76248 - DNA, 20 bp, synthetic construct
  misc_feature 1..20: note = CRISPR gRNA sequence
  source 1..20: mol_type = other DNA
ttgtcgcccaagctggagtg

SEQ ID NO: 76249 - DNA, 20 bp, synthetic construct
  misc_feature 1..20: note = CRISPR gRNA sequence
  source 1..20: mol_type = other DNA
gtcgcccaagctggagtgca

SEQ ID NO: 76250 - DNA, 20 bp, synthetic construct
  misc_feature 1..20: note = CRISPR gRNA sequence
  source 1..20: mol_type = other DNA
tcgcccaagctggagtgcaa

SEQ ID NO: 76251 - DNA, 20 bp, synthetic construct
  misc_feature 1..20: note = CRISPR gRNA sequence
  source 1..20: mol_type = other DNA
gagtgcaatggcgcgatctc

SEQ ID NO: 76252 - DNA, 20 bp, synthetic construct
  misc_feature 1..20: note = CRISPR gRNA sequence
  source 1..20: mol_type = other DNA
ggctcactgcaacctccgcc

SEQ ID NO: 76253 - DNA, 20 bp, synthetic construct
  misc_feature 1..20: note = CRISPR gRNA sequence
  source 1..20: mol_type = other DNA
actgcaacctccgcctccca

SEQ ID NO: 76254 - DNA, 20 bp, synthetic construct
  misc_feature 1..20: note = CRISPR gRNA sequence
  source 1..20: mol_type = other DNA
caacctccgcctcccaagtt

SEQ ID NO: 76255 - DNA, 20 bp, synthetic construct
  misc_feature 1..20: note = CRISPR gRNA sequence
  source 1..20: mol_type = other DNA
cgcctcccaagttcaagcaa

SEQ ID NO: 76256 - DNA, 20 bp, synthetic construct
  misc_feature 1..20: note = CRISPR gRNA sequence
  source 1..20: mol_type = other DNA
ccaagttcaagcaattctcc

SEQ ID NO: 76257 - DNA, 20 bp, synthetic construct
  misc_feature 1..20: note = CRISPR gRNA sequence
  source 1..20: mol_type = other DNA
aagcaattctcctgcctcag

SEQ ID NO: 76258 - DNA, 20 bp, synthetic construct
  misc_feature 1..20: note = CRISPR gRNA sequence
  source 1..20: mol_type = other DNA
tcctgcctcagcctcccaag

SEQ ID NO: 76259 - DNA, 20 bp, synthetic construct
  misc_feature 1..20: note = CRISPR gRNA sequence
  source 1..20: mol_type = other DNA
ctgcctcagcctcccaagta

SEQ ID NO: 76260 - DNA, 20 bp, synthetic construct
  misc_feature 1..20: note = CRISPR gRNA sequence
  source 1..20: mol_type = other DNA
cctcagcctcccaagtagct

SEQ ID NO: 76261 - DNA, 20 bp, synthetic construct
  misc_feature 1..20: note = CRISPR gRNA sequence
  source 1..20: mol_type = other DNA
agcctcccaagtagctggaa

SEQ ID NO: 76262 - DNA, 20 bp, synthetic construct
  misc_feature 1..20: note = CRISPR gRNA sequence
  source 1..20: mol_type = other DNA
ccaagtagctggaattacag

SEQ ID NO: 76263 - DNA, 20 bp, synthetic construct
  misc_feature 1..20: note = CRISPR gRNA sequence
  source 1..20: mol_type = other DNA
gaattacaggcacccaccac

SEQ ID NO: 76264 - DNA, 20 bp, synthetic construct
  misc_feature 1..20: note = CRISPR gRNA sequence
  source 1..20: mol_type = other DNA
caggcacccaccaccacacc

SEQ ID NO: 76265 - DNA, 20 bp, synthetic construct
  misc_feature 1..20: note = CRISPR gRNA sequence
  source 1..20: mol_type = other DNA
atttttgtatttttagtaga

SEQ ID NO: 76266 - DNA, 20 bp, synthetic construct
  misc_feature 1..20: note = CRISPR gRNA sequence
  source 1..20: mol_type = other DNA
ttgtatttttagtagagacg

SEQ ID NO: 76267 - DNA, 20 bp, synthetic construct
  misc_feature 1..20: note = CRISPR gRNA sequence
  source 1..20: mol_type = other DNA
tgtatttttagtagagacgg

SEQ ID NO: 76268 - DNA, 20 bp, synthetic construct
  misc_feature 1..20: note = CRISPR gRNA sequence
  source 1..20: mol_type = other DNA
gtatttttagtagagacggg

SEQ ID NO: 76269 - DNA, 20 bp, synthetic construct
  misc_feature 1..20: note = CRISPR gRNA sequence
  source 1..20: mol_type = other DNA
tatttttagtagagacgggg

SEQ ID NO: 76270 - DNA, 20 bp, synthetic construct
  misc_feature 1..20: note = CRISPR gRNA sequence
  source 1..20: mol_type = other DNA
ttagtagagacggggtttca

SEQ ID NO: 76271 - DNA, 20 bp, synthetic construct
  misc_feature 1..20: note = CRISPR gRNA sequence
  source 1..20: mol_type = other DNA
tagtagagacggggtttcac

SEQ ID NO: 76272 - DNA, 20 bp, synthetic construct
  misc_feature 1..20: note = CRISPR gRNA sequence
  source 1..20: mol_type = other DNA
agtagagacggggtttcacc

SEQ ID NO: 76273 - DNA, 20 bp, synthetic construct
  misc_feature 1..20: note = CRISPR gRNA sequence
  source 1..20: mol_type = other DNA
gtagagacggggtttcacca

SEQ ID NO: 76274 - DNA, 20 bp, synthetic construct
  misc_feature 1..20: note = CRISPR gRNA sequence
  source 1..20: mol_type = other DNA
caccacattggccaggctgg

SEQ ID NO: 76275 - DNA, 20 bp, synthetic construct
  misc_feature 1..20: note = CRISPR gRNA sequence
  source 1..20: mol_type = other DNA
accacattggccaggctggt

SEQ ID NO: 76276 - DNA, 20 bp, synthetic construct
  misc_feature 1..20: note = CRISPR gRNA sequence
  source 1..20: mol_type = other DNA
gccaggctggtctcaaactc

SEQ ID NO: 76277 - DNA, 20 bp, synthetic construct
  misc_feature 1..20: note = CRISPR gRNA sequence
  source 1..20: mol_type = other DNA
gtctcaaactcctgacctca

SEQ ID NO: 76278 - DNA, 20 bp, synthetic construct
  misc_feature 1..20: note = CRISPR gRNA sequence
  source 1..20: mol_type = other DNA
aaactcctgacctcaggtga

SEQ ID NO: 76279 - DNA, 20 bp, synthetic construct
  misc_feature 1..20: note = CRISPR gRNA sequence
  source 1..20: mol_type = other DNA
ctgacctcaggtgatctgcc

SEQ ID NO: 76280 - DNA, 20 bp, synthetic construct
  misc_feature 1..20: note = CRISPR gRNA sequence
  source 1..20: mol_type = other DNA
acctcaggtgatctgcccgc

SEQ ID NO: 76281 - DNA, 20 bp, synthetic construct
  misc_feature 1..20: note = CRISPR gRNA sequence
  source 1..20: mol_type = other DNA
aggtgatctgcccgcctcgg

SEQ ID NO: 76282 - DNA, 20 bp, synthetic construct
  misc_feature 1..20: note = CRISPR gRNA sequence
  source 1..20: mol_type = other DNA
cccgcctcggcctcccaaag

SEQ ID NO: 76283 - DNA, 20 bp, synthetic construct
  misc_feature 1..20: note = CRISPR gRNA sequence
  source 1..20: mol_type = other DNA
ggcctcccaaagtgccggga

SEQ ID NO: 76284 - DNA, 20 bp, synthetic construct
  misc_feature 1..20: note = CRISPR gRNA sequence
  source 1..20: mol_type = other DNA
ccaaagtgccgggattacag

SEQ ID NO: 76285 - DNA, 20 bp, synthetic construct
  misc_feature 1..20: note = CRISPR gRNA sequence
  source 1..20: mol_type = other DNA
caggcatgagccaccacaca

SEQ ID NO: 76286 - DNA, 20 bp, synthetic construct
  misc_feature 1..20: note = CRISPR gRNA sequence
  source 1..20: mol_type = other DNA
aatacttttaaaattctaac

SEQ ID NO: 76287 - DNA, 20 bp, synthetic construct
  misc_feature 1..20: note = CRISPR gRNA sequence
  source 1..20: mol_type = other DNA
ttaaaattctaaccagtctg

SEQ ID NO: 76288 - DNA, 20 bp, synthetic construct
  misc_feature 1..20: note = CRISPR gRNA sequence
  source 1..20: mol_type = other DNA
taaaattctaaccagtctga

SEQ ID NO: 76289 - DNA, 20 bp, synthetic construct
  misc_feature 1..20: note = CRISPR gRNA sequence
  source 1..20: mol_type = other DNA
aaaattctaaccagtctgag

SEQ ID NO: 76290 - DNA, 20 bp, synthetic construct
  misc_feature 1..20: note = CRISPR gRNA sequence
  source 1..20: mol_type = other DNA
aaattctaaccagtctgagc

SEQ ID NO: 76291 - DNA, 20 bp, synthetic construct
  misc_feature 1..20: note = CRISPR gRNA sequence
  source 1..20: mol_type = other DNA
taaccagtctgagctgaaat

SEQ ID NO: 76292 - DNA, 20 bp, synthetic construct
  misc_feature 1..20: note = CRISPR gRNA sequence
  source 1..20: mol_type = other DNA
accagtctgagctgaaatta

SEQ ID NO: 76293 - DNA, 20 bp, synthetic construct
  misc_feature 1..20: note = CRISPR gRNA sequence
  source 1..20: mol_type = other DNA
agctgaaattagaaaatagt

SEQ ID NO: 76294 - DNA, 20 bp, synthetic construct
  misc_feature 1..20: note = CRISPR gRNA sequence
  source 1..20: mol_type = other DNA
aaattagaaaatagttttaa

SEQ ID NO: 76295 - DNA, 20 bp, synthetic construct
  misc_feature 1..20: note = CRISPR gRNA sequence
  source 1..20: mol_type = other DNA
gaaaatagttttaatacttt

SEQ ID NO: 76296 - DNA, 20 bp, synthetic construct
  misc_feature 1..20: note = CRISPR gRNA sequence
  source 1..20: mol_type = other DNA
taatactttgggggaattct

SEQ ID NO: 76297 - DNA, 20 bp, synthetic construct
  misc_feature 1..20: note = CRISPR gRNA sequence
  source 1..20: mol_type = other DNA
aatactttgggggaattctg

SEQ ID NO: 76298 - DNA, 20 bp, synthetic construct
  misc_feature 1..20: note = CRISPR gRNA sequence
  source 1..20: mol_type = other DNA
atactttgggggaattctgc

SEQ ID NO: 76299 - DNA, 20 bp, synthetic construct
  misc_feature 1..20: note = CRISPR gRNA sequence
  source 1..20: mol_type = other DNA
tgggggaattctgcttaaat

SEQ ID NO: 76300 - DNA, 20 bp, synthetic construct
  misc_feature 1..20: note = CRISPR gRNA sequence
  source 1..20: mol_type = other DNA
gggggaattctgcttaaatt

SEQ ID NO: 76301 - DNA, 20 bp, synthetic construct
  misc_feature 1..20: note = CRISPR gRNA sequence
  source 1..20: mol_type = other DNA
ggggaattctgcttaaattc

SEQ ID NO: 76302 - DNA, 20 bp, synthetic construct
  misc_feature 1..20: note = CRISPR gRNA sequence
  source 1..20: mol_type = other DNA
tgcttaaattccctttttgc

SEQ ID NO: 76303 - DNA, 20 bp, synthetic construct
  misc_feature 1..20: note = CRISPR gRNA sequence
  source 1..20: mol_type = other DNA
cttaaattccctttttgcga

SEQ ID NO: 76304 - DNA, 20 bp, synthetic construct
  misc_feature 1..20: note = CRISPR gRNA sequence
  source 1..20: mol_type = other DNA
aaattccctttttgcgagtt

SEQ ID NO: 76305 - DNA, 20 bp, synthetic construct
  misc_feature 1..20: note = CRISPR gRNA sequence
  source 1..20: mol_type = other DNA
aattccctttttgcgagttt

SEQ ID NO: 76306 - DNA, 20 bp, synthetic construct
  misc_feature 1..20: note = CRISPR gRNA sequence
  source 1..20: mol_type = other DNA
cctttttgcgagtttgacgg

SEQ ID NO: 76307 - DNA, 20 bp, synthetic construct
  misc_feature 1..20: note = CRISPR gRNA sequence
  source 1..20: mol_type = other DNA
tttgcgagtttgacggtgac

SEQ ID NO: 76308 - DNA, 20 bp, synthetic construct
  misc_feature 1..20: note = CRISPR gRNA sequence
  source 1..20: mol_type = other DNA
ttgcgagtttgacggtgacc

SEQ ID NO: 76309 - DNA, 20 bp, synthetic construct
  misc_feature 1..20: note = CRISPR gRNA sequence
  source 1..20: mol_type = other DNA
tgcgagtttgacggtgacct

SEQ ID NO: 76310 - DNA, 20 bp, synthetic construct
  misc_feature 1..20: note = CRISPR gRNA sequence
  source 1..20: mol_type = other DNA
gcgagtttgacggtgacctt

SEQ ID NO: 76311 - DNA, 20 bp, synthetic construct
  misc_feature 1..20: note = CRISPR gRNA sequence
  source 1..20: mol_type = other DNA
cgagtttgacggtgaccttt

SEQ ID NO: 76312 - DNA, 20 bp, synthetic construct
  misc_feature 1..20: note = CRISPR gRNA sequence
  source 1..20: mol_type = other DNA
gacggtgacctttaaaaagc

SEQ ID NO: 76313 - DNA, 20 bp, synthetic construct
  misc_feature 1..20: note = CRISPR gRNA sequence
  source 1..20: mol_type = other DNA
acggtgacctttaaaaagca

SEQ ID NO: 76314 - DNA, 20 bp, synthetic construct
  misc_feature 1..20: note = CRISPR gRNA sequence
  source 1..20: mol_type = other DNA
taaaaagcagcatgtgataa

SEQ ID NO: 76315 - DNA, 20 bp, synthetic construct
  misc_feature 1..20: note = CRISPR gRNA sequence
  source 1..20: mol_type = other DNA
aaaaagcagcatgtgataag

SEQ ID NO: 76316 - DNA, 20 bp, synthetic construct
  misc_feature 1..20: note = CRISPR gRNA sequence
  source 1..20: mol_type = other DNA
aaaagcagcatgtgataagt

SEQ ID NO: 76317 - DNA, 20 bp, synthetic construct
  misc_feature 1..20: note = CRISPR gRNA sequence
  source 1..20: mol_type = other DNA
catctgtacagcccctttct

SEQ ID NO: 76318 - DNA, 20 bp, synthetic construct
  misc_feature 1..20: note = CRISPR gRNA sequence
  source 1..20: mol_type = other DNA
tacagcccctttctacgagt

SEQ ID NO: 76319 - DNA, 20 bp, synthetic construct
  misc_feature 1..20: note = CRISPR gRNA sequence
  source 1..20: mol_type = other DNA
tctacgagtgggtgaccctc

SEQ ID NO: 76320 - DNA, 20 bp, synthetic construct
  misc_feature 1..20: note = CRISPR gRNA sequence
  source 1..20: mol_type = other DNA
ctacgagtgggtgaccctcc

SEQ ID NO: 76321 - DNA, 20 bp, synthetic construct
  misc_feature 1..20: note = CRISPR gRNA sequence
  source 1..20: mol_type = other DNA
tacgagtgggtgaccctccg

SEQ ID NO: 76322 - DNA, 20 bp, synthetic construct
  misc_feature 1..20: note = CRISPR gRNA sequence
  source 1..20: mol_type = other DNA
cgagtgggtgaccctccgtg

SEQ ID NO: 76323 - DNA, 20 bp, synthetic construct
  misc_feature 1..20: note = CRISPR gRNA sequence
  source 1..20: mol_type = other DNA
cgtgggtggggagaagttgg

SEQ ID NO: 76324 - DNA, 20 bp, synthetic construct
  misc_feature 1..20: note = CRISPR gRNA sequence
  source 1..20: mol_type = other DNA
gacagctcatttgtcacaga

SEQ ID NO: 76325 - DNA, 20 bp, synthetic construct
  misc_feature 1..20: note = CRISPR gRNA sequence
  source 1..20: mol_type = other DNA
atttgtcacagatcttccat

SEQ ID NO: 76326 - DNA, 20 bp, synthetic construct
  misc_feature 1..20: note = CRISPR gRNA sequence
  source 1..20: mol_type = other DNA
gtcacagatcttccatttct

SEQ ID NO: 76327 - DNA, 20 bp, synthetic construct
  misc_feature 1..20: note = CRISPR gRNA sequence
  source 1..20: mol_type = other DNA
tcacagatcttccatttctt

SEQ ID NO: 76328 - DNA, 20 bp, synthetic construct
  misc_feature 1..20: note = CRISPR gRNA sequence
  source 1..20: mol_type = other DNA
ccatttcttaaggtgatttt

SEQ ID NO: 76329 - DNA, 20 bp, synthetic construct
  misc_feature 1..20: note = CRISPR gRNA sequence
  source 1..20: mol_type = other DNA
catttcttaaggtgatttta

SEQ ID NO: 76330 - DNA, 20 bp, synthetic construct
  misc_feature 1..20: note = CRISPR gRNA sequence
  source 1..20: mol_type = other DNA
cttaaggtgattttagaata

SEQ ID NO: 76331 - DNA, 20 bp, synthetic construct
  misc_feature 1..20: note = CRISPR gRNA sequence
  source 1..20: mol_type = other DNA
ttaaggtgattttagaataa

SEQ ID NO: 76332 - DNA, 20 bp, synthetic construct
  misc_feature 1..20: note = CRISPR gRNA sequence
  source 1..20: mol_type = other DNA
aaggtgattttagaataact

SEQ ID NO: 76333 - DNA, 20 bp, synthetic construct
  misc_feature 1..20: note = CRISPR gRNA sequence
  source 1..20: mol_type = other DNA
aggtgattttagaataactt

SEQ ID NO: 76334 - DNA, 20 bp, synthetic construct
  misc_feature 1..20: note = CRISPR gRNA sequence
  source 1..20: mol_type = other DNA
tagaataacttatttgagtc

SEQ ID NO: 76335 - DNA, 20 bp, synthetic construct
  misc_feature 1..20: note = CRISPR gRNA sequence
  source 1..20: mol_type = other DNA
agaataacttatttgagtcc

SEQ ID NO: 76336 - DNA, 20 bp, synthetic construct
  misc_feature 1..20: note = CRISPR gRNA sequence
  source 1..20: mol_type = other DNA
gaataacttatttgagtccc

SEQ ID NO: 76337 - DNA, 20 bp, synthetic construct
  misc_feature 1..20: note = CRISPR gRNA sequence
  source 1..20: mol_type = other DNA
atttgagtcccaactctggg

SEQ ID NO: 76338 - DNA, 20 bp, synthetic construct
  misc_feature 1..20: note = CRISPR gRNA sequence
  source 1..20: mol_type = other DNA
tttgagtcccaactctgggg

SEQ ID NO: 76339 - DNA, 20 bp, synthetic construct
  misc_feature 1..20: note = CRISPR gRNA sequence
  source 1..20: mol_type = other DNA
gagtcccaactctgggggaa

SEQ ID NO: 76340 - DNA, 20 bp, synthetic construct
  misc_feature 1..20: note = CRISPR gRNA sequence
  source 1..20: mol_type = other DNA
agtcccaactctgggggaat

SEQ ID NO: 76341 - DNA, 20 bp, synthetic construct
  misc_feature 1..20: note = CRISPR gRNA sequence
  source 1..20: mol_type = other DNA
tgggggaatgggcggggaat

SEQ ID NO: 76342 - DNA, 20 bp, synthetic construct
  misc_feature 1..20: note = CRISPR gRNA sequence
  source 1..20: mol_type = other DNA
ggggaatgggcggggaatat

SEQ ID NO: 76343 - DNA, 20 bp, synthetic construct
  misc_feature 1..20: note = CRISPR gRNA sequence
  source 1..20: mol_type = other DNA
atcccatttgtcagatgagg

SEQ ID NO: 76344 - DNA, 20 bp, synthetic construct
  misc_feature 1..20: note = CRISPR gRNA sequence
  source 1..20: mol_type = other DNA
gtcagatgaggaaactgaga

SEQ ID NO: 76345 - DNA, 20 bp, synthetic construct
  misc_feature 1..20: note = CRISPR gRNA sequence
  source 1..20: mol_type = other DNA
tcagatgaggaaactgagac

SEQ ID NO: 76346 - DNA, 20 bp, synthetic construct
  misc_feature 1..20: note = CRISPR gRNA sequence
  source 1..20: mol_type = other DNA
agacgcagaggaggcaaacg

SEQ ID NO: 76347 - DNA, 20 bp, synthetic construct
  misc_feature 1..20: note = CRISPR gRNA sequence
  source 1..20: mol_type = other DNA
aggttgacaaagtattaggg

SEQ ID NO: 76348 - DNA, 20 bp, synthetic construct
  misc_feature 1..20: note = CRISPR gRNA sequence
  source 1..20: mol_type = other DNA
acaaagtattagggtggagc

SEQ ID NO: 76349 - DNA, 20 bp, synthetic construct
  misc_feature 1..20: note = CRISPR gRNA sequence
  source 1..20: mol_type = other DNA
gggtggagctggaagcagat

SEQ ID NO: 76350 - DNA, 20 bp, synthetic construct
  misc_feature 1..20: note = CRISPR gRNA sequence
  source 1..20: mol_type = other DNA
gaagcagattggagtcccca

SEQ ID NO: 76351 - DNA, 20 bp, synthetic construct
  misc_feature 1..20: note = CRISPR gRNA sequence
  source 1..20: mol_type = other DNA
gagtccccagttgtgccagg

SEQ ID NO: 76352 - DNA, 20 bp, synthetic construct
  misc_feature 1..20: note = CRISPR gRNA sequence
  source 1..20: mol_type = other DNA
tgccaggtaaaatgataaaa

SEQ ID NO: 76353 - DNA, 20 bp, synthetic construct
  misc_feature 1..20: note = CRISPR gRNA sequence
  source 1..20: mol_type = other DNA
aggaaagaatggagcgggta

SEQ ID NO: 76354 - DNA, 20 bp, synthetic construct
  misc_feature 1..20: note = CRISPR gRNA sequence
  source 1..20: mol_type = other DNA
gagggggtaaaggcgggggg

SEQ ID NO: 76355 - DNA, 20 bp, synthetic construct
  misc_feature 1..20: note = CRISPR gRNA sequence
  source 1..20: mol_type = other DNA
aggggttagagggcaggtac

SEQ ID NO: 76356 - DNA, 20 bp, synthetic construct
  misc_feature 1..20: note = CRISPR gRNA sequence
  source 1..20: mol_type = other DNA
gagggcaggtacagctttgc

SEQ ID NO: 76357 - DNA, 20 bp, synthetic construct
  misc_feature 1..20: note = CRISPR gRNA sequence
  source 1..20: mol_type = other DNA
tgccatggaggagccttaga

SEQ ID NO: 76358 - DNA, 20 bp, synthetic construct
  misc_feature 1..20: note = CRISPR gRNA sequence
  source 1..20: mol_type = other DNA
gccatggaggagccttagaa

SEQ ID NO: 76359 - DNA, 20 bp, synthetic construct
  misc_feature 1..20: note = CRISPR gRNA sequence
  source 1..20: mol_type = other DNA
ccatggaggagccttagaaa

SEQ ID NO: 76360 - DNA, 20 bp, synthetic construct
  misc_feature 1..20: note = CRISPR gRNA sequence
  source 1..20: mol_type = other DNA
agaaacacgagcacaaggaa

SEQ ID NO: 76361 - DNA, 20 bp, synthetic construct
  misc_feature 1..20: note = CRISPR gRNA sequence
  source 1..20: mol_type = other DNA
gaaacacgagcacaaggaac

SEQ ID NO: 76362 - DNA, 20 bp, synthetic construct
  misc_feature 1..20: note = CRISPR gRNA sequence
  source 1..20: mol_type = other DNA
tcgtcttactgcagcaggct

SEQ ID NO: 76363 - DNA, 20 bp, synthetic construct
  misc_feature 1..20: note = CRISPR gRNA sequence
  source 1..20: mol_type = other DNA
gtcttactgcagcaggctca

SEQ ID NO: 76364 - DNA, 20 bp, synthetic construct
  misc_feature 1..20: note = CRISPR gRNA sequence
  source 1..20: mol_type = other DNA
actgcagcaggctcagctga

SEQ ID NO: 76365 - DNA, 20 bp, synthetic construct
  misc_feature 1..20: note = CRISPR gRNA sequence
  source 1..20: mol_type = other DNA
ctgcagcaggctcagctgag

SEQ ID NO: 76366 - DNA, 20 bp, synthetic construct
  misc_feature 1..20: note = CRISPR gRNA sequence
  source 1..20: mol_type = other DNA
cagcaggctcagctgaggga

SEQ ID NO: 76367 - DNA, 20 bp, synthetic construct
  misc_feature 1..20: note = CRISPR gRNA sequence
  source 1..20: mol_type = other DNA
agctgagggagttgaggtaa

SEQ ID NO: 76368 - DNA, 20 bp, synthetic construct
  misc_feature 1..20: note = CRISPR gRNA sequence
  source 1..20: mol_type = other DNA
agggagttgaggtaagcagt

SEQ ID NO: 76369 - DNA, 20 bp, synthetic construct
  misc_feature 1..20: note = CRISPR gRNA sequence
  source 1..20: mol_type = other DNA
aggtaagcagtccagtagag

SEQ ID NO: 76370 - DNA, 20 bp, synthetic construct
  misc_feature 1..20: note = CRISPR gRNA sequence
  source 1..20: mol_type = other DNA
caggctctggtcactcagga

SEQ ID NO: 76371 - DNA, 20 bp, synthetic construct
  misc_feature 1..20: note = CRISPR gRNA sequence
  source 1..20: mol_type = other DNA
tggtcactcaggaactcaca

SEQ ID NO: 76372 - DNA, 20 bp, synthetic construct
  misc_feature 1..20: note = CRISPR gRNA sequence
  source 1..20: mol_type = other DNA
gtcactcaggaactcacagg

SEQ ID NO: 76373 - DNA, 20 bp, synthetic construct
  misc_feature 1..20: note = CRISPR gRNA sequence
  source 1..20: mol_type = other DNA
aggaactcacaggacaatct

SEQ ID NO: 76374 - DNA, 20 bp, synthetic construct
  misc_feature 1..20: note = CRISPR gRNA sequence
  source 1..20: mol_type = other DNA
acaggacaatctgtgaaaca

SEQ ID NO: 76375 - DNA, 20 bp, synthetic construct
  misc_feature 1..20: note = CRISPR gRNA sequence
  source 1..20: mol_type = other DNA
tgaaacaaagcaggtggatg

SEQ ID NO: 76376 - DNA, 20 bp, synthetic construct
  misc_feature 1..20: note = CRISPR gRNA sequence
  source 1..20: mol_type = other DNA
ccaggaaagcagggagcacg

SEQ ID NO: 76377 - DNA, 20 bp, synthetic construct
  misc_feature 1..20: note = CRISPR gRNA sequence
  source 1..20: mol_type = other DNA
caggaaagcagggagcacgg

SEQ ID NO: 76378 - DNA, 20 bp, synthetic construct
  misc_feature 1..20: note = CRISPR gRNA sequence
  source 1..20: mol_type = other DNA
atagccagagccttctggag

SEQ ID NO: 76379 - DNA, 20 bp, synthetic construct
  misc_feature 1..20: note = CRISPR gRNA sequence
  source 1..20: mol_type = other DNA
ctggagatgggacctaacca

SEQ ID NO: 76380 - DNA, 20 bp, synthetic construct
  misc_feature 1..20: note = CRISPR gRNA sequence
  source 1..20: mol_type = other DNA
tggagatgggacctaaccag

SEQ ID NO: 76381 - DNA, 20 bp, synthetic construct
  misc_feature 1..20: note = CRISPR gRNA sequence
  source 1..20: mol_type = other DNA
gagatgggacctaaccaggg

SEQ ID NO: 76382 - DNA, 20 bp, synthetic construct
  misc_feature 1..20: note = CRISPR gRNA sequence
  source 1..20: mol_type = other DNA
accagggtcacctgaaacat

SEQ ID NO: 76383 - DNA, 20 bp, synthetic construct
  misc_feature 1..20: note = CRISPR gRNA sequence
  source 1..20: mol_type = other DNA
aaacattccctcccagcact

SEQ ID NO: 76384 - DNA, 20 bp, synthetic construct
  misc_feature 1..20: note = CRISPR gRNA sequence
  source 1..20: mol_type = other DNA
cctcccagcactgggtccat

SEQ ID NO: 76385 - DNA, 20 bp, synthetic construct
  misc_feature 1..20: note = CRISPR gRNA sequence
  source 1..20: mol_type = other DNA
ccagcactgggtccatgggt

SEQ ID NO: 76386 - DNA, 20 bp, synthetic construct
  misc_feature 1..20: note = CRISPR gRNA sequence
  source 1..20: mol_type = other DNA
ggtccatgggttatccgtga

SEQ ID NO: 76387 - DNA, 20 bp, synthetic construct
  misc_feature 1..20: note = CRISPR gRNA sequence
  source 1..20: mol_type = other DNA
tccgtgaggctggaagaaga

SEQ ID NO: 76388 - DNA, 20 bp, synthetic construct
  misc_feature 1..20: note = CRISPR gRNA sequence
  source 1..20: mol_type = other DNA
gaagaagaggaaggtctttt

SEQ ID NO: 76389 - DNA, 20 bp, synthetic construct
  misc_feature 1..20: note = CRISPR gRNA sequence
  source 1..20: mol_type = other DNA
ttaagtttgggaaatacggg

SEQ ID NO: 76390 - DNA, 20 bp, synthetic construct
  misc_feature 1..20: note = CRISPR gRNA sequence
  source 1..20: mol_type = other DNA
taagtttgggaaatacgggg

SEQ ID NO: 76391 - DNA, 20 bp, synthetic construct
  misc_feature 1..20: note = CRISPR gRNA sequence
  source 1..20: mol_type = other DNA
aagtttgggaaatacggggt

SEQ ID NO: 76392 - DNA, 20 bp, synthetic construct
  misc_feature 1..20: note = CRISPR gRNA sequence
  source 1..20: mol_type = other DNA
agtttgggaaatacggggtt

SEQ ID NO: 76393 - DNA, 20 bp, synthetic construct
  misc_feature 1..20: note = CRISPR gRNA sequence
  source 1..20: mol_type = other DNA
gggaaatacggggttaagcc

SEQ ID NO: 76394 - DNA, 20 bp, synthetic construct
  misc_feature 1..20: note = CRISPR gRNA sequence
  source 1..20: mol_type = other DNA
ggaaatacggggttaagcca

SEQ ID NO: 76395 - DNA, 20 bp, synthetic construct
  misc_feature 1..20: note = CRISPR gRNA sequence
  source 1..20: mol_type = other DNA
agccaaattaaatggttttg

SEQ ID NO: 76396 - DNA, 20 bp, synthetic construct
  misc_feature 1..20: note = CRISPR gRNA sequence
  source 1..20: mol_type = other DNA
aatggttttgtttgctgcag

SEQ ID NO: 76397 - DNA, 20 bp, synthetic construct
  misc_feature 1..20: note = CRISPR gRNA sequence
  source 1..20: mol_type = other DNA
tgtttgctgcagggcttctc

SEQ ID NO: 76398 - DNA, 20 bp, synthetic construct
  misc_feature 1..20: note = CRISPR gRNA sequence
  source 1..20: mol_type = other DNA
gtttgctgcagggcttctct

SEQ ID NO: 76399 - DNA, 20 bp, synthetic construct
  misc_feature 1..20: note = CRISPR gRNA sequence
  source 1..20: mol_type = other DNA
tttgctgcagggcttctctg

SEQ ID NO: 76400 - DNA, 20 bp, synthetic construct
  misc_feature 1..20: note = CRISPR gRNA sequence
  source 1..20: mol_type = other DNA
gctgcagggcttctctgagg

SEQ ID NO: 76401 - DNA, 20 bp, synthetic construct
  misc_feature 1..20: note = CRISPR gRNA sequence
  source 1..20: mol_type = other DNA
ctgcagggcttctctgaggc

SEQ ID NO: 76402 - DNA, 20 bp, synthetic construct
  misc_feature 1..20: note = CRISPR gRNA sequence
  source 1..20: mol_type = other DNA
cagggcttctctgaggctgc

SEQ ID NO: 76403 - DNA, 20 bp, synthetic construct
  misc_feature 1..20: note = CRISPR gRNA sequence
  source 1..20: mol_type = other DNA
ctctgaggctgcgataggct

SEQ ID NO: 76404 - DNA, 20 bp, synthetic construct
  misc_feature 1..20: note = CRISPR gRNA sequence
  source 1..20: mol_type = other DNA
tctgaggctgcgataggctg

SEQ ID NO: 76405 - DNA, 20 bp, synthetic construct
  misc_feature 1..20: note = CRISPR gRNA sequence
  source 1..20: mol_type = other DNA
tgaggctgcgataggctgct

SEQ ID NO: 76406 - DNA, 20 bp, synthetic construct
  misc_feature 1..20: note = CRISPR gRNA sequence
  source 1..20: mol_type = other DNA
aggctgcgataggctgctgt

SEQ ID NO: 76407 - DNA, 20 bp, synthetic construct
  misc_feature 1..20: note = CRISPR gRNA sequence
  source 1..20: mol_type = other DNA
cgataggctgctgtgcatta

SEQ ID NO: 76408 - DNA, 20 bp, synthetic construct
  misc_feature 1..20: note = CRISPR gRNA sequence
  source 1..20: mol_type = other DNA
ctgtgcattatgaatttcca

SEQ ID NO: 76409 - DNA, 20 bp, synthetic construct
  misc_feature 1..20: note = CRISPR gRNA sequence
  source 1..20: mol_type = other DNA
tgcattatgaatttccaagg

SEQ ID NO: 76410 - DNA, 20 bp, synthetic construct
  misc_feature 1..20: note = CRISPR gRNA sequence
  source 1..20: mol_type = other DNA
tgaatttccaaggagctaca

SEQ ID NO: 76411 - DNA, 20 bp, synthetic construct
  misc_feature 1..20: note = CRISPR gRNA sequence
  source 1..20: mol_type = other DNA
ccaaggagctacagcagact

SEQ ID NO: 76412 - DNA, 20 bp, synthetic construct
  misc_feature 1..20: note = CRISPR gRNA sequence
  source 1..20: mol_type = other DNA
caaggagctacagcagactt

SEQ ID NO: 76413 - DNA, 20 bp, synthetic construct
  misc_feature 1..20: note = CRISPR gRNA sequence
  source 1..20: mol_type = other DNA
cagcagacttttccccaaac

SEQ ID NO: 76414 - DNA, 20 bp, synthetic construct
  misc_feature 1..20: note = CRISPR gRNA sequence
  source 1..20: mol_type = other DNA
ttccccaaactaaatggact

SEQ ID NO: 76415 - DNA, 20 bp, synthetic construct
  misc_feature 1..20: note = CRISPR gRNA sequence
  source 1..20: mol_type = other DNA
tccccaaactaaatggacta

SEQ ID NO: 76416 - DNA, 20 bp, synthetic construct
  misc_feature 1..20: note = CRISPR gRNA sequence
  source 1..20: mol_type = other DNA
ccccaaactaaatggactag

SEQ ID NO: 76417 - DNA, 20 bp, synthetic construct
  misc_feature 1..20: note = CRISPR gRNA sequence
  source 1..20: mol_type = other DNA
cccaaactaaatggactagc

SEQ ID NO: 76418 - DNA, 20 bp, synthetic construct
  misc_feature 1..20: note = CRISPR gRNA sequence
  source 1..20: mol_type = other DNA
aatggactagcagaattaat

SEQ ID NO: 76419 - DNA, 20 bp, synthetic construct
  misc_feature 1..20: note = CRISPR gRNA sequence
  source 1..20: mol_type = other DNA
gcagaattaatttttaaggg

SEQ ID NO: 76420 - DNA, 20 bp, synthetic construct
  misc_feature 1..20: note = CRISPR gRNA sequence
  source 1..20: mol_type = other DNA
atttttaagggccatgaagg

SEQ ID NO: 76421 - DNA, 20 bp, synthetic construct
  misc_feature 1..20: note = CRISPR gRNA sequence
  source 1..20: mol_type = other DNA
ttaagggccatgaaggttag

SEQ ID NO: 76422 - DNA, 20 bp, synthetic construct
  misc_feature 1..20: note = CRISPR gRNA sequence
  source 1..20: mol_type = other DNA
taagggccatgaaggttagt

SEQ ID NO: 76423 - DNA, 20 bp, synthetic construct
  misc_feature 1..20: note = CRISPR gRNA sequence
  source 1..20: mol_type = other DNA
aagggccatgaaggttagtg

SEQ ID NO: 76424 - DNA, 20 bp, synthetic construct
  misc_feature 1..20: note = CRISPR gRNA sequence
  source 1..20: mol_type = other DNA
agggccatgaaggttagtgt

SEQ ID NO: 76425 - DNA, 20 bp, synthetic construct
  misc_feature 1..20: note = CRISPR gRNA sequence
  source 1..20: mol_type = other DNA
gtgttccgcaaaacatgttt

SEQ ID NO: 76426 - DNA, 20 bp, synthetic construct
  misc_feature 1..20: note = CRISPR gRNA sequence
  source 1..20: mol_type = other DNA
cgcaaaacatgtttgttaag

SEQ ID NO: 76427 - DNA, 20 bp, synthetic construct
  misc_feature 1..20: note = CRISPR gRNA sequence
  source 1..20: mol_type = other DNA
gttaagaaaagaatgcagct

SEQ ID NO: 76428 - DNA, 20 bp, synthetic construct
  misc_feature 1..20: note = CRISPR gRNA sequence
  source 1..20: mol_type = other DNA
ttaagaaaagaatgcagctg

SEQ ID NO: 76429 - DNA, 20 bp, synthetic construct
  misc_feature 1..20: note = CRISPR gRNA sequence
  source 1..20: mol_type = other DNA
agaaaagaatgcagctgggc

SEQ ID NO: 76430 - DNA, 20 bp, synthetic construct
  misc_feature 1..20: note = CRISPR gRNA sequence
  source 1..20: mol_type = other DNA
ggcatggtggctcatgcctg

SEQ ID NO: 76431 - DNA, 20 bp, synthetic construct
  misc_feature 1..20: note = CRISPR gRNA sequence
  source 1..20: mol_type = other DNA
atgcctgtaatcgcagcact

SEQ ID NO: 76432 - DNA, 20 bp, synthetic construct
  misc_feature 1..20: note = CRISPR gRNA sequence
  source 1..20: mol_type = other DNA
taatcgcagcactttgggag

SEQ ID NO: 76433 - DNA, 20 bp, synthetic construct
  misc_feature 1..20: note = CRISPR gRNA sequence
  source 1..20: mol_type = other DNA
tgggaggctgaggtgggtgg

SEQ ID NO: 76434 - DNA, 20 bp, synthetic construct
  misc_feature 1..20: note = CRISPR gRNA sequence
  source 1..20: mol_type = other DNA
gggaggctgaggtgggtgga

SEQ ID NO: 76435 - DNA, 20 bp, synthetic construct
  misc_feature 1..20: note = CRISPR gRNA sequence
  source 1..20: mol_type = other DNA
ggaggctgaggtgggtggat

SEQ ID NO: 76436 - DNA, 20 bp, synthetic construct
  misc_feature 1..20: note = CRISPR gRNA sequence
  source 1..20: mol_type = other DNA
aggtgggtggatcatctgag

SEQ ID NO: 76437 - DNA, 20 bp, synthetic construct
  misc_feature 1..20: note = CRISPR gRNA sequence
  source 1..20: mol_type = other DNA
aggtcaggagtctgggacca

SEQ ID NO: 76438 - DNA, 20 bp, synthetic construct
  misc_feature 1..20: note = CRISPR gRNA sequence
  source 1..20: mol_type = other DNA
ggaccagcctgggcaacatg

SEQ ID NO: 76439 - DNA, 20 bp, synthetic construct
  misc_feature 1..20: note = CRISPR gRNA sequence
  source 1..20: mol_type = other DNA
ggcaacatggtgaaattcca

SEQ ID NO: 76440 - DNA, 20 bp, synthetic construct
  misc_feature 1..20: note = CRISPR gRNA sequence
  source 1..20: mol_type = other DNA
cacctctactacaaaaaacg

SEQ ID NO: 76441 - DNA, 20 bp, synthetic construct
  misc_feature 1..20: note = CRISPR gRNA sequence
  source 1..20: mol_type = other DNA
tactacaaaaaacgaaaaaa

SEQ ID NO: 76442 - DNA, 20 bp, synthetic construct
  misc_feature 1..20: note = CRISPR gRNA sequence
  source 1..20: mol_type = other DNA
ctacaaaaaacgaaaaaaaa

SEQ ID NO: 76443 - DNA, 20 bp, synthetic construct
  misc_feature 1..20: note = CRISPR gRNA sequence
  source 1..20: mol_type = other DNA
caaaaaacgaaaaaaaaatt

SEQ ID NO: 76444 - DNA, 20 bp, synthetic construct
  misc_feature 1..20: note = CRISPR gRNA sequence
  source 1..20: mol_type = other DNA
gccaggcgtggtggtgcaca

SEQ ID NO: 76445 - DNA, 20 bp, synthetic construct
  misc_feature 1..20: note = CRISPR gRNA sequence
  source 1..20: mol_type = other DNA
tagtaatagctactcaggag

SEQ ID NO: 76446 - DNA, 20 bp, synthetic construct
  misc_feature 1..20: note = CRISPR gRNA sequence
  source 1..20: mol_type = other DNA
ctcaggaggctgaggcatgg

SEQ ID NO: 76447 - DNA, 20 bp, synthetic construct
  misc_feature 1..20: note = CRISPR gRNA sequence
  source 1..20: mol_type = other DNA
aggaggctgaggcatgggaa

SEQ ID NO: 76448 - DNA, 20 bp, synthetic construct
  misc_feature 1..20: note = CRISPR gRNA sequence
  source 1..20: mol_type = other DNA
aggcatgggaatcacttgaa

SEQ ID NO: 76449 - DNA, 20 bp, synthetic construct
  misc_feature 1..20: note = CRISPR gRNA sequence
  source 1..20: mol_type = other DNA
gaacctgggaggcagaggtt

SEQ ID NO: 76450 - DNA, 20 bp, synthetic construct
  misc_feature 1..20: note = CRISPR gRNA sequence
  source 1..20: mol_type = other DNA
aacctgggaggcagaggttg

SEQ ID NO: 76451 - DNA, 20 bp, synthetic construct
  misc_feature 1..20: note = CRISPR gRNA sequence
  source 1..20: mol_type = other DNA
ggaggcagaggttgcagtga

SEQ ID NO: 76452 - DNA, 20 bp, synthetic construct
  misc_feature 1..20: note = CRISPR gRNA sequence
  source 1..20: mol_type = other DNA
cagtgagccaagatcgtacc

SEQ ID NO: 76453 - DNA, 20 bp, synthetic construct
  misc_feature 1..20: note = CRISPR gRNA sequence
  source 1..20: mol_type = other DNA
cactccagcctgggtgacag

SEQ ID NO: 76454 - DNA, 20 bp, synthetic construct
  misc_feature 1..20: note = CRISPR gRNA sequence
  source 1..20: mol_type = other DNA
cagcctgggtgacagagcga

SEQ ID NO: 76455 - DNA, 20 bp, synthetic construct
  misc_feature 1..20: note = CRISPR gRNA sequence
  source 1..20: mol_type = other DNA
ggtgacagagcgagtctcta

SEQ ID NO: 76456 - DNA, 20 bp, synthetic construct
  misc_feature 1..20: note = CRISPR gRNA sequence
  source 1..20: mol_type = other DNA
tatctcaaaaaaataaaaaa

SEQ ID NO: 76457 - DNA, 20 bp, synthetic construct
  misc_feature 1..20: note = CRISPR gRNA sequence
  source 1..20: mol_type = other DNA
tctcaaaaaaataaaaaaga

SEQ ID NO: 76458 - DNA, 20 bp, synthetic construct
  misc_feature 1..20: note = CRISPR gRNA sequence
  source 1..20: mol_type = other DNA
aaaaaaataaaaaagaaaag

SEQ ID NO: 76459 - DNA, 20 bp, synthetic construct
  misc_feature 1..20: note = CRISPR gRNA sequence
  source 1..20: mol_type = other DNA
ccttaacccagaggagtgga

SEQ ID NO: 76460 - DNA, 20 bp, synthetic construct
  misc_feature 1..20: note = CRISPR gRNA sequence
  source 1..20: mol_type = other DNA
aacccagaggagtggatatg

SEQ ID NO: 76461 - DNA, 20 bp, synthetic construct
  misc_feature 1..20: note = CRISPR gRNA sequence
  source 1..20: mol_type = other DNA
acccagaggagtggatatga

SEQ ID NO: 76462 - DNA, 20 bp, synthetic construct
  misc_feature 1..20: note = CRISPR gRNA sequence
  source 1..20: mol_type = other DNA
agcatacaacaggtcagcga

SEQ ID NO: 76463 - DNA, 20 bp, synthetic construct
  misc_feature 1..20: note = CRISPR gRNA sequence
  source 1..20: mol_type = other DNA
gcttgggtctctagttgccc

SEQ ID NO: 76464 - DNA, 20 bp, synthetic construct
  misc_feature 1..20: note = CRISPR gRNA sequence
  source 1..20: mol_type = other DNA
gggtctctagttgcccatta

SEQ ID NO: 76465 - DNA, 20 bp, synthetic construct
  misc_feature 1..20: note = CRISPR gRNA sequence
  source 1..20: mol_type = other DNA
ggtctctagttgcccattaa

SEQ ID NO: 76466 - DNA, 20 bp, synthetic construct
  misc_feature 1..20: note = CRISPR gRNA sequence
  source 1..20: mol_type = other DNA
tagttgcccattaacaccag

SEQ ID NO: 76467 - DNA, 20 bp, synthetic construct
  misc_feature 1..20: note = CRISPR gRNA sequence
  source 1..20: mol_type = other DNA
gttgcccattaacaccagac

SEQ ID NO: 76468 - DNA, 20 bp, synthetic construct
  misc_feature 1..20: note = CRISPR gRNA sequence
  source 1..20: mol_type = other DNA
cccattaacaccagaccaac

SEQ ID NO: 76469 - DNA, 20 bp, synthetic construct
  misc_feature 1..20: note = CRISPR gRNA sequence
  source 1..20: mol_type = other DNA
acaccagaccaaccagctca

SEQ ID NO: 76470 - DNA, 20 bp, synthetic construct
  misc_feature 1..20: note = CRISPR gRNA sequence
  source 1..20: mol_type = other DNA
atcattgttcagataattcg

SEQ ID NO: 76471 - DNA, 20 bp, synthetic construct
  misc_feature 1..20: note = CRISPR gRNA sequence
  source 1..20: mol_type = other DNA
ttcagataattcgtcagaac

SEQ ID NO: 76472 - DNA, 20 bp, synthetic construct
  misc_feature 1..20: note = CRISPR gRNA sequence
  source 1..20: mol_type = other DNA
agataattcgtcagaaccca

SEQ ID NO: 76473 - DNA, 20 bp, synthetic construct
  misc_feature 1..20: note = CRISPR gRNA sequence
  source 1..20: mol_type = other DNA
gtcagaacccagtgcattta

SEQ ID NO: 76474 - DNA, 20 bp, synthetic construct
  misc_feature 1..20: note = CRISPR gRNA sequence
  source 1..20: mol_type = other DNA
aggagaaactccagatacct

SEQ ID NO: 76475 - DNA, 20 bp, synthetic construct
  misc_feature 1..20: note = CRISPR gRNA sequence
  source 1..20: mol_type = other DNA
ggagaaactccagatacctg

SEQ ID NO: 76476 - DNA, 20 bp, synthetic construct
  misc_feature 1..20: note = CRISPR gRNA sequence
  source 1..20: mol_type = other DNA
cagatacctgccttgctgtc

SEQ ID NO: 76477 - DNA, 20 bp, synthetic construct
  misc_feature 1..20: note = CRISPR gRNA sequence
  source 1..20: mol_type = other DNA
ccttgctgtctctgctctag

SEQ ID NO: 76478 - DNA, 20 bp, synthetic construct
  misc_feature 1..20: note = CRISPR gRNA sequence
  source 1..20: mol_type = other DNA
gctgtctctgctctagatgg

SEQ ID NO: 76479 - DNA, 20 bp, synthetic construct
  misc_feature 1..20: note = CRISPR gRNA sequence
  source 1..20: mol_type = other DNA
ctgtctctgctctagatgga

SEQ ID NO: 76480 - DNA, 20 bp, synthetic construct
  misc_feature 1..20: note = CRISPR gRNA sequence
  source 1..20: mol_type = other DNA
tctctgctctagatggagga

SEQ ID NO: 76481 - DNA, 20 bp, synthetic construct
  misc_feature 1..20: note = CRISPR gRNA sequence
  source 1..20: mol_type = other DNA
tgctctagatggaggaccag

SEQ ID NO: 76482 - DNA, 20 bp, synthetic construct
  misc_feature 1..20: note = CRISPR gRNA sequence
  source 1..20: mol_type = other DNA
ctctagatggaggaccagga

SEQ ID NO: 76483 - DNA, 20 bp, synthetic construct
  misc_feature 1..20: note = CRISPR gRNA sequence
  source 1..20: mol_type = other DNA
tagatggaggaccaggacaa

SEQ ID NO: 76484 - DNA, 20 bp, synthetic construct
  misc_feature 1..20: note = CRISPR gRNA sequence
  source 1..20: mol_type = other DNA
gatggaggaccaggacaact

SEQ ID NO: 76485 - DNA, 20 bp, synthetic construct
  misc_feature 1..20: note = CRISPR gRNA sequence
  source 1..20: mol_type = other DNA
aagacactgagttccctggg

SEQ ID NO: 76486 - DNA, 20 bp, synthetic construct
  misc_feature 1..20: note = CRISPR gRNA sequence
  source 1..20: mol_type = other DNA
agttccctggggtttaccta

SEQ ID NO: 76487 - DNA, 20 bp, synthetic construct
  misc_feature 1..20: note = CRISPR gRNA sequence
  source 1..20: mol_type = other DNA
cctggggtttacctacagcc

SEQ ID NO: 76488 - DNA, 20 bp, synthetic construct
  misc_feature 1..20: note = CRISPR gRNA sequence
  source 1..20: mol_type = other DNA
gggtttacctacagcccctt

SEQ ID NO: 76489 - DNA, 20 bp, synthetic construct
  misc_feature 1..20: note = CRISPR gRNA sequence
  source 1..20: mol_type = other DNA
acctacagccccttcctggg

SEQ ID NO: 76490 - DNA, 20 bp, synthetic construct
  misc_feature 1..20: note = CRISPR gRNA sequence
  source 1..20: mol_type = other DNA
cctacagccccttcctgggg

SEQ ID NO: 76491 - DNA, 20 bp, synthetic construct
  misc_feature 1..20: note = CRISPR gRNA sequence
  source 1..20: mol_type = other DNA
cagccccttcctggggggcc

SEQ ID NO: 76492 - DNA, 20 bp, synthetic construct
  misc_feature 1..20: note = CRISPR gRNA sequence
  source 1..20: mol_type = other DNA
cctggggggcctggagccac

SEQ ID NO: 76493 - DNA, 20 bp, synthetic construct
  misc_feature 1..20: note = CRISPR gRNA sequence
  source 1..20: mol_type = other DNA
ctggggggcctggagccact

SEQ ID NO: 76494 - DNA, 20 bp, synthetic construct
  misc_feature 1..20: note = CRISPR gRNA sequence
  source 1..20: mol_type = other DNA
gggggcctggagccacttcc

SEQ ID NO: 76495 - DNA, 20 bp, synthetic construct
  misc_feature 1..20: note = CRISPR gRNA sequence
  source 1..20: mol_type = other DNA
gagccacttcccaacccccg

SEQ ID NO: 76496 - DNA, 20 bp, synthetic construct
  misc_feature 1..20: note = CRISPR gRNA sequence
  source 1..20: mol_type = other DNA
cccaacccccgcagacctct

SEQ ID NO: 76497 - DNA, 20 bp, synthetic construct
  misc_feature 1..20: note = CRISPR gRNA sequence
  source 1..20: mol_type = other DNA
ccaacccccgcagacctcta

SEQ ID NO: 76498 - DNA, 20 bp, synthetic construct
  misc_feature 1..20: note = CRISPR gRNA sequence
  source 1..20: mol_type = other DNA
tactatgttctccttctgcc

SEQ ID NO: 76499 - DNA, 20 bp, synthetic construct
  misc_feature 1..20: note = CRISPR gRNA sequence
  source 1..20: mol_type = other DNA
ctatgttctccttctgcctt

SEQ ID NO: 76500 - DNA, 20 bp, synthetic construct
  misc_feature 1..20: note = CRISPR gRNA sequence
  source 1..20: mol_type = other DNA
tgttctccttctgccttctc

SEQ ID NO: 76501 - DNA, 20 bp, synthetic construct
  misc_feature 1..20: note = CRISPR gRNA sequence
  source 1..20: mol_type = other DNA
tccttctgccttctccacct

SEQ ID NO: 76502 - DNA, 20 bp, synthetic construct
  misc_feature 1..20: note = CRISPR gRNA sequence
  source 1..20: mol_type = other DNA
cttctgccttctccacctcc

SEQ ID NO: 76503 - DNA, 20 bp, synthetic construct
  misc_feature 1..20: note = CRISPR gRNA sequence
  source 1..20: mol_type = other DNA
ctgccttctccacctccccc

SEQ ID NO: 76504 - DNA, 20 bp, synthetic construct
  misc_feature 1..20: note = CRISPR gRNA sequence
  source 1..20: mol_type = other DNA
tgccttctccacctccccct

SEQ ID NO: 76505 - DNA, 20 bp, synthetic construct
  misc_feature 1..20: note = CRISPR gRNA sequence
  source 1..20: mol_type = other DNA
ccttctccacctcccccttc

SEQ ID NO: 76506 - DNA, 20 bp, synthetic construct
  misc_feature 1..20: note = CRISPR gRNA sequence
  source 1..20: mol_type = other DNA
ctccacctcccccttcctct

SEQ ID NO: 76507 - DNA, 20 bp, synthetic construct
  misc_feature 1..20: note = CRISPR gRNA sequence
  source 1..20: mol_type = other DNA
tccacctcccccttcctctc

SEQ ID NO: 76508 - DNA, 20 bp, synthetic construct
  misc_feature 1..20: note = CRISPR gRNA sequence
  source 1..20: mol_type = other DNA
cacctcccccttcctctctt

SEQ ID NO: 76509 - DNA, 20 bp, synthetic construct
  misc_feature 1..20: note = CRISPR gRNA sequence
  source 1..20: mol_type = other DNA
ccccttcctctctttctgtt

SEQ ID NO: 76510 - DNA, 20 bp, synthetic construct
  misc_feature 1..20: note = CRISPR gRNA sequence
  source 1..20: mol_type = other DNA
cctctctttctgttccttca

SEQ ID NO: 76511 - DNA, 20 bp, synthetic construct
  misc_feature 1..20: note = CRISPR gRNA sequence
  source 1..20: mol_type = other DNA
ctctctttctgttccttcat

SEQ ID NO: 76512 - DNA, 20 bp, synthetic construct
  misc_feature 1..20: note = CRISPR gRNA sequence
  source 1..20: mol_type = other DNA
tctttctgttccttcatcct

SEQ ID NO: 76513 - DNA, 20 bp, synthetic construct
  misc_feature 1..20: note = CRISPR gRNA sequence
  source 1..20: mol_type = other DNA
tttctgttccttcatcctct

SEQ ID NO: 76514 - DNA, 20 bp, synthetic construct
  misc_feature 1..20: note = CRISPR gRNA sequence
  source 1..20: mol_type = other DNA
tctgttccttcatcctctgc

SEQ ID NO: 76515 - DNA, 20 bp, synthetic construct
  misc_feature 1..20: note = CRISPR gRNA sequence
  source 1..20: mol_type = other DNA
ctgttccttcatcctctgca

SEQ ID NO: 76516 - DNA, 20 bp, synthetic construct
  misc_feature 1..20: note = CRISPR gRNA sequence
  source 1..20: mol_type = other DNA
tgttccttcatcctctgcag

SEQ ID NO: 76517 - DNA, 20 bp, synthetic construct
  misc_feature 1..20: note = CRISPR gRNA sequence
  source 1..20: mol_type = other DNA
ttccttcatcctctgcaggc

SEQ ID NO: 76518 - DNA, 20 bp, synthetic construct
  misc_feature 1..20: note = CRISPR gRNA sequence
  source 1..20: mol_type = other DNA
cttcatcctctgcaggctgc

SEQ ID NO: 76519 - DNA, 20 bp, synthetic construct
  misc_feature 1..20: note = CRISPR gRNA sequence
  source 1..20: mol_type = other DNA
catcctctgcaggctgccct

SEQ ID NO: 76520 - DNA, 20 bp, synthetic construct
  misc_feature 1..20: note = CRISPR gRNA sequence
  source 1..20: mol_type = other DNA
atcctctgcaggctgccctc

SEQ ID NO: 76521 - DNA, 20 bp, synthetic construct
  misc_feature 1..20: note = CRISPR gRNA sequence
  source 1..20: mol_type = other DNA
tgcaggctgccctctcccct

SEQ ID NO: 76522 - DNA, 20 bp, synthetic construct
  misc_feature 1..20: note = CRISPR gRNA sequence
  source 1..20: mol_type = other DNA
caggctgccctctcccctct

SEQ ID NO: 76523 - DNA, 20 bp, synthetic construct
  misc_feature 1..20: note = CRISPR gRNA sequence
  source 1..20: mol_type = other DNA
ccctctcccctctccggggc

SEQ ID NO: 76524 - DNA, 20 bp, synthetic construct
  misc_feature 1..20: note = CRISPR gRNA sequence
  source 1..20: mol_type = other DNA
tcccctctccggggcctcca

SEQ ID NO: 76525 - DNA, 20 bp, synthetic construct
  misc_feature 1..20: note = CRISPR gRNA sequence
  source 1..20: mol_type = other DNA
ccctctccggggcctccaag

SEQ ID NO: 76526 - DNA, 20 bp, synthetic construct
  misc_feature 1..20: note = CRISPR gRNA sequence
  source 1..20: mol_type = other DNA
tccggggcctccaagggcct

SEQ ID NO: 76527 - DNA, 20 bp, synthetic construct
  misc_feature 1..20: note = CRISPR gRNA sequence
  source 1..20: mol_type = other DNA
cggggcctccaagggcctgg

SEQ ID NO: 76528 - DNA, 20 bp, synthetic construct
  misc_feature 1..20: note = CRISPR gRNA sequence
  source 1..20: mol_type = other DNA
caagggcctggcccatctct

SEQ ID NO: 76529 - DNA, 20 bp, synthetic construct
  misc_feature 1..20: note = CRISPR gRNA sequence
  source 1..20: mol_type = other DNA
gcccatctctgctgctttct

SEQ ID NO: 76530 - DNA, 20 bp, synthetic construct
  misc_feature 1..20: note = CRISPR gRNA sequence
  source 1..20: mol_type = other DNA
tgctgctttctcctctggct

SEQ ID NO: 76531 - DNA, 20 bp, synthetic construct
  misc_feature 1..20: note = CRISPR gRNA sequence
  source 1..20: mol_type = other DNA
ctgctttctcctctggctgt

SEQ ID NO: 76532 - DNA, 20 bp, synthetic construct
  misc_feature 1..20: note = CRISPR gRNA sequence
  source 1..20: mol_type = other DNA
ctttctcctctggctgtttg

SEQ ID NO: 76533 - DNA, 20 bp, synthetic construct
  misc_feature 1..20: note = CRISPR gRNA sequence
  source 1..20: mol_type = other DNA
tctcctctggctgtttggag

SEQ ID NO: 76534 - DNA, 20 bp, synthetic construct
  misc_feature 1..20: note = CRISPR gRNA sequence
  source 1..20: mol_type = other DNA
ctcctctggctgtttggagg

SEQ ID NO: 76535 - DNA, 20 bp, synthetic construct
  misc_feature 1..20: note = CRISPR gRNA sequence
  source 1..20: mol_type = other DNA
tcctctggctgtttggaggg

SEQ ID NO: 76536 - DNA, 20 bp, synthetic construct
  misc_feature 1..20: note = CRISPR gRNA sequence
  source 1..20: mol_type = other DNA
ctctggctgtttggagggga

SEQ ID NO: 76537 - DNA, 20 bp, synthetic construct
  misc_feature 1..20: note = CRISPR gRNA sequence
  source 1..20: mol_type = other DNA
tggctgtttggaggggaggc

SEQ ID NO: 76538 - DNA, 20 bp, synthetic construct
  misc_feature 1..20: note = CRISPR gRNA sequence
  source 1..20: mol_type = other DNA
gctgtttggaggggaggcat

SEQ ID NO: 76539 - DNA, 20 bp, synthetic construct
  misc_feature 1..20: note = CRISPR gRNA sequence
  source 1..20: mol_type = other DNA
tttggaggggaggcatggag

SEQ ID NO: 76540 - DNA, 20 bp, synthetic construct
  misc_feature 1..20: note = CRISPR gRNA sequence
  source 1..20: mol_type = other DNA
ggaggggaggcatggagtac

SEQ ID NO: 76541 - DNA, 20 bp, synthetic construct
  misc_feature 1..20: note = CRISPR gRNA sequence
  source 1..20: mol_type = other DNA
gaggggaggcatggagtaca

SEQ ID NO: 76542 - DNA, 20 bp, synthetic construct
  misc_feature 1..20: note = CRISPR gRNA sequence
  source 1..20: mol_type = other DNA
catcaactggctcagtgagc

SEQ ID NO: 76543 - DNA, 20 bp, synthetic construct
  misc_feature 1..20: note = CRISPR gRNA sequence
  source 1..20: mol_type = other DNA
gctcagtgagctggggggca

SEQ ID NO: 76544 - DNA, 20 bp, synthetic construct
  misc_feature 1..20: note = CRISPR gRNA sequence
  source 1..20: mol_type = other DNA
agtgagctggggggcagggt

SEQ ID NO: 76545 - DNA, 20 bp, synthetic construct
  misc_feature 1..20: note = CRISPR gRNA sequence
  source 1..20: mol_type = other DNA
gggggcagggtagggcggga

SEQ ID NO: 76546 - DNA, 20 bp, synthetic construct
  misc_feature 1..20: note = CRISPR gRNA sequence
  source 1..20: mol_type = other DNA
atgttggagcctctgccagg

SEQ ID NO: 76547 - DNA, 20 bp, synthetic construct
  misc_feature 1..20: note = CRISPR gRNA sequence
  source 1..20: mol_type = other DNA
gagcctctgccagggcccag

SEQ ID NO: 76548 - DNA, 20 bp, synthetic construct
  misc_feature 1..20: note = CRISPR gRNA sequence
  source 1..20: mol_type = other DNA
tgccagggcccaggctggag

SEQ ID NO: 76549 - DNA, 20 bp, synthetic construct
  misc_feature 1..20: note = CRISPR gRNA sequence
  source 1..20: mol_type = other DNA
ccagggcccaggctggaggc

SEQ ID NO: 76550 - DNA, 20 bp, synthetic construct
  misc_feature 1..20: note = CRISPR gRNA sequence
  source 1..20: mol_type = other DNA
gaggcccaactctacccttt

SEQ ID NO: 76551 - DNA, 20 bp, synthetic construct
  misc_feature 1..20: note = CRISPR gRNA sequence
  source 1..20: mol_type = other DNA
taccctttctgccccaggga

SEQ ID NO: 76552 - DNA, 20 bp, synthetic construct
  misc_feature 1..20: note = CRISPR gRNA sequence
  source 1..20: mol_type = other DNA
ccctttctgccccagggact

SEQ ID NO: 76553 - DNA, 20 bp, synthetic construct
  misc_feature 1..20: note = CRISPR gRNA sequence
  source 1..20: mol_type = other DNA
tctgccccagggactgggca

SEQ ID NO: 76554 - DNA, 20 bp, synthetic construct
  misc_feature 1..20: note = CRISPR gRNA sequence
  source 1..20: mol_type = other DNA
ctgccccagggactgggcat

SEQ ID NO: 76555 - DNA, 20 bp, synthetic construct
  misc_feature 1..20: note = CRISPR gRNA sequence
  source 1..20: mol_type = other DNA
tgccccagggactgggcatg

SEQ ID NO: 76556 - DNA, 20 bp, synthetic construct
  misc_feature 1..20: note = CRISPR gRNA sequence
  source 1..20: mol_type = other DNA
ccccagggactgggcatggg

SEQ ID NO: 76557 - DNA, 20 bp, synthetic construct
  misc_feature 1..20: note = CRISPR gRNA sequence
  source 1..20: mol_type = other DNA
ggcatgggcccctgaggcac

SEQ ID NO: 76558 - DNA, 20 bp, synthetic construct
  misc_feature 1..20: note = CRISPR gRNA sequence
  source 1..20: mol_type = other DNA
aggcacagtcaggactgggg

SEQ ID NO: 76559 - DNA, 20 bp, synthetic construct
  misc_feature 1..20: note = CRISPR gRNA sequence
  source 1..20: mol_type = other DNA
gggcctttattgagggtggt

SEQ ID NO: 76560 - DNA, 20 bp, synthetic construct
  misc_feature 1..20: note = CRISPR gRNA sequence
  source 1..20: mol_type = other DNA
tattgagggtggtctttcca

SEQ ID NO: 76561 - DNA, 20 bp, synthetic construct
  misc_feature 1..20: note = CRISPR gRNA sequence
  source 1..20: mol_type = other DNA
attgagggtggtctttccag

SEQ ID NO: 76562 - DNA, 20 bp, synthetic construct
  misc_feature 1..20: note = CRISPR gRNA sequence
  source 1..20: mol_type = other DNA
ttgagggtggtctttccaga

SEQ ID NO: 76563 - DNA, 20 bp, synthetic construct
  misc_feature 1..20: note = CRISPR gRNA sequence
  source 1..20: mol_type = other DNA
agggtggtctttccagaaac

SEQ ID NO: 76564 - DNA, 20 bp, synthetic construct
  misc_feature 1..20: note = CRISPR gRNA sequence
  source 1..20: mol_type = other DNA
tccagaaacacatcccgtat

SEQ ID NO: 76565 - DNA, 20 bp, synthetic construct
  misc_feature 1..20: note = CRISPR gRNA sequence
  source 1..20: mol_type = other DNA
ccagaaacacatcccgtatg

SEQ ID NO: 76566 - DNA, 20 bp, synthetic construct
  misc_feature 1..20: note = CRISPR gRNA sequence
  source 1..20: mol_type = other DNA
cagaaacacatcccgtatgg

SEQ ID NO: 76567 - DNA, 20 bp, synthetic construct
  misc_feature 1..20: note = CRISPR gRNA sequence
  source 1..20: mol_type = other DNA
tggttggcaaaggaggtgat

SEQ ID NO: 76568 - DNA, 20 bp, synthetic construct
  misc_feature 1..20: note = CRISPR gRNA sequence
  source 1..20: mol_type = other DNA
gttggcaaaggaggtgatta

SEQ ID NO: 76569 - DNA, 20 bp, synthetic construct
  misc_feature 1..20: note = CRISPR gRNA sequence
  source 1..20: mol_type = other DNA
gcaaaggaggtgattacacc

SEQ ID NO: 76570 - DNA, 20 bp, synthetic construct
  misc_feature 1..20: note = CRISPR gRNA sequence
  source 1..20: mol_type = other DNA
caccctcctttttttttttt

SEQ ID NO: 76571 - DNA, 20 bp, synthetic construct
  misc_feature 1..20: note = CRISPR gRNA sequence
  source 1..20: mol_type = other DNA
cttttttttttttttaaagc

SEQ ID NO: 76572 - DNA, 20 bp, synthetic construct
  misc_feature 1..20: note = CRISPR gRNA sequence
  source 1..20: mol_type = other DNA
ttttttttttttaaagcaat

SEQ ID NO: 76573 - DNA, 20 bp, synthetic construct
  misc_feature 1..20: note = CRISPR gRNA sequence
  source 1..20: mol_type = other DNA
tttttttttttaaagcaatg

SEQ ID NO: 76574 - DNA, 20 bp, synthetic construct
  misc_feature 1..20: note = CRISPR gRNA sequence
  source 1..20: mol_type = other DNA
ttttttttttaaagcaatgg

SEQ ID NO: 76575 - DNA, 20 bp, synthetic construct
  misc_feature 1..20: note = CRISPR gRNA sequence
  source 1..20: mol_type = other DNA
tttttttttaaagcaatgga

SEQ ID NO: 76576 - DNA, 20 bp, synthetic construct
  misc_feature 1..20: note = CRISPR gRNA sequence
  source 1..20: mol_type = other DNA
ttttttttaaagcaatggaa

SEQ ID NO: 76577 - DNA, 20 bp, synthetic construct
  misc_feature 1..20: note = CRISPR gRNA sequence
  source 1..20: mol_type = other DNA
tttttttaaagcaatggaat

SEQ ID NO: 76578 - DNA, 20 bp, synthetic construct
  misc_feature 1..20: note = CRISPR gRNA sequence
  source 1..20: mol_type = other DNA
ttttttaaagcaatggaatc

SEQ ID NO: 76579 - DNA, 20 bp, synthetic construct
  misc_feature 1..20: note = CRISPR gRNA sequence
  source 1..20: mol_type = other DNA
tttttaaagcaatggaatct

SEQ ID NO: 76580 - DNA, 20 bp, synthetic construct
  misc_feature 1..20: note = CRISPR gRNA sequence
  source 1..20: mol_type = other DNA
ttttaaagcaatggaatctt

SEQ ID NO: 76581 - DNA, 20 bp, synthetic construct
  misc_feature 1..20: note = CRISPR gRNA sequence
  source 1..20: mol_type = other DNA
tttaaagcaatggaatcttt

SEQ ID NO: 76582 - DNA, 20 bp, synthetic construct
  misc_feature 1..20: note = CRISPR gRNA sequence
  source 1..20: mol_type = other DNA
ttaaagcaatggaatcttta

SEQ ID NO: 76583 - DNA, 20 bp, synthetic construct
  misc_feature 1..20: note = CRISPR gRNA sequence
  source 1..20: mol_type = other DNA
taaagcaatggaatctttac

SEQ ID NO: 76584 - DNA, 20 bp, synthetic construct
  misc_feature 1..20: note = CRISPR gRNA sequence
  source 1..20: mol_type = other DNA
aaagcaatggaatctttact

SEQ ID NO: 76585 - DNA, 20 bp, synthetic construct
  misc_feature 1..20: note = CRISPR gRNA sequence
  source 1..20: mol_type = other DNA
aagcaatggaatctttactc

SEQ ID NO: 76586 - DNA, 20 bp, synthetic construct
  misc_feature 1..20: note = CRISPR gRNA sequence
  source 1..20: mol_type = other DNA
tactctttaccacatcccac

SEQ ID NO: 76587 - DNA, 20 bp, synthetic construct
  misc_feature 1..20: note = CRISPR gRNA sequence
  source 1..20: mol_type = other DNA
actctttaccacatcccaca

SEQ ID NO: 76588 - DNA, 20 bp, synthetic construct
  misc_feature 1..20: note = CRISPR gRNA sequence
  source 1..20: mol_type = other DNA
ctctttaccacatcccacat

SEQ ID NO: 76589 - DNA, 20 bp, synthetic construct
  misc_feature 1..20: note = CRISPR gRNA sequence
  source 1..20: mol_type = other DNA
tttaccacatcccacatggt

SEQ ID NO: 76590 - DNA, 20 bp, synthetic construct
  misc_feature 1..20: note = CRISPR gRNA sequence
  source 1..20: mol_type = other DNA
taccacatcccacatggtat

SEQ ID NO: 76591 - DNA, 20 bp, synthetic construct
  misc_feature 1..20: note = CRISPR gRNA sequence
  source 1..20: mol_type = other DNA
accacatcccacatggtatg

SEQ ID NO: 76592 - DNA, 20 bp, synthetic construct
  misc_feature 1..20: note = CRISPR gRNA sequence
  source 1..20: mol_type = other DNA
ccacatcccacatggtatgc

SEQ ID NO: 76593 - DNA, 20 bp, synthetic construct
  misc_feature 1..20: note = CRISPR gRNA sequence
  source 1..20: mol_type = other DNA
cagtgcttgaattcagggag

SEQ ID NO: 76594 - DNA, 20 bp, synthetic construct
  misc_feature 1..20: note = CRISPR gRNA sequence
  source 1..20: mol_type = other DNA
gaattcagggaggggggatg

SEQ ID NO: 76595 - DNA, 20 bp, synthetic construct
  misc_feature 1..20: note = CRISPR gRNA sequence
  source 1..20: mol_type = other DNA
aattcagggaggggggatgg

SEQ ID NO: 76596 - DNA, 20 bp, synthetic construct
  misc_feature 1..20: note = CRISPR gRNA sequence
  source 1..20: mol_type = other DNA
agggaggggggatggagccc

SEQ ID NO: 76597 - DNA, 20 bp, synthetic construct
  misc_feature 1..20: note = CRISPR gRNA sequence
  source 1..20: mol_type = other DNA
tcttccctggcttccccggt

SEQ ID NO: 76598 - DNA, 20 bp, synthetic construct
  misc_feature 1..20: note = CRISPR gRNA sequence
  source 1..20: mol_type = other DNA
ccctggcttccccggtggaa

SEQ ID NO: 76599 - DNA, 20 bp, synthetic construct
  misc_feature 1..20: note = CRISPR gRNA sequence
  source 1..20: mol_type = other DNA
cctggcttccccggtggaac

SEQ ID NO: 76600 - DNA, 20 bp, synthetic construct
  misc_feature 1..20: note = CRISPR gRNA sequence
  source 1..20: mol_type = other DNA
gcttccccggtggaaccccg

SEQ ID NO: 76601 - DNA, 20 bp, synthetic construct
  misc_feature 1..20: note = CRISPR gRNA sequence
  source 1..20: mol_type = other DNA
ccccggtggaaccccgggga

SEQ ID NO: 76602 - DNA, 20 bp, synthetic construct
  misc_feature 1..20: note = CRISPR gRNA sequence
  source 1..20: mol_type = other DNA
cccggtggaaccccggggaa

SEQ ID NO: 76603 - DNA, 20 bp, synthetic construct
  misc_feature 1..20: note = CRISPR gRNA sequence
  source 1..20: mol_type = other DNA
gacttcagcattgagtacct

SEQ ID NO: 76604 - DNA, 20 bp, synthetic construct
  misc_feature 1..20: note = CRISPR gRNA sequence
  source 1..20: mol_type = other DNA
cagcattgagtaccttgatg

SEQ ID NO: 76605 - DNA, 20 bp, synthetic construct
  misc_feature 1..20: note = CRISPR gRNA sequence
  source 1..20: mol_type = other DNA
agcattgagtaccttgatga

SEQ ID NO: 76606 - DNA, 20 bp, synthetic construct
  misc_feature 1..20: note = CRISPR gRNA sequence
  source 1..20: mol_type = other DNA
agtaccttgatgactattta

SEQ ID NO: 76607 - DNA, 20 bp, synthetic construct
  misc_feature 1..20: note = CRISPR gRNA sequence
  source 1..20: mol_type = other DNA
gatgactatttatagcaata

SEQ ID NO: 76608 - DNA, 20 bp, synthetic construct
  misc_feature 1..20: note = CRISPR gRNA sequence
  source 1..20: mol_type = other DNA
atgactatttatagcaataa

SEQ ID NO: 76609 - DNA, 20 bp, synthetic construct
  misc_feature 1..20: note = CRISPR gRNA sequence
  source 1..20: mol_type = other DNA
tttatagcaataatcctgca

SEQ ID NO: 76610 - DNA, 20 bp, synthetic construct
  misc_feature 1..20: note = CRISPR gRNA sequence
  source 1..20: mol_type = other DNA
atagcaataatcctgcaagt

SEQ ID NO: 76611 - DNA, 20 bp, synthetic construct
  misc_feature 1..20: note = CRISPR gRNA sequence
  source 1..20: mol_type = other DNA
tagcaataatcctgcaagtg

SEQ ID NO: 76612 - DNA, 20 bp, synthetic construct
  misc_feature 1..20: note = CRISPR gRNA sequence
  source 1..20: mol_type = other DNA
caagtgatcacagtactcta

SEQ ID NO: 76613 - DNA, 20 bp, synthetic construct
  misc_feature 1..20: note = CRISPR gRNA sequence
  source 1..20: mol_type = other DNA
tacagttgacaaagtgcttt

SEQ ID NO: 76614 - DNA, 20 bp, synthetic construct
  misc_feature 1..20: note = CRISPR gRNA sequence
  source 1..20: mol_type = other DNA
cagttgacaaagtgctttca

SEQ ID NO: 76615 - DNA, 20 bp, synthetic construct
  misc_feature 1..20: note = CRISPR gRNA sequence
  source 1..20: mol_type = other DNA
acaaagtgctttcatattca

SEQ ID NO: 76616 - DNA, 20 bp, synthetic construct
  misc_feature 1..20: note = CRISPR gRNA sequence
  source 1..20: mol_type = other DNA
tcatattcactattgcactt

SEQ ID NO: 76617 - DNA, 20 bp, synthetic construct
  misc_feature 1..20: note = CRISPR gRNA sequence
  source 1..20: mol_type = other DNA
catattcactattgcacttt

SEQ ID NO: 76618 - DNA, 20 bp, synthetic construct
  misc_feature 1..20: note = CRISPR gRNA sequence
  source 1..20: mol_type = other DNA
atattcactattgcactttc

SEQ ID NO: 76619 - DNA, 20 bp, synthetic construct
  misc_feature 1..20: note = CRISPR gRNA sequence
  source 1..20: mol_type = other DNA
actattgcactttccccaac

SEQ ID NO: 76620 - DNA, 20 bp, synthetic construct
  misc_feature 1..20: note = CRISPR gRNA sequence
  source 1..20: mol_type = other DNA
ttgcactttccccaaccaca

SEQ ID NO: 76621 - DNA, 20 bp, synthetic construct
  misc_feature 1..20: note = CRISPR gRNA sequence
  source 1..20: mol_type = other DNA
cactttccccaaccacaggt

SEQ ID NO: 76622 - DNA, 20 bp, synthetic construct
  misc_feature 1..20: note = CRISPR gRNA sequence
  source 1..20: mol_type = other DNA
tccccaaccacaggtaatgg

SEQ ID NO: 76623 - DNA, 20 bp, synthetic construct
  misc_feature 1..20: note = CRISPR gRNA sequence
  source 1..20: mol_type = other DNA
ccccaaccacaggtaatgga

SEQ ID NO: 76624 - DNA, 20 bp, synthetic construct
  misc_feature 1..20: note = CRISPR gRNA sequence
  source 1..20: mol_type = other DNA
cccaaccacaggtaatggag

SEQ ID NO: 76625 - DNA, 20 bp, synthetic construct
  misc_feature 1..20: note = CRISPR gRNA sequence
  source 1..20: mol_type = other DNA
aaactcccacctgtgctcag

SEQ ID NO: 76626 - DNA, 20 bp, synthetic construct
  misc_feature 1..20: note = CRISPR gRNA sequence
  source 1..20: mol_type = other DNA
ccacctgtgctcagaccgcc

SEQ ID NO: 76627 - DNA, 20 bp, synthetic construct
  misc_feature 1..20: note = CRISPR gRNA sequence
  source 1..20: mol_type = other DNA
tgctcagaccgcccagtgct

SEQ ID NO: 76628 - DNA, 20 bp, synthetic construct
  misc_feature 1..20: note = CRISPR gRNA sequence
  source 1..20: mol_type = other DNA
agaccgcccagtgctgccag

SEQ ID NO: 76629 - DNA, 20 bp, synthetic construct
  misc_feature 1..20: note = CRISPR gRNA sequence
  source 1..20: mol_type = other DNA
ccagtgggctttatttattt

SEQ ID NO: 76630 - DNA, 20 bp, synthetic construct
  misc_feature 1..20: note = CRISPR gRNA sequence
  source 1..20: mol_type = other DNA
tatttatttatttatttatt

SEQ ID NO: 76631 - DNA, 20 bp, synthetic construct
  misc_feature 1..20: note = CRISPR gRNA sequence
  source 1..20: mol_type = other DNA
atttatttatttatttattt

SEQ ID NO: 76632 - DNA, 20 bp, synthetic construct
  misc_feature 1..20: note = CRISPR gRNA sequence
  source 1..20: mol_type = other DNA
tttatttatttatttattta

SEQ ID NO: 76633 - DNA, 20 bp, synthetic construct
  misc_feature 1..20: note = CRISPR gRNA sequence
  source 1..20: mol_type = other DNA
atttatttatttatttattt

SEQ ID NO: 76634 - DNA, 20 bp, synthetic construct
  misc_feature 1..20: note = CRISPR gRNA sequence
  source 1..20: mol_type = other DNA
tttatttatttatttattta

SEQ ID NO: 76635 - DNA, 20 bp, synthetic construct
  misc_feature 1..20: note = CRISPR gRNA sequence
  source 1..20: mol_type = other DNA
atttatttatttatttattt

SEQ ID NO: 76636 - DNA, 20 bp, synthetic construct
  misc_feature 1..20: note = CRISPR gRNA sequence
  source 1..20: mol_type = other DNA
tttatttatttatttattta

SEQ ID NO: 76637 - DNA, 20 bp, synthetic construct
  misc_feature 1..20: note = CRISPR gRNA sequence
  source 1..20: mol_type = other DNA
atttatttatttatttattt

SEQ ID NO: 76638 - DNA, 20 bp, synthetic construct
  misc_feature 1..20: note = CRISPR gRNA sequence
  source 1..20: mol_type = other DNA
tttatttatttatttattta

SEQ ID NO: 76639 - DNA, 20 bp, synthetic construct
  misc_feature 1..20: note = CRISPR gRNA sequence
  source 1..20: mol_type = other DNA
atttatttatttatttattt

SEQ ID NO: 76640 - DNA, 20 bp, synthetic construct
  misc_feature 1..20: note = CRISPR gRNA sequence
  source 1..20: mol_type = other DNA
tttatttatttatttatttg

SEQ ID NO: 76641 - DNA, 20 bp, synthetic construct
  misc_feature 1..20: note = CRISPR gRNA sequence
  source 1..20: mol_type = other DNA
atttatttatttatttgaga

SEQ ID NO: 76642 - DNA, 20 bp, synthetic construct
  misc_feature 1..20: note = CRISPR gRNA sequence
  source 1..20: mol_type = other DNA
tttatttatttatttgagac

SEQ ID NO: 76643 - DNA, 20 bp, synthetic construct
  misc_feature 1..20: note = CRISPR gRNA sequence
  source 1..20: mol_type = other DNA
atttatttatttgagacaga

SEQ ID NO: 76644 - DNA, 20 bp, synthetic construct
  misc_feature 1..20: note = CRISPR gRNA sequence
  source 1..20: mol_type = other DNA
tttatttatttgagacagag

SEQ ID NO: 76645 - DNA, 20 bp, synthetic construct
  misc_feature 1..20: note = CRISPR gRNA sequence
  source 1..20: mol_type = other DNA
atttatttgagacagagtct

SEQ ID NO: 76646 - DNA, 20 bp, synthetic construct
  misc_feature 1..20: note = CRISPR gRNA sequence
  source 1..20: mol_type = other DNA
tttatttgagacagagtctt

SEQ ID NO: 76647 - DNA, 20 bp, synthetic construct
  misc_feature 1..20: note = CRISPR gRNA sequence
  source 1..20: mol_type = other DNA
atttgagacagagtcttgct

SEQ ID NO: 76648 - DNA, 20 bp, synthetic construct
  misc_feature 1..20: note = CRISPR gRNA sequence
  source 1..20: mol_type = other DNA
tttgagacagagtcttgctc

SEQ ID NO: 76649 - DNA, 20 bp, synthetic construct
  misc_feature 1..20: note = CRISPR gRNA sequence
  source 1..20: mol_type = other DNA
gagacagagtcttgctctgt

SEQ ID NO: 76650 - DNA, 20 bp, synthetic construct
  misc_feature 1..20: note = CRISPR gRNA sequence
  source 1..20: mol_type = other DNA
agacagagtcttgctctgtt

SEQ ID NO: 76651 - DNA, 20 bp, synthetic construct
  misc_feature 1..20: note = CRISPR gRNA sequence
  source 1..20: mol_type = other DNA
gctctgttgcccaggctgga

SEQ ID NO: 76652 - DNA, 20 bp, synthetic construct
  misc_feature 1..20: note = CRISPR gRNA sequence
  source 1..20: mol_type = other DNA
ctctgttgcccaggctggag

SEQ ID NO: 76653 - DNA, 20 bp, synthetic construct
  misc_feature 1..20: note = CRISPR gRNA sequence
  source 1..20: mol_type = other DNA
tgttgcccaggctggaggac

SEQ ID NO: 76654 - DNA, 20 bp, synthetic construct
  misc_feature 1..20: note = CRISPR gRNA sequence
  source 1..20: mol_type = other DNA
ttgcccaggctggaggacag

SEQ ID NO: 76655 - DNA, 20 bp, synthetic construct
  misc_feature 1..20: note = CRISPR gRNA sequence
  source 1..20: mol_type = other DNA
cccaggctggaggacagtgg

SEQ ID NO: 76656 - DNA, 20 bp, synthetic construct
  misc_feature 1..20: note = CRISPR gRNA sequence
  source 1..20: mol_type = other DNA
gaggacagtggcgcagtctt

SEQ ID NO: 76657 - DNA, 20 bp, synthetic construct
  misc_feature 1..20: note = CRISPR gRNA sequence
  source 1..20: mol_type = other DNA
ggctcaccacaatctctgcc

SEQ ID NO: 76658 - DNA, 20 bp, synthetic construct
  misc_feature 1..20: note = CRISPR gRNA sequence
  source 1..20: mol_type = other DNA
gctcaccacaatctctgcct

SEQ ID NO: 76659 - DNA, 20 bp, synthetic construct
  misc_feature 1..20: note = CRISPR gRNA sequence
  source 1..20: mol_type = other DNA
accacaatctctgcctcccg

SEQ ID NO: 76660 - DNA, 20 bp, synthetic construct
  misc_feature 1..20: note = CRISPR gRNA sequence
  source 1..20: mol_type = other DNA
tgcctcccgggttcaagcaa

SEQ ID NO: 76661 - DNA, 20 bp, synthetic construct
  misc_feature 1..20: note = CRISPR gRNA sequence
  source 1..20: mol_type = other DNA
cctcccgggttcaagcaagt

SEQ ID NO: 76662 - DNA, 20 bp, synthetic construct
  misc_feature 1..20: note = CRISPR gRNA sequence
  source 1..20: mol_type = other DNA
ccgggttcaagcaagtctcc

SEQ ID NO: 76663 - DNA, 20 bp, synthetic construct
  misc_feature 1..20: note = CRISPR gRNA sequence
  source 1..20: mol_type = other DNA
aagcaagtctcctgcctgcc

SEQ ID NO: 76664 - DNA, 20 bp, synthetic construct
  misc_feature 1..20: note = CRISPR gRNA sequence
  source 1..20: mol_type = other DNA
ctgcctgcctccagagtagc

SEQ ID NO: 76665 - DNA, 20 bp, synthetic construct
  misc_feature 1..20: note = CRISPR gRNA sequence
  source 1..20: mol_type = other DNA
cctgcctccagagtagctgg

SEQ ID NO: 76666 - DNA, 20 bp, synthetic construct
  misc_feature 1..20: note = CRISPR gRNA sequence
  source 1..20: mol_type = other DNA
cctccagagtagctgggatt

SEQ ID NO: 76667 - DNA, 20 bp, synthetic construct
  misc_feature 1..20: note = CRISPR gRNA sequence
  source 1..20: mol_type = other DNA
cagagtagctgggattacag

SEQ ID NO: 76668 - DNA, 20 bp, synthetic construct
  misc_feature 1..20: note = CRISPR gRNA sequence
  source 1..20: mol_type = other DNA
ggattacaggggtgcaccac

SEQ ID NO: 76669 - DNA, 20 bp, synthetic construct
  misc_feature 1..20: note = CRISPR gRNA sequence
  source 1..20: mol_type = other DNA
caggggtgcaccaccatgcc

SEQ ID NO: 76670 - DNA, 20 bp, synthetic construct
  misc_feature 1..20: note = CRISPR gRNA sequence
  source 1..20: mol_type = other DNA
gctaatttttgtatttttag

SEQ ID NO: 76671 - DNA, 20 bp, synthetic construct
  misc_feature 1..20: note = CRISPR gRNA sequence
  source 1..20: mol_type = other DNA
atttttgtatttttagtaga

SEQ ID NO: 76672 - DNA, 20 bp, synthetic construct
  misc_feature 1..20: note = CRISPR gRNA sequence
  source 1..20: mol_type = other DNA
ttgtatttttagtagagatg

SEQ ID NO: 76673 - DNA, 20 bp, synthetic construct
  misc_feature 1..20: note = CRISPR gRNA sequence
  source 1..20: mol_type = other DNA
tgtatttttagtagagatgg

SEQ ID NO: 76674 - DNA, 20 bp, synthetic construct
  misc_feature 1..20: note = CRISPR gRNA sequence
  source 1..20: mol_type = other DNA
gtatttttagtagagatggg

SEQ ID NO: 76675 - DNA, 20 bp, synthetic construct
  misc_feature 1..20: note = CRISPR gRNA sequence
  source 1..20: mol_type = other DNA
tatttttagtagagatgggg

SEQ ID NO: 76676 - DNA, 20 bp, synthetic construct
  misc_feature 1..20: note = CRISPR gRNA sequence
  source 1..20: mol_type = other DNA
ttagtagagatggggtttca

SEQ ID NO: 76677 - DNA, 20 bp, synthetic construct
  misc_feature 1..20: note = CRISPR gRNA sequence
  source 1..20: mol_type = other DNA
tagtagagatggggtttcac

SEQ ID NO: 76678 - DNA, 20 bp, synthetic construct
  misc_feature 1..20: note = CRISPR gRNA sequence
  source 1..20: mol_type = other DNA
agtagagatggggtttcact

SEQ ID NO: 76679 - DNA, 20 bp, synthetic construct
  misc_feature 1..20: note = CRISPR gRNA sequence
  source 1..20: mol_type = other DNA
gtagagatggggtttcacta

SEQ ID NO: 76680 - DNA, 20 bp, synthetic construct
  misc_feature 1..20: note = CRISPR gRNA sequence
  source 1..20: mol_type = other DNA
cactatgttggccaggctag

SEQ ID NO: 76681 - DNA, 20 bp, synthetic construct
  misc_feature 1..20: note = CRISPR gRNA sequence
  source 1..20: mol_type = other DNA
actatgttggccaggctagt

SEQ ID NO: 76682 - DNA, 20 bp, synthetic construct
  misc_feature 1..20: note = CRISPR gRNA sequence
  source 1..20: mol_type = other DNA
tgttggccaggctagtctcg

SEQ ID NO: 76683 - DNA, 20 bp, synthetic construct
  misc_feature 1..20: note = CRISPR gRNA sequence
  source 1..20: mol_type = other DNA
gccaggctagtctcgaactc

SEQ ID NO: 76684 - DNA, 20 bp, synthetic construct
  misc_feature 1..20: note = CRISPR gRNA sequence
  source 1..20: mol_type = other DNA
gtctcgaactcctgacctca

SEQ ID NO: 76685 - DNA, 20 bp, synthetic construct
  misc_feature 1..20: note = CRISPR gRNA sequence
  source 1..20: mol_type = other DNA
gaactcctgacctcatgatc

SEQ ID NO: 76686 - DNA, 20 bp, synthetic construct
  misc_feature 1..20: note = CRISPR gRNA sequence
  source 1..20: mol_type = other DNA
ctgacctcatgatccagcca

SEQ ID NO: 76687 - DNA, 20 bp, synthetic construct
  misc_feature 1..20: note = CRISPR gRNA sequence
  source 1..20: mol_type = other DNA
acctcatgatccagccacct

SEQ ID NO: 76688 - DNA, 20 bp, synthetic construct
  misc_feature 1..20: note = CRISPR gRNA sequence
  source 1..20: mol_type = other DNA
atgatccagccacctcggcc

SEQ ID NO: 76689 - DNA, 20 bp, synthetic construct
  misc_feature 1..20: note = CRISPR gRNA sequence
  source 1..20: mol_type = other DNA
ggcctcccaaagtgctggga

SEQ ID NO: 76690 - DNA, 20 bp, synthetic construct
  misc_feature 1..20: note = CRISPR gRNA sequence
  source 1..20: mol_type = other DNA
ccaaagtgctgggattatag

SEQ ID NO: 76691 - DNA, 20 bp, synthetic construct
  misc_feature 1..20: note = CRISPR gRNA sequence
  source 1..20: mol_type = other DNA
ggattataggcgtgagtcac

SEQ ID NO: 76692 - DNA, 20 bp, synthetic construct
  misc_feature 1..20: note = CRISPR gRNA sequence
  source 1..20: mol_type = other DNA
taggcgtgagtcaccgtgcc

SEQ ID NO: 76693 - DNA, 20 bp, synthetic construct
  misc_feature 1..20: note = CRISPR gRNA sequence
  source 1..20: mol_type = other DNA
tttatattaagcttcctctg

SEQ ID NO: 76694 - DNA, 20 bp, synthetic construct
  misc_feature 1..20: note = CRISPR gRNA sequence
  source 1..20: mol_type = other DNA
ttatattaagcttcctctgc

SEQ ID NO: 76695 - DNA, 20 bp, synthetic construct
  misc_feature 1..20: note = CRISPR gRNA sequence
  source 1..20: mol_type = other DNA
tatattaagcttcctctgca

SEQ ID NO: 76696 - DNA, 20 bp, synthetic construct
  misc_feature 1..20: note = CRISPR gRNA sequence
  source 1..20: mol_type = other DNA
atattaagcttcctctgcag

SEQ ID NO: 76697 - DNA, 20 bp, synthetic construct
  misc_feature 1..20: note = CRISPR gRNA sequence
  source 1..20: mol_type = other DNA
tattaagcttcctctgcaga

SEQ ID NO: 76698 - DNA, 20 bp, synthetic construct
  misc_feature 1..20: note = CRISPR gRNA sequence
  source 1..20: mol_type = other DNA
agcttcctctgcagatgatt

SEQ ID NO: 76699 - DNA, 20 bp, synthetic construct
  misc_feature 1..20: note = CRISPR gRNA sequence
  source 1..20: mol_type = other DNA
cctctgcagatgatttgcct

SEQ ID NO: 76700 - DNA, 20 bp, synthetic construct
  misc_feature 1..20: note = CRISPR gRNA sequence
  source 1..20: mol_type = other DNA
ctctgcagatgatttgcctt

SEQ ID NO: 76701 - DNA, 20 bp, synthetic construct
  misc_feature 1..20: note = CRISPR gRNA sequence
  source 1..20: mol_type = other DNA
tgcagatgatttgccttggc

SEQ ID NO: 76702 - DNA, 20 bp, synthetic construct
  misc_feature 1..20: note = CRISPR gRNA sequence
  source 1..20: mol_type = other DNA
cagatgatttgccttggcca

SEQ ID NO: 76703 - DNA, 20 bp, synthetic construct
  misc_feature 1..20: note = CRISPR gRNA sequence
  source 1..20: mol_type = other DNA
gccttggccagcagagcccg

SEQ ID NO: 76704 - DNA, 20 bp, synthetic construct
  misc_feature 1..20: note = CRISPR gRNA sequence
  source 1..20: mol_type = other DNA
ccttggccagcagagcccgc

SEQ ID NO: 76705 - DNA, 20 bp, synthetic construct
  misc_feature 1..20: note = CRISPR gRNA sequence
  source 1..20: mol_type = other DNA
ggccagcagagcccgcatcc

SEQ ID NO: 76706 - DNA, 20 bp, synthetic construct
  misc_feature 1..20: note = CRISPR gRNA sequence
  source 1..20: mol_type = other DNA
gccagcagagcccgcatccc

SEQ ID NO: 76707 - DNA, 20 bp, synthetic construct
  misc_feature 1..20: note = CRISPR gRNA sequence
  source 1..20: mol_type = other DNA
cttgtgttcccaggatctgg

SEQ ID NO: 76708 - DNA, 20 bp, synthetic construct
  misc_feature 1..20: note = CRISPR gRNA sequence
  source 1..20: mol_type = other DNA
gtgttcccaggatctggccc

SEQ ID NO: 76709 - DNA, 20 bp, synthetic construct
  misc_feature 1..20: note = CRISPR gRNA sequence
  source 1..20: mol_type = other DNA
tgttcccaggatctggccca

SEQ ID NO: 76710 - DNA, 20 bp, synthetic construct
  misc_feature 1..20: note = CRISPR gRNA sequence
  source 1..20: mol_type = other DNA
ccaggatctggcccagtgca

SEQ ID NO: 76711 - DNA, 20 bp, synthetic construct
  misc_feature 1..20: note = CRISPR gRNA sequence
  source 1..20: mol_type = other DNA
gcccagtgcatggtatacaa

SEQ ID NO: 76712 - DNA, 20 bp, synthetic construct
  misc_feature 1..20: note = CRISPR gRNA sequence
  source 1..20: mol_type = other DNA
aacagtcaaatcacgtaaga

SEQ ID NO: 76713 - DNA, 20 bp, synthetic construct
  misc_feature 1..20: note = CRISPR gRNA sequence
  source 1..20: mol_type = other DNA
acagtcaaatcacgtaagag

SEQ ID NO: 76714 - DNA, 20 bp, synthetic construct
  misc_feature 1..20: note = CRISPR gRNA sequence
  source 1..20: mol_type = other DNA
tttgtagcactgactgcagt

SEQ ID NO: 76715 - DNA, 20 bp, synthetic construct
  misc_feature 1..20: note = CRISPR gRNA sequence
  source 1..20: mol_type = other DNA
ttgtagcactgactgcagtg

SEQ ID NO: 76716 - DNA, 20 bp, synthetic construct
  misc_feature 1..20: note = CRISPR gRNA sequence
  source 1..20: mol_type = other DNA
tgtagcactgactgcagtgc

SEQ ID NO: 76717 - DNA, 20 bp, synthetic construct
  misc_feature 1..20: note = CRISPR gRNA sequence
  source 1..20: mol_type = other DNA
gtagcactgactgcagtgct

SEQ ID NO: 76718 - DNA, 20 bp, synthetic construct
  misc_feature 1..20: note = CRISPR gRNA sequence
  source 1..20: mol_type = other DNA
tagcactgactgcagtgcta

SEQ ID NO: 76719 - DNA, 20 bp, synthetic construct
  misc_feature 1..20: note = CRISPR gRNA sequence
  source 1..20: mol_type = other DNA
actgcagtgctacacaaaac

SEQ ID NO: 76720 - DNA, 20 bp, synthetic construct
  misc_feature 1..20: note = CRISPR gRNA sequence
  source 1..20: mol_type = other DNA
cagtgctacacaaaacaaaa

SEQ ID NO: 76721 - DNA, 20 bp, synthetic construct
  misc_feature 1..20: note = CRISPR gRNA sequence
  source 1..20: mol_type = other DNA
cacaaaacaaaacacaacac

SEQ ID NO: 76722 - DNA, 20 bp, synthetic construct
  misc_feature 1..20: note = CRISPR gRNA sequence
  source 1..20: mol_type = other DNA
gaagcagtttggatttcaat

SEQ ID NO: 76723 - DNA, 20 bp, synthetic construct
  misc_feature 1..20: note = CRISPR gRNA sequence
  source 1..20: mol_type = other DNA
ggatttcaatctagaccaag

SEQ ID NO: 76724 - DNA, 20 bp, synthetic construct
  misc_feature 1..20: note = CRISPR gRNA sequence
  source 1..20: mol_type = other DNA
gatttcaatctagaccaagt

SEQ ID NO: 76725 - DNA, 20 bp, synthetic construct
  misc_feature 1..20: note = CRISPR gRNA sequence
  source 1..20: mol_type = other DNA
caatctagaccaagttgtcc

SEQ ID NO: 76726 - DNA, 20 bp, synthetic construct
  misc_feature 1..20: note = CRISPR gRNA sequence
  source 1..20: mol_type = other DNA
aatctagaccaagttgtcca

SEQ ID NO: 76727 - DNA, 20 bp, synthetic construct
  misc_feature 1..20: note = CRISPR gRNA sequence
  source 1..20: mol_type = other DNA
gaccaagttgtccaagccac

SEQ ID NO: 76728 - DNA, 20 bp, synthetic construct
  misc_feature 1..20: note = CRISPR gRNA sequence
  source 1..20: mol_type = other DNA
tccaagccacatggcctgct

SEQ ID NO: 76729 - DNA, 20 bp, synthetic construct
  misc_feature 1..20: note = CRISPR gRNA sequence
  source 1..20: mol_type = other DNA
ctgcatgcagcctaggatgg

SEQ ID NO: 76730 - DNA, 20 bp, synthetic construct
  misc_feature 1..20: note = CRISPR gRNA sequence
  source 1..20: mol_type = other DNA
catgcagcctaggatggctt

SEQ ID NO: 76731 - DNA, 20 bp, synthetic construct
  misc_feature 1..20: note = CRISPR gRNA sequence
  source 1..20: mol_type = other DNA
ggatggctttgaatacggcc

SEQ ID NO: 76732 - DNA, 20 bp, synthetic construct
  misc_feature 1..20: note = CRISPR gRNA sequence
  source 1..20: mol_type = other DNA
tgaatacggcctaacaaaaa

SEQ ID NO: 76733 - DNA, 20 bp, synthetic construct
  misc_feature 1..20: note = CRISPR gRNA sequence
  source 1..20: mol_type = other DNA
gaatacggcctaacaaaaat

SEQ ID NO: 76734 - DNA, 20 bp, synthetic construct
  misc_feature 1..20: note = CRISPR gRNA sequence
  source 1..20: mol_type = other DNA
aatacggcctaacaaaaatt

SEQ ID NO: 76735 - DNA, 20 bp, synthetic construct
  misc_feature 1..20: note = CRISPR gRNA sequence
  source 1..20: mol_type = other DNA
acaaaaattcgtaaactttc

SEQ ID NO: 76736 - DNA, 20 bp, synthetic construct
  misc_feature 1..20: note = CRISPR gRNA sequence
  source 1..20: mol_type = other DNA
gtaaactttcttaaaacact

SEQ ID NO: 76737 - DNA, 20 bp, synthetic construct
  misc_feature 1..20: note = CRISPR gRNA sequence
  source 1..20: mol_type = other DNA
tcttaaaacactatgagatt

SEQ ID NO: 76738 - DNA, 20 bp, synthetic construct
  misc_feature 1..20: note = CRISPR gRNA sequence
  source 1..20: mol_type = other DNA
cttaaaacactatgagattt

SEQ ID NO: 76739 - DNA, 20 bp, synthetic construct
  misc_feature 1..20: note = CRISPR gRNA sequence
  source 1..20: mol_type = other DNA
ttaaaacactatgagatttt

SEQ ID NO: 76740 - DNA, 20 bp, synthetic construct
  misc_feature 1..20: note = CRISPR gRNA sequence
  source 1..20: mol_type = other DNA
aaaacactatgagatttttc

SEQ ID NO: 76741 - DNA, 20 bp, synthetic construct
  misc_feature 1..20: note = CRISPR gRNA sequence
  source 1..20: mol_type = other DNA
aaacactatgagatttttct

SEQ ID NO: 76742 - DNA, 20 bp, synthetic construct
  misc_feature 1..20: note = CRISPR gRNA sequence
  source 1..20: mol_type = other DNA
tgagatttttctttggagtt

SEQ ID NO: 76743 - DNA, 20 bp, synthetic construct
  misc_feature 1..20: note = CRISPR gRNA sequence
  source 1..20: mol_type = other DNA
ttctttggagttttgttttt

SEQ ID NO: 76744 - DNA, 20 bp, synthetic construct
  misc_feature 1..20: note = CRISPR gRNA sequence
  source 1..20: mol_type = other DNA
tctttggagttttgtttttt

SEQ ID NO: 76745 - DNA, 20 bp, synthetic construct
  misc_feature 1..20: note = CRISPR gRNA sequence
  source 1..20: mol_type = other DNA
ctttggagttttgttttttt

SEQ ID NO: 76746 - DNA, 20 bp, synthetic construct
  misc_feature 1..20: note = CRISPR gRNA sequence
  source 1..20: mol_type = other DNA
tttggagttttgtttttttt

SEQ ID NO: 76747 - DNA, 20 bp, synthetic construct
  misc_feature 1..20: note = CRISPR gRNA sequence
  source 1..20: mol_type = other DNA
tggagttttgtttttttttt

SEQ ID NO: 76748 - DNA, 20 bp, synthetic construct
  misc_feature 1..20: note = CRISPR gRNA sequence
  source 1..20: mol_type = other DNA
ggagttttgttttttttttt

SEQ ID NO: 76749 - DNA, 20 bp, synthetic construct
  misc_feature 1..20: note = CRISPR gRNA sequence
  source 1..20: mol_type = other DNA
gagttttgtttttttttttt

SEQ ID NO: 76750 - DNA, 20 bp, synthetic construct
  misc_feature 1..20: note = CRISPR gRNA sequence
  source 1..20: mol_type = other DNA
tgttttttttttttagcaca

SEQ ID NO: 76751 - DNA, 20 bp, synthetic construct
  misc_feature 1..20: note = CRISPR gRNA sequence
  source 1..20: mol_type = other DNA
gttttttttttttagcacat

SEQ ID NO: 76752 - DNA, 20 bp, synthetic construct
  misc_feature 1..20: note = CRISPR gRNA sequence
  source 1..20: mol_type = other DNA
ttttttttttttagcacatc

SEQ ID NO: 76753 - DNA, 20 bp, synthetic construct
  misc_feature 1..20: note = CRISPR gRNA sequence
  source 1..20: mol_type = other DNA
tttttttttagcacatcagc

SEQ ID NO: 76754 - DNA, 20 bp, synthetic construct
  misc_feature 1..20: note = CRISPR gRNA sequence
  source 1..20: mol_type = other DNA
ttttttttagcacatcagct

SEQ ID NO: 76755 - DNA, 20 bp, synthetic construct
  misc_feature 1..20: note = CRISPR gRNA sequence
  source 1..20: mol_type = other DNA
tttttttagcacatcagcta

SEQ ID NO: 76756 - DNA, 20 bp, synthetic construct
  misc_feature 1..20: note = CRISPR gRNA sequence
  source 1..20: mol_type = other DNA
ttttttagcacatcagctat

SEQ ID NO: 76757 - DNA, 20 bp, synthetic construct
  misc_feature 1..20: note = CRISPR gRNA sequence
  source 1..20: mol_type = other DNA
tttttagcacatcagctatc

SEQ ID NO: 76758 - DNA, 20 bp, synthetic construct
  misc_feature 1..20: note = CRISPR gRNA sequence
  source 1..20: mol_type = other DNA
ttttagcacatcagctatcg

SEQ ID NO: 76759 - DNA, 20 bp, synthetic construct
  misc_feature 1..20: note = CRISPR gRNA sequence
  source 1..20: mol_type = other DNA
tttagcacatcagctatcgc

SEQ ID NO: 76760 - DNA, 20 bp, synthetic construct
  misc_feature 1..20: note = CRISPR gRNA sequence
  source 1..20: mol_type = other DNA
ttagcacatcagctatcgct

SEQ ID NO: 76761 - DNA, 20 bp, synthetic construct
  misc_feature 1..20: note = CRISPR gRNA sequence
  source 1..20: mol_type = other DNA
tagcacatcagctatcgcta

SEQ ID NO: 76762 - DNA, 20 bp, synthetic construct
  misc_feature 1..20: note = CRISPR gRNA sequence
  source 1..20: mol_type = other DNA
agcacatcagctatcgctag

SEQ ID NO: 76763 - DNA, 20 bp, synthetic construct
  misc_feature 1..20: note = CRISPR gRNA sequence
  source 1..20: mol_type = other DNA
gcacatcagctatcgctagt

SEQ ID NO: 76764 - DNA, 20 bp, synthetic construct
  misc_feature 1..20: note = CRISPR gRNA sequence
  source 1..20: mol_type = other DNA
tcgctagtgttagtgtattt

SEQ ID NO: 76765 - DNA, 20 bp, synthetic construct
  misc_feature 1..20: note = CRISPR gRNA sequence
  source 1..20: mol_type = other DNA
gtgttagtgtattttatgtg

SEQ ID NO: 76766 - DNA, 20 bp, synthetic construct
  misc_feature 1..20: note = CRISPR gRNA sequence
  source 1..20: mol_type = other DNA
gtgtattttatgtgtggccc

SEQ ID NO: 76767 - DNA, 20 bp, synthetic construct
  misc_feature 1..20: note = CRISPR gRNA sequence
  source 1..20: mol_type = other DNA
tatgtgtggcccaagacaat

SEQ ID NO: 76768 - DNA, 20 bp, synthetic construct
  misc_feature 1..20: note = CRISPR gRNA sequence
  source 1..20: mol_type = other DNA
atgtgtggcccaagacaatt

SEQ ID NO: 76769 - DNA, 20 bp, synthetic construct
  misc_feature 1..20: note = CRISPR gRNA sequence
  source 1..20: mol_type = other DNA
tgtgtggcccaagacaattc

SEQ ID NO: 76770 - DNA, 20 bp, synthetic construct
  misc_feature 1..20: note = CRISPR gRNA sequence
  source 1..20: mol_type = other DNA
tttttcttcttccaatgtgg

SEQ ID NO: 76771 - DNA, 20 bp, synthetic construct
  misc_feature 1..20: note = CRISPR gRNA sequence
  source 1..20: mol_type = other DNA
tttcttcttccaatgtggcc

SEQ ID NO: 76772 - DNA, 20 bp, synthetic construct
  misc_feature 1..20: note = CRISPR gRNA sequence
  source 1..20: mol_type = other DNA
ttcttcttccaatgtggccc

SEQ ID NO: 76773 - DNA, 20 bp, synthetic construct
  misc_feature 1..20: note = CRISPR gRNA sequence
  source 1..20: mol_type = other DNA
tcttcttccaatgtggccca

SEQ ID NO: 76774 - DNA, 20 bp, synthetic construct
  misc_feature 1..20: note = CRISPR gRNA sequence
  source 1..20: mol_type = other DNA
cttcttccaatgtggcccag

SEQ ID NO: 76775 - DNA, 20 bp, synthetic construct
  misc_feature 1..20: note = CRISPR gRNA sequence
  source 1..20: mol_type = other DNA
ttcttccaatgtggcccagg

SEQ ID NO: 76776 - DNA, 20 bp, synthetic construct
  misc_feature 1..20: note = CRISPR gRNA sequence
  source 1..20: mol_type = other DNA
cttccaatgtggcccaggga

SEQ ID NO: 76777 - DNA, 20 bp, synthetic construct
  misc_feature 1..20: note = CRISPR gRNA sequence
  source 1..20: mol_type = other DNA
ttccaatgtggcccagggaa

SEQ ID NO: 76778 - DNA, 20 bp, synthetic construct
  misc_feature 1..20: note = CRISPR gRNA sequence
  source 1..20: mol_type = other DNA
ccaatgtggcccagggaagc

SEQ ID NO: 76779 - DNA, 20 bp, synthetic construct
  misc_feature 1..20: note = CRISPR gRNA sequence
  source 1..20: mol_type = other DNA
caatgtggcccagggaagcc

SEQ ID NO: 76780 - DNA, 20 bp, synthetic construct
  misc_feature 1..20: note = CRISPR gRNA sequence
  source 1..20: mol_type = other DNA
gacacccttgatctagactc

SEQ ID NO: 76781 - DNA, 20 bp, synthetic construct
  misc_feature 1..20: note = CRISPR gRNA sequence
  source 1..20: mol_type = other DNA
gatctagactctagaagggt

SEQ ID NO: 76782 - DNA, 20 bp, synthetic construct
  misc_feature 1..20: note = CRISPR gRNA sequence
  source 1..20: mol_type = other DNA
atctagactctagaagggtg

SEQ ID NO: 76783 - DNA, 20 bp, synthetic construct
  misc_feature 1..20: note = CRISPR gRNA sequence
  source 1..20: mol_type = other DNA
gactctagaagggtgtggtg

SEQ ID NO: 76784 - DNA, 20 bp, synthetic construct
  misc_feature 1..20: note = CRISPR gRNA sequence
  source 1..20: mol_type = other DNA
tagaagggtgtggtggagta

SEQ ID NO: 76785 - DNA, 20 bp, synthetic construct
  misc_feature 1..20: note = CRISPR gRNA sequence
  source 1..20: mol_type = other DNA
gaagggtgtggtggagtaac

SEQ ID NO: 76786 - DNA, 20 bp, synthetic construct
  misc_feature 1..20: note = CRISPR gRNA sequence
  source 1..20: mol_type = other DNA
gcagctcgtcccgtactgtg

SEQ ID NO: 76787 - DNA, 20 bp, synthetic construct
  misc_feature 1..20: note = CRISPR gRNA sequence
  source 1..20: mol_type = other DNA
cagctcgtcccgtactgtgg

SEQ ID NO: 76788 - DNA, 20 bp, synthetic construct
  misc_feature 1..20: note = CRISPR gRNA sequence
  source 1..20: mol_type = other DNA
gtcccgtactgtggcaattt

SEQ ID NO: 76789 - DNA, 20 bp, synthetic construct
  misc_feature 1..20: note = CRISPR gRNA sequence
  source 1..20: mol_type = other DNA
tggcaatttagtattaaaag

SEQ ID NO: 76790 - DNA, 20 bp, synthetic construct
  misc_feature 1..20: note = CRISPR gRNA sequence
  source 1..20: mol_type = other DNA
agtattaaaaggcatcagta

SEQ ID NO: 76791 - DNA, 20 bp, synthetic construct
  misc_feature 1..20: note = CRISPR gRNA sequence
  source 1..20: mol_type = other DNA
gtattaaaaggcatcagtat

SEQ ID NO: 76792 - DNA, 20 bp, synthetic construct
  misc_feature 1..20: note = CRISPR gRNA sequence
  source 1..20: mol_type = other DNA
aaaggcatcagtatatactc

SEQ ID NO: 76793 - DNA, 20 bp, synthetic construct
  misc_feature 1..20: note = CRISPR gRNA sequence
  source 1..20: mol_type = other DNA
tgtgaaaacaggtaagagac

SEQ ID NO: 76794 - DNA, 20 bp, synthetic construct
  misc_feature 1..20: note = CRISPR gRNA sequence
  source 1..20: mol_type = other DNA
tgaaaacaggtaagagacaa

SEQ ID NO: 76795 - DNA, 20 bp, synthetic construct
  misc_feature 1..20: note = CRISPR gRNA sequence
  source 1..20: mol_type = other DNA
accattggttgactttaagg

SEQ ID NO: 76796 - DNA, 20 bp, synthetic construct
  misc_feature 1..20: note = CRISPR gRNA sequence
  source 1..20: mol_type = other DNA
gttgactttaaggaattgcc

SEQ ID NO: 76797 - DNA, 20 bp, synthetic construct
  misc_feature 1..20: note = CRISPR gRNA sequence
  source 1..20: mol_type = other DNA
actttaaggaattgccatta

SEQ ID NO: 76798 - DNA, 20 bp, synthetic construct
  misc_feature 1..20: note = CRISPR gRNA sequence
  source 1..20: mol_type = other DNA
taaggaattgccattaatag

SEQ ID NO: 76799 - DNA, 20 bp, synthetic construct
  misc_feature 1..20: note = CRISPR gRNA sequence
  source 1..20: mol_type = other DNA
aaggaattgccattaatagg

SEQ ID NO: 76800 - DNA, 20 bp, synthetic construct
  misc_feature 1..20: note = CRISPR gRNA sequence
  source 1..20: mol_type = other DNA
aggaattgccattaataggg

SEQ ID NO: 76801 - DNA, 20 bp, synthetic construct
  misc_feature 1..20: note = CRISPR gRNA sequence
  source 1..20: mol_type = other DNA
ccattaatagggtaggtctg

SEQ ID NO: 76802 - DNA, 20 bp, synthetic construct
  misc_feature 1..20: note = CRISPR gRNA sequence
  source 1..20: mol_type = other DNA
atagggtaggtctgggccag

SEQ ID NO: 76803 - DNA, 20 bp, synthetic construct
  misc_feature 1..20: note = CRISPR gRNA sequence
  source 1..20: mol_type = other DNA
ggccaggtgcagtggctcaa

SEQ ID NO: 76804 - DNA, 20 bp, synthetic construct
  misc_feature 1..20: note = CRISPR gRNA sequence
  source 1..20: mol_type = other DNA
aagcctgtaatcccaacact

SEQ ID NO: 76805 - DNA, 20 bp, synthetic construct
  misc_feature 1..20: note = CRISPR gRNA sequence
  source 1..20: mol_type = other DNA
taatcccaacactttgggag

SEQ ID NO: 76806 - DNA, 20 bp, synthetic construct
  misc_feature 1..20: note = CRISPR gRNA sequence
  source 1..20: mol_type = other DNA
tgggaggctgaggaaggtgg

SEQ ID NO: 76807 - DNA, 20 bp, synthetic construct
  misc_feature 1..20: note = CRISPR gRNA sequence
  source 1..20: mol_type = other DNA
gggaggctgaggaaggtgga

SEQ ID NO: 76808 - DNA, 20 bp, synthetic construct
  misc_feature 1..20: note = CRISPR gRNA sequence
  source 1..20: mol_type = other DNA
ggaggctgaggaaggtggat

SEQ ID NO: 76809 - DNA, 20 bp, synthetic construct
  misc_feature 1..20: note = CRISPR gRNA sequence
  source 1..20: mol_type = other DNA
aggaaggtggatcacttgag

SEQ ID NO: 76810 - DNA, 20 bp, synthetic construct
  misc_feature 1..20: note = CRISPR gRNA sequence
  source 1..20: mol_type = other DNA
gaggtcaggagttcgagacc

SEQ ID NO: 76811 - DNA, 20 bp, synthetic construct
  misc_feature 1..20: note = CRISPR gRNA sequence
  source 1..20: mol_type = other DNA
aggtcaggagttcgagacca

SEQ ID NO: 76812 - DNA, 20 bp, synthetic construct
  misc_feature 1..20: note = CRISPR gRNA sequence
  source 1..20: mol_type = other DNA
gagaccagcctggccaacat

SEQ ID NO: 76813 - DNA, 20 bp, synthetic construct
  misc_feature 1..20: note = CRISPR gRNA sequence
  source 1..20: mol_type = other DNA
gccaacatggtgaaaccctg

SEQ ID NO: 76814 - DNA, 20 bp, synthetic construct
  misc_feature 1..20: note = CRISPR gRNA sequence
  source 1..20: mol_type = other DNA
cctctactaaaaatacaaaa

SEQ ID NO: 76815 - DNA, 20 bp, synthetic construct
  misc_feature 1..20: note = CRISPR gRNA sequence
  source 1..20: mol_type = other DNA
tactaaaaatacaaaaatta

SEQ ID NO: 76816 - DNA, 20 bp, synthetic construct
  misc_feature 1..20: note = CRISPR gRNA sequence
  source 1..20: mol_type = other DNA
ctaaaaatacaaaaattagc

SEQ ID NO: 76817 - DNA, 20 bp, synthetic construct
  misc_feature 1..20: note = CRISPR gRNA sequence
  source 1..20: mol_type = other DNA
aaaatacaaaaattagccag

SEQ ID NO: 76818 - DNA, 20 bp, synthetic construct
  misc_feature 1..20: note = CRISPR gRNA sequence
  source 1..20: mol_type = other DNA
gccaggcatgatggcgggcg

SEQ ID NO: 76819 - DNA, 20 bp, synthetic construct
  misc_feature 1..20: note = CRISPR gRNA sequence
  source 1..20: mol_type = other DNA
taatcccagctactcaggag

SEQ ID NO: 76820 - DNA, 20 bp, synthetic construct
  misc_feature 1..20: note = CRISPR gRNA sequence
  source 1..20: mol_type = other DNA
ctcaggaggctgaggcagga

SEQ ID NO: 76821 - DNA, 20 bp, synthetic construct
  misc_feature 1..20: note = CRISPR gRNA sequence
  source 1..20: mol_type = other DNA
aggaggctgaggcaggagaa

SEQ ID NO: 76822 - DNA, 20 bp, synthetic construct
  misc_feature 1..20: note = CRISPR gRNA sequence
  source 1..20: mol_type = other DNA
aggcaggagaattgcttgaa

SEQ ID NO: 76823 - DNA, 20 bp, synthetic construct
  misc_feature 1..20: note = CRISPR gRNA sequence
  source 1..20: mol_type = other DNA
cttgaacccaggaggcagag

SEQ ID NO: 76824 - DNA, 20 bp, synthetic construct
  misc_feature 1..20: note = CRISPR gRNA sequence
  source 1..20: mol_type = other DNA
gaacccaggaggcagaggtg

SEQ ID NO: 76825 - DNA, 20 bp, synthetic construct
  misc_feature 1..20: note = CRISPR gRNA sequence
  source 1..20: mol_type = other DNA
aacccaggaggcagaggtgg

SEQ ID NO: 76826 - DNA, 20 bp, synthetic construct
  misc_feature 1..20: note = CRISPR gRNA sequence
  source 1..20: mol_type = other DNA
cactccagcctgggcaacaa

SEQ ID NO: 76827 - DNA, 20 bp, synthetic construct
  misc_feature 1..20: note = CRISPR gRNA sequence
  source 1..20: mol_type = other DNA
cagcctgggcaacaagagca

SEQ ID NO: 76828 - DNA, 20 bp, synthetic construct
  misc_feature 1..20: note = CRISPR gRNA sequence
  source 1..20: mol_type = other DNA
ggcaacaagagcaaaactct

SEQ ID NO: 76829 - DNA, 20 bp, synthetic construct
  misc_feature 1..20: note = CRISPR gRNA sequence
  source 1..20: mol_type = other DNA
tgtctcagaaaaaaaaaata

SEQ ID NO: 76830 - DNA, 20 bp, synthetic construct
  misc_feature 1..20: note = CRISPR gRNA sequence
  source 1..20: mol_type = other DNA
tctcagaaaaaaaaaatagt

SEQ ID NO: 76831 - DNA, 20 bp, synthetic construct
  misc_feature 1..20: note = CRISPR gRNA sequence
  source 1..20: mol_type = other DNA
agaaaaaaaaaatagtgtag

SEQ ID NO: 76832 - DNA, 20 bp, synthetic construct
  misc_feature 1..20: note = CRISPR gRNA sequence
  source 1..20: mol_type = other DNA
ataatggttttgtggttata

SEQ ID NO: 76833 - DNA, 20 bp, synthetic construct
  misc_feature 1..20: note = CRISPR gRNA sequence
  source 1..20: mol_type = other DNA
tgtggttatatgtttgaacc

SEQ ID NO: 76834 - DNA, 20 bp, synthetic construct
  misc_feature 1..20: note = CRISPR gRNA sequence
  source 1..20: mol_type = other DNA
gtggttatatgtttgaacct

SEQ ID NO: 76835 - DNA, 20 bp, synthetic construct
  misc_feature 1..20: note = CRISPR gRNA sequence
  source 1..20: mol_type = other DNA
tggttatatgtttgaacctg

SEQ ID NO: 76836 - DNA, 20 bp, synthetic construct
  misc_feature 1..20: note = CRISPR gRNA sequence
  source 1..20: mol_type = other DNA
tatgtttgaacctggagaag

SEQ ID NO: 76837 - DNA, 20 bp, synthetic construct
  misc_feature 1..20: note = CRISPR gRNA sequence
  source 1..20: mol_type = other DNA
gaacctggagaaggacatgg

SEQ ID NO: 76838 - DNA, 20 bp, synthetic construct
  misc_feature 1..20: note = CRISPR gRNA sequence
  source 1..20: mol_type = other DNA
aacctggagaaggacatggg

SEQ ID NO: 76839 - DNA, 20 bp, synthetic construct
  misc_feature 1..20: note = CRISPR gRNA sequence
  source 1..20: mol_type = other DNA
gagaaggacatgggaaggcc

SEQ ID NO: 76840 - DNA, 20 bp, synthetic construct
  misc_feature 1..20: note = CRISPR gRNA sequence
  source 1..20: mol_type = other DNA
cagggggtcaaaccggatta

SEQ ID NO: 76841 - DNA, 20 bp, synthetic construct
  misc_feature 1..20: note = CRISPR gRNA sequence
  source 1..20: mol_type = other DNA
tctggttggaagggctggaa

SEQ ID NO: 76842 - DNA, 20 bp, synthetic construct
  misc_feature 1..20: note = CRISPR gRNA sequence
  source 1..20: mol_type = other DNA
gttggaagggctggaagggc

SEQ ID NO: 76843 - DNA, 20 bp, synthetic construct
  misc_feature 1..20: note = CRISPR gRNA sequence
  source 1..20: mol_type = other DNA
gaagggctggaagggcattt

SEQ ID NO: 76844 - DNA, 20 bp, synthetic construct
  misc_feature 1..20: note = CRISPR gRNA sequence
  source 1..20: mol_type = other DNA
gaagggcatttgagatgggg

SEQ ID NO: 76845 - DNA, 20 bp, synthetic construct
  misc_feature 1..20: note = CRISPR gRNA sequence
  source 1..20: mol_type = other DNA
gagatgggggctagaaagca

SEQ ID NO: 76846 - DNA, 20 bp, synthetic construct
  misc_feature 1..20: note = CRISPR gRNA sequence
  source 1..20: mol_type = other DNA
agatgggggctagaaagcaa

SEQ ID NO: 76847 - DNA, 20 bp, synthetic construct
  misc_feature 1..20: note = CRISPR gRNA sequence
  source 1..20: mol_type = other DNA
gaaagcaagaaaaaagactg

SEQ ID NO: 76848 - DNA, 20 bp, synthetic construct
  misc_feature 1..20: note = CRISPR gRNA sequence
  source 1..20: mol_type = other DNA
aagcaaaatggaaaacacag

SEQ ID NO: 76849 - DNA, 20 bp, synthetic construct
  misc_feature 1..20: note = CRISPR gRNA sequence
  source 1..20: mol_type = other DNA
tgaaaacacagtgcatgaaa

SEQ ID NO: 76850 - DNA, 20 bp, synthetic construct
  misc_feature 1..20: note = CRISPR gRNA sequence
  source 1..20: mol_type = other DNA
gtttatgactgcaaacaggt

SEQ ID NO: 76851 - DNA, 20 bp, synthetic construct
  misc_feature 1..20: note = CRISPR gRNA sequence
  source 1..20: mol_type = other DNA
atgactgcaaacaggtagaa

SEQ ID NO: 76852 - DNA, 20 bp, synthetic construct
  misc_feature 1..20: note = CRISPR gRNA sequence
  source 1..20: mol_type = other DNA
tgactgcaaacaggtagaaa

SEQ ID NO: 76853 - DNA, 20 bp, synthetic construct
  misc_feature 1..20: note = CRISPR gRNA sequence
  source 1..20: mol_type = other DNA
caaacaggtagaaactgaat

SEQ ID NO: 76854 - DNA, 20 bp, synthetic construct
  misc_feature 1..20: note = CRISPR gRNA sequence
  source 1..20: mol_type = other DNA
aatatgcaaataggcaagga

SEQ ID NO: 76855 - DNA, 20 bp, synthetic construct
  misc_feature 1..20: note = CRISPR gRNA sequence
  source 1..20: mol_type = other DNA
tggacacatgacaacatgga

SEQ ID NO: 76856 - DNA, 20 bp, synthetic construct
  misc_feature 1..20: note = CRISPR gRNA sequence
  source 1..20: mol_type = other DNA
gatgagagaagaggttgttt

SEQ ID NO: 76857 - DNA, 20 bp, synthetic construct
  misc_feature 1..20: note = CRISPR gRNA sequence
  source 1..20: mol_type = other DNA
atgagagaagaggttgttta

SEQ ID NO: 76858 - DNA, 20 bp, synthetic construct
  misc_feature 1..20: note = CRISPR gRNA sequence
  source 1..20: mol_type = other DNA
tttaggtgaggcaggttttg

SEQ ID NO: 76859 - DNA, 20 bp, synthetic construct
  misc_feature 1..20: note = CRISPR gRNA sequence
  source 1..20: mol_type = other DNA
aggtgaggcaggttttgtct

SEQ ID NO: 76860 - DNA, 20 bp, synthetic construct
  misc_feature 1..20: note = CRISPR gRNA sequence
  source 1..20: mol_type = other DNA
ggtgaggcaggttttgtctt

SEQ ID NO: 76861 - DNA, 20 bp, synthetic construct
  misc_feature 1..20: note = CRISPR gRNA sequence
  source 1..20: mol_type = other DNA
tgtcttggatttctttattt

SEQ ID NO: 76862 - DNA, 20 bp, synthetic construct
  misc_feature 1..20: note = CRISPR gRNA sequence
  source 1..20: mol_type = other DNA
gtcttggatttctttatttt

SEQ ID NO: 76863 - DNA, 20 bp, synthetic construct
  misc_feature 1..20: note = CRISPR gRNA sequence
  source 1..20: mol_type = other DNA
tcttggatttctttatttta

SEQ ID NO: 76864 - DNA, 20 bp, synthetic construct
  misc_feature 1..20: note = CRISPR gRNA sequence
  source 1..20: mol_type = other DNA
ggatttctttattttaaggt

SEQ ID NO: 76865 - DNA, 20 bp, synthetic construct
  misc_feature 1..20: note = CRISPR gRNA sequence
  source 1..20: mol_type = other DNA
gatttctttattttaaggta

SEQ ID NO: 76866 - DNA, 20 bp, synthetic construct
  misc_feature 1..20: note = CRISPR gRNA sequence
  source 1..20: mol_type = other DNA
ctttattttaaggtaattac

SEQ ID NO: 76867 - DNA, 20 bp, synthetic construct
  misc_feature 1..20: note = CRISPR gRNA sequence
  source 1..20: mol_type = other DNA
tttattttaaggtaattact

SEQ ID NO: 76868 - DNA, 20 bp, synthetic construct
  misc_feature 1..20: note = CRISPR gRNA sequence
  source 1..20: mol_type = other DNA
tattttaaggtaattactat

SEQ ID NO: 76869 - DNA, 20 bp, synthetic construct
  misc_feature 1..20: note = CRISPR gRNA sequence
  source 1..20: mol_type = other DNA
attttaaggtaattactata

SEQ ID NO: 76870 - DNA, 20 bp, synthetic construct
  misc_feature 1..20: note = CRISPR gRNA sequence
  source 1..20: mol_type = other DNA
ttttaaggtaattactataa

SEQ ID NO: 76871 - DNA, 20 bp, synthetic construct
  misc_feature 1..20: note = CRISPR gRNA sequence
  source 1..20: mol_type = other DNA
taaggtaattactataatag

SEQ ID NO: 76872 - DNA, 20 bp, synthetic construct
  misc_feature 1..20: note = CRISPR gRNA sequence
  source 1..20: mol_type = other DNA
aaggtaattactataataga

SEQ ID NO: 76873 - DNA, 20 bp, synthetic construct
  misc_feature 1..20: note = CRISPR gRNA sequence
  source 1..20: mol_type = other DNA
aggtaattactataatagaa

SEQ ID NO: 76874 - DNA, 20 bp, synthetic construct
  misc_feature 1..20: note = CRISPR gRNA sequence
  source 1..20: mol_type = other DNA
ctataatagaatcaccacaa

SEQ ID NO: 76875 - DNA, 20 bp, synthetic construct
  misc_feature 1..20: note = CRISPR gRNA sequence
  source 1..20: mol_type = other DNA
taatagaatcaccacaatga

SEQ ID NO: 76876 - DNA, 20 bp, synthetic construct
  misc_feature 1..20: note = CRISPR gRNA sequence
  source 1..20: mol_type = other DNA
accatccactgtgcagatga

SEQ ID NO: 76877 - DNA, 20 bp, synthetic construct
  misc_feature 1..20: note = CRISPR gRNA sequence
  source 1..20: mol_type = other DNA
tgcagatgaagaagctgagg

SEQ ID NO: 76878 - DNA, 20 bp, synthetic construct
  misc_feature 1..20: note = CRISPR gRNA sequence
  source 1..20: mol_type = other DNA
aggcccggggagttaaatcc

SEQ ID NO: 76879 - DNA, 20 bp, synthetic construct
  misc_feature 1..20: note = CRISPR gRNA sequence
  source 1..20: mol_type = other DNA
aatcccttttgagccaagag

SEQ ID NO: 76880 - DNA, 20 bp, synthetic construct
  misc_feature 1..20: note = CRISPR gRNA sequence
  source 1..20: mol_type = other DNA
ttgagccaagagtcctgatt

SEQ ID NO: 76881 - DNA, 20 bp, synthetic construct
  misc_feature 1..20: note = CRISPR gRNA sequence
  source 1..20: mol_type = other DNA
tgagccaagagtcctgattc

SEQ ID NO: 76882 - DNA, 20 bp, synthetic construct
  misc_feature 1..20: note = CRISPR gRNA sequence
  source 1..20: mol_type = other DNA
gagccaagagtcctgattcc

SEQ ID NO: 76883 - DNA, 20 bp, synthetic construct
  misc_feature 1..20: note = CRISPR gRNA sequence
  source 1..20: mol_type = other DNA
agccaagagtcctgattcca

SEQ ID NO: 76884 - DNA, 20 bp, synthetic construct
  misc_feature 1..20: note = CRISPR gRNA sequence
  source 1..20: mol_type = other DNA
attccaggtccagtctctgg

SEQ ID NO: 76885 - DNA, 20 bp, synthetic construct
  misc_feature 1..20: note = CRISPR gRNA sequence
  source 1..20: mol_type = other DNA
caggtccagtctctggttac

SEQ ID NO: 76886 - DNA, 20 bp, synthetic construct
  misc_feature 1..20: note = CRISPR gRNA sequence
  source 1..20: mol_type = other DNA
tggttacagacccagatgtt

SEQ ID NO: 76887 - DNA, 20 bp, synthetic construct
  misc_feature 1..20: note = CRISPR gRNA sequence
  source 1..20: mol_type = other DNA
gttacagacccagatgttct

SEQ ID NO: 76888 - DNA, 20 bp, synthetic construct
  misc_feature 1..20: note = CRISPR gRNA sequence
  source 1..20: mol_type = other DNA
cagacccagatgttctgggg

SEQ ID NO: 76889 - DNA, 20 bp, synthetic construct
  misc_feature 1..20: note = CRISPR gRNA sequence
  source 1..20: mol_type = other DNA
tggggcgagtgaggtggtaa

SEQ ID NO: 76890 - DNA, 20 bp, synthetic construct
  misc_feature 1..20: note = CRISPR gRNA sequence
  source 1..20: mol_type = other DNA
gggcgagtgaggtggtaacc

SEQ ID NO: 76891 - DNA, 20 bp, synthetic construct
  misc_feature 1..20: note = CRISPR gRNA sequence
  source 1..20: mol_type = other DNA
gaggaagggctttcagaagt

SEQ ID NO: 76892 - DNA, 20 bp, synthetic construct
  misc_feature 1..20: note = CRISPR gRNA sequence
  source 1..20: mol_type = other DNA
aggaagggctttcagaagtg

SEQ ID NO: 76893 - DNA, 20 bp, synthetic construct
  misc_feature 1..20: note = CRISPR gRNA sequence
  source 1..20: mol_type = other DNA
tcagaagtgctacgctccag

SEQ ID NO: 76894 - DNA, 20 bp, synthetic construct
  misc_feature 1..20: note = CRISPR gRNA sequence
  source 1..20: mol_type = other DNA
cagaagtgctacgctccagc

SEQ ID NO: 76895 - DNA, 20 bp, synthetic construct
  misc_feature 1..20: note = CRISPR gRNA sequence
  source 1..20: mol_type = other DNA
agaagtgctacgctccagcc

SEQ ID NO: 76896 - DNA, 20 bp, synthetic construct
  misc_feature 1..20: note = CRISPR gRNA sequence
  source 1..20: mol_type = other DNA
cgctccagccatgcaggcag

SEQ ID NO: 76897 - DNA, 20 bp, synthetic construct
  misc_feature 1..20: note = CRISPR gRNA sequence
  source 1..20: mol_type = other DNA
cagccatgcaggcaggttca

SEQ ID NO: 76898 - DNA, 20 bp, synthetic construct
  misc_feature 1..20: note = CRISPR gRNA sequence
  source 1..20: mol_type = other DNA
aagtgggtgccctggtgagg

SEQ ID NO: 76899 - DNA, 20 bp, synthetic construct
  misc_feature 1..20: note = CRISPR gRNA sequence
  source 1..20: mol_type = other DNA
gtgaggctccaggggtgggg

SEQ ID NO: 76900 - DNA, 20 bp, synthetic construct
  misc_feature 1..20: note = CRISPR gRNA sequence
  source 1..20: mol_type = other DNA
caggggtggggttggaggtg

SEQ ID NO: 76901 - DNA, 20 bp, synthetic construct
  misc_feature 1..20: note = CRISPR gRNA sequence
  source 1..20: mol_type = other DNA
gaggtggacagggctcccag

SEQ ID NO: 76902 - DNA, 20 bp, synthetic construct
  misc_feature 1..20: note = CRISPR gRNA sequence
  source 1..20: mol_type = other DNA
ccaggtgccctgagttgagt

SEQ ID NO: 76903 - DNA, 20 bp, synthetic construct
  misc_feature 1..20: note = CRISPR gRNA sequence
  source 1..20: mol_type = other DNA
agttgagtggatggtgcagg

SEQ ID NO: 76904 - DNA, 20 bp, synthetic construct
  misc_feature 1..20: note = CRISPR gRNA sequence
  source 1..20: mol_type = other DNA
agtggatggtgcaggtgaag

SEQ ID NO: 76905 - DNA, 20 bp, synthetic construct
  misc_feature 1..20: note = CRISPR gRNA sequence
  source 1..20: mol_type = other DNA
ccccagtccagcacagcatc

SEQ ID NO: 76906 - DNA, 20 bp, synthetic construct
  misc_feature 1..20: note = CRISPR gRNA sequence
  source 1..20: mol_type = other DNA
cccagtccagcacagcatct

SEQ ID NO: 76907 - DNA, 20 bp, synthetic construct
  misc_feature 1..20: note = CRISPR gRNA sequence
  source 1..20: mol_type = other DNA
ccagtgggagacatgcgctg

SEQ ID NO: 76908 - DNA, 20 bp, synthetic construct
  misc_feature 1..20: note = CRISPR gRNA sequence
  source 1..20: mol_type = other DNA
cctaaggctgggggctgccg

SEQ ID NO: 76909 - DNA, 20 bp, synthetic construct
  misc_feature 1..20: note = CRISPR gRNA sequence
  source 1..20: mol_type = other DNA
aggctgggggctgccgagag

SEQ ID NO: 76910 - DNA, 20 bp, synthetic construct
  misc_feature 1..20: note = CRISPR gRNA sequence
  source 1..20: mol_type = other DNA
ggggctgccgagagacagcc

SEQ ID NO: 76911 - DNA, 20 bp, synthetic construct
  misc_feature 1..20: note = CRISPR gRNA sequence
  source 1..20: mol_type = other DNA
ccgagagacagccaagtttc

SEQ ID NO: 76912 - DNA, 20 bp, synthetic construct
  misc_feature 1..20: note = CRISPR gRNA sequence
  source 1..20: mol_type = other DNA
ctaccaaaggccaggggact

SEQ ID NO: 76913 - DNA, 20 bp, synthetic construct
  misc_feature 1..20: note = CRISPR gRNA sequence
  source 1..20: mol_type = other DNA
taccaaaggccaggggactc

SEQ ID NO: 76914 - DNA, 20 bp, synthetic construct
  misc_feature 1..20: note = CRISPR gRNA sequence
  source 1..20: mol_type = other DNA
ccaaaggccaggggactctc

SEQ ID NO: 76915 - DNA, 20 bp, synthetic construct
  misc_feature 1..20: note = CRISPR gRNA sequence
  source 1..20: mol_type = other DNA
tcatggggcagggctggtgg

SEQ ID NO: 76916 - DNA, 20 bp, synthetic construct
  misc_feature 1..20: note = CRISPR gRNA sequence
  source 1..20: mol_type = other DNA
atggggcagggctggtggga

SEQ ID NO: 76917 - DNA, 20 bp, synthetic construct
  misc_feature 1..20: note = CRISPR gRNA sequence
  source 1..20: mol_type = other DNA
gtgggaagaaatcgagaaag

SEQ ID NO: 76918 - DNA, 20 bp, synthetic construct
  misc_feature 1..20: note = CRISPR gRNA sequence
  source 1..20: mol_type = other DNA
acctgtcttctaaccaagaa

SEQ ID NO: 76919 - DNA, 20 bp, synthetic construct
  misc_feature 1..20: note = CRISPR gRNA sequence
  source 1..20: mol_type = other DNA
tcttctaaccaagaagcccc

SEQ ID NO: 76920 - DNA, 20 bp, synthetic construct
  misc_feature 1..20: note = CRISPR gRNA sequence
  source 1..20: mol_type = other DNA
ctaaccaagaagccccctcc

SEQ ID NO: 76921 - DNA, 20 bp, synthetic construct
  misc_feature 1..20: note = CRISPR gRNA sequence
  source 1..20: mol_type = other DNA
taaccaagaagccccctccc

SEQ ID NO: 76922 - DNA, 20 bp, synthetic construct
  misc_feature 1..20: note = CRISPR gRNA sequence
  source 1..20: mol_type = other DNA
accaagaagccccctcccag

SEQ ID NO: 76923 - DNA, 20 bp, synthetic construct
  misc_feature 1..20: note = CRISPR gRNA sequence
  source 1..20: mol_type = other DNA
ccaggtcactgggcagatcc

SEQ ID NO: 76924 - DNA, 20 bp, synthetic construct
  misc_feature 1..20: note = CRISPR gRNA sequence
  source 1..20: mol_type = other DNA
ggcagatccccacatggtgc

SEQ ID NO: 76925 - DNA, 20 bp, synthetic construct
  misc_feature 1..20: note = CRISPR gRNA sequence
  source 1..20: mol_type = other DNA
tggggctgtgtcctcgttac

SEQ ID NO: 76926 - DNA, 20 bp, synthetic construct
  misc_feature 1..20: note = CRISPR gRNA sequence
  source 1..20: mol_type = other DNA
gggctgtgtcctcgttactt

SEQ ID NO: 76927 - DNA, 20 bp, synthetic construct
  misc_feature 1..20: note = CRISPR gRNA sequence
  source 1..20: mol_type = other DNA
tgtcctcgttacttactgca

SEQ ID NO: 76928 - DNA, 20 bp, synthetic construct
  misc_feature 1..20: note = CRISPR gRNA sequence
  source 1..20: mol_type = other DNA
gttacttactgcagttccag

SEQ ID NO: 76929 - DNA, 20 bp, synthetic construct
  misc_feature 1..20: note = CRISPR gRNA sequence
  source 1..20: mol_type = other DNA
cttactgcagttccaggggt

SEQ ID NO: 76930 - DNA, 20 bp, synthetic construct
  misc_feature 1..20: note = CRISPR gRNA sequence
  source 1..20: mol_type = other DNA
actgcagttccaggggtccc

SEQ ID NO: 76931 - DNA, 20 bp, synthetic construct
  misc_feature 1..20: note = CRISPR gRNA sequence
  source 1..20: mol_type = other DNA
ctgcagttccaggggtcccg

SEQ ID NO: 76932 - DNA, 20 bp, synthetic construct
  misc_feature 1..20: note = CRISPR gRNA sequence
  source 1..20: mol_type = other DNA
cagttccaggggtcccgggc

SEQ ID NO: 76933 - DNA, 20 bp, synthetic construct
  misc_feature 1..20: note = CRISPR gRNA sequence
  source 1..20: mol_type = other DNA
caggggtcccgggcagtcct

SEQ ID NO: 76934 - DNA, 20 bp, synthetic construct
  misc_feature 1..20: note = CRISPR gRNA sequence
  source 1..20: mol_type = other DNA
cagagtggcacagaggcggg

SEQ ID NO: 76935 - DNA, 20 bp, synthetic construct
  misc_feature 1..20: note = CRISPR gRNA sequence
  source 1..20: mol_type = other DNA
agagtggcacagaggcgggt

SEQ ID NO: 76936 - DNA, 20 bp, synthetic construct
  misc_feature 1..20: note = CRISPR gRNA sequence
  source 1..20: mol_type = other DNA
gggggctccagaggacactc

SEQ ID NO: 76937 - DNA, 20 bp, synthetic construct
  misc_feature 1..20: note = CRISPR gRNA sequence
  source 1..20: mol_type = other DNA
ggggctccagaggacactca

SEQ ID NO: 76938 - DNA, 20 bp, synthetic construct
  misc_feature 1..20: note = CRISPR gRNA sequence
  source 1..20: mol_type = other DNA
cagaggacactcactgaggc

SEQ ID NO: 76939 - DNA, 20 bp, synthetic construct
  misc_feature 1..20: note = CRISPR gRNA sequence
  source 1..20: mol_type = other DNA
actgaggctgcaaaggggca

SEQ ID NO: 76940 - DNA, 20 bp, synthetic construct
  misc_feature 1..20: note = CRISPR gRNA sequence
  source 1..20: mol_type = other DNA
aggctgcaaaggggcaatgg

SEQ ID NO: 76941 - DNA, 20 bp, synthetic construct
  misc_feature 1..20: note = CRISPR gRNA sequence
  source 1..20: mol_type = other DNA
caaaggggcaatgggcaggg

SEQ ID NO: 76942 - DNA, 20 bp, synthetic construct
  misc_feature 1..20: note = CRISPR gRNA sequence
  source 1..20: mol_type = other DNA
gctagccccaggggctctat

SEQ ID NO: 76943 - DNA, 20 bp, synthetic construct
  misc_feature 1..20: note = CRISPR gRNA sequence
  source 1..20: mol_type = other DNA
gccccaggggctctatcctt

SEQ ID NO: 76944 - DNA, 20 bp, synthetic construct
  misc_feature 1..20: note = CRISPR gRNA sequence
  source 1..20: mol_type = other DNA
tatccttctcccagcatccc

SEQ ID NO: 76945 - DNA, 20 bp, synthetic construct
  misc_feature 1..20: note = CRISPR gRNA sequence
  source 1..20: mol_type = other DNA
tccttctcccagcatccctc

SEQ ID NO: 76946 - DNA, 20 bp, synthetic construct
  misc_feature 1..20: note = CRISPR gRNA sequence
  source 1..20: mol_type = other DNA
ctcccagcatccctcactct

SEQ ID NO: 76947 - DNA, 20 bp, synthetic construct
  misc_feature 1..20: note = CRISPR gRNA sequence
  source 1..20: mol_type = other DNA
tcccagcatccctcactcta

SEQ ID NO: 76948 - DNA, 20 bp, synthetic construct
  misc_feature 1..20: note = CRISPR gRNA sequence
  source 1..20: mol_type = other DNA
ccagcatccctcactctaag

SEQ ID NO: 76949 - DNA, 20 bp, synthetic construct
  misc_feature 1..20: note = CRISPR gRNA sequence
  source 1..20: mol_type = other DNA
actctaagtgggaggccaca

SEQ ID NO: 76950 - DNA, 20 bp, synthetic construct
  misc_feature 1..20: note = CRISPR gRNA sequence
  source 1..20: mol_type = other DNA
taagtgggaggccacaggcc

SEQ ID NO: 76951 - DNA, 20 bp, synthetic construct
  misc_feature 1..20: note = CRISPR gRNA sequence
  source 1..20: mol_type = other DNA
agtgggaggccacaggcccc

SEQ ID NO: 76952 - DNA, 20 bp, synthetic construct
  misc_feature 1..20: note = CRISPR gRNA sequence
  source 1..20: mol_type = other DNA
cccctgtggggcactcgctt

SEQ ID NO: 76953 - DNA, 20 bp, synthetic construct
  misc_feature 1..20: note = CRISPR gRNA sequence
  source 1..20: mol_type = other DNA
ccctgtggggcactcgcttc

SEQ ID NO: 76954 - DNA, 20 bp, synthetic construct
  misc_feature 1..20: note = CRISPR gRNA sequence
  source 1..20: mol_type = other DNA
tggggcactcgcttccctct

SEQ ID NO: 76955 - DNA, 20 bp, synthetic construct
  misc_feature 1..20: note = CRISPR gRNA sequence
  source 1..20: mol_type = other DNA
gcttccctctcgagtctccc

SEQ ID NO: 76956 - DNA, 20 bp, synthetic construct
  misc_feature 1..20: note = CRISPR gRNA sequence
  source 1..20: mol_type = other DNA
ccctctcgagtctcccctgc

SEQ ID NO: 76957 - DNA, 20 bp, synthetic construct
  misc_feature 1..20: note = CRISPR gRNA sequence
  source 1..20: mol_type = other DNA
cctctcgagtctcccctgca

SEQ ID NO: 76958 - DNA, 20 bp, synthetic construct
  misc_feature 1..20: note = CRISPR gRNA sequence
  source 1..20: mol_type = other DNA
tcgagtctcccctgcagccc

SEQ ID NO: 76959 - DNA, 20 bp, synthetic construct
  misc_feature 1..20: note = CRISPR gRNA sequence
  source 1..20: mol_type = other DNA
gagtctcccctgcagccccc

SEQ ID NO: 76960 - DNA, 20 bp, synthetic construct
  misc_feature 1..20: note = CRISPR gRNA sequence
  source 1..20: mol_type = other DNA
ccctgcagcccccaatcctc

SEQ ID NO: 76961 - DNA, 20 bp, synthetic construct
  misc_feature 1..20: note = CRISPR gRNA sequence
  source 1..20: mol_type = other DNA
cagcccccaatcctcctgcc

SEQ ID NO: 76962 - DNA, 20 bp, synthetic construct
  misc_feature 1..20: note = CRISPR gRNA sequence
  source 1..20: mol_type = other DNA
ctgccctgacagtgacagtg

SEQ ID NO: 76963 - DNA, 20 bp, synthetic construct
  misc_feature 1..20: note = CRISPR gRNA sequence
  source 1..20: mol_type = other DNA
ccctgacagtgacagtgcag

SEQ ID NO: 76964 - DNA, 20 bp, synthetic construct
  misc_feature 1..20: note = CRISPR gRNA sequence
  source 1..20: mol_type = other DNA
acagtgacagtgcaggaccc

SEQ ID NO: 76965 - DNA, 20 bp, synthetic construct
  misc_feature 1..20: note = CRISPR gRNA sequence
  source 1..20: mol_type = other DNA
agttcccagctgcccttgtc

SEQ ID NO: 76966 - DNA, 20 bp, synthetic construct
  misc_feature 1..20: note = CRISPR gRNA sequence
  source 1..20: mol_type = other DNA
ccagctgcccttgtcagtga

SEQ ID NO: 76967 - DNA, 20 bp, synthetic construct
  misc_feature 1..20: note = CRISPR gRNA sequence
  source 1..20: mol_type = other DNA
cccttgtcagtgactctcca

SEQ ID NO: 76968 - DNA, 20 bp, synthetic construct
  misc_feature 1..20: note = CRISPR gRNA sequence
  source 1..20: mol_type = other DNA
gtcagtgactctccaagtcc

SEQ ID NO: 76969 - DNA, 20 bp, synthetic construct
  misc_feature 1..20: note = CRISPR gRNA sequence
  source 1..20: mol_type = other DNA
tcagtgactctccaagtcct

SEQ ID NO: 76970 - DNA, 20 bp, synthetic construct
  misc_feature 1..20: note = CRISPR gRNA sequence
  source 1..20: mol_type = other DNA
tccaagtcctccccaccgcc

SEQ ID NO: 76971 - DNA, 20 bp, synthetic construct
  misc_feature 1..20: note = CRISPR gRNA sequence
  source 1..20: mol_type = other DNA
caagtcctccccaccgcccc

SEQ ID NO: 76972 - DNA, 20 bp, synthetic construct
  misc_feature 1..20: note = CRISPR gRNA sequence
  source 1..20: mol_type = other DNA
cccaccgccccctccagagc

SEQ ID NO: 76973 - DNA, 20 bp, synthetic construct
  misc_feature 1..20: note = CRISPR gRNA sequence
  source 1..20: mol_type = other DNA
cagagcccaggccaccatcc

SEQ ID NO: 76974 - DNA, 20 bp, synthetic construct
  misc_feature 1..20: note = CRISPR gRNA sequence
  source 1..20: mol_type = other DNA
actcaccttgaccatttaac

SEQ ID NO: 76975 - DNA, 20 bp, synthetic construct
  misc_feature 1..20: note = CRISPR gRNA sequence
  source 1..20: mol_type = other DNA
accttgaccatttaacaccc

SEQ ID NO: 76976 - DNA, 20 bp, synthetic construct
  misc_feature 1..20: note = CRISPR gRNA sequence
  source 1..20: mol_type = other DNA
gaccatttaacaccctctgg

SEQ ID NO: 76977 - DNA, 20 bp, synthetic construct
  misc_feature 1..20: note = CRISPR gRNA sequence
  source 1..20: mol_type = other DNA
accatttaacaccctctggg

SEQ ID NO: 76978 - DNA, 20 bp, synthetic construct
  misc_feature 1..20: note = CRISPR gRNA sequence
  source 1..20: mol_type = other DNA
aacaccctctgggcttccac

SEQ ID NO: 76979 - DNA, 20 bp, synthetic construct
  misc_feature 1..20: note = CRISPR gRNA sequence
  source 1..20: mol_type = other DNA
acaccctctgggcttccact

SEQ ID NO: 76980 - DNA, 20 bp, synthetic construct
  misc_feature 1..20: note = CRISPR gRNA sequence
  source 1..20: mol_type = other DNA
tgggcttccactcttgcctc

SEQ ID NO: 76981 - DNA, 20 bp, synthetic construct
  misc_feature 1..20: note = CRISPR gRNA sequence
  source 1..20: mol_type = other DNA
ggcttccactcttgcctccc

SEQ ID NO: 76982 - DNA, 20 bp, synthetic construct
  misc_feature 1..20: note = CRISPR gRNA sequence
  source 1..20: mol_type = other DNA
ccactcttgcctccctttaa

SEQ ID NO: 76983 - DNA, 20 bp, synthetic construct
  misc_feature 1..20: note = CRISPR gRNA sequence
  source 1..20: mol_type = other DNA
cactcttgcctccctttaat

SEQ ID NO: 76984 - DNA, 20 bp, synthetic construct
  misc_feature 1..20: note = CRISPR gRNA sequence
  source 1..20: mol_type = other DNA
ttgcctccctttaatccctc

SEQ ID NO: 76985 - DNA, 20 bp, synthetic construct
  misc_feature 1..20: note = CRISPR gRNA sequence
  source 1..20: mol_type = other DNA
gcctccctttaatccctctc

SEQ ID NO: 76986 - DNA, 20 bp, synthetic construct
  misc_feature 1..20: note = CRISPR gRNA sequence
  source 1..20: mol_type = other DNA
cctccctttaatccctctct

SEQ ID NO: 76987 - DNA, 20 bp, synthetic construct
  misc_feature 1..20: note = CRISPR gRNA sequence
  source 1..20: mol_type = other DNA
cctttaatccctctctgccc

SEQ ID NO: 76988 - DNA, 20 bp, synthetic construct
  misc_feature 1..20: note = CRISPR gRNA sequence
  source 1..20: mol_type = other DNA
taatccctctctgccccaca

SEQ ID NO: 76989 - DNA, 20 bp, synthetic construct
  misc_feature 1..20: note = CRISPR gRNA sequence
  source 1..20: mol_type = other DNA
aatccctctctgccccacaa

SEQ ID NO: 76990 - DNA, 20 bp, synthetic construct
  misc_feature 1..20: note = CRISPR gRNA sequence
  source 1..20: mol_type = other DNA
atccctctctgccccacaag

SEQ ID NO: 76991 - DNA, 20 bp, synthetic construct
  misc_feature 1..20: note = CRISPR gRNA sequence
  source 1..20: mol_type = other DNA
tctgccccacaagtgtctca

SEQ ID NO: 76992 - DNA, 20 bp, synthetic construct
  misc_feature 1..20: note = CRISPR gRNA sequence
  source 1..20: mol_type = other DNA
tgccccacaagtgtctcaca

SEQ ID NO: 76993 - DNA, 20 bp, synthetic construct
  misc_feature 1..20: note = CRISPR gRNA sequence
  source 1..20: mol_type = other DNA
ccccacaagtgtctcacatt

SEQ ID NO: 76994 - DNA, 20 bp, synthetic construct
  misc_feature 1..20: note = CRISPR gRNA sequence
  source 1..20: mol_type = other DNA
acattttaacactgcacatc

SEQ ID NO: 76995 - DNA, 20 bp, synthetic construct
  misc_feature 1..20: note = CRISPR gRNA sequence
  source 1..20: mol_type = other DNA
taacactgcacatctgacca

SEQ ID NO: 76996 - DNA, 20 bp, synthetic construct
  misc_feature 1..20: note = CRISPR gRNA sequence
  source 1..20: mol_type = other DNA
aacactgcacatctgaccag

SEQ ID NO: 76997 - DNA, 20 bp, synthetic construct
  misc_feature 1..20: note = CRISPR gRNA sequence
  source 1..20: mol_type = other DNA
acactgcacatctgaccagg

SEQ ID NO: 76998 - DNA, 20 bp, synthetic construct
  misc_feature 1..20: note = CRISPR gRNA sequence
  source 1..20: mol_type = other DNA
cacatctgaccaggcctctc

SEQ ID NO: 76999 - DNA, 20 bp, synthetic construct
  misc_feature 1..20: note = CRISPR gRNA sequence
  source 1..20: mol_type = other DNA
accaggcctctccctgttac

SEQ ID NO: 77000 - DNA, 20 bp, synthetic construct
  misc_feature 1..20: note = CRISPR gRNA sequence
  source 1..20: mol_type = other DNA
tccctgttacccccgtggct

SEQ ID NO: 77001 - DNA, 20 bp, synthetic construct
  misc_feature 1..20: note = CRISPR gRNA sequence
  source 1..20: mol_type = other DNA
cctgttacccccgtggctcc

SEQ ID NO: 77002 - DNA, 20 bp, synthetic construct
  misc_feature 1..20: note = CRISPR gRNA sequence
  source 1..20: mol_type = other DNA
ttacccccgtggctccccat

SEQ ID NO: 77003 - DNA, 20 bp, synthetic construct
  misc_feature 1..20: note = CRISPR gRNA sequence
  source 1..20: mol_type = other DNA
cccccgtggctccccattgc

SEQ ID NO: 77004 - DNA, 20 bp, synthetic construct
  misc_feature 1..20: note = CRISPR gRNA sequence
  source 1..20: mol_type = other DNA
cccattgccctggggctaac

SEQ ID NO: 77005 - DNA, 20 bp, synthetic construct
  misc_feature 1..20: note = CRISPR gRNA sequence
  source 1..20: mol_type = other DNA
ccctggggctaacagtgaaa

SEQ ID NO: 77006 - DNA, 20 bp, synthetic construct
  misc_feature 1..20: note = CRISPR gRNA sequence
  source 1..20: mol_type = other DNA
gggctaacagtgaaattgaa

SEQ ID NO: 77007 - DNA, 20 bp, synthetic construct
  misc_feature 1..20: note = CRISPR gRNA sequence
  source 1..20: mol_type = other DNA
acagtgaaattgaaatgtcc

SEQ ID NO: 77008 - DNA, 20 bp, synthetic construct
  misc_feature 1..20: note = CRISPR gRNA sequence
  source 1..20: mol_type = other DNA
aaatgtccttcccagggcct

SEQ ID NO: 77009 - DNA, 20 bp, synthetic construct
  misc_feature 1..20: note = CRISPR gRNA sequence
  source 1..20: mol_type = other DNA
cccagggcctcacttgcctc

SEQ ID NO: 77010 - DNA, 20 bp, synthetic construct
  misc_feature 1..20: note = CRISPR gRNA sequence
  source 1..20: mol_type = other DNA
ccagggcctcacttgcctcc

SEQ ID NO: 77011 - DNA, 20 bp, synthetic construct
  misc_feature 1..20: note = CRISPR gRNA sequence
  source 1..20: mol_type = other DNA
acttgcctccacttccctgg

SEQ ID NO: 77012 - DNA, 20 bp, synthetic construct
  misc_feature 1..20: note = CRISPR gRNA sequence
  source 1..20: mol_type = other DNA
gcctccacttccctggaggc

SEQ ID NO: 77013 - DNA, 20 bp, synthetic construct
  misc_feature 1..20: note = CRISPR gRNA sequence
  source 1..20: mol_type = other DNA
cctccacttccctggaggcc

SEQ ID NO: 77014 - DNA, 20 bp, synthetic construct
  misc_feature 1..20: note = CRISPR gRNA sequence
  source 1..20: mol_type = other DNA
cacttccctggaggcctaga

SEQ ID NO: 77015 - DNA, 20 bp, synthetic construct
  misc_feature 1..20: note = CRISPR gRNA sequence
  source 1..20: mol_type = other DNA
ccctggaggcctagagagag

SEQ ID NO: 77016 - DNA, 20 bp, synthetic construct
  misc_feature 1..20: note = CRISPR gRNA sequence
  source 1..20: mol_type = other DNA
cctggaggcctagagagagg

SEQ ID NO: 77017 - DNA, 20 bp, synthetic construct
  misc_feature 1..20: note = CRISPR gRNA sequence
  source 1..20: mol_type = other DNA
gaggcctagagagaggtggg

SEQ ID NO: 77018 - DNA, 20 bp, synthetic construct
  misc_feature 1..20: note = CRISPR gRNA sequence
  source 1..20: mol_type = other DNA
gagagaggtggggccaagtc

SEQ ID NO: 77019 - DNA, 20 bp, synthetic construct
  misc_feature 1..20: note = CRISPR gRNA sequence
  source 1..20: mol_type = other DNA
acagcctctcatggcagagc

SEQ ID NO: 77020 - DNA, 20 bp, synthetic construct
  misc_feature 1..20: note = CRISPR gRNA sequence
  source 1..20: mol_type = other DNA
tcatggcagagcttgcagat

SEQ ID NO: 77021 - DNA, 20 bp, synthetic construct
  misc_feature 1..20: note = CRISPR gRNA sequence
  source 1..20: mol_type = other DNA
atggcagagcttgcagatgg

SEQ ID NO: 77022 - DNA, 20 bp, synthetic construct
  misc_feature 1..20: note = CRISPR gRNA sequence
  source 1..20: mol_type = other DNA
gcagatggggagtgtattag

SEQ ID NO: 77023 - DNA, 20 bp, synthetic construct
  misc_feature 1..20: note = CRISPR gRNA sequence
  source 1..20: mol_type = other DNA
cagatggggagtgtattagt

SEQ ID NO: 77024 - DNA, 20 bp, synthetic construct
  misc_feature 1..20: note = CRISPR gRNA sequence
  source 1..20: mol_type = other DNA
gtggggagacaggccaaccc

SEQ ID NO: 77025 - DNA, 20 bp, synthetic construct
  misc_feature 1..20: note = CRISPR gRNA sequence
  source 1..20: mol_type = other DNA
tctttctggaaagtgggtgt

SEQ ID NO: 77026 - DNA, 20 bp, synthetic construct
  misc_feature 1..20: note = CRISPR gRNA sequence
  source 1..20: mol_type = other DNA
ctttctggaaagtgggtgtc

SEQ ID NO: 77027 - DNA, 20 bp, synthetic construct
  misc_feature 1..20: note = CRISPR gRNA sequence
  source 1..20: mol_type = other DNA
tttctggaaagtgggtgtcc

SEQ ID NO: 77028 - DNA, 20 bp, synthetic construct
  misc_feature 1..20: note = CRISPR gRNA sequence
  source 1..20: mol_type = other DNA
tctggaaagtgggtgtcccc

SEQ ID NO: 77029 - DNA, 20 bp, synthetic construct
  misc_feature 1..20: note = CRISPR gRNA sequence
  source 1..20: mol_type = other DNA
ctggaaagtgggtgtccccc

SEQ ID NO: 77030 - DNA, 20 bp, synthetic construct
  misc_feature 1..20: note = CRISPR gRNA sequence
  source 1..20: mol_type = other DNA
tggaaagtgggtgtccccca

SEQ ID NO: 77031 - DNA, 20 bp, synthetic construct
  misc_feature 1..20: note = CRISPR gRNA sequence
  source 1..20: mol_type = other DNA
gaaagtgggtgtcccccaga

SEQ ID NO: 77032 - DNA, 20 bp, synthetic construct
  misc_feature 1..20: note = CRISPR gRNA sequence
  source 1..20: mol_type = other DNA
agctgctctgtttgcttcac

SEQ ID NO: 77033 - DNA, 20 bp, synthetic construct
  misc_feature 1..20: note = CRISPR gRNA sequence
  source 1..20: mol_type = other DNA
ctctgtttgcttcacagaaa

SEQ ID NO: 77034 - DNA, 20 bp, synthetic construct
  misc_feature 1..20: note = CRISPR gRNA sequence
  source 1..20: mol_type = other DNA
tgtttgcttcacagaaatgt

SEQ ID NO: 77035 - DNA, 20 bp, synthetic construct
  misc_feature 1..20: note = CRISPR gRNA sequence
  source 1..20: mol_type = other DNA
tttgcttcacagaaatgtgg

SEQ ID NO: 77036 - DNA, 20 bp, synthetic construct
  misc_feature 1..20: note = CRISPR gRNA sequence
  source 1..20: mol_type = other DNA
gcttcacagaaatgtggaat

SEQ ID NO: 77037 - DNA, 20 bp, synthetic construct
  misc_feature 1..20: note = CRISPR gRNA sequence
  source 1..20: mol_type = other DNA
cttcacagaaatgtggaatc

SEQ ID NO: 77038 - DNA, 20 bp, synthetic construct
  misc_feature 1..20: note = CRISPR gRNA sequence
  source 1..20: mol_type = other DNA
cacagaaatgtggaatcttc

SEQ ID NO: 77039 - DNA, 20 bp, synthetic construct
  misc_feature 1..20: note = CRISPR gRNA sequence
  source 1..20: mol_type = other DNA
acagaaatgtggaatcttct

SEQ ID NO: 77040 - DNA, 20 bp, synthetic construct
  misc_feature 1..20: note = CRISPR gRNA sequence
  source 1..20: mol_type = other DNA
ctctccaaggagaatgcggg

SEQ ID NO: 77041 - DNA, 20 bp, synthetic construct
  misc_feature 1..20: note = CRISPR gRNA sequence
  source 1..20: mol_type = other DNA
tctccaaggagaatgcgggg

SEQ ID NO: 77042 - DNA, 20 bp, synthetic construct
  misc_feature 1..20: note = CRISPR gRNA sequence
  source 1..20: mol_type = other DNA
tccaaggagaatgcggggca

SEQ ID NO: 77043 - DNA, 20 bp, synthetic construct
  misc_feature 1..20: note = CRISPR gRNA sequence
  source 1..20: mol_type = other DNA
caaggagaatgcggggcatg

SEQ ID NO: 77044 - DNA, 20 bp, synthetic construct
  misc_feature 1..20: note = CRISPR gRNA sequence
  source 1..20: mol_type = other DNA
agctgcccgtcaggggccag

SEQ ID NO: 77045 - DNA, 20 bp, synthetic construct
  misc_feature 1..20: note = CRISPR gRNA sequence
  source 1..20: mol_type = other DNA
cccgtcaggggccagagctc

SEQ ID NO: 77046 - DNA, 20 bp, synthetic construct
  misc_feature 1..20: note = CRISPR gRNA sequence
  source 1..20: mol_type = other DNA
cccaactcccagcacccctc

SEQ ID NO: 77047 - DNA, 20 bp, synthetic construct
  misc_feature 1..20: note = CRISPR gRNA sequence
  source 1..20: mol_type = other DNA
ccagcacccctcacacccac

SEQ ID NO: 77048 - DNA, 20 bp, synthetic construct
  misc_feature 1..20: note = CRISPR gRNA sequence
  source 1..20: mol_type = other DNA
acacccacgcctctttcttt

SEQ ID NO: 77049 - DNA, 20 bp, synthetic construct
  misc_feature 1..20: note = CRISPR gRNA sequence
  source 1..20: mol_type = other DNA
tttcttttccttttctctta

SEQ ID NO: 77050 - DNA, 20 bp, synthetic construct
  misc_feature 1..20: note = CRISPR gRNA sequence
  source 1..20: mol_type = other DNA
tcttttccttttctcttaaa

SEQ ID NO: 77051 - DNA, 20 bp, synthetic construct
  misc_feature 1..20: note = CRISPR gRNA sequence
  source 1..20: mol_type = other DNA
cttttccttttctcttaaac

SEQ ID NO: 77052 - DNA, 20 bp, synthetic construct
  misc_feature 1..20: note = CRISPR gRNA sequence
  source 1..20: mol_type = other DNA
ttttccttttctcttaaact

SEQ ID NO: 77053 - DNA, 20 bp, synthetic construct
  misc_feature 1..20: note = CRISPR gRNA sequence
  source 1..20: mol_type = other DNA
ttccttttctcttaaactcc

SEQ ID NO: 77054 - DNA, 20 bp, synthetic construct
  misc_feature 1..20: note = CRISPR gRNA sequence
  source 1..20: mol_type = other DNA
tccttttctcttaaactccc

SEQ ID NO: 77055 - DNA, 20 bp, synthetic construct
  misc_feature 1..20: note = CRISPR gRNA sequence
  source 1..20: mol_type = other DNA
ccttttctcttaaactccct

SEQ ID NO: 77056 - DNA, 20 bp, synthetic construct
  misc_feature 1..20: note = CRISPR gRNA sequence
  source 1..20: mol_type = other DNA
cttttctcttaaactccctc

SEQ ID NO: 77057 - DNA, 20 bp, synthetic construct
  misc_feature 1..20: note = CRISPR gRNA sequence
  source 1..20: mol_type = other DNA
ttctcttaaactccctctct

SEQ ID NO: 77058 - DNA, 20 bp, synthetic construct
  misc_feature 1..20: note = CRISPR gRNA sequence
  source 1..20: mol_type = other DNA
tctcttaaactccctctctt

SEQ ID NO: 77059 - DNA, 20 bp, synthetic construct
  misc_feature 1..20: note = CRISPR gRNA sequence
  source 1..20: mol_type = other DNA
ctcttaaactccctctcttc

SEQ ID NO: 77060 - DNA, 20 bp, synthetic construct
  misc_feature 1..20: note = CRISPR gRNA sequence
  source 1..20: mol_type = other DNA
tcttaaactccctctcttcc

SEQ ID NO: 77061 - DNA, 20 bp, synthetic construct
  misc_feature 1..20: note = CRISPR gRNA sequence
  source 1..20: mol_type = other DNA
ttaaactccctctcttccct

SEQ ID NO: 77062 - DNA, 20 bp, synthetic construct
  misc_feature 1..20: note = CRISPR gRNA sequence
  source 1..20: mol_type = other DNA
aaactccctctcttccctct

SEQ ID NO: 77063 - DNA, 20 bp, synthetic construct
  misc_feature 1..20: note = CRISPR gRNA sequence
  source 1..20: mol_type = other DNA
aactccctctcttccctcta

SEQ ID NO: 77064 - DNA, 20 bp, synthetic construct
  misc_feature 1..20: note = CRISPR gRNA sequence
  source 1..20: mol_type = other DNA
cctctcttccctctatccca

SEQ ID NO: 77065 - DNA, 20 bp, synthetic construct
  misc_feature 1..20: note = CRISPR gRNA sequence
  source 1..20: mol_type = other DNA
tcttccctctatcccaatcc

SEQ ID NO: 77066 - DNA, 20 bp, synthetic construct
  misc_feature 1..20: note = CRISPR gRNA sequence
  source 1..20: mol_type = other DNA
ttccctctatcccaatcccc

SEQ ID NO: 77067 - DNA, 20 bp, synthetic construct
  misc_feature 1..20: note = CRISPR gRNA sequence
  source 1..20: mol_type = other DNA
ccctctatcccaatccccag

SEQ ID NO: 77068 - DNA, 20 bp, synthetic construct
  misc_feature 1..20: note = CRISPR gRNA sequence
  source 1..20: mol_type = other DNA
cctctatcccaatccccagc

SEQ ID NO: 77069 - DNA, 20 bp, synthetic construct
  misc_feature 1..20: note = CRISPR gRNA sequence
  source 1..20: mol_type = other DNA
tatcccaatccccagcccta

SEQ ID NO: 77070 - DNA, 20 bp, synthetic construct
  misc_feature 1..20: note = CRISPR gRNA sequence
  source 1..20: mol_type = other DNA
tcccaatccccagccctagc

SEQ ID NO: 77071 - DNA, 20 bp, synthetic construct
  misc_feature 1..20: note = CRISPR gRNA sequence
  source 1..20: mol_type = other DNA
gccccctgccagctctgccc

SEQ ID NO: 77072 - DNA, 20 bp, synthetic construct
  misc_feature 1..20: note = CRISPR gRNA sequence
  source 1..20: mol_type = other DNA
ccagctctgccccctctgac

SEQ ID NO: 77073 - DNA, 20 bp, synthetic construct
  misc_feature 1..20: note = CRISPR gRNA sequence
  source 1..20: mol_type = other DNA
tgccccctctgacgcctcat

SEQ ID NO: 77074 - DNA, 20 bp, synthetic construct
  misc_feature 1..20: note = CRISPR gRNA sequence
  source 1..20: mol_type = other DNA
ccccctctgacgcctcatcc

SEQ ID NO: 77075 - DNA, 20 bp, synthetic construct
  misc_feature 1..20: note = CRISPR gRNA sequence
  source 1..20: mol_type = other DNA
tgacgcctcatccctattat

SEQ ID NO: 77076 - DNA, 20 bp, synthetic construct
  misc_feature 1..20: note = CRISPR gRNA sequence
  source 1..20: mol_type = other DNA
acgcctcatccctattatgg

SEQ ID NO: 77077 - DNA, 20 bp, synthetic construct
  misc_feature 1..20: note = CRISPR gRNA sequence
  source 1..20: mol_type = other DNA
atccctattatggttacccc

SEQ ID NO: 77078 - DNA, 20 bp, synthetic construct
  misc_feature 1..20: note = CRISPR gRNA sequence
  source 1..20: mol_type = other DNA
ttatggttacccccaaacaa

SEQ ID NO: 77079 - DNA, 20 bp, synthetic construct
  misc_feature 1..20: note = CRISPR gRNA sequence
  source 1..20: mol_type = other DNA
tggttacccccaaacaagaa

SEQ ID NO: 77080 - DNA, 20 bp, synthetic construct
  misc_feature 1..20: note = CRISPR gRNA sequence
  source 1..20: mol_type = other DNA
cccccaaacaagaagggctg

SEQ ID NO: 77081 - DNA, 20 bp, synthetic construct
  misc_feature 1..20: note = CRISPR gRNA sequence
  source 1..20: mol_type = other DNA
ggacagtaccagaggctcct

SEQ ID NO: 77082 - DNA, 20 bp, synthetic construct
  misc_feature 1..20: note = CRISPR gRNA sequence
  source 1..20: mol_type = other DNA
ctggggatgcagcgctgacg

SEQ ID NO: 77083 - DNA, 20 bp, synthetic construct
  misc_feature 1..20: note = CRISPR gRNA sequence
  source 1..20: mol_type = other DNA
gggatgcagcgctgacggaa

SEQ ID NO: 77084 - DNA, 20 bp, synthetic construct
  misc_feature 1..20: note = CRISPR gRNA sequence
  source 1..20: mol_type = other DNA
acggaaccctaagaacttgg

SEQ ID NO: 77085 - DNA, 20 bp, synthetic construct
  misc_feature 1..20: note = CRISPR gRNA sequence
  source 1..20: mol_type = other DNA
agaacttggctgcagctggg

SEQ ID NO: 77086 - DNA, 20 bp, synthetic construct
  misc_feature 1..20: note = CRISPR gRNA sequence
  source 1..20: mol_type = other DNA
ggctgcagctgggaagtctg

SEQ ID NO: 77087 - DNA, 20 bp, synthetic construct
  misc_feature 1..20: note = CRISPR gRNA sequence
  source 1..20: mol_type = other DNA
gctgcagctgggaagtctgg

SEQ ID NO: 77088 - DNA, 20 bp, synthetic construct
  misc_feature 1..20: note = CRISPR gRNA sequence
  source 1..20: mol_type = other DNA
cagctgggaagtctggcaaa

SEQ ID NO: 77089 - DNA, 20 bp, synthetic construct
  misc_feature 1..20: note = CRISPR gRNA sequence
  source 1..20: mol_type = other DNA
ggaagtctggcaaagatcca

SEQ ID NO: 77090 - DNA, 20 bp, synthetic construct
  misc_feature 1..20: note = CRISPR gRNA sequence
  source 1..20: mol_type = other DNA
gcaaagatccagtggcccac

SEQ ID NO: 77091 - DNA, 20 bp, synthetic construct
  misc_feature 1..20: note = CRISPR gRNA sequence
  source 1..20: mol_type = other DNA
ggagggggatcatttagaaa

SEQ ID NO: 77092 - DNA, 20 bp, synthetic construct
  misc_feature 1..20: note = CRISPR gRNA sequence
  source 1..20: mol_type = other DNA
agaaaggaaagttcagatca

SEQ ID NO: 77093 - DNA, 20 bp, synthetic construct
  misc_feature 1..20: note = CRISPR gRNA sequence
  source 1..20: mol_type = other DNA
gaaaggaaagttcagatcac

SEQ ID NO: 77094 - DNA, 20 bp, synthetic construct
  misc_feature 1..20: note = CRISPR gRNA sequence
  source 1..20: mol_type = other DNA
agatcaccccctcggactcc

SEQ ID NO: 77095 - DNA, 20 bp, synthetic construct
  misc_feature 1..20: note = CRISPR gRNA sequence
  source 1..20: mol_type = other DNA
ggactcccagcccagcccat

SEQ ID NO: 77096 - DNA, 20 bp, synthetic construct
  misc_feature 1..20: note = CRISPR gRNA sequence
  source 1..20: mol_type = other DNA
ccagcccagcccatataccc

SEQ ID NO: 77097 - DNA, 20 bp, synthetic construct
  misc_feature 1..20: note = CRISPR gRNA sequence
  source 1..20: mol_type = other DNA
ggagggggatcgtttagaaa

SEQ ID NO: 77098 - DNA, 20 bp, synthetic construct
  misc_feature 1..20: note = CRISPR gRNA sequence
  source 1..20: mol_type = other DNA
agaaaggaaagttcagatca

SEQ ID NO: 77099 - DNA, 20 bp, synthetic construct
  misc_feature 1..20: note = CRISPR gRNA sequence
  source 1..20: mol_type = other DNA
gaaaggaaagttcagatcac

SEQ ID NO: 77100 - DNA, 20 bp, synthetic construct
  misc_feature 1..20: note = CRISPR gRNA sequence
  source 1..20: mol_type = other DNA
agatcacccacattggactc

SEQ ID NO: 77101 - DNA, 20 bp, synthetic construct
  misc_feature 1..20: note = CRISPR gRNA sequence
  source 1..20: mol_type = other DNA
gactcccagacttggaaagt

SEQ ID NO: 77102 - DNA, 20 bp, synthetic construct
  misc_feature 1..20: note = CRISPR gRNA sequence
  source 1..20: mol_type = other DNA
ccagacttggaaagtcaggg

SEQ ID NO: 77103 - DNA, 20 bp, synthetic construct
  misc_feature 1..20: note = CRISPR gRNA sequence
  source 1..20: mol_type = other DNA
ggaaagtcagggctggaagg

SEQ ID NO: 77104 - DNA, 20 bp, synthetic construct
  misc_feature 1..20: note = CRISPR gRNA sequence
  source 1..20: mol_type = other DNA
gaaagtcagggctggaaggc

SEQ ID NO: 77105 - DNA, 20 bp, synthetic construct
  misc_feature 1..20: note = CRISPR gRNA sequence
  source 1..20: mol_type = other DNA
gaaggcatctcagagacaat

SEQ ID NO: 77106 - DNA, 20 bp, synthetic construct
  misc_feature 1..20: note = CRISPR gRNA sequence
  source 1..20: mol_type = other DNA
agagacaatgcagtcactag

SEQ ID NO: 77107 - DNA, 20 bp, synthetic construct
  misc_feature 1..20: note = CRISPR gRNA sequence
  source 1..20: mol_type = other DNA
gatcctagctcagtccctca

SEQ ID NO: 77108 - DNA, 20 bp, synthetic construct
  misc_feature 1..20: note = CRISPR gRNA sequence
  source 1..20: mol_type = other DNA
gctcagtccctcattgttca

SEQ ID NO: 77109 - DNA, 20 bp, synthetic construct
  misc_feature 1..20: note = CRISPR gRNA sequence
  source 1..20: mol_type = other DNA
agtccctcattgttcagatg

SEQ ID NO: 77110 - DNA, 20 bp, synthetic construct
  misc_feature 1..20: note = CRISPR gRNA sequence
  source 1..20: mol_type = other DNA
attgttcagatggggaaact

SEQ ID NO: 77111 - DNA, 20 bp, synthetic construct
  misc_feature 1..20: note = CRISPR gRNA sequence
  source 1..20: mol_type = other DNA
ttcagatggggaaactgagg

SEQ ID NO: 77112 - DNA, 20 bp, synthetic construct
  misc_feature 1..20: note = CRISPR gRNA sequence
  source 1..20: mol_type = other DNA
agatggggaaactgaggctc

SEQ ID NO: 77113 - DNA, 20 bp, synthetic construct
  misc_feature 1..20: note = CRISPR gRNA sequence
  source 1..20: mol_type = other DNA
aggctcagggaagggaagcc

SEQ ID NO: 77114 - DNA, 20 bp, synthetic construct
  misc_feature 1..20: note = CRISPR gRNA sequence
  source 1..20: mol_type = other DNA
agggaagggaagcctgagtt

SEQ ID NO: 77115 - DNA, 20 bp, synthetic construct
  misc_feature 1..20: note = CRISPR gRNA sequence
  source 1..20: mol_type = other DNA
agttagaaaagccagcagct

SEQ ID NO: 77116 - DNA, 20 bp, synthetic construct
  misc_feature 1..20: note = CRISPR gRNA sequence
  source 1..20: mol_type = other DNA
gaaaagccagcagcttgttc

SEQ ID NO: 77117 - DNA, 20 bp, synthetic construct
  misc_feature 1..20: note = CRISPR gRNA sequence
  source 1..20: mol_type = other DNA
gttcctgtccaggtgagcag

SEQ ID NO: 77118 - DNA, 20 bp, synthetic construct
  misc_feature 1..20: note = CRISPR gRNA sequence
  source 1..20: mol_type = other DNA
ttcctgtccaggtgagcagg

SEQ ID NO: 77119 - DNA, 20 bp, synthetic construct
  misc_feature 1..20: note = CRISPR gRNA sequence
  source 1..20: mol_type = other DNA
ctgtccaggtgagcaggcag

SEQ ID NO: 77120 - DNA, 20 bp, synthetic construct
  misc_feature 1..20: note = CRISPR gRNA sequence
  source 1..20: mol_type = other DNA
tccaggtgagcaggcaggag

SEQ ID NO: 77121 - DNA, 20 bp, synthetic construct
  misc_feature 1..20: note = CRISPR gRNA sequence
  source 1..20: mol_type = other DNA
tctgaccactgcttggcatc

SEQ ID NO: 77122 - DNA, 20 bp, synthetic construct
  misc_feature 1..20: note = CRISPR gRNA sequence
  source 1..20: mol_type = other DNA
tgaccactgcttggcatcac

SEQ ID NO: 77123 - DNA, 20 bp, synthetic construct
  misc_feature 1..20: note = CRISPR gRNA sequence
  source 1..20: mol_type = other DNA
accactgcttggcatcacat

SEQ ID NO: 77124 - DNA, 20 bp, synthetic construct
  misc_feature 1..20: note = CRISPR gRNA sequence
  source 1..20: mol_type = other DNA
cttggcatcacatgacttct

SEQ ID NO: 77125 - DNA, 20 bp, synthetic construct
  misc_feature 1..20: note = CRISPR gRNA sequence
  source 1..20: mol_type = other DNA
ggcatcacatgacttctgcc

SEQ ID NO: 77126 - DNA, 20 bp, synthetic construct
  misc_feature 1..20: note = CRISPR gRNA sequence
  source 1..20: mol_type = other DNA
gcatcacatgacttctgcct

SEQ ID NO: 77127 - DNA, 20 bp, synthetic construct
  misc_feature 1..20: note = CRISPR gRNA sequence
  source 1..20: mol_type = other DNA
ctgcctccctgtacgtcagt

SEQ ID NO: 77128 - DNA, 20 bp, synthetic construct
  misc_feature 1..20: note = CRISPR gRNA sequence
  source 1..20: mol_type = other DNA
tgcctccctgtacgtcagtt

SEQ ID NO: 77129 - DNA, 20 bp, synthetic construct
  misc_feature 1..20: note = CRISPR gRNA sequence
  source 1..20: mol_type = other DNA
cctccctgtacgtcagttct

SEQ ID NO: 77130 - DNA, 20 bp, synthetic construct
  misc_feature 1..20: note = CRISPR gRNA sequence
  source 1..20: mol_type = other DNA
cctgtacgtcagttctttgg

SEQ ID NO: 77131 - DNA, 20 bp, synthetic construct
  misc_feature 1..20: note = CRISPR gRNA sequence
  source 1..20: mol_type = other DNA
tacgtcagttctttgggcct

SEQ ID NO: 77132 - DNA, 20 bp, synthetic construct
  misc_feature 1..20: note = CRISPR gRNA sequence
  source 1..20: mol_type = other DNA
tttgggcctcaagaacccgg

SEQ ID NO: 77133 - DNA, 20 bp, synthetic construct
  misc_feature 1..20: note = CRISPR gRNA sequence
  source 1..20: mol_type = other DNA
tgggcctcaagaacccgggg

SEQ ID NO: 77134 - DNA, 20 bp, synthetic construct
  misc_feature 1..20: note = CRISPR gRNA sequence
  source 1..20: mol_type = other DNA
gggcctcaagaacccggggg

SEQ ID NO: 77135 - DNA, 20 bp, synthetic construct
  misc_feature 1..20: note = CRISPR gRNA sequence
  source 1..20: mol_type = other DNA
ggcctcaagaacccgggggt

SEQ ID NO: 77136 - DNA, 20 bp, synthetic construct
  misc_feature 1..20: note = CRISPR gRNA sequence
  source 1..20: mol_type = other DNA
aagaacccgggggttcccca

SEQ ID NO: 77137 - DNA, 20 bp, synthetic construct
  misc_feature 1..20: note = CRISPR gRNA sequence
  source 1..20: mol_type = other DNA
cccagaaacagagatcctat

SEQ ID NO: 77138 - DNA, 20 bp, synthetic construct
  misc_feature 1..20: note = CRISPR gRNA sequence
  source 1..20: mol_type = other DNA
tcctgggaagcaagaccacc

SEQ ID NO: 77139 - DNA, 20 bp, synthetic construct
  misc_feature 1..20: note = CRISPR gRNA sequence
  source 1..20: mol_type = other DNA
ggaagcaagaccacccaggc

SEQ ID NO: 77140 - DNA, 20 bp, synthetic construct
  misc_feature 1..20: note = CRISPR gRNA sequence
  source 1..20: mol_type = other DNA
gagccacccctgactcctga

SEQ ID NO: 77141 - DNA, 20 bp, synthetic construct
  misc_feature 1..20: note = CRISPR gRNA sequence
  source 1..20: mol_type = other DNA
agccacccctgactcctgac

SEQ ID NO: 77142 - DNA, 20 bp, synthetic construct
  misc_feature 1..20: note = CRISPR gRNA sequence
  source 1..20: mol_type = other DNA
actcctgacagcccatctgt

SEQ ID NO: 77143 - DNA, 20 bp, synthetic construct
  misc_feature 1..20: note = CRISPR gRNA sequence
  source 1..20: mol_type = other DNA
ctgacagcccatctgtacgg

SEQ ID NO: 77144 - DNA, 20 bp, synthetic construct
  misc_feature 1..20: note = CRISPR gRNA sequence
  source 1..20: mol_type = other DNA
acagcccatctgtacggcag

SEQ ID NO: 77145 - DNA, 20 bp, synthetic construct
  misc_feature 1..20: note = CRISPR gRNA sequence
  source 1..20: mol_type = other DNA
tacggcagtgccttttcttg

SEQ ID NO: 77146 - DNA, 20 bp, synthetic construct
  misc_feature 1..20: note = CRISPR gRNA sequence
  source 1..20: mol_type = other DNA
ttcttgacacactagctgtg

SEQ ID NO: 77147 - DNA, 20 bp, synthetic construct
  misc_feature 1..20: note = CRISPR gRNA sequence
  source 1..20: mol_type = other DNA
tcttgacacactagctgtga

SEQ ID NO: 77148 - DNA, 20 bp, synthetic construct
  misc_feature 1..20: note = CRISPR gRNA sequence
  source 1..20: mol_type = other DNA
cttgacacactagctgtgac

SEQ ID NO: 77149 - DNA, 20 bp, synthetic construct
  misc_feature 1..20: note = CRISPR gRNA sequence
  source 1..20: mol_type = other DNA
ttgacacactagctgtgact

SEQ ID NO: 77150 - DNA, 20 bp, synthetic construct
  misc_feature 1..20: note = CRISPR gRNA sequence
  source 1..20: mol_type = other DNA
gacacactagctgtgactct

SEQ ID NO: 77151 - DNA, 20 bp, synthetic construct
  misc_feature 1..20: note = CRISPR gRNA sequence
  source 1..20: mol_type = other DNA
acacactagctgtgactctc

SEQ ID NO: 77152 - DNA, 20 bp, synthetic construct
  misc_feature 1..20: note = CRISPR gRNA sequence
  source 1..20: mol_type = other DNA
gctgtgactctctccaccca

SEQ ID NO: 77153 - DNA, 20 bp, synthetic construct
  misc_feature 1..20: note = CRISPR gRNA sequence
  source 1..20: mol_type = other DNA
tgactctctccacccagcca

SEQ ID NO: 77154 - DNA, 20 bp, synthetic construct
  misc_feature 1..20: note = CRISPR gRNA sequence
  source 1..20: mol_type = other DNA
tctccacccagccagctgca

SEQ ID NO: 77155 - DNA, 20 bp, synthetic construct
  misc_feature 1..20: note = CRISPR gRNA sequence
  source 1..20: mol_type = other DNA
tccacccagccagctgcaca

SEQ ID NO: 77156 - DNA, 20 bp, synthetic construct
  misc_feature 1..20: note = CRISPR gRNA sequence
  source 1..20: mol_type = other DNA
cacccagccagctgcacatg

SEQ ID NO: 77157 - DNA, 20 bp, synthetic construct
  misc_feature 1..20: note = CRISPR gRNA sequence
  source 1..20: mol_type = other DNA
cacatgggcccaccctgtcc

SEQ ID NO: 77158 - DNA, 20 bp, synthetic construct
  misc_feature 1..20: note = CRISPR gRNA sequence
  source 1..20: mol_type = other DNA
tccgctgccactgctcccaa

SEQ ID NO: 77159 - DNA, 20 bp, synthetic construct
  misc_feature 1..20: note = CRISPR gRNA sequence
  source 1..20: mol_type = other DNA
ccactgctcccaagtgaggc

SEQ ID NO: 77160 - DNA, 20 bp, synthetic construct
  misc_feature 1..20: note = CRISPR gRNA sequence
  source 1..20: mol_type = other DNA
ctcccaagtgaggccaagag

SEQ ID NO: 77161 - DNA, 20 bp, synthetic construct
  misc_feature 1..20: note = CRISPR gRNA sequence
  source 1..20: mol_type = other DNA
ccaagtgaggccaagaggcc

SEQ ID NO: 77162 - DNA, 20 bp, synthetic construct
  misc_feature 1..20: note = CRISPR gRNA sequence
  source 1..20: mol_type = other DNA
gtcccactagagggcagccg

SEQ ID NO: 77163 - DNA, 20 bp, synthetic construct
  misc_feature 1..20: note = CRISPR gRNA sequence
  source 1..20: mol_type = other DNA
gagggcagccgggaacatca

SEQ ID NO: 77164 - DNA, 20 bp, synthetic construct
  misc_feature 1..20: note = CRISPR gRNA sequence
  source 1..20: mol_type = other DNA
aactagtattggttgtttac

SEQ ID NO: 77165 - DNA, 20 bp, synthetic construct
  misc_feature 1..20: note = CRISPR gRNA sequence
  source 1..20: mol_type = other DNA
gtattggttgtttactgcga

SEQ ID NO: 77166 - DNA, 20 bp, synthetic construct
  misc_feature 1..20: note = CRISPR gRNA sequence
  source 1..20: mol_type = other DNA
gttgtttactgcgaagacgg

SEQ ID NO: 77167 - DNA, 20 bp, synthetic construct
  misc_feature 1..20: note = CRISPR gRNA sequence
  source 1..20: mol_type = other DNA
tttactgcgaagacggggaa

SEQ ID NO: 77168 - DNA, 20 bp, synthetic construct
  misc_feature 1..20: note = CRISPR gRNA sequence
  source 1..20: mol_type = other DNA
actgcgaagacggggaaaat

SEQ ID NO: 77169 - DNA, 20 bp, synthetic construct
  misc_feature 1..20: note = CRISPR gRNA sequence
  source 1..20: mol_type = other DNA
ctgcgaagacggggaaaatg

SEQ ID NO: 77170 - DNA, 20 bp, synthetic construct
  misc_feature 1..20: note = CRISPR gRNA sequence
  source 1..20: mol_type = other DNA
cgaagacggggaaaatgttt

SEQ ID NO: 77171 - DNA, 20 bp, synthetic construct
  misc_feature 1..20: note = CRISPR gRNA sequence
  source 1..20: mol_type = other DNA
tttcagagcacccacggccc

SEQ ID NO: 77172 - DNA, 20 bp, synthetic construct
  misc_feature 1..20: note = CRISPR gRNA sequence
  source 1..20: mol_type = other DNA
ttcagagcacccacggcccc

SEQ ID NO: 77173 - DNA, 20 bp, synthetic construct
  misc_feature 1..20: note = CRISPR gRNA sequence
  source 1..20: mol_type = other DNA
tcagagcacccacggcccct

SEQ ID NO: 77174 - DNA, 20 bp, synthetic construct
  misc_feature 1..20: note = CRISPR gRNA sequence
  source 1..20: mol_type = other DNA
cagagcacccacggcccctg

SEQ ID NO: 77175 - DNA, 20 bp, synthetic construct
  misc_feature 1..20: note = CRISPR gRNA sequence
  source 1..20: mol_type = other DNA
agagcacccacggcccctgc

SEQ ID NO: 77176 - DNA, 20 bp, synthetic construct
  misc_feature 1..20: note = CRISPR gRNA sequence
  source 1..20: mol_type = other DNA
ccttcagagcgtgaaagggc

SEQ ID NO: 77177 - DNA, 20 bp, synthetic construct
  misc_feature 1..20: note = CRISPR gRNA sequence
  source 1..20: mol_type = other DNA
cagagcgtgaaagggcagtg

SEQ ID NO: 77178 - DNA, 20 bp, synthetic construct
  misc_feature 1..20: note = CRISPR gRNA sequence
  source 1..20: mol_type = other DNA
agagcgtgaaagggcagtga

SEQ ID NO: 77179 - DNA, 20 bp, synthetic construct
  misc_feature 1..20: note = CRISPR gRNA sequence
  source 1..20: mol_type = other DNA
caaaattccccgaaacgcag

SEQ ID NO: 77180 - DNA, 20 bp, synthetic construct
  misc_feature 1..20: note = CRISPR gRNA sequence
  source 1..20: mol_type = other DNA
cccgaaacgcagaagcacaa

SEQ ID NO: 77181 - DNA, 20 bp, synthetic construct
  misc_feature 1..20: note = CRISPR gRNA sequence
  source 1..20: mol_type = other DNA
tcctgtctcctcccacacag

SEQ ID NO: 77182 - DNA, 20 bp, synthetic construct
  misc_feature 1..20: note = CRISPR gRNA sequence
  source 1..20: mol_type = other DNA
ctgtctcctcccacacagca

SEQ ID NO: 77183 - DNA, 20 bp, synthetic construct
  misc_feature 1..20: note = CRISPR gRNA sequence
  source 1..20: mol_type = other DNA
tctcctcccacacagcagca

SEQ ID NO: 77184 - DNA, 20 bp, synthetic construct
  misc_feature 1..20: note = CRISPR gRNA sequence
  source 1..20: mol_type = other DNA
ctcccacacagcagcaatct

SEQ ID NO: 77185 - DNA, 20 bp, synthetic construct
  misc_feature 1..20: note = CRISPR gRNA sequence
  source 1..20: mol_type = other DNA
ccacacagcagcaatctgcg

SEQ ID NO: 77186 - DNA, 20 bp, synthetic construct
  misc_feature 1..20: note = CRISPR gRNA sequence
  source 1..20: mol_type = other DNA
cgggcacctgccctgctctg

SEQ ID NO: 77187 - DNA, 20 bp, synthetic construct
  misc_feature 1..20: note = CRISPR gRNA sequence
  source 1..20: mol_type = other DNA
ccctgctctgggacctctcc

SEQ ID NO: 77188 - DNA, 20 bp, synthetic construct
  misc_feature 1..20: note = CRISPR gRNA sequence
  source 1..20: mol_type = other DNA
ctctgggacctctcccaacc

SEQ ID NO: 77189 - DNA, 20 bp, synthetic construct
  misc_feature 1..20: note = CRISPR gRNA sequence
  source 1..20: mol_type = other DNA
tgggacctctcccaaccata

SEQ ID NO: 77190 - DNA, 20 bp, synthetic construct
  misc_feature 1..20: note = CRISPR gRNA sequence
  source 1..20: mol_type = other DNA
ggacctctcccaaccatatc

SEQ ID NO: 77191 - DNA, 20 bp, synthetic construct
  misc_feature 1..20: note = CRISPR gRNA sequence
  source 1..20: mol_type = other DNA
tcccaaccatatccctccct

SEQ ID NO: 77192 - DNA, 20 bp, synthetic construct
  misc_feature 1..20: note = CRISPR gRNA sequence
  source 1..20: mol_type = other DNA
ccaaccatatccctcccttc

SEQ ID NO: 77193 - DNA, 20 bp, synthetic construct
  misc_feature 1..20: note = CRISPR gRNA sequence
  source 1..20: mol_type = other DNA
ccttcctcccatctgcattg

SEQ ID NO: 77194 - DNA, 20 bp, synthetic construct
  misc_feature 1..20: note = CRISPR gRNA sequence
  source 1..20: mol_type = other DNA
cctcccatctgcattgcctc

SEQ ID NO: 77195 - DNA, 20 bp, synthetic construct
  misc_feature 1..20: note = CRISPR gRNA sequence
  source 1..20: mol_type = other DNA
ctcccatctgcattgcctcc

SEQ ID NO: 77196 - DNA, 20 bp, synthetic construct
  misc_feature 1..20: note = CRISPR gRNA sequence
  source 1..20: mol_type = other DNA
ccatctgcattgcctccttc

SEQ ID NO: 77197 - DNA, 20 bp, synthetic construct
  misc_feature 1..20: note = CRISPR gRNA sequence
  source 1..20: mol_type = other DNA
cattgcctccttccaagggg

SEQ ID NO: 77198 - DNA, 20 bp, synthetic construct
  misc_feature 1..20: note = CRISPR gRNA sequence
  source 1..20: mol_type = other DNA
cctccttccaaggggaaaac

SEQ ID NO: 77199 - DNA, 20 bp, synthetic construct
  misc_feature 1..20: note = CRISPR gRNA sequence
  source 1..20: mol_type = other DNA
cttccaaggggaaaacaggg

SEQ ID NO: 77200 - DNA, 20 bp, synthetic construct
  misc_feature 1..20: note = CRISPR gRNA sequence
  source 1..20: mol_type = other DNA
ccaaggggaaaacagggcag

SEQ ID NO: 77201 - DNA, 20 bp, synthetic construct
  misc_feature 1..20: note = CRISPR gRNA sequence
  source 1..20: mol_type = other DNA
caaggggaaaacagggcagt

SEQ ID NO: 77202 - DNA, 20 bp, synthetic construct
  misc_feature 1..20: note = CRISPR gRNA sequence
  source 1..20: mol_type = other DNA
attactgacaatttatgggg

SEQ ID NO: 77203 - DNA, 20 bp, synthetic construct
  misc_feature 1..20: note = CRISPR gRNA sequence
  source 1..20: mol_type = other DNA
ctgacaatttatgggggggg

SEQ ID NO: 77204 - DNA, 20 bp, synthetic construct
  misc_feature 1..20: note = CRISPR gRNA sequence
  source 1..20: mol_type = other DNA
acaatttatggggggggcgg

SEQ ID NO: 77205 - DNA, 20 bp, synthetic construct
  misc_feature 1..20: note = CRISPR gRNA sequence
  source 1..20: mol_type = other DNA
atggggggggcggtggttac

SEQ ID NO: 77206 - DNA, 20 bp, synthetic construct
  misc_feature 1..20: note = CRISPR gRNA sequence
  source 1..20: mol_type = other DNA
tggggggggcggtggttact

SEQ ID NO: 77207 - DNA, 20 bp, synthetic construct
  misc_feature 1..20: note = CRISPR gRNA sequence
  source 1..20: mol_type = other DNA
ctgaagtggtgattaaacct

SEQ ID NO: 77208 - DNA, 20 bp, synthetic construct
  misc_feature 1..20: note = CRISPR gRNA sequence
  source 1..20: mol_type = other DNA
aagtggtgattaaacctagt

SEQ ID NO: 77209 - DNA, 20 bp, synthetic construct
  misc_feature 1..20: note = CRISPR gRNA sequence
  source 1..20: mol_type = other DNA
aacctagtgtgccggacttg

SEQ ID NO: 77210 - DNA, 20 bp, synthetic construct
  misc_feature 1..20: note = CRISPR gRNA sequence
  source 1..20: mol_type = other DNA
gtgtgccggacttgggtggt

SEQ ID NO: 77211 - DNA, 20 bp, synthetic construct
  misc_feature 1..20: note = CRISPR gRNA sequence
  source 1..20: mol_type = other DNA
gggtggtttaactgagagct

SEQ ID NO: 77212 - DNA, 20 bp, synthetic construct
  misc_feature 1..20: note = CRISPR gRNA sequence
  source 1..20: mol_type = other DNA
ggtggtttaactgagagctg

SEQ ID NO: 77213 - DNA, 20 bp, synthetic construct
  misc_feature 1..20: note = CRISPR gRNA sequence
  source 1..20: mol_type = other DNA
aactgagagctgagtggtca

SEQ ID NO: 77214 - DNA, 20 bp, synthetic construct
  misc_feature 1..20: note = CRISPR gRNA sequence
  source 1..20: mol_type = other DNA
actgagagctgagtggtcag

SEQ ID NO: 77215 - DNA, 20 bp, synthetic construct
  misc_feature 1..20: note = CRISPR gRNA sequence
  source 1..20: mol_type = other DNA
agagctgagtggtcagcatg

SEQ ID NO: 77216 - DNA, 20 bp, synthetic construct
  misc_feature 1..20: note = CRISPR gRNA sequence
  source 1..20: mol_type = other DNA
agtggtcagcatgggtctgg

SEQ ID NO: 77217 - DNA, 20 bp, synthetic construct
  misc_feature 1..20: note = CRISPR gRNA sequence
  source 1..20: mol_type = other DNA
ggggtggggggacctccaac

SEQ ID NO: 77218 - DNA, 20 bp, synthetic construct
  misc_feature 1..20: note = CRISPR gRNA sequence
  source 1..20: mol_type = other DNA
caacagacggggaccagagc

SEQ ID NO: 77219 - DNA, 20 bp, synthetic construct
  misc_feature 1..20: note = CRISPR gRNA sequence
  source 1..20: mol_type = other DNA
ccccaccccgagcgttccct

SEQ ID NO: 77220 - DNA, 20 bp, synthetic construct
  misc_feature 1..20: note = CRISPR gRNA sequence
  source 1..20: mol_type = other DNA
cctcctcacctgcttgtctt

SEQ ID NO: 77221 - DNA, 20 bp, synthetic construct
  misc_feature 1..20: note = CRISPR gRNA sequence
  source 1..20: mol_type = other DNA
ctcacctgcttgtcttgtcc

SEQ ID NO: 77222 - DNA, 20 bp, synthetic construct
  misc_feature 1..20: note = CRISPR gRNA sequence
  source 1..20: mol_type = other DNA
acctgcttgtcttgtcccct

SEQ ID NO: 77223 - DNA, 20 bp, synthetic construct
  misc_feature 1..20: note = CRISPR gRNA sequence
  source 1..20: mol_type = other DNA
cttgtcttgtcccctctcag

SEQ ID NO: 77224 - DNA, 20 bp, synthetic construct
  misc_feature 1..20: note = CRISPR gRNA sequence
  source 1..20: mol_type = other DNA
gtcttgtcccctctcaggag

SEQ ID NO: 77225 - DNA, 20 bp, synthetic construct
  misc_feature 1..20: note = CRISPR gRNA sequence
  source 1..20: mol_type = other DNA
tcttgtcccctctcaggagg

SEQ ID NO: 77226 - DNA, 20 bp, synthetic construct
  misc_feature 1..20: note = CRISPR gRNA sequence
  source 1..20: mol_type = other DNA
gtcccctctcaggaggatgt

SEQ ID NO: 77227 - DNA, 20 bp, synthetic construct
  misc_feature 1..20: note = CRISPR gRNA sequence
  source 1..20: mol_type = other DNA
tcccctctcaggaggatgtg

SEQ ID NO: 77228 - DNA, 20 bp, synthetic construct
  misc_feature 1..20: note = CRISPR gRNA sequence
  source 1..20: mol_type = other DNA
tcaggaggatgtgttggctt

SEQ ID NO: 77229 - DNA, 20 bp, synthetic construct
  misc_feature 1..20: note = CRISPR gRNA sequence
  source 1..20: mol_type = other DNA
aggaggatgtgttggctttc

SEQ ID NO: 77230 - DNA, 20 bp, synthetic construct
  misc_feature 1..20: note = CRISPR gRNA sequence
  source 1..20: mol_type = other DNA
gctttcaaagctggaagcag

SEQ ID NO: 77231 - DNA, 20 bp, synthetic construct
  misc_feature 1..20: note = CRISPR gRNA sequence
  source 1..20: mol_type = other DNA
tcaaagctggaagcagagag

SEQ ID NO: 77232 - DNA, 20 bp, synthetic construct
  misc_feature 1..20: note = CRISPR gRNA sequence
  source 1..20: mol_type = other DNA
caaagctggaagcagagagg

SEQ ID NO: 77233 - DNA, 20 bp, synthetic construct
  misc_feature 1..20: note = CRISPR gRNA sequence
  source 1..20: mol_type = other DNA
aaagctggaagcagagagga

SEQ ID NO: 77234 - DNA, 20 bp, synthetic construct
  misc_feature 1..20: note = CRISPR gRNA sequence
  source 1..20: mol_type = other DNA
gaagcagagaggaagcagca

SEQ ID NO: 77235 - DNA, 20 bp, synthetic construct
  misc_feature 1..20: note = CRISPR gRNA sequence
  source 1..20: mol_type = other DNA
gaaaatggtcaaagaccaac

SEQ ID NO: 77236 - DNA, 20 bp, synthetic construct
  misc_feature 1..20: note = CRISPR gRNA sequence
  source 1..20: mol_type = other DNA
aaaatggtcaaagaccaact

SEQ ID NO: 77237 - DNA, 20 bp, synthetic construct
  misc_feature 1..20: note = CRISPR gRNA sequence
  source 1..20: mol_type = other DNA
ccctggcagtggcaagaacc

SEQ ID NO: 77238 - DNA, 20 bp, synthetic construct
  misc_feature 1..20: note = CRISPR gRNA sequence
  source 1..20: mol_type = other DNA
cctggcagtggcaagaaccc

SEQ ID NO: 77239 - DNA, 20 bp, synthetic construct
  misc_feature 1..20: note = CRISPR gRNA sequence
  source 1..20: mol_type = other DNA
gcagtggcaagaacccagac

SEQ ID NO: 77240 - DNA, 20 bp, synthetic construct
  misc_feature 1..20: note = CRISPR gRNA sequence
  source 1..20: mol_type = other DNA
gtcagggcaaggagggcctg

SEQ ID NO: 77241 - DNA, 20 bp, synthetic construct
  misc_feature 1..20: note = CRISPR gRNA sequence
  source 1..20: mol_type = other DNA
gggtggcctgctttcttagc

SEQ ID NO: 77242 - DNA, 20 bp, synthetic construct
  misc_feature 1..20: note = CRISPR gRNA sequence
  source 1..20: mol_type = other DNA
ctttcttagcaaacaaggaa

SEQ ID NO: 77243 - DNA, 20 bp, synthetic construct
  misc_feature 1..20: note = CRISPR gRNA sequence
  source 1..20: mol_type = other DNA
tcttagcaaacaaggaatag

SEQ ID NO: 77244 - DNA, 20 bp, synthetic construct
  misc_feature 1..20: note = CRISPR gRNA sequence
  source 1..20: mol_type = other DNA
cttagcaaacaaggaataga

SEQ ID NO: 77245 - DNA, 20 bp, synthetic construct
  misc_feature 1..20: note = CRISPR gRNA sequence
  source 1..20: mol_type = other DNA
ttagcaaacaaggaatagat

SEQ ID NO: 77246 - DNA, 20 bp, synthetic construct
  misc_feature 1..20: note = CRISPR gRNA sequence
  source 1..20: mol_type = other DNA
agcaaacaaggaatagatta

SEQ ID NO: 77247 - DNA, 20 bp, synthetic construct
  misc_feature 1..20: note = CRISPR gRNA sequence
  source 1..20: mol_type = other DNA
gcaaacaaggaatagattaa

SEQ ID NO: 77248 - DNA, 20 bp, synthetic construct
  misc_feature 1..20: note = CRISPR gRNA sequence
  source 1..20: mol_type = other DNA
agcaacaattacatgtatca

SEQ ID NO: 77249 - DNA, 20 bp, synthetic construct
  misc_feature 1..20: note = CRISPR gRNA sequence
  source 1..20: mol_type = other DNA
catgtatcaagtcacatgca

SEQ ID NO: 77250 - DNA, 20 bp, synthetic construct
  misc_feature 1..20: note = CRISPR gRNA sequence
  source 1..20: mol_type = other DNA
ctcatttgattctcacaata

SEQ ID NO: 77251 - DNA, 20 bp, synthetic construct
  misc_feature 1..20: note = CRISPR gRNA sequence
  source 1..20: mol_type = other DNA
tcatttgattctcacaataa

SEQ ID NO: 77252 - DNA, 20 bp, synthetic construct
  misc_feature 1..20: note = CRISPR gRNA sequence
  source 1..20: mol_type = other DNA
atttgattctcacaataaac

SEQ ID NO: 77253 - DNA, 20 bp, synthetic construct
  misc_feature 1..20: note = CRISPR gRNA sequence
  source 1..20: mol_type = other DNA
gattctcacaataaacaatg

SEQ ID NO: 77254 - DNA, 20 bp, synthetic construct
  misc_feature 1..20: note = CRISPR gRNA sequence
  source 1..20: mol_type = other DNA
attctcacaataaacaatga

SEQ ID NO: 77255 - DNA, 20 bp, synthetic construct
  misc_feature 1..20: note = CRISPR gRNA sequence
  source 1..20: mol_type = other DNA
tcacaataaacaatgaggta

SEQ ID NO: 77256 - DNA, 20 bp, synthetic construct
  misc_feature 1..20: note = CRISPR gRNA sequence
  source 1..20: mol_type = other DNA
acaataaacaatgaggtaag

SEQ ID NO: 77257 - DNA, 20 bp, synthetic construct
  misc_feature 1..20: note = CRISPR gRNA sequence
  source 1..20: mol_type = other DNA
ttctttgttgttgtttcgaa

SEQ ID NO: 77258 - DNA, 20 bp, synthetic construct
  misc_feature 1..20: note = CRISPR gRNA sequence
  source 1..20: mol_type = other DNA
ctttgttgttgtttcgaaga

SEQ ID NO: 77259 - DNA, 20 bp, synthetic construct
  misc_feature 1..20: note = CRISPR gRNA sequence
  source 1..20: mol_type = other DNA
tttgttgttgtttcgaagaa

SEQ ID NO: 77260 - DNA, 20 bp, synthetic construct
  misc_feature 1..20: note = CRISPR gRNA sequence
  source 1..20: mol_type = other DNA
tgttgttgtttcgaagaaag

SEQ ID NO: 77261 - DNA, 20 bp, synthetic construct
  misc_feature 1..20: note = CRISPR gRNA sequence
  source 1..20: mol_type = other DNA
gttgttgtttcgaagaaagg

SEQ ID NO: 77262 - DNA, 20 bp, synthetic construct
  misc_feature 1..20: note = CRISPR gRNA sequence
  source 1..20: mol_type = other DNA
ttgttgtttcgaagaaaggg

SEQ ID NO: 77263 - DNA, 20 bp, synthetic construct
  misc_feature 1..20: note = CRISPR gRNA sequence
  source 1..20: mol_type = other DNA
ttgtttcgaagaaagggtct

SEQ ID NO: 77264 - DNA, 20 bp, synthetic construct
  misc_feature 1..20: note = CRISPR gRNA sequence
  source 1..20: mol_type = other DNA
tttcgaagaaagggtcttgc

SEQ ID NO: 77265 - DNA, 20 bp, synthetic construct
  misc_feature 1..20: note = CRISPR gRNA sequence
  source 1..20: mol_type = other DNA
cgaagaaagggtcttgctct

SEQ ID NO: 77266 - DNA, 20 bp, synthetic construct
  misc_feature 1..20: note = CRISPR gRNA sequence
  source 1..20: mol_type = other DNA
gaagaaagggtcttgctctg

SEQ ID NO: 77267 - DNA, 20 bp, synthetic construct
  misc_feature 1..20: note = CRISPR gRNA sequence
  source 1..20: mol_type = other DNA
gctctgtcgcccaggctggt

SEQ ID NO: 77268 - DNA, 20 bp, synthetic construct
  misc_feature 1..20: note = CRISPR gRNA sequence
  source 1..20: mol_type = other DNA
ctctgtcgcccaggctggtg

SEQ ID NO: 77269 - DNA, 20 bp, synthetic construct
  misc_feature 1..20: note = CRISPR gRNA sequence
  source 1..20: mol_type = other DNA
tgtcgcccaggctggtgtgc

SEQ ID NO: 77270 - DNA, 20 bp, synthetic construct
  misc_feature 1..20: note = CRISPR gRNA sequence
  source 1..20: mol_type = other DNA
tcgcccaggctggtgtgcag

SEQ ID NO: 77271 - DNA, 20 bp, synthetic construct
  misc_feature 1..20: note = CRISPR gRNA sequence
  source 1..20: mol_type = other DNA
gtgtgcagtggtgcagtcat

SEQ ID NO: 77272 - DNA, 20 bp, synthetic construct
  misc_feature 1..20: note = CRISPR gRNA sequence
  source 1..20: mol_type = other DNA
actgcagcctcaaccttccc

SEQ ID NO: 77273 - DNA, 20 bp, synthetic construct
  misc_feature 1..20: note = CRISPR gRNA sequence
  source 1..20: mol_type = other DNA
cagcctcaaccttccccggg

SEQ ID NO: 77274 - DNA, 20 bp, synthetic construct
  misc_feature 1..20: note = CRISPR gRNA sequence
  source 1..20: mol_type = other DNA
aaccttccccgggctcaact

SEQ ID NO: 77275 - DNA, 20 bp, synthetic construct
  misc_feature 1..20: note = CRISPR gRNA sequence
  source 1..20: mol_type = other DNA
ccccgggctcaactgatcct

SEQ ID NO: 77276 - DNA, 20 bp, synthetic construct
  misc_feature 1..20: note = CRISPR gRNA sequence
  source 1..20: mol_type = other DNA
cccgggctcaactgatccta

SEQ ID NO: 77277 - DNA, 20 bp, synthetic construct
  misc_feature 1..20: note = CRISPR gRNA sequence
  source 1..20: mol_type = other DNA
aactgatcctactgcctcag

SEQ ID NO: 77278 - DNA, 20 bp, synthetic construct
  misc_feature 1..20: note = CRISPR gRNA sequence
  source 1..20: mol_type = other DNA
atcctactgcctcagcctcc

SEQ ID NO: 77279 - DNA, 20 bp, synthetic construct
  misc_feature 1..20: note = CRISPR gRNA sequence
  source 1..20: mol_type = other DNA
ctgcctcagcctcccaagta

SEQ ID NO: 77280 - DNA, 20 bp, synthetic construct
  misc_feature 1..20: note = CRISPR gRNA sequence
  source 1..20: mol_type = other DNA
cctcagcctcccaagtagct

SEQ ID NO: 77281 - DNA, 20 bp, synthetic construct
  misc_feature 1..20: note = CRISPR gRNA sequence
  source 1..20: mol_type = other DNA
agcctcccaagtagctggga

SEQ ID NO: 77282 - DNA, 20 bp, synthetic construct
  misc_feature 1..20: note = CRISPR gRNA sequence
  source 1..20: mol_type = other DNA
ccaagtagctgggactacag

SEQ ID NO: 77283 - DNA, 20 bp, synthetic construct
  misc_feature 1..20: note = CRISPR gRNA sequence
  source 1..20: mol_type = other DNA
ggactacaggaacgccccac

SEQ ID NO: 77284 - DNA, 20 bp, synthetic construct
  misc_feature 1..20: note = CRISPR gRNA sequence
  source 1..20: mol_type = other DNA
caggaacgccccaccatgac

SEQ ID NO: 77285 - DNA, 20 bp, synthetic construct
  misc_feature 1..20: note = CRISPR gRNA sequence
  source 1..20: mol_type = other DNA
tctaatttttgtattttttg

SEQ ID NO: 77286 - DNA, 20 bp, synthetic construct
  misc_feature 1..20: note = CRISPR gRNA sequence
  source 1..20: mol_type = other DNA
atttttgtattttttgtaga

SEQ ID NO: 77287 - DNA, 20 bp, synthetic construct
  misc_feature 1..20: note = CRISPR gRNA sequence
  source 1..20: mol_type = other DNA
ttgtattttttgtagagatg

SEQ ID NO: 77288 - DNA, 20 bp, synthetic construct
  misc_feature 1..20: note = CRISPR gRNA sequence
  source 1..20: mol_type = other DNA
tgtattttttgtagagatgg

SEQ ID NO: 77289 - DNA, 20 bp, synthetic construct
  misc_feature 1..20: note = CRISPR gRNA sequence
  source 1..20: mol_type = other DNA
gtattttttgtagagatggg

SEQ ID NO: 77290 - DNA, 20 bp, synthetic construct
  misc_feature 1..20: note = CRISPR gRNA sequence
  source 1..20: mol_type = other DNA
tattttttgtagagatgggg

SEQ ID NO: 77291 - DNA, 20 bp, synthetic construct
  misc_feature 1..20: note = CRISPR gRNA sequence
  source 1..20: mol_type = other DNA
tttgtagagatggggttttg

SEQ ID NO: 77292 - DNA, 20 bp, synthetic construct
  misc_feature 1..20: note = CRISPR gRNA sequence
  source 1..20: mol_type = other DNA
ttgtagagatggggttttgc

SEQ ID NO: 77293 - DNA, 20 bp, synthetic construct
  misc_feature 1..20: note = CRISPR gRNA sequence
  source 1..20: mol_type = other DNA
tgtagagatggggttttgcc

SEQ ID NO: 77294 - DNA, 20 bp, synthetic construct
  misc_feature 1..20: note = CRISPR gRNA sequence
  source 1..20: mol_type = other DNA
gtagagatggggttttgcca

SEQ ID NO: 77295 - DNA, 20 bp, synthetic construct
  misc_feature 1..20: note = CRISPR gRNA sequence
  source 1..20: mol_type = other DNA
tagagatggggttttgccat

SEQ ID NO: 77296 - DNA, 20 bp, synthetic construct
  misc_feature 1..20: note = CRISPR gRNA sequence
  source 1..20: mol_type = other DNA
tgccatgttgagcaggctgg

SEQ ID NO: 77297 - DNA, 20 bp, synthetic construct
  misc_feature 1..20: note = CRISPR gRNA sequence
  source 1..20: mol_type = other DNA
gccatgttgagcaggctggt

SEQ ID NO: 77298 - DNA, 20 bp, synthetic construct
  misc_feature 1..20: note = CRISPR gRNA sequence
  source 1..20: mol_type = other DNA
ccatgttgagcaggctggtc

SEQ ID NO: 77299 - DNA, 20 bp, synthetic construct
  misc_feature 1..20: note = CRISPR gRNA sequence
  source 1..20: mol_type = other DNA
agcaggctggtctcaaactc

SEQ ID NO: 77300 - DNA, 20 bp, synthetic construct
  misc_feature 1..20: note = CRISPR gRNA sequence
  source 1..20: mol_type = other DNA
gtctcaaactccatggctca

SEQ ID NO: 77301 - DNA, 20 bp, synthetic construct
  misc_feature 1..20: note = CRISPR gRNA sequence
  source 1..20: mol_type = other DNA
aaactccatggctcaaacga

SEQ ID NO: 77302 - DNA, 20 bp, synthetic construct
  misc_feature 1..20: note = CRISPR gRNA sequence
  source 1..20: mol_type = other DNA
catggctcaaacgatcctcc

SEQ ID NO: 77303 - DNA, 20 bp, synthetic construct
  misc_feature 1..20: note = CRISPR gRNA sequence
  source 1..20: mol_type = other DNA
aaacgatcctcctgccttag

SEQ ID NO: 77304 - DNA, 20 bp, synthetic construct
  misc_feature 1..20: note = CRISPR gRNA sequence
  source 1..20: mol_type = other DNA
ctgccttagcctcccaaagt

SEQ ID NO: 77305 - DNA, 20 bp, synthetic construct
  misc_feature 1..20: note = CRISPR gRNA sequence
  source 1..20: mol_type = other DNA
ccttagcctcccaaagtgct

SEQ ID NO: 77306 - DNA, 20 bp, synthetic construct
  misc_feature 1..20: note = CRISPR gRNA sequence
  source 1..20: mol_type = other DNA
agcctcccaaagtgctggaa

SEQ ID NO: 77307 - DNA, 20 bp, synthetic construct
  misc_feature 1..20: note = CRISPR gRNA sequence
  source 1..20: mol_type = other DNA
gcctcccaaagtgctggaat

SEQ ID NO: 77308 - DNA, 20 bp, synthetic construct
  misc_feature 1..20: note = CRISPR gRNA sequence
  source 1..20: mol_type = other DNA
ccaaagtgctggaattacag

SEQ ID NO: 77309 - DNA, 20 bp, synthetic construct
  misc_feature 1..20: note = CRISPR gRNA sequence
  source 1..20: mol_type = other DNA
gaattacagatgtgagccat

SEQ ID NO: 77310 - DNA, 20 bp, synthetic construct
  misc_feature 1..20: note = CRISPR gRNA sequence
  source 1..20: mol_type = other DNA
cagatgtgagccattgtgcc

SEQ ID NO: 77311 - DNA, 20 bp, synthetic construct
  misc_feature 1..20: note = CRISPR gRNA sequence
  source 1..20: mol_type = other DNA
tgcctgacatttttttttct

SEQ ID NO: 77312 - DNA, 20 bp, synthetic construct
  misc_feature 1..20: note = CRISPR gRNA sequence
  source 1..20: mol_type = other DNA
acatttttttttctttgaga

SEQ ID NO: 77313 - DNA, 20 bp, synthetic construct
  misc_feature 1..20: note = CRISPR gRNA sequence
  source 1..20: mol_type = other DNA
ttttttctttgagacagagt

SEQ ID NO: 77314 - DNA, 20 bp, synthetic construct
  misc_feature 1..20: note = CRISPR gRNA sequence
  source 1..20: mol_type = other DNA
tttttctttgagacagagtc

SEQ ID NO: 77315 - DNA, 20 bp, synthetic construct
  misc_feature 1..20: note = CRISPR gRNA sequence
  source 1..20: mol_type = other DNA
ttttctttgagacagagtct

SEQ ID NO: 77316 - DNA, 20 bp, synthetic construct
  misc_feature 1..20: note = CRISPR gRNA sequence
  source 1..20: mol_type = other DNA
tttctttgagacagagtctt

SEQ ID NO: 77317 - DNA, 20 bp, synthetic construct
  misc_feature 1..20: note = CRISPR gRNA sequence
  source 1..20: mol_type = other DNA
ttctttgagacagagtcttg

SEQ ID NO: 77318 - DNA, 20 bp, synthetic construct
  misc_feature 1..20: note = CRISPR gRNA sequence
  source 1..20: mol_type = other DNA
tctttgagacagagtcttgc

SEQ ID NO: 77319 - DNA, 20 bp, synthetic construct
  misc_feature 1..20: note = CRISPR gRNA sequence
  source 1..20: mol_type = other DNA
ctttgagacagagtcttgct

SEQ ID NO: 77320 - DNA, 20 bp, synthetic construct
  misc_feature 1..20: note = CRISPR gRNA sequence
  source 1..20: mol_type = other DNA
tttgagacagagtcttgctc

SEQ ID NO: 77321 - DNA, 20 bp, synthetic construct
  misc_feature 1..20: note = CRISPR gRNA sequence
  source 1..20: mol_type = other DNA
tgagacagagtcttgctctg

SEQ ID NO: 77322 - DNA, 20 bp, synthetic construct
  misc_feature 1..20: note = CRISPR gRNA sequence
  source 1..20: mol_type = other DNA
gagacagagtcttgctctgt

SEQ ID NO: 77323 - DNA, 20 bp, synthetic construct
  misc_feature 1..20: note = CRISPR gRNA sequence
  source 1..20: mol_type = other DNA
agacagagtcttgctctgtt

SEQ ID NO: 77324 - DNA, 20 bp, synthetic construct
  misc_feature 1..20: note = CRISPR gRNA sequence
  source 1..20: mol_type = other DNA
gctctgttgcccaggctgga

SEQ ID NO: 77325 - DNA, 20 bp, synthetic construct
  misc_feature 1..20: note = CRISPR gRNA sequence
  source 1..20: mol_type = other DNA
ctctgttgcccaggctggag

SEQ ID NO: 77326 - DNA, 20 bp, synthetic construct
  misc_feature 1..20: note = CRISPR gRNA sequence
  source 1..20: mol_type = other DNA
tgttgcccaggctggagtgc

SEQ ID NO: 77327 - DNA, 20 bp, synthetic construct
  misc_feature 1..20: note = CRISPR gRNA sequence
  source 1..20: mol_type = other DNA
ttgcccaggctggagtgcaa

SEQ ID NO: 77328 - DNA, 20 bp, synthetic construct
  misc_feature 1..20: note = CRISPR gRNA sequence
  source 1..20: mol_type = other DNA
cccaggctggagtgcaatgg

SEQ ID NO: 77329 - DNA, 20 bp, synthetic construct
  misc_feature 1..20: note = CRISPR gRNA sequence
  source 1..20: mol_type = other DNA
gagtgcaatggtgtgatcac

SEQ ID NO: 77330 - DNA, 20 bp, synthetic construct
  misc_feature 1..20: note = CRISPR gRNA sequence
  source 1..20: mol_type = other DNA
actgtagcctcgatctcctg

SEQ ID NO: 77331 - DNA, 20 bp, synthetic construct
  misc_feature 1..20: note = CRISPR gRNA sequence
  source 1..20: mol_type = other DNA
tagcctcgatctcctgagtc

SEQ ID NO: 77332 - DNA, 20 bp, synthetic construct
  misc_feature 1..20: note = CRISPR gRNA sequence
  source 1..20: mol_type = other DNA
gatctcctgagtctaagcaa

SEQ ID NO: 77333 - DNA, 20 bp, synthetic construct
  misc_feature 1..20: note = CRISPR gRNA sequence
  source 1..20: mol_type = other DNA
ctgagtctaagcaatcctcc

SEQ ID NO: 77334 - DNA, 20 bp, synthetic construct
  misc_feature 1..20: note = CRISPR gRNA sequence
  source 1..20: mol_type = other DNA
agtctaagcaatcctcccac

SEQ ID NO: 77335 - DNA, 20 bp, synthetic construct
  misc_feature 1..20: note = CRISPR gRNA sequence
  source 1..20: mol_type = other DNA
agcaatcctcccacctcagc

SEQ ID NO: 77336 - DNA, 20 bp, synthetic construct
  misc_feature 1..20: note = CRISPR gRNA sequence
  source 1..20: mol_type = other DNA
ccacctcagcctcccaagta

SEQ ID NO: 77337 - DNA, 20 bp, synthetic construct
  misc_feature 1..20: note = CRISPR gRNA sequence
  source 1..20: mol_type = other DNA
agcctcccaagtaggtgcat

SEQ ID NO: 77338 - DNA, 20 bp, synthetic construct
  misc_feature 1..20: note = CRISPR gRNA sequence
  source 1..20: mol_type = other DNA
ccaagtaggtgcatgccatc

SEQ ID NO: 77339 - DNA, 20 bp, synthetic construct
  misc_feature 1..20: note = CRISPR gRNA sequence
  source 1..20: mol_type = other DNA
ggctaatttttaaagtttct

SEQ ID NO: 77340 - DNA, 20 bp, synthetic construct
  misc_feature 1..20: note = CRISPR gRNA sequence
  source 1..20: mol_type = other DNA
gctaatttttaaagtttctg

SEQ ID NO: 77341 - DNA, 20 bp, synthetic construct
  misc_feature 1..20: note = CRISPR gRNA sequence
  source 1..20: mol_type = other DNA
atttttaaagtttctgtaga

SEQ ID NO: 77342 - DNA, 20 bp, synthetic construct
  misc_feature 1..20: note = CRISPR gRNA sequence
  source 1..20: mol_type = other DNA
ttaaagtttctgtagagatg

SEQ ID NO: 77343 - DNA, 20 bp, synthetic construct
  misc_feature 1..20: note = CRISPR gRNA sequence
  source 1..20: mol_type = other DNA
taaagtttctgtagagatgg

SEQ ID NO: 77344 - DNA, 20 bp, synthetic construct
  misc_feature 1..20: note = CRISPR gRNA sequence
  source 1..20: mol_type = other DNA
aaagtttctgtagagatggg

SEQ ID NO: 77345 - DNA, 20 bp, synthetic construct
  misc_feature 1..20: note = CRISPR gRNA sequence
  source 1..20: mol_type = other DNA
aagtttctgtagagatgggg

SEQ ID NO: 77346 - DNA, 20 bp, synthetic construct
  misc_feature 1..20: note = CRISPR gRNA sequence
  source 1..20: mol_type = other DNA
ctgtagagatgggggggtct

SEQ ID NO: 77347 - DNA, 20 bp, synthetic construct
  misc_feature 1..20: note = CRISPR gRNA sequence
  source 1..20: mol_type = other DNA
tgtagagatgggggggtctc

SEQ ID NO: 77348 - DNA, 20 bp, synthetic construct
  misc_feature 1..20: note = CRISPR gRNA sequence
  source 1..20: mol_type = other DNA
tagagatgggggggtctcac

SEQ ID NO: 77349 - DNA, 20 bp, synthetic construct
  misc_feature 1..20: note = CRISPR gRNA sequence
  source 1..20: mol_type = other DNA
accatgttgtccaggctggt

SEQ ID NO: 77350 - DNA, 20 bp, synthetic construct
  misc_feature 1..20: note = CRISPR gRNA sequence
  source 1..20: mol_type = other DNA
tccaggctggtctcaaactc

SEQ ID NO: 77351 - DNA, 20 bp, synthetic construct
  misc_feature 1..20: note = CRISPR gRNA sequence
  source 1..20: mol_type = other DNA
gtctcaaactcctaggctca

SEQ ID NO: 77352 - DNA, 20 bp, synthetic construct
  misc_feature 1..20: note = CRISPR gRNA sequence
  source 1..20: mol_type = other DNA
aaactcctaggctcaggtga

SEQ ID NO: 77353 - DNA, 20 bp, synthetic construct
  misc_feature 1..20: note = CRISPR gRNA sequence
  source 1..20: mol_type = other DNA
ctaggctcaggtgatcctcc

SEQ ID NO: 77354 - DNA, 20 bp, synthetic construct
  misc_feature 1..20: note = CRISPR gRNA sequence
  source 1..20: mol_type = other DNA
ggctcaggtgatcctcctcc

SEQ ID NO: 77355 - DNA, 20 bp, synthetic construct
  misc_feature 1..20: note = CRISPR gRNA sequence
  source 1..20: mol_type = other DNA
aggtgatcctcctcctcctg

SEQ ID NO: 77356 - DNA, 20 bp, synthetic construct
  misc_feature 1..20: note = CRISPR gRNA sequence
  source 1..20: mol_type = other DNA
ctcctcctgtcttggcctcc

SEQ ID NO: 77357 - DNA, 20 bp, synthetic construct
  misc_feature 1..20: note = CRISPR gRNA sequence
  source 1..20: mol_type = other DNA
ctcctgtcttggcctcccaa

SEQ ID NO: 77358 - DNA, 20 bp, synthetic construct
  misc_feature 1..20: note = CRISPR gRNA sequence
  source 1..20: mol_type = other DNA
ctgtcttggcctcccaaagt

SEQ ID NO: 77359 - DNA, 20 bp, synthetic construct
  misc_feature 1..20: note = CRISPR gRNA sequence
  source 1..20: mol_type = other DNA
tcttggcctcccaaagtgct

SEQ ID NO: 77360 - DNA, 20 bp, synthetic construct
  misc_feature 1..20: note = CRISPR gRNA sequence
  source 1..20: mol_type = other DNA
ggcctcccaaagtgctggga

SEQ ID NO: 77361 - DNA, 20 bp, synthetic construct
  misc_feature 1..20: note = CRISPR gRNA sequence
  source 1..20: mol_type = other DNA
gcctcccaaagtgctgggat

SEQ ID NO: 77362 - DNA, 20 bp, synthetic construct
  misc_feature 1..20: note = CRISPR gRNA sequence
  source 1..20: mol_type = other DNA
ccaaagtgctgggattacag

SEQ ID NO: 77363 - DNA, 20 bp, synthetic construct
  misc_feature 1..20: note = CRISPR gRNA sequence
  source 1..20: mol_type = other DNA
ggattacaggcttgagccac

SEQ ID NO: 77364 - DNA, 20 bp, synthetic construct
  misc_feature 1..20: note = CRISPR gRNA sequence
  source 1..20: mol_type = other DNA
caggcttgagccactgtgcc

SEQ ID NO: 77365 - DNA, 20 bp, synthetic construct
  misc_feature 1..20: note = CRISPR gRNA sequence
  source 1..20: mol_type = other DNA
gagccactgtgccaggccag

SEQ ID NO: 77366 - DNA, 20 bp, synthetic construct
  misc_feature 1..20: note = CRISPR gRNA sequence
  source 1..20: mol_type = other DNA
agccactgtgccaggccagt

SEQ ID NO: 77367 - DNA, 20 bp, synthetic construct
  misc_feature 1..20: note = CRISPR gRNA sequence
  source 1..20: mol_type = other DNA
tgccaggccagtaattattc

SEQ ID NO: 77368 - DNA, 20 bp, synthetic construct
  misc_feature 1..20: note = CRISPR gRNA sequence
  source 1..20: mol_type = other DNA
ttcttatctccattttacag

SEQ ID NO: 77369 - DNA, 20 bp, synthetic construct
  misc_feature 1..20: note = CRISPR gRNA sequence
  source 1..20: mol_type = other DNA
ttatctccattttacagatg

SEQ ID NO: 77370 - DNA, 20 bp, synthetic construct
  misc_feature 1..20: note = CRISPR gRNA sequence
  source 1..20: mol_type = other DNA
atctccattttacagatgag

SEQ ID NO: 77371 - DNA, 20 bp, synthetic construct
  misc_feature 1..20: note = CRISPR gRNA sequence
  source 1..20: mol_type = other DNA
tctccattttacagatgagg

SEQ ID NO: 77372 - DNA, 20 bp, synthetic construct
  misc_feature 1..20: note = CRISPR gRNA sequence
  source 1..20: mol_type = other DNA
cattttacagatgaggaaac

SEQ ID NO: 77373 - DNA, 20 bp, synthetic construct
  misc_feature 1..20: note = CRISPR gRNA sequence
  source 1..20: mol_type = other DNA
tacagatgaggaaactgagg

SEQ ID NO: 77374 - DNA, 20 bp, synthetic construct
  misc_feature 1..20: note = CRISPR gRNA sequence
  source 1..20: mol_type = other DNA
acagatgaggaaactgaggc

SEQ ID NO: 77375 - DNA, 20 bp, synthetic construct
  misc_feature 1..20: note = CRISPR gRNA sequence
  source 1..20: mol_type = other DNA
cagatgaggaaactgaggcc

SEQ ID NO: 77376 - DNA, 20 bp, synthetic construct
  misc_feature 1..20: note = CRISPR gRNA sequence
  source 1..20: mol_type = other DNA
aggcctggagaggctctggg

SEQ ID NO: 77377 - DNA, 20 bp, synthetic construct
  misc_feature 1..20: note = CRISPR gRNA sequence
  source 1..20: mol_type = other DNA
gagaggctctgggacctgct

SEQ ID NO: 77378 - DNA, 20 bp, synthetic construct
  misc_feature 1..20: note = CRISPR gRNA sequence
  source 1..20: mol_type = other DNA
tgggacctgctctgagctcg

SEQ ID NO: 77379 - DNA, 20 bp, synthetic construct
  misc_feature 1..20: note = CRISPR gRNA sequence
  source 1..20: mol_type = other DNA
ggacctgctctgagctcgca

SEQ ID NO: 77380 - DNA, 20 bp, synthetic construct
  misc_feature 1..20: note = CRISPR gRNA sequence
  source 1..20: mol_type = other DNA
ctctgagctcgcagcagtta

SEQ ID NO: 77381 - DNA, 20 bp, synthetic construct
  misc_feature 1..20: note = CRISPR gRNA sequence
  source 1..20: mol_type = other DNA
tgagctcgcagcagttaagt

SEQ ID NO: 77382 - DNA, 20 bp, synthetic construct
  misc_feature 1..20: note = CRISPR gRNA sequence
  source 1..20: mol_type = other DNA
agctcgcagcagttaagtaa

SEQ ID NO: 77383 - DNA, 20 bp, synthetic construct
  misc_feature 1..20: note = CRISPR gRNA sequence
  source 1..20: mol_type = other DNA
gcagcagttaagtaactgag

SEQ ID NO: 77384 - DNA, 20 bp, synthetic construct
  misc_feature 1..20: note = CRISPR gRNA sequence
  source 1..20: mol_type = other DNA
agtaactgagcctggtccat

SEQ ID NO: 77385 - DNA, 20 bp, synthetic construct
  misc_feature 1..20: note = CRISPR gRNA sequence
  source 1..20: mol_type = other DNA
agcctggtccatctgctgtg

SEQ ID NO: 77386 - DNA, 20 bp, synthetic construct
  misc_feature 1..20: note = CRISPR gRNA sequence
  source 1..20: mol_type = other DNA
gtccatctgctgtggcacct

SEQ ID NO: 77387 - DNA, 20 bp, synthetic construct
  misc_feature 1..20: note = CRISPR gRNA sequence
  source 1..20: mol_type = other DNA
ctgtggcacctcccattctt

SEQ ID NO: 77388 - DNA, 20 bp, synthetic construct
  misc_feature 1..20: note = CRISPR gRNA sequence
  source 1..20: mol_type = other DNA
tggcacctcccattcttggg

SEQ ID NO: 77389 - DNA, 20 bp, synthetic construct
  misc_feature 1..20: note = CRISPR gRNA sequence
  source 1..20: mol_type = other DNA
ccattcttgggggtccttag

SEQ ID NO: 77390 - DNA, 20 bp, synthetic construct
  misc_feature 1..20: note = CRISPR gRNA sequence
  source 1..20: mol_type = other DNA
ttgggggtccttagggaagg

SEQ ID NO: 77391 - DNA, 20 bp, synthetic construct
  misc_feature 1..20: note = CRISPR gRNA sequence
  source 1..20: mol_type = other DNA
gggggtccttagggaaggga

SEQ ID NO: 77392 - DNA, 20 bp, synthetic construct
  misc_feature 1..20: note = CRISPR gRNA sequence
  source 1..20: mol_type = other DNA
ggggtccttagggaagggaa

SEQ ID NO: 77393 - DNA, 20 bp, synthetic construct
  misc_feature 1..20: note = CRISPR gRNA sequence
  source 1..20: mol_type = other DNA
agggaagggaaagggaagca

SEQ ID NO: 77394 - DNA, 20 bp, synthetic construct
  misc_feature 1..20: note = CRISPR gRNA sequence
  source 1..20: mol_type = other DNA
gggaagggaaagggaagcag

SEQ ID NO: 77395 - DNA, 20 bp, synthetic construct
  misc_feature 1..20: note = CRISPR gRNA sequence
  source 1..20: mol_type = other DNA
ccctgaaaatcatggatgcg

SEQ ID NO: 77396 - DNA, 20 bp, synthetic construct
  misc_feature 1..20: note = CRISPR gRNA sequence
  source 1..20: mol_type = other DNA
aaaatcatggatgcggtgcc

SEQ ID NO: 77397 - DNA, 20 bp, synthetic construct
  misc_feature 1..20: note = CRISPR gRNA sequence
  source 1..20: mol_type = other DNA
agtgcctggggtggcttggc

SEQ ID NO: 77398 - DNA, 20 bp, synthetic construct
  misc_feature 1..20: note = CRISPR gRNA sequence
  source 1..20: mol_type = other DNA
gggtggcttggctggctggt

SEQ ID NO: 77399 - DNA, 20 bp, synthetic construct
  misc_feature 1..20: note = CRISPR gRNA sequence
  source 1..20: mol_type = other DNA
ggctggctggtgcctcccct

SEQ ID NO: 77400 - DNA, 20 bp, synthetic construct
  misc_feature 1..20: note = CRISPR gRNA sequence
  source 1..20: mol_type = other DNA
gctggctggtgcctcccctt

SEQ ID NO: 77401 - DNA, 20 bp, synthetic construct
  misc_feature 1..20: note = CRISPR gRNA sequence
  source 1..20: mol_type = other DNA
gctggtgcctccccttttat

SEQ ID NO: 77402 - DNA, 20 bp, synthetic construct
  misc_feature 1..20: note = CRISPR gRNA sequence
  source 1..20: mol_type = other DNA
gtgcctccccttttatattc

SEQ ID NO: 77403 - DNA, 20 bp, synthetic construct
  misc_feature 1..20: note = CRISPR gRNA sequence
  source 1..20: mol_type = other DNA
cccttttatattctcatcag

SEQ ID NO: 77404 - DNA, 20 bp, synthetic construct
  misc_feature 1..20: note = CRISPR gRNA sequence
  source 1..20: mol_type = other DNA
ttatattctcatcagctccc

SEQ ID NO: 77405 - DNA, 20 bp, synthetic construct
  misc_feature 1..20: note = CRISPR gRNA sequence
  source 1..20: mol_type = other DNA
tatattctcatcagctccca

SEQ ID NO: 77406 - DNA, 20 bp, synthetic construct
  misc_feature 1..20: note = CRISPR gRNA sequence
  source 1..20: mol_type = other DNA
atattctcatcagctcccac

SEQ ID NO: 77407 - DNA, 20 bp, synthetic construct
  misc_feature 1..20: note = CRISPR gRNA sequence
  source 1..20: mol_type = other DNA
tattctcatcagctcccaca

SEQ ID NO: 77408 - DNA, 20 bp, synthetic construct
  misc_feature 1..20: note = CRISPR gRNA sequence
  source 1..20: mol_type = other DNA
tcatcagctcccacaattaa

SEQ ID NO: 77409 - DNA, 20 bp, synthetic construct
  misc_feature 1..20: note = CRISPR gRNA sequence
  source 1..20: mol_type = other DNA
atcagctcccacaattaaga

SEQ ID NO: 77410 - DNA, 20 bp, synthetic construct
  misc_feature 1..20: note = CRISPR gRNA sequence
  source 1..20: mol_type = other DNA
ccacaattaagacaggtccc

SEQ ID NO: 77411 - DNA, 20 bp, synthetic construct
  misc_feature 1..20: note = CRISPR gRNA sequence
  source 1..20: mol_type = other DNA
agacaggtccctgagtcccc

SEQ ID NO: 77412 - DNA, 20 bp, synthetic construct
  misc_feature 1..20: note = CRISPR gRNA sequence
  source 1..20: mol_type = other DNA
agtccccagtggcaactagg

SEQ ID NO: 77413 - DNA, 20 bp, synthetic construct
  misc_feature 1..20: note = CRISPR gRNA sequence
  source 1..20: mol_type = other DNA
ggaagctcccagttttcttt

SEQ ID NO: 77414 - DNA, 20 bp, synthetic construct
  misc_feature 1..20: note = CRISPR gRNA sequence
  source 1..20: mol_type = other DNA
ccagttttcttttcttttct

SEQ ID NO: 77415 - DNA, 20 bp, synthetic construct
  misc_feature 1..20: note = CRISPR gRNA sequence
  source 1..20: mol_type = other DNA
tcttttcttttctttttttt

SEQ ID NO: 77416 - DNA, 20 bp, synthetic construct
  misc_feature 1..20: note = CRISPR gRNA sequence
  source 1..20: mol_type = other DNA
cttttcttttcttttttttt

SEQ ID NO: 77417 - DNA, 20 bp, synthetic construct
  misc_feature 1..20: note = CRISPR gRNA sequence
  source 1..20: mol_type = other DNA
ttttcttttctttttttttt

SEQ ID NO: 77418 - DNA, 20 bp, synthetic construct
  misc_feature 1..20: note = CRISPR gRNA sequence
  source 1..20: mol_type = other DNA
ttcttttctttttttttttg

SEQ ID NO: 77419 - DNA, 20 bp, synthetic construct
  misc_feature 1..20: note = CRISPR gRNA sequence
  source 1..20: mol_type = other DNA
tcttttctttttttttttga

SEQ ID NO: 77420 - DNA, 20 bp, synthetic construct
  misc_feature 1..20: note = CRISPR gRNA sequence
  source 1..20: mol_type = other DNA
cttttctttttttttttgag

SEQ ID NO: 77421 - DNA, 20 bp, synthetic construct
  misc_feature 1..20: note = CRISPR gRNA sequence
  source 1..20: mol_type = other DNA
ttttctttttttttttgaga

SEQ ID NO: 77422 - DNA, 20 bp, synthetic construct
  misc_feature 1..20: note = CRISPR gRNA sequence
  source 1..20: mol_type = other DNA
ttctttttttttttgagatg

SEQ ID NO: 77423 - DNA, 20 bp, synthetic construct
  misc_feature 1..20: note = CRISPR gRNA sequence
  source 1..20: mol_type = other DNA
tctttttttttttgagatgg

SEQ ID NO: 77424 - DNA, 20 bp, synthetic construct
  misc_feature 1..20: note = CRISPR gRNA sequence
  source 1..20: mol_type = other DNA
ctttttttttttgagatgga

SEQ ID NO: 77425 - DNA, 20 bp, synthetic construct
  misc_feature 1..20: note = CRISPR gRNA sequence
  source 1..20: mol_type = other DNA
tttttttttttgagatggag

SEQ ID NO: 77426 - DNA, 20 bp, synthetic construct
  misc_feature 1..20: note = CRISPR gRNA sequence
  source 1..20: mol_type = other DNA
tttttttttgagatggagtc

SEQ ID NO: 77427 - DNA, 20 bp, synthetic construct
  misc_feature 1..20: note = CRISPR gRNA sequence
  source 1..20: mol_type = other DNA
ttttttttgagatggagtct

SEQ ID NO: 77428 - DNA, 20 bp, synthetic construct
  misc_feature 1..20: note = CRISPR gRNA sequence
  source 1..20: mol_type = other DNA
tttttttgagatggagtctc

SEQ ID NO: 77429 - DNA, 20 bp, synthetic construct
  misc_feature 1..20: note = CRISPR gRNA sequence
  source 1..20: mol_type = other DNA
ttttttgagatggagtctca

SEQ ID NO: 77430 - DNA, 20 bp, synthetic construct
  misc_feature 1..20: note = CRISPR gRNA sequence
  source 1..20: mol_type = other DNA
tttttgagatggagtctcac

SEQ ID NO: 77431 - DNA, 20 bp, synthetic construct
  misc_feature 1..20: note = CRISPR gRNA sequence
  source 1..20: mol_type = other DNA
ttttgagatggagtctcact

SEQ ID NO: 77432 - DNA, 20 bp, synthetic construct
  misc_feature 1..20: note = CRISPR gRNA sequence
  source 1..20: mol_type = other DNA
tttgagatggagtctcactc

SEQ ID NO: 77433 - DNA, 20 bp, synthetic construct
  misc_feature 1..20: note = CRISPR gRNA sequence
  source 1..20: mol_type = other DNA
ttgagatggagtctcactct

SEQ ID NO: 77434 - DNA, 20 bp, synthetic construct
  misc_feature 1..20: note = CRISPR gRNA sequence
  source 1..20: mol_type = other DNA
tgagatggagtctcactctg

SEQ ID NO: 77435 - DNA, 20 bp, synthetic construct
  misc_feature 1..20: note = CRISPR gRNA sequence
  source 1..20: mol_type = other DNA
gagatggagtctcactctgt

SEQ ID NO: 77436 - DNA, 20 bp, synthetic construct
  misc_feature 1..20: note = CRISPR gRNA sequence
  source 1..20: mol_type = other DNA
agatggagtctcactctgtc

SEQ ID NO: 77437 - DNA, 20 bp, synthetic construct
  misc_feature 1..20: note = CRISPR gRNA sequence
  source 1..20: mol_type = other DNA
actctgtcgcccaggctgga

SEQ ID NO: 77438 - DNA, 20 bp, synthetic construct
  misc_feature 1..20: note = CRISPR gRNA sequence
  source 1..20: mol_type = other DNA
tgtcgcccaggctggagtgc

SEQ ID NO: 77439 - DNA, 20 bp, synthetic construct
  misc_feature 1..20: note = CRISPR gRNA sequence
  source 1..20: mol_type = other DNA
tcgcccaggctggagtgcag

SEQ ID NO: 77440 - DNA, 20 bp, synthetic construct
  misc_feature 1..20: note = CRISPR gRNA sequence
  source 1..20: mol_type = other DNA
gagtgcagtggcacgatctc

SEQ ID NO: 77441 - DNA, 20 bp, synthetic construct
  misc_feature 1..20: note = CRISPR gRNA sequence
  source 1..20: mol_type = other DNA
agctcactgcaaccttcgcc

SEQ ID NO: 77442 - DNA, 20 bp, synthetic construct
  misc_feature 1..20: note = CRISPR gRNA sequence
  source 1..20: mol_type = other DNA
actgcaaccttcgcctcctg

SEQ ID NO: 77443 - DNA, 20 bp, synthetic construct
  misc_feature 1..20: note = CRISPR gRNA sequence
  source 1..20: mol_type = other DNA
caaccttcgcctcctgggtt

SEQ ID NO: 77444 - DNA, 20 bp, synthetic construct
  misc_feature 1..20: note = CRISPR gRNA sequence
  source 1..20: mol_type = other DNA
cgcctcctgggttcaagtga

SEQ ID NO: 77445 - DNA, 20 bp, synthetic construct
  misc_feature 1..20: note = CRISPR gRNA sequence
  source 1..20: mol_type = other DNA
gcctcctgggttcaagtgat

SEQ ID NO: 77446 - DNA, 20 bp, synthetic construct
  misc_feature 1..20: note = CRISPR gRNA sequence
  source 1..20: mol_type = other DNA
ctgggttcaagtgattctcc

SEQ ID NO: 77447 - DNA, 20 bp, synthetic construct
  misc_feature 1..20: note = CRISPR gRNA sequence
  source 1..20: mol_type = other DNA
ggttcaagtgattctcctga

SEQ ID NO: 77448 - DNA, 20 bp, synthetic construct
  misc_feature 1..20: note = CRISPR gRNA sequence
  source 1..20: mol_type = other DNA
aagtgattctcctgactcct

SEQ ID NO: 77449 - DNA, 20 bp, synthetic construct
  misc_feature 1..20: note = CRISPR gRNA sequence
  source 1..20: mol_type = other DNA
tcctgactcctgagcggctg

SEQ ID NO: 77450 - DNA, 20 bp, synthetic construct
  misc_feature 1..20: note = CRISPR gRNA sequence
  source 1..20: mol_type = other DNA
ctgactcctgagcggctggc

SEQ ID NO: 77451 - DNA, 20 bp, synthetic construct
  misc_feature 1..20: note = CRISPR gRNA sequence
  source 1..20: mol_type = other DNA
actcctgagcggctggcact

SEQ ID NO: 77452 - DNA, 20 bp, synthetic construct
  misc_feature 1..20: note = CRISPR gRNA sequence
  source 1..20: mol_type = other DNA
ctgagcggctggcactacaa

SEQ ID NO: 77453 - DNA, 20 bp, synthetic construct
  misc_feature 1..20: note = CRISPR gRNA sequence
  source 1..20: mol_type = other DNA
agcggctggcactacaaggg

SEQ ID NO: 77454 - DNA, 20 bp, synthetic construct
  misc_feature 1..20: note = CRISPR gRNA sequence
  source 1..20: mol_type = other DNA
gcactacaagggctcacaac

SEQ ID NO: 77455 - DNA, 20 bp, synthetic construct
  misc_feature 1..20: note = CRISPR gRNA sequence
  source 1..20: mol_type = other DNA
caagggctcacaaccacgcc

SEQ ID NO: 77456 - DNA, 20 bp, synthetic construct
  misc_feature 1..20: note = CRISPR gRNA sequence
  source 1..20: mol_type = other DNA
acaaccacgcccagatactt

SEQ ID NO: 77457 - DNA, 20 bp, synthetic construct
  misc_feature 1..20: note = CRISPR gRNA sequence
  source 1..20: mol_type = other DNA
ttttttttttttttggtatt

SEQ ID NO: 77458 - DNA, 20 bp, synthetic construct
  misc_feature 1..20: note = CRISPR gRNA sequence
  source 1..20: mol_type = other DNA
tttttttttttttggtattt

SEQ ID NO: 77459 - DNA, 20 bp, synthetic construct
  misc_feature 1..20: note = CRISPR gRNA sequence
  source 1..20: mol_type = other DNA
ttttttttttttggtatttt

SEQ ID NO: 77460 - DNA, 20 bp, synthetic construct
  misc_feature 1..20: note = CRISPR gRNA sequence
  source 1..20: mol_type = other DNA
tttttttttttggtattttt

SEQ ID NO: 77461 - DNA, 20 bp, synthetic construct
  misc_feature 1..20: note = CRISPR gRNA sequence
  source 1..20: mol_type = other DNA
ttttttttttggtattttta

SEQ ID NO: 77462 - DNA, 20 bp, synthetic construct
  misc_feature 1..20: note = CRISPR gRNA sequence
  source 1..20: mol_type = other DNA
tttttttttggtatttttag

SEQ ID NO: 77463 - DNA, 20 bp, synthetic construct
  misc_feature 1..20: note = CRISPR gRNA sequence
  source 1..20: mol_type = other DNA
ttttttttggtatttttagc

SEQ ID NO: 77464 - DNA, 20 bp, synthetic construct
  misc_feature 1..20: note = CRISPR gRNA sequence
  source 1..20: mol_type = other DNA
tttttttggtatttttagca

SEQ ID NO: 77465 - DNA, 20 bp, synthetic construct
  misc_feature 1..20: note = CRISPR gRNA sequence
  source 1..20: mol_type = other DNA
ttttttggtatttttagcag

SEQ ID NO: 77466 - DNA, 20 bp, synthetic construct
  misc_feature 1..20: note = CRISPR gRNA sequence
  source 1..20: mol_type = other DNA
tttttggtatttttagcaga

SEQ ID NO: 77467 - DNA, 20 bp, synthetic construct
  misc_feature 1..20: note = CRISPR gRNA sequence
  source 1..20: mol_type = other DNA
ttttggtatttttagcagag

SEQ ID NO: 77468 - DNA, 20 bp, synthetic construct
  misc_feature 1..20: note = CRISPR gRNA sequence
  source 1..20: mol_type = other DNA
tttggtatttttagcagaga

SEQ ID NO: 77469 - DNA, 20 bp, synthetic construct
  misc_feature 1..20: note = CRISPR gRNA sequence
  source 1..20: mol_type = other DNA
ttggtatttttagcagagac

SEQ ID NO: 77470 - DNA, 20 bp, synthetic construct
  misc_feature 1..20: note = CRISPR gRNA sequence
  source 1..20: mol_type = other DNA
tggtatttttagcagagaca

SEQ ID NO: 77471 - DNA, 20 bp, synthetic construct
  misc_feature 1..20: note = CRISPR gRNA sequence
  source 1..20: mol_type = other DNA
ggtatttttagcagagacag

SEQ ID NO: 77472 - DNA, 20 bp, synthetic construct
  misc_feature 1..20: note = CRISPR gRNA sequence
  source 1..20: mol_type = other DNA
gtatttttagcagagacagg

SEQ ID NO: 77473 - DNA, 20 bp, synthetic construct
  misc_feature 1..20: note = CRISPR gRNA sequence
  source 1..20: mol_type = other DNA
ttagcagagacagggtttca

SEQ ID NO: 77474 - DNA, 20 bp, synthetic construct
  misc_feature 1..20: note = CRISPR gRNA sequence
  source 1..20: mol_type = other DNA
tagcagagacagggtttcac

SEQ ID NO: 77475 - DNA, 20 bp, synthetic construct
  misc_feature 1..20: note = CRISPR gRNA sequence
  source 1..20: mol_type = other DNA
agcagagacagggtttcacc

SEQ ID NO: 77476 - DNA, 20 bp, synthetic construct
  misc_feature 1..20: note = CRISPR gRNA sequence
  source 1..20: mol_type = other DNA
gcagagacagggtttcaccc

SEQ ID NO: 77477 - DNA, 20 bp, synthetic construct
  misc_feature 1..20: note = CRISPR gRNA sequence
  source 1..20: mol_type = other DNA
caccctgttggccaggctgt

SEQ ID NO: 77478 - DNA, 20 bp, synthetic construct
  misc_feature 1..20: note = CRISPR gRNA sequence
  source 1..20: mol_type = other DNA
accctgttggccaggctgtt

SEQ ID NO: 77479 - DNA, 20 bp, synthetic construct
  misc_feature 1..20: note = CRISPR gRNA sequence
  source 1..20: mol_type = other DNA
ttggccaggctgttctcaaa

SEQ ID NO: 77480 - DNA, 20 bp, synthetic construct
  misc_feature 1..20: note = CRISPR gRNA sequence
  source 1..20: mol_type = other DNA
gccaggctgttctcaaactc

SEQ ID NO: 77481 - DNA, 20 bp, synthetic construct
  misc_feature 1..20: note = CRISPR gRNA sequence
  source 1..20: mol_type = other DNA
ttctcaaactcctgacctca

SEQ ID NO: 77482 - DNA, 20 bp, synthetic construct
  misc_feature 1..20: note = CRISPR gRNA sequence
  source 1..20: mol_type = other DNA
tcaaactcctgacctcacgt

SEQ ID NO: 77483 - DNA, 20 bp, synthetic construct
  misc_feature 1..20: note = CRISPR gRNA sequence
  source 1..20: mol_type = other DNA
aaactcctgacctcacgtga

SEQ ID NO: 77484 - DNA, 20 bp, synthetic construct
  misc_feature 1..20: note = CRISPR gRNA sequence
  source 1..20: mol_type = other DNA
ctgacctcacgtgatccgcc

SEQ ID NO: 77485 - DNA, 20 bp, synthetic construct
  misc_feature 1..20: note = CRISPR gRNA sequence
  source 1..20: mol_type = other DNA
acctcacgtgatccgcccac

SEQ ID NO: 77486 - DNA, 20 bp, synthetic construct
  misc_feature 1..20: note = CRISPR gRNA sequence
  source 1..20: mol_type = other DNA
acgtgatccgcccaccttgg

SEQ ID NO: 77487 - DNA, 20 bp, synthetic construct
  misc_feature 1..20: note = CRISPR gRNA sequence
  source 1..20: mol_type = other DNA
ggcctcccaaaatgctggga

SEQ ID NO: 77488 - DNA, 20 bp, synthetic construct
  misc_feature 1..20: note = CRISPR gRNA sequence
  source 1..20: mol_type = other DNA
gcctcccaaaatgctgggat

SEQ ID NO: 77489 - DNA, 20 bp, synthetic construct
  misc_feature 1..20: note = CRISPR gRNA sequence
  source 1..20: mol_type = other DNA
ccaaaatgctgggattacag

SEQ ID NO: 77490 - DNA, 20 bp, synthetic construct
  misc_feature 1..20: note = CRISPR gRNA sequence
  source 1..20: mol_type = other DNA
ggattacaggcgtgagccac

SEQ ID NO: 77491 - DNA, 20 bp, synthetic construct
  misc_feature 1..20: note = CRISPR gRNA sequence
  source 1..20: mol_type = other DNA
caggcgtgagccaccgcgcc

SEQ ID NO: 77492 - DNA, 20 bp, synthetic construct
  misc_feature 1..20: note = CRISPR gRNA sequence
  source 1..20: mol_type = other DNA
gcccccagttttcttaaaag

SEQ ID NO: 77493 - DNA, 20 bp, synthetic construct
  misc_feature 1..20: note = CRISPR gRNA sequence
  source 1..20: mol_type = other DNA
tcttaaaagtctctgcagca

SEQ ID NO: 77494 - DNA, 20 bp, synthetic construct
  misc_feature 1..20: note = CRISPR gRNA sequence
  source 1..20: mol_type = other DNA
cttaaaagtctctgcagcat

SEQ ID NO: 77495 - DNA, 20 bp, synthetic construct
  misc_feature 1..20: note = CRISPR gRNA sequence
  source 1..20: mol_type = other DNA
ttaaaagtctctgcagcata

SEQ ID NO: 77496 - DNA, 20 bp, synthetic construct
  misc_feature 1..20: note = CRISPR gRNA sequence
  source 1..20: mol_type = other DNA
aaaagtctctgcagcatacc

SEQ ID NO: 77497 - DNA, 20 bp, synthetic construct
  misc_feature 1..20: note = CRISPR gRNA sequence
  source 1..20: mol_type = other DNA
aaagtctctgcagcatacca

SEQ ID NO: 77498 - DNA, 20 bp, synthetic construct
  misc_feature 1..20: note = CRISPR gRNA sequence
  source 1..20: mol_type = other DNA
tgcagcataccaacatggca

SEQ ID NO: 77499 - DNA, 20 bp, synthetic construct
  misc_feature 1..20: note = CRISPR gRNA sequence
  source 1..20: mol_type = other DNA
cagcataccaacatggcaca

SEQ ID NO: 77500 - DNA, 20 bp, synthetic construct
  misc_feature 1..20: note = CRISPR gRNA sequence
  source 1..20: mol_type = other DNA
tatgttgtgcacatgtaccc

SEQ ID NO: 77501 - DNA, 20 bp, synthetic construct
  misc_feature 1..20: note = CRISPR gRNA sequence
  source 1..20: mol_type = other DNA
tgcacatgtaccctagaact

SEQ ID NO: 77502 - DNA, 20 bp, synthetic construct
  misc_feature 1..20: note = CRISPR gRNA sequence
  source 1..20: mol_type = other DNA
gaacttaaagtataataatt

SEQ ID NO: 77503 - DNA, 20 bp, synthetic construct
  misc_feature 1..20: note = CRISPR gRNA sequence
  source 1..20: mol_type = other DNA
aaagtataataattaaaaaa

SEQ ID NO: 77504 - DNA, 20 bp, synthetic construct
  misc_feature 1..20: note = CRISPR gRNA sequence
  source 1..20: mol_type = other DNA
aagtataataattaaaaaaa

SEQ ID NO: 77505 - DNA, 20 bp, synthetic construct
  misc_feature 1..20: note = CRISPR gRNA sequence
  source 1..20: mol_type = other DNA
aaaaaaaaatcctaaaaaaa

SEQ ID NO: 77506 - DNA, 20 bp, synthetic construct
  misc_feature 1..20: note = CRISPR gRNA sequence
  source 1..20: mol_type = other DNA
aaaaaaaaaatctctaagga

SEQ ID NO: 77507 - DNA, 20 bp, synthetic construct
  misc_feature 1..20: note = CRISPR gRNA sequence
  source 1..20: mol_type = other DNA
taaggactatccaaagaacg

SEQ ID NO: 77508 - DNA, 20 bp, synthetic construct
  misc_feature 1..20: note = CRISPR gRNA sequence
  source 1..20: mol_type = other DNA
aggactatccaaagaacgag

SEQ ID NO: 77509 - DNA, 20 bp, synthetic construct
  misc_feature 1..20: note = CRISPR gRNA sequence
  source 1..20: mol_type = other DNA
tccaaagaacgagtgaggca

SEQ ID NO: 77510 - DNA, 20 bp, synthetic construct
  misc_feature 1..20: note = CRISPR gRNA sequence
  source 1..20: mol_type = other DNA
tctaatggtgaatttggaga

SEQ ID NO: 77511 - DNA, 20 bp, synthetic construct
  misc_feature 1..20: note = CRISPR gRNA sequence
  source 1..20: mol_type = other DNA
taatggtgaatttggagaaa

SEQ ID NO: 77512 - DNA, 20 bp, synthetic construct
  misc_feature 1..20: note = CRISPR gRNA sequence
  source 1..20: mol_type = other DNA
atggtgaatttggagaaatt

SEQ ID NO: 77513 - DNA, 20 bp, synthetic construct
  misc_feature 1..20: note = CRISPR gRNA sequence
  source 1..20: mol_type = other DNA
ggagaaatttgagcatccgt

SEQ ID NO: 77514 - DNA, 20 bp, synthetic construct
  misc_feature 1..20: note = CRISPR gRNA sequence
  source 1..20: mol_type = other DNA
gagaaatttgagcatccgtg

SEQ ID NO: 77515 - DNA, 20 bp, synthetic construct
  misc_feature 1..20: note = CRISPR gRNA sequence
  source 1..20: mol_type = other DNA
gagcatccgtgaggccatac

SEQ ID NO: 77516 - DNA, 20 bp, synthetic construct
  misc_feature 1..20: note = CRISPR gRNA sequence
  source 1..20: mol_type = other DNA
agcatccgtgaggccatact

SEQ ID NO: 77517 - DNA, 20 bp, synthetic construct
  misc_feature 1..20: note = CRISPR gRNA sequence
  source 1..20: mol_type = other DNA
attcattcatttgatcattc

SEQ ID NO: 77518 - DNA, 20 bp, synthetic construct
  misc_feature 1..20: note = CRISPR gRNA sequence
  source 1..20: mol_type = other DNA
ttcattcatttgatcattca

SEQ ID NO: 77519 - DNA, 20 bp, synthetic construct
  misc_feature 1..20: note = CRISPR gRNA sequence
  source 1..20: mol_type = other DNA
attcatttgatcattcattc

SEQ ID NO: 77520 - DNA, 20 bp, synthetic construct
  misc_feature 1..20: note = CRISPR gRNA sequence
  source 1..20: mol_type = other DNA
atttgatcattcattcattc

SEQ ID NO: 77521 - DNA, 20 bp, synthetic construct
  misc_feature 1..20: note = CRISPR gRNA sequence
  source 1..20: mol_type = other DNA
gatcattcattcattcagtg

SEQ ID NO: 77522 - DNA, 20 bp, synthetic construct
  misc_feature 1..20: note = CRISPR gRNA sequence
  source 1..20: mol_type = other DNA
atcattcattcattcagtgg

SEQ ID NO: 77523 - DNA, 20 bp, synthetic construct
  misc_feature 1..20: note = CRISPR gRNA sequence
  source 1..20: mol_type = other DNA
attcattcagtggacgccca

SEQ ID NO: 77524 - DNA, 20 bp, synthetic construct
  misc_feature 1..20: note = CRISPR gRNA sequence
  source 1..20: mol_type = other DNA
attcagtggacgcccatcac

SEQ ID NO: 77525 - DNA, 20 bp, synthetic construct
  misc_feature 1..20: note = CRISPR gRNA sequence
  source 1..20: mol_type = other DNA
agtggacgcccatcacatgc

SEQ ID NO: 77526 - DNA, 20 bp, synthetic construct
  misc_feature 1..20: note = CRISPR gRNA sequence
  source 1..20: mol_type = other DNA
tgcagatctggtactgccca

SEQ ID NO: 77527 - DNA, 20 bp, synthetic construct
  misc_feature 1..20: note = CRISPR gRNA sequence
  source 1..20: mol_type = other DNA
cagatctggtactgcccaag

SEQ ID NO: 77528 - DNA, 20 bp, synthetic construct
  misc_feature 1..20: note = CRISPR gRNA sequence
  source 1..20: mol_type = other DNA
gtactgcccaaggtgctgag

SEQ ID NO: 77529 - DNA, 20 bp, synthetic construct
  misc_feature 1..20: note = CRISPR gRNA sequence
  source 1..20: mol_type = other DNA
cccaaggtgctgaggatgac

SEQ ID NO: 77530 - DNA, 20 bp, synthetic construct
  misc_feature 1..20: note = CRISPR gRNA sequence
  source 1..20: mol_type = other DNA
aggatgacaggttggcatga

SEQ ID NO: 77531 - DNA, 20 bp, synthetic construct
  misc_feature 1..20: note = CRISPR gRNA sequence
  source 1..20: mol_type = other DNA
gcatgaaactggtggacaag

SEQ ID NO: 77532 - DNA, 20 bp, synthetic construct
  misc_feature 1..20: note = CRISPR gRNA sequence
  source 1..20: mol_type = other DNA
gtggacaaggggcccacgtg

SEQ ID NO: 77533 - DNA, 20 bp, synthetic construct
  misc_feature 1..20: note = CRISPR gRNA sequence
  source 1..20: mol_type = other DNA
tgggatgggggacaggggca

SEQ ID NO: 77534 - DNA, 20 bp, synthetic construct
  misc_feature 1..20: note = CRISPR gRNA sequence
  source 1..20: mol_type = other DNA
ggggcggagaggcacgctca

SEQ ID NO: 77535 - DNA, 20 bp, synthetic construct
  misc_feature 1..20: note = CRISPR gRNA sequence
  source 1..20: mol_type = other DNA
acctgatgtccaagcggaag

SEQ ID NO: 77536 - DNA, 20 bp, synthetic construct
  misc_feature 1..20: note = CRISPR gRNA sequence
  source 1..20: mol_type = other DNA
atgtccaagcggaagagcca

SEQ ID NO: 77537 - DNA, 20 bp, synthetic construct
  misc_feature 1..20: note = CRISPR gRNA sequence
  source 1..20: mol_type = other DNA
cagagtggagaagcaccgaa

SEQ ID NO: 77538 - DNA, 20 bp, synthetic construct
  misc_feature 1..20: note = CRISPR gRNA sequence
  source 1..20: mol_type = other DNA
tcactgaggctggagatcac

SEQ ID NO: 77539 - DNA, 20 bp, synthetic construct
  misc_feature 1..20: note = CRISPR gRNA sequence
  source 1..20: mol_type = other DNA
actgaggctggagatcacag

SEQ ID NO: 77540 - DNA, 20 bp, synthetic construct
  misc_feature 1..20: note = CRISPR gRNA sequence
  source 1..20: mol_type = other DNA
aggctggagatcacaggggt

SEQ ID NO: 77541 - DNA, 20 bp, synthetic construct
  misc_feature 1..20: note = CRISPR gRNA sequence
  source 1..20: mol_type = other DNA
gagatcacaggggtggcaca

SEQ ID NO: 77542 - DNA, 20 bp, synthetic construct
  misc_feature 1..20: note = CRISPR gRNA sequence
  source 1..20: mol_type = other DNA
aggacccaaacacatcctct

SEQ ID NO: 77543 - DNA, 20 bp, synthetic construct
  misc_feature 1..20: note = CRISPR gRNA sequence
  source 1..20: mol_type = other DNA
tttgtggtcagggcacaggg

SEQ ID NO: 77544 - DNA, 20 bp, synthetic construct
  misc_feature 1..20: note = CRISPR gRNA sequence
  source 1..20: mol_type = other DNA
tgtggtcagggcacagggcg

SEQ ID NO: 77545 - DNA, 20 bp, synthetic construct
  misc_feature 1..20: note = CRISPR gRNA sequence
  source 1..20: mol_type = other DNA
gtggtcagggcacagggcgg

SEQ ID NO: 77546 - DNA, 20 bp, synthetic construct
  misc_feature 1..20: note = CRISPR gRNA sequence
  source 1..20: mol_type = other DNA
tggtcagggcacagggcggg

SEQ ID NO: 77547 - DNA, 20 bp, synthetic construct
  misc_feature 1..20: note = CRISPR gRNA sequence
  source 1..20: mol_type = other DNA
gttccagatgacggaaccca

SEQ ID NO: 77548 - DNA, 20 bp, synthetic construct
  misc_feature 1..20: note = CRISPR gRNA sequence
  source 1..20: mol_type = other DNA
cagatgacggaacccactga

SEQ ID NO: 77549 - DNA, 20 bp, synthetic construct
  misc_feature 1..20: note = CRISPR gRNA sequence
  source 1..20: mol_type = other DNA
aacccaagatggtcagagag

SEQ ID NO: 77550 - DNA, 20 bp, synthetic construct
  misc_feature 1..20: note = CRISPR gRNA sequence
  source 1..20: mol_type = other DNA
gcaagtcctcatggtggaga

SEQ ID NO: 77551 - DNA, 20 bp, synthetic construct
  misc_feature 1..20: note = CRISPR gRNA sequence
  source 1..20: mol_type = other DNA
caagtcctcatggtggagat

SEQ ID NO: 77552 - DNA, 20 bp, synthetic construct
  misc_feature 1..20: note = CRISPR gRNA sequence
  source 1..20: mol_type = other DNA
atggtggagatggggaaaca

SEQ ID NO: 77553 - DNA, 20 bp, synthetic construct
  misc_feature 1..20: note = CRISPR gRNA sequence
  source 1..20: mol_type = other DNA
gagagaatcaaggtctagcc

SEQ ID NO: 77554 - DNA, 20 bp, synthetic construct
  misc_feature 1..20: note = CRISPR gRNA sequence
  source 1..20: mol_type = other DNA
gcccaaggttatgagacatg

SEQ ID NO: 77555 - DNA, 20 bp, synthetic construct
  misc_feature 1..20: note = CRISPR gRNA sequence
  source 1..20: mol_type = other DNA
tgagacatgttggtgacaga

SEQ ID NO: 77556 - DNA, 20 bp, synthetic construct
  misc_feature 1..20: note = CRISPR gRNA sequence
  source 1..20: mol_type = other DNA
gtgacagagctgagatgggc

SEQ ID NO: 77557 - DNA, 20 bp, synthetic construct
  misc_feature 1..20: note = CRISPR gRNA sequence
  source 1..20: mol_type = other DNA
agatgggcacccagtgggtc

SEQ ID NO: 77558 - DNA, 20 bp, synthetic construct
  misc_feature 1..20: note = CRISPR gRNA sequence
  source 1..20: mol_type = other DNA
ggtctgtgatggatctgagg

SEQ ID NO: 77559 - DNA, 20 bp, synthetic construct
  misc_feature 1..20: note = CRISPR gRNA sequence
  source 1..20: mol_type = other DNA
tgatggatctgaggagtgct

SEQ ID NO: 77560 - DNA, 20 bp, synthetic construct
  misc_feature 1..20: note = CRISPR gRNA sequence
  source 1..20: mol_type = other DNA
aggagtgctttctggctgga

SEQ ID NO: 77561 - DNA, 20 bp, synthetic construct
  misc_feature 1..20: note = CRISPR gRNA sequence
  source 1..20: mol_type = other DNA
tctggctggagctgggcctc

SEQ ID NO: 77562 - DNA, 20 bp, synthetic construct
  misc_feature 1..20: note = CRISPR gRNA sequence
  source 1..20: mol_type = other DNA
ctggctggagctgggcctcc

SEQ ID NO: 77563 - DNA, 20 bp, synthetic construct
  misc_feature 1..20: note = CRISPR gRNA sequence
  source 1..20: mol_type = other DNA
tggctggagctgggcctcct

SEQ ID NO: 77564 - DNA, 20 bp, synthetic construct
  misc_feature 1..20: note = CRISPR gRNA sequence
  source 1..20: mol_type = other DNA
gctggagctgggcctccttt

SEQ ID NO: 77565 - DNA, 20 bp, synthetic construct
  misc_feature 1..20: note = CRISPR gRNA sequence
  source 1..20: mol_type = other DNA
gagctgggcctccttttctc

SEQ ID NO: 77566 - DNA, 20 bp, synthetic construct
  misc_feature 1..20: note = CRISPR gRNA sequence
  source 1..20: mol_type = other DNA
ggcctccttttctccacctg

SEQ ID NO: 77567 - DNA, 20 bp, synthetic construct
  misc_feature 1..20: note = CRISPR gRNA sequence
  source 1..20: mol_type = other DNA
cttttctccacctgataagg

SEQ ID NO: 77568 - DNA, 20 bp, synthetic construct
  misc_feature 1..20: note = CRISPR gRNA sequence
  source 1..20: mol_type = other DNA
ttctccacctgataagggag

SEQ ID NO: 77569 - DNA, 20 bp, synthetic construct
  misc_feature 1..20: note = CRISPR gRNA sequence
  source 1..20: mol_type = other DNA
tctccacctgataagggagg

SEQ ID NO: 77570 - DNA, 20 bp, synthetic construct
  misc_feature 1..20: note = CRISPR gRNA sequence
  source 1..20: mol_type = other DNA
ctccacctgataagggaggg

SEQ ID NO: 77571 - DNA, 20 bp, synthetic construct
  misc_feature 1..20: note = CRISPR gRNA sequence
  source 1..20: mol_type = other DNA
tccacctgataagggagggg

SEQ ID NO: 77572 - DNA, 20 bp, synthetic construct
  misc_feature 1..20: note = CRISPR gRNA sequence
  source 1..20: mol_type = other DNA
cacctgataagggaggggtg

SEQ ID NO: 77573 - DNA, 20 bp, synthetic construct
  misc_feature 1..20: note = CRISPR gRNA sequence
  source 1..20: mol_type = other DNA
ataagggaggggtggtaccc

SEQ ID NO: 77574 - DNA, 20 bp, synthetic construct
  misc_feature 1..20: note = CRISPR gRNA sequence
  source 1..20: mol_type = other DNA
ttgtgcagaaagcaggaaca

SEQ ID NO: 77575 - DNA, 20 bp, synthetic construct
  misc_feature 1..20: note = CRISPR gRNA sequence
  source 1..20: mol_type = other DNA
gtgcagaaagcaggaacaaa

SEQ ID NO: 77576 - DNA, 20 bp, synthetic construct
  misc_feature 1..20: note = CRISPR gRNA sequence
  source 1..20: mol_type = other DNA
tgcagaaagcaggaacaaag

SEQ ID NO: 77577 - DNA, 20 bp, synthetic construct
  misc_feature 1..20: note = CRISPR gRNA sequence
  source 1..20: mol_type = other DNA
ctttctttcagggtctcctg

SEQ ID NO: 77578 - DNA, 20 bp, synthetic construct
  misc_feature 1..20: note = CRISPR gRNA sequence
  source 1..20: mol_type = other DNA
tctttcagggtctcctgtca

SEQ ID NO: 77579 - DNA, 20 bp, synthetic construct
  misc_feature 1..20: note = CRISPR gRNA sequence
  source 1..20: mol_type = other DNA
ctttcagggtctcctgtcaa

SEQ ID NO: 77580 - DNA, 20 bp, synthetic construct
  misc_feature 1..20: note = CRISPR gRNA sequence
  source 1..20: mol_type = other DNA
tttcagggtctcctgtcaac

SEQ ID NO: 77581 - DNA, 20 bp, synthetic construct
  misc_feature 1..20: note = CRISPR gRNA sequence
  source 1..20: mol_type = other DNA
tcagggtctcctgtcaactt

SEQ ID NO: 77582 - DNA, 20 bp, synthetic construct
  misc_feature 1..20: note = CRISPR gRNA sequence
  source 1..20: mol_type = other DNA
cagggtctcctgtcaacttg

SEQ ID NO: 77583 - DNA, 20 bp, synthetic construct
  misc_feature 1..20: note = CRISPR gRNA sequence
  source 1..20: mol_type = other DNA
agggtctcctgtcaacttgt

SEQ ID NO: 77584 - DNA, 20 bp, synthetic construct
  misc_feature 1..20: note = CRISPR gRNA sequence
  source 1..20: mol_type = other DNA
ctgtcaacttgttattgttt

SEQ ID NO: 77585 - DNA, 20 bp, synthetic construct
  misc_feature 1..20: note = CRISPR gRNA sequence
  source 1..20: mol_type = other DNA
tcaacttgttattgttttct

SEQ ID NO: 77586 - DNA, 20 bp, synthetic construct
  misc_feature 1..20: note = CRISPR gRNA sequence
  source 1..20: mol_type = other DNA
gttattgttttctatttact

SEQ ID NO: 77587 - DNA, 20 bp, synthetic construct
  misc_feature 1..20: note = CRISPR gRNA sequence
  source 1..20: mol_type = other DNA
ttattgttttctatttacta

SEQ ID NO: 77588 - DNA, 20 bp, synthetic construct
  misc_feature 1..20: note = CRISPR gRNA sequence
  source 1..20: mol_type = other DNA
ttgttttctatttactattt

SEQ ID NO: 77589 - DNA, 20 bp, synthetic construct
  misc_feature 1..20: note = CRISPR gRNA sequence
  source 1..20: mol_type = other DNA
ttttctatttactatttaat

SEQ ID NO: 77590 - DNA, 20 bp, synthetic construct
  misc_feature 1..20: note = CRISPR gRNA sequence
  source 1..20: mol_type = other DNA
tctatttactatttaatgct

SEQ ID NO: 77591 - DNA, 20 bp, synthetic construct
  misc_feature 1..20: note = CRISPR gRNA sequence
  source 1..20: mol_type = other DNA
ctatttactatttaatgcta

SEQ ID NO: 77592 - DNA, 20 bp, synthetic construct
  misc_feature 1..20: note = CRISPR gRNA sequence
  source 1..20: mol_type = other DNA
tatttactatttaatgctac

SEQ ID NO: 77593 - DNA, 20 bp, synthetic construct
  misc_feature 1..20: note = CRISPR gRNA sequence
  source 1..20: mol_type = other DNA
tttactatttaatgctacac

SEQ ID NO: 77594 - DNA, 20 bp, synthetic construct
  misc_feature 1..20: note = CRISPR gRNA sequence
  source 1..20: mol_type = other DNA
actatttaatgctacactcc

SEQ ID NO: 77595 - DNA, 20 bp, synthetic construct
  misc_feature 1..20: note = CRISPR gRNA sequence
  source 1..20: mol_type = other DNA
ctatttaatgctacactccc

SEQ ID NO: 77596 - DNA, 20 bp, synthetic construct
  misc_feature 1..20: note = CRISPR gRNA sequence
  source 1..20: mol_type = other DNA
tttaatgctacactcccctc

SEQ ID NO: 77597 - DNA, 20 bp, synthetic construct
  misc_feature 1..20: note = CRISPR gRNA sequence
  source 1..20: mol_type = other DNA
aatgctacactcccctccca

SEQ ID NO: 77598 - DNA, 20 bp, synthetic construct
  misc_feature 1..20: note = CRISPR gRNA sequence
  source 1..20: mol_type = other DNA
atgctacactcccctcccac

SEQ ID NO: 77599 - DNA, 20 bp, synthetic construct
  misc_feature 1..20: note = CRISPR gRNA sequence
  source 1..20: mol_type = other DNA
cactcccctcccacggggac

SEQ ID NO: 77600 - DNA, 20 bp, synthetic construct
  misc_feature 1..20: note = CRISPR gRNA sequence
  source 1..20: mol_type = other DNA
ccctcccacggggacactgg

SEQ ID NO: 77601 - DNA, 20 bp, synthetic construct
  misc_feature 1..20: note = CRISPR gRNA sequence
  source 1..20: mol_type = other DNA
ccacggggacactggtaggg

SEQ ID NO: 77602 - DNA, 20 bp, synthetic construct
  misc_feature 1..20: note = CRISPR gRNA sequence
  source 1..20: mol_type = other DNA
gtagggcgagtgtggaccct

SEQ ID NO: 77603 - DNA, 20 bp, synthetic construct
  misc_feature 1..20: note = CRISPR gRNA sequence
  source 1..20: mol_type = other DNA
acagcaccaggtcacgagtc

SEQ ID NO: 77604 - DNA, 20 bp, synthetic construct
  misc_feature 1..20: note = CRISPR gRNA sequence
  source 1..20: mol_type = other DNA
ataagaaggtcacatgagga

SEQ ID NO: 77605 - DNA, 20 bp, synthetic construct
  misc_feature 1..20: note = CRISPR gRNA sequence
  source 1..20: mol_type = other DNA
aaacctccagtcttcatgta

SEQ ID NO: 77606 - DNA, 20 bp, synthetic construct
  misc_feature 1..20: note = CRISPR gRNA sequence
  source 1..20: mol_type = other DNA
cagtcttcatgtaatttgcc

SEQ ID NO: 77607 - DNA, 20 bp, synthetic construct
  misc_feature 1..20: note = CRISPR gRNA sequence
  source 1..20: mol_type = other DNA
catgtaatttgcctgcaatg

SEQ ID NO: 77608 - DNA, 20 bp, synthetic construct
  misc_feature 1..20: note = CRISPR gRNA sequence
  source 1..20: mol_type = other DNA
atgtaatttgcctgcaatgg

SEQ ID NO: 77609 - DNA, 20 bp, synthetic construct
  misc_feature 1..20: note = CRISPR gRNA sequence
  source 1..20: mol_type = other DNA
gcctgcaatggttagacctt

SEQ ID NO: 77610 - DNA, 20 bp, synthetic construct
  misc_feature 1..20: note = CRISPR gRNA sequence
  source 1..20: mol_type = other DNA
cctgcaatggttagaccttc

SEQ ID NO: 77611 - DNA, 20 bp, synthetic construct
  misc_feature 1..20: note = CRISPR gRNA sequence
  source 1..20: mol_type = other DNA
caatggttagaccttccttc

SEQ ID NO: 77612 - DNA, 20 bp, synthetic construct
  misc_feature 1..20: note = CRISPR gRNA sequence
  source 1..20: mol_type = other DNA
gaccttccttccttcccagg

SEQ ID NO: 77613 - DNA, 20 bp, synthetic construct
  misc_feature 1..20: note = CRISPR gRNA sequence
  source 1..20: mol_type = other DNA
ccttccttcccaggtgcagg

SEQ ID NO: 77614 - DNA, 20 bp, synthetic construct
  misc_feature 1..20: note = CRISPR gRNA sequence
  source 1..20: mol_type = other DNA
cttccttcccaggtgcaggc

SEQ ID NO: 77615 - DNA, 20 bp, synthetic construct
  misc_feature 1..20: note = CRISPR gRNA sequence
  source 1..20: mol_type = other DNA
ccttcccaggtgcaggccct

SEQ ID NO: 77616 - DNA, 20 bp, synthetic construct
  misc_feature 1..20: note = CRISPR gRNA sequence
  source 1..20: mol_type = other DNA
cttcccaggtgcaggccctg

SEQ ID NO: 77617 - DNA, 20 bp, synthetic construct
  misc_feature 1..20: note = CRISPR gRNA sequence
  source 1..20: mol_type = other DNA
cccaggtgcaggccctgaac

SEQ ID NO: 77618 - DNA, 20 bp, synthetic construct
  misc_feature 1..20: note = CRISPR gRNA sequence
  source 1..20: mol_type = other DNA
ccaggtgcaggccctgaaca

SEQ ID NO: 77619 - DNA, 20 bp, synthetic construct
  misc_feature 1..20: note = CRISPR gRNA sequence
  source 1..20: mol_type = other DNA
aacaggaaccaaggcaactc

SEQ ID NO: 77620 - DNA, 20 bp, synthetic construct
  misc_feature 1..20: note = CRISPR gRNA sequence
  source 1..20: mol_type = other DNA
ccttccttcccagcattgca

SEQ ID NO: 77621 - DNA, 20 bp, synthetic construct
  misc_feature 1..20: note = CRISPR gRNA sequence
  source 1..20: mol_type = other DNA
ccttcccagcattgcacaaa

SEQ ID NO: 77622 - DNA, 20 bp, synthetic construct
  misc_feature 1..20: note = CRISPR gRNA sequence
  source 1..20: mol_type = other DNA
cttcccagcattgcacaaaa

SEQ ID NO: 77623 - DNA, 20 bp, synthetic construct
  misc_feature 1..20: note = CRISPR gRNA sequence
  source 1..20: mol_type = other DNA
cccagcattgcacaaaaaca

SEQ ID NO: 77624 - DNA, 20 bp, synthetic construct
  misc_feature 1..20: note = CRISPR gRNA sequence
  source 1..20: mol_type = other DNA
ccagcattgcacaaaaacag

SEQ ID NO: 77625 - DNA, 20 bp, synthetic construct
  misc_feature 1..20: note = CRISPR gRNA sequence
  source 1..20: mol_type = other DNA
cacaaaaacagggtgtgagc

SEQ ID NO: 77626 - DNA, 20 bp, synthetic construct
  misc_feature 1..20: note = CRISPR gRNA sequence
  source 1..20: mol_type = other DNA
aggccccagcactcatttca

SEQ ID NO: 77627 - DNA, 20 bp, synthetic construct
  misc_feature 1..20: note = CRISPR gRNA sequence
  source 1..20: mol_type = other DNA
ggccccagcactcatttcag

SEQ ID NO: 77628 - DNA, 20 bp, synthetic construct
  misc_feature 1..20: note = CRISPR gRNA sequence
  source 1..20: mol_type = other DNA
atttcagagatcgtagccac

SEQ ID NO: 77629 - DNA, 20 bp, synthetic construct
  misc_feature 1..20: note = CRISPR gRNA sequence
  source 1..20: mol_type = other DNA
cagagatcgtagccaccaac

SEQ ID NO: 77630 - DNA, 20 bp, synthetic construct
  misc_feature 1..20: note = CRISPR gRNA sequence
  source 1..20: mol_type = other DNA
agagatcgtagccaccaaca

SEQ ID NO: 77631 - DNA, 20 bp, synthetic construct
  misc_feature 1..20: note = CRISPR gRNA sequence
  source 1..20: mol_type = other DNA
caatttatgtatttaccgac

SEQ ID NO: 77632 - DNA, 20 bp, synthetic construct
  misc_feature 1..20: note = CRISPR gRNA sequence
  source 1..20: mol_type = other DNA
atgtatttaccgactgggaa

SEQ ID NO: 77633 - DNA, 20 bp, synthetic construct
  misc_feature 1..20: note = CRISPR gRNA sequence
  source 1..20: mol_type = other DNA
tgtatttaccgactgggaac

SEQ ID NO: 77634 - DNA, 20 bp, synthetic construct
  misc_feature 1..20: note = CRISPR gRNA sequence
  source 1..20: mol_type = other DNA
accgactgggaaccagggac

SEQ ID NO: 77635 - DNA, 20 bp, synthetic construct
  misc_feature 1..20: note = CRISPR gRNA sequence
  source 1..20: mol_type = other DNA
ccgactgggaaccagggact

SEQ ID NO: 77636 - DNA, 20 bp, synthetic construct
  misc_feature 1..20: note = CRISPR gRNA sequence
  source 1..20: mol_type = other DNA
ggaaccagggactcggagag

SEQ ID NO: 77637 - DNA, 20 bp, synthetic construct
  misc_feature 1..20: note = CRISPR gRNA sequence
  source 1..20: mol_type = other DNA
ggagaggggatgtaacttgc

SEQ ID NO: 77638 - DNA, 20 bp, synthetic construct
  misc_feature 1..20: note = CRISPR gRNA sequence
  source 1..20: mol_type = other DNA
gcccagaatcacacagcaaa

SEQ ID NO: 77639 - DNA, 20 bp, synthetic construct
  misc_feature 1..20: note = CRISPR gRNA sequence
  source 1..20: mol_type = other DNA
cccagaatcacacagcaaag

SEQ ID NO: 77640 - DNA, 20 bp, synthetic construct
  misc_feature 1..20: note = CRISPR gRNA sequence
  source 1..20: mol_type = other DNA
acagagacagcctggaatat

SEQ ID NO: 77641 - DNA, 20 bp, synthetic construct
  misc_feature 1..20: note = CRISPR gRNA sequence
  source 1..20: mol_type = other DNA
gaatataggacctgtgacct

SEQ ID NO: 77642 - DNA, 20 bp, synthetic construct
  misc_feature 1..20: note = CRISPR gRNA sequence
  source 1..20: mol_type = other DNA
tgacctctcccctgggctcc

SEQ ID NO: 77643 - DNA, 20 bp, synthetic construct
  misc_feature 1..20: note = CRISPR gRNA sequence
  source 1..20: mol_type = other DNA
tcccctgggctcctctggct

SEQ ID NO: 77644 - DNA, 20 bp, synthetic construct
  misc_feature 1..20: note = CRISPR gRNA sequence
  source 1..20: mol_type = other DNA
ccctgggctcctctggcttt

SEQ ID NO: 77645 - DNA, 20 bp, synthetic construct
  misc_feature 1..20: note = CRISPR gRNA sequence
  source 1..20: mol_type = other DNA
ggctcctctggctttggccc

SEQ ID NO: 77646 - DNA, 20 bp, synthetic construct
  misc_feature 1..20: note = CRISPR gRNA sequence
  source 1..20: mol_type = other DNA
ctctggctttggcccagaag

SEQ ID NO: 77647 - DNA, 20 bp, synthetic construct
  misc_feature 1..20: note = CRISPR gRNA sequence
  source 1..20: mol_type = other DNA
tggctttggcccagaagtgc

SEQ ID NO: 77648 - DNA, 20 bp, synthetic construct
  misc_feature 1..20: note = CRISPR gRNA sequence
  source 1..20: mol_type = other DNA
gctttggcccagaagtgcct

SEQ ID NO: 77649 - DNA, 20 bp, synthetic construct
  misc_feature 1..20: note = CRISPR gRNA sequence
  source 1..20: mol_type = other DNA
tggcccagaagtgcctggga

SEQ ID NO: 77650 - DNA, 20 bp, synthetic construct
  misc_feature 1..20: note = CRISPR gRNA sequence
  source 1..20: mol_type = other DNA
ggcccagaagtgcctgggag

SEQ ID NO: 77651 - DNA, 20 bp, synthetic construct
  misc_feature 1..20: note = CRISPR gRNA sequence
  source 1..20: mol_type = other DNA
gcccagaagtgcctgggagg

SEQ ID NO: 77652 - DNA, 20 bp, synthetic construct
  misc_feature 1..20: note = CRISPR gRNA sequence
  source 1..20: mol_type = other DNA
ggaggagggggtgctttgtg

SEQ ID NO: 77653 - DNA, 20 bp, synthetic construct
  misc_feature 1..20: note = CRISPR gRNA sequence
  source 1..20: mol_type = other DNA
tgtgagccaaaagcaccaag

SEQ ID NO: 77654 - DNA, 20 bp, synthetic construct
  misc_feature 1..20: note = CRISPR gRNA sequence
  source 1..20: mol_type = other DNA
gtgagccaaaagcaccaagg

SEQ ID NO: 77655 - DNA, 20 bp, synthetic construct
  misc_feature 1..20: note = CRISPR gRNA sequence
  source 1..20: mol_type = other DNA
tgagccaaaagcaccaaggg

SEQ ID NO: 77656 - DNA, 20 bp, synthetic construct
  misc_feature 1..20: note = CRISPR gRNA sequence
  source 1..20: mol_type = other DNA
agggatcaagaactctggtc

SEQ ID NO: 77657 - DNA, 20 bp, synthetic construct
  misc_feature 1..20: note = CRISPR gRNA sequence
  source 1..20: mol_type = other DNA
gggatcaagaactctggtcc

SEQ ID NO: 77658 - DNA, 20 bp, synthetic construct
  misc_feature 1..20: note = CRISPR gRNA sequence
  source 1..20: mol_type = other DNA
tggtccattgcaggcaaact

SEQ ID NO: 77659 - DNA, 20 bp, synthetic construct
  misc_feature 1..20: note = CRISPR gRNA sequence
  source 1..20: mol_type = other DNA
gtccattgcaggcaaacttt

SEQ ID NO: 77660 - DNA, 20 bp, synthetic construct
  misc_feature 1..20: note = CRISPR gRNA sequence
  source 1..20: mol_type = other DNA
caggcaaactttggggattc

SEQ ID NO: 77661 - DNA, 20 bp, synthetic construct
  misc_feature 1..20: note = CRISPR gRNA sequence
  source 1..20: mol_type = other DNA
tggggattcctcctacacac

SEQ ID NO: 77662 - DNA, 20 bp, synthetic construct
  misc_feature 1..20: note = CRISPR gRNA sequence
  source 1..20: mol_type = other DNA
ggggattcctcctacacact

SEQ ID NO: 77663 - DNA, 20 bp, synthetic construct
  misc_feature 1..20: note = CRISPR gRNA sequence
  source 1..20: mol_type = other DNA
gggattcctcctacacactc

SEQ ID NO: 77664 - DNA, 20 bp, synthetic construct
  misc_feature 1..20: note = CRISPR gRNA sequence
  source 1..20: mol_type = other DNA
ctcctacacactctctgcca

SEQ ID NO: 77665 - DNA, 20 bp, synthetic construct
  misc_feature 1..20: note = CRISPR gRNA sequence
  source 1..20: mol_type = other DNA
ctacacactctctgccaggt

SEQ ID NO: 77666 - DNA, 20 bp, synthetic construct
  misc_feature 1..20: note = CRISPR gRNA sequence
  source 1..20: mol_type = other DNA
cacactctctgccaggtact

SEQ ID NO: 77667 - DNA, 20 bp, synthetic construct
  misc_feature 1..20: note = CRISPR gRNA sequence
  source 1..20: mol_type = other DNA
tctgccaggtactcagggat

SEQ ID NO: 77668 - DNA, 20 bp, synthetic construct
  misc_feature 1..20: note = CRISPR gRNA sequence
  source 1..20: mol_type = other DNA
tgccaggtactcagggatcc

SEQ ID NO: 77669 - DNA, 20 bp, synthetic construct
  misc_feature 1..20: note = CRISPR gRNA sequence
  source 1..20: mol_type = other DNA
ccaggtactcagggatcctt

SEQ ID NO: 77670 - DNA, 20 bp, synthetic construct
  misc_feature 1..20: note = CRISPR gRNA sequence
  source 1..20: mol_type = other DNA
agggatccttggcagccctg

SEQ ID NO: 77671 - DNA, 20 bp, synthetic construct
  misc_feature 1..20: note = CRISPR gRNA sequence
  source 1..20: mol_type = other DNA
ggcagccctgggcaccctgc

SEQ ID NO: 77672 - DNA, 20 bp, synthetic construct
  misc_feature 1..20: note = CRISPR gRNA sequence
  source 1..20: mol_type = other DNA
gcagccctgggcaccctgct

SEQ ID NO: 77673 - DNA, 20 bp, synthetic construct
  misc_feature 1..20: note = CRISPR gRNA sequence
  source 1..20: mol_type = other DNA
ggcaccctgcttgagtgtcc

SEQ ID NO: 77674 - DNA, 20 bp, synthetic construct
  misc_feature 1..20: note = CRISPR gRNA sequence
  source 1..20: mol_type = other DNA
cttgagtgtcctctctggta

SEQ ID NO: 77675 - DNA, 20 bp, synthetic construct
  misc_feature 1..20: note = CRISPR gRNA sequence
  source 1..20: mol_type = other DNA
gagtgtcctctctggtacaa

SEQ ID NO: 77676 - DNA, 20 bp, synthetic construct
  misc_feature 1..20: note = CRISPR gRNA sequence
  source 1..20: mol_type = other DNA
agtgtcctctctggtacaaa

SEQ ID NO: 77677 - DNA, 20 bp, synthetic construct
  misc_feature 1..20: note = CRISPR gRNA sequence
  source 1..20: mol_type = other DNA
tctggtacaaaccctccctg

SEQ ID NO: 77678 - DNA, 20 bp, synthetic construct
  misc_feature 1..20: note = CRISPR gRNA sequence
  source 1..20: mol_type = other DNA
tggtacaaaccctccctgtc

SEQ ID NO: 77679 - DNA, 20 bp, synthetic construct
  misc_feature 1..20: note = CRISPR gRNA sequence
  source 1..20: mol_type = other DNA
gtacaaaccctccctgtcta

SEQ ID NO: 77680 - DNA, 20 bp, synthetic construct
  misc_feature 1..20: note = CRISPR gRNA sequence
  source 1..20: mol_type = other DNA
cctgtctaccctgaccatac

SEQ ID NO: 77681 - DNA, 20 bp, synthetic construct
  misc_feature 1..20: note = CRISPR gRNA sequence
  source 1..20: mol_type = other DNA
tctaccctgaccatacccca

SEQ ID NO: 77682 - DNA, 20 bp, synthetic construct
  misc_feature 1..20: note = CRISPR gRNA sequence
  source 1..20: mol_type = other DNA
ccctgaccataccccagcta

SEQ ID NO: 77683 - DNA, 20 bp, synthetic construct
  misc_feature 1..20: note = CRISPR gRNA sequence
  source 1..20: mol_type = other DNA
accataccccagctaacagc

SEQ ID NO: 77684 - DNA, 20 bp, synthetic construct
  misc_feature 1..20: note = CRISPR gRNA sequence
  source 1..20: mol_type = other DNA
acagccccagcccctcccgg

SEQ ID NO: 77685 - DNA, 20 bp, synthetic construct
  misc_feature 1..20: note = CRISPR gRNA sequence
  source 1..20: mol_type = other DNA
ccggcaccccagggccagaa

SEQ ID NO: 77686 - DNA, 20 bp, synthetic construct
  misc_feature 1..20: note = CRISPR gRNA sequence
  source 1..20: mol_type = other DNA
ccagccgttagtcatacttc

SEQ ID NO: 77687 - DNA, 20 bp, synthetic construct
  misc_feature 1..20: note = CRISPR gRNA sequence
  source 1..20: mol_type = other DNA
gtcatacttcgcacccacac

SEQ ID NO: 77688 - DNA, 20 bp, synthetic construct
  misc_feature 1..20: note = CRISPR gRNA sequence
  source 1..20: mol_type = other DNA
cgcacccacacctgccctcc

SEQ ID NO: 77689 - DNA, 20 bp, synthetic construct
  misc_feature 1..20: note = CRISPR gRNA sequence
  source 1..20: mol_type = other DNA
gcacccacacctgccctccc

SEQ ID NO: 77690 - DNA, 20 bp, synthetic construct
  misc_feature 1..20: note = CRISPR gRNA sequence
  source 1..20: mol_type = other DNA
ccctccccagggtggcctca

SEQ ID NO: 77691 - DNA, 20 bp, synthetic construct
  misc_feature 1..20: note = CRISPR gRNA sequence
  source 1..20: mol_type = other DNA
cccagggtggcctcagaagc

SEQ ID NO: 77692 - DNA, 20 bp, synthetic construct
  misc_feature 1..20: note = CRISPR gRNA sequence
  source 1..20: mol_type = other DNA
agaagcctgttcagagatgc

SEQ ID NO: 77693 - DNA, 20 bp, synthetic construct
  misc_feature 1..20: note = CRISPR gRNA sequence
  source 1..20: mol_type = other DNA
ttcagagatgcggagacagg

SEQ ID NO: 77694 - DNA, 20 bp, synthetic construct
  misc_feature 1..20: note = CRISPR gRNA sequence
  source 1..20: mol_type = other DNA
agagatgcggagacaggttc

SEQ ID NO: 77695 - DNA, 20 bp, synthetic construct
  misc_feature 1..20: note = CRISPR gRNA sequence
  source 1..20: mol_type = other DNA
cagaagtgaaaccttgaatc

SEQ ID NO: 77696 - DNA, 20 bp, synthetic construct
  misc_feature 1..20: note = CRISPR gRNA sequence
  source 1..20: mol_type = other DNA
gaatcagaagtgggattatt

SEQ ID NO: 77697 - DNA, 20 bp, synthetic construct
  misc_feature 1..20: note = CRISPR gRNA sequence
  source 1..20: mol_type = other DNA
aatcagaagtgggattattg

SEQ ID NO: 77698 - DNA, 20 bp, synthetic construct
  misc_feature 1..20: note = CRISPR gRNA sequence
  source 1..20: mol_type = other DNA
ttgagtcacagactctctga

SEQ ID NO: 77699 - DNA, 20 bp, synthetic construct
  misc_feature 1..20: note = CRISPR gRNA sequence
  source 1..20: mol_type = other DNA
agtcacagactctctgagta

SEQ ID NO: 77700 - DNA, 20 bp, synthetic construct
  misc_feature 1..20: note = CRISPR gRNA sequence
  source 1..20: mol_type = other DNA
tctgagtaagaatcatctat

SEQ ID NO: 77701 - DNA, 20 bp, synthetic construct
  misc_feature 1..20: note = CRISPR gRNA sequence
  source 1..20: mol_type = other DNA
tgagtaagaatcatctatta

SEQ ID NO: 77702 - DNA, 20 bp, synthetic construct
  misc_feature 1..20: note = CRISPR gRNA sequence
  source 1..20: mol_type = other DNA
agtaagaatcatctattagc

SEQ ID NO: 77703 - DNA, 20 bp, synthetic construct
  misc_feature 1..20: note = CRISPR gRNA sequence
  source 1..20: mol_type = other DNA
ttagctagccttcaccgaga

SEQ ID NO: 77704 - DNA, 20 bp, synthetic construct
  misc_feature 1..20: note = CRISPR gRNA sequence
  source 1..20: mol_type = other DNA
gctagccttcaccgagaact

SEQ ID NO: 77705 - DNA, 20 bp, synthetic construct
  misc_feature 1..20: note = CRISPR gRNA sequence
  source 1..20: mol_type = other DNA
gccttcaccgagaacttaca

SEQ ID NO: 77706 - DNA, 20 bp, synthetic construct
  misc_feature 1..20: note = CRISPR gRNA sequence
  source 1..20: mol_type = other DNA
caccgagaacttacattgta

SEQ ID NO: 77707 - DNA, 20 bp, synthetic construct
  misc_feature 1..20: note = CRISPR gRNA sequence
  source 1..20: mol_type = other DNA
accgagaacttacattgtat

SEQ ID NO: 77708 - DNA, 20 bp, synthetic construct
  misc_feature 1..20: note = CRISPR gRNA sequence
  source 1..20: mol_type = other DNA
acattgtattaggggcaatt

SEQ ID NO: 77709 - DNA, 20 bp, synthetic construct
  misc_feature 1..20: note = CRISPR gRNA sequence
  source 1..20: mol_type = other DNA
cattgtattaggggcaattt

SEQ ID NO: 77710 - DNA, 20 bp, synthetic construct
  misc_feature 1..20: note = CRISPR gRNA sequence
  source 1..20: mol_type = other DNA
tattaggggcaattttcatg

SEQ ID NO: 77711 - DNA, 20 bp, synthetic construct
  misc_feature 1..20: note = CRISPR gRNA sequence
  source 1..20: mol_type = other DNA
ggggcaattttcatgcattt

SEQ ID NO: 77712 - DNA, 20 bp, synthetic construct
  misc_feature 1..20: note = CRISPR gRNA sequence
  source 1..20: mol_type = other DNA
tcatgcattttccgatttaa

SEQ ID NO: 77713 - DNA, 20 bp, synthetic construct
  misc_feature 1..20: note = CRISPR gRNA sequence
  source 1..20: mol_type = other DNA
catgcattttccgatttaat

SEQ ID NO: 77714 - DNA, 20 bp, synthetic construct
  misc_feature 1..20: note = CRISPR gRNA sequence
  source 1..20: mol_type = other DNA
atgcattttccgatttaatc

SEQ ID NO: 77715 - DNA, 20 bp, synthetic construct
  misc_feature 1..20: note = CRISPR gRNA sequence
  source 1..20: mol_type = other DNA
tccgatttaatctttacaat

SEQ ID NO: 77716 - DNA, 20 bp, synthetic construct
  misc_feature 1..20: note = CRISPR gRNA sequence
  source 1..20: mol_type = other DNA
ccgatttaatctttacaata

SEQ ID NO: 77717 - DNA, 20 bp, synthetic construct
  misc_feature 1..20: note = CRISPR gRNA sequence
  source 1..20: mol_type = other DNA
cgatttaatctttacaataa

SEQ ID NO: 77718 - DNA, 20 bp, synthetic construct
  misc_feature 1..20: note = CRISPR gRNA sequence
  source 1..20: mol_type = other DNA
aatctttacaataaccccag

SEQ ID NO: 77719 - DNA, 20 bp, synthetic construct
  misc_feature 1..20: note = CRISPR gRNA sequence
  source 1..20: mol_type = other DNA
atctttacaataaccccagg

SEQ ID NO: 77720 - DNA, 20 bp, synthetic construct
  misc_feature 1..20: note = CRISPR gRNA sequence
  source 1..20: mol_type = other DNA
tacaataaccccaggaaaga

SEQ ID NO: 77721 - DNA, 20 bp, synthetic construct
  misc_feature 1..20: note = CRISPR gRNA sequence
  source 1..20: mol_type = other DNA
acaataaccccaggaaagag

SEQ ID NO: 77722 - DNA, 20 bp, synthetic construct
  misc_feature 1..20: note = CRISPR gRNA sequence
  source 1..20: mol_type = other DNA
caataaccccaggaaagagg

SEQ ID NO: 77723 - DNA, 20 bp, synthetic construct
  misc_feature 1..20: note = CRISPR gRNA sequence
  source 1..20: mol_type = other DNA
cccccctgccccagcctcag

SEQ ID NO: 77724 - DNA, 20 bp, synthetic construct
  misc_feature 1..20: note = CRISPR gRNA sequence
  source 1..20: mol_type = other DNA
ccccagcctcagaggctctg

SEQ ID NO: 77725 - DNA, 20 bp, synthetic construct
  misc_feature 1..20: note = CRISPR gRNA sequence
  source 1..20: mol_type = other DNA
agaggctctgcctagcgggc

SEQ ID NO: 77726 - DNA, 20 bp, synthetic construct
  misc_feature 1..20: note = CRISPR gRNA sequence
  source 1..20: mol_type = other DNA
tgcctagcgggctactcact

SEQ ID NO: 77727 - DNA, 20 bp, synthetic construct
  misc_feature 1..20: note = CRISPR gRNA sequence
  source 1..20: mol_type = other DNA
cctagcgggctactcacttc

SEQ ID NO: 77728 - DNA, 20 bp, synthetic construct
  misc_feature 1..20: note = CRISPR gRNA sequence
  source 1..20: mol_type = other DNA
gcgggctactcacttcaagg

SEQ ID NO: 77729 - DNA, 20 bp, synthetic construct
  misc_feature 1..20: note = CRISPR gRNA sequence
  source 1..20: mol_type = other DNA
ctcacttcaaggactgcaga

SEQ ID NO: 77730 - DNA, 20 bp, synthetic construct
  misc_feature 1..20: note = CRISPR gRNA sequence
  source 1..20: mol_type = other DNA
acttcaaggactgcagagct

SEQ ID NO: 77731 - DNA, 20 bp, synthetic construct
  misc_feature 1..20: note = CRISPR gRNA sequence
  source 1..20: mol_type = other DNA
caaggactgcagagctccca

SEQ ID NO: 77732 - DNA, 20 bp, synthetic construct
  misc_feature 1..20: note = CRISPR gRNA sequence
  source 1..20: mol_type = other DNA
aaggactgcagagctcccag

SEQ ID NO: 77733 - DNA, 20 bp, synthetic construct
  misc_feature 1..20: note = CRISPR gRNA sequence
  source 1..20: mol_type = other DNA
cagagctcccagccctggga

SEQ ID NO: 77734 - DNA, 20 bp, synthetic construct
  misc_feature 1..20: note = CRISPR gRNA sequence
  source 1..20: mol_type = other DNA
ccagccctgggagcagctga

SEQ ID NO: 77735 - DNA, 20 bp, synthetic construct
  misc_feature 1..20: note = CRISPR gRNA sequence
  source 1..20: mol_type = other DNA
ggagcagctgagccagccgg

SEQ ID NO: 77736 - DNA, 20 bp, synthetic construct
  misc_feature 1..20: note = CRISPR gRNA sequence
  source 1..20: mol_type = other DNA
agccagccgggctgcacctt

SEQ ID NO: 77737 - DNA, 20 bp, synthetic construct
  misc_feature 1..20: note = CRISPR gRNA sequence
  source 1..20: mol_type = other DNA
caccttcatcccccagagca

SEQ ID NO: 77738 - DNA, 20 bp, synthetic construct
  misc_feature 1..20: note = CRISPR gRNA sequence
  source 1..20: mol_type = other DNA
catcccccagagcattgcct

SEQ ID NO: 77739 - DNA, 20 bp, synthetic construct
  misc_feature 1..20: note = CRISPR gRNA sequence
  source 1..20: mol_type = other DNA
atcccccagagcattgcctg

SEQ ID NO: 77740 - DNA, 20 bp, synthetic construct
  misc_feature 1..20: note = CRISPR gRNA sequence
  source 1..20: mol_type = other DNA
cctgagaagctgggggtggg

SEQ ID NO: 77741 - DNA, 20 bp, synthetic construct
  misc_feature 1..20: note = CRISPR gRNA sequence
  source 1..20: mol_type = other DNA
agaagctgggggtggggaga

SEQ ID NO: 77742 - DNA, 20 bp, synthetic construct
  misc_feature 1..20: note = CRISPR gRNA sequence
  source 1..20: mol_type = other DNA
ggggtggggagaagggaggg

SEQ ID NO: 77743 - DNA, 20 bp, synthetic construct
  misc_feature 1..20: note = CRISPR gRNA sequence
  source 1..20: mol_type = other DNA
gcaggtggggagtgggttgc

SEQ ID NO: 77744 - DNA, 20 bp, synthetic construct
  misc_feature 1..20: note = CRISPR gRNA sequence
  source 1..20: mol_type = other DNA
ctggcagcatggtccctgca

SEQ ID NO: 77745 - DNA, 20 bp, synthetic construct
  misc_feature 1..20: note = CRISPR gRNA sequence
  source 1..20: mol_type = other DNA
gcagcatggtccctgcattc

SEQ ID NO: 77746 - DNA, 20 bp, synthetic construct
  misc_feature 1..20: note = CRISPR gRNA sequence
  source 1..20: mol_type = other DNA
cattccagttactcaacttc

SEQ ID NO: 77747 - DNA, 20 bp, synthetic construct
  misc_feature 1..20: note = CRISPR gRNA sequence
  source 1..20: mol_type = other DNA
cagttactcaacttcctgaa

SEQ ID NO: 77748 - DNA, 20 bp, synthetic construct
  misc_feature 1..20: note = CRISPR gRNA sequence
  source 1..20: mol_type = other DNA
ctcaacttcctgaaactgga

SEQ ID NO: 77749 - DNA, 20 bp, synthetic construct
  misc_feature 1..20: note = CRISPR gRNA sequence
  source 1..20: mol_type = other DNA
aacttcctgaaactggacac

SEQ ID NO: 77750 - DNA, 20 bp, synthetic construct
  misc_feature 1..20: note = CRISPR gRNA sequence
  source 1..20: mol_type = other DNA
cctgaaactggacacagccc

SEQ ID NO: 77751 - DNA, 20 bp, synthetic construct
  misc_feature 1..20: note = CRISPR gRNA sequence
  source 1..20: mol_type = other DNA
ctgaaactggacacagccct

SEQ ID NO: 77752 - DNA, 20 bp, synthetic construct
  misc_feature 1..20: note = CRISPR gRNA sequence
  source 1..20: mol_type = other DNA
aaactggacacagccctggg

SEQ ID NO: 77753 - DNA, 20 bp, synthetic construct
  misc_feature 1..20: note = CRISPR gRNA sequence
  source 1..20: mol_type = other DNA
gacacagccctgggctgcca

SEQ ID NO: 77754 - DNA, 20 bp, synthetic construct
  misc_feature 1..20: note = CRISPR gRNA sequence
  source 1..20: mol_type = other DNA
ggctgccaggccagatctca

SEQ ID NO: 77755 - DNA, 20 bp, synthetic construct
  misc_feature 1..20: note = CRISPR gRNA sequence
  source 1..20: mol_type = other DNA
ccaggccagatctcagcaga

SEQ ID NO: 77756 - DNA, 20 bp, synthetic construct
  misc_feature 1..20: note = CRISPR gRNA sequence
  source 1..20: mol_type = other DNA
agcagatctggcacgggcag

SEQ ID NO: 77757 - DNA, 20 bp, synthetic construct
  misc_feature 1..20: note = CRISPR gRNA sequence
  source 1..20: mol_type = other DNA
gcacgggcagctggggtctc

SEQ ID NO: 77758 - DNA, 20 bp, synthetic construct
  misc_feature 1..20: note = CRISPR gRNA sequence
  source 1..20: mol_type = other DNA
gggtctcccccaggttctta

SEQ ID NO: 77759 - DNA, 20 bp, synthetic construct
  misc_feature 1..20: note = CRISPR gRNA sequence
  source 1..20: mol_type = other DNA
ccccaggttcttattctgag

SEQ ID NO: 77760 - DNA, 20 bp, synthetic construct
  misc_feature 1..20: note = CRISPR gRNA sequence
  source 1..20: mol_type = other DNA
ttattctgaggttcgtggac

SEQ ID NO: 77761 - DNA, 20 bp, synthetic construct
  misc_feature 1..20: note = CRISPR gRNA sequence
  source 1..20: mol_type = other DNA
attctgaggttcgtggacct

SEQ ID NO: 77762 - DNA, 20 bp, synthetic construct
  misc_feature 1..20: note = CRISPR gRNA sequence
  source 1..20: mol_type = other DNA
ttctgaggttcgtggacctc

SEQ ID NO: 77763 - DNA, 20 bp, synthetic construct
  misc_feature 1..20: note = CRISPR gRNA sequence
  source 1..20: mol_type = other DNA
tgaggttcgtggacctctga

SEQ ID NO: 77764 - DNA, 20 bp, synthetic construct
  misc_feature 1..20: note = CRISPR gRNA sequence
  source 1..20: mol_type = other DNA
aggttcgtggacctctgagg

SEQ ID NO: 77765 - DNA, 20 bp, synthetic construct
  misc_feature 1..20: note = CRISPR gRNA sequence
  source 1..20: mol_type = other DNA
gtggacctctgagggaccag

SEQ ID NO: 77766 - DNA, 20 bp, synthetic construct
  misc_feature 1..20: note = CRISPR gRNA sequence
  source 1..20: mol_type = other DNA
tgagggaccaggggtgagcc

SEQ ID NO: 77767 - DNA, 20 bp, synthetic construct
  misc_feature 1..20: note = CRISPR gRNA sequence
  source 1..20: mol_type = other DNA
agggaccaggggtgagcctc

SEQ ID NO: 77768 - DNA, 20 bp, synthetic construct
  misc_feature 1..20: note = CRISPR gRNA sequence
  source 1..20: mol_type = other DNA
cgagcgtgtcagacatgggg

SEQ ID NO: 77769 - DNA, 20 bp, synthetic construct
  misc_feature 1..20: note = CRISPR gRNA sequence
  source 1..20: mol_type = other DNA
tatcttgggaggaagagtca

SEQ ID NO: 77770 - DNA, 20 bp, synthetic construct
  misc_feature 1..20: note = CRISPR gRNA sequence
  source 1..20: mol_type = other DNA
gggaggaagagtcacaactt

SEQ ID NO: 77771 - DNA, 20 bp, synthetic construct
  misc_feature 1..20: note = CRISPR gRNA sequence
  source 1..20: mol_type = other DNA
ggaggaagagtcacaacttt

SEQ ID NO: 77772 - DNA, 20 bp, synthetic construct
  misc_feature 1..20: note = CRISPR gRNA sequence
  source 1..20: mol_type = other DNA
tcaccagattctccaagggg

SEQ ID NO: 77773 - DNA, 20 bp, synthetic construct
  misc_feature 1..20: note = CRISPR gRNA sequence
  source 1..20: mol_type = other DNA
caccagattctccaaggggt

SEQ ID NO: 77774 - DNA, 20 bp, synthetic construct
  misc_feature 1..20: note = CRISPR gRNA sequence
  source 1..20: mol_type = other DNA
accagattctccaaggggtt

SEQ ID NO: 77775 - DNA, 20 bp, synthetic construct
  misc_feature 1..20: note = CRISPR gRNA sequence
  source 1..20: mol_type = other DNA
tccaaggggtttctgacttc

SEQ ID NO: 77776 - DNA, 20 bp, synthetic construct
  misc_feature 1..20: note = CRISPR gRNA sequence
  source 1..20: mol_type = other DNA
caaggggtttctgacttcag

SEQ ID NO: 77777 - DNA, 20 bp, synthetic construct
  misc_feature 1..20: note = CRISPR gRNA sequence
  source 1..20: mol_type = other DNA
ctgacttcagcagggaaaga

SEQ ID NO: 77778 - DNA, 20 bp, synthetic construct
  misc_feature 1..20: note = CRISPR gRNA sequence
  source 1..20: mol_type = other DNA
tgacttcagcagggaaagaa

SEQ ID NO: 77779 - DNA, 20 bp, synthetic construct
  misc_feature 1..20: note = CRISPR gRNA sequence
  source 1..20: mol_type = other DNA
acttcagcagggaaagaaca

SEQ ID NO: 77780 - DNA, 20 bp, synthetic construct
  misc_feature 1..20: note = CRISPR gRNA sequence
  source 1..20: mol_type = other DNA
cagcagggaaagaacagttg

SEQ ID NO: 77781 - DNA, 20 bp, synthetic construct
  misc_feature 1..20: note = CRISPR gRNA sequence
  source 1..20: mol_type = other DNA
agcagggaaagaacagttga

SEQ ID NO: 77782 - DNA, 20 bp, synthetic construct
  misc_feature 1..20: note = CRISPR gRNA sequence
  source 1..20: mol_type = other DNA
atctaaatcttaaaaaccaa

SEQ ID NO: 77783 - DNA, 20 bp, synthetic construct
  misc_feature 1..20: note = CRISPR gRNA sequence
  source 1..20: mol_type = other DNA
aatcttaaaaaccaaaccca

SEQ ID NO: 77784 - DNA, 20 bp, synthetic construct
  misc_feature 1..20: note = CRISPR gRNA sequence
  source 1..20: mol_type = other DNA
aaaaaccaaacccaaacacc

SEQ ID NO: 77785 - DNA, 20 bp, synthetic construct
  misc_feature 1..20: note = CRISPR gRNA sequence
  source 1..20: mol_type = other DNA
aaaaccaaacccaaacacca

SEQ ID NO: 77786 - DNA, 20 bp, synthetic construct
  misc_feature 1..20: note = CRISPR gRNA sequence
  source 1..20: mol_type = other DNA
actcactgtaattggcccca

SEQ ID NO: 77787 - DNA, 20 bp, synthetic construct
  misc_feature 1..20: note = CRISPR gRNA sequence
  source 1..20: mol_type = other DNA
actgtaattggccccaccca

SEQ ID NO: 77788 - DNA, 20 bp, synthetic construct
  misc_feature 1..20: note = CRISPR gRNA sequence
  source 1..20: mol_type = other DNA
taattggccccacccaccca

SEQ ID NO: 77789 - DNA, 20 bp, synthetic construct
  misc_feature 1..20: note = CRISPR gRNA sequence
  source 1..20: mol_type = other DNA
gccccacccacccaccttcc

SEQ ID NO: 77790 - DNA, 20 bp, synthetic construct
  misc_feature 1..20: note = CRISPR gRNA sequence
  source 1..20: mol_type = other DNA
ccaacacacaaaccactcac

SEQ ID NO: 77791 - DNA, 20 bp, synthetic construct
  misc_feature 1..20: note = CRISPR gRNA sequence
  source 1..20: mol_type = other DNA
caacacacaaaccactcact

SEQ ID NO: 77792 - DNA, 20 bp, synthetic construct
  misc_feature 1..20: note = CRISPR gRNA sequence
  source 1..20: mol_type = other DNA
actcgaggtggaggtgaccg

SEQ ID NO: 77793 - DNA, 20 bp, synthetic construct
  misc_feature 1..20: note = CRISPR gRNA sequence
  source 1..20: mol_type = other DNA
gaggtggaggtgaccgaggt

SEQ ID NO: 77794 - DNA, 20 bp, synthetic construct
  misc_feature 1..20: note = CRISPR gRNA sequence
  source 1..20: mol_type = other DNA
cctcccagagccttgcagag

SEQ ID NO: 77795 - DNA, 20 bp, synthetic construct
  misc_feature 1..20: note = CRISPR gRNA sequence
  source 1..20: mol_type = other DNA
ctcccagagccttgcagagc

SEQ ID NO: 77796 - DNA, 20 bp, synthetic construct
  misc_feature 1..20: note = CRISPR gRNA sequence
  source 1..20: mol_type = other DNA
ccagagccttgcagagctgc

SEQ ID NO: 77797 - DNA, 20 bp, synthetic construct
  misc_feature 1..20: note = CRISPR gRNA sequence
  source 1..20: mol_type = other DNA
gcagagctgctctaggtgct

SEQ ID NO: 77798 - DNA, 20 bp, synthetic construct
  misc_feature 1..20: note = CRISPR gRNA sequence
  source 1..20: mol_type = other DNA
cagagctgctctaggtgctt

SEQ ID NO: 77799 - DNA, 20 bp, synthetic construct
  misc_feature 1..20: note = CRISPR gRNA sequence
  source 1..20: mol_type = other DNA
ctctaggtgcttttcttgga

SEQ ID NO: 77800 - DNA, 20 bp, synthetic construct
  misc_feature 1..20: note = CRISPR gRNA sequence
  source 1..20: mol_type = other DNA
taggtgcttttcttggaggc

SEQ ID NO: 77801 - DNA, 20 bp, synthetic construct
  misc_feature 1..20: note = CRISPR gRNA sequence
  source 1..20: mol_type = other DNA
ggtgcttttcttggaggcca

SEQ ID NO: 77802 - DNA, 20 bp, synthetic construct
  misc_feature 1..20: note = CRISPR gRNA sequence
  source 1..20: mol_type = other DNA
ttcttggaggccacaatgtg

SEQ ID NO: 77803 - DNA, 20 bp, synthetic construct
  misc_feature 1..20: note = CRISPR gRNA sequence
  source 1..20: mol_type = other DNA
tcttggaggccacaatgtgt

SEQ ID NO: 77804 - DNA, 20 bp, synthetic construct
  misc_feature 1..20: note = CRISPR gRNA sequence
  source 1..20: mol_type = other DNA
cttggaggccacaatgtgtc

SEQ ID NO: 77805 - DNA, 20 bp, synthetic construct
  misc_feature 1..20: note = CRISPR gRNA sequence
  source 1..20: mol_type = other DNA
ttggaggccacaatgtgtca

SEQ ID NO: 77806 - DNA, 20 bp, synthetic construct
  misc_feature 1..20: note = CRISPR gRNA sequence
  source 1..20: mol_type = other DNA
ggaggccacaatgtgtcagc

SEQ ID NO: 77807 - DNA, 20 bp, synthetic construct
  misc_feature 1..20: note = CRISPR gRNA sequence
  source 1..20: mol_type = other DNA
gaggccacaatgtgtcagcc

SEQ ID NO: 77808 - DNA, 20 bp, synthetic construct
  misc_feature 1..20: note = CRISPR gRNA sequence
  source 1..20: mol_type = other DNA
cccagggacaaaaacacagt

SEQ ID NO: 77809 - DNA, 20 bp, synthetic construct
  misc_feature 1..20: note = CRISPR gRNA sequence
  source 1..20: mol_type = other DNA
catgccccactgaacagagg

SEQ ID NO: 77810 - DNA, 20 bp, synthetic construct
  misc_feature 1..20: note = CRISPR gRNA sequence
  source 1..20: mol_type = other DNA
aacagaggcgggaaggagcc

SEQ ID NO: 77811 - DNA, 20 bp, synthetic construct
  misc_feature 1..20: note = CRISPR gRNA sequence
  source 1..20: mol_type = other DNA
tcccaccccccagacacaga

SEQ ID NO: 77812 - DNA, 20 bp, synthetic construct
  misc_feature 1..20: note = CRISPR gRNA sequence
  source 1..20: mol_type = other DNA
cccaccccccagacacagag

SEQ ID NO: 77813 - DNA, 20 bp, synthetic construct
  misc_feature 1..20: note = CRISPR gRNA sequence
  source 1..20: mol_type = other DNA
ccaccccccagacacagagg

SEQ ID NO: 77814 - DNA, 20 bp, synthetic construct
  misc_feature 1..20: note = CRISPR gRNA sequence
  source 1..20: mol_type = other DNA
gcaggagaggagggactggg

SEQ ID NO: 77815 - DNA, 20 bp, synthetic construct
  misc_feature 1..20: note = CRISPR gRNA sequence
  source 1..20: mol_type = other DNA
caggagaggagggactggga

SEQ ID NO: 77816 - DNA, 20 bp, synthetic construct
  misc_feature 1..20: note = CRISPR gRNA sequence
  source 1..20: mol_type = other DNA
ggatgtatctggcacctaga

SEQ ID NO: 77817 - DNA, 20 bp, synthetic construct
  misc_feature 1..20: note = CRISPR gRNA sequence
  source 1..20: mol_type = other DNA
gcacctagacagacggacaa

SEQ ID NO: 77818 - DNA, 20 bp, synthetic construct
  misc_feature 1..20: note = CRISPR gRNA sequence
  source 1..20: mol_type = other DNA
gacagacggacaaagaggga

SEQ ID NO: 77819 - DNA, 20 bp, synthetic construct
  misc_feature 1..20: note = CRISPR gRNA sequence
  source 1..20: mol_type = other DNA
agagagagagagcagatcag

SEQ ID NO: 77820 - DNA, 20 bp, synthetic construct
  misc_feature 1..20: note = CRISPR gRNA sequence
  source 1..20: mol_type = other DNA
aaataacagttaaataaact

SEQ ID NO: 77821 - DNA, 20 bp, synthetic construct
  misc_feature 1..20: note = CRISPR gRNA sequence
  source 1..20: mol_type = other DNA
aataaactgataaaacagaa

SEQ ID NO: 77822 - DNA, 20 bp, synthetic construct
  misc_feature 1..20: note = CRISPR gRNA sequence
  source 1..20: mol_type = other DNA
ataaaacagaaatacacgat

SEQ ID NO: 77823 - DNA, 20 bp, synthetic construct
  misc_feature 1..20: note = CRISPR gRNA sequence
  source 1..20: mol_type = other DNA
ggacagacaaagaccaagag

SEQ ID NO: 77824 - DNA, 20 bp, synthetic construct
  misc_feature 1..20: note = CRISPR gRNA sequence
  source 1..20: mol_type = other DNA
atgggagcccccaggcccag

SEQ ID NO: 77825 - DNA, 20 bp, synthetic construct
  misc_feature 1..20: note = CRISPR gRNA sequence
  source 1..20: mol_type = other DNA
cccttcacctcttttcagag

SEQ ID NO: 77826 - DNA, 20 bp, synthetic construct
  misc_feature 1..20: note = CRISPR gRNA sequence
  source 1..20: mol_type = other DNA
cacctcttttcagagtctcc

SEQ ID NO: 77827 - DNA, 20 bp, synthetic construct
  misc_feature 1..20: note = CRISPR gRNA sequence
  source 1..20: mol_type = other DNA
acctcttttcagagtctcca

SEQ ID NO: 77828 - DNA, 20 bp, synthetic construct
  misc_feature 1..20: note = CRISPR gRNA sequence
  source 1..20: mol_type = other DNA
ttttcagagtctccacaacc

SEQ ID NO: 77829 - DNA, 20 bp, synthetic construct
  misc_feature 1..20: note = CRISPR gRNA sequence
  source 1..20: mol_type = other DNA
ttcagagtctccacaacccc

SEQ ID NO: 77830 - DNA, 20 bp, synthetic construct
  misc_feature 1..20: note = CRISPR gRNA sequence
  source 1..20: mol_type = other DNA
tcagagtctccacaacccct

SEQ ID NO: 77831 - DNA, 20 bp, synthetic construct
  misc_feature 1..20: note = CRISPR gRNA sequence
  source 1..20: mol_type = other DNA
cagagtctccacaacccctc

SEQ ID NO: 77832 - DNA, 20 bp, synthetic construct
  misc_feature 1..20: note = CRISPR gRNA sequence
  source 1..20: mol_type = other DNA
agagtctccacaacccctca

SEQ ID NO: 77833 - DNA, 20 bp, synthetic construct
  misc_feature 1..20: note = CRISPR gRNA sequence
  source 1..20: mol_type = other DNA
cacaacccctcagctgctgg

SEQ ID NO: 77834 - DNA, 20 bp, synthetic construct
  misc_feature 1..20: note = CRISPR gRNA sequence
  source 1..20: mol_type = other DNA
agctgctgggggtcagggag

SEQ ID NO: 77835 - DNA, 20 bp, synthetic construct
  misc_feature 1..20: note = CRISPR gRNA sequence
  source 1..20: mol_type = other DNA
ctgggggtcagggagctaag

SEQ ID NO: 77836 - DNA, 20 bp, synthetic construct
  misc_feature 1..20: note = CRISPR gRNA sequence
  source 1..20: mol_type = other DNA
ggggtcagggagctaagggg

SEQ ID NO: 77837 - DNA, 20 bp, synthetic construct
  misc_feature 1..20: note = CRISPR gRNA sequence
  source 1..20: mol_type = other DNA
aggggagtggggtctcctgg

SEQ ID NO: 77838 - DNA, 20 bp, synthetic construct
  misc_feature 1..20: note = CRISPR gRNA sequence
  source 1..20: mol_type = other DNA
ctgggcttgggaaggtggtt

SEQ ID NO: 77839 - DNA, 20 bp, synthetic construct
  misc_feature 1..20: note = CRISPR gRNA sequence
  source 1..20: mol_type = other DNA
ggcttgggaaggtggttgac

SEQ ID NO: 77840 - DNA, 20 bp, synthetic construct
  misc_feature 1..20: note = CRISPR gRNA sequence
  source 1..20: mol_type = other DNA
gggaaggtggttgacggggc

SEQ ID NO: 77841 - DNA, 20 bp, synthetic construct
  misc_feature 1..20: note = CRISPR gRNA sequence
  source 1..20: mol_type = other DNA
ggaaggtggttgacggggct

SEQ ID NO: 77842 - DNA, 20 bp, synthetic construct
  misc_feature 1..20: note = CRISPR gRNA sequence
  source 1..20: mol_type = other DNA
acggggctgccttgtgagcc

SEQ ID NO: 77843 - DNA, 20 bp, synthetic construct
  misc_feature 1..20: note = CRISPR gRNA sequence
  source 1..20: mol_type = other DNA
ccttgtgagccctgtctggg

SEQ ID NO: 77844 - DNA, 20 bp, synthetic construct
  misc_feature 1..20: note = CRISPR gRNA sequence
  source 1..20: mol_type = other DNA
gtgagccctgtctggggtgg

SEQ ID NO: 77845 - DNA, 20 bp, synthetic construct
  misc_feature 1..20: note = CRISPR gRNA sequence
  source 1..20: mol_type = other DNA
tgagccctgtctggggtggg

SEQ ID NO: 77846 - DNA, 20 bp, synthetic construct
  misc_feature 1..20: note = CRISPR gRNA sequence
  source 1..20: mol_type = other DNA
tctggggtgggctgggcagg

SEQ ID NO: 77847 - DNA, 20 bp, synthetic construct
  misc_feature 1..20: note = CRISPR gRNA sequence
  source 1..20: mol_type = other DNA
gggtgggctgggcaggggag

SEQ ID NO: 77848 - DNA, 20 bp, synthetic construct
  misc_feature 1..20: note = CRISPR gRNA sequence
  source 1..20: mol_type = other DNA
ggcaggggaggtaggaggta

SEQ ID NO: 77849 - DNA, 20 bp, synthetic construct
  misc_feature 1..20: note = CRISPR gRNA sequence
  source 1..20: mol_type = other DNA
gacacagcaggtcaggtgtc

SEQ ID NO: 77850 - DNA, 20 bp, synthetic construct
  misc_feature 1..20: note = CRISPR gRNA sequence
  source 1..20: mol_type = other DNA
cagggagcatgtggggcctg

SEQ ID NO: 77851 - DNA, 20 bp, synthetic construct
  misc_feature 1..20: note = CRISPR gRNA sequence
  source 1..20: mol_type = other DNA
agggagcatgtggggcctgg

SEQ ID NO: 77852 - DNA, 20 bp, synthetic construct
  misc_feature 1..20: note = CRISPR gRNA sequence
  source 1..20: mol_type = other DNA
ggcacaggtttgggagcagg

SEQ ID NO: 77853 - DNA, 20 bp, synthetic construct
  misc_feature 1..20: note = CRISPR gRNA sequence
  source 1..20: mol_type = other DNA
gggagcaggctctgagcagg

SEQ ID NO: 77854 - DNA, 20 bp, synthetic construct
  misc_feature 1..20: note = CRISPR gRNA sequence
  source 1..20: mol_type = other DNA
ggagcaggctctgagcaggg

SEQ ID NO: 77855 - DNA, 20 bp, synthetic construct
  misc_feature 1..20: note = CRISPR gRNA sequence
  source 1..20: mol_type = other DNA
tgagcaggggaagggagggg

SEQ ID NO: 77856 - DNA, 20 bp, synthetic construct
  misc_feature 1..20: note = CRISPR gRNA sequence
  source 1..20: mol_type = other DNA
agcaggggaagggagggggc

SEQ ID NO: 77857 - DNA, 20 bp, synthetic construct
  misc_feature 1..20: note = CRISPR gRNA sequence
  source 1..20: mol_type = other DNA
gaatcacacacagggctgga

SEQ ID NO: 77858 - DNA, 20 bp, synthetic construct
  misc_feature 1..20: note = CRISPR gRNA sequence
  source 1..20: mol_type = other DNA
gaggccatcactgtacctca

SEQ ID NO: 77859 - DNA, 20 bp, synthetic construct
  misc_feature 1..20: note = CRISPR gRNA sequence
  source 1..20: mol_type = other DNA
tacctcatccttcgggagct

SEQ ID NO: 77860 - DNA, 20 bp, synthetic construct
  misc_feature 1..20: note = CRISPR gRNA sequence
  source 1..20: mol_type = other DNA
atccttcgggagctcagagg

SEQ ID NO: 77861 - DNA, 20 bp, synthetic construct
  misc_feature 1..20: note = CRISPR gRNA sequence
  source 1..20: mol_type = other DNA
cgggagctcagaggcagctc

SEQ ID NO: 77862 - DNA, 20 bp, synthetic construct
  misc_feature 1..20: note = CRISPR gRNA sequence
  source 1..20: mol_type = other DNA
gggagctcagaggcagctca

SEQ ID NO: 77863 - DNA, 20 bp, synthetic construct
  misc_feature 1..20: note = CRISPR gRNA sequence
  source 1..20: mol_type = other DNA
agaggcagctcagagggcat

SEQ ID NO: 77864 - DNA, 20 bp, synthetic construct
  misc_feature 1..20: note = CRISPR gRNA sequence
  source 1..20: mol_type = other DNA
agagggcatctggagcatga

SEQ ID NO: 77865 - DNA, 20 bp, synthetic construct
  misc_feature 1..20: note = CRISPR gRNA sequence
  source 1..20: mol_type = other DNA
gagcatgaggctgtcaagaa

SEQ ID NO: 77866 - DNA, 20 bp, synthetic construct
  misc_feature 1..20: note = CRISPR gRNA sequence
  source 1..20: mol_type = other DNA
tcaagaaatgcagccctgga

SEQ ID NO: 77867 - DNA, 20 bp, synthetic construct
  misc_feature 1..20: note = CRISPR gRNA sequence
  source 1..20: mol_type = other DNA
gagggacatcaccaaggcca

SEQ ID NO: 77868 - DNA, 20 bp, synthetic construct
  misc_feature 1..20: note = CRISPR gRNA sequence
  source 1..20: mol_type = other DNA
agcaaaggccatgtccgcca

SEQ ID NO: 77869 - DNA, 20 bp, synthetic construct
  misc_feature 1..20: note = CRISPR gRNA sequence
  source 1..20: mol_type = other DNA
cagaatccatcctcagcctg

SEQ ID NO: 77870 - DNA, 20 bp, synthetic construct
  misc_feature 1..20: note = CRISPR gRNA sequence
  source 1..20: mol_type = other DNA
agcctggccttccaccatcg

SEQ ID NO: 77871 - DNA, 20 bp, synthetic construct
  misc_feature 1..20: note = CRISPR gRNA sequence
  source 1..20: mol_type = other DNA
gccttccaccatcgagccct

SEQ ID NO: 77872 - DNA, 20 bp, synthetic construct
  misc_feature 1..20: note = CRISPR gRNA sequence
  source 1..20: mol_type = other DNA
ccaccatcgagccctatcct

SEQ ID NO: 77873 - DNA, 20 bp, synthetic construct
  misc_feature 1..20: note = CRISPR gRNA sequence
  source 1..20: mol_type = other DNA
caccatcgagccctatcctc

SEQ ID NO: 77874 - DNA, 20 bp, synthetic construct
  misc_feature 1..20: note = CRISPR gRNA sequence
  source 1..20: mol_type = other DNA
tcctccacctagagtcaatc

SEQ ID NO: 77875 - DNA, 20 bp, synthetic construct
  misc_feature 1..20: note = CRISPR gRNA sequence
  source 1..20: mol_type = other DNA
cacctagagtcaatcagacc

SEQ ID NO: 77876 - DNA, 20 bp, synthetic construct
  misc_feature 1..20: note = CRISPR gRNA sequence
  source 1..20: mol_type = other DNA
gagtcaatcagaccttggtg

SEQ ID NO: 77877 - DNA, 20 bp, synthetic construct
  misc_feature 1..20: note = CRISPR gRNA sequence
  source 1..20: mol_type = other DNA
ggtgccaatttggcttctcc

SEQ ID NO: 77878 - DNA, 20 bp, synthetic construct
  misc_feature 1..20: note = CRISPR gRNA sequence
  source 1..20: mol_type = other DNA
gtgccaatttggcttctcca

SEQ ID NO: 77879 - DNA, 20 bp, synthetic construct
  misc_feature 1..20: note = CRISPR gRNA sequence
  source 1..20: mol_type = other DNA
ggcttctccacttcctggtt

SEQ ID NO: 77880 - DNA, 20 bp, synthetic construct
  misc_feature 1..20: note = CRISPR gRNA sequence
  source 1..20: mol_type = other DNA
gcttctccacttcctggttg

SEQ ID NO: 77881 - DNA, 20 bp, synthetic construct
  misc_feature 1..20: note = CRISPR gRNA sequence
  source 1..20: mol_type = other DNA
ctccacttcctggttgtgtg

SEQ ID NO: 77882 - DNA, 20 bp, synthetic construct
  misc_feature 1..20: note = CRISPR gRNA sequence
  source 1..20: mol_type = other DNA
tccacttcctggttgtgtga

SEQ ID NO: 77883 - DNA, 20 bp, synthetic construct
  misc_feature 1..20: note = CRISPR gRNA sequence
  source 1..20: mol_type = other DNA
cacttcctggttgtgtgacc

SEQ ID NO: 77884 - DNA, 20 bp, synthetic construct
  misc_feature 1..20: note = CRISPR gRNA sequence
  source 1..20: mol_type = other DNA
cctggttgtgtgaccctgga

SEQ ID NO: 77885 - DNA, 20 bp, synthetic construct
  misc_feature 1..20: note = CRISPR gRNA sequence
  source 1..20: mol_type = other DNA
ctggttgtgtgaccctggac

SEQ ID NO: 77886 - DNA, 20 bp, synthetic construct
  misc_feature 1..20: note = CRISPR gRNA sequence
  source 1..20: mol_type = other DNA
gttgtgtgaccctggacaaa

SEQ ID NO: 77887 - DNA, 20 bp, synthetic construct
  misc_feature 1..20: note = CRISPR gRNA sequence
  source 1..20: mol_type = other DNA
tgtgaccctggacaaatcac

SEQ ID NO: 77888 - DNA, 20 bp, synthetic construct
  misc_feature 1..20: note = CRISPR gRNA sequence
  source 1..20: mol_type = other DNA
gacaaatcacagcctctcaa

SEQ ID NO: 77889 - DNA, 20 bp, synthetic construct
  misc_feature 1..20: note = CRISPR gRNA sequence
  source 1..20: mol_type = other DNA
tcaatgggagactgtatgtg

SEQ ID NO: 77890 - DNA, 20 bp, synthetic construct
  misc_feature 1..20: note = CRISPR gRNA sequence
  source 1..20: mol_type = other DNA
aatgggagactgtatgtgaa

SEQ ID NO: 77891 - DNA, 20 bp, synthetic construct
  misc_feature 1..20: note = CRISPR gRNA sequence
  source 1..20: mol_type = other DNA
tatgtgaactgccttagttt

SEQ ID NO: 77892 - DNA, 20 bp, synthetic construct
  misc_feature 1..20: note = CRISPR gRNA sequence
  source 1..20: mol_type = other DNA
ccttagtttggtgcttggtg

SEQ ID NO: 77893 - DNA, 20 bp, synthetic construct
  misc_feature 1..20: note = CRISPR gRNA sequence
  source 1..20: mol_type = other DNA
agtttggtgcttggtgcata

SEQ ID NO: 77894 - DNA, 20 bp, synthetic construct
  misc_feature 1..20: note = CRISPR gRNA sequence
  source 1..20: mol_type = other DNA
gtttggtgcttggtgcatac

SEQ ID NO: 77895 - DNA, 20 bp, synthetic construct
  misc_feature 1..20: note = CRISPR gRNA sequence
  source 1..20: mol_type = other DNA
ggtgcttggtgcatacatgg

SEQ ID NO: 77896 - DNA, 20 bp, synthetic construct
  misc_feature 1..20: note = CRISPR gRNA sequence
  source 1..20: mol_type = other DNA
gtgcttggtgcatacatggc

SEQ ID NO: 77897 - DNA, 20 bp, synthetic construct
  misc_feature 1..20: note = CRISPR gRNA sequence
  source 1..20: mol_type = other DNA
ggtgcatacatggcaagtac

SEQ ID NO: 77898 - DNA, 20 bp, synthetic construct
  misc_feature 1..20: note = CRISPR gRNA sequence
  source 1..20: mol_type = other DNA
gtgcatacatggcaagtact

SEQ ID NO: 77899 - DNA, 20 bp, synthetic construct
  misc_feature 1..20: note = CRISPR gRNA sequence
  source 1..20: mol_type = other DNA
aattgaccttgactgctatt

SEQ ID NO: 77900 - DNA, 20 bp, synthetic construct
  misc_feature 1..20: note = CRISPR gRNA sequence
  source 1..20: mol_type = other DNA
accttgactgctattatcat

SEQ ID NO: 77901 - DNA, 20 bp, synthetic construct
  misc_feature 1..20: note = CRISPR gRNA sequence
  source 1..20: mol_type = other DNA
gactgctattatcattaatc

SEQ ID NO: 77902 - DNA, 20 bp, synthetic construct
  misc_feature 1..20: note = CRISPR gRNA sequence
  source 1..20: mol_type = other DNA
actgctattatcattaatct

SEQ ID NO: 77903 - DNA, 20 bp, synthetic construct
  misc_feature 1..20: note = CRISPR gRNA sequence
  source 1..20: mol_type = other DNA
ctattatcattaatctcatc

SEQ ID NO: 77904 - DNA, 20 bp, synthetic construct
  misc_feature 1..20: note = CRISPR gRNA sequence
  source 1..20: mol_type = other DNA
ttatcattaatctcatcctc

SEQ ID NO: 77905 - DNA, 20 bp, synthetic construct
  misc_feature 1..20: note = CRISPR gRNA sequence
  source 1..20: mol_type = other DNA
tcattaatctcatcctcctc

SEQ ID NO: 77906 - DNA, 20 bp, synthetic construct
  misc_feature 1..20: note = CRISPR gRNA sequence
  source 1..20: mol_type = other DNA
atctcatcctcctcctcatc

SEQ ID NO: 77907 - DNA, 20 bp, synthetic construct
  misc_feature 1..20: note = CRISPR gRNA sequence
  source 1..20: mol_type = other DNA
atcctcctcctcatctgtgc

SEQ ID NO: 77908 - DNA, 20 bp, synthetic construct
  misc_feature 1..20: note = CRISPR gRNA sequence
  source 1..20: mol_type = other DNA
ctcctcatctgtgcttcaga

SEQ ID NO: 77909 - DNA, 20 bp, synthetic construct
  misc_feature 1..20: note = CRISPR gRNA sequence
  source 1..20: mol_type = other DNA
ctcatctgtgcttcagagat

SEQ ID NO: 77910 - DNA, 20 bp, synthetic construct
  misc_feature 1..20: note = CRISPR gRNA sequence
  source 1..20: mol_type = other DNA
atctgtgcttcagagatgtc

SEQ ID NO: 77911 - DNA, 20 bp, synthetic construct
  misc_feature 1..20: note = CRISPR gRNA sequence
  source 1..20: mol_type = other DNA
tgcttcagagatgtcagccc

SEQ ID NO: 77912 - DNA, 20 bp, synthetic construct
  misc_feature 1..20: note = CRISPR gRNA sequence
  source 1..20: mol_type = other DNA
cagagatgtcagccccagct

SEQ ID NO: 77913 - DNA, 20 bp, synthetic construct
  misc_feature 1..20: note = CRISPR gRNA sequence
  source 1..20: mol_type = other DNA
agagatgtcagccccagctg

SEQ ID NO: 77914 - DNA, 20 bp, synthetic construct
  misc_feature 1..20: note = CRISPR gRNA sequence
  source 1..20: mol_type = other DNA
gaatcgagccttcagtagtc

SEQ ID NO: 77915 - DNA, 20 bp, synthetic construct
  misc_feature 1..20: note = CRISPR gRNA sequence
  source 1..20: mol_type = other DNA
cagtagtccagactctacag

SEQ ID NO: 77916 - DNA, 20 bp, synthetic construct
  misc_feature 1..20: note = CRISPR gRNA sequence
  source 1..20: mol_type = other DNA
agtagtccagactctacaga

SEQ ID NO: 77917 - DNA, 20 bp, synthetic construct
  misc_feature 1..20: note = CRISPR gRNA sequence
  source 1..20: mol_type = other DNA
tacagaagagattgtgggtg

SEQ ID NO: 77918 - DNA, 20 bp, synthetic construct
  misc_feature 1..20: note = CRISPR gRNA sequence
  source 1..20: mol_type = other DNA
cagaagagattgtgggtggg

SEQ ID NO: 77919 - DNA, 20 bp, synthetic construct
  misc_feature 1..20: note = CRISPR gRNA sequence
  source 1..20: mol_type = other DNA
tgggtgggctccgggagcaa

SEQ ID NO: 77920 - DNA, 20 bp, synthetic construct
  misc_feature 1..20: note = CRISPR gRNA sequence
  source 1..20: mol_type = other DNA
cgggagcaaagagctgagtc

SEQ ID NO: 77921 - DNA, 20 bp, synthetic construct
  misc_feature 1..20: note = CRISPR gRNA sequence
  source 1..20: mol_type = other DNA
agtctctacccatgcgctag

SEQ ID NO: 77922 - DNA, 20 bp, synthetic construct
  misc_feature 1..20: note = CRISPR gRNA sequence
  source 1..20: mol_type = other DNA
tacccatgcgctaggctggg

SEQ ID NO: 77923 - DNA, 20 bp, synthetic construct
  misc_feature 1..20: note = CRISPR gRNA sequence
  source 1..20: mol_type = other DNA
cccatgcgctaggctggggc

SEQ ID NO: 77924 - DNA, 20 bp, synthetic construct
  misc_feature 1..20: note = CRISPR gRNA sequence
  source 1..20: mol_type = other DNA
ggctggggcaatccaggacc

SEQ ID NO: 77925 - DNA, 20 bp, synthetic construct
  misc_feature 1..20: note = CRISPR gRNA sequence
  source 1..20: mol_type = other DNA
gggcaatccaggaccctaat

SEQ ID NO: 77926 - DNA, 20 bp, synthetic construct
  misc_feature 1..20: note = CRISPR gRNA sequence
  source 1..20: mol_type = other DNA
atgggtccttgtgtgaaagg

SEQ ID NO: 77927 - DNA, 20 bp, synthetic construct
  misc_feature 1..20: note = CRISPR gRNA sequence
  source 1..20: mol_type = other DNA
gtgtgaaagggatacagaag

SEQ ID NO: 77928 - DNA, 20 bp, synthetic construct
  misc_feature 1..20: note = CRISPR gRNA sequence
  source 1..20: mol_type = other DNA
tgtgaaagggatacagaagt

SEQ ID NO: 77929 - DNA, 20 bp, synthetic construct
  misc_feature 1..20: note = CRISPR gRNA sequence
  source 1..20: mol_type = other DNA
cgaccaggaccagagctaca

SEQ ID NO: 77930 - DNA, 20 bp, synthetic construct
  misc_feature 1..20: note = CRISPR gRNA sequence
  source 1..20: mol_type = other DNA
caggccaggcaatcccctgg

SEQ ID NO: 77931 - DNA, 20 bp, synthetic construct
  misc_feature 1..20: note = CRISPR gRNA sequence
  source 1..20: mol_type = other DNA
ggtttaagctggagggctct

SEQ ID NO: 77932 - DNA, 20 bp, synthetic construct
  misc_feature 1..20: note = CRISPR gRNA sequence
  source 1..20: mol_type = other DNA
aagctggagggctctagtct

SEQ ID NO: 77933 - DNA, 20 bp, synthetic construct
  misc_feature 1..20: note = CRISPR gRNA sequence
  source 1..20: mol_type = other DNA
agctggagggctctagtctc

SEQ ID NO: 77934 - DNA, 20 bp, synthetic construct
  misc_feature 1..20: note = CRISPR gRNA sequence
  source 1..20: mol_type = other DNA
gagggctctagtctcccgga

SEQ ID NO: 77935 - DNA, 20 bp, synthetic construct
  misc_feature 1..20: note = CRISPR gRNA sequence
  source 1..20: mol_type = other DNA
tagtctcccggaatccccct

SEQ ID NO: 77936 - DNA, 20 bp, synthetic construct
  misc_feature 1..20: note = CRISPR gRNA sequence
  source 1..20: mol_type = other DNA
gtctcccggaatccccctct

SEQ ID NO: 77937 - DNA, 20 bp, synthetic construct
  misc_feature 1..20: note = CRISPR gRNA sequence
  source 1..20: mol_type = other DNA
ccggaatccccctctggcta

SEQ ID NO: 77938 - DNA, 20 bp, synthetic construct
  misc_feature 1..20: note = CRISPR gRNA sequence
  source 1..20: mol_type = other DNA
tggctacccaactcctgccc

SEQ ID NO: 77939 - DNA, 20 bp, synthetic construct
  misc_feature 1..20: note = CRISPR gRNA sequence
  source 1..20: mol_type = other DNA
gctacccaactcctgccctg

SEQ ID NO: 77940 - DNA, 20 bp, synthetic construct
  misc_feature 1..20: note = CRISPR gRNA sequence
  source 1..20: mol_type = other DNA
cccaactcctgccctggcct

SEQ ID NO: 77941 - DNA, 20 bp, synthetic construct
  misc_feature 1..20: note = CRISPR gRNA sequence
  source 1..20: mol_type = other DNA
ctgccctggcctgctgtcta

SEQ ID NO: 77942 - DNA, 20 bp, synthetic construct
  misc_feature 1..20: note = CRISPR gRNA sequence
  source 1..20: mol_type = other DNA
ccctggcctgctgtctatat

SEQ ID NO: 77943 - DNA, 20 bp, synthetic construct
  misc_feature 1..20: note = CRISPR gRNA sequence
  source 1..20: mol_type = other DNA
gcctgctgtctatatcctac

SEQ ID NO: 77944 - DNA, 20 bp, synthetic construct
  misc_feature 1..20: note = CRISPR gRNA sequence
  source 1..20: mol_type = other DNA
ctgtctatatcctacacact

SEQ ID NO: 77945 - DNA, 20 bp, synthetic construct
  misc_feature 1..20: note = CRISPR gRNA sequence
  source 1..20: mol_type = other DNA
tctatatcctacacactggg

SEQ ID NO: 77946 - DNA, 20 bp, synthetic construct
  misc_feature 1..20: note = CRISPR gRNA sequence
  source 1..20: mol_type = other DNA
tatcctacacactggggctc

SEQ ID NO: 77947 - DNA, 20 bp, synthetic construct
  misc_feature 1..20: note = CRISPR gRNA sequence
  source 1..20: mol_type = other DNA
cacactggggctcctttcag

SEQ ID NO: 77948 - DNA, 20 bp, synthetic construct
  misc_feature 1..20: note = CRISPR gRNA sequence
  source 1..20: mol_type = other DNA
gggctcctttcaggcaccat

SEQ ID NO: 77949 - DNA, 20 bp, synthetic construct
  misc_feature 1..20: note = CRISPR gRNA sequence
  source 1..20: mol_type = other DNA
ctttcaggcaccatgagagg

SEQ ID NO: 77950 - DNA, 20 bp, synthetic construct
  misc_feature 1..20: note = CRISPR gRNA sequence
  source 1..20: mol_type = other DNA
tcaggcaccatgagaggcgg

SEQ ID NO: 77951 - DNA, 20 bp, synthetic construct
  misc_feature 1..20: note = CRISPR gRNA sequence
  source 1..20: mol_type = other DNA
caggcaccatgagaggcgga

SEQ ID NO: 77952 - DNA, 20 bp, synthetic construct
  misc_feature 1..20: note = CRISPR gRNA sequence
  source 1..20: mol_type = other DNA
aggcaccatgagaggcggag

SEQ ID NO: 77953 - DNA, 20 bp, synthetic construct
  misc_feature 1..20: note = CRISPR gRNA sequence
  source 1..20: mol_type = other DNA
gatttggaccctcccccttt

SEQ ID NO: 77954 - DNA, 20 bp, synthetic construct
  misc_feature 1..20: note = CRISPR gRNA sequence
  source 1..20: mol_type = other DNA
ggaccctccccctttggggc

SEQ ID NO: 77955 - DNA, 20 bp, synthetic construct
  misc_feature 1..20: note = CRISPR gRNA sequence
  source 1..20: mol_type = other DNA
gaccctccccctttggggct

SEQ ID NO: 77956 - DNA, 20 bp, synthetic construct
  misc_feature 1..20: note = CRISPR gRNA sequence
  source 1..20: mol_type = other DNA
cccctttggggctgcatcct

SEQ ID NO: 77957 - DNA, 20 bp, synthetic construct
  misc_feature 1..20: note = CRISPR gRNA sequence
  source 1..20: mol_type = other DNA
tggggctgcatcctttgcca

SEQ ID NO: 77958 - DNA, 20 bp, synthetic construct
  misc_feature 1..20: note = CRISPR gRNA sequence
  source 1..20: mol_type = other DNA
ggggctgcatcctttgccaa

SEQ ID NO: 77959 - DNA, 20 bp, synthetic construct
  misc_feature 1..20: note = CRISPR gRNA sequence
  source 1..20: mol_type = other DNA
gggctgcatcctttgccaag

SEQ ID NO: 77960 - DNA, 20 bp, synthetic construct
  misc_feature 1..20: note = CRISPR gRNA sequence
  source 1..20: mol_type = other DNA
catcctttgccaagcctgct

SEQ ID NO: 77961 - DNA, 20 bp, synthetic construct
  misc_feature 1..20: note = CRISPR gRNA sequence
  source 1..20: mol_type = other DNA
tgccaagcctgctcacttcc

SEQ ID NO: 77962 - DNA, 20 bp, synthetic construct
  misc_feature 1..20: note = CRISPR gRNA sequence
  source 1..20: mol_type = other DNA
gccaagcctgctcacttccc

SEQ ID NO: 77963 - DNA, 20 bp, synthetic construct
  misc_feature 1..20: note = CRISPR gRNA sequence
  source 1..20: mol_type = other DNA
ccaagcctgctcacttcccg

SEQ ID NO: 77964 - DNA, 20 bp, synthetic construct
  misc_feature 1..20: note = CRISPR gRNA sequence
  source 1..20: mol_type = other DNA
ctcacttcccgctcttccgt

SEQ ID NO: 77965 - DNA, 20 bp, synthetic construct
  misc_feature 1..20: note = CRISPR gRNA sequence
  source 1..20: mol_type = other DNA
acttcccgctcttccgtgaa

SEQ ID NO: 77966 - DNA, 20 bp, synthetic construct
  misc_feature 1..20: note = CRISPR gRNA sequence
  source 1..20: mol_type = other DNA
cccgctcttccgtgaatttg

SEQ ID NO: 77967 - DNA, 20 bp, synthetic construct
  misc_feature 1..20: note = CRISPR gRNA sequence
  source 1..20: mol_type = other DNA
ccgctcttccgtgaatttgt

SEQ ID NO: 77968 - DNA, 20 bp, synthetic construct
  misc_feature 1..20: note = CRISPR gRNA sequence
  source 1..20: mol_type = other DNA
ttccgtgaatttgtccaggt

SEQ ID NO: 77969 - DNA, 20 bp, synthetic construct
  misc_feature 1..20: note = CRISPR gRNA sequence
  source 1..20: mol_type = other DNA
ccgtgaatttgtccaggtca

SEQ ID NO: 77970 - DNA, 20 bp, synthetic construct
  misc_feature 1..20: note = CRISPR gRNA sequence
  source 1..20: mol_type = other DNA
cgtgaatttgtccaggtcac

SEQ ID NO: 77971 - DNA, 20 bp, synthetic construct
  misc_feature 1..20: note = CRISPR gRNA sequence
  source 1..20: mol_type = other DNA
gtccaggtcaccctggcagt

SEQ ID NO: 77972 - DNA, 20 bp, synthetic construct
  misc_feature 1..20: note = CRISPR gRNA sequence
  source 1..20: mol_type = other DNA
tccaggtcaccctggcagtt

SEQ ID NO: 77973 - DNA, 20 bp, synthetic construct
  misc_feature 1..20: note = CRISPR gRNA sequence
  source 1..20: mol_type = other DNA
gcagttgactgactggcact

SEQ ID NO: 77974 - DNA, 20 bp, synthetic construct
  misc_feature 1..20: note = CRISPR gRNA sequence
  source 1..20: mol_type = other DNA
actgactggcactgcccagc

SEQ ID NO: 77975 - DNA, 20 bp, synthetic construct
  misc_feature 1..20: note = CRISPR gRNA sequence
  source 1..20: mol_type = other DNA
actggcactgcccagctgtg

SEQ ID NO: 77976 - DNA, 20 bp, synthetic construct
  misc_feature 1..20: note = CRISPR gRNA sequence
  source 1..20: mol_type = other DNA
gcactgcccagctgtggagg

SEQ ID NO: 77977 - DNA, 20 bp, synthetic construct
  misc_feature 1..20: note = CRISPR gRNA sequence
  source 1..20: mol_type = other DNA
cccagctgtggagggtagag

SEQ ID NO: 77978 - DNA, 20 bp, synthetic construct
  misc_feature 1..20: note = CRISPR gRNA sequence
  source 1..20: mol_type = other DNA
tggagggtagagaggggaat

SEQ ID NO: 77979 - DNA, 20 bp, synthetic construct
  misc_feature 1..20: note = CRISPR gRNA sequence
  source 1..20: mol_type = other DNA
actgagcatggagttggggt

SEQ ID NO: 77980 - DNA, 20 bp, synthetic construct
  misc_feature 1..20: note = CRISPR gRNA sequence
  source 1..20: mol_type = other DNA
agcatggagttggggtgaaa

SEQ ID NO: 77981 - DNA, 20 bp, synthetic construct
  misc_feature 1..20: note = CRISPR gRNA sequence
  source 1..20: mol_type = other DNA
gggtgaaatcgggccctacc

SEQ ID NO: 77982 - DNA, 20 bp, synthetic construct
  misc_feature 1..20: note = CRISPR gRNA sequence
  source 1..20: mol_type = other DNA
cctctcctggggccccttct

SEQ ID NO: 77983 - DNA, 20 bp, synthetic construct
  misc_feature 1..20: note = CRISPR gRNA sequence
  source 1..20: mol_type = other DNA
tcctggggccccttctgctc

SEQ ID NO: 77984 - DNA, 20 bp, synthetic construct
  misc_feature 1..20: note = CRISPR gRNA sequence
  source 1..20: mol_type = other DNA
ctggggccccttctgctcct

SEQ ID NO: 77985 - DNA, 20 bp, synthetic construct
  misc_feature 1..20: note = CRISPR gRNA sequence
  source 1..20: mol_type = other DNA
gggccccttctgctcctctg

SEQ ID NO: 77986 - DNA, 20 bp, synthetic construct
  misc_feature 1..20: note = CRISPR gRNA sequence
  source 1..20: mol_type = other DNA
ctgctcctctggctcctggg

SEQ ID NO: 77987 - DNA, 20 bp, synthetic construct
  misc_feature 1..20: note = CRISPR gRNA sequence
  source 1..20: mol_type = other DNA
tgctcctctggctcctgggc

SEQ ID NO: 77988 - DNA, 20 bp, synthetic construct
  misc_feature 1..20: note = CRISPR gRNA sequence
  source 1..20: mol_type = other DNA
ctcctctggctcctgggcaa

SEQ ID NO: 77989 - DNA, 20 bp, synthetic construct
  misc_feature 1..20: note = CRISPR gRNA sequence
  source 1..20: mol_type = other DNA
ctctggctcctgggcaaaca

SEQ ID NO: 77990 - DNA, 20 bp, synthetic construct
  misc_feature 1..20: note = CRISPR gRNA sequence
  source 1..20: mol_type = other DNA
tggctcctgggcaaacatga

SEQ ID NO: 77991 - DNA, 20 bp, synthetic construct
  misc_feature 1..20: note = CRISPR gRNA sequence
  source 1..20: mol_type = other DNA
gctcctgggcaaacatgaag

SEQ ID NO: 77992 - DNA, 20 bp, synthetic construct
  misc_feature 1..20: note = CRISPR gRNA sequence
  source 1..20: mol_type = other DNA
ctgggcaaacatgaagatca

SEQ ID NO: 77993 - DNA, 20 bp, synthetic construct
  misc_feature 1..20: note = CRISPR gRNA sequence
  source 1..20: mol_type = other DNA
ggcaaacatgaagatcacag

SEQ ID NO: 77994 - DNA, 20 bp, synthetic construct
  misc_feature 1..20: note = CRISPR gRNA sequence
  source 1..20: mol_type = other DNA
tgtgctgcaggctgtgaaga

SEQ ID NO: 77995 - DNA, 20 bp, synthetic construct
  misc_feature 1..20: note = CRISPR gRNA sequence
  source 1..20: mol_type = other DNA
gtgctgcaggctgtgaagac

SEQ ID NO: 77996 - DNA, 20 bp, synthetic construct
  misc_feature 1..20: note = CRISPR gRNA sequence
  source 1..20: mol_type = other DNA
tgctgcaggctgtgaagaca

SEQ ID NO: 77997 - DNA, 20 bp, synthetic construct
  misc_feature 1..20: note = CRISPR gRNA sequence
  source 1..20: mol_type = other DNA
caggctgtgaagacaaaaga

SEQ ID NO: 77998 - DNA, 20 bp, synthetic construct
  misc_feature 1..20: note = CRISPR gRNA sequence
  source 1..20: mol_type = other DNA
tgaagacaaaagaggggtga

SEQ ID NO: 77999 - DNA, 20 bp, synthetic construct
  misc_feature 1..20: note = CRISPR gRNA sequence
  source 1..20: mol_type = other DNA
ttggctccctgttactattt

SEQ ID NO: 78000 - DNA, 20 bp, synthetic construct
  misc_feature 1..20: note = CRISPR gRNA sequence
  source 1..20: mol_type = other DNA
gctccctgttactatttctt

SEQ ID NO: 78001 - DNA, 20 bp, synthetic construct
  misc_feature 1..20: note = CRISPR gRNA sequence
  source 1..20: mol_type = other DNA
cctgttactatttctttttg

SEQ ID NO: 78002 - DNA, 20 bp, synthetic construct
  misc_feature 1..20: note = CRISPR gRNA sequence
  source 1..20: mol_type = other DNA
ttactatttctttttgagag

SEQ ID NO: 78003 - DNA, 20 bp, synthetic construct
  misc_feature 1..20: note = CRISPR gRNA sequence
  source 1..20: mol_type = other DNA
ctatttctttttgagagaag

SEQ ID NO: 78004 - DNA, 20 bp, synthetic construct
  misc_feature 1..20: note = CRISPR gRNA sequence
  source 1..20: mol_type = other DNA
tttctttttgagagaaggtc

SEQ ID NO: 78005 - DNA, 20 bp, synthetic construct
  misc_feature 1..20: note = CRISPR gRNA sequence
  source 1..20: mol_type = other DNA
ctttttgagagaaggtctca

SEQ ID NO: 78006 - DNA, 20 bp, synthetic construct
  misc_feature 1..20: note = CRISPR gRNA sequence
  source 1..20: mol_type = other DNA
tttttgagagaaggtctcag

SEQ ID NO: 78007 - DNA, 20 bp, synthetic construct
  misc_feature 1..20: note = CRISPR gRNA sequence
  source 1..20: mol_type = other DNA
tttgagagaaggtctcagtc

SEQ ID NO: 78008 - DNA, 20 bp, synthetic construct
  misc_feature 1..20: note = CRISPR gRNA sequence
  source 1..20: mol_type = other DNA
ttgagagaaggtctcagtct

SEQ ID NO: 78009 - DNA, 20 bp, synthetic construct
  misc_feature 1..20: note = CRISPR gRNA sequence
  source 1..20: mol_type = other DNA
tgagagaaggtctcagtctg

SEQ ID NO: 78010 - DNA, 20 bp, synthetic construct
  misc_feature 1..20: note = CRISPR gRNA sequence
  source 1..20: mol_type = other DNA
gagagaaggtctcagtctgt

SEQ ID NO: 78011 - DNA, 20 bp, synthetic construct
  misc_feature 1..20: note = CRISPR gRNA sequence
  source 1..20: mol_type = other DNA
agagaaggtctcagtctgtt

SEQ ID NO: 78012 - DNA, 20 bp, synthetic construct
  misc_feature 1..20: note = CRISPR gRNA sequence
  source 1..20: mol_type = other DNA
agtctgttgcccaagctggt

SEQ ID NO: 78013 - DNA, 20 bp, synthetic construct
  misc_feature 1..20: note = CRISPR gRNA sequence
  source 1..20: mol_type = other DNA
ttgcccaagctggtgtgcag

SEQ ID NO: 78014 - DNA, 20 bp, synthetic construct
  misc_feature 1..20: note = CRISPR gRNA sequence
  source 1..20: mol_type = other DNA
cccaagctggtgtgcagtgg

SEQ ID NO: 78015 - DNA, 20 bp, synthetic construct
  misc_feature 1..20: note = CRISPR gRNA sequence
  source 1..20: mol_type = other DNA
gtgtgcagtggtgcaatcat

SEQ ID NO: 78016 - DNA, 20 bp, synthetic construct
  misc_feature 1..20: note = CRISPR gRNA sequence
  source 1..20: mol_type = other DNA
actgaagcctccacctcctg

SEQ ID NO: 78017 - DNA, 20 bp, synthetic construct
  misc_feature 1..20: note = CRISPR gRNA sequence
  source 1..20: mol_type = other DNA
aagcctccacctcctgggct

SEQ ID NO: 78018 - DNA, 20 bp, synthetic construct
  misc_feature 1..20: note = CRISPR gRNA sequence
  source 1..20: mol_type = other DNA
cacctcctgggctcaagcaa

SEQ ID NO: 78019 - DNA, 20 bp, synthetic construct
  misc_feature 1..20: note = CRISPR gRNA sequence
  source 1..20: mol_type = other DNA
ctgggctcaagcaatcctcc

SEQ ID NO: 78020 - DNA, 20 bp, synthetic construct
  misc_feature 1..20: note = CRISPR gRNA sequence
  source 1..20: mol_type = other DNA
ggctcaagcaatcctcccac

SEQ ID NO: 78021 - DNA, 20 bp, synthetic construct
  misc_feature 1..20: note = CRISPR gRNA sequence
  source 1..20: mol_type = other DNA
aagcaatcctcccacttcag

SEQ ID NO: 78022 - DNA, 20 bp, synthetic construct
  misc_feature 1..20: note = CRISPR gRNA sequence
  source 1..20: mol_type = other DNA
ccacttcagcctcctgagta

SEQ ID NO: 78023 - DNA, 20 bp, synthetic construct
  misc_feature 1..20: note = CRISPR gRNA sequence
  source 1..20: mol_type = other DNA
cagcctcctgagtagctggg

SEQ ID NO: 78024 - DNA, 20 bp, synthetic construct
  misc_feature 1..20: note = CRISPR gRNA sequence
  source 1..20: mol_type = other DNA
agcctcctgagtagctggga

SEQ ID NO: 78025 - DNA, 20 bp, synthetic construct
  misc_feature 1..20: note = CRISPR gRNA sequence
  source 1..20: mol_type = other DNA
ctgagtagctgggattacag

SEQ ID NO: 78026 - DNA, 20 bp, synthetic construct
  misc_feature 1..20: note = CRISPR gRNA sequence
  source 1..20: mol_type = other DNA
agtagctgggattacaggct

SEQ ID NO: 78027 - DNA, 20 bp, synthetic construct
  misc_feature 1..20: note = CRISPR gRNA sequence
  source 1..20: mol_type = other DNA
ggattacaggcttgtgccat

SEQ ID NO: 78028 - DNA, 20 bp, synthetic construct
  misc_feature 1..20: note = CRISPR gRNA sequence
  source 1..20: mol_type = other DNA
caggcttgtgccatcaggcc

SEQ ID NO: 78029 - DNA, 20 bp, synthetic construct
  misc_feature 1..20: note = CRISPR gRNA sequence
  source 1..20: mol_type = other DNA
gtgccatcaggcccagctaa

SEQ ID NO: 78030 - DNA, 20 bp, synthetic construct
  misc_feature 1..20: note = CRISPR gRNA sequence
  source 1..20: mol_type = other DNA
tgccatcaggcccagctaat

SEQ ID NO: 78031 - DNA, 20 bp, synthetic construct
  misc_feature 1..20: note = CRISPR gRNA sequence
  source 1..20: mol_type = other DNA
attaaaaaaaaaagtatgta

SEQ ID NO: 78032 - DNA, 20 bp, synthetic construct
  misc_feature 1..20: note = CRISPR gRNA sequence
  source 1..20: mol_type = other DNA
aaaaaaaaagtatgtagaga

SEQ ID NO: 78033 - DNA, 20 bp, synthetic construct
  misc_feature 1..20: note = CRISPR gRNA sequence
  source 1..20: mol_type = other DNA
tgttgtctactctggtctcg

SEQ ID NO: 78034 - DNA, 20 bp, synthetic construct
  misc_feature 1..20: note = CRISPR gRNA sequence
  source 1..20: mol_type = other DNA
tctactctggtctcgaactt

SEQ ID NO: 78035 - DNA, 20 bp, synthetic construct
  misc_feature 1..20: note = CRISPR gRNA sequence
  source 1..20: mol_type = other DNA
ctctggtctcgaacttctgg

SEQ ID NO: 78036 - DNA, 20 bp, synthetic construct
  misc_feature 1..20: note = CRISPR gRNA sequence
  source 1..20: mol_type = other DNA
tggtctcgaacttctgggct

SEQ ID NO: 78037 - DNA, 20 bp, synthetic construct
  misc_feature 1..20: note = CRISPR gRNA sequence
  source 1..20: mol_type = other DNA
gtctcgaacttctgggctca

SEQ ID NO: 78038 - DNA, 20 bp, synthetic construct
  misc_feature 1..20: note = CRISPR gRNA sequence
  source 1..20: mol_type = other DNA
gaacttctgggctcaggtga

SEQ ID NO: 78039 - DNA, 20 bp, synthetic construct
  misc_feature 1..20: note = CRISPR gRNA sequence
  source 1..20: mol_type = other DNA
ctgggctcaggtgatcctcc

SEQ ID NO: 78040 - DNA, 20 bp, synthetic construct
  misc_feature 1..20: note = CRISPR gRNA sequence
  source 1..20: mol_type = other DNA
tgggctcaggtgatcctccc

SEQ ID NO: 78041 - DNA, 20 bp, synthetic construct
  misc_feature 1..20: note = CRISPR gRNA sequence
  source 1..20: mol_type = other DNA
ggctcaggtgatcctcccac

SEQ ID NO: 78042 - DNA, 20 bp, synthetic construct
  misc_feature 1..20: note = CRISPR gRNA sequence
  source 1..20: mol_type = other DNA
aggtgatcctcccacctttg

SEQ ID NO: 78043 - DNA, 20 bp, synthetic construct
  misc_feature 1..20: note = CRISPR gRNA sequence
  source 1..20: mol_type = other DNA
ccacctttgcttcccaaagt

SEQ ID NO: 78044 - DNA, 20 bp, synthetic construct
  misc_feature 1..20: note = CRISPR gRNA sequence
  source 1..20: mol_type = other DNA
tgcttcccaaagtgctggga

SEQ ID NO: 78045 - DNA, 20 bp, synthetic construct
  misc_feature 1..20: note = CRISPR gRNA sequence
  source 1..20: mol_type = other DNA
gcttcccaaagtgctgggat

SEQ ID NO: 78046 - DNA, 20 bp, synthetic construct
  misc_feature 1..20: note = CRISPR gRNA sequence
  source 1..20: mol_type = other DNA
cttcccaaagtgctgggatg

SEQ ID NO: 78047 - DNA, 20 bp, synthetic construct
  misc_feature 1..20: note = CRISPR gRNA sequence
  source 1..20: mol_type = other DNA
cccaaagtgctgggatgata

SEQ ID NO: 78048 - DNA, 20 bp, synthetic construct
  misc_feature 1..20: note = CRISPR gRNA sequence
  source 1..20: mol_type = other DNA
ccaaagtgctgggatgatag

SEQ ID NO: 78049 - DNA, 20 bp, synthetic construct
  misc_feature 1..20: note = CRISPR gRNA sequence
  source 1..20: mol_type = other DNA
ggatgataggtgtgagccac

SEQ ID NO: 78050 - DNA, 20 bp, synthetic construct
  misc_feature 1..20: note = CRISPR gRNA sequence
  source 1..20: mol_type = other DNA
tcactttttacccctggccc

SEQ ID NO: 78051 - DNA, 20 bp, synthetic construct
  misc_feature 1..20: note = CRISPR gRNA sequence
  source 1..20: mol_type = other DNA
tttacccctggcccgggagg

SEQ ID NO: 78052 - DNA, 20 bp, synthetic construct
  misc_feature 1..20: note = CRISPR gRNA sequence
  source 1..20: mol_type = other DNA
ttacccctggcccgggagga

SEQ ID NO: 78053 - DNA, 20 bp, synthetic construct
  misc_feature 1..20: note = CRISPR gRNA sequence
  source 1..20: mol_type = other DNA
tacccctggcccgggaggac

SEQ ID NO: 78054 - DNA, 20 bp, synthetic construct
  misc_feature 1..20: note = CRISPR gRNA sequence
  source 1..20: mol_type = other DNA
acccctggcccgggaggacc

SEQ ID NO: 78055 - DNA, 20 bp, synthetic construct
  misc_feature 1..20: note = CRISPR gRNA sequence
  source 1..20: mol_type = other DNA
cccctggcccgggaggacct

SEQ ID NO: 78056 - DNA, 20 bp, synthetic construct
  misc_feature 1..20: note = CRISPR gRNA sequence
  source 1..20: mol_type = other DNA
gcccgggaggacctctcaag

SEQ ID NO: 78057 - DNA, 20 bp, synthetic construct
  misc_feature 1..20: note = CRISPR gRNA sequence
  source 1..20: mol_type = other DNA
tcaagttccatccccctgcc

SEQ ID NO: 78058 - DNA, 20 bp, synthetic construct
  misc_feature 1..20: note = CRISPR gRNA sequence
  source 1..20: mol_type = other DNA
aagttccatccccctgcctc

SEQ ID NO: 78059 - DNA, 20 bp, synthetic construct
  misc_feature 1..20: note = CRISPR gRNA sequence
  source 1..20: mol_type = other DNA
catccccctgcctccagctg

SEQ ID NO: 78060 - DNA, 20 bp, synthetic construct
  misc_feature 1..20: note = CRISPR gRNA sequence
  source 1..20: mol_type = other DNA
cctccagctgcagccacttc

SEQ ID NO: 78061 - DNA, 20 bp, synthetic construct
  misc_feature 1..20: note = CRISPR gRNA sequence
  source 1..20: mol_type = other DNA
cagctgcagccacttcctct

SEQ ID NO: 78062 - DNA, 20 bp, synthetic construct
  misc_feature 1..20: note = CRISPR gRNA sequence
  source 1..20: mol_type = other DNA
cagccacttcctctgactcc

SEQ ID NO: 78063 - DNA, 20 bp, synthetic construct
  misc_feature 1..20: note = CRISPR gRNA sequence
  source 1..20: mol_type = other DNA
cctctgactcccctctgact

SEQ ID NO: 78064 - DNA, 20 bp, synthetic construct
  misc_feature 1..20: note = CRISPR gRNA sequence
  source 1..20: mol_type = other DNA
ctctgactcccctctgactt

SEQ ID NO: 78065 - DNA, 20 bp, synthetic construct
  misc_feature 1..20: note = CRISPR gRNA sequence
  source 1..20: mol_type = other DNA
tgactcccctctgacttcct

SEQ ID NO: 78066 - DNA, 20 bp, synthetic construct
  misc_feature 1..20: note = CRISPR gRNA sequence
  source 1..20: mol_type = other DNA
actcccctctgacttcctct

SEQ ID NO: 78067 - DNA, 20 bp, synthetic construct
  misc_feature 1..20: note = CRISPR gRNA sequence
  source 1..20: mol_type = other DNA
ccctctgacttcctctgagc

SEQ ID NO: 78068 - DNA, 20 bp, synthetic construct
  misc_feature 1..20: note = CRISPR gRNA sequence
  source 1..20: mol_type = other DNA
tgacttcctctgagcttttg

SEQ ID NO: 78069 - DNA, 20 bp, synthetic construct
  misc_feature 1..20: note = CRISPR gRNA sequence
  source 1..20: mol_type = other DNA
acttcctctgagcttttgga

SEQ ID NO: 78070 - DNA, 20 bp, synthetic construct
  misc_feature 1..20: note = CRISPR gRNA sequence
  source 1..20: mol_type = other DNA
cctctgagcttttggagggc

SEQ ID NO: 78071 - DNA, 20 bp, synthetic construct
  misc_feature 1..20: note = CRISPR gRNA sequence
  source 1..20: mol_type = other DNA
ctctgagcttttggagggct

SEQ ID NO: 78072 - DNA, 20 bp, synthetic construct
  misc_feature 1..20: note = CRISPR gRNA sequence
  source 1..20: mol_type = other DNA
tgagcttttggagggctgaa

SEQ ID NO: 78073 - DNA, 20 bp, synthetic construct
  misc_feature 1..20: note = CRISPR gRNA sequence
  source 1..20: mol_type = other DNA
agcttttggagggctgaaat

SEQ ID NO: 78074 - DNA, 20 bp, synthetic construct
  misc_feature 1..20: note = CRISPR gRNA sequence
  source 1..20: mol_type = other DNA
ttggagggctgaaatctttc

SEQ ID NO: 78075 - DNA, 20 bp, synthetic construct
  misc_feature 1..20: note = CRISPR gRNA sequence
  source 1..20: mol_type = other DNA
tggagggctgaaatctttct

SEQ ID NO: 78076 - DNA, 20 bp, synthetic construct
  misc_feature 1..20: note = CRISPR gRNA sequence
  source 1..20: mol_type = other DNA
ggagggctgaaatctttcta

SEQ ID NO: 78077 - DNA, 20 bp, synthetic construct
  misc_feature 1..20: note = CRISPR gRNA sequence
  source 1..20: mol_type = other DNA
gagggctgaaatctttctac

SEQ ID NO: 78078 - DNA, 20 bp, synthetic construct
  misc_feature 1..20: note = CRISPR gRNA sequence
  source 1..20: mol_type = other DNA
aaatctttctaccacagata

SEQ ID NO: 78079 - DNA, 20 bp, synthetic construct
  misc_feature 1..20: note = CRISPR gRNA sequence
  source 1..20: mol_type = other DNA
tctaccacagatatttcaca

SEQ ID NO: 78080 - DNA, 20 bp, synthetic construct
  misc_feature 1..20: note = CRISPR gRNA sequence
  source 1..20: mol_type = other DNA
ctaccacagatatttcacaa

SEQ ID NO: 78081 - DNA, 20 bp, synthetic construct
  misc_feature 1..20: note = CRISPR gRNA sequence
  source 1..20: mol_type = other DNA
taccacagatatttcacaaa

SEQ ID NO: 78082 - DNA, 20 bp, synthetic construct
  misc_feature 1..20: note = CRISPR gRNA sequence
  source 1..20: mol_type = other DNA
ccacagatatttcacaaatg

SEQ ID NO: 78083 - DNA, 20 bp, synthetic construct
  misc_feature 1..20: note = CRISPR gRNA sequence
  source 1..20: mol_type = other DNA
cacaaatgtatctattgcct

SEQ ID NO: 78084 - DNA, 20 bp, synthetic construct
  misc_feature 1..20: note = CRISPR gRNA sequence
  source 1..20: mol_type = other DNA
acaaatgtatctattgccta

SEQ ID NO: 78085 - DNA, 20 bp, synthetic construct
  misc_feature 1..20: note = CRISPR gRNA sequence
  source 1..20: mol_type = other DNA
ttgcctaagtaagccccatt

SEQ ID NO: 78086 - DNA, 20 bp, synthetic construct
  misc_feature 1..20: note = CRISPR gRNA sequence
  source 1..20: mol_type = other DNA
cctaagtaagccccatttcc

SEQ ID NO: 78087 - DNA, 20 bp, synthetic construct
  misc_feature 1..20: note = CRISPR gRNA sequence
  source 1..20: mol_type = other DNA
agtaagccccatttcctggc

SEQ ID NO: 78088 - DNA, 20 bp, synthetic construct
  misc_feature 1..20: note = CRISPR gRNA sequence
  source 1..20: mol_type = other DNA
cctggcaagtcttaaaagaa

SEQ ID NO: 78089 - DNA, 20 bp, synthetic construct
  misc_feature 1..20: note = CRISPR gRNA sequence
  source 1..20: mol_type = other DNA
ctggcaagtcttaaaagaaa

SEQ ID NO: 78090 - DNA, 20 bp, synthetic construct
  misc_feature 1..20: note = CRISPR gRNA sequence
  source 1..20: mol_type = other DNA
gcaagtcttaaaagaaaaca

SEQ ID NO: 78091 - DNA, 20 bp, synthetic construct
  misc_feature 1..20: note = CRISPR gRNA sequence
  source 1..20: mol_type = other DNA
aaaagaaaacaaattctgtg

SEQ ID NO: 78092 - DNA, 20 bp, synthetic construct
  misc_feature 1..20: note = CRISPR gRNA sequence
  source 1..20: mol_type = other DNA
aaagaaaacaaattctgtgt

SEQ ID NO: 78093 - DNA, 20 bp, synthetic construct
  misc_feature 1..20: note = CRISPR gRNA sequence
  source 1..20: mol_type = other DNA
tgtgttctctcttttagccc

SEQ ID NO: 78094 - DNA, 20 bp, synthetic construct
  misc_feature 1..20: note = CRISPR gRNA sequence
  source 1..20: mol_type = other DNA
tgttctctcttttagcccca

SEQ ID NO: 78095 - DNA, 20 bp, synthetic construct
  misc_feature 1..20: note = CRISPR gRNA sequence
  source 1..20: mol_type = other DNA
tctcttttagccccagactg

SEQ ID NO: 78096 - DNA, 20 bp, synthetic construct
  misc_feature 1..20: note = CRISPR gRNA sequence
  source 1..20: mol_type = other DNA
tcttttagccccagactgaa

SEQ ID NO: 78097 - DNA, 20 bp, synthetic construct
  misc_feature 1..20: note = CRISPR gRNA sequence
  source 1..20: mol_type = other DNA
ttttagccccagactgaaac

SEQ ID NO: 78098 - DNA, 20 bp, synthetic construct
  misc_feature 1..20: note = CRISPR gRNA sequence
  source 1..20: mol_type = other DNA
ttagccccagactgaaaccc

SEQ ID NO: 78099 - DNA, 20 bp, synthetic construct
  misc_feature 1..20: note = CRISPR gRNA sequence
  source 1..20: mol_type = other DNA
tagccccagactgaaacccc

SEQ ID NO: 78100 - DNA, 20 bp, synthetic construct
  misc_feature 1..20: note = CRISPR gRNA sequence
  source 1..20: mol_type = other DNA
agccccagactgaaacccct

SEQ ID NO: 78101 - DNA, 20 bp, synthetic construct
  misc_feature 1..20: note = CRISPR gRNA sequence
  source 1..20: mol_type = other DNA
gccccagactgaaacccctc

SEQ ID NO: 78102 - DNA, 20 bp, synthetic construct
  misc_feature 1..20: note = CRISPR gRNA sequence
  source 1..20: mol_type = other DNA
aaacccctctctctgctagt

SEQ ID NO: 78103 - DNA, 20 bp, synthetic construct
  misc_feature 1..20: note = CRISPR gRNA sequence
  source 1..20: mol_type = other DNA
tctctgctagtcagtgttct

SEQ ID NO: 78104 - DNA, 20 bp, synthetic construct
  misc_feature 1..20: note = CRISPR gRNA sequence
  source 1..20: mol_type = other DNA
tctgctagtcagtgttctgt

SEQ ID NO: 78105 - DNA, 20 bp, synthetic construct
  misc_feature 1..20: note = CRISPR gRNA sequence
  source 1..20: mol_type = other DNA
tgctagtcagtgttctgtct

SEQ ID NO: 78106 - DNA, 20 bp, synthetic construct
  misc_feature 1..20: note = CRISPR gRNA sequence
  source 1..20: mol_type = other DNA
ctagtcagtgttctgtctgt

SEQ ID NO: 78107 - DNA, 20 bp, synthetic construct
  misc_feature 1..20: note = CRISPR gRNA sequence
  source 1..20: mol_type = other DNA
gtcagtgttctgtctgtgct

SEQ ID NO: 78108 - DNA, 20 bp, synthetic construct
  misc_feature 1..20: note = CRISPR gRNA sequence
  source 1..20: mol_type = other DNA
tgtctgtgctcaaagtatgt

SEQ ID NO: 78109 - DNA, 20 bp, synthetic construct
  misc_feature 1..20: note = CRISPR gRNA sequence
  source 1..20: mol_type = other DNA
tctgtgctcaaagtatgtgt

SEQ ID NO: 78110 - DNA, 20 bp, synthetic construct
  misc_feature 1..20: note = CRISPR gRNA sequence
  source 1..20: mol_type = other DNA
tgctcaaagtatgtgtggat

SEQ ID NO: 78111 - DNA, 20 bp, synthetic construct
  misc_feature 1..20: note = CRISPR gRNA sequence
  source 1..20: mol_type = other DNA
aaagtatgtgtggattaccc

SEQ ID NO: 78112 - DNA, 20 bp, synthetic construct
  misc_feature 1..20: note = CRISPR gRNA sequence
  source 1..20: mol_type = other DNA
cccctggtaacctttggagt

SEQ ID NO: 78113 - DNA, 20 bp, synthetic construct
  misc_feature 1..20: note = CRISPR gRNA sequence
  source 1..20: mol_type = other DNA
gtaacctttggagtgagtcc

SEQ ID NO: 78114 - DNA, 20 bp, synthetic construct
  misc_feature 1..20: note = CRISPR gRNA sequence
  source 1..20: mol_type = other DNA
tggagtgagtccttcaaacc

SEQ ID NO: 78115 - DNA, 20 bp, synthetic construct
  misc_feature 1..20: note = CRISPR gRNA sequence
  source 1..20: mol_type = other DNA
ggagtgagtccttcaaacct

SEQ ID NO: 78116 - DNA, 20 bp, synthetic construct
  misc_feature 1..20: note = CRISPR gRNA sequence
  source 1..20: mol_type = other DNA
gagtgagtccttcaaacctt

SEQ ID NO: 78117 - DNA, 20 bp, synthetic construct
  misc_feature 1..20: note = CRISPR gRNA sequence
  source 1..20: mol_type = other DNA
caaaccttccattttctagt

SEQ ID NO: 78118 - DNA, 20 bp, synthetic construct
  misc_feature 1..20: note = CRISPR gRNA sequence
  source 1..20: mol_type = other DNA
aaaccttccattttctagtg

SEQ ID NO: 78119 - DNA, 20 bp, synthetic construct
  misc_feature 1..20: note = CRISPR gRNA sequence
  source 1..20: mol_type = other DNA
ccattttctagtgcaataat

SEQ ID NO: 78120 - DNA, 20 bp, synthetic construct
  misc_feature 1..20: note = CRISPR gRNA sequence
  source 1..20: mol_type = other DNA
cattttctagtgcaataatt

SEQ ID NO: 78121 - DNA, 20 bp, synthetic construct
  misc_feature 1..20: note = CRISPR gRNA sequence
  source 1..20: mol_type = other DNA
tctagtgcaataatttttgt

SEQ ID NO: 78122 - DNA, 20 bp, synthetic construct
  misc_feature 1..20: note = CRISPR gRNA sequence
  source 1..20: mol_type = other DNA
ctagtgcaataatttttgtt

SEQ ID NO: 78123 - DNA, 20 bp, synthetic construct
  misc_feature 1..20: note = CRISPR gRNA sequence
  source 1..20: mol_type = other DNA
tagtgcaataatttttgttt

SEQ ID NO: 78124 - DNA, 20 bp, synthetic construct
  misc_feature 1..20: note = CRISPR gRNA sequence
  source 1..20: mol_type = other DNA
gtgcaataatttttgtttta

SEQ ID NO: 78125 - DNA, 20 bp, synthetic construct
  misc_feature 1..20: note = CRISPR gRNA sequence
  source 1..20: mol_type = other DNA
ttgttttacaaacatgggat

SEQ ID NO: 78126 - DNA, 20 bp, synthetic construct
  misc_feature 1..20: note = CRISPR gRNA sequence
  source 1..20: mol_type = other DNA
tgttttacaaacatgggatt

SEQ ID NO: 78127 - DNA, 20 bp, synthetic construct
  misc_feature 1..20: note = CRISPR gRNA sequence
  source 1..20: mol_type = other DNA
gttttacaaacatgggatta

SEQ ID NO: 78128 - DNA, 20 bp, synthetic construct
  misc_feature 1..20: note = CRISPR gRNA sequence
  source 1..20: mol_type = other DNA
ttttacaaacatgggattaa

SEQ ID NO: 78129 - DNA, 20 bp, synthetic construct
  misc_feature 1..20: note = CRISPR gRNA sequence
  source 1..20: mol_type = other DNA
tacaaacatgggattaaact

SEQ ID NO: 78130 - DNA, 20 bp, synthetic construct
  misc_feature 1..20: note = CRISPR gRNA sequence
  source 1..20: mol_type = other DNA
acaaacatgggattaaacta

SEQ ID NO: 78131 - DNA, 20 bp, synthetic construct
  misc_feature 1..20: note = CRISPR gRNA sequence
  source 1..20: mol_type = other DNA
caaacatgggattaaactat

SEQ ID NO: 78132 - DNA, 20 bp, synthetic construct
  misc_feature 1..20: note = CRISPR gRNA sequence
  source 1..20: mol_type = other DNA
aactatagattctcttttta

SEQ ID NO: 78133 - DNA, 20 bp, synthetic construct
  misc_feature 1..20: note = CRISPR gRNA sequence
  source 1..20: mol_type = other DNA
tagattctctttttaaacat

SEQ ID NO: 78134 - DNA, 20 bp, synthetic construct
  misc_feature 1..20: note = CRISPR gRNA sequence
  source 1..20: mol_type = other DNA
tctttttaaacattagtttt

SEQ ID NO: 78135 - DNA, 20 bp, synthetic construct
  misc_feature 1..20: note = CRISPR gRNA sequence
  source 1..20: mol_type = other DNA
tttttaaacattagtttttt

SEQ ID NO: 78136 - DNA, 20 bp, synthetic construct
  misc_feature 1..20: note = CRISPR gRNA sequence
  source 1..20: mol_type = other DNA
tttaaacattagttttttaa

SEQ ID NO: 78137 - DNA, 20 bp, synthetic construct
  misc_feature 1..20: note = CRISPR gRNA sequence
  source 1..20: mol_type = other DNA
ttaaacattagttttttaag

SEQ ID NO: 78138 - DNA, 20 bp, synthetic construct
  misc_feature 1..20: note = CRISPR gRNA sequence
  source 1..20: mol_type = other DNA
taaacattagttttttaagg

SEQ ID NO: 78139 - DNA, 20 bp, synthetic construct
  misc_feature 1..20: note = CRISPR gRNA sequence
  source 1..20: mol_type = other DNA
aaacattagttttttaaggg

SEQ ID NO: 78140 - DNA, 20 bp, synthetic construct
  misc_feature 1..20: note = CRISPR gRNA sequence
  source 1..20: mol_type = other DNA
aacattagttttttaagggc

SEQ ID NO: 78141 - DNA, 20 bp, synthetic construct
  misc_feature 1..20: note = CRISPR gRNA sequence
  source 1..20: mol_type = other DNA
gttttttaagggctagaagc

SEQ ID NO: 78142 - DNA, 20 bp, synthetic construct
  misc_feature 1..20: note = CRISPR gRNA sequence
  source 1..20: mol_type = other DNA
tttaagggctagaagcaggg

SEQ ID NO: 78143 - DNA, 20 bp, synthetic construct
  misc_feature 1..20: note = CRISPR gRNA sequence
  source 1..20: mol_type = other DNA
ttaagggctagaagcaggga

SEQ ID NO: 78144 - DNA, 20 bp, synthetic construct
  misc_feature 1..20: note = CRISPR gRNA sequence
  source 1..20: mol_type = other DNA
taagggctagaagcagggat

SEQ ID NO: 78145 - DNA, 20 bp, synthetic construct
  misc_feature 1..20: note = CRISPR gRNA sequence
  source 1..20: mol_type = other DNA
aagggctagaagcagggatg

SEQ ID NO: 78146 - DNA, 20 bp, synthetic construct
  misc_feature 1..20: note = CRISPR gRNA sequence
  source 1..20: mol_type = other DNA
agggctagaagcagggatga

SEQ ID NO: 78147 - DNA, 20 bp, synthetic construct
  misc_feature 1..20: note = CRISPR gRNA sequence
  source 1..20: mol_type = other DNA
gaagcagggatgacaaataa

SEQ ID NO: 78148 - DNA, 20 bp, synthetic construct
  misc_feature 1..20: note = CRISPR gRNA sequence
  source 1..20: mol_type = other DNA
ttaatacttgatcattattg

SEQ ID NO: 78149 - DNA, 20 bp, synthetic construct
  misc_feature 1..20: note = CRISPR gRNA sequence
  source 1..20: mol_type = other DNA
atacttgatcattattgatg

SEQ ID NO: 78150 - DNA, 20 bp, synthetic construct
  misc_feature 1..20: note = CRISPR gRNA sequence
  source 1..20: mol_type = other DNA
gatcattattgatgggaaca

SEQ ID NO: 78151 - DNA, 20 bp, synthetic construct
  misc_feature 1..20: note = CRISPR gRNA sequence
  source 1..20: mol_type = other DNA
atcattattgatgggaacag

SEQ ID NO: 78152 - DNA, 20 bp, synthetic construct
  misc_feature 1..20: note = CRISPR gRNA sequence
  source 1..20: mol_type = other DNA
ttgatgggaacagattatat

SEQ ID NO: 78153 - DNA, 20 bp, synthetic construct
  misc_feature 1..20: note = CRISPR gRNA sequence
  source 1..20: mol_type = other DNA
atgggaacagattatatata

SEQ ID NO: 78154 - DNA, 20 bp, synthetic construct
  misc_feature 1..20: note = CRISPR gRNA sequence
  source 1..20: mol_type = other DNA
tatataccatgctctctctt

SEQ ID NO: 78155 - DNA, 20 bp, synthetic construct
  misc_feature 1..20: note = CRISPR gRNA sequence
  source 1..20: mol_type = other DNA
tctctttttttttttttttt

SEQ ID NO: 78156 - DNA, 20 bp, synthetic construct
  misc_feature 1..20: note = CRISPR gRNA sequence
  source 1..20: mol_type = other DNA
tctttttttttttttttttt

SEQ ID NO: 78157 - DNA, 20 bp, synthetic construct
  misc_feature 1..20: note = CRISPR gRNA sequence
  source 1..20: mol_type = other DNA
ttttttttttttttttttta

SEQ ID NO: 78158 - DNA, 20 bp, synthetic construct
  misc_feature 1..20: note = CRISPR gRNA sequence
  source 1..20: mol_type = other DNA
tttttttttttttttttaat

SEQ ID NO: 78159 - DNA, 20 bp, synthetic construct
  misc_feature 1..20: note = CRISPR gRNA sequence
  source 1..20: mol_type = other DNA
ttttttttttttttttaatt

SEQ ID NO: 78160 - DNA, 20 bp, synthetic construct
  misc_feature 1..20: note = CRISPR gRNA sequence
  source 1..20: mol_type = other DNA
tttttttttttttttaattt

SEQ ID NO: 78161 - DNA, 20 bp, synthetic construct
  misc_feature 1..20: note = CRISPR gRNA sequence
  source 1..20: mol_type = other DNA
ttttttttttttttaatttg

SEQ ID NO: 78162 - DNA, 20 bp, synthetic construct
  misc_feature 1..20: note = CRISPR gRNA sequence
  source 1..20: mol_type = other DNA
tttttttttttttaatttga

SEQ ID NO: 78163 - DNA, 20 bp, synthetic construct
  misc_feature 1..20: note = CRISPR gRNA sequence
  source 1..20: mol_type = other DNA
ttttttttttttaatttgag

SEQ ID NO: 78164 - DNA, 20 bp, synthetic construct
  misc_feature 1..20: note = CRISPR gRNA sequence
  source 1..20: mol_type = other DNA
tttttttttttaatttgaga

SEQ ID NO: 78165 - DNA, 20 bp, synthetic construct
  misc_feature 1..20: note = CRISPR gRNA sequence
  source 1..20: mol_type = other DNA
ttttttttttaatttgagac

SEQ ID NO: 78166 - DNA, 20 bp, synthetic construct
  misc_feature 1..20: note = CRISPR gRNA sequence
  source 1..20: mol_type = other DNA
tttttttttaatttgagaca

SEQ ID NO: 78167 - DNA, 20 bp, synthetic construct
  misc_feature 1..20: note = CRISPR gRNA sequence
  source 1..20: mol_type = other DNA
ttttttttaatttgagacag

SEQ ID NO: 78168 - DNA, 20 bp, synthetic construct
  misc_feature 1..20: note = CRISPR gRNA sequence
  source 1..20: mol_type = other DNA
tttttttaatttgagacaga

SEQ ID NO: 78169 - DNA, 20 bp, synthetic construct
  misc_feature 1..20: note = CRISPR gRNA sequence
  source 1..20: mol_type = other DNA
ttttttaatttgagacagag

SEQ ID NO: 78170 - DNA, 20 bp, synthetic construct
  misc_feature 1..20: note = CRISPR gRNA sequence
  source 1..20: mol_type = other DNA
tttttaatttgagacagagt

SEQ ID NO: 78171 - DNA, 20 bp, synthetic construct
  misc_feature 1..20: note = CRISPR gRNA sequence
  source 1..20: mol_type = other DNA
ttttaatttgagacagagtc

SEQ ID NO: 78172 - DNA, 20 bp, synthetic construct
  misc_feature 1..20: note = CRISPR gRNA sequence
  source 1..20: mol_type = other DNA
tttaatttgagacagagtct

SEQ ID NO: 78173 - DNA, 20 bp, synthetic construct
  misc_feature 1..20: note = CRISPR gRNA sequence
  source 1..20: mol_type = other DNA
ttaatttgagacagagtctt

SEQ ID NO: 78174 - DNA, 20 bp, synthetic construct
  misc_feature 1..20: note = CRISPR gRNA sequence
  source 1..20: mol_type = other DNA
taatttgagacagagtcttg

SEQ ID NO: 78175 - DNA, 20 bp, synthetic construct
  misc_feature 1..20: note = CRISPR gRNA sequence
  source 1..20: mol_type = other DNA
aatttgagacagagtcttgc

SEQ ID NO: 78176 - DNA, 20 bp, synthetic construct
  misc_feature 1..20: note = CRISPR gRNA sequence
  source 1..20: mol_type = other DNA
atttgagacagagtcttgct

SEQ ID NO: 78177 - DNA, 20 bp, synthetic construct
  misc_feature 1..20: note = CRISPR gRNA sequence
  source 1..20: mol_type = other DNA
gagacagagtcttgctctgt

SEQ ID NO: 78178 - DNA, 20 bp, synthetic construct
  misc_feature 1..20: note = CRISPR gRNA sequence
  source 1..20: mol_type = other DNA
agacagagtcttgctctgtc

SEQ ID NO: 78179 - DNA, 20 bp, synthetic construct
  misc_feature 1..20: note = CRISPR gRNA sequence
  source 1..20: mol_type = other DNA
gctctgtctcccaggctgga

SEQ ID NO: 78180 - DNA, 20 bp, synthetic construct
  misc_feature 1..20: note = CRISPR gRNA sequence
  source 1..20: mol_type = other DNA
ctctgtctcccaggctggag

SEQ ID NO: 78181 - DNA, 20 bp, synthetic construct
  misc_feature 1..20: note = CRISPR gRNA sequence
  source 1..20: mol_type = other DNA
tgtctcccaggctggagtgc

SEQ ID NO: 78182 - DNA, 20 bp, synthetic construct
  misc_feature 1..20: note = CRISPR gRNA sequence
  source 1..20: mol_type = other DNA
tctcccaggctggagtgcag

SEQ ID NO: 78183 - DNA, 20 bp, synthetic construct
  misc_feature 1..20: note = CRISPR gRNA sequence
  source 1..20: mol_type = other DNA
ccaggctggagtgcagtggc

SEQ ID NO: 78184 - DNA, 20 bp, synthetic construct
  misc_feature 1..20: note = CRISPR gRNA sequence
  source 1..20: mol_type = other DNA
gagtgcagtggcatgatctc

SEQ ID NO: 78185 - DNA, 20 bp, synthetic construct
  misc_feature 1..20: note = CRISPR gRNA sequence
  source 1..20: mol_type = other DNA
ggctcactgcaacctccgcc

SEQ ID NO: 78186 - DNA, 20 bp, synthetic construct
  misc_feature 1..20: note = CRISPR gRNA sequence
  source 1..20: mol_type = other DNA
actgcaacctccgcctccca

SEQ ID NO: 78187 - DNA, 20 bp, synthetic construct
  misc_feature 1..20: note = CRISPR gRNA sequence
  source 1..20: mol_type = other DNA
caacctccgcctcccaggtt

SEQ ID NO: 78188 - DNA, 20 bp, synthetic construct
  misc_feature 1..20: note = CRISPR gRNA sequence
  source 1..20: mol_type = other DNA
cgcctcccaggttccagcga

SEQ ID NO: 78189 - DNA, 20 bp, synthetic construct
  misc_feature 1..20: note = CRISPR gRNA sequence
  source 1..20: mol_type = other DNA
ccaggttccagcgattctcc

SEQ ID NO: 78190 - DNA, 20 bp, synthetic construct
  misc_feature 1..20: note = CRISPR gRNA sequence
  source 1..20: mol_type = other DNA
cagcgattctcctgcctcag

SEQ ID NO: 78191 - DNA, 20 bp, synthetic construct
  misc_feature 1..20: note = CRISPR gRNA sequence
  source 1..20: mol_type = other DNA
tcctgcctcagcctcctgag

SEQ ID NO: 78192 - DNA, 20 bp, synthetic construct
  misc_feature 1..20: note = CRISPR gRNA sequence
  source 1..20: mol_type = other DNA
ctgcctcagcctcctgagta

SEQ ID NO: 78193 - DNA, 20 bp, synthetic construct
  misc_feature 1..20: note = CRISPR gRNA sequence
  source 1..20: mol_type = other DNA
cctcagcctcctgagtagct

SEQ ID NO: 78194 - DNA, 20 bp, synthetic construct
  misc_feature 1..20: note = CRISPR gRNA sequence
  source 1..20: mol_type = other DNA
agcctcctgagtagctggaa

SEQ ID NO: 78195 - DNA, 20 bp, synthetic construct
  misc_feature 1..20: note = CRISPR gRNA sequence
  source 1..20: mol_type = other DNA
ctgagtagctggaattacag

SEQ ID NO: 78196 - DNA, 20 bp, synthetic construct
  misc_feature 1..20: note = CRISPR gRNA sequence
  source 1..20: mol_type = other DNA
agtagctggaattacaggtg

SEQ ID NO: 78197 - DNA, 20 bp, synthetic construct
  misc_feature 1..20: note = CRISPR gRNA sequence
  source 1..20: mol_type = other DNA
gaattacaggtgcacgccac

SEQ ID NO: 78198 - DNA, 20 bp, synthetic construct
  misc_feature 1..20: note = CRISPR gRNA sequence
  source 1..20: mol_type = other DNA
caggtgcacgccaccatgcc

SEQ ID NO: 78199 - DNA, 20 bp, synthetic construct
  misc_feature 1..20: note = CRISPR gRNA sequence
  source 1..20: mol_type = other DNA
gtttttgtatttttagtaga

SEQ ID NO: 78200 - DNA, 20 bp, synthetic construct
  misc_feature 1..20: note = CRISPR gRNA sequence
  source 1..20: mol_type = other DNA
ttgtatttttagtagagacg

SEQ ID NO: 78201 - DNA, 20 bp, synthetic construct
  misc_feature 1..20: note = CRISPR gRNA sequence
  source 1..20: mol_type = other DNA
tgtatttttagtagagacgg

SEQ ID NO: 78202 - DNA, 20 bp, synthetic construct
  misc_feature 1..20: note = CRISPR gRNA sequence
  source 1..20: mol_type = other DNA
gtatttttagtagagacggg

SEQ ID NO: 78203 - DNA, 20 bp, synthetic construct
  misc_feature 1..20: note = CRISPR gRNA sequence
  source 1..20: mol_type = other DNA
tatttttagtagagacgggg

SEQ ID NO: 78204 - DNA, 20 bp, synthetic construct
  misc_feature 1..20: note = CRISPR gRNA sequence
  source 1..20: mol_type = other DNA
ttagtagagacggggtttca

SEQ ID NO: 78205 - DNA, 20 bp, synthetic construct
  misc_feature 1..20: note = CRISPR gRNA sequence
  source 1..20: mol_type = other DNA
tagtagagacggggtttcat

SEQ ID NO: 78206 - DNA, 20 bp, synthetic construct
  misc_feature 1..20: note = CRISPR gRNA sequence
  source 1..20: mol_type = other DNA
agtagagacggggtttcatc

SEQ ID NO: 78207 - DNA, 20 bp, synthetic construct
  misc_feature 1..20: note = CRISPR gRNA sequence
  source 1..20: mol_type = other DNA
gtagagacggggtttcatcc

SEQ ID NO: 78208 - DNA, 20 bp, synthetic construct
  misc_feature 1..20: note = CRISPR gRNA sequence
  source 1..20: mol_type = other DNA
catcctattggccaggctgg

SEQ ID NO: 78209 - DNA, 20 bp, synthetic construct
  misc_feature 1..20: note = CRISPR gRNA sequence
  source 1..20: mol_type = other DNA
atcctattggccaggctggt

SEQ ID NO: 78210 - DNA, 20 bp, synthetic construct
  misc_feature 1..20: note = CRISPR gRNA sequence
  source 1..20: mol_type = other DNA
ttggccaggctggtcttgaa

SEQ ID NO: 78211 - DNA, 20 bp, synthetic construct
  misc_feature 1..20: note = CRISPR gRNA sequence
  source 1..20: mol_type = other DNA
gccaggctggtcttgaactc

SEQ ID NO: 78212 - DNA, 20 bp, synthetic construct
  misc_feature 1..20: note = CRISPR gRNA sequence
  source 1..20: mol_type = other DNA
gtcttgaactcctgacctca

SEQ ID NO: 78213 - DNA, 20 bp, synthetic construct
  misc_feature 1..20: note = CRISPR gRNA sequence
  source 1..20: mol_type = other DNA
gaactcctgacctcaggtga

SEQ ID NO: 78214 - DNA, 20 bp, synthetic construct
  misc_feature 1..20: note = CRISPR gRNA sequence
  source 1..20: mol_type = other DNA
aactcctgacctcaggtgat

SEQ ID NO: 78215 - DNA, 20 bp, synthetic construct
  misc_feature 1..20: note = CRISPR gRNA sequence
  source 1..20: mol_type = other DNA
ctgacctcaggtgatccccc

SEQ ID NO: 78216 - DNA, 20 bp, synthetic construct
  misc_feature 1..20: note = CRISPR gRNA sequence
  source 1..20: mol_type = other DNA
acctcaggtgatccccctgc

SEQ ID NO: 78217 - DNA, 20 bp, synthetic construct
  misc_feature 1..20: note = CRISPR gRNA sequence
  source 1..20: mol_type = other DNA
aggtgatccccctgcctcag

SEQ ID NO: 78218 - DNA, 20 bp, synthetic construct
  misc_feature 1..20: note = CRISPR gRNA sequence
  source 1..20: mol_type = other DNA
cctcagcctcccaaagtgct

SEQ ID NO: 78219 - DNA, 20 bp, synthetic construct
  misc_feature 1..20: note = CRISPR gRNA sequence
  source 1..20: mol_type = other DNA
agcctcccaaagtgctgggt

SEQ ID NO: 78220 - DNA, 20 bp, synthetic construct
  misc_feature 1..20: note = CRISPR gRNA sequence
  source 1..20: mol_type = other DNA
ccaaagtgctgggtttacag

SEQ ID NO: 78221 - DNA, 20 bp, synthetic construct
  misc_feature 1..20: note = CRISPR gRNA sequence
  source 1..20: mol_type = other DNA
ggtttacagcatgagccaca

SEQ ID NO: 78222 - DNA, 20 bp, synthetic construct
  misc_feature 1..20: note = CRISPR gRNA sequence
  source 1..20: mol_type = other DNA
acagcatgagccacagcacc

SEQ ID NO: 78223 - DNA, 20 bp, synthetic construct
  misc_feature 1..20: note = CRISPR gRNA sequence
  source 1..20: mol_type = other DNA
cagcatgagccacagcacct

SEQ ID NO: 78224 - DNA, 20 bp, synthetic construct
  misc_feature 1..20: note = CRISPR gRNA sequence
  source 1..20: mol_type = other DNA
gcccagattataccattctt

SEQ ID NO: 78225 - DNA, 20 bp, synthetic construct
  misc_feature 1..20: note = CRISPR gRNA sequence
  source 1..20: mol_type = other DNA
taccattctttctgccattg

SEQ ID NO: 78226 - DNA, 20 bp, synthetic construct
  misc_feature 1..20: note = CRISPR gRNA sequence
  source 1..20: mol_type = other DNA
tttctgccattgcatatctt

SEQ ID NO: 78227 - DNA, 20 bp, synthetic construct
  misc_feature 1..20: note = CRISPR gRNA sequence
  source 1..20: mol_type = other DNA
tctgccattgcatatcttga

SEQ ID NO: 78228 - DNA, 20 bp, synthetic construct
  misc_feature 1..20: note = CRISPR gRNA sequence
  source 1..20: mol_type = other DNA
ctgccattgcatatcttgaa

SEQ ID NO: 78229 - DNA, 20 bp, synthetic construct
  misc_feature 1..20: note = CRISPR gRNA sequence
  source 1..20: mol_type = other DNA
tgccattgcatatcttgaaa

SEQ ID NO: 78230 - DNA, 20 bp, synthetic construct
  misc_feature 1..20: note = CRISPR gRNA sequence
  source 1..20: mol_type = other DNA
ccattgcatatcttgaaaag

SEQ ID NO: 78231 - DNA, 20 bp, synthetic construct
  misc_feature 1..20: note = CRISPR gRNA sequence
  source 1..20: mol_type = other DNA
catatcttgaaaagctttat

SEQ ID NO: 78232 - DNA, 20 bp, synthetic construct
  misc_feature 1..20: note = CRISPR gRNA sequence
  source 1..20: mol_type = other DNA
gaaaagctttattataatct

SEQ ID NO: 78233 - DNA, 20 bp, synthetic construct
  misc_feature 1..20: note = CRISPR gRNA sequence
  source 1..20: mol_type = other DNA
aaaagctttattataatctt

SEQ ID NO: 78234 - DNA, 20 bp, synthetic construct
  misc_feature 1..20: note = CRISPR gRNA sequence
  source 1..20: mol_type = other DNA
tattataatcttttataatc

SEQ ID NO: 78235 - DNA, 20 bp, synthetic construct
  misc_feature 1..20: note = CRISPR gRNA sequence
  source 1..20: mol_type = other DNA
attataatcttttataatct

SEQ ID NO: 78236 - DNA, 20 bp, synthetic construct
  misc_feature 1..20: note = CRISPR gRNA sequence
  source 1..20: mol_type = other DNA
ttataatcttttataatctt

SEQ ID NO: 78237 - DNA, 20 bp, synthetic construct
  misc_feature 1..20: note = CRISPR gRNA sequence
  source 1..20: mol_type = other DNA
taatcttttataatctttta

SEQ ID NO: 78238 - DNA, 20 bp, synthetic construct
  misc_feature 1..20: note = CRISPR gRNA sequence
  source 1..20: mol_type = other DNA
ttataatcttttaagataat

SEQ ID NO: 78239 - DNA, 20 bp, synthetic construct
  misc_feature 1..20: note = CRISPR gRNA sequence
  source 1..20: mol_type = other DNA
tataatcttttaagataatg

SEQ ID NO: 78240 - DNA, 20 bp, synthetic construct
  misc_feature 1..20: note = CRISPR gRNA sequence
  source 1..20: mol_type = other DNA
ataatcttttaagataatga

SEQ ID NO: 78241 - DNA, 20 bp, synthetic construct
  misc_feature 1..20: note = CRISPR gRNA sequence
  source 1..20: mol_type = other DNA
taatcttttaagataatgag

SEQ ID NO: 78242 - DNA, 20 bp, synthetic construct
  misc_feature 1..20: note = CRISPR gRNA sequence
  source 1..20: mol_type = other DNA
ttaagataatgagttaaaat

SEQ ID NO: 78243 - DNA, 20 bp, synthetic construct
  misc_feature 1..20: note = CRISPR gRNA sequence
  source 1..20: mol_type = other DNA
taagataatgagttaaaatt

SEQ ID NO: 78244 - DNA, 20 bp, synthetic construct
  misc_feature 1..20: note = CRISPR gRNA sequence
  source 1..20: mol_type = other DNA
aagataatgagttaaaattt

SEQ ID NO: 78245 - DNA, 20 bp, synthetic construct
  misc_feature 1..20: note = CRISPR gRNA sequence
  source 1..20: mol_type = other DNA
agataatgagttaaaatttt

SEQ ID NO: 78246 - DNA, 20 bp, synthetic construct
  misc_feature 1..20: note = CRISPR gRNA sequence
  source 1..20: mol_type = other DNA
aaatttttatgtttggcctg

SEQ ID NO: 78247 - DNA, 20 bp, synthetic construct
  misc_feature 1..20: note = CRISPR gRNA sequence
  source 1..20: mol_type = other DNA
ttatgtttggcctggtgcag

SEQ ID NO: 78248 - DNA, 20 bp, synthetic construct
  misc_feature 1..20: note = CRISPR gRNA sequence
  source 1..20: mol_type = other DNA
tatgtttggcctggtgcagt

SEQ ID NO: 78249 - DNA, 20 bp, synthetic construct
  misc_feature 1..20: note = CRISPR gRNA sequence
  source 1..20: mol_type = other DNA
atgtttggcctggtgcagtg

SEQ ID NO: 78250 - DNA, 20 bp, synthetic construct
  misc_feature 1..20: note = CRISPR gRNA sequence
  source 1..20: mol_type = other DNA
tgtttggcctggtgcagtgg

SEQ ID NO: 78251 - DNA, 20 bp, synthetic construct
  misc_feature 1..20: note = CRISPR gRNA sequence
  source 1..20: mol_type = other DNA
ggcctggtgcagtggttcat

SEQ ID NO: 78252 - DNA, 20 bp, synthetic construct
  misc_feature 1..20: note = CRISPR gRNA sequence
  source 1..20: mol_type = other DNA
gcctggtgcagtggttcata

SEQ ID NO: 78253 - DNA, 20 bp, synthetic construct
  misc_feature 1..20: note = CRISPR gRNA sequence
  source 1..20: mol_type = other DNA
gtgcagtggttcatacctat

SEQ ID NO: 78254 - DNA, 20 bp, synthetic construct
  misc_feature 1..20: note = CRISPR gRNA sequence
  source 1..20: mol_type = other DNA
atacctataatccttgctct

SEQ ID NO: 78255 - DNA, 20 bp, synthetic construct
  misc_feature 1..20: note = CRISPR gRNA sequence
  source 1..20: mol_type = other DNA
taatccttgctctttgggag

SEQ ID NO: 78256 - DNA, 20 bp, synthetic construct
  misc_feature 1..20: note = CRISPR gRNA sequence
  source 1..20: mol_type = other DNA
gctctttgggaggccagggc

SEQ ID NO: 78257 - DNA, 20 bp, synthetic construct
  misc_feature 1..20: note = CRISPR gRNA sequence
  source 1..20: mol_type = other DNA
ctctttgggaggccagggca

SEQ ID NO: 78258 - DNA, 20 bp, synthetic construct
  misc_feature 1..20: note = CRISPR gRNA sequence
  source 1..20: mol_type = other DNA
tttgggaggccagggcagga

SEQ ID NO: 78259 - DNA, 20 bp, synthetic construct
  misc_feature 1..20: note = CRISPR gRNA sequence
  source 1..20: mol_type = other DNA
tgggaggccagggcaggagg

SEQ ID NO: 78260 - DNA, 20 bp, synthetic construct
  misc_feature 1..20: note = CRISPR gRNA sequence
  source 1..20: mol_type = other DNA
gggaggccagggcaggagga

SEQ ID NO: 78261 - DNA, 20 bp, synthetic construct
  misc_feature 1..20: note = CRISPR gRNA sequence
  source 1..20: mol_type = other DNA
ggaggccagggcaggaggat

SEQ ID NO: 78262 - DNA, 20 bp, synthetic construct
  misc_feature 1..20: note = CRISPR gRNA sequence
  source 1..20: mol_type = other DNA
gggagtttgagaacagcctg

SEQ ID NO: 78263 - DNA, 20 bp, synthetic construct
  misc_feature 1..20: note = CRISPR gRNA sequence
  source 1..20: mol_type = other DNA
gagaacagcctggtcaatat

SEQ ID NO: 78264 - DNA, 20 bp, synthetic construct
  misc_feature 1..20: note = CRISPR gRNA sequence
  source 1..20: mol_type = other DNA
agaacagcctggtcaatata

SEQ ID NO: 78265 - DNA, 20 bp, synthetic construct
  misc_feature 1..20: note = CRISPR gRNA sequence
  source 1..20: mol_type = other DNA
gtcaatatagcaagaccctc

SEQ ID NO: 78266 - DNA, 20 bp, synthetic construct
  misc_feature 1..20: note = CRISPR gRNA sequence
  source 1..20: mol_type = other DNA
tctctactaaaaataaaaaa

SEQ ID NO: 78267 - DNA, 20 bp, synthetic construct
  misc_feature 1..20: note = CRISPR gRNA sequence
  source 1..20: mol_type = other DNA
tctactaaaaataaaaaaaa

SEQ ID NO: 78268 - DNA, 20 bp, synthetic construct
  misc_feature 1..20: note = CRISPR gRNA sequence
  source 1..20: mol_type = other DNA
tactaaaaataaaaaaaatt

SEQ ID NO: 78269 - DNA, 20 bp, synthetic construct
  misc_feature 1..20: note = CRISPR gRNA sequence
  source 1..20: mol_type = other DNA
ctaaaaataaaaaaaattgc

SEQ ID NO: 78270 - DNA, 20 bp, synthetic construct
  misc_feature 1..20: note = CRISPR gRNA sequence
  source 1..20: mol_type = other DNA
aaaataaaaaaaattgccag

SEQ ID NO: 78271 - DNA, 20 bp, synthetic construct
  misc_feature 1..20: note = CRISPR gRNA sequence
  source 1..20: mol_type = other DNA
ccaggcatagtgactcatga

SEQ ID NO: 78272 - DNA, 20 bp, synthetic construct
  misc_feature 1..20: note = CRISPR gRNA sequence
  source 1..20: mol_type = other DNA
atgactgtaatcccagcact

SEQ ID NO: 78273 - DNA, 20 bp, synthetic construct
  misc_feature 1..20: note = CRISPR gRNA sequence
  source 1..20: mol_type = other DNA
taatcccagcactttgggag

SEQ ID NO: 78274 - DNA, 20 bp, synthetic construct
  misc_feature 1..20: note = CRISPR gRNA sequence
  source 1..20: mol_type = other DNA
tgggagactaagagagatgg

SEQ ID NO: 78275 - DNA, 20 bp, synthetic construct
  misc_feature 1..20: note = CRISPR gRNA sequence
  source 1..20: mol_type = other DNA
gggagactaagagagatgga

SEQ ID NO: 78276 - DNA, 20 bp, synthetic construct
  misc_feature 1..20: note = CRISPR gRNA sequence
  source 1..20: mol_type = other DNA
ggagactaagagagatggat

SEQ ID NO: 78277 - DNA, 20 bp, synthetic construct
  misc_feature 1..20: note = CRISPR gRNA sequence
  source 1..20: mol_type = other DNA
agagagatggattgctgagc

SEQ ID NO: 78278 - DNA, 20 bp, synthetic construct
  misc_feature 1..20: note = CRISPR gRNA sequence
  source 1..20: mol_type = other DNA
ctgagcccaggatttggagg

SEQ ID NO: 78279 - DNA, 20 bp, synthetic construct
  misc_feature 1..20: note = CRISPR gRNA sequence
  source 1..20: mol_type = other DNA
agcccaggatttggaggtta

SEQ ID NO: 78280 - DNA, 20 bp, synthetic construct
  misc_feature 1..20: note = CRISPR gRNA sequence
  source 1..20: mol_type = other DNA
ggaggttacagtgagctgtg

SEQ ID NO: 78281 - DNA, 20 bp, synthetic construct
  misc_feature 1..20: note = CRISPR gRNA sequence
  source 1..20: mol_type = other DNA
gaggttacagtgagctgtga

SEQ ID NO: 78282 - DNA, 20 bp, synthetic construct
  misc_feature 1..20: note = CRISPR gRNA sequence
  source 1..20: mol_type = other DNA
cagtgagctgtgattgtgtc

SEQ ID NO: 78283 - DNA, 20 bp, synthetic construct
  misc_feature 1..20: note = CRISPR gRNA sequence
  source 1..20: mol_type = other DNA
tgattgtgtcactgtactcc

SEQ ID NO: 78284 - DNA, 20 bp, synthetic construct
  misc_feature 1..20: note = CRISPR gRNA sequence
  source 1..20: mol_type = other DNA
tgtcactgtactccagcctt

SEQ ID NO: 78285 - DNA, 20 bp, synthetic construct
  misc_feature 1..20: note = CRISPR gRNA sequence
  source 1..20: mol_type = other DNA
tactccagccttggtaacag

SEQ ID NO: 78286 - DNA, 20 bp, synthetic construct
  misc_feature 1..20: note = CRISPR gRNA sequence
  source 1..20: mol_type = other DNA
cagccttggtaacagagcaa

SEQ ID NO: 78287 - DNA, 20 bp, synthetic construct
  misc_feature 1..20: note = CRISPR gRNA sequence
  source 1..20: mol_type = other DNA
ggtaacagagcaagatcctg

SEQ ID NO: 78288 - DNA, 20 bp, synthetic construct
  misc_feature 1..20: note = CRISPR gRNA sequence
  source 1..20: mol_type = other DNA
gtaacagagcaagatcctgt

SEQ ID NO: 78289 - DNA, 20 bp, synthetic construct
  misc_feature 1..20: note = CRISPR gRNA sequence
  source 1..20: mol_type = other DNA
tctctaaagaaatttcttta

SEQ ID NO: 78290 - DNA, 20 bp, synthetic construct
  misc_feature 1..20: note = CRISPR gRNA sequence
  source 1..20: mol_type = other DNA
taaagaaatttctttatgtt

SEQ ID NO: 78291 - DNA, 20 bp, synthetic construct
  misc_feature 1..20: note = CRISPR gRNA sequence
  source 1..20: mol_type = other DNA
aagaaatttctttatgttta

SEQ ID NO: 78292 - DNA, 20 bp, synthetic construct
  misc_feature 1..20: note = CRISPR gRNA sequence
  source 1..20: mol_type = other DNA
ctttatgtttacttaataac

SEQ ID NO: 78293 - DNA, 20 bp, synthetic construct
  misc_feature 1..20: note = CRISPR gRNA sequence
  source 1..20: mol_type = other DNA
tttatgtttacttaataact

SEQ ID NO: 78294 - DNA, 20 bp, synthetic construct
  misc_feature 1..20: note = CRISPR gRNA sequence
  source 1..20: mol_type = other DNA
tatgtttacttaataactcc

SEQ ID NO: 78295 - DNA, 20 bp, synthetic construct
  misc_feature 1..20: note = CRISPR gRNA sequence
  source 1..20: mol_type = other DNA
atgtttacttaataactccc

SEQ ID NO: 78296 - DNA, 20 bp, synthetic construct
  misc_feature 1..20: note = CRISPR gRNA sequence
  source 1..20: mol_type = other DNA
tgtttacttaataactcccc

SEQ ID NO: 78297 - DNA, 20 bp, synthetic construct
  misc_feature 1..20: note = CRISPR gRNA sequence
  source 1..20: mol_type = other DNA
acttaataactccccgtcac

SEQ ID NO: 78298 - DNA, 20 bp, synthetic construct
  misc_feature 1..20: note = CRISPR gRNA sequence
  source 1..20: mol_type = other DNA
cttaataactccccgtcacc

SEQ ID NO: 78299 - DNA, 20 bp, synthetic construct
  misc_feature 1..20: note = CRISPR gRNA sequence
  source 1..20: mol_type = other DNA
aataactccccgtcacccct

SEQ ID NO: 78300 - DNA, 20 bp, synthetic construct
  misc_feature 1..20: note = CRISPR gRNA sequence
  source 1..20: mol_type = other DNA
ataactccccgtcacccctc

SEQ ID NO: 78301 - DNA, 20 bp, synthetic construct
  misc_feature 1..20: note = CRISPR gRNA sequence
  source 1..20: mol_type = other DNA
cccgtcacccctccatattg

SEQ ID NO: 78302 - DNA, 20 bp, synthetic construct
  misc_feature 1..20: note = CRISPR gRNA sequence
  source 1..20: mol_type = other DNA
catattgaaactgcacctat

SEQ ID NO: 78303 - DNA, 20 bp, synthetic construct
  misc_feature 1..20: note = CRISPR gRNA sequence
  source 1..20: mol_type = other DNA
aaactgcacctatattatca

SEQ ID NO: 78304 - DNA, 20 bp, synthetic construct
  misc_feature 1..20: note = CRISPR gRNA sequence
  source 1..20: mol_type = other DNA
cacctatattatcatttttt

SEQ ID NO: 78305 - DNA, 20 bp, synthetic construct
  misc_feature 1..20: note = CRISPR gRNA sequence
  source 1..20: mol_type = other DNA
tattatcatttttttttcta

SEQ ID NO: 78306 - DNA, 20 bp, synthetic construct
  misc_feature 1..20: note = CRISPR gRNA sequence
  source 1..20: mol_type = other DNA
tcatttttttttctatggtt

SEQ ID NO: 78307 - DNA, 20 bp, synthetic construct
  misc_feature 1..20: note = CRISPR gRNA sequence
  source 1..20: mol_type = other DNA
ttttttctatggttccactg

SEQ ID NO: 78308 - DNA, 20 bp, synthetic construct
  misc_feature 1..20: note = CRISPR gRNA sequence
  source 1..20: mol_type = other DNA
tttttctatggttccactga

SEQ ID NO: 78309 - DNA, 20 bp, synthetic construct
  misc_feature 1..20: note = CRISPR gRNA sequence
  source 1..20: mol_type = other DNA
ttttctatggttccactgag

SEQ ID NO: 78310 - DNA, 20 bp, synthetic construct
  misc_feature 1..20: note = CRISPR gRNA sequence
  source 1..20: mol_type = other DNA
tttctatggttccactgagt

SEQ ID NO: 78311 - DNA, 20 bp, synthetic construct
  misc_feature 1..20: note = CRISPR gRNA sequence
  source 1..20: mol_type = other DNA
ttctatggttccactgagtt

SEQ ID NO: 78312 - DNA, 20 bp, synthetic construct
  misc_feature 1..20: note = CRISPR gRNA sequence
  source 1..20: mol_type = other DNA
tctatggttccactgagttc

SEQ ID NO: 78313 - DNA, 20 bp, synthetic construct
  misc_feature 1..20: note = CRISPR gRNA sequence
  source 1..20: mol_type = other DNA
ctatggttccactgagttct

SEQ ID NO: 78314 - DNA, 20 bp, synthetic construct
  misc_feature 1..20: note = CRISPR gRNA sequence
  source 1..20: mol_type = other DNA
tatggttccactgagttctc

SEQ ID NO: 78315 - DNA, 20 bp, synthetic construct
  misc_feature 1..20: note = CRISPR gRNA sequence
  source 1..20: mol_type = other DNA
tggttccactgagttctctc

SEQ ID NO: 78316 - DNA, 20 bp, synthetic construct
  misc_feature 1..20: note = CRISPR gRNA sequence
  source 1..20: mol_type = other DNA
cactgagttctctctggaag

SEQ ID NO: 78317 - DNA, 20 bp, synthetic construct
  misc_feature 1..20: note = CRISPR gRNA sequence
  source 1..20: mol_type = other DNA
agttctctctggaagtaact

SEQ ID NO: 78318 - DNA, 20 bp, synthetic construct
  misc_feature 1..20: note = CRISPR gRNA sequence
  source 1..20: mol_type = other DNA
tctctggaagtaacttagtc

SEQ ID NO: 78319 - DNA, 20 bp, synthetic construct
  misc_feature 1..20: note = CRISPR gRNA sequence
  source 1..20: mol_type = other DNA
tctggaagtaacttagtcta

SEQ ID NO: 78320 - DNA, 20 bp, synthetic construct
  misc_feature 1..20: note = CRISPR gRNA sequence
  source 1..20: mol_type = other DNA
tggaagtaacttagtctaac

SEQ ID NO: 78321 - DNA, 20 bp, synthetic construct
  misc_feature 1..20: note = CRISPR gRNA sequence
  source 1..20: mol_type = other DNA
gaagtaacttagtctaacta

SEQ ID NO: 78322 - DNA, 20 bp, synthetic construct
  misc_feature 1..20: note = CRISPR gRNA sequence
  source 1..20: mol_type = other DNA
agtctaactaatatccctcg

SEQ ID NO: 78323 - DNA, 20 bp, synthetic construct
  misc_feature 1..20: note = CRISPR gRNA sequence
  source 1..20: mol_type = other DNA
gtctaactaatatccctcgg

SEQ ID NO: 78324 - DNA, 20 bp, synthetic construct
  misc_feature 1..20: note = CRISPR gRNA sequence
  source 1..20: mol_type = other DNA
actaatatccctcggttaaa

SEQ ID NO: 78325 - DNA, 20 bp, synthetic construct
  misc_feature 1..20: note = CRISPR gRNA sequence
  source 1..20: mol_type = other DNA
atatccctcggttaaacatt

SEQ ID NO: 78326 - DNA, 20 bp, synthetic construct
  misc_feature 1..20: note = CRISPR gRNA sequence
  source 1..20: mol_type = other DNA
ggttaaacattccagctatt

SEQ ID NO: 78327 - DNA, 20 bp, synthetic construct
  misc_feature 1..20: note = CRISPR gRNA sequence
  source 1..20: mol_type = other DNA
aacattccagctattttctt

SEQ ID NO: 78328 - DNA, 20 bp, synthetic construct
  misc_feature 1..20: note = CRISPR gRNA sequence
  source 1..20: mol_type = other DNA
cagctattttcttttttttt

SEQ ID NO: 78329 - DNA, 20 bp, synthetic construct
  misc_feature 1..20: note = CRISPR gRNA sequence
  source 1..20: mol_type = other DNA
ttttctttttttttcctatt

SEQ ID NO: 78330 - DNA, 20 bp, synthetic construct
  misc_feature 1..20: note = CRISPR gRNA sequence
  source 1..20: mol_type = other DNA
tctttttttttcctattata

SEQ ID NO: 78331 - DNA, 20 bp, synthetic construct
  misc_feature 1..20: note = CRISPR gRNA sequence
  source 1..20: mol_type = other DNA
ctttttttttcctattataa

SEQ ID NO: 78332 - DNA, 20 bp, synthetic construct
  misc_feature 1..20: note = CRISPR gRNA sequence
  source 1..20: mol_type = other DNA
tttttttttcctattataac

SEQ ID NO: 78333 - DNA, 20 bp, synthetic construct
  misc_feature 1..20: note = CRISPR gRNA sequence
  source 1..20: mol_type = other DNA
tttttttcctattataacca

SEQ ID NO: 78334 - DNA, 20 bp, synthetic construct
  misc_feature 1..20: note = CRISPR gRNA sequence
  source 1..20: mol_type = other DNA
ttttttcctattataaccaa

SEQ ID NO: 78335 - DNA, 20 bp, synthetic construct
  misc_feature 1..20: note = CRISPR gRNA sequence
  source 1..20: mol_type = other DNA
tttttcctattataaccaat

SEQ ID NO: 78336 - DNA, 20 bp, synthetic construct
  misc_feature 1..20: note = CRISPR gRNA sequence
  source 1..20: mol_type = other DNA
ttttcctattataaccaata

SEQ ID NO: 78337 - DNA, 20 bp, synthetic construct
  misc_feature 1..20: note = CRISPR gRNA sequence
  source 1..20: mol_type = other DNA
tttcctattataaccaatac

SEQ ID NO: 78338 - DNA, 20 bp, synthetic construct
  misc_feature 1..20: note = CRISPR gRNA sequence
  source 1..20: mol_type = other DNA
ttcctattataaccaatact

SEQ ID NO: 78339 - DNA, 20 bp, synthetic construct
  misc_feature 1..20: note = CRISPR gRNA sequence
  source 1..20: mol_type = other DNA
tcctattataaccaatactg

SEQ ID NO: 78340 - DNA, 20 bp, synthetic construct
  misc_feature 1..20: note = CRISPR gRNA sequence
  source 1..20: mol_type = other DNA
cctattataaccaatactga

SEQ ID NO: 78341 - DNA, 20 bp, synthetic construct
  misc_feature 1..20: note = CRISPR gRNA sequence
  source 1..20: mol_type = other DNA
ctattataaccaatactgag

SEQ ID NO: 78342 - DNA, 20 bp, synthetic construct
  misc_feature 1..20: note = CRISPR gRNA sequence
  source 1..20: mol_type = other DNA
ttataaccaatactgaggtg

SEQ ID NO: 78343 - DNA, 20 bp, synthetic construct
  misc_feature 1..20: note = CRISPR gRNA sequence
  source 1..20: mol_type = other DNA
taaccaatactgaggtgaac

SEQ ID NO: 78344 - DNA, 20 bp, synthetic construct
  misc_feature 1..20: note = CRISPR gRNA sequence
  source 1..20: mol_type = other DNA
aggtgaacatccctacagct

SEQ ID NO: 78345 - DNA, 20 bp, synthetic construct
  misc_feature 1..20: note = CRISPR gRNA sequence
  source 1..20: mol_type = other DNA
cagctaaatgtgtttgcaca

SEQ ID NO: 78346 - DNA, 20 bp, synthetic construct
  misc_feature 1..20: note = CRISPR gRNA sequence
  source 1..20: mol_type = other DNA
aatgtgtttgcacaatcgtg

SEQ ID NO: 78347 - DNA, 20 bp, synthetic construct
  misc_feature 1..20: note = CRISPR gRNA sequence
  source 1..20: mol_type = other DNA
gcacaatcgtgataatttat

SEQ ID NO: 78348 - DNA, 20 bp, synthetic construct
  misc_feature 1..20: note = CRISPR gRNA sequence
  source 1..20: mol_type = other DNA
cacaatcgtgataatttatt

SEQ ID NO: 78349 - DNA, 20 bp, synthetic construct
  misc_feature 1..20: note = CRISPR gRNA sequence
  source 1..20: mol_type = other DNA
atttagtataagttcctgga

SEQ ID NO: 78350 - DNA, 20 bp, synthetic construct
  misc_feature 1..20: note = CRISPR gRNA sequence
  source 1..20: mol_type = other DNA
tttagtataagttcctggaa

SEQ ID NO: 78351 - DNA, 20 bp, synthetic construct
  misc_feature 1..20: note = CRISPR gRNA sequence
  source 1..20: mol_type = other DNA
agtataagttcctggaagtg

SEQ ID NO: 78352 - DNA, 20 bp, synthetic construct
  misc_feature 1..20: note = CRISPR gRNA sequence
  source 1..20: mol_type = other DNA
gtataagttcctggaagtga

SEQ ID NO: 78353 - DNA, 20 bp, synthetic construct
  misc_feature 1..20: note = CRISPR gRNA sequence
  source 1..20: mol_type = other DNA
ctggaagtgaacagggcatc

SEQ ID NO: 78354 - DNA, 20 bp, synthetic construct
  misc_feature 1..20: note = CRISPR gRNA sequence
  source 1..20: mol_type = other DNA
gaagtgaacagggcatcgct

SEQ ID NO: 78355 - DNA, 20 bp, synthetic construct
  misc_feature 1..20: note = CRISPR gRNA sequence
  source 1..20: mol_type = other DNA
ggaatgcactagggaccctt

SEQ ID NO: 78356 - DNA, 20 bp, synthetic construct
  misc_feature 1..20: note = CRISPR gRNA sequence
  source 1..20: mol_type = other DNA
gaatgcactagggacccttt

SEQ ID NO: 78357 - DNA, 20 bp, synthetic construct
  misc_feature 1..20: note = CRISPR gRNA sequence
  source 1..20: mol_type = other DNA
gggaccctttattgaatcat

SEQ ID NO: 78358 - DNA, 20 bp, synthetic construct
  misc_feature 1..20: note = CRISPR gRNA sequence
  source 1..20: mol_type = other DNA
tattgaatcatcatatacag

SEQ ID NO: 78359 - DNA, 20 bp, synthetic construct
  misc_feature 1..20: note = CRISPR gRNA sequence
  source 1..20: mol_type = other DNA
attgaatcatcatatacagt

SEQ ID NO: 78360 - DNA, 20 bp, synthetic construct
  misc_feature 1..20: note = CRISPR gRNA sequence
  source 1..20: mol_type = other DNA
ttgaatcatcatatacagtg

SEQ ID NO: 78361 - DNA, 20 bp, synthetic construct
  misc_feature 1..20: note = CRISPR gRNA sequence
  source 1..20: mol_type = other DNA
aatcatcatatacagtgaac

SEQ ID NO: 78362 - DNA, 20 bp, synthetic construct
  misc_feature 1..20: note = CRISPR gRNA sequence
  source 1..20: mol_type = other DNA
atctaccttttgggtgaatc

SEQ ID NO: 78363 - DNA, 20 bp, synthetic construct
  misc_feature 1..20: note = CRISPR gRNA sequence
  source 1..20: mol_type = other DNA
ccttttgggtgaatcggttt

SEQ ID NO: 78364 - DNA, 20 bp, synthetic construct
  misc_feature 1..20: note = CRISPR gRNA sequence
  source 1..20: mol_type = other DNA
ttgggtgaatcggtttccct

SEQ ID NO: 78365 - DNA, 20 bp, synthetic construct
  misc_feature 1..20: note = CRISPR gRNA sequence
  source 1..20: mol_type = other DNA
tgggtgaatcggtttccctc

SEQ ID NO: 78366 - DNA, 20 bp, synthetic construct
  misc_feature 1..20: note = CRISPR gRNA sequence
  source 1..20: mol_type = other DNA
gggtgaatcggtttccctct

SEQ ID NO: 78367 - DNA, 20 bp, synthetic construct
  misc_feature 1..20: note = CRISPR gRNA sequence
  source 1..20: mol_type = other DNA
ggtgaatcggtttccctctc

SEQ ID NO: 78368 - DNA, 20 bp, synthetic construct
  misc_feature 1..20: note = CRISPR gRNA sequence
  source 1..20: mol_type = other DNA
ccctctcctcccttgagggg

SEQ ID NO: 78369 - DNA, 20 bp, synthetic construct
  misc_feature 1..20: note = CRISPR gRNA sequence
  source 1..20: mol_type = other DNA
cctctcctcccttgaggggt

SEQ ID NO: 78370 - DNA, 20 bp, synthetic construct
  misc_feature 1..20: note = CRISPR gRNA sequence
  source 1..20: mol_type = other DNA
tcctcccttgaggggtgttt

SEQ ID NO: 78371 - DNA, 20 bp, synthetic construct
  misc_feature 1..20: note = CRISPR gRNA sequence
  source 1..20: mol_type = other DNA
ctcccttgaggggtgtttaa

SEQ ID NO: 78372 - DNA, 20 bp, synthetic construct
  misc_feature 1..20: note = CRISPR gRNA sequence
  source 1..20: mol_type = other DNA
ccttgaggggtgtttaaagc

SEQ ID NO: 78373 - DNA, 20 bp, synthetic construct
  misc_feature 1..20: note = CRISPR gRNA sequence
  source 1..20: mol_type = other DNA
gaggggtgtttaaagcaggg

SEQ ID NO: 78374 - DNA, 20 bp, synthetic construct
  misc_feature 1..20: note = CRISPR gRNA sequence
  source 1..20: mol_type = other DNA
aggggtgtttaaagcaggga

SEQ ID NO: 78375 - DNA, 20 bp, synthetic construct
  misc_feature 1..20: note = CRISPR gRNA sequence
  source 1..20: mol_type = other DNA
aaagcagggaccaccctact

SEQ ID NO: 78376 - DNA, 20 bp, synthetic construct
  misc_feature 1..20: note = CRISPR gRNA sequence
  source 1..20: mol_type = other DNA
aagcagggaccaccctactg

SEQ ID NO: 78377 - DNA, 20 bp, synthetic construct
  misc_feature 1..20: note = CRISPR gRNA sequence
  source 1..20: mol_type = other DNA
ctgggttgagaatgaggctt

SEQ ID NO: 78378 - DNA, 20 bp, synthetic construct
  misc_feature 1..20: note = CRISPR gRNA sequence
  source 1..20: mol_type = other DNA
ggttgagaatgaggctttcc

SEQ ID NO: 78379 - DNA, 20 bp, synthetic construct
  misc_feature 1..20: note = CRISPR gRNA sequence
  source 1..20: mol_type = other DNA
agaatgaggctttcctccga

SEQ ID NO: 78380 - DNA, 20 bp, synthetic construct
  misc_feature 1..20: note = CRISPR gRNA sequence
  source 1..20: mol_type = other DNA
tcctccgagtgggaactgag

SEQ ID NO: 78381 - DNA, 20 bp, synthetic construct
  misc_feature 1..20: note = CRISPR gRNA sequence
  source 1..20: mol_type = other DNA
cctccgagtgggaactgagt

SEQ ID NO: 78382 - DNA, 20 bp, synthetic construct
  misc_feature 1..20: note = CRISPR gRNA sequence
  source 1..20: mol_type = other DNA
ctccgagtgggaactgagtt

SEQ ID NO: 78383 - DNA, 20 bp, synthetic construct
  misc_feature 1..20: note = CRISPR gRNA sequence
  source 1..20: mol_type = other DNA
cgagtgggaactgagttgac

SEQ ID NO: 78384 - DNA, 20 bp, synthetic construct
  misc_feature 1..20: note = CRISPR gRNA sequence
  source 1..20: mol_type = other DNA
agttgacattaatcatcatc

SEQ ID NO: 78385 - DNA, 20 bp, synthetic construct
  misc_feature 1..20: note = CRISPR gRNA sequence
  source 1..20: mol_type = other DNA
acattaatcatcatctgtcc

SEQ ID NO: 78386 - DNA, 20 bp, synthetic construct
  misc_feature 1..20: note = CRISPR gRNA sequence
  source 1..20: mol_type = other DNA
atcatcatctgtcctcacct

SEQ ID NO: 78387 - DNA, 20 bp, synthetic construct
  misc_feature 1..20: note = CRISPR gRNA sequence
  source 1..20: mol_type = other DNA
tcctcacctccccatactca

SEQ ID NO: 78388 - DNA, 20 bp, synthetic construct
  misc_feature 1..20: note = CRISPR gRNA sequence
  source 1..20: mol_type = other DNA
acctccccatactcaacggc

SEQ ID NO: 78389 - DNA, 20 bp, synthetic construct
  misc_feature 1..20: note = CRISPR gRNA sequence
  source 1..20: mol_type = other DNA
cccatactcaacggcgagac

SEQ ID NO: 78390 - DNA, 20 bp, synthetic construct
  misc_feature 1..20: note = CRISPR gRNA sequence
  source 1..20: mol_type = other DNA
aacggcgagacttacagaaa

SEQ ID NO: 78391 - DNA, 20 bp, synthetic construct
  misc_feature 1..20: note = CRISPR gRNA sequence
  source 1..20: mol_type = other DNA
acagaaataggattgggttc

SEQ ID NO: 78392 - DNA, 20 bp, synthetic construct
  misc_feature 1..20: note = CRISPR gRNA sequence
  source 1..20: mol_type = other DNA
cagaaataggattgggttcc

SEQ ID NO: 78393 - DNA, 20 bp, synthetic construct
  misc_feature 1..20: note = CRISPR gRNA sequence
  source 1..20: mol_type = other DNA
ggttccctagtggcagagcc

SEQ ID NO: 78394 - DNA, 20 bp, synthetic construct
  misc_feature 1..20: note = CRISPR gRNA sequence
  source 1..20: mol_type = other DNA
cctagtggcagagcctgggt

SEQ ID NO: 78395 - DNA, 20 bp, synthetic construct
  misc_feature 1..20: note = CRISPR gRNA sequence
  source 1..20: mol_type = other DNA
gtggcagagcctgggtctgt

SEQ ID NO: 78396 - DNA, 20 bp, synthetic construct
  misc_feature 1..20: note = CRISPR gRNA sequence
  source 1..20: mol_type = other DNA
ggtctgtgagtggggtaggg

SEQ ID NO: 78397 - DNA, 20 bp, synthetic construct
  misc_feature 1..20: note = CRISPR gRNA sequence
  source 1..20: mol_type = other DNA
tgagtggggtagggggtcgc

SEQ ID NO: 78398 - DNA, 20 bp, synthetic construct
  misc_feature 1..20: note = CRISPR gRNA sequence
  source 1..20: mol_type = other DNA
gtcagttgcgcacatcatga

SEQ ID NO: 78399 - DNA, 20 bp, synthetic construct
  misc_feature 1..20: note = CRISPR gRNA sequence
  source 1..20: mol_type = other DNA
tcagttgcgcacatcatgaa

SEQ ID NO: 78400 - DNA, 20 bp, synthetic construct
  misc_feature 1..20: note = CRISPR gRNA sequence
  source 1..20: mol_type = other DNA
cgcacatcatgaactgacgg

SEQ ID NO: 78401 - DNA, 20 bp, synthetic construct
  misc_feature 1..20: note = CRISPR gRNA sequence
  source 1..20: mol_type = other DNA
acggtctgctctcaggagaa

SEQ ID NO: 78402 - DNA, 20 bp, synthetic construct
  misc_feature 1..20: note = CRISPR gRNA sequence
  source 1..20: mol_type = other DNA
ctctcaggagaaacagtaag

SEQ ID NO: 78403 - DNA, 20 bp, synthetic construct
  misc_feature 1..20: note = CRISPR gRNA sequence
  source 1..20: mol_type = other DNA
tcaggagaaacagtaaggga

SEQ ID NO: 78404 - DNA, 20 bp, synthetic construct
  misc_feature 1..20: note = CRISPR gRNA sequence
  source 1..20: mol_type = other DNA
aggagaaacagtaagggact

SEQ ID NO: 78405 - DNA, 20 bp, synthetic construct
  misc_feature 1..20: note = CRISPR gRNA sequence
  source 1..20: mol_type = other DNA
agggaagccaaacggagcaa

SEQ ID NO: 78406 - DNA, 20 bp, synthetic construct
  misc_feature 1..20: note = CRISPR gRNA sequence
  source 1..20: mol_type = other DNA
ggcctagtctcccagggagc

SEQ ID NO: 78407 - DNA, 20 bp, synthetic construct
  misc_feature 1..20: note = CRISPR gRNA sequence
  source 1..20: mol_type = other DNA
gcctagtctcccagggagct

SEQ ID NO: 78408 - DNA, 20 bp, synthetic construct
  misc_feature 1..20: note = CRISPR gRNA sequence
  source 1..20: mol_type = other DNA
gtctcccagggagctttgtc

SEQ ID NO: 78409 - DNA, 20 bp, synthetic construct
  misc_feature 1..20: note = CRISPR gRNA sequence
  source 1..20: mol_type = other DNA
ccagggagctttgtcccact

SEQ ID NO: 78410 - DNA, 20 bp, synthetic construct
  misc_feature 1..20: note = CRISPR gRNA sequence
  source 1..20: mol_type = other DNA
tgtcccactggagagtttgg

SEQ ID NO: 78411 - DNA, 20 bp, synthetic construct
  misc_feature 1..20: note = CRISPR gRNA sequence
  source 1..20: mol_type = other DNA
gtcccactggagagtttggg

SEQ ID NO: 78412 - DNA, 20 bp, synthetic construct
  misc_feature 1..20: note = CRISPR gRNA sequence
  source 1..20: mol_type = other DNA
tcccactggagagtttgggc

SEQ ID NO: 78413 - DNA, 20 bp, synthetic construct
  misc_feature 1..20: note = CRISPR gRNA sequence
  source 1..20: mol_type = other DNA
gagagtttgggctggagagt

SEQ ID NO: 78414 - DNA, 20 bp, synthetic construct
  misc_feature 1..20: note = CRISPR gRNA sequence
  source 1..20: mol_type = other DNA
gggctggagagttgtgccct

SEQ ID NO: 78415 - DNA, 20 bp, synthetic construct
  misc_feature 1..20: note = CRISPR gRNA sequence
  source 1..20: mol_type = other DNA
ggctggagagttgtgccctc

SEQ ID NO: 78416 - DNA, 20 bp, synthetic construct
  misc_feature 1..20: note = CRISPR gRNA sequence
  source 1..20: mol_type = other DNA
gagagttgtgccctctgcct

SEQ ID NO: 78417 - DNA, 20 bp, synthetic construct
  misc_feature 1..20: note = CRISPR gRNA sequence
  source 1..20: mol_type = other DNA
tgccctctgcctctgtcatt

SEQ ID NO: 78418 - DNA, 20 bp, synthetic construct
  misc_feature 1..20: note = CRISPR gRNA sequence
  source 1..20: mol_type = other DNA
tgcctctgtcattggccact

SEQ ID NO: 78419 - DNA, 20 bp, synthetic construct
  misc_feature 1..20: note = CRISPR gRNA sequence
  source 1..20: mol_type = other DNA
cctctgtcattggccactct

SEQ ID NO: 78420 - DNA, 20 bp, synthetic construct
  misc_feature 1..20: note = CRISPR gRNA sequence
  source 1..20: mol_type = other DNA
tgtcattggccactctaggt

SEQ ID NO: 78421 - DNA, 20 bp, synthetic construct
  misc_feature 1..20: note = CRISPR gRNA sequence
  source 1..20: mol_type = other DNA
tcattggccactctaggtta

SEQ ID NO: 78422 - DNA, 20 bp, synthetic construct
  misc_feature 1..20: note = CRISPR gRNA sequence
  source 1..20: mol_type = other DNA
gccactctaggttaggggaa

SEQ ID NO: 78423 - DNA, 20 bp, synthetic construct
  misc_feature 1..20: note = CRISPR gRNA sequence
  source 1..20: mol_type = other DNA
taggttaggggaaagtgggg

SEQ ID NO: 78424 - DNA, 20 bp, synthetic construct
  misc_feature 1..20: note = CRISPR gRNA sequence
  source 1..20: mol_type = other DNA
ggttaggggaaagtgggggt

SEQ ID NO: 78425 - DNA, 20 bp, synthetic construct
  misc_feature 1..20: note = CRISPR gRNA sequence
  source 1..20: mol_type = other DNA
ggggaaagtgggggttgtac

SEQ ID NO: 78426 - DNA, 20 bp, synthetic construct
  misc_feature 1..20: note = CRISPR gRNA sequence
  source 1..20: mol_type = other DNA
taccctgccaggcgtctctg

SEQ ID NO: 78427 - DNA, 20 bp, synthetic construct
  misc_feature 1..20: note = CRISPR gRNA sequence
  source 1..20: mol_type = other DNA
ccaggcgtctctggttctta

SEQ ID NO: 78428 - DNA, 20 bp, synthetic construct
  misc_feature 1..20: note = CRISPR gRNA sequence
  source 1..20: mol_type = other DNA
tggttcttatcagccaaggg

SEQ ID NO: 78429 - DNA, 20 bp, synthetic construct
  misc_feature 1..20: note = CRISPR gRNA sequence
  source 1..20: mol_type = other DNA
gttcttatcagccaagggta

SEQ ID NO: 78430 - DNA, 20 bp, synthetic construct
  misc_feature 1..20: note = CRISPR gRNA sequence
  source 1..20: mol_type = other DNA
ttatcagccaagggtagttc

SEQ ID NO: 78431 - DNA, 20 bp, synthetic construct
  misc_feature 1..20: note = CRISPR gRNA sequence
  source 1..20: mol_type = other DNA
atcagccaagggtagttctc

SEQ ID NO: 78432 - DNA, 20 bp, synthetic construct
  misc_feature 1..20: note = CRISPR gRNA sequence
  source 1..20: mol_type = other DNA
tcagccaagggtagttctcc

SEQ ID NO: 78433 - DNA, 20 bp, synthetic construct
  misc_feature 1..20: note = CRISPR gRNA sequence
  source 1..20: mol_type = other DNA
tccagaggtataaaccatga

SEQ ID NO: 78434 - DNA, 20 bp, synthetic construct
  misc_feature 1..20: note = CRISPR gRNA sequence
  source 1..20: mol_type = other DNA
cagaggtataaaccatgagc

SEQ ID NO: 78435 - DNA, 20 bp, synthetic construct
  misc_feature 1..20: note = CRISPR gRNA sequence
  source 1..20: mol_type = other DNA
tatccacagcagctaggaag

SEQ ID NO: 78436 - DNA, 20 bp, synthetic construct
  misc_feature 1..20: note = CRISPR gRNA sequence
  source 1..20: mol_type = other DNA
ggaagaggggtgccggctgt

SEQ ID NO: 78437 - DNA, 20 bp, synthetic construct
  misc_feature 1..20: note = CRISPR gRNA sequence
  source 1..20: mol_type = other DNA
taacggggtctgggtgggac

SEQ ID NO: 78438 - DNA, 20 bp, synthetic construct
  misc_feature 1..20: note = CRISPR gRNA sequence
  source 1..20: mol_type = other DNA
ggtgggacagcagcagcatc

SEQ ID NO: 78439 - DNA, 20 bp, synthetic construct
  misc_feature 1..20: note = CRISPR gRNA sequence
  source 1..20: mol_type = other DNA
ctgcccgtcccaaggcctgg

SEQ ID NO: 78440 - DNA, 20 bp, synthetic construct
  misc_feature 1..20: note = CRISPR gRNA sequence
  source 1..20: mol_type = other DNA
tgcccgtcccaaggcctggg

SEQ ID NO: 78441 - DNA, 20 bp, synthetic construct
  misc_feature 1..20: note = CRISPR gRNA sequence
  source 1..20: mol_type = other DNA
cccgtcccaaggcctgggcc

SEQ ID NO: 78442 - DNA, 20 bp, synthetic construct
  misc_feature 1..20: note = CRISPR gRNA sequence
  source 1..20: mol_type = other DNA
ggcccagaaggaattccaag

SEQ ID NO: 78443 - DNA, 20 bp, synthetic construct
  misc_feature 1..20: note = CRISPR gRNA sequence
  source 1..20: mol_type = other DNA
caagggcttcagagagagca

SEQ ID NO: 78444 - DNA, 20 bp, synthetic construct
  misc_feature 1..20: note = CRISPR gRNA sequence
  source 1..20: mol_type = other DNA
cagagagagcatgatggggg

SEQ ID NO: 78445 - DNA, 20 bp, synthetic construct
  misc_feature 1..20: note = CRISPR gRNA sequence
  source 1..20: mol_type = other DNA
agagagagcatgatgggggg

SEQ ID NO: 78446 - DNA, 20 bp, synthetic construct
  misc_feature 1..20: note = CRISPR gRNA sequence
  source 1..20: mol_type = other DNA
agggagctcccacctgatgt

SEQ ID NO: 78447 - DNA, 20 bp, synthetic construct
  misc_feature 1..20: note = CRISPR gRNA sequence
  source 1..20: mol_type = other DNA
ccacctgatgtgcagctctg

SEQ ID NO: 78448 - DNA, 20 bp, synthetic construct
  misc_feature 1..20: note = CRISPR gRNA sequence
  source 1..20: mol_type = other DNA
atgtgcagctctgccagggt

SEQ ID NO: 78449 - DNA, 20 bp, synthetic construct
  misc_feature 1..20: note = CRISPR gRNA sequence
  source 1..20: mol_type = other DNA
tgccagggtccagcacgcac

SEQ ID NO: 78450 - DNA, 20 bp, synthetic construct
  misc_feature 1..20: note = CRISPR gRNA sequence
  source 1..20: mol_type = other DNA
ccagggtccagcacgcactc

SEQ ID NO: 78451 - DNA, 20 bp, synthetic construct
  misc_feature 1..20: note = CRISPR gRNA sequence
  source 1..20: mol_type = other DNA
acggccctcagcacacaatg

SEQ ID NO: 78452 - DNA, 20 bp, synthetic construct
  misc_feature 1..20: note = CRISPR gRNA sequence
  source 1..20: mol_type = other DNA
agcacacaatgcaccccggc

SEQ ID NO: 78453 - DNA, 20 bp, synthetic construct
  misc_feature 1..20: note = CRISPR gRNA sequence
  source 1..20: mol_type = other DNA
ttactgaggctgtggagagc

SEQ ID NO: 78454 - DNA, 20 bp, synthetic construct
  misc_feature 1..20: note = CRISPR gRNA sequence
  source 1..20: mol_type = other DNA
ctgaggctgtggagagcagg

SEQ ID NO: 78455 - DNA, 20 bp, synthetic construct
  misc_feature 1..20: note = CRISPR gRNA sequence
  source 1..20: mol_type = other DNA
aggctgtggagagcaggaga

SEQ ID NO: 78456 - DNA, 20 bp, synthetic construct
  misc_feature 1..20: note = CRISPR gRNA sequence
  source 1..20: mol_type = other DNA
tggagagcaggagaaggcag

SEQ ID NO: 78457 - DNA, 20 bp, synthetic construct
  misc_feature 1..20: note = CRISPR gRNA sequence
  source 1..20: mol_type = other DNA
gcatgtggctgaggtaccca

SEQ ID NO: 78458 - DNA, 20 bp, synthetic construct
  misc_feature 1..20: note = CRISPR gRNA sequence
  source 1..20: mol_type = other DNA
aggtacccagccccagccag

SEQ ID NO: 78459 - DNA, 20 bp, synthetic construct
  misc_feature 1..20: note = CRISPR gRNA sequence
  source 1..20: mol_type = other DNA
tagcccctccctgtggctca

SEQ ID NO: 78460 - DNA, 20 bp, synthetic construct
  misc_feature 1..20: note = CRISPR gRNA sequence
  source 1..20: mol_type = other DNA
gcccctccctgtggctcagc

SEQ ID NO: 78461 - DNA, 20 bp, synthetic construct
  misc_feature 1..20: note = CRISPR gRNA sequence
  source 1..20: mol_type = other DNA
cctgtggctcagcagcttgc

SEQ ID NO: 78462 - DNA, 20 bp, synthetic construct
  misc_feature 1..20: note = CRISPR gRNA sequence
  source 1..20: mol_type = other DNA
tggctcagcagcttgctggc

SEQ ID NO: 78463 - DNA, 20 bp, synthetic construct
  misc_feature 1..20: note = CRISPR gRNA sequence
  source 1..20: mol_type = other DNA
agcagcttgctggctgtcac

SEQ ID NO: 78464 - DNA, 20 bp, synthetic construct
  misc_feature 1..20: note = CRISPR gRNA sequence
  source 1..20: mol_type = other DNA
gctggctgtcactcctggat

SEQ ID NO: 78465 - DNA, 20 bp, synthetic construct
  misc_feature 1..20: note = CRISPR gRNA sequence
  source 1..20: mol_type = other DNA
ctggctgtcactcctggatg

SEQ ID NO: 78466 - DNA, 20 bp, synthetic construct
  misc_feature 1..20: note = CRISPR gRNA sequence
  source 1..20: mol_type = other DNA
gctgtcactcctggatgtcc

SEQ ID NO: 78467 - DNA, 20 bp, synthetic construct
  misc_feature 1..20: note = CRISPR gRNA sequence
  source 1..20: mol_type = other DNA
tcactcctggatgtcctagg

SEQ ID NO: 78468 - DNA, 20 bp, synthetic construct
  misc_feature 1..20: note = CRISPR gRNA sequence
  source 1..20: mol_type = other DNA
ctggatgtcctaggtccctt

SEQ ID NO: 78469 - DNA, 20 bp, synthetic construct
  misc_feature 1..20: note = CRISPR gRNA sequence
  source 1..20: mol_type = other DNA
gatgtcctaggtcccttgcc

SEQ ID NO: 78470 - DNA, 20 bp, synthetic construct
  misc_feature 1..20: note = CRISPR gRNA sequence
  source 1..20: mol_type = other DNA
ggtcccttgccaggggatct

SEQ ID NO: 78471 - DNA, 20 bp, synthetic construct
  misc_feature 1..20: note = CRISPR gRNA sequence
  source 1..20: mol_type = other DNA
gccaggggatctcaaaggat

SEQ ID NO: 78472 - DNA, 20 bp, synthetic construct
  misc_feature 1..20: note = CRISPR gRNA sequence
  source 1..20: mol_type = other DNA
ccaggggatctcaaaggatt

SEQ ID NO: 78473 - DNA, 20 bp, synthetic construct
  misc_feature 1..20: note = CRISPR gRNA sequence
  source 1..20: mol_type = other DNA
aaaggattctggtgcgtgtg

SEQ ID NO: 78474 - DNA, 20 bp, synthetic construct
  misc_feature 1..20: note = CRISPR gRNA sequence
  source 1..20: mol_type = other DNA
tggtgcgtgtgagtaagcca

SEQ ID NO: 78475 - DNA, 20 bp, synthetic construct
  misc_feature 1..20: note = CRISPR gRNA sequence
  source 1..20: mol_type = other DNA
gtgcgtgtgagtaagccaaa

SEQ ID NO: 78476 - DNA, 20 bp, synthetic construct
  misc_feature 1..20: note = CRISPR gRNA sequence
  source 1..20: mol_type = other DNA
ggaaaataaagttgtccagc

SEQ ID NO: 78477 - DNA, 20 bp, synthetic construct
  misc_feature 1..20: note = CRISPR gRNA sequence
  source 1..20: mol_type = other DNA
gaaaataaagttgtccagct

SEQ ID NO: 78478 - DNA, 20 bp, synthetic construct
  misc_feature 1..20: note = CRISPR gRNA sequence
  source 1..20: mol_type = other DNA
tccagcttgacagcaagaac

SEQ ID NO: 78479 - DNA, 20 bp, synthetic construct
  misc_feature 1..20: note = CRISPR gRNA sequence
  source 1..20: mol_type = other DNA
gacagcaagaactcagtgtt

SEQ ID NO: 78480 - DNA, 20 bp, synthetic construct
  misc_feature 1..20: note = CRISPR gRNA sequence
  source 1..20: mol_type = other DNA
acagcaagaactcagtgttt

SEQ ID NO: 78481 - DNA, 20 bp, synthetic construct
  misc_feature 1..20: note = CRISPR gRNA sequence
  source 1..20: mol_type = other DNA
agtgttttcacctctctgac

SEQ ID NO: 78482 - DNA, 20 bp, synthetic construct
  misc_feature 1..20: note = CRISPR gRNA sequence
  source 1..20: mol_type = other DNA
tcacctctctgacccccagt

SEQ ID NO: 78483 - DNA, 20 bp, synthetic construct
  misc_feature 1..20: note = CRISPR gRNA sequence
  source 1..20: mol_type = other DNA
cacctctctgacccccagtt

SEQ ID NO: 78484 - DNA, 20 bp, synthetic construct
  misc_feature 1..20: note = CRISPR gRNA sequence
  source 1..20: mol_type = other DNA
acctctctgacccccagttt

SEQ ID NO: 78485 - DNA, 20 bp, synthetic construct
  misc_feature 1..20: note = CRISPR gRNA sequence
  source 1..20: mol_type = other DNA
tctgacccccagttttctca

SEQ ID NO: 78486 - DNA, 20 bp, synthetic construct
  misc_feature 1..20: note = CRISPR gRNA sequence
  source 1..20: mol_type = other DNA
tgacccccagttttctcatc

SEQ ID NO: 78487 - DNA, 20 bp, synthetic construct
  misc_feature 1..20: note = CRISPR gRNA sequence
  source 1..20: mol_type = other DNA
acccccagttttctcatctg

SEQ ID NO: 78488 - DNA, 20 bp, synthetic construct
  misc_feature 1..20: note = CRISPR gRNA sequence
  source 1..20: mol_type = other DNA
tctcatctgtaaaataacca

SEQ ID NO: 78489 - DNA, 20 bp, synthetic construct
  misc_feature 1..20: note = CRISPR gRNA sequence
  source 1..20: mol_type = other DNA
ctcatctgtaaaataaccac

SEQ ID NO: 78490 - DNA, 20 bp, synthetic construct
  misc_feature 1..20: note = CRISPR gRNA sequence
  source 1..20: mol_type = other DNA
tcatctgtaaaataaccacc

SEQ ID NO: 78491 - DNA, 20 bp, synthetic construct
  misc_feature 1..20: note = CRISPR gRNA sequence
  source 1..20: mol_type = other DNA
atctgtaaaataaccaccat

SEQ ID NO: 78492 - DNA, 20 bp, synthetic construct
  misc_feature 1..20: note = CRISPR gRNA sequence
  source 1..20: mol_type = other DNA
taaaataaccaccattttct

SEQ ID NO: 78493 - DNA, 20 bp, synthetic construct
  misc_feature 1..20: note = CRISPR gRNA sequence
  source 1..20: mol_type = other DNA
tctgagccctgactatacca

SEQ ID NO: 78494 - DNA, 20 bp, synthetic construct
  misc_feature 1..20: note = CRISPR gRNA sequence
  source 1..20: mol_type = other DNA
ctgagccctgactataccag

SEQ ID NO: 78495 - DNA, 20 bp, synthetic construct
  misc_feature 1..20: note = CRISPR gRNA sequence
  source 1..20: mol_type = other DNA
tgagccctgactataccaga

SEQ ID NO: 78496 - DNA, 20 bp, synthetic construct
  misc_feature 1..20: note = CRISPR gRNA sequence
  source 1..20: mol_type = other DNA
agccctgactataccagact

SEQ ID NO: 78497 - DNA, 20 bp, synthetic construct
  misc_feature 1..20: note = CRISPR gRNA sequence
  source 1..20: mol_type = other DNA
actataccagactctgtaca

SEQ ID NO: 78498 - DNA, 20 bp, synthetic construct
  misc_feature 1..20: note = CRISPR gRNA sequence
  source 1..20: mol_type = other DNA
taccagactctgtacaaaag

SEQ ID NO: 78499 - DNA, 20 bp, synthetic construct
  misc_feature 1..20: note = CRISPR gRNA sequence
  source 1..20: mol_type = other DNA
tgtacaaaaggctttgtaca

SEQ ID NO: 78500 - DNA, 20 bp, synthetic construct
  misc_feature 1..20: note = CRISPR gRNA sequence
  source 1..20: mol_type = other DNA
tacaaaaggctttgtacata

SEQ ID NO: 78501 - DNA, 20 bp, synthetic construct
  misc_feature 1..20: note = CRISPR gRNA sequence
  source 1..20: mol_type = other DNA
tgtacatatatggtttcatg

SEQ ID NO: 78502 - DNA, 20 bp, synthetic construct
  misc_feature 1..20: note = CRISPR gRNA sequence
  source 1..20: mol_type = other DNA
gtacatatatggtttcatgt

SEQ ID NO: 78503 - DNA, 20 bp, synthetic construct
  misc_feature 1..20: note = CRISPR gRNA sequence
  source 1..20: mol_type = other DNA
tacatatatggtttcatgtg

SEQ ID NO: 78504 - DNA, 20 bp, synthetic construct
  misc_feature 1..20: note = CRISPR gRNA sequence
  source 1..20: mol_type = other DNA
catgtgatcccattttacag

SEQ ID NO: 78505 - DNA, 20 bp, synthetic construct
  misc_feature 1..20: note = CRISPR gRNA sequence
  source 1..20: mol_type = other DNA
atgtgatcccattttacaga

SEQ ID NO: 78506 - DNA, 20 bp, synthetic construct
  misc_feature 1..20: note = CRISPR gRNA sequence
  source 1..20: mol_type = other DNA
tacagaggggaaaccgaggc

SEQ ID NO: 78507 - DNA, 20 bp, synthetic construct
  misc_feature 1..20: note = CRISPR gRNA sequence
  source 1..20: mol_type = other DNA
acagaggggaaaccgaggcc

SEQ ID NO: 78508 - DNA, 20 bp, synthetic construct
  misc_feature 1..20: note = CRISPR gRNA sequence
  source 1..20: mol_type = other DNA
cagaggggaaaccgaggccc

SEQ ID NO: 78509 - DNA, 20 bp, synthetic construct
  misc_feature 1..20: note = CRISPR gRNA sequence
  source 1..20: mol_type = other DNA
aattactttcccaggttcac

SEQ ID NO: 78510 - DNA, 20 bp, synthetic construct
  misc_feature 1..20: note = CRISPR gRNA sequence
  source 1..20: mol_type = other DNA
ctttcccaggttcacaatgc

SEQ ID NO: 78511 - DNA, 20 bp, synthetic construct
  misc_feature 1..20: note = CRISPR gRNA sequence
  source 1..20: mol_type = other DNA
tcccaggttcacaatgctac

SEQ ID NO: 78512 - DNA, 20 bp, synthetic construct
  misc_feature 1..20: note = CRISPR gRNA sequence
  source 1..20: mol_type = other DNA
cccaggttcacaatgctact

SEQ ID NO: 78513 - DNA, 20 bp, synthetic construct
  misc_feature 1..20: note = CRISPR gRNA sequence
  source 1..20: mol_type = other DNA
ccaggttcacaatgctacta

SEQ ID NO: 78514 - DNA, 20 bp, synthetic construct
  misc_feature 1..20: note = CRISPR gRNA sequence
  source 1..20: mol_type = other DNA
acaatgctactaagtgacag

SEQ ID NO: 78515 - DNA, 20 bp, synthetic construct
  misc_feature 1..20: note = CRISPR gRNA sequence
  source 1..20: mol_type = other DNA
ctaagtgacagagcgaagat

SEQ ID NO: 78516 - DNA, 20 bp, synthetic construct
  misc_feature 1..20: note = CRISPR gRNA sequence
  source 1..20: mol_type = other DNA
agtgacagagcgaagattga

SEQ ID NO: 78517 - DNA, 20 bp, synthetic construct
  misc_feature 1..20: note = CRISPR gRNA sequence
  source 1..20: mol_type = other DNA
aaatccaaagctgaggcccc

SEQ ID NO: 78518 - DNA, 20 bp, synthetic construct
  misc_feature 1..20: note = CRISPR gRNA sequence
  source 1..20: mol_type = other DNA
aggccccaaaccactgctac

SEQ ID NO: 78519 - DNA, 20 bp, synthetic construct
  misc_feature 1..20: note = CRISPR gRNA sequence
  source 1..20: mol_type = other DNA
ctacccaatctcaacactcc

SEQ ID NO: 78520 - DNA, 20 bp, synthetic construct
  misc_feature 1..20: note = CRISPR gRNA sequence
  source 1..20: mol_type = other DNA
cccaatctcaacactcccca

SEQ ID NO: 78521 - DNA, 20 bp, synthetic construct
  misc_feature 1..20: note = CRISPR gRNA sequence
  source 1..20: mol_type = other DNA
aacactccccaaacccgacc

SEQ ID NO: 78522 - DNA, 20 bp, synthetic construct
  misc_feature 1..20: note = CRISPR gRNA sequence
  source 1..20: mol_type = other DNA
cccaaacccgacccacactt

SEQ ID NO: 78523 - DNA, 20 bp, synthetic construct
  misc_feature 1..20: note = CRISPR gRNA sequence
  source 1..20: mol_type = other DNA
gatcctaagacccccaagac

SEQ ID NO: 78524 - DNA, 20 bp, synthetic construct
  misc_feature 1..20: note = CRISPR gRNA sequence
  source 1..20: mol_type = other DNA
atcctaagacccccaagaca

SEQ ID NO: 78525 - DNA, 20 bp, synthetic construct
  misc_feature 1..20: note = CRISPR gRNA sequence
  source 1..20: mol_type = other DNA
agacccccaagacaccccca

SEQ ID NO: 78526 - DNA, 20 bp, synthetic construct
  misc_feature 1..20: note = CRISPR gRNA sequence
  source 1..20: mol_type = other DNA
accccatgcaacaccacagc

SEQ ID NO: 78527 - DNA, 20 bp, synthetic construct
  misc_feature 1..20: note = CRISPR gRNA sequence
  source 1..20: mol_type = other DNA
atagcctacctttccatctc

SEQ ID NO: 78528 - DNA, 20 bp, synthetic construct
  misc_feature 1..20: note = CRISPR gRNA sequence
  source 1..20: mol_type = other DNA
cctttccatctcaccacccc

SEQ ID NO: 78529 - DNA, 20 bp, synthetic construct
  misc_feature 1..20: note = CRISPR gRNA sequence
  source 1..20: mol_type = other DNA
tccatctcaccacccctcac

SEQ ID NO: 78530 - DNA, 20 bp, synthetic construct
  misc_feature 1..20: note = CRISPR gRNA sequence
  source 1..20: mol_type = other DNA
ccatctcaccacccctcacc

SEQ ID NO: 78531 - DNA, 20 bp, synthetic construct
  misc_feature 1..20: note = CRISPR gRNA sequence
  source 1..20: mol_type = other DNA
catctcaccacccctcaccc

SEQ ID NO: 78532 - DNA, 20 bp, synthetic construct
  misc_feature 1..20: note = CRISPR gRNA sequence
  source 1..20: mol_type = other DNA
accacccctcaccccaacag

SEQ ID NO: 78533 - DNA, 20 bp, synthetic construct
  misc_feature 1..20: note = CRISPR gRNA sequence
  source 1..20: mol_type = other DNA
accccaacagtgtatcccca

SEQ ID NO: 78534 - DNA, 20 bp, synthetic construct
  misc_feature 1..20: note = CRISPR gRNA sequence
  source 1..20: mol_type = other DNA
cctaccctagcaccccagca

SEQ ID NO: 78535 - DNA, 20 bp, synthetic construct
  misc_feature 1..20: note = CRISPR gRNA sequence
  source 1..20: mol_type = other DNA
ccctagcaccccagcatgac

SEQ ID NO: 78536 - DNA, 20 bp, synthetic construct
  misc_feature 1..20: note = CRISPR gRNA sequence
  source 1..20: mol_type = other DNA
gcaccccagcatgacacctc

SEQ ID NO: 78537 - DNA, 20 bp, synthetic construct
  misc_feature 1..20: note = CRISPR gRNA sequence
  source 1..20: mol_type = other DNA
cacagtgcaacatcccaccc

SEQ ID NO: 78538 - DNA, 20 bp, synthetic construct
  misc_feature 1..20: note = CRISPR gRNA sequence
  source 1..20: mol_type = other DNA
acacctccccagtgcaacac

SEQ ID NO: 78539 - DNA, 20 bp, synthetic construct
  misc_feature 1..20: note = CRISPR gRNA sequence
  source 1..20: mol_type = other DNA
cccagtgcaacaccccaccc

SEQ ID NO: 78540 - DNA, 20 bp, synthetic construct
  misc_feature 1..20: note = CRISPR gRNA sequence
  source 1..20: mol_type = other DNA
cagggcagctacaaagatga

SEQ ID NO: 78541 - DNA, 20 bp, synthetic construct
  misc_feature 1..20: note = CRISPR gRNA sequence
  source 1..20: mol_type = other DNA
caaagatgaattggaatgca

SEQ ID NO: 78542 - DNA, 20 bp, synthetic construct
  misc_feature 1..20: note = CRISPR gRNA sequence
  source 1..20: mol_type = other DNA
gaatgcaagccactgatgta

SEQ ID NO: 78543 - DNA, 20 bp, synthetic construct
  misc_feature 1..20: note = CRISPR gRNA sequence
  source 1..20: mol_type = other DNA
atgtataatgaacgcatttt

SEQ ID NO: 78544 - DNA, 20 bp, synthetic construct
  misc_feature 1..20: note = CRISPR gRNA sequence
  source 1..20: mol_type = other DNA
tacacatgtaagggtgctag

SEQ ID NO: 78545 - DNA, 20 bp, synthetic construct
  misc_feature 1..20: note = CRISPR gRNA sequence
  source 1..20: mol_type = other DNA
acacatgtaagggtgctaga

SEQ ID NO: 78546 - DNA, 20 bp, synthetic construct
  misc_feature 1..20: note = CRISPR gRNA sequence
  source 1..20: mol_type = other DNA
cacatgtaagggtgctagat

SEQ ID NO: 78547 - DNA, 20 bp, synthetic construct
  misc_feature 1..20: note = CRISPR gRNA sequence
  source 1..20: mol_type = other DNA
gatgattggactaagacagt

SEQ ID NO: 78548 - DNA, 20 bp, synthetic construct
  misc_feature 1..20: note = CRISPR gRNA sequence
  source 1..20: mol_type = other DNA
gactaagacagtggctcatg

SEQ ID NO: 78549 - DNA, 20 bp, synthetic construct
  misc_feature 1..20: note = CRISPR gRNA sequence
  source 1..20: mol_type = other DNA
agacagtggctcatgccgga

SEQ ID NO: 78550 - DNA, 20 bp, synthetic construct
  misc_feature 1..20: note = CRISPR gRNA sequence
  source 1..20: mol_type = other DNA
atgccggaggtgaaggcaag

SEQ ID NO: 78551 - DNA, 20 bp, synthetic construct
  misc_feature 1..20: note = CRISPR gRNA sequence
  source 1..20: mol_type = other DNA
gactttgctggagttgggag

SEQ ID NO: 78552 - DNA, 20 bp, synthetic construct
  misc_feature 1..20: note = CRISPR gRNA sequence
  source 1..20: mol_type = other DNA
actttgctggagttgggagg

SEQ ID NO: 78553 - DNA, 20 bp, synthetic construct
  misc_feature 1..20: note = CRISPR gRNA sequence
  source 1..20: mol_type = other DNA
tgctggagttgggaggaagc

SEQ ID NO: 78554 - DNA, 20 bp, synthetic construct
  misc_feature 1..20: note = CRISPR gRNA sequence
  source 1..20: mol_type = other DNA
gctggagttgggaggaagca

SEQ ID NO: 78555 - DNA, 20 bp, synthetic construct
  misc_feature 1..20: note = CRISPR gRNA sequence
  source 1..20: mol_type = other DNA
ctggagttgggaggaagcag

SEQ ID NO: 78556 - DNA, 20 bp, synthetic construct
  misc_feature 1..20: note = CRISPR gRNA sequence
  source 1..20: mol_type = other DNA
gagttgggaggaagcagggg

SEQ ID NO: 78557 - DNA, 20 bp, synthetic construct
  misc_feature 1..20: note = CRISPR gRNA sequence
  source 1..20: mol_type = other DNA
ggaggaagcaggggtggcag

SEQ ID NO: 78558 - DNA, 20 bp, synthetic construct
  misc_feature 1..20: note = CRISPR gRNA sequence
  source 1..20: mol_type = other DNA
actgctgattacgaacacgg

SEQ ID NO: 78559 - DNA, 20 bp, synthetic construct
  misc_feature 1..20: note = CRISPR gRNA sequence
  source 1..20: mol_type = other DNA
ctgctgattacgaacacggg

SEQ ID NO: 78560 - DNA, 20 bp, synthetic construct
  misc_feature 1..20: note = CRISPR gRNA sequence
  source 1..20: mol_type = other DNA
ctgattacgaacacggggac

SEQ ID NO: 78561 - DNA, 20 bp, synthetic construct
  misc_feature 1..20: note = CRISPR gRNA sequence
  source 1..20: mol_type = other DNA
attacgaacacggggacctc

SEQ ID NO: 78562 - DNA, 20 bp, synthetic construct
  misc_feature 1..20: note = CRISPR gRNA sequence
  source 1..20: mol_type = other DNA
cgaacacggggacctcctgg

SEQ ID NO: 78563 - DNA, 20 bp, synthetic construct
  misc_feature 1..20: note = CRISPR gRNA sequence
  source 1..20: mol_type = other DNA
ctggggctctacagggcctt

SEQ ID NO: 78564 - DNA, 20 bp, synthetic construct
  misc_feature 1..20: note = CRISPR gRNA sequence
  source 1..20: mol_type = other DNA
gggctctacagggccttccc

SEQ ID NO: 78565 - DNA, 20 bp, synthetic construct
  misc_feature 1..20: note = CRISPR gRNA sequence
  source 1..20: mol_type = other DNA
tacagggccttccctggtac

SEQ ID NO: 78566 - DNA, 20 bp, synthetic construct
  misc_feature 1..20: note = CRISPR gRNA sequence
  source 1..20: mol_type = other DNA
cagggccttccctggtaccc

SEQ ID NO: 78567 - DNA, 20 bp, synthetic construct
  misc_feature 1..20: note = CRISPR gRNA sequence
  source 1..20: mol_type = other DNA
ccctggtacccagcggtggg

SEQ ID NO: 78568 - DNA, 20 bp, synthetic construct
  misc_feature 1..20: note = CRISPR gRNA sequence
  source 1..20: mol_type = other DNA
cctggtacccagcggtgggg

SEQ ID NO: 78569 - DNA, 20 bp, synthetic construct
  misc_feature 1..20: note = CRISPR gRNA sequence
  source 1..20: mol_type = other DNA
gtacccagcggtggggtgga

SEQ ID NO: 78570 - DNA, 20 bp, synthetic construct
  misc_feature 1..20: note = CRISPR gRNA sequence
  source 1..20: mol_type = other DNA
actccagcttcctggcgatg

SEQ ID NO: 78571 - DNA, 20 bp, synthetic construct
  misc_feature 1..20: note = CRISPR gRNA sequence
  source 1..20: mol_type = other DNA
cagcttcctggcgatgtgca

SEQ ID NO: 78572 - DNA, 20 bp, synthetic construct
  misc_feature 1..20: note = CRISPR gRNA sequence
  source 1..20: mol_type = other DNA
cctggcgatgtgcagctggg

SEQ ID NO: 78573 - DNA, 20 bp, synthetic construct
  misc_feature 1..20: note = CRISPR gRNA sequence
  source 1..20: mol_type = other DNA
ctggcgatgtgcagctggga

SEQ ID NO: 78574 - DNA, 20 bp, synthetic construct
  misc_feature 1..20: note = CRISPR gRNA sequence
  source 1..20: mol_type = other DNA
gcgatgtgcagctgggatgc

SEQ ID NO: 78575 - DNA, 20 bp, synthetic construct
  misc_feature 1..20: note = CRISPR gRNA sequence
  source 1..20: mol_type = other DNA
ggatgcagcctctgccatca

SEQ ID NO: 78576 - DNA, 20 bp, synthetic construct
  misc_feature 1..20: note = CRISPR gRNA sequence
  source 1..20: mol_type = other DNA
tgccatcagccgacagcctt

SEQ ID NO: 78577 - DNA, 20 bp, synthetic construct
  misc_feature 1..20: note = CRISPR gRNA sequence
  source 1..20: mol_type = other DNA
ccatcagccgacagccttca

SEQ ID NO: 78578 - DNA, 20 bp, synthetic construct
  misc_feature 1..20: note = CRISPR gRNA sequence
  source 1..20: mol_type = other DNA
catcttccagctggttccct

SEQ ID NO: 78579 - DNA, 20 bp, synthetic construct
  misc_feature 1..20: note = CRISPR gRNA sequence
  source 1..20: mol_type = other DNA
atcttccagctggttccctg

SEQ ID NO: 78580 - DNA, 20 bp, synthetic construct
  misc_feature 1..20: note = CRISPR gRNA sequence
  source 1..20: mol_type = other DNA
ccagctggttccctgagagg

SEQ ID NO: 78581 - DNA, 20 bp, synthetic construct
  misc_feature 1..20: note = CRISPR gRNA sequence
  source 1..20: mol_type = other DNA
cagctggttccctgagaggc

SEQ ID NO: 78582 - DNA, 20 bp, synthetic construct
  misc_feature 1..20: note = CRISPR gRNA sequence
  source 1..20: mol_type = other DNA
gttccctgagaggctgagac

SEQ ID NO: 78583 - DNA, 20 bp, synthetic construct
  misc_feature 1..20: note = CRISPR gRNA sequence
  source 1..20: mol_type = other DNA
cctgagaggctgagacgggg

SEQ ID NO: 78584 - DNA, 20 bp, synthetic construct
  misc_feature 1..20: note = CRISPR gRNA sequence
  source 1..20: mol_type = other DNA
agaggctgagacggggggcc

SEQ ID NO: 78585 - DNA, 20 bp, synthetic construct
  misc_feature 1..20: note = CRISPR gRNA sequence
  source 1..20: mol_type = other DNA
agacggggggcccaatgcac

SEQ ID NO: 78586 - DNA, 20 bp, synthetic construct
  misc_feature 1..20: note = CRISPR gRNA sequence
  source 1..20: mol_type = other DNA
tattgtggggctggagtcct

SEQ ID NO: 78587 - DNA, 20 bp, synthetic construct
  misc_feature 1..20: note = CRISPR gRNA sequence
  source 1..20: mol_type = other DNA
tggggctggagtcctccctc

SEQ ID NO: 78588 - DNA, 20 bp, synthetic construct
  misc_feature 1..20: note = CRISPR gRNA sequence
  source 1..20: mol_type = other DNA
gagtcctccctcaatcccca

SEQ ID NO: 78589 - DNA, 20 bp, synthetic construct
  misc_feature 1..20: note = CRISPR gRNA sequence
  source 1..20: mol_type = other DNA
cctcaatccccatcacttac

SEQ ID NO: 78590 - DNA, 20 bp, synthetic construct
  misc_feature 1..20: note = CRISPR gRNA sequence
  source 1..20: mol_type = other DNA
aatccccatcacttactcct

SEQ ID NO: 78591 - DNA, 20 bp, synthetic construct
  misc_feature 1..20: note = CRISPR gRNA sequence
  source 1..20: mol_type = other DNA
actcctcctttgctaacttt

SEQ ID NO: 78592 - DNA, 20 bp, synthetic construct
  misc_feature 1..20: note = CRISPR gRNA sequence
  source 1..20: mol_type = other DNA
ctcctcctttgctaacttta

SEQ ID NO: 78593 - DNA, 20 bp, synthetic construct
  misc_feature 1..20: note = CRISPR gRNA sequence
  source 1..20: mol_type = other DNA
ctcctttgctaactttagtc

SEQ ID NO: 78594 - DNA, 20 bp, synthetic construct
  misc_feature 1..20: note = CRISPR gRNA sequence
  source 1..20: mol_type = other DNA
ctttgctaactttagtcaaa

SEQ ID NO: 78595 - DNA, 20 bp, synthetic construct
  misc_feature 1..20: note = CRISPR gRNA sequence
  source 1..20: mol_type = other DNA
tgctaactttagtcaaagtg

SEQ ID NO: 78596 - DNA, 20 bp, synthetic construct
  misc_feature 1..20: note = CRISPR gRNA sequence
  source 1..20: mol_type = other DNA
gctaactttagtcaaagtgt

SEQ ID NO: 78597 - DNA, 20 bp, synthetic construct
  misc_feature 1..20: note = CRISPR gRNA sequence
  source 1..20: mol_type = other DNA
ctaactttagtcaaagtgtc

SEQ ID NO: 78598 - DNA, 20 bp, synthetic construct
  misc_feature 1..20: note = CRISPR gRNA sequence
  source 1..20: mol_type = other DNA
actttagtcaaagtgtcact

SEQ ID NO: 78599 - DNA, 20 bp, synthetic construct
  misc_feature 1..20: note = CRISPR gRNA sequence
  source 1..20: mol_type = other DNA
tagtcaaagtgtcactctca

SEQ ID NO: 78600 - DNA, 20 bp, synthetic construct
  misc_feature 1..20: note = CRISPR gRNA sequence
  source 1..20: mol_type = other DNA
agtcaaagtgtcactctcag

SEQ ID NO: 78601 - DNA, 20 bp, synthetic construct
  misc_feature 1..20: note = CRISPR gRNA sequence
  source 1..20: mol_type = other DNA
gtcaaagtgtcactctcagg

SEQ ID NO: 78602 - DNA, 20 bp, synthetic construct
  misc_feature 1..20: note = CRISPR gRNA sequence
  source 1..20: mol_type = other DNA
tcaggaatgaaccttgataa

SEQ ID NO: 78603 - DNA, 20 bp, synthetic construct
  misc_feature 1..20: note = CRISPR gRNA sequence
  source 1..20: mol_type = other DNA
aggaatgaaccttgataata

SEQ ID NO: 78604 - DNA, 20 bp, synthetic construct
  misc_feature 1..20: note = CRISPR gRNA sequence
  source 1..20: mol_type = other DNA
gataataactgaaatcgaca

SEQ ID NO: 78605 - DNA, 20 bp, synthetic construct
  misc_feature 1..20: note = CRISPR gRNA sequence
  source 1..20: mol_type = other DNA
ataataactgaaatcgacag

SEQ ID NO: 78606 - DNA, 20 bp, synthetic construct
  misc_feature 1..20: note = CRISPR gRNA sequence
  source 1..20: mol_type = other DNA
aaatcgacagactccatacc

SEQ ID NO: 78607 - DNA, 20 bp, synthetic construct
  misc_feature 1..20: note = CRISPR gRNA sequence
  source 1..20: mol_type = other DNA
cataccacatgcctggcaac

SEQ ID NO: 78608 - DNA, 20 bp, synthetic construct
  misc_feature 1..20: note = CRISPR gRNA sequence
  source 1..20: mol_type = other DNA
gcaacatcctaggttcttct

SEQ ID NO: 78609 - DNA, 20 bp, synthetic construct
  misc_feature 1..20: note = CRISPR gRNA sequence
  source 1..20: mol_type = other DNA
ggttcttctatgactattgg

SEQ ID NO: 78610 - DNA, 20 bp, synthetic construct
  misc_feature 1..20: note = CRISPR gRNA sequence
  source 1..20: mol_type = other DNA
ttctatgactattggcctat

SEQ ID NO: 78611 - DNA, 20 bp, synthetic construct
  misc_feature 1..20: note = CRISPR gRNA sequence
  source 1..20: mol_type = other DNA
ctatgactattggcctattt

SEQ ID NO: 78612 - DNA, 20 bp, synthetic construct
  misc_feature 1..20: note = CRISPR gRNA sequence
  source 1..20: mol_type = other DNA
tatgactattggcctatttc

SEQ ID NO: 78613 - DNA, 20 bp, synthetic construct
  misc_feature 1..20: note = CRISPR gRNA sequence
  source 1..20: mol_type = other DNA
tgactattggcctatttcat

SEQ ID NO: 78614 - DNA, 20 bp, synthetic construct
  misc_feature 1..20: note = CRISPR gRNA sequence
  source 1..20: mol_type = other DNA
ttggcctatttcatcctcat

SEQ ID NO: 78615 - DNA, 20 bp, synthetic construct
  misc_feature 1..20: note = CRISPR gRNA sequence
  source 1..20: mol_type = other DNA
gcctatttcatcctcatagt

SEQ ID NO: 78616 - DNA, 20 bp, synthetic construct
  misc_feature 1..20: note = CRISPR gRNA sequence
  source 1..20: mol_type = other DNA
tttcatcctcatagtgccga

SEQ ID NO: 78617 - DNA, 20 bp, synthetic construct
  misc_feature 1..20: note = CRISPR gRNA sequence
  source 1..20: mol_type = other DNA
catcctcatagtgccgatga

SEQ ID NO: 78618 - DNA, 20 bp, synthetic construct
  misc_feature 1..20: note = CRISPR gRNA sequence
  source 1..20: mol_type = other DNA
atcctcatagtgccgatgac

SEQ ID NO: 78619 - DNA, 20 bp, synthetic construct
  misc_feature 1..20: note = CRISPR gRNA sequence
  source 1..20: mol_type = other DNA
atagtgccgatgacgtgggc

SEQ ID NO: 78620 - DNA, 20 bp, synthetic construct
  misc_feature 1..20: note = CRISPR gRNA sequence
  source 1..20: mol_type = other DNA
taattatcctcaccttactg

SEQ ID NO: 78621 - DNA, 20 bp, synthetic construct
  misc_feature 1..20: note = CRISPR gRNA sequence
  source 1..20: mol_type = other DNA
tcctcaccttactgatgagt

SEQ ID NO: 78622 - DNA, 20 bp, synthetic construct
  misc_feature 1..20: note = CRISPR gRNA sequence
  source 1..20: mol_type = other DNA
accttactgatgagtaaact

SEQ ID NO: 78623 - DNA, 20 bp, synthetic construct
  misc_feature 1..20: note = CRISPR gRNA sequence
  source 1..20: mol_type = other DNA
actgatgagtaaactcaagt

SEQ ID NO: 78624 - DNA, 20 bp, synthetic construct
  misc_feature 1..20: note = CRISPR gRNA sequence
  source 1..20: mol_type = other DNA
ctgatgagtaaactcaagtg

SEQ ID NO: 78625 - DNA, 20 bp, synthetic construct
  misc_feature 1..20: note = CRISPR gRNA sequence
  source 1..20: mol_type = other DNA
atgagtaaactcaagtgcag

SEQ ID NO: 78626 - DNA, 20 bp, synthetic construct
  misc_feature 1..20: note = CRISPR gRNA sequence
  source 1..20: mol_type = other DNA
aagtgcagagtggttaagtg

SEQ ID NO: 78627 - DNA, 20 bp, synthetic construct
  misc_feature 1..20: note = CRISPR gRNA sequence
  source 1..20: mol_type = other DNA
agtgcagagtaaagttaagg

SEQ ID NO: 78628 - DNA, 20 bp, synthetic construct
  misc_feature 1..20: note = CRISPR gRNA sequence
  source 1..20: mol_type = other DNA
aggcacttgctcgagggaga

SEQ ID NO: 78629 - DNA, 20 bp, synthetic construct
  misc_feature 1..20: note = CRISPR gRNA sequence
  source 1..20: mol_type = other DNA
gctcgagggagaacctggat

SEQ ID NO: 78630 - DNA, 20 bp, synthetic construct
  misc_feature 1..20: note = CRISPR gRNA sequence
  source 1..20: mol_type = other DNA
ctcgagggagaacctggatt

SEQ ID NO: 78631 - DNA, 20 bp, synthetic construct
  misc_feature 1..20: note = CRISPR gRNA sequence
  source 1..20: mol_type = other DNA
gagggagaacctggatttga

SEQ ID NO: 78632 - DNA, 20 bp, synthetic construct
  misc_feature 1..20: note = CRISPR gRNA sequence
  source 1..20: mol_type = other DNA
gatttgaacccaggcagcct

SEQ ID NO: 78633 - DNA, 20 bp, synthetic construct
  misc_feature 1..20: note = CRISPR gRNA sequence
  source 1..20: mol_type = other DNA
gaacccaggcagcctgcctt

SEQ ID NO: 78634 - DNA, 20 bp, synthetic construct
  misc_feature 1..20: note = CRISPR gRNA sequence
  source 1..20: mol_type = other DNA
aacccaggcagcctgccttc

SEQ ID NO: 78635 - DNA, 20 bp, synthetic construct
  misc_feature 1..20: note = CRISPR gRNA sequence
  source 1..20: mol_type = other DNA
ccttcaaggccccaccctca

SEQ ID NO: 78636 - DNA, 20 bp, synthetic construct
  misc_feature 1..20: note = CRISPR gRNA sequence
  source 1..20: mol_type = other DNA
caaggccccaccctcaactc

SEQ ID NO: 78637 - DNA, 20 bp, synthetic construct
  misc_feature 1..20: note = CRISPR gRNA sequence
  source 1..20: mol_type = other DNA
aaggccccaccctcaactct

SEQ ID NO: 78638 - DNA, 20 bp, synthetic construct
  misc_feature 1..20: note = CRISPR gRNA sequence
  source 1..20: mol_type = other DNA
aactcttcctttatgctgca

SEQ ID NO: 78639 - DNA, 20 bp, synthetic construct
  misc_feature 1..20: note = CRISPR gRNA sequence
  source 1..20: mol_type = other DNA
ttcctttatgctgcaagtta

SEQ ID NO: 78640 - DNA, 20 bp, synthetic construct
  misc_feature 1..20: note = CRISPR gRNA sequence
  source 1..20: mol_type = other DNA
cctttatgctgcaagttaca

SEQ ID NO: 78641 - DNA, 20 bp, synthetic construct
  misc_feature 1..20: note = CRISPR gRNA sequence
  source 1..20: mol_type = other DNA
ctttatgctgcaagttacat

SEQ ID NO: 78642 - DNA, 20 bp, synthetic construct
  misc_feature 1..20: note = CRISPR gRNA sequence
  source 1..20: mol_type = other DNA
tatgctgcaagttacataat

SEQ ID NO: 78643 - DNA, 20 bp, synthetic construct
  misc_feature 1..20: note = CRISPR gRNA sequence
  source 1..20: mol_type = other DNA
atgctgcaagttacataatt

SEQ ID NO: 78644 - DNA, 20 bp, synthetic construct
  misc_feature 1..20: note = CRISPR gRNA sequence
  source 1..20: mol_type = other DNA
tgctgcaagttacataattg

SEQ ID NO: 78645 - DNA, 20 bp, synthetic construct
  misc_feature 1..20: note = CRISPR gRNA sequence
  source 1..20: mol_type = other DNA
caagttacataattgctttt

SEQ ID NO: 78646 - DNA, 20 bp, synthetic construct
  misc_feature 1..20: note = CRISPR gRNA sequence
  source 1..20: mol_type = other DNA
cataattgctttttgtgata

SEQ ID NO: 78647 - DNA, 20 bp, synthetic construct
  misc_feature 1..20: note = CRISPR gRNA sequence
  source 1..20: mol_type = other DNA
ctttttgtgataaacttcat

SEQ ID NO: 78648 - DNA, 20 bp, synthetic construct
  misc_feature 1..20: note = CRISPR gRNA sequence
  source 1..20: mol_type = other DNA
tttgtgataaacttcatgat

SEQ ID NO: 78649 - DNA, 20 bp, synthetic construct
  misc_feature 1..20: note = CRISPR gRNA sequence
  source 1..20: mol_type = other DNA
ttgtgataaacttcatgatt

SEQ ID NO: 78650 - DNA, 20 bp, synthetic construct
  misc_feature 1..20: note = CRISPR gRNA sequence
  source 1..20: mol_type = other DNA
tgtgataaacttcatgatta

SEQ ID NO: 78651 - DNA, 20 bp, synthetic construct
  misc_feature 1..20: note = CRISPR gRNA sequence
  source 1..20: mol_type = other DNA
gtgataaacttcatgattat

SEQ ID NO: 78652 - DNA, 20 bp, synthetic construct
  misc_feature 1..20: note = CRISPR gRNA sequence
  source 1..20: mol_type = other DNA
tgataaacttcatgattatg

SEQ ID NO: 78653 - DNA, 20 bp, synthetic construct
  misc_feature 1..20: note = CRISPR gRNA sequence
  source 1..20: mol_type = other DNA
catgattatgggggcatctg

SEQ ID NO: 78654 - DNA, 20 bp, synthetic construct
  misc_feature 1..20: note = CRISPR gRNA sequence
  source 1..20: mol_type = other DNA
atgattatgggggcatctga

SEQ ID NO: 78655 - DNA, 20 bp, synthetic construct
  misc_feature 1..20: note = CRISPR gRNA sequence
  source 1..20: mol_type = other DNA
tgggggcatctgacctagtc

SEQ ID NO: 78656 - DNA, 20 bp, synthetic construct
  misc_feature 1..20: note = CRISPR gRNA sequence
  source 1..20: mol_type = other DNA
acctagtctgggagtcgggg

SEQ ID NO: 78657 - DNA, 20 bp, synthetic construct
  misc_feature 1..20: note = CRISPR gRNA sequence
  source 1..20: mol_type = other DNA
gtctgggagtcggggatggc

SEQ ID NO: 78658 - DNA, 20 bp, synthetic construct
  misc_feature 1..20: note = CRISPR gRNA sequence
  source 1..20: mol_type = other DNA
ggagtcggggatggcttatt

SEQ ID NO: 78659 - DNA, 20 bp, synthetic construct
  misc_feature 1..20: note = CRISPR gRNA sequence
  source 1..20: mol_type = other DNA
atttgttgcttaagctactt

SEQ ID NO: 78660 - DNA, 20 bp, synthetic construct
  misc_feature 1..20: note = CRISPR gRNA sequence
  source 1..20: mol_type = other DNA
tttgttgcttaagctacttg

SEQ ID NO: 78661 - DNA, 20 bp, synthetic construct
  misc_feature 1..20: note = CRISPR gRNA sequence
  source 1..20: mol_type = other DNA
gttgcttaagctacttgctg

SEQ ID NO: 78662 - DNA, 20 bp, synthetic construct
  misc_feature 1..20: note = CRISPR gRNA sequence
  source 1..20: mol_type = other DNA
ttgcttaagctacttgctga

SEQ ID NO: 78663 - DNA, 20 bp, synthetic construct
  misc_feature 1..20: note = CRISPR gRNA sequence
  source 1..20: mol_type = other DNA
cttaagctacttgctgaaat

SEQ ID NO: 78664 - DNA, 20 bp, synthetic construct
  misc_feature 1..20: note = CRISPR gRNA sequence
  source 1..20: mol_type = other DNA
aagctacttgctgaaataac

SEQ ID NO: 78665 - DNA, 20 bp, synthetic construct
  misc_feature 1..20: note = CRISPR gRNA sequence
  source 1..20: mol_type = other DNA
agctacttgctgaaataact

SEQ ID NO: 78666 - DNA, 20 bp, synthetic construct
  misc_feature 1..20: note = CRISPR gRNA sequence
  source 1..20: mol_type = other DNA
cttgctgaaataactgggag

SEQ ID NO: 78667 - DNA, 20 bp, synthetic construct
  misc_feature 1..20: note = CRISPR gRNA sequence
  source 1..20: mol_type = other DNA
gctgaaataactgggagttc

SEQ ID NO: 78668 - DNA, 20 bp, synthetic construct
  misc_feature 1..20: note = CRISPR gRNA sequence
  source 1..20: mol_type = other DNA
ctgaaataactgggagttca

SEQ ID NO: 78669 - DNA, 20 bp, synthetic construct
  misc_feature 1..20: note = CRISPR gRNA sequence
  source 1..20: mol_type = other DNA
aaataactgggagttcagta

SEQ ID NO: 78670 - DNA, 20 bp, synthetic construct
  misc_feature 1..20: note = CRISPR gRNA sequence
  source 1..20: mol_type = other DNA
ggagttcagtaggtaaaagg

SEQ ID NO: 78671 - DNA, 20 bp, synthetic construct
  misc_feature 1..20: note = CRISPR gRNA sequence
  source 1..20: mol_type = other DNA
agtaggtaaaaggttggggg

SEQ ID NO: 78672 - DNA, 20 bp, synthetic construct
  misc_feature 1..20: note = CRISPR gRNA sequence
  source 1..20: mol_type = other DNA
ggggagagatggaggaaggg

SEQ ID NO: 78673 - DNA, 20 bp, synthetic construct
  misc_feature 1..20: note = CRISPR gRNA sequence
  source 1..20: mol_type = other DNA
ctggtggtagaagcagtaca

SEQ ID NO: 78674 - DNA, 20 bp, synthetic construct
  misc_feature 1..20: note = CRISPR gRNA sequence
  source 1..20: mol_type = other DNA
gtggtagaagcagtacattc

SEQ ID NO: 78675 - DNA, 20 bp, synthetic construct
  misc_feature 1..20: note = CRISPR gRNA sequence
  source 1..20: mol_type = other DNA
aaaggccctgtggcataaca

SEQ ID NO: 78676 - DNA, 20 bp, synthetic construct
  misc_feature 1..20: note = CRISPR gRNA sequence
  source 1..20: mol_type = other DNA
tggcataacacatatgagga

SEQ ID NO: 78677 - DNA, 20 bp, synthetic construct
  misc_feature 1..20: note = CRISPR gRNA sequence
  source 1..20: mol_type = other DNA
aaagagagccagtgtgtctg

SEQ ID NO: 78678 - DNA, 20 bp, synthetic construct
  misc_feature 1..20: note = CRISPR gRNA sequence
  source 1..20: mol_type = other DNA
gattggagattgagtggaag

SEQ ID NO: 78679 - DNA, 20 bp, synthetic construct
  misc_feature 1..20: note = CRISPR gRNA sequence
  source 1..20: mol_type = other DNA
gagattgagtggaaggatgg

SEQ ID NO: 78680 - DNA, 20 bp, synthetic construct
  misc_feature 1..20: note = CRISPR gRNA sequence
  source 1..20: mol_type = other DNA
agtggaaggatggggtcaga

SEQ ID NO: 78681 - DNA, 20 bp, synthetic construct
  misc_feature 1..20: note = CRISPR gRNA sequence
  source 1..20: mol_type = other DNA
aggaggctgggggcagggtt

SEQ ID NO: 78682 - DNA, 20 bp, synthetic construct
  misc_feature 1..20: note = CRISPR gRNA sequence
  source 1..20: mol_type = other DNA
ggaggctgggggcagggttc

SEQ ID NO: 78683 - DNA, 20 bp, synthetic construct
  misc_feature 1..20: note = CRISPR gRNA sequence
  source 1..20: mol_type = other DNA
ggggcagggttctggaccac

SEQ ID NO: 78684 - DNA, 20 bp, synthetic construct
  misc_feature 1..20: note = CRISPR gRNA sequence
  source 1..20: mol_type = other DNA
tggaccacctgggagtttag

SEQ ID NO: 78685 - DNA, 20 bp, synthetic construct
  misc_feature 1..20: note = CRISPR gRNA sequence
  source 1..20: mol_type = other DNA
gaccacctgggagtttagaa

SEQ ID NO: 78686 - DNA, 20 bp, synthetic construct
  misc_feature 1..20: note = CRISPR gRNA sequence
  source 1..20: mol_type = other DNA
ggagtttagaatgtgggttt

SEQ ID NO: 78687 - DNA, 20 bp, synthetic construct
  misc_feature 1..20: note = CRISPR gRNA sequence
  source 1..20: mol_type = other DNA
agaatgtgggttttatcctg

SEQ ID NO: 78688 - DNA, 20 bp, synthetic construct
  misc_feature 1..20: note = CRISPR gRNA sequence
  source 1..20: mol_type = other DNA
gaatgtgggttttatcctga

SEQ ID NO: 78689 - DNA, 20 bp, synthetic construct
  misc_feature 1..20: note = CRISPR gRNA sequence
  source 1..20: mol_type = other DNA
tatcctgagcagtgggaagg

SEQ ID NO: 78690 - DNA, 20 bp, synthetic construct
  misc_feature 1..20: note = CRISPR gRNA sequence
  source 1..20: mol_type = other DNA
atcctgagcagtgggaagga

SEQ ID NO: 78691 - DNA, 20 bp, synthetic construct
  misc_feature 1..20: note = CRISPR gRNA sequence
  source 1..20: mol_type = other DNA
tcctgagcagtgggaaggag

SEQ ID NO: 78692 - DNA, 20 bp, synthetic construct
  misc_feature 1..20: note = CRISPR gRNA sequence
  source 1..20: mol_type = other DNA
agcagtgggaaggagtgaag

SEQ ID NO: 78693 - DNA, 20 bp, synthetic construct
  misc_feature 1..20: note = CRISPR gRNA sequence
  source 1..20: mol_type = other DNA
ctctctgccaggtggaagtg

SEQ ID NO: 78694 - DNA, 20 bp, synthetic construct
  misc_feature 1..20: note = CRISPR gRNA sequence
  source 1..20: mol_type = other DNA
tctgccaggtggaagtggcc

SEQ ID NO: 78695 - DNA, 20 bp, synthetic construct
  misc_feature 1..20: note = CRISPR gRNA sequence
  source 1..20: mol_type = other DNA
tgccaggtggaagtggccag

SEQ ID NO: 78696 - DNA, 20 bp, synthetic construct
  misc_feature 1..20: note = CRISPR gRNA sequence
  source 1..20: mol_type = other DNA
ccaggtggaagtggccaggg

SEQ ID NO: 78697 - DNA, 20 bp, synthetic construct
  misc_feature 1..20: note = CRISPR gRNA sequence
  source 1..20: mol_type = other DNA
gactagaaaggtggaggaaa

SEQ ID NO: 78698 - DNA, 20 bp, synthetic construct
  misc_feature 1..20: note = CRISPR gRNA sequence
  source 1..20: mol_type = other DNA
gaaaggtggaggaaaagagg

SEQ ID NO: 78699 - DNA, 20 bp, synthetic construct
  misc_feature 1..20: note = CRISPR gRNA sequence
  source 1..20: mol_type = other DNA
tgagcgctaccagtaggtcc

SEQ ID NO: 78700 - DNA, 20 bp, synthetic construct
  misc_feature 1..20: note = CRISPR gRNA sequence
  source 1..20: mol_type = other DNA
gagcgctaccagtaggtcca

SEQ ID NO: 78701 - DNA, 20 bp, synthetic construct
  misc_feature 1..20: note = CRISPR gRNA sequence
  source 1..20: mol_type = other DNA
agcgctaccagtaggtccat

SEQ ID NO: 78702 - DNA, 20 bp, synthetic construct
  misc_feature 1..20: note = CRISPR gRNA sequence
  source 1..20: mol_type = other DNA
ccagtaggtccatctggagg

SEQ ID NO: 78703 - DNA, 20 bp, synthetic construct
  misc_feature 1..20: note = CRISPR gRNA sequence
  source 1..20: mol_type = other DNA
gagggactaaatgtgggaga

SEQ ID NO: 78704 - DNA, 20 bp, synthetic construct
  misc_feature 1..20: note = CRISPR gRNA sequence
  source 1..20: mol_type = other DNA
aatgtgggagaagggcaagg

SEQ ID NO: 78705 - DNA, 20 bp, synthetic construct
  misc_feature 1..20: note = CRISPR gRNA sequence
  source 1..20: mol_type = other DNA
ggaggtggctgcgtaaccag

SEQ ID NO: 78706 - DNA, 20 bp, synthetic construct
  misc_feature 1..20: note = CRISPR gRNA sequence
  source 1..20: mol_type = other DNA
cgtaaccaggcgggtgatgg

SEQ ID NO: 78707 - DNA, 20 bp, synthetic construct
  misc_feature 1..20: note = CRISPR gRNA sequence
  source 1..20: mol_type = other DNA
cttctgcaggtgatggcact

SEQ ID NO: 78708 - DNA, 20 bp, synthetic construct
  misc_feature 1..20: note = CRISPR gRNA sequence
  source 1..20: mol_type = other DNA
ctgcaggtgatggcactcgg

SEQ ID NO: 78709 - DNA, 20 bp, synthetic construct
  misc_feature 1..20: note = CRISPR gRNA sequence
  source 1..20: mol_type = other DNA
tgcaggtgatggcactcggg

SEQ ID NO: 78710 - DNA, 20 bp, synthetic construct
  misc_feature 1..20: note = CRISPR gRNA sequence
  source 1..20: mol_type = other DNA
caggtgatggcactcgggga

SEQ ID NO: 78711 - DNA, 20 bp, synthetic construct
  misc_feature 1..20: note = CRISPR gRNA sequence
  source 1..20: mol_type = other DNA
ggggaggggcatgctcagtg

SEQ ID NO: 78712 - DNA, 20 bp, synthetic construct
  misc_feature 1..20: note = CRISPR gRNA sequence
  source 1..20: mol_type = other DNA
agtgctggtgaggcaggtag

SEQ ID NO: 78713 - DNA, 20 bp, synthetic construct
  misc_feature 1..20: note = CRISPR gRNA sequence
  source 1..20: mol_type = other DNA
gtgaggcaggtagaagtgtg

SEQ ID NO: 78714 - DNA, 20 bp, synthetic construct
  misc_feature 1..20: note = CRISPR gRNA sequence
  source 1..20: mol_type = other DNA
gttaaaaaaccaccttctaa

SEQ ID NO: 78715 - DNA, 20 bp, synthetic construct
  misc_feature 1..20: note = CRISPR gRNA sequence
  source 1..20: mol_type = other DNA
ttaaaaaaccaccttctaat

SEQ ID NO: 78716 - DNA, 20 bp, synthetic construct
  misc_feature 1..20: note = CRISPR gRNA sequence
  source 1..20: mol_type = other DNA
aaaaaccaccttctaattct

SEQ ID NO: 78717 - DNA, 20 bp, synthetic construct
  misc_feature 1..20: note = CRISPR gRNA sequence
  source 1..20: mol_type = other DNA
ctaattctgtcctggttctc

SEQ ID NO: 78718 - DNA, 20 bp, synthetic construct
  misc_feature 1..20: note = CRISPR gRNA sequence
  source 1..20: mol_type = other DNA
taattctgtcctggttctcc

SEQ ID NO: 78719 - DNA, 20 bp, synthetic construct
  misc_feature 1..20: note = CRISPR gRNA sequence
  source 1..20: mol_type = other DNA
attctgtcctggttctccca

SEQ ID NO: 78720 - DNA, 20 bp, synthetic construct
  misc_feature 1..20: note = CRISPR gRNA sequence
  source 1..20: mol_type = other DNA
tgtcctggttctcccaatgg

SEQ ID NO: 78721 - DNA, 20 bp, synthetic construct
  misc_feature 1..20: note = CRISPR gRNA sequence
  source 1..20: mol_type = other DNA
tcctggttctcccaatggga

SEQ ID NO: 78722 - DNA, 20 bp, synthetic construct
  misc_feature 1..20: note = CRISPR gRNA sequence
  source 1..20: mol_type = other DNA
gttctcccaatgggacgagg

SEQ ID NO: 78723 - DNA, 20 bp, synthetic construct
  misc_feature 1..20: note = CRISPR gRNA sequence
  source 1..20: mol_type = other DNA
tcccaatgggacgaggtcca

SEQ ID NO: 78724 - DNA, 20 bp, synthetic construct
  misc_feature 1..20: note = CRISPR gRNA sequence
  source 1..20: mol_type = other DNA
ccaatgggacgaggtccagg

SEQ ID NO: 78725 - DNA, 20 bp, synthetic construct
  misc_feature 1..20: note = CRISPR gRNA sequence
  source 1..20: mol_type = other DNA
acccctatccgtcttaccct

SEQ ID NO: 78726 - DNA, 20 bp, synthetic construct
  misc_feature 1..20: note = CRISPR gRNA sequence
  source 1..20: mol_type = other DNA
tccgtcttaccctgaggtgg

SEQ ID NO: 78727 - DNA, 20 bp, synthetic construct
  misc_feature 1..20: note = CRISPR gRNA sequence
  source 1..20: mol_type = other DNA
accctgaggtggggccactc

SEQ ID NO: 78728 - DNA, 20 bp, synthetic construct
  misc_feature 1..20: note = CRISPR gRNA sequence
  source 1..20: mol_type = other DNA
ccctgaggtggggccactcg

SEQ ID NO: 78729 - DNA, 20 bp, synthetic construct
  misc_feature 1..20: note = CRISPR gRNA sequence
  source 1..20: mol_type = other DNA
aggtggggccactcgaccca

SEQ ID NO: 78730 - DNA, 20 bp, synthetic construct
  misc_feature 1..20: note = CRISPR gRNA sequence
  source 1..20: mol_type = other DNA
gacccagaacacatcctggc

SEQ ID NO: 78731 - DNA, 20 bp, synthetic construct
  misc_feature 1..20: note = CRISPR gRNA sequence
  source 1..20: mol_type = other DNA
gcgttccatcatctgccttc

SEQ ID NO: 78732 - DNA, 20 bp, synthetic construct
  misc_feature 1..20: note = CRISPR gRNA sequence
  source 1..20: mol_type = other DNA
catcatctgccttcatgttc

SEQ ID NO: 78733 - DNA, 20 bp, synthetic construct
  misc_feature 1..20: note = CRISPR gRNA sequence
  source 1..20: mol_type = other DNA
ccttcatgttcacttggagg

SEQ ID NO: 78734 - DNA, 20 bp, synthetic construct
  misc_feature 1..20: note = CRISPR gRNA sequence
  source 1..20: mol_type = other DNA
catgttcacttggaggtttc

SEQ ID NO: 78735 - DNA, 20 bp, synthetic construct
  misc_feature 1..20: note = CRISPR gRNA sequence
  source 1..20: mol_type = other DNA
atgttcacttggaggtttcc

SEQ ID NO: 78736 - DNA, 20 bp, synthetic construct
  misc_feature 1..20: note = CRISPR gRNA sequence
  source 1..20: mol_type = other DNA
acttggaggtttcctggagg

SEQ ID NO: 78737 - DNA, 20 bp, synthetic construct
  misc_feature 1..20: note = CRISPR gRNA sequence
  source 1..20: mol_type = other DNA
ggaggtttcctggaggggcg

SEQ ID NO: 78738 - DNA, 20 bp, synthetic construct
  misc_feature 1..20: note = CRISPR gRNA sequence
  source 1..20: mol_type = other DNA
gaggtttcctggaggggcgc

SEQ ID NO: 78739 - DNA, 20 bp, synthetic construct
  misc_feature 1..20: note = CRISPR gRNA sequence
  source 1..20: mol_type = other DNA
cctggaggggcgcccctcct

SEQ ID NO: 78740 - DNA, 20 bp, synthetic construct
  misc_feature 1..20: note = CRISPR gRNA sequence
  source 1..20: mol_type = other DNA
ctggaggggcgcccctccta

SEQ ID NO: 78741 - DNA, 20 bp, synthetic construct
  misc_feature 1..20: note = CRISPR gRNA sequence
  source 1..20: mol_type = other DNA
gaggggcgcccctcctaggg

SEQ ID NO: 78742 - DNA, 20 bp, synthetic construct
  misc_feature 1..20: note = CRISPR gRNA sequence
  source 1..20: mol_type = other DNA
ctagggtcgtgacagagcct

SEQ ID NO: 78743 - DNA, 20 bp, synthetic construct
  misc_feature 1..20: note = CRISPR gRNA sequence
  source 1..20: mol_type = other DNA
gggtcgtgacagagcctccg

SEQ ID NO: 78744 - DNA, 20 bp, synthetic construct
  misc_feature 1..20: note = CRISPR gRNA sequence
  source 1..20: mol_type = other DNA
cgtccatccccaagcactac

SEQ ID NO: 78745 - DNA, 20 bp, synthetic construct
  misc_feature 1..20: note = CRISPR gRNA sequence
  source 1..20: mol_type = other DNA
ctcttattggcttcagccag

SEQ ID NO: 78746 - DNA, 20 bp, synthetic construct
  misc_feature 1..20: note = CRISPR gRNA sequence
  source 1..20: mol_type = other DNA
ttattggcttcagccagggg

SEQ ID NO: 78747 - DNA, 20 bp, synthetic construct
  misc_feature 1..20: note = CRISPR gRNA sequence
  source 1..20: mol_type = other DNA
attggcttcagccaggggct

SEQ ID NO: 78748 - DNA, 20 bp, synthetic construct
  misc_feature 1..20: note = CRISPR gRNA sequence
  source 1..20: mol_type = other DNA
ttggcttcagccaggggctg

SEQ ID NO: 78749 - DNA, 20 bp, synthetic construct
  misc_feature 1..20: note = CRISPR gRNA sequence
  source 1..20: mol_type = other DNA
gcttcagccaggggctggac

SEQ ID NO: 78750 - DNA, 20 bp, synthetic construct
  misc_feature 1..20: note = CRISPR gRNA sequence
  source 1..20: mol_type = other DNA
cagccaggggctggacgcca

SEQ ID NO: 78751 - DNA, 20 bp, synthetic construct
  misc_feature 1..20: note = CRISPR gRNA sequence
  source 1..20: mol_type = other DNA
agccaggggctggacgccat

SEQ ID NO: 78752 - DNA, 20 bp, synthetic construct
  misc_feature 1..20: note = CRISPR gRNA sequence
  source 1..20: mol_type = other DNA
gacgccatgggaatttctcc

SEQ ID NO: 78753 - DNA, 20 bp, synthetic construct
  misc_feature 1..20: note = CRISPR gRNA sequence
  source 1..20: mol_type = other DNA
ctccatcccgaaaagagaag

SEQ ID NO: 78754 - DNA, 20 bp, synthetic construct
  misc_feature 1..20: note = CRISPR gRNA sequence
  source 1..20: mol_type = other DNA
tccatcccgaaaagagaagg

SEQ ID NO: 78755 - DNA, 20 bp, synthetic construct
  misc_feature 1..20: note = CRISPR gRNA sequence
  source 1..20: mol_type = other DNA
catcccgaaaagagaaggtt

SEQ ID NO: 78756 - DNA, 20 bp, synthetic construct
  misc_feature 1..20: note = CRISPR gRNA sequence
  source 1..20: mol_type = other DNA
tcccactctactctgggaga

SEQ ID NO: 78757 - DNA, 20 bp, synthetic construct
  misc_feature 1..20: note = CRISPR gRNA sequence
  source 1..20: mol_type = other DNA
tactctgggagaaggatgaa

SEQ ID NO: 78758 - DNA, 20 bp, synthetic construct
  misc_feature 1..20: note = CRISPR gRNA sequence
  source 1..20: mol_type = other DNA
ctctgggagaaggatgaagg

SEQ ID NO: 78759 - DNA, 20 bp, synthetic construct
  misc_feature 1..20: note = CRISPR gRNA sequence
  source 1..20: mol_type = other DNA
tgggagaaggatgaaggggg

SEQ ID NO: 78760 - DNA, 20 bp, synthetic construct
  misc_feature 1..20: note = CRISPR gRNA sequence
  source 1..20: mol_type = other DNA
ggagaaggatgaagggggtg

SEQ ID NO: 78761 - DNA, 20 bp, synthetic construct
  misc_feature 1..20: note = CRISPR gRNA sequence
  source 1..20: mol_type = other DNA
agggactgtggtttggaagg

SEQ ID NO: 78762 - DNA, 20 bp, synthetic construct
  misc_feature 1..20: note = CRISPR gRNA sequence
  source 1..20: mol_type = other DNA
tggtttggaaggcagaccca

SEQ ID NO: 78763 - DNA, 20 bp, synthetic construct
  misc_feature 1..20: note = CRISPR gRNA sequence
  source 1..20: mol_type = other DNA
ggaaggcagacccaggtgtg

SEQ ID NO: 78764 - DNA, 20 bp, synthetic construct
  misc_feature 1..20: note = CRISPR gRNA sequence
  source 1..20: mol_type = other DNA
gaaggcagacccaggtgtgg

SEQ ID NO: 78765 - DNA, 20 bp, synthetic construct
  misc_feature 1..20: note = CRISPR gRNA sequence
  source 1..20: mol_type = other DNA
ctacttggcagatctcagca

SEQ ID NO: 78766 - DNA, 20 bp, synthetic construct
  misc_feature 1..20: note = CRISPR gRNA sequence
  source 1..20: mol_type = other DNA
tacttggcagatctcagcaa

SEQ ID NO: 78767 - DNA, 20 bp, synthetic construct
  misc_feature 1..20: note = CRISPR gRNA sequence
  source 1..20: mol_type = other DNA
cttggcagatctcagcaaga

SEQ ID NO: 78768 - DNA, 20 bp, synthetic construct
  misc_feature 1..20: note = CRISPR gRNA sequence
  source 1..20: mol_type = other DNA
ggcagatctcagcaagagag

SEQ ID NO: 78769 - DNA, 20 bp, synthetic construct
  misc_feature 1..20: note = CRISPR gRNA sequence
  source 1..20: mol_type = other DNA
gcagatctcagcaagagagg

SEQ ID NO: 78770 - DNA, 20 bp, synthetic construct
  misc_feature 1..20: note = CRISPR gRNA sequence
  source 1..20: mol_type = other DNA
agcaagagaggtagcagtgg

SEQ ID NO: 78771 - DNA, 20 bp, synthetic construct
  misc_feature 1..20: note = CRISPR gRNA sequence
  source 1..20: mol_type = other DNA
tgaggatgaggctgcgagcc

SEQ ID NO: 78772 - DNA, 20 bp, synthetic construct
  misc_feature 1..20: note = CRISPR gRNA sequence
  source 1..20: mol_type = other DNA
cgagccagactgtctgggct

SEQ ID NO: 78773 - DNA, 20 bp, synthetic construct
  misc_feature 1..20: note = CRISPR gRNA sequence
  source 1..20: mol_type = other DNA
tctgggcttgaaccctagcc

SEQ ID NO: 78774 - DNA, 20 bp, synthetic construct
  misc_feature 1..20: note = CRISPR gRNA sequence
  source 1..20: mol_type = other DNA
ggcttgaaccctagcctaga

SEQ ID NO: 78775 - DNA, 20 bp, synthetic construct
  misc_feature 1..20: note = CRISPR gRNA sequence
  source 1..20: mol_type = other DNA
gaaccctagcctagactctt

SEQ ID NO: 78776 - DNA, 20 bp, synthetic construct
  misc_feature 1..20: note = CRISPR gRNA sequence
  source 1..20: mol_type = other DNA
aaccctagcctagactcttc

SEQ ID NO: 78777 - DNA, 20 bp, synthetic construct
  misc_feature 1..20: note = CRISPR gRNA sequence
  source 1..20: mol_type = other DNA
gcctagactcttcctacctg

SEQ ID NO: 78778 - DNA, 20 bp, synthetic construct
  misc_feature 1..20: note = CRISPR gRNA sequence
  source 1..20: mol_type = other DNA
gactcttcctacctgtgtgg

SEQ ID NO: 78779 - DNA, 20 bp, synthetic construct
  misc_feature 1..20: note = CRISPR gRNA sequence
  source 1..20: mol_type = other DNA
ttcctacctgtgtggccttg

SEQ ID NO: 78780 - DNA, 20 bp, synthetic construct
  misc_feature 1..20: note = CRISPR gRNA sequence
  source 1..20: mol_type = other DNA
cctacctgtgtggccttgag

SEQ ID NO: 78781 - DNA, 20 bp, synthetic construct
  misc_feature 1..20: note = CRISPR gRNA sequence
  source 1..20: mol_type = other DNA
ctacctgtgtggccttgagc

SEQ ID NO: 78782 - DNA, 20 bp, synthetic construct
  misc_feature 1..20: note = CRISPR gRNA sequence
  source 1..20: mol_type = other DNA
cctgtgtggccttgagcaag

SEQ ID NO: 78783 - DNA, 20 bp, synthetic construct
  misc_feature 1..20: note = CRISPR gRNA sequence
  source 1..20: mol_type = other DNA
tgtggccttgagcaagttta

SEQ ID NO: 78784 - DNA, 20 bp, synthetic construct
  misc_feature 1..20: note = CRISPR gRNA sequence
  source 1..20: mol_type = other DNA
gagcaagtttatctttctgc

SEQ ID NO: 78785 - DNA, 20 bp, synthetic construct
  misc_feature 1..20: note = CRISPR gRNA sequence
  source 1..20: mol_type = other DNA
agcaagtttatctttctgca

SEQ ID NO: 78786 - DNA, 20 bp, synthetic construct
  misc_feature 1..20: note = CRISPR gRNA sequence
  source 1..20: mol_type = other DNA
atctttctgcagcttaactt

SEQ ID NO: 78787 - DNA, 20 bp, synthetic construct
  misc_feature 1..20: note = CRISPR gRNA sequence
  source 1..20: mol_type = other DNA
tctttctgcagcttaacttc

SEQ ID NO: 78788 - DNA, 20 bp, synthetic construct
  misc_feature 1..20: note = CRISPR gRNA sequence
  source 1..20: mol_type = other DNA
tctgcagcttaacttcctcc

SEQ ID NO: 78789 - DNA, 20 bp, synthetic construct
  misc_feature 1..20: note = CRISPR gRNA sequence
  source 1..20: mol_type = other DNA
ctgcagcttaacttcctcct

SEQ ID NO: 78790 - DNA, 20 bp, synthetic construct
  misc_feature 1..20: note = CRISPR gRNA sequence
  source 1..20: mol_type = other DNA
tgcagcttaacttcctcctc

SEQ ID NO: 78791 - DNA, 20 bp, synthetic construct
  misc_feature 1..20: note = CRISPR gRNA sequence
  source 1..20: mol_type = other DNA
cagcttaacttcctcctcta

SEQ ID NO: 78792 - DNA, 20 bp, synthetic construct
  misc_feature 1..20: note = CRISPR gRNA sequence
  source 1..20: mol_type = other DNA
aacttcctcctctataaaat

SEQ ID NO: 78793 - DNA, 20 bp, synthetic construct
  misc_feature 1..20: note = CRISPR gRNA sequence
  source 1..20: mol_type = other DNA
acttcctcctctataaaatg

SEQ ID NO: 78794 - DNA, 20 bp, synthetic construct
  misc_feature 1..20: note = CRISPR gRNA sequence
  source 1..20: mol_type = other DNA
cctcctctataaaatgagga

SEQ ID NO: 78795 - DNA, 20 bp, synthetic construct
  misc_feature 1..20: note = CRISPR gRNA sequence
  source 1..20: mol_type = other DNA
ctcctctataaaatgaggac

SEQ ID NO: 78796 - DNA, 20 bp, synthetic construct
  misc_feature 1..20: note = CRISPR gRNA sequence
  source 1..20: mol_type = other DNA
ctctataaaatgaggacagt

SEQ ID NO: 78797 - DNA, 20 bp, synthetic construct
  misc_feature 1..20: note = CRISPR gRNA sequence
  source 1..20: mol_type = other DNA
tataaaatgaggacagtaac

SEQ ID NO: 78798 - DNA, 20 bp, synthetic construct
  misc_feature 1..20: note = CRISPR gRNA sequence
  source 1..20: mol_type = other DNA
taaaatgaggacagtaacag

SEQ ID NO: 78799 - DNA, 20 bp, synthetic construct
  misc_feature 1..20: note = CRISPR gRNA sequence
  source 1..20: mol_type = other DNA
acatcacagagatgtgagga

SEQ ID NO: 78800 - DNA, 20 bp, synthetic construct
  misc_feature 1..20: note = CRISPR gRNA sequence
  source 1..20: mol_type = other DNA
catcacagagatgtgaggag

SEQ ID NO: 78801 - DNA, 20 bp, synthetic construct
  misc_feature 1..20: note = CRISPR gRNA sequence
  source 1..20: mol_type = other DNA
gcacagcacctgacccggga

SEQ ID NO: 78802 - DNA, 20 bp, synthetic construct
  misc_feature 1..20: note = CRISPR gRNA sequence
  source 1..20: mol_type = other DNA
acccgggacaagtgctgaat

SEQ ID NO: 78803 - DNA, 20 bp, synthetic construct
  misc_feature 1..20: note = CRISPR gRNA sequence
  source 1..20: mol_type = other DNA
aatagtagcagctgttacaa

SEQ ID NO: 78804 - DNA, 20 bp, synthetic construct
  misc_feature 1..20: note = CRISPR gRNA sequence
  source 1..20: mol_type = other DNA
ttacaatgatctgattcccc

SEQ ID NO: 78805 - DNA, 20 bp, synthetic construct
  misc_feature 1..20: note = CRISPR gRNA sequence
  source 1..20: mol_type = other DNA
caatgatctgattcccccaa

SEQ ID NO: 78806 - DNA, 20 bp, synthetic construct
  misc_feature 1..20: note = CRISPR gRNA sequence
  source 1..20: mol_type = other DNA
attcccccaaattcttcatg

SEQ ID NO: 78807 - DNA, 20 bp, synthetic construct
  misc_feature 1..20: note = CRISPR gRNA sequence
  source 1..20: mol_type = other DNA
ccccaaattcttcatgaggc

SEQ ID NO: 78808 - DNA, 20 bp, synthetic construct
  misc_feature 1..20: note = CRISPR gRNA sequence
  source 1..20: mol_type = other DNA
ttcatgaggcagcatgcccc

SEQ ID NO: 78809 - DNA, 20 bp, synthetic construct
  misc_feature 1..20: note = CRISPR gRNA sequence
  source 1..20: mol_type = other DNA
catgaggcagcatgcccctc

SEQ ID NO: 78810 - DNA, 20 bp, synthetic construct
  misc_feature 1..20: note = CRISPR gRNA sequence
  source 1..20: mol_type = other DNA
atgaggcagcatgcccctcc

SEQ ID NO: 78811 - DNA, 20 bp, synthetic construct
  misc_feature 1..20: note = CRISPR gRNA sequence
  source 1..20: mol_type = other DNA
ccccacaccacccacccaaa

SEQ ID NO: 78812 - DNA, 20 bp, synthetic construct
  misc_feature 1..20: note = CRISPR gRNA sequence
  source 1..20: mol_type = other DNA
cccaccctctccaacctcct

SEQ ID NO: 78813 - DNA, 20 bp, synthetic construct
  misc_feature 1..20: note = CRISPR gRNA sequence
  source 1..20: mol_type = other DNA
tccaacctcctttcctggct

SEQ ID NO: 78814 - DNA, 20 bp, synthetic construct
  misc_feature 1..20: note = CRISPR gRNA sequence
  source 1..20: mol_type = other DNA
caacctcctttcctggctcc

SEQ ID NO: 78815 - DNA, 20 bp, synthetic construct
  misc_feature 1..20: note = CRISPR gRNA sequence
  source 1..20: mol_type = other DNA
ctttcctggctcctacgcca

SEQ ID NO: 78816 - DNA, 20 bp, synthetic construct
  misc_feature 1..20: note = CRISPR gRNA sequence
  source 1..20: mol_type = other DNA
tcctggctcctacgccaggg

SEQ ID NO: 78817 - DNA, 20 bp, synthetic construct
  misc_feature 1..20: note = CRISPR gRNA sequence
  source 1..20: mol_type = other DNA
cctggctcctacgccagggc

SEQ ID NO: 78818 - DNA, 20 bp, synthetic construct
  misc_feature 1..20: note = CRISPR gRNA sequence
  source 1..20: mol_type = other DNA
ctggctcctacgccagggct

SEQ ID NO: 78819 - DNA, 20 bp, synthetic construct
  misc_feature 1..20: note = CRISPR gRNA sequence
  source 1..20: mol_type = other DNA
gctcctacgccagggcttcc

SEQ ID NO: 78820 - DNA, 20 bp, synthetic construct
  misc_feature 1..20: note = CRISPR gRNA sequence
  source 1..20: mol_type = other DNA
ctacgccagggcttcccgtg

SEQ ID NO: 78821 - DNA, 20 bp, synthetic construct
  misc_feature 1..20: note = CRISPR gRNA sequence
  source 1..20: mol_type = other DNA
cgccagggcttcccgtgata

SEQ ID NO: 78822 - DNA, 20 bp, synthetic construct
  misc_feature 1..20: note = CRISPR gRNA sequence
  source 1..20: mol_type = other DNA
cccgtgatactcactccact

SEQ ID NO: 78823 - DNA, 20 bp, synthetic construct
  misc_feature 1..20: note = CRISPR gRNA sequence
  source 1..20: mol_type = other DNA
ccgtgatactcactccactt

SEQ ID NO: 78824 - DNA, 20 bp, synthetic construct
  misc_feature 1..20: note = CRISPR gRNA sequence
  source 1..20: mol_type = other DNA
actccacttcctccaggtga

SEQ ID NO: 78825 - DNA, 20 bp, synthetic construct
  misc_feature 1..20: note = CRISPR gRNA sequence
  source 1..20: mol_type = other DNA
cacttcctccaggtgagggc

SEQ ID NO: 78826 - DNA, 20 bp, synthetic construct
  misc_feature 1..20: note = CRISPR gRNA sequence
  source 1..20: mol_type = other DNA
cctccaggtgagggccttcc

SEQ ID NO: 78827 - DNA, 20 bp, synthetic construct
  misc_feature 1..20: note = CRISPR gRNA sequence
  source 1..20: mol_type = other DNA
ctccaggtgagggccttcct

SEQ ID NO: 78828 - DNA, 20 bp, synthetic construct
  misc_feature 1..20: note = CRISPR gRNA sequence
  source 1..20: mol_type = other DNA
caggtgagggccttcctgga

SEQ ID NO: 78829 - DNA, 20 bp, synthetic construct
  misc_feature 1..20: note = CRISPR gRNA sequence
  source 1..20: mol_type = other DNA
cctggagcagggctatgagg

SEQ ID NO: 78830 - DNA, 20 bp, synthetic construct
  misc_feature 1..20: note = CRISPR gRNA sequence
  source 1..20: mol_type = other DNA
ctggagcagggctatgaggg

SEQ ID NO: 78831 - DNA, 20 bp, synthetic construct
  misc_feature 1..20: note = CRISPR gRNA sequence
  source 1..20: mol_type = other DNA
gagcagggctatgagggcct

SEQ ID NO: 78832 - DNA, 20 bp, synthetic construct
  misc_feature 1..20: note = CRISPR gRNA sequence
  source 1..20: mol_type = other DNA
tgagggcctccgcatcgtgg

SEQ ID NO: 78833 - DNA, 20 bp, synthetic construct
  misc_feature 1..20: note = CRISPR gRNA sequence
  source 1..20: mol_type = other DNA
cgcatcgtggacctggagct

SEQ ID NO: 78834 - DNA, 20 bp, synthetic construct
  misc_feature 1..20: note = CRISPR gRNA sequence
  source 1..20: mol_type = other DNA
gagctgacacttctgcagcc

SEQ ID NO: 78835 - DNA, 20 bp, synthetic construct
  misc_feature 1..20: note = CRISPR gRNA sequence
  source 1..20: mol_type = other DNA
acacttctgcagccttgggt

SEQ ID NO: 78836 - DNA, 20 bp, synthetic construct
  misc_feature 1..20: note = CRISPR gRNA sequence
  source 1..20: mol_type = other DNA
ctgcagccttgggtaggagt

SEQ ID NO: 78837 - DNA, 20 bp, synthetic construct
  misc_feature 1..20: note = CRISPR gRNA sequence
  source 1..20: mol_type = other DNA
tgcagccttgggtaggagtg

SEQ ID NO: 78838 - DNA, 20 bp, synthetic construct
  misc_feature 1..20: note = CRISPR gRNA sequence
  source 1..20: mol_type = other DNA
cagccttgggtaggagtggg

SEQ ID NO: 78839 - DNA, 20 bp, synthetic construct
  misc_feature 1..20: note = CRISPR gRNA sequence
  source 1..20: mol_type = other DNA
gggtaggagtgggggacaga

SEQ ID NO: 78840 - DNA, 20 bp, synthetic construct
  misc_feature 1..20: note = CRISPR gRNA sequence
  source 1..20: mol_type = other DNA
ggtaggagtgggggacagaa

SEQ ID NO: 78841 - DNA, 20 bp, synthetic construct
  misc_feature 1..20: note = CRISPR gRNA sequence
  source 1..20: mol_type = other DNA
agggcaaacagcccctactc

SEQ ID NO: 78842 - DNA, 20 bp, synthetic construct
  misc_feature 1..20: note = CRISPR gRNA sequence
  source 1..20: mol_type = other DNA
ctccatggcccctccagctt

SEQ ID NO: 78843 - DNA, 20 bp, synthetic construct
  misc_feature 1..20: note = CRISPR gRNA sequence
  source 1..20: mol_type = other DNA
catggcccctccagcttcca

SEQ ID NO: 78844 - DNA, 20 bp, synthetic construct
  misc_feature 1..20: note = CRISPR gRNA sequence
  source 1..20: mol_type = other DNA
cagcttccaatgctggggga

SEQ ID NO: 78845 - DNA, 20 bp, synthetic construct
  misc_feature 1..20: note = CRISPR gRNA sequence
  source 1..20: mol_type = other DNA
ccaatgctgggggagtcagg

SEQ ID NO: 78846 - DNA, 20 bp, synthetic construct
  misc_feature 1..20: note = CRISPR gRNA sequence
  source 1..20: mol_type = other DNA
caatgctgggggagtcaggg

SEQ ID NO: 78847 - DNA, 20 bp, synthetic construct
  misc_feature 1..20: note = CRISPR gRNA sequence
  source 1..20: mol_type = other DNA
ggggagtcagggggcccaca

SEQ ID NO: 78848 - DNA, 20 bp, synthetic construct
  misc_feature 1..20: note = CRISPR gRNA sequence
  source 1..20: mol_type = other DNA
ggtctaatcctagccacacc

SEQ ID NO: 78849 - DNA, 20 bp, synthetic construct
  misc_feature 1..20: note = CRISPR gRNA sequence
  source 1..20: mol_type = other DNA
atcctagccacacctcttag

SEQ ID NO: 78850 - DNA, 20 bp, synthetic construct
  misc_feature 1..20: note = CRISPR gRNA sequence
  source 1..20: mol_type = other DNA
gccacacctcttagtagctg

SEQ ID NO: 78851 - DNA, 20 bp, synthetic construct
  misc_feature 1..20: note = CRISPR gRNA sequence
  source 1..20: mol_type = other DNA
ttagtagctgggtgatcttg

SEQ ID NO: 78852 - DNA, 20 bp, synthetic construct
  misc_feature 1..20: note = CRISPR gRNA sequence
  source 1..20: mol_type = other DNA
agtagctgggtgatcttgag

SEQ ID NO: 78853 - DNA, 20 bp, synthetic construct
  misc_feature 1..20: note = CRISPR gRNA sequence
  source 1..20: mol_type = other DNA
gtagctgggtgatcttgagc

SEQ ID NO: 78854 - DNA, 20 bp, synthetic construct
  misc_feature 1..20: note = CRISPR gRNA sequence
  source 1..20: mol_type = other DNA
ggtgatcttgagcaagggac

SEQ ID NO: 78855 - DNA, 20 bp, synthetic construct
  misc_feature 1..20: note = CRISPR gRNA sequence
  source 1..20: mol_type = other DNA
gagcaagggacttaacctgt

SEQ ID NO: 78856 - DNA, 20 bp, synthetic construct
  misc_feature 1..20: note = CRISPR gRNA sequence
  source 1..20: mol_type = other DNA
agcaagggacttaacctgtc

SEQ ID NO: 78857 - DNA, 20 bp, synthetic construct
  misc_feature 1..20: note = CRISPR gRNA sequence
  source 1..20: mol_type = other DNA
aacctgtctgagactcagtt

SEQ ID NO: 78858 - DNA, 20 bp, synthetic construct
  misc_feature 1..20: note = CRISPR gRNA sequence
  source 1..20: mol_type = other DNA
acctgtctgagactcagttt

SEQ ID NO: 78859 - DNA, 20 bp, synthetic construct
  misc_feature 1..20: note = CRISPR gRNA sequence
  source 1..20: mol_type = other DNA
tctgagactcagtttcctcc

SEQ ID NO: 78860 - DNA, 20 bp, synthetic construct
  misc_feature 1..20: note = CRISPR gRNA sequence
  source 1..20: mol_type = other DNA
agactcagtttcctcctccc

SEQ ID NO: 78861 - DNA, 20 bp, synthetic construct
  misc_feature 1..20: note = CRISPR gRNA sequence
  source 1..20: mol_type = other DNA
agtttcctcctccctcaaag

SEQ ID NO: 78862 - DNA, 20 bp, synthetic construct
  misc_feature 1..20: note = CRISPR gRNA sequence
  source 1..20: mol_type = other DNA
cctcctccctcaaaggggaa

SEQ ID NO: 78863 - DNA, 20 bp, synthetic construct
  misc_feature 1..20: note = CRISPR gRNA sequence
  source 1..20: mol_type = other DNA
ctcctccctcaaaggggaat

SEQ ID NO: 78864 - DNA, 20 bp, synthetic construct
  misc_feature 1..20: note = CRISPR gRNA sequence
  source 1..20: mol_type = other DNA
ctccctcaaaggggaataat

SEQ ID NO: 78865 - DNA, 20 bp, synthetic construct
  misc_feature 1..20: note = CRISPR gRNA sequence
  source 1..20: mol_type = other DNA
cctcaaaggggaataataat

SEQ ID NO: 78866 - DNA, 20 bp, synthetic construct
  misc_feature 1..20: note = CRISPR gRNA sequence
  source 1..20: mol_type = other DNA
aaaggggaataataatgtgt

SEQ ID NO: 78867 - DNA, 20 bp, synthetic construct
  misc_feature 1..20: note = CRISPR gRNA sequence
  source 1..20: mol_type = other DNA
cacagagattctaaaggaat

SEQ ID NO: 78868 - DNA, 20 bp, synthetic construct
  misc_feature 1..20: note = CRISPR gRNA sequence
  source 1..20: mol_type = other DNA
acagagattctaaaggaatt

SEQ ID NO: 78869 - DNA, 20 bp, synthetic construct
  misc_feature 1..20: note = CRISPR gRNA sequence
  source 1..20: mol_type = other DNA
taaaggaattacagtgaggt

SEQ ID NO: 78870 - DNA, 20 bp, synthetic construct
  misc_feature 1..20: note = CRISPR gRNA sequence
  source 1..20: mol_type = other DNA
aaggaattacagtgaggtaa

SEQ ID NO: 78871 - DNA, 20 bp, synthetic construct
  misc_feature 1..20: note = CRISPR gRNA sequence
  source 1..20: mol_type = other DNA
cagtgaggtaatggatgtaa

SEQ ID NO: 78872 - DNA, 20 bp, synthetic construct
  misc_feature 1..20: note = CRISPR gRNA sequence
  source 1..20: mol_type = other DNA
gtgcaatgcccggcatatag

SEQ ID NO: 78873 - DNA, 20 bp, synthetic construct
  misc_feature 1..20: note = CRISPR gRNA sequence
  source 1..20: mol_type = other DNA
cattaagttgcagctattgt

SEQ ID NO: 78874 - DNA, 20 bp, synthetic construct
  misc_feature 1..20: note = CRISPR gRNA sequence
  source 1..20: mol_type = other DNA
agttgcagctattgttatta

SEQ ID NO: 78875 - DNA, 20 bp, synthetic construct
  misc_feature 1..20: note = CRISPR gRNA sequence
  source 1..20: mol_type = other DNA
cagctattgttattatgaca

SEQ ID NO: 78876 - DNA, 20 bp, synthetic construct
  misc_feature 1..20: note = CRISPR gRNA sequence
  source 1..20: mol_type = other DNA
ttgttattatgacagatgct

SEQ ID NO: 78877 - DNA, 20 bp, synthetic construct
  misc_feature 1..20: note = CRISPR gRNA sequence
  source 1..20: mol_type = other DNA
ttattatgacagatgctcct

SEQ ID NO: 78878 - DNA, 20 bp, synthetic construct
  misc_feature 1..20: note = CRISPR gRNA sequence
  source 1..20: mol_type = other DNA
ttatgacagatgctccttat

SEQ ID NO: 78879 - DNA, 20 bp, synthetic construct
  misc_feature 1..20: note = CRISPR gRNA sequence
  source 1..20: mol_type = other DNA
tgacagatgctccttattca

SEQ ID NO: 78880 - DNA, 20 bp, synthetic construct
  misc_feature 1..20: note = CRISPR gRNA sequence
  source 1..20: mol_type = other DNA
cttattcaagccaggatggg

SEQ ID NO: 78881 - DNA, 20 bp, synthetic construct
  misc_feature 1..20: note = CRISPR gRNA sequence
  source 1..20: mol_type = other DNA
attcaagccaggatgggcta

SEQ ID NO: 78882 - DNA, 20 bp, synthetic construct
  misc_feature 1..20: note = CRISPR gRNA sequence
  source 1..20: mol_type = other DNA
ttcaagccaggatgggctat

SEQ ID NO: 78883 - DNA, 20 bp, synthetic construct
  misc_feature 1..20: note = CRISPR gRNA sequence
  source 1..20: mol_type = other DNA
aagccaggatgggctatcca

SEQ ID NO: 78884 - DNA, 20 bp, synthetic construct
  misc_feature 1..20: note = CRISPR gRNA sequence
  source 1..20: mol_type = other DNA
tccaggatgggcaccacacc

SEQ ID NO: 78885 - DNA, 20 bp, synthetic construct
  misc_feature 1..20: note = CRISPR gRNA sequence
  source 1..20: mol_type = other DNA
atcctttccctgtccctcat

SEQ ID NO: 78886 - DNA, 20 bp, synthetic construct
  misc_feature 1..20: note = CRISPR gRNA sequence
  source 1..20: mol_type = other DNA
tccctgtccctcatctgctt

SEQ ID NO: 78887 - DNA, 20 bp, synthetic construct
  misc_feature 1..20: note = CRISPR gRNA sequence
  source 1..20: mol_type = other DNA
ccctgtccctcatctgcttt

SEQ ID NO: 78888 - DNA, 20 bp, synthetic construct
  misc_feature 1..20: note = CRISPR gRNA sequence
  source 1..20: mol_type = other DNA
cctgtccctcatctgctttt

SEQ ID NO: 78889 - DNA, 20 bp, synthetic construct
  misc_feature 1..20: note = CRISPR gRNA sequence
  source 1..20: mol_type = other DNA
tccctcatctgcttttccct

SEQ ID NO: 78890 - DNA, 20 bp, synthetic construct
  misc_feature 1..20: note = CRISPR gRNA sequence
  source 1..20: mol_type = other DNA
atctgcttttccctttatcc

SEQ ID NO: 78891 - DNA, 20 bp, synthetic construct
  misc_feature 1..20: note = CRISPR gRNA sequence
  source 1..20: mol_type = other DNA
cttttccctttatcctccct

SEQ ID NO: 78892 - DNA, 20 bp, synthetic construct
  misc_feature 1..20: note = CRISPR gRNA sequence
  source 1..20: mol_type = other DNA
ttccctttatcctccctgcc

SEQ ID NO: 78893 - DNA, 20 bp, synthetic construct
  misc_feature 1..20: note = CRISPR gRNA sequence
  source 1..20: mol_type = other DNA
tccctttatcctccctgccc

SEQ ID NO: 78894 - DNA, 20 bp, synthetic construct
  misc_feature 1..20: note = CRISPR gRNA sequence
  source 1..20: mol_type = other DNA
ccctttatcctccctgcccc

SEQ ID NO: 78895 - DNA, 20 bp, synthetic construct
  misc_feature 1..20: note = CRISPR gRNA sequence
  source 1..20: mol_type = other DNA
cctttatcctccctgcccct

SEQ ID NO: 78896 - DNA, 20 bp, synthetic construct
  misc_feature 1..20: note = CRISPR gRNA sequence
  source 1..20: mol_type = other DNA
tatcctccctgcccctgctc

SEQ ID NO: 78897 - DNA, 20 bp, synthetic construct
  misc_feature 1..20: note = CRISPR gRNA sequence
  source 1..20: mol_type = other DNA
atcctccctgcccctgctct

SEQ ID NO: 78898 - DNA, 20 bp, synthetic construct
  misc_feature 1..20: note = CRISPR gRNA sequence
  source 1..20: mol_type = other DNA
tcctccctgcccctgctctc

SEQ ID NO: 78899 - DNA, 20 bp, synthetic construct
  misc_feature 1..20: note = CRISPR gRNA sequence
  source 1..20: mol_type = other DNA
cctgcccctgctctcccttg

SEQ ID NO: 78900 - DNA, 20 bp, synthetic construct
  misc_feature 1..20: note = CRISPR gRNA sequence
  source 1..20: mol_type = other DNA
cccctgctctcccttgcctc

SEQ ID NO: 78901 - DNA, 20 bp, synthetic construct
  misc_feature 1..20: note = CRISPR gRNA sequence
  source 1..20: mol_type = other DNA
ctctcccttgcctcggactt

SEQ ID NO: 78902 - DNA, 20 bp, synthetic construct
  misc_feature 1..20: note = CRISPR gRNA sequence
  source 1..20: mol_type = other DNA
tcccttgcctcggactttcc

SEQ ID NO: 78903 - DNA, 20 bp, synthetic construct
  misc_feature 1..20: note = CRISPR gRNA sequence
  source 1..20: mol_type = other DNA
ccttgcctcggactttcccc

SEQ ID NO: 78904 - DNA, 20 bp, synthetic construct
  misc_feature 1..20: note = CRISPR gRNA sequence
  source 1..20: mol_type = other DNA
gcctcggactttcccccata

SEQ ID NO: 78905 - DNA, 20 bp, synthetic construct
  misc_feature 1..20: note = CRISPR gRNA sequence
  source 1..20: mol_type = other DNA
cctcggactttcccccatat

SEQ ID NO: 78906 - DNA, 20 bp, synthetic construct
  misc_feature 1..20: note = CRISPR gRNA sequence
  source 1..20: mol_type = other DNA
ggactttcccccatatcata

SEQ ID NO: 78907 - DNA, 20 bp, synthetic construct
  misc_feature 1..20: note = CRISPR gRNA sequence
  source 1..20: mol_type = other DNA
tcccccatatcatatccctc

SEQ ID NO: 78908 - DNA, 20 bp, synthetic construct
  misc_feature 1..20: note = CRISPR gRNA sequence
  source 1..20: mol_type = other DNA
cccccatatcatatccctct

SEQ ID NO: 78909 - DNA, 20 bp, synthetic construct
  misc_feature 1..20: note = CRISPR gRNA sequence
  source 1..20: mol_type = other DNA
ccccatatcatatccctctc

SEQ ID NO: 78910 - DNA, 20 bp, synthetic construct
  misc_feature 1..20: note = CRISPR gRNA sequence
  source 1..20: mol_type = other DNA
tcctaaggcaatagatccct

SEQ ID NO: 78911 - DNA, 20 bp, synthetic construct
  misc_feature 1..20: note = CRISPR gRNA sequence
  source 1..20: mol_type = other DNA
ctaaggcaatagatccctcc

SEQ ID NO: 78912 - DNA, 20 bp, synthetic construct
  misc_feature 1..20: note = CRISPR gRNA sequence
  source 1..20: mol_type = other DNA
aggcaatagatccctccaag

SEQ ID NO: 78913 - DNA, 20 bp, synthetic construct
  misc_feature 1..20: note = CRISPR gRNA sequence
  source 1..20: mol_type = other DNA
caaggtacctgagcgtcaag

SEQ ID NO: 78914 - DNA, 20 bp, synthetic construct
  misc_feature 1..20: note = CRISPR gRNA sequence
  source 1..20: mol_type = other DNA
agcgtcaagcttctgctctg

SEQ ID NO: 78915 - DNA, 20 bp, synthetic construct
  misc_feature 1..20: note = CRISPR gRNA sequence
  source 1..20: mol_type = other DNA
ctgctctgagcccctttcct

SEQ ID NO: 78916 - DNA, 20 bp, synthetic construct
  misc_feature 1..20: note = CRISPR gRNA sequence
  source 1..20: mol_type = other DNA
tgctctgagcccctttcctc

SEQ ID NO: 78917 - DNA, 20 bp, synthetic construct
  misc_feature 1..20: note = CRISPR gRNA sequence
  source 1..20: mol_type = other DNA
ctctgagcccctttcctctg

SEQ ID NO: 78918 - DNA, 20 bp, synthetic construct
  misc_feature 1..20: note = CRISPR gRNA sequence
  source 1..20: mol_type = other DNA
tgagcccctttcctctggcc

SEQ ID NO: 78919 - DNA, 20 bp, synthetic construct
  misc_feature 1..20: note = CRISPR gRNA sequence
  source 1..20: mol_type = other DNA
agcccctttcctctggccgt

SEQ ID NO: 78920 - DNA, 20 bp, synthetic construct
  misc_feature 1..20: note = CRISPR gRNA sequence
  source 1..20: mol_type = other DNA
tcctctggccgtcactttcc

SEQ ID NO: 78921 - DNA, 20 bp, synthetic construct
  misc_feature 1..20: note = CRISPR gRNA sequence
  source 1..20: mol_type = other DNA
cctctggccgtcactttcct

SEQ ID NO: 78922 - DNA, 20 bp, synthetic construct
  misc_feature 1..20: note = CRISPR gRNA sequence
  source 1..20: mol_type = other DNA
ctctggccgtcactttcctg

SEQ ID NO: 78923 - DNA, 20 bp, synthetic construct
  misc_feature 1..20: note = CRISPR gRNA sequence
  source 1..20: mol_type = other DNA
tggccgtcactttcctgcag

SEQ ID NO: 78924 - DNA, 20 bp, synthetic construct
  misc_feature 1..20: note = CRISPR gRNA sequence
  source 1..20: mol_type = other DNA
gccgtcactttcctgcaggt

SEQ ID NO: 78925 - DNA, 20 bp, synthetic construct
  misc_feature 1..20: note = CRISPR gRNA sequence
  source 1..20: mol_type = other DNA
tcctgcaggtctggagctct

SEQ ID NO: 78926 - DNA, 20 bp, synthetic construct
  misc_feature 1..20: note = CRISPR gRNA sequence
  source 1..20: mol_type = other DNA
cctgcaggtctggagctctg

SEQ ID NO: 78927 - DNA, 20 bp, synthetic construct
  misc_feature 1..20: note = CRISPR gRNA sequence
  source 1..20: mol_type = other DNA
ctgcaggtctggagctctgg

SEQ ID NO: 78928 - DNA, 20 bp, synthetic construct
  misc_feature 1..20: note = CRISPR gRNA sequence
  source 1..20: mol_type = other DNA
caggtctggagctctggcaa

SEQ ID NO: 78929 - DNA, 20 bp, synthetic construct
  misc_feature 1..20: note = CRISPR gRNA sequence
  source 1..20: mol_type = other DNA
gagctctggcaagaacaaat

SEQ ID NO: 78930 - DNA, 20 bp, synthetic construct
  misc_feature 1..20: note = CRISPR gRNA sequence
  source 1..20: mol_type = other DNA
tggcaagaacaaatcaagca

SEQ ID NO: 78931 - DNA, 20 bp, synthetic construct
  misc_feature 1..20: note = CRISPR gRNA sequence
  source 1..20: mol_type = other DNA
gcaagaacaaatcaagcatt

SEQ ID NO: 78932 - DNA, 20 bp, synthetic construct
  misc_feature 1..20: note = CRISPR gRNA sequence
  source 1..20: mol_type = other DNA
gcctgggctcaggcatctag

SEQ ID NO: 78933 - DNA, 20 bp, synthetic construct
  misc_feature 1..20: note = CRISPR gRNA sequence
  source 1..20: mol_type = other DNA
ggctcaggcatctagggcct

SEQ ID NO: 78934 - DNA, 20 bp, synthetic construct
  misc_feature 1..20: note = CRISPR gRNA sequence
  source 1..20: mol_type = other DNA
aggcatctagggcctggtgg

SEQ ID NO: 78935 - DNA, 20 bp, synthetic construct
  misc_feature 1..20: note = CRISPR gRNA sequence
  source 1..20: mol_type = other DNA
gggcctggtggatcaagcct

SEQ ID NO: 78936 - DNA, 20 bp, synthetic construct
  misc_feature 1..20: note = CRISPR gRNA sequence
  source 1..20: mol_type = other DNA
gtggatcaagcctctttcct

SEQ ID NO: 78937 - DNA, 20 bp, synthetic construct
  misc_feature 1..20: note = CRISPR gRNA sequence
  source 1..20: mol_type = other DNA
tttccttggcttctagaggc

SEQ ID NO: 78938 - DNA, 20 bp, synthetic construct
  misc_feature 1..20: note = CRISPR gRNA sequence
  source 1..20: mol_type = other DNA
tccttggcttctagaggctg

SEQ ID NO: 78939 - DNA, 20 bp, synthetic construct
  misc_feature 1..20: note = CRISPR gRNA sequence
  source 1..20: mol_type = other DNA
ccttggcttctagaggctga

SEQ ID NO: 78940 - DNA, 20 bp, synthetic construct
  misc_feature 1..20: note = CRISPR gRNA sequence
  source 1..20: mol_type = other DNA
cttggcttctagaggctgaa

SEQ ID NO: 78941 - DNA, 20 bp, synthetic construct
  misc_feature 1..20: note = CRISPR gRNA sequence
  source 1..20: mol_type = other DNA
ggcttctagaggctgaagac

SEQ ID NO: 78942 - DNA, 20 bp, synthetic construct
  misc_feature 1..20: note = CRISPR gRNA sequence
  source 1..20: mol_type = other DNA
gcttctagaggctgaagacc

SEQ ID NO: 78943 - DNA, 20 bp, synthetic construct
  misc_feature 1..20: note = CRISPR gRNA sequence
  source 1..20: mol_type = other DNA
ctagaggctgaagaccctga

SEQ ID NO: 78944 - DNA, 20 bp, synthetic construct
  misc_feature 1..20: note = CRISPR gRNA sequence
  source 1..20: mol_type = other DNA
tagaggctgaagaccctgaa

SEQ ID NO: 78945 - DNA, 20 bp, synthetic construct
  misc_feature 1..20: note = CRISPR gRNA sequence
  source 1..20: mol_type = other DNA
gaggctgaagaccctgaagc

SEQ ID NO: 78946 - DNA, 20 bp, synthetic construct
  misc_feature 1..20: note = CRISPR gRNA sequence
  source 1..20: mol_type = other DNA
aagaccctgaagcacaaccc

SEQ ID NO: 78947 - DNA, 20 bp, synthetic construct
  misc_feature 1..20: note = CRISPR gRNA sequence
  source 1..20: mol_type = other DNA
aagcacaacccaaagtgagt

SEQ ID NO: 78948 - DNA, 20 bp, synthetic construct
  misc_feature 1..20: note = CRISPR gRNA sequence
  source 1..20: mol_type = other DNA
cttgcagatgctcaagatgt

SEQ ID NO: 78949 - DNA, 20 bp, synthetic construct
  misc_feature 1..20: note = CRISPR gRNA sequence
  source 1..20: mol_type = other DNA
gcagatgctcaagatgtgat

SEQ ID NO: 78950 - DNA, 20 bp, synthetic construct
  misc_feature 1..20: note = CRISPR gRNA sequence
  source 1..20: mol_type = other DNA
cagatgctcaagatgtgatt

SEQ ID NO: 78951 - DNA, 20 bp, synthetic construct
  misc_feature 1..20: note = CRISPR gRNA sequence
  source 1..20: mol_type = other DNA
aagatgtgattcagcagagc

SEQ ID NO: 78952 - DNA, 20 bp, synthetic construct
  misc_feature 1..20: note = CRISPR gRNA sequence
  source 1..20: mol_type = other DNA
agcagagcaggaggggcaac

SEQ ID NO: 78953 - DNA, 20 bp, synthetic construct
  misc_feature 1..20: note = CRISPR gRNA sequence
  source 1..20: mol_type = other DNA
gaggtcaaatggaaccttta

SEQ ID NO: 78954 - DNA, 20 bp, synthetic construct
  misc_feature 1..20: note = CRISPR gRNA sequence
  source 1..20: mol_type = other DNA
aggtcaaatggaacctttat

SEQ ID NO: 78955 - DNA, 20 bp, synthetic construct
  misc_feature 1..20: note = CRISPR gRNA sequence
  source 1..20: mol_type = other DNA
tattcaaattttggctctgc

SEQ ID NO: 78956 - DNA, 20 bp, synthetic construct
  misc_feature 1..20: note = CRISPR gRNA sequence
  source 1..20: mol_type = other DNA
attcaaattttggctctgcc

SEQ ID NO: 78957 - DNA, 20 bp, synthetic construct
  misc_feature 1..20: note = CRISPR gRNA sequence
  source 1..20: mol_type = other DNA
ttcaaattttggctctgcca

SEQ ID NO: 78958 - DNA, 20 bp, synthetic construct
  misc_feature 1..20: note = CRISPR gRNA sequence
  source 1..20: mol_type = other DNA
aaattttggctctgccatgt

SEQ ID NO: 78959 - DNA, 20 bp, synthetic construct
  misc_feature 1..20: note = CRISPR gRNA sequence
  source 1..20: mol_type = other DNA
tggctctgccatgtatagcc

SEQ ID NO: 78960 - DNA, 20 bp, synthetic construct
  misc_feature 1..20: note = CRISPR gRNA sequence
  source 1..20: mol_type = other DNA
ggctctgccatgtatagcca

SEQ ID NO: 78961 - DNA, 20 bp, synthetic construct
  misc_feature 1..20: note = CRISPR gRNA sequence
  source 1..20: mol_type = other DNA
gctctgccatgtatagccat

SEQ ID NO: 78962 - DNA, 20 bp, synthetic construct
  misc_feature 1..20: note = CRISPR gRNA sequence
  source 1..20: mol_type = other DNA
tgccatgtatagccatgtgg

SEQ ID NO: 78963 - DNA, 20 bp, synthetic construct
  misc_feature 1..20: note = CRISPR gRNA sequence
  source 1..20: mol_type = other DNA
ccatgtatagccatgtggcc

SEQ ID NO: 78964 - DNA, 20 bp, synthetic construct
  misc_feature 1..20: note = CRISPR gRNA sequence
  source 1..20: mol_type = other DNA
gggcaaatcactgcagtcgg

SEQ ID NO: 78965 - DNA, 20 bp, synthetic construct
  misc_feature 1..20: note = CRISPR gRNA sequence
  source 1..20: mol_type = other DNA
ggcaaatcactgcagtcggc

SEQ ID NO: 78966 - DNA, 20 bp, synthetic construct
  misc_feature 1..20: note = CRISPR gRNA sequence
  source 1..20: mol_type = other DNA
cagtcggctcccttttctct

SEQ ID NO: 78967 - DNA, 20 bp, synthetic construct
  misc_feature 1..20: note = CRISPR gRNA sequence
  source 1..20: mol_type = other DNA
ccttttctcttttctaaaac

SEQ ID NO: 78968 - DNA, 20 bp, synthetic construct
  misc_feature 1..20: note = CRISPR gRNA sequence
  source 1..20: mol_type = other DNA
ttctcttttctaaaacggat

SEQ ID NO: 78969 - DNA, 20 bp, synthetic construct
  misc_feature 1..20: note = CRISPR gRNA sequence
  source 1..20: mol_type = other DNA
tctcttttctaaaacggatg

SEQ ID NO: 78970 - DNA, 20 bp, synthetic construct
  misc_feature 1..20: note = CRISPR gRNA sequence
  source 1..20: mol_type = other DNA
ctcttttctaaaacggatga

SEQ ID NO: 78971 - DNA, 20 bp, synthetic construct
  misc_feature 1..20: note = CRISPR gRNA sequence
  source 1..20: mol_type = other DNA
tcttttctaaaacggatgac

SEQ ID NO: 78972 - DNA, 20 bp, synthetic construct
  misc_feature 1..20: note = CRISPR gRNA sequence
  source 1..20: mol_type = other DNA
ttttctaaaacggatgacaa

SEQ ID NO: 78973 - DNA, 20 bp, synthetic construct
  misc_feature 1..20: note = CRISPR gRNA sequence
  source 1..20: mol_type = other DNA
ttctaaaacggatgacaaca

SEQ ID NO: 78974 - DNA, 20 bp, synthetic construct
  misc_feature 1..20: note = CRISPR gRNA sequence
  source 1..20: mol_type = other DNA
tctaaaacggatgacaacat

SEQ ID NO: 78975 - DNA, 20 bp, synthetic construct
  misc_feature 1..20: note = CRISPR gRNA sequence
  source 1..20: mol_type = other DNA
ctaaaacggatgacaacatc

SEQ ID NO: 78976 - DNA, 20 bp, synthetic construct
  misc_feature 1..20: note = CRISPR gRNA sequence
  source 1..20: mol_type = other DNA
taaaacggatgacaacatct

SEQ ID NO: 78977 - DNA, 20 bp, synthetic construct
  misc_feature 1..20: note = CRISPR gRNA sequence
  source 1..20: mol_type = other DNA
aaacggatgacaacatctag

SEQ ID NO: 78978 - DNA, 20 bp, synthetic construct
  misc_feature 1..20: note = CRISPR gRNA sequence
  source 1..20: mol_type = other DNA
gcacataggtacctgaagga

SEQ ID NO: 78979 - DNA, 20 bp, synthetic construct
  misc_feature 1..20: note = CRISPR gRNA sequence
  source 1..20: mol_type = other DNA
aaggattgaatgagacaatg

SEQ ID NO: 78980 - DNA, 20 bp, synthetic construct
  misc_feature 1..20: note = CRISPR gRNA sequence
  source 1..20: mol_type = other DNA
aatgagacaatgtatgtcca

SEQ ID NO: 78981 - DNA, 20 bp, synthetic construct
  misc_feature 1..20: note = CRISPR gRNA sequence
  source 1..20: mol_type = other DNA
gtaaacagaagctgctattg

SEQ ID NO: 78982 - DNA, 20 bp, synthetic construct
  misc_feature 1..20: note = CRISPR gRNA sequence
  source 1..20: mol_type = other DNA
ctattgtcgatgatgtgatg

SEQ ID NO: 78983 - DNA, 20 bp, synthetic construct
  misc_feature 1..20: note = CRISPR gRNA sequence
  source 1..20: mol_type = other DNA
ttgtcgatgatgtgatggtc

SEQ ID NO: 78984 - DNA, 20 bp, synthetic construct
  misc_feature 1..20: note = CRISPR gRNA sequence
  source 1..20: mol_type = other DNA
tcgatgatgtgatggtctcc

SEQ ID NO: 78985 - DNA, 20 bp, synthetic construct
  misc_feature 1..20: note = CRISPR gRNA sequence
  source 1..20: mol_type = other DNA
catttgtggatgtgctgtct

SEQ ID NO: 78986 - DNA, 20 bp, synthetic construct
  misc_feature 1..20: note = CRISPR gRNA sequence
  source 1..20: mol_type = other DNA
gtggatgtgctgtctgtggt

SEQ ID NO: 78987 - DNA, 20 bp, synthetic construct
  misc_feature 1..20: note = CRISPR gRNA sequence
  source 1..20: mol_type = other DNA
tggatgtgctgtctgtggtt

SEQ ID NO: 78988 - DNA, 20 bp, synthetic construct
  misc_feature 1..20: note = CRISPR gRNA sequence
  source 1..20: mol_type = other DNA
tctgtggttcagaaggcgag

SEQ ID NO: 78989 - DNA, 20 bp, synthetic construct
  misc_feature 1..20: note = CRISPR gRNA sequence
  source 1..20: mol_type = other DNA
tggttcagaaggcgaggagc

SEQ ID NO: 78990 - DNA, 20 bp, synthetic construct
  misc_feature 1..20: note = CRISPR gRNA sequence
  source 1..20: mol_type = other DNA
agaaggcgaggagcatgagc

SEQ ID NO: 78991 - DNA, 20 bp, synthetic construct
  misc_feature 1..20: note = CRISPR gRNA sequence
  source 1..20: mol_type = other DNA
tatgcagtgagtccaggcta

SEQ ID NO: 78992 - DNA, 20 bp, synthetic construct
  misc_feature 1..20: note = CRISPR gRNA sequence
  source 1..20: mol_type = other DNA
tggtaaaccacagactctct

SEQ ID NO: 78993 - DNA, 20 bp, synthetic construct
  misc_feature 1..20: note = CRISPR gRNA sequence
  source 1..20: mol_type = other DNA
tctcccactgggctgaggga

SEQ ID NO: 78994 - DNA, 20 bp, synthetic construct
  misc_feature 1..20: note = CRISPR gRNA sequence
  source 1..20: mol_type = other DNA
tcccactgggctgagggagc

SEQ ID NO: 78995 - DNA, 20 bp, synthetic construct
  misc_feature 1..20: note = CRISPR gRNA sequence
  source 1..20: mol_type = other DNA
ccactgggctgagggagcgt

SEQ ID NO: 78996 - DNA, 20 bp, synthetic construct
  misc_feature 1..20: note = CRISPR gRNA sequence
  source 1..20: mol_type = other DNA
ggctgagggagcgttagggg

SEQ ID NO: 78997 - DNA, 20 bp, synthetic construct
  misc_feature 1..20: note = CRISPR gRNA sequence
  source 1..20: mol_type = other DNA
agggagcgttaggggatgca

SEQ ID NO: 78998 - DNA, 20 bp, synthetic construct
  misc_feature 1..20: note = CRISPR gRNA sequence
  source 1..20: mol_type = other DNA
ggggatgcagggaagctagg

SEQ ID NO: 78999 - DNA, 20 bp, synthetic construct
  misc_feature 1..20: note = CRISPR gRNA sequence
  source 1..20: mol_type = other DNA
ggacatcatgagccaggttt

SEQ ID NO: 79000 - DNA, 20 bp, synthetic construct
  misc_feature 1..20: note = CRISPR gRNA sequence
  source 1..20: mol_type = other DNA
cacagactttttggattggt

SEQ ID NO: 79001 - DNA, 20 bp, synthetic construct
  misc_feature 1..20: note = CRISPR gRNA sequence
  source 1..20: mol_type = other DNA
acagactttttggattggtg

SEQ ID NO: 79002 - DNA, 20 bp, synthetic construct
  misc_feature 1..20: note = CRISPR gRNA sequence
  source 1..20: mol_type = other DNA
tttggattggtgctaaccat

SEQ ID NO: 79003 - DNA, 20 bp, synthetic construct
  misc_feature 1..20: note = CRISPR gRNA sequence
  source 1..20: mol_type = other DNA
ttggattggtgctaaccatt

SEQ ID NO: 79004 - DNA, 20 bp, synthetic construct
  misc_feature 1..20: note = CRISPR gRNA sequence
  source 1..20: mol_type = other DNA
tggattggtgctaaccattt

SEQ ID NO: 79005 - DNA, 20 bp, synthetic construct
  misc_feature 1..20: note = CRISPR gRNA sequence
  source 1..20: mol_type = other DNA
ggattggtgctaaccatttt

SEQ ID NO: 79006 - DNA, 20 bp, synthetic construct
  misc_feature 1..20: note = CRISPR gRNA sequence
  source 1..20: mol_type = other DNA
gattggtgctaaccattttt

SEQ ID NO: 79007 - DNA, 20 bp, synthetic construct
  misc_feature 1..20: note = CRISPR gRNA sequence
  source 1..20: mol_type = other DNA
gtgctaaccatttttttttt

SEQ ID NO: 79008 - DNA, 20 bp, synthetic construct
  misc_feature 1..20: note = CRISPR gRNA sequence
  source 1..20: mol_type = other DNA
accatttttttttttttaga

SEQ ID NO: 79009 - DNA, 20 bp, synthetic construct
  misc_feature 1..20: note = CRISPR gRNA sequence
  source 1..20: mol_type = other DNA
ttttttttttagagacaggg

SEQ ID NO: 79010 - DNA, 20 bp, synthetic construct
  misc_feature 1..20: note = CRISPR gRNA sequence
  source 1..20: mol_type = other DNA
tttttttttagagacagggt

SEQ ID NO: 79011 - DNA, 20 bp, synthetic construct
  misc_feature 1..20: note = CRISPR gRNA sequence
  source 1..20: mol_type = other DNA
ttttttttagagacagggtc

SEQ ID NO: 79012 - DNA, 20 bp, synthetic construct
  misc_feature 1..20: note = CRISPR gRNA sequence
  source 1..20: mol_type = other DNA
tttttttagagacagggtcc

SEQ ID NO: 79013 - DNA, 20 bp, synthetic construct
  misc_feature 1..20: note = CRISPR gRNA sequence
  source 1..20: mol_type = other DNA
ttttttagagacagggtccc

SEQ ID NO: 79014 - DNA, 20 bp, synthetic construct
  misc_feature 1..20: note = CRISPR gRNA sequence
  source 1..20: mol_type = other DNA
tttttagagacagggtccca

SEQ ID NO: 79015 - DNA, 20 bp, synthetic construct
  misc_feature 1..20: note = CRISPR gRNA sequence
  source 1..20: mol_type = other DNA
ttttagagacagggtcccac

SEQ ID NO: 79016 - DNA, 20 bp, synthetic construct
  misc_feature 1..20: note = CRISPR gRNA sequence
  source 1..20: mol_type = other DNA
tttagagacagggtcccact

SEQ ID NO: 79017 - DNA, 20 bp, synthetic construct
  misc_feature 1..20: note = CRISPR gRNA sequence
  source 1..20: mol_type = other DNA
ttagagacagggtcccactc

SEQ ID NO: 79018 - DNA, 20 bp, synthetic construct
  misc_feature 1..20: note = CRISPR gRNA sequence
  source 1..20: mol_type = other DNA
tagagacagggtcccactca

SEQ ID NO: 79019 - DNA, 20 bp, synthetic construct
  misc_feature 1..20: note = CRISPR gRNA sequence
  source 1..20: mol_type = other DNA
agagacagggtcccactcag

SEQ ID NO: 79020 - DNA, 20 bp, synthetic construct
  misc_feature 1..20: note = CRISPR gRNA sequence
  source 1..20: mol_type = other DNA
gagacagggtcccactcagt

SEQ ID NO: 79021 - DNA, 20 bp, synthetic construct
  misc_feature 1..20: note = CRISPR gRNA sequence
  source 1..20: mol_type = other DNA
agtccccaagctggagtgca

SEQ ID NO: 79022 - DNA, 20 bp, synthetic construct
  misc_feature 1..20: note = CRISPR gRNA sequence
  source 1..20: mol_type = other DNA
gagtgcagtggctctatccc

SEQ ID NO: 79023 - DNA, 20 bp, synthetic construct
  misc_feature 1..20: note = CRISPR gRNA sequence
  source 1..20: mol_type = other DNA
tatcccagttcactgcagcc

SEQ ID NO: 79024 - DNA, 20 bp, synthetic construct
  misc_feature 1..20: note = CRISPR gRNA sequence
  source 1..20: mol_type = other DNA
tcccagttcactgcagcctc

SEQ ID NO: 79025 - DNA, 20 bp, synthetic construct
  misc_feature 1..20: note = CRISPR gRNA sequence
  source 1..20: mol_type = other DNA
actgcagcctcaaactcctg

SEQ ID NO: 79026 - DNA, 20 bp, synthetic construct
  misc_feature 1..20: note = CRISPR gRNA sequence
  source 1..20: mol_type = other DNA
cagcctcaaactcctgggct

SEQ ID NO: 79027 - DNA, 20 bp, synthetic construct
  misc_feature 1..20: note = CRISPR gRNA sequence
  source 1..20: mol_type = other DNA
aaactcctgggctcaagtga

SEQ ID NO: 79028 - DNA, 20 bp, synthetic construct
  misc_feature 1..20: note = CRISPR gRNA sequence
  source 1..20: mol_type = other DNA
ctgggctcaagtgatcctcc

SEQ ID NO: 79029 - DNA, 20 bp, synthetic construct
  misc_feature 1..20: note = CRISPR gRNA sequence
  source 1..20: mol_type = other DNA
ggctcaagtgatcctcccac

SEQ ID NO: 79030 - DNA, 20 bp, synthetic construct
  misc_feature 1..20: note = CRISPR gRNA sequence
  source 1..20: mol_type = other DNA
aagtgatcctcccaccttgg

SEQ ID NO: 79031 - DNA, 20 bp, synthetic construct
  misc_feature 1..20: note = CRISPR gRNA sequence
  source 1..20: mol_type = other DNA
ccaccttggcttcctgagta

SEQ ID NO: 79032 - DNA, 20 bp, synthetic construct
  misc_feature 1..20: note = CRISPR gRNA sequence
  source 1..20: mol_type = other DNA
ggcttcctgagtaactggta

SEQ ID NO: 79033 - DNA, 20 bp, synthetic construct
  misc_feature 1..20: note = CRISPR gRNA sequence
  source 1..20: mol_type = other DNA
gcttcctgagtaactggtac

SEQ ID NO: 79034 - DNA, 20 bp, synthetic construct
  misc_feature 1..20: note = CRISPR gRNA sequence
  source 1..20: mol_type = other DNA
cctgagtaactggtactata

SEQ ID NO: 79035 - DNA, 20 bp, synthetic construct
  misc_feature 1..20: note = CRISPR gRNA sequence
  source 1..20: mol_type = other DNA
ctgagtaactggtactatag

SEQ ID NO: 79036 - DNA, 20 bp, synthetic construct
  misc_feature 1..20: note = CRISPR gRNA sequence
  source 1..20: mol_type = other DNA
agtaactggtactataggag

SEQ ID NO: 79037 - DNA, 20 bp, synthetic construct
  misc_feature 1..20: note = CRISPR gRNA sequence
  source 1..20: mol_type = other DNA
gtactataggagtgaatcac

SEQ ID NO: 79038 - DNA, 20 bp, synthetic construct
  misc_feature 1..20: note = CRISPR gRNA sequence
  source 1..20: mol_type = other DNA
taggagtgaatcaccatgcc

SEQ ID NO: 79039 - DNA, 20 bp, synthetic construct
  misc_feature 1..20: note = CRISPR gRNA sequence
  source 1..20: mol_type = other DNA
ttttttttttttttttgtag

SEQ ID NO: 79040 - DNA, 20 bp, synthetic construct
  misc_feature 1..20: note = CRISPR gRNA sequence
  source 1..20: mol_type = other DNA
tttttttttttttgtagaga

SEQ ID NO: 79041 - DNA, 20 bp, synthetic construct
  misc_feature 1..20: note = CRISPR gRNA sequence
  source 1..20: mol_type = other DNA
ttttttttttttgtagagat

SEQ ID NO: 79042 - DNA, 20 bp, synthetic construct
  misc_feature 1..20: note = CRISPR gRNA sequence
  source 1..20: mol_type = other DNA
tttttttttttgtagagatg

SEQ ID NO: 79043 - DNA, 20 bp, synthetic construct
  misc_feature 1..20: note = CRISPR gRNA sequence
  source 1..20: mol_type = other DNA
ttttttttttgtagagatgg

SEQ ID NO: 79044 - DNA, 20 bp, synthetic construct
  misc_feature 1..20: note = CRISPR gRNA sequence
  source 1..20: mol_type = other DNA
tttttttttgtagagatggg

SEQ ID NO: 79045 - DNA, 20 bp, synthetic construct
  misc_feature 1..20: note = CRISPR gRNA sequence
  source 1..20: mol_type = other DNA
ttttttttgtagagatgggg

SEQ ID NO: 79046 - DNA, 20 bp, synthetic construct
  misc_feature 1..20: note = CRISPR gRNA sequence
  source 1..20: mol_type = other DNA
tttttttgtagagatggggg

SEQ ID NO: 79047 - DNA, 20 bp, synthetic construct
  misc_feature 1..20: note = CRISPR gRNA sequence
  source 1..20: mol_type = other DNA
ttttttgtagagatgggggt

SEQ ID NO: 79048 - DNA, 20 bp, synthetic construct
  misc_feature 1..20: note = CRISPR gRNA sequence
  source 1..20: mol_type = other DNA
tttttgtagagatgggggtc

SEQ ID NO: 79049 - DNA, 20 bp, synthetic construct
  misc_feature 1..20: note = CRISPR gRNA sequence
  source 1..20: mol_type = other DNA
ttttgtagagatgggggtct

SEQ ID NO: 79050 - DNA, 20 bp, synthetic construct
  misc_feature 1..20: note = CRISPR gRNA sequence
  source 1..20: mol_type = other DNA
tttgtagagatgggggtctc

SEQ ID NO: 79051 - DNA, 20 bp, synthetic construct
  misc_feature 1..20: note = CRISPR gRNA sequence
  source 1..20: mol_type = other DNA
ttgtagagatgggggtctca

SEQ ID NO: 79052 - DNA, 20 bp, synthetic construct
  misc_feature 1..20: note = CRISPR gRNA sequence
  source 1..20: mol_type = other DNA
tgtagagatgggggtctcac

SEQ ID NO: 79053 - DNA, 20 bp, synthetic construct
  misc_feature 1..20: note = CRISPR gRNA sequence
  source 1..20: mol_type = other DNA
gtagagatgggggtctcact

SEQ ID NO: 79054 - DNA, 20 bp, synthetic construct
  misc_feature 1..20: note = CRISPR gRNA sequence
  source 1..20: mol_type = other DNA
tagagatgggggtctcactt

SEQ ID NO: 79055 - DNA, 20 bp, synthetic construct
  misc_feature 1..20: note = CRISPR gRNA sequence
  source 1..20: mol_type = other DNA
actttgttgcccaggctggt

SEQ ID NO: 79056 - DNA, 20 bp, synthetic construct
  misc_feature 1..20: note = CRISPR gRNA sequence
  source 1..20: mol_type = other DNA
tgttgcccaggctggtcttg

SEQ ID NO: 79057 - DNA, 20 bp, synthetic construct
  misc_feature 1..20: note = CRISPR gRNA sequence
  source 1..20: mol_type = other DNA
gttgcccaggctggtcttga

SEQ ID NO: 79058 - DNA, 20 bp, synthetic construct
  misc_feature 1..20: note = CRISPR gRNA sequence
  source 1..20: mol_type = other DNA
ttgcccaggctggtcttgaa

SEQ ID NO: 79059 - DNA, 20 bp, synthetic construct
  misc_feature 1..20: note = CRISPR gRNA sequence
  source 1..20: mol_type = other DNA
cccaggctggtcttgaactc

SEQ ID NO: 79060 - DNA, 20 bp, synthetic construct
  misc_feature 1..20: note = CRISPR gRNA sequence
  source 1..20: mol_type = other DNA
gtcttgaactcctagcttca

SEQ ID NO: 79061 - DNA, 20 bp, synthetic construct
  misc_feature 1..20: note = CRISPR gRNA sequence
  source 1..20: mol_type = other DNA
gaactcctagcttcaagcga

SEQ ID NO: 79062 - DNA, 20 bp, synthetic construct
  misc_feature 1..20: note = CRISPR gRNA sequence
  source 1..20: mol_type = other DNA
aactcctagcttcaagcgat

SEQ ID NO: 79063 - DNA, 20 bp, synthetic construct
  misc_feature 1..20: note = CRISPR gRNA sequence
  source 1..20: mol_type = other DNA
ctagcttcaagcgatcctgc

SEQ ID NO: 79064 - DNA, 20 bp, synthetic construct
  misc_feature 1..20: note = CRISPR gRNA sequence
  source 1..20: mol_type = other DNA
gcttcaagcgatcctgcccc

SEQ ID NO: 79065 - DNA, 20 bp, synthetic construct
  misc_feature 1..20: note = CRISPR gRNA sequence
  source 1..20: mol_type = other DNA
caagcgatcctgccccctca

SEQ ID NO: 79066 - DNA, 20 bp, synthetic construct
  misc_feature 1..20: note = CRISPR gRNA sequence
  source 1..20: mol_type = other DNA
aagcgatcctgccccctcag

SEQ ID NO: 79067 - DNA, 20 bp, synthetic construct
  misc_feature 1..20: note = CRISPR gRNA sequence
  source 1..20: mol_type = other DNA
ccccctcagcctctcaaagt

SEQ ID NO: 79068 - DNA, 20 bp, synthetic construct
  misc_feature 1..20: note = CRISPR gRNA sequence
  source 1..20: mol_type = other DNA
agcctctcaaagtgctgggg

SEQ ID NO: 79069 - DNA, 20 bp, synthetic construct
  misc_feature 1..20: note = CRISPR gRNA sequence
  source 1..20: mol_type = other DNA
tcaaagtgctggggttacag

SEQ ID NO: 79070 - DNA, 20 bp, synthetic construct
  misc_feature 1..20: note = CRISPR gRNA sequence
  source 1..20: mol_type = other DNA
aaagtgctggggttacagac

SEQ ID NO: 79071 - DNA, 20 bp, synthetic construct
  misc_feature 1..20: note = CRISPR gRNA sequence
  source 1..20: mol_type = other DNA
gggttacagacatgagccac

SEQ ID NO: 79072 - DNA, 20 bp, synthetic construct
  misc_feature 1..20: note = CRISPR gRNA sequence
  source 1..20: mol_type = other DNA
cagacatgagccaccatgcc

SEQ ID NO: 79073 - DNA, 20 bp, synthetic construct
  misc_feature 1..20: note = CRISPR gRNA sequence
  source 1..20: mol_type = other DNA
tttaatagaactttctgcaa

SEQ ID NO: 79074 - DNA, 20 bp, synthetic construct
  misc_feature 1..20: note = CRISPR gRNA sequence
  source 1..20: mol_type = other DNA
aatagaactttctgcaatga

SEQ ID NO: 79075 - DNA, 20 bp, synthetic construct
  misc_feature 1..20: note = CRISPR gRNA sequence
  source 1..20: mol_type = other DNA
atagaactttctgcaatgat

SEQ ID NO: 79076 - DNA, 20 bp, synthetic construct
  misc_feature 1..20: note = CRISPR gRNA sequence
  source 1..20: mol_type = other DNA
tctgcaatgatggaaatgtc

SEQ ID NO: 79077 - DNA, 20 bp, synthetic construct
  misc_feature 1..20: note = CRISPR gRNA sequence
  source 1..20: mol_type = other DNA
ctgcaatgatggaaatgtcc

SEQ ID NO: 79078 - DNA, 20 bp, synthetic construct
  misc_feature 1..20: note = CRISPR gRNA sequence
  source 1..20: mol_type = other DNA
tgcaatgatggaaatgtcct

SEQ ID NO: 79079 - DNA, 20 bp, synthetic construct
  misc_feature 1..20: note = CRISPR gRNA sequence
  source 1..20: mol_type = other DNA
caatgatggaaatgtcctgg

SEQ ID NO: 79080 - DNA, 20 bp, synthetic construct
  misc_feature 1..20: note = CRISPR gRNA sequence
  source 1..20: mol_type = other DNA
gcatctgtaccacttgctat

SEQ ID NO: 79081 - DNA, 20 bp, synthetic construct
  misc_feature 1..20: note = CRISPR gRNA sequence
  source 1..20: mol_type = other DNA
taccacttgctatgggagcc

SEQ ID NO: 79082 - DNA, 20 bp, synthetic construct
  misc_feature 1..20: note = CRISPR gRNA sequence
  source 1..20: mol_type = other DNA
gctatgggagccactagcca

SEQ ID NO: 79083 - DNA, 20 bp, synthetic construct
  misc_feature 1..20: note = CRISPR gRNA sequence
  source 1..20: mol_type = other DNA
ctatgggagccactagccac

SEQ ID NO: 79084 - DNA, 20 bp, synthetic construct
  misc_feature 1..20: note = CRISPR gRNA sequence
  source 1..20: mol_type = other DNA
tgggagccactagccaccta

SEQ ID NO: 79085 - DNA, 20 bp, synthetic construct
  misc_feature 1..20: note = CRISPR gRNA sequence
  source 1..20: mol_type = other DNA
gccacctatggccactgagc

SEQ ID NO: 79086 - DNA, 20 bp, synthetic construct
  misc_feature 1..20: note = CRISPR gRNA sequence
  source 1..20: mol_type = other DNA
tggccactgagcagttgaaa

SEQ ID NO: 79087 - DNA, 20 bp, synthetic construct
  misc_feature 1..20: note = CRISPR gRNA sequence
  source 1..20: mol_type = other DNA
agcagttgaaatatagctaa

SEQ ID NO: 79088 - DNA, 20 bp, synthetic construct
  misc_feature 1..20: note = CRISPR gRNA sequence
  source 1..20: mol_type = other DNA
aaatatagctaatgtgacta

SEQ ID NO: 79089 - DNA, 20 bp, synthetic construct
  misc_feature 1..20: note = CRISPR gRNA sequence
  source 1..20: mol_type = other DNA
atgtgactaatgaactgaaa

SEQ ID NO: 79090 - DNA, 20 bp, synthetic construct
  misc_feature 1..20: note = CRISPR gRNA sequence
  source 1..20: mol_type = other DNA
atgaactgaaaatttcattt

SEQ ID NO: 79091 - DNA, 20 bp, synthetic construct
  misc_feature 1..20: note = CRISPR gRNA sequence
  source 1..20: mol_type = other DNA
aaaatttcattttacttaat

SEQ ID NO: 79092 - DNA, 20 bp, synthetic construct
  misc_feature 1..20: note = CRISPR gRNA sequence
  source 1..20: mol_type = other DNA
cattttacttaattttaatt

SEQ ID NO: 79093 - DNA, 20 bp, synthetic construct
  misc_feature 1..20: note = CRISPR gRNA sequence
  source 1..20: mol_type = other DNA
attttacttaattttaattt

SEQ ID NO: 79094 - DNA, 20 bp, synthetic construct
  misc_feature 1..20: note = CRISPR gRNA sequence
  source 1..20: mol_type = other DNA
tacttaattttaatttattt

SEQ ID NO: 79095 - DNA, 20 bp, synthetic construct
  misc_feature 1..20: note = CRISPR gRNA sequence
  source 1..20: mol_type = other DNA
acttaattttaatttattta

SEQ ID NO: 79096 - DNA, 20 bp, synthetic construct
  misc_feature 1..20: note = CRISPR gRNA sequence
  source 1..20: mol_type = other DNA
cttaattttaatttatttaa

SEQ ID NO: 79097 - DNA, 20 bp, synthetic construct
  misc_feature 1..20: note = CRISPR gRNA sequence
  source 1..20: mol_type = other DNA
aattttaatttatttaaatt

SEQ ID NO: 79098 - DNA, 20 bp, synthetic construct
  misc_feature 1..20: note = CRISPR gRNA sequence
  source 1..20: mol_type = other DNA
attttaatttatttaaatta

SEQ ID NO: 79099 - DNA, 20 bp, synthetic construct
  misc_feature 1..20: note = CRISPR gRNA sequence
  source 1..20: mol_type = other DNA
taatttatttaaattaaaat

SEQ ID NO: 79100 - DNA, 20 bp, synthetic construct
  misc_feature 1..20: note = CRISPR gRNA sequence
  source 1..20: mol_type = other DNA
aatttatttaaattaaaata

SEQ ID NO: 79101 - DNA, 20 bp, synthetic construct
  misc_feature 1..20: note = CRISPR gRNA sequence
  source 1..20: mol_type = other DNA
atttatttaaattaaaatag

SEQ ID NO: 79102 - DNA, 20 bp, synthetic construct
  misc_feature 1..20: note = CRISPR gRNA sequence
  source 1..20: mol_type = other DNA
atttaaattaaaatagcatt

SEQ ID NO: 79103 - DNA, 20 bp, synthetic construct
  misc_feature 1..20: note = CRISPR gRNA sequence
  source 1..20: mol_type = other DNA
tttaaattaaaatagcatta

SEQ ID NO: 79104 - DNA, 20 bp, synthetic construct
  misc_feature 1..20: note = CRISPR gRNA sequence
  source 1..20: mol_type = other DNA
aaattaaaatagcattaaaa

SEQ ID NO: 79105 - DNA, 20 bp, synthetic construct
  misc_feature 1..20: note = CRISPR gRNA sequence
  source 1..20: mol_type = other DNA
aattaaaatagcattaaaat

SEQ ID NO: 79106 - DNA, 20 bp, synthetic construct
  misc_feature 1..20: note = CRISPR gRNA sequence
  source 1..20: mol_type = other DNA
aaatagcattaaaattttaa

SEQ ID NO: 79107 - DNA, 20 bp, synthetic construct
  misc_feature 1..20: note = CRISPR gRNA sequence
  source 1..20: mol_type = other DNA
aaattttaatttatttaaat

SEQ ID NO: 79108 - DNA, 20 bp, synthetic construct
  misc_feature 1..20: note = CRISPR gRNA sequence
  source 1..20: mol_type = other DNA
taatttatttaaattgaaat

SEQ ID NO: 79109 - DNA, 20 bp, synthetic construct
  misc_feature 1..20: note = CRISPR gRNA sequence
  source 1..20: mol_type = other DNA
aatttatttaaattgaaata

SEQ ID NO: 79110 - DNA, 20 bp, synthetic construct
  misc_feature 1..20: note = CRISPR gRNA sequence
  source 1..20: mol_type = other DNA
atttatttaaattgaaatag

SEQ ID NO: 79111 - DNA, 20 bp, synthetic construct
  misc_feature 1..20: note = CRISPR gRNA sequence
  source 1..20: mol_type = other DNA
atttaaattgaaatagcatt

SEQ ID NO: 79112 - DNA, 20 bp, synthetic construct
  misc_feature 1..20: note = CRISPR gRNA sequence
  source 1..20: mol_type = other DNA
tttaaattgaaatagcatta

SEQ ID NO: 79113 - DNA, 20 bp, synthetic construct
  misc_feature 1..20: note = CRISPR gRNA sequence
  source 1..20: mol_type = other DNA
aaattgaaatagcattaaaa

SEQ ID NO: 79114 - DNA, 20 bp, synthetic construct
  misc_feature 1..20: note = CRISPR gRNA sequence
  source 1..20: mol_type = other DNA
aattgaaatagcattaaaat

SEQ ID NO: 79115 - DNA, 20 bp, synthetic construct
  misc_feature 1..20: note = CRISPR gRNA sequence
  source 1..20: mol_type = other DNA
aaatagcattaaaattttaa

SEQ ID NO: 79116 - DNA, 20 bp, synthetic construct
  misc_feature 1..20: note = CRISPR gRNA sequence
  source 1..20: mol_type = other DNA
aaattttaatttatttaaat

SEQ ID NO: 79117 - DNA, 20 bp, synthetic construct
  misc_feature 1..20: note = CRISPR gRNA sequence
  source 1..20: mol_type = other DNA
taatttatttaaattgaaat

SEQ ID NO: 79118 - DNA, 20 bp, synthetic construct
  misc_feature 1..20: note = CRISPR gRNA sequence
  source 1..20: mol_type = other DNA
aatttatttaaattgaaata

SEQ ID NO: 79119 - DNA, 20 bp, synthetic construct
  misc_feature 1..20: note = CRISPR gRNA sequence
  source 1..20: mol_type = other DNA
atttatttaaattgaaatag

SEQ ID NO: 79120 - DNA, 20 bp, synthetic construct
  misc_feature 1..20: note = CRISPR gRNA sequence
  source 1..20: mol_type = other DNA
atttaaattgaaatagccat

SEQ ID NO: 79121 - DNA, 20 bp, synthetic construct
  misc_feature 1..20: note = CRISPR gRNA sequence
  source 1..20: mol_type = other DNA
tttaaattgaaatagccata

SEQ ID NO: 79122 - DNA, 20 bp, synthetic construct
  misc_feature 1..20: note = CRISPR gRNA sequence
  source 1..20: mol_type = other DNA
aaattgaaatagccatatgg

SEQ ID NO: 79123 - DNA, 20 bp, synthetic construct
  misc_feature 1..20: note = CRISPR gRNA sequence
  source 1..20: mol_type = other DNA
aattgaaatagccatatggg

SEQ ID NO: 79124 - DNA, 20 bp, synthetic construct
  misc_feature 1..20: note = CRISPR gRNA sequence
  source 1..20: mol_type = other DNA
aaatagccatatggggctag

SEQ ID NO: 79125 - DNA, 20 bp, synthetic construct
  misc_feature 1..20: note = CRISPR gRNA sequence
  source 1..20: mol_type = other DNA
gtggctatcctactgagcat

SEQ ID NO: 79126 - DNA, 20 bp, synthetic construct
  misc_feature 1..20: note = CRISPR gRNA sequence
  source 1..20: mol_type = other DNA
tcctactgagcatcacagct

SEQ ID NO: 79127 - DNA, 20 bp, synthetic construct
  misc_feature 1..20: note = CRISPR gRNA sequence
  source 1..20: mol_type = other DNA
ctgagcatcacagctttaag

SEQ ID NO: 79128 - DNA, 20 bp, synthetic construct
  misc_feature 1..20: note = CRISPR gRNA sequence
  source 1..20: mol_type = other DNA
agcatcacagctttaagcag

SEQ ID NO: 79129 - DNA, 20 bp, synthetic construct
  misc_feature 1..20: note = CRISPR gRNA sequence
  source 1..20: mol_type = other DNA
taagcagttagagggaaaag

SEQ ID NO: 79130 - DNA, 20 bp, synthetic construct
  misc_feature 1..20: note = CRISPR gRNA sequence
  source 1..20: mol_type = other DNA
aagcagttagagggaaaaga

SEQ ID NO: 79131 - DNA, 20 bp, synthetic construct
  misc_feature 1..20: note = CRISPR gRNA sequence
  source 1..20: mol_type = other DNA
agcagttagagggaaaagaa

SEQ ID NO: 79132 - DNA, 20 bp, synthetic construct
  misc_feature 1..20: note = CRISPR gRNA sequence
  source 1..20: mol_type = other DNA
gagggaaaagaaagtgacac

SEQ ID NO: 79133 - DNA, 20 bp, synthetic construct
  misc_feature 1..20: note = CRISPR gRNA sequence
  source 1..20: mol_type = other DNA
gtcctagtgggtcatttttt

SEQ ID NO: 79134 - DNA, 20 bp, synthetic construct
  misc_feature 1..20: note = CRISPR gRNA sequence
  source 1..20: mol_type = other DNA
gtgggtcattttttgagaca

SEQ ID NO: 79135 - DNA, 20 bp, synthetic construct
  misc_feature 1..20: note = CRISPR gRNA sequence
  source 1..20: mol_type = other DNA
tttgagacagagtccctctc

SEQ ID NO: 79136 - DNA, 20 bp, synthetic construct
  misc_feature 1..20: note = CRISPR gRNA sequence
  source 1..20: mol_type = other DNA
ttgagacagagtccctctct

SEQ ID NO: 79137 - DNA, 20 bp, synthetic construct
  misc_feature 1..20: note = CRISPR gRNA sequence
  source 1..20: mol_type = other DNA
tgagacagagtccctctctg

SEQ ID NO: 79138 - DNA, 20 bp, synthetic construct
  misc_feature 1..20: note = CRISPR gRNA sequence
  source 1..20: mol_type = other DNA
gagacagagtccctctctgt

SEQ ID NO: 79139 - DNA, 20 bp, synthetic construct
  misc_feature 1..20: note = CRISPR gRNA sequence
  source 1..20: mol_type = other DNA
agacagagtccctctctgtc

SEQ ID NO: 79140 - DNA, 20 bp, synthetic construct
  misc_feature 1..20: note = CRISPR gRNA sequence
  source 1..20: mol_type = other DNA
tctgtcacccaggctggagt

SEQ ID NO: 79141 - DNA, 20 bp, synthetic construct
  misc_feature 1..20: note = CRISPR gRNA sequence
  source 1..20: mol_type = other DNA
tgtcacccaggctggagtac

SEQ ID NO: 79142 - DNA, 20 bp, synthetic construct
  misc_feature 1..20: note = CRISPR gRNA sequence
  source 1..20: mol_type = other DNA
tcacccaggctggagtacag

SEQ ID NO: 79143 - DNA, 20 bp, synthetic construct
  misc_feature 1..20: note = CRISPR gRNA sequence
  source 1..20: mol_type = other DNA
gagtacagtggtgtgatcat

SEQ ID NO: 79144 - DNA, 20 bp, synthetic construct
  misc_feature 1..20: note = CRISPR gRNA sequence
  source 1..20: mol_type = other DNA
aagctcccaggctcaagcga

SEQ ID NO: 79145 - DNA, 20 bp, synthetic construct
  misc_feature 1..20: note = CRISPR gRNA sequence
  source 1..20: mol_type = other DNA
ccaggctcaagcgatcctcc

SEQ ID NO: 79146 - DNA, 20 bp, synthetic construct
  misc_feature 1..20: note = CRISPR gRNA sequence
  source 1..20: mol_type = other DNA
aagcgatcctcccaacgtca

SEQ ID NO: 79147 - DNA, 20 bp, synthetic construct
  misc_feature 1..20: note = CRISPR gRNA sequence
  source 1..20: mol_type = other DNA
ccaacgtcagcatcttgagt

SEQ ID NO: 79148 - DNA, 20 bp, synthetic construct
  misc_feature 1..20: note = CRISPR gRNA sequence
  source 1..20: mol_type = other DNA
gagtagctgggactacaggt

SEQ ID NO: 79149 - DNA, 20 bp, synthetic construct
  misc_feature 1..20: note = CRISPR gRNA sequence
  source 1..20: mol_type = other DNA
agtagctgggactacaggtg

SEQ ID NO: 79150 - DNA, 20 bp, synthetic construct
  misc_feature 1..20: note = CRISPR gRNA sequence
  source 1..20: mol_type = other DNA
ggactacaggtgtgcaccac

SEQ ID NO: 79151 - DNA, 20 bp, synthetic construct
  misc_feature 1..20: note = CRISPR gRNA sequence
  source 1..20: mol_type = other DNA
caggtgtgcaccaccacgcc

SEQ ID NO: 79152 - DNA, 20 bp, synthetic construct
  misc_feature 1..20: note = CRISPR gRNA sequence
  source 1..20: mol_type = other DNA
ccttttttttttagagatgg

SEQ ID NO: 79153 - DNA, 20 bp, synthetic construct
  misc_feature 1..20: note = CRISPR gRNA sequence
  source 1..20: mol_type = other DNA
ttttttttagagatggggtc

SEQ ID NO: 79154 - DNA, 20 bp, synthetic construct
  misc_feature 1..20: note = CRISPR gRNA sequence
  source 1..20: mol_type = other DNA
tttttttagagatggggtct

SEQ ID NO: 79155 - DNA, 20 bp, synthetic construct
  misc_feature 1..20: note = CRISPR gRNA sequence
  source 1..20: mol_type = other DNA
ttttttagagatggggtctt

SEQ ID NO: 79156 - DNA, 20 bp, synthetic construct
  misc_feature 1..20: note = CRISPR gRNA sequence
  source 1..20: mol_type = other DNA
tttttagagatggggtcttg

SEQ ID NO: 79157 - DNA, 20 bp, synthetic construct
  misc_feature 1..20: note = CRISPR gRNA sequence
  source 1..20: mol_type = other DNA
ttttagagatggggtcttgc

SEQ ID NO: 79158 - DNA, 20 bp, synthetic construct
  misc_feature 1..20: note = CRISPR gRNA sequence
  source 1..20: mol_type = other DNA
tttagagatggggtcttgct

SEQ ID NO: 79159 - DNA, 20 bp, synthetic construct
  misc_feature 1..20: note = CRISPR gRNA sequence
  source 1..20: mol_type = other DNA
ttagagatggggtcttgcta

SEQ ID NO: 79160 - DNA, 20 bp, synthetic construct
  misc_feature 1..20: note = CRISPR gRNA sequence
  source 1..20: mol_type = other DNA
tagagatggggtcttgctat

SEQ ID NO: 79161 - DNA, 20 bp, synthetic construct
  misc_feature 1..20: note = CRISPR gRNA sequence
  source 1..20: mol_type = other DNA
agagatggggtcttgctatg

SEQ ID NO: 79162 - DNA, 20 bp, synthetic construct
  misc_feature 1..20: note = CRISPR gRNA sequence
  source 1..20: mol_type = other DNA
gagatggggtcttgctatgt

SEQ ID NO: 79163 - DNA, 20 bp, synthetic construct
  misc_feature 1..20: note = CRISPR gRNA sequence
  source 1..20: mol_type = other DNA
gctatgttgcccaggctggt

SEQ ID NO: 79164 - DNA, 20 bp, synthetic construct
  misc_feature 1..20: note = CRISPR gRNA sequence
  source 1..20: mol_type = other DNA
ctatgttgcccaggctggtc

SEQ ID NO: 79165 - DNA, 20 bp, synthetic construct
  misc_feature 1..20: note = CRISPR gRNA sequence
  source 1..20: mol_type = other DNA
tgttgcccaggctggtcttg

SEQ ID NO: 79166 - DNA, 20 bp, synthetic construct
  misc_feature 1..20: note = CRISPR gRNA sequence
  source 1..20: mol_type = other DNA
cccaggctggtcttgaacac

SEQ ID NO: 79167 - DNA, 20 bp, synthetic construct
  misc_feature 1..20: note = CRISPR gRNA sequence
  source 1..20: mol_type = other DNA
gtcttgaacacctggaatca

SEQ ID NO: 79168 - DNA, 20 bp, synthetic construct
  misc_feature 1..20: note = CRISPR gRNA sequence
  source 1..20: mol_type = other DNA
gaacacctggaatcaagaga

SEQ ID NO: 79169 - DNA, 20 bp, synthetic construct
  misc_feature 1..20: note = CRISPR gRNA sequence
  source 1..20: mol_type = other DNA
aacacctggaatcaagagat

SEQ ID NO: 79170 - DNA, 20 bp, synthetic construct
  misc_feature 1..20: note = CRISPR gRNA sequence
  source 1..20: mol_type = other DNA
gaatcaagagattctcgtgc

SEQ ID NO: 79171 - DNA, 20 bp, synthetic construct
  misc_feature 1..20: note = CRISPR gRNA sequence
  source 1..20: mol_type = other DNA
tcgtgcttggcgttccaaag

SEQ ID NO: 79172 - DNA, 20 bp, synthetic construct
  misc_feature 1..20: note = CRISPR gRNA sequence
  source 1..20: mol_type = other DNA
gtgcttggcgttccaaagtg

SEQ ID NO: 79173 - DNA, 20 bp, synthetic construct
  misc_feature 1..20: note = CRISPR gRNA sequence
  source 1..20: mol_type = other DNA
ggcgttccaaagtgctagga

SEQ ID NO: 79174 - DNA, 20 bp, synthetic construct
  misc_feature 1..20: note = CRISPR gRNA sequence
  source 1..20: mol_type = other DNA
gcgttccaaagtgctaggat

SEQ ID NO: 79175 - DNA, 20 bp, synthetic construct
  misc_feature 1..20: note = CRISPR gRNA sequence
  source 1..20: mol_type = other DNA
caaagtgctaggattacagg

SEQ ID NO: 79176 - DNA, 20 bp, synthetic construct
  misc_feature 1..20: note = CRISPR gRNA sequence
  source 1..20: mol_type = other DNA
ggattacaggcatgagccac

SEQ ID NO: 79177 - DNA, 20 bp, synthetic construct
  misc_feature 1..20: note = CRISPR gRNA sequence
  source 1..20: mol_type = other DNA
caggcatgagccaccgcacc

SEQ ID NO: 79178 - DNA, 20 bp, synthetic construct
  misc_feature 1..20: note = CRISPR gRNA sequence
  source 1..20: mol_type = other DNA
gtcctacactaccaggtcat

SEQ ID NO: 79179 - DNA, 20 bp, synthetic construct
  misc_feature 1..20: note = CRISPR gRNA sequence
  source 1..20: mol_type = other DNA
cactaccaggtcattataca

SEQ ID NO: 79180 - DNA, 20 bp, synthetic construct
  misc_feature 1..20: note = CRISPR gRNA sequence
  source 1..20: mol_type = other DNA
ccaggtcattatacaagcaa

SEQ ID NO: 79181 - DNA, 20 bp, synthetic construct
  misc_feature 1..20: note = CRISPR gRNA sequence
  source 1..20: mol_type = other DNA
tacaagcaaggaatcgagat

SEQ ID NO: 79182 - DNA, 20 bp, synthetic construct
  misc_feature 1..20: note = CRISPR gRNA sequence
  source 1..20: mol_type = other DNA
ctcaggggcatacatacatc

SEQ ID NO: 79183 - DNA, 20 bp, synthetic construct
  misc_feature 1..20: note = CRISPR gRNA sequence
  source 1..20: mol_type = other DNA
aggggcatacatacatctgt

SEQ ID NO: 79184 - DNA, 20 bp, synthetic construct
  misc_feature 1..20: note = CRISPR gRNA sequence
  source 1..20: mol_type = other DNA
tctctgagtcttagccagga

SEQ ID NO: 79185 - DNA, 20 bp, synthetic construct
  misc_feature 1..20: note = CRISPR gRNA sequence
  source 1..20: mol_type = other DNA
tgagtcttagccaggagagc

SEQ ID NO: 79186 - DNA, 20 bp, synthetic construct
  misc_feature 1..20: note = CRISPR gRNA sequence
  source 1..20: mol_type = other DNA
agtcttagccaggagagcaa

SEQ ID NO: 79187 - DNA, 20 bp, synthetic construct
  misc_feature 1..20: note = CRISPR gRNA sequence
  source 1..20: mol_type = other DNA
agccaggagagcaaagtgtg

SEQ ID NO: 79188 - DNA, 20 bp, synthetic construct
  misc_feature 1..20: note = CRISPR gRNA sequence
  source 1..20: mol_type = other DNA
gccaggagagcaaagtgtgg

SEQ ID NO: 79189 - DNA, 20 bp, synthetic construct
  misc_feature 1..20: note = CRISPR gRNA sequence
  source 1..20: mol_type = other DNA
ggatggtcttttagggaaaa

SEQ ID NO: 79190 - DNA, 20 bp, synthetic construct
  misc_feature 1..20: note = CRISPR gRNA sequence
  source 1..20: mol_type = other DNA
ttagggaaaagcagctccct

SEQ ID NO: 79191 - DNA, 20 bp, synthetic construct
  misc_feature 1..20: note = CRISPR gRNA sequence
  source 1..20: mol_type = other DNA
tagggaaaagcagctccctt

SEQ ID NO: 79192 - DNA, 20 bp, synthetic construct
  misc_feature 1..20: note = CRISPR gRNA sequence
  source 1..20: mol_type = other DNA
agggaaaagcagctcccttt

SEQ ID NO: 79193 - DNA, 20 bp, synthetic construct
  misc_feature 1..20: note = CRISPR gRNA sequence
  source 1..20: mol_type = other DNA
gggaaaagcagctccctttt

SEQ ID NO: 79194 - DNA, 20 bp, synthetic construct
  misc_feature 1..20: note = CRISPR gRNA sequence
  source 1..20: mol_type = other DNA
ccttttctcagcccatccaa

SEQ ID NO: 79195 - DNA, 20 bp, synthetic construct
  misc_feature 1..20: note = CRISPR gRNA sequence
  source 1..20: mol_type = other DNA
ttctcagcccatccaagact

SEQ ID NO: 79196 - DNA, 20 bp, synthetic construct
  misc_feature 1..20: note = CRISPR gRNA sequence
  source 1..20: mol_type = other DNA
tctcagcccatccaagactg

SEQ ID NO: 79197 - DNA, 20 bp, synthetic construct
  misc_feature 1..20: note = CRISPR gRNA sequence
  source 1..20: mol_type = other DNA
ctcagcccatccaagactgg

SEQ ID NO: 79198 - DNA, 20 bp, synthetic construct
  misc_feature 1..20: note = CRISPR gRNA sequence
  source 1..20: mol_type = other DNA
tcagcccatccaagactggc

SEQ ID NO: 79199 - DNA, 20 bp, synthetic construct
  misc_feature 1..20: note = CRISPR gRNA sequence
  source 1..20: mol_type = other DNA
agcccatccaagactggcca

SEQ ID NO: 79200 - DNA, 20 bp, synthetic construct
  misc_feature 1..20: note = CRISPR gRNA sequence
  source 1..20: mol_type = other DNA
gccaagctggaatccatgca

SEQ ID NO: 79201 - DNA, 20 bp, synthetic construct
  misc_feature 1..20: note = CRISPR gRNA sequence
  source 1..20: mol_type = other DNA
gaatccatgcacagctggaa

SEQ ID NO: 79202 - DNA, 20 bp, synthetic construct
  misc_feature 1..20: note = CRISPR gRNA sequence
  source 1..20: mol_type = other DNA
gaatagccagcatttgactg

SEQ ID NO: 79203 - DNA, 20 bp, synthetic construct
  misc_feature 1..20: note = CRISPR gRNA sequence
  source 1..20: mol_type = other DNA
gactgcccactgcatgccaa

SEQ ID NO: 79204 - DNA, 20 bp, synthetic construct
  misc_feature 1..20: note = CRISPR gRNA sequence
  source 1..20: mol_type = other DNA
actgcccactgcatgccaac

SEQ ID NO: 79205 - DNA, 20 bp, synthetic construct
  misc_feature 1..20: note = CRISPR gRNA sequence
  source 1..20: mol_type = other DNA
cccactgcatgccaacagtg

SEQ ID NO: 79206 - DNA, 20 bp, synthetic construct
  misc_feature 1..20: note = CRISPR gRNA sequence
  source 1..20: mol_type = other DNA
catgccaacagtgctctaaa

SEQ ID NO: 79207 - DNA, 20 bp, synthetic construct
  misc_feature 1..20: note = CRISPR gRNA sequence
  source 1..20: mol_type = other DNA
taaactccttaagtgtagta

SEQ ID NO: 79208 - DNA, 20 bp, synthetic construct
  misc_feature 1..20: note = CRISPR gRNA sequence
  source 1..20: mol_type = other DNA
aactccttaagtgtagtaac

SEQ ID NO: 79209 - DNA, 20 bp, synthetic construct
  misc_feature 1..20: note = CRISPR gRNA sequence
  source 1..20: mol_type = other DNA
cttaagtgtagtaactcatt

SEQ ID NO: 79210 - DNA, 20 bp, synthetic construct
  misc_feature 1..20: note = CRISPR gRNA sequence
  source 1..20: mol_type = other DNA
aagtgtagtaactcatttaa

SEQ ID NO: 79211 - DNA, 20 bp, synthetic construct
  misc_feature 1..20: note = CRISPR gRNA sequence
  source 1..20: mol_type = other DNA
agtgtagtaactcatttaat

SEQ ID NO: 79212 - DNA, 20 bp, synthetic construct
  misc_feature 1..20: note = CRISPR gRNA sequence
  source 1..20: mol_type = other DNA
atttaattctcagaacaacc

SEQ ID NO: 79213 - DNA, 20 bp, synthetic construct
  misc_feature 1..20: note = CRISPR gRNA sequence
  source 1..20: mol_type = other DNA
aattctcagaacaaccctaa

SEQ ID NO: 79214 - DNA, 20 bp, synthetic construct
  misc_feature 1..20: note = CRISPR gRNA sequence
  source 1..20: mol_type = other DNA
attctcagaacaaccctaag

SEQ ID NO: 79215 - DNA, 20 bp, synthetic construct
  misc_feature 1..20: note = CRISPR gRNA sequence
  source 1..20: mol_type = other DNA
tcagaacaaccctaagatgt

SEQ ID NO: 79216 - DNA, 20 bp, synthetic construct
  misc_feature 1..20: note = CRISPR gRNA sequence
  source 1..20: mol_type = other DNA
agaacaaccctaagatgtag

SEQ ID NO: 79217 - DNA, 20 bp, synthetic construct
  misc_feature 1..20: note = CRISPR gRNA sequence
  source 1..20: mol_type = other DNA
agatgtaggtaccataattg

SEQ ID NO: 79218 - DNA, 20 bp, synthetic construct
  misc_feature 1..20: note = CRISPR gRNA sequence
  source 1..20: mol_type = other DNA
ccctccctgtcttttttcag

SEQ ID NO: 79219 - DNA, 20 bp, synthetic construct
  misc_feature 1..20: note = CRISPR gRNA sequence
  source 1..20: mol_type = other DNA
cctgtcttttttcagttgta

SEQ ID NO: 79220 - DNA, 20 bp, synthetic construct
  misc_feature 1..20: note = CRISPR gRNA sequence
  source 1..20: mol_type = other DNA
tcttttttcagttgtaaggg

SEQ ID NO: 79221 - DNA, 20 bp, synthetic construct
  misc_feature 1..20: note = CRISPR gRNA sequence
  source 1..20: mol_type = other DNA
ttttcagttgtaagggcttt

SEQ ID NO: 79222 - DNA, 20 bp, synthetic construct
  misc_feature 1..20: note = CRISPR gRNA sequence
  source 1..20: mol_type = other DNA
tttcagttgtaagggctttt

SEQ ID NO: 79223 - DNA, 20 bp, synthetic construct
  misc_feature 1..20: note = CRISPR gRNA sequence
  source 1..20: mol_type = other DNA
ttcagttgtaagggcttttc

SEQ ID NO: 79224 - DNA, 20 bp, synthetic construct
  misc_feature 1..20: note = CRISPR gRNA sequence
  source 1..20: mol_type = other DNA
tcagttgtaagggcttttcc

SEQ ID NO: 79225 - DNA, 20 bp, synthetic construct
  misc_feature 1..20: note = CRISPR gRNA sequence
  source 1..20: mol_type = other DNA
cagttgtaagggcttttcca

SEQ ID NO: 79226 - DNA, 20 bp, synthetic construct
  misc_feature 1..20: note = CRISPR gRNA sequence
  source 1..20: mol_type = other DNA
agttgtaagggcttttccag

SEQ ID NO: 79227 - DNA, 20 bp, synthetic construct
  misc_feature 1..20: note = CRISPR gRNA sequence
  source 1..20: mol_type = other DNA
taagggcttttccagagttt

SEQ ID NO: 79228 - DNA, 20 bp, synthetic construct
  misc_feature 1..20: note = CRISPR gRNA sequence
  source 1..20: mol_type = other DNA
ttccagagttttcaccatct

SEQ ID NO: 79229 - DNA, 20 bp, synthetic construct
  misc_feature 1..20: note = CRISPR gRNA sequence
  source 1..20: mol_type = other DNA
tccagagttttcaccatcta

SEQ ID NO: 79230 - DNA, 20 bp, synthetic construct
  misc_feature 1..20: note = CRISPR gRNA sequence
  source 1..20: mol_type = other DNA
ccagagttttcaccatctag

SEQ ID NO: 79231 - DNA, 20 bp, synthetic construct
  misc_feature 1..20: note = CRISPR gRNA sequence
  source 1..20: mol_type = other DNA
cagagttttcaccatctagt

SEQ ID NO: 79232 - DNA, 20 bp, synthetic construct
  misc_feature 1..20: note = CRISPR gRNA sequence
  source 1..20: mol_type = other DNA
tcaccatctagtaatgccag

SEQ ID NO: 79233 - DNA, 20 bp, synthetic construct
  misc_feature 1..20: note = CRISPR gRNA sequence
  source 1..20: mol_type = other DNA
caccatctagtaatgccagt

SEQ ID NO: 79234 - DNA, 20 bp, synthetic construct
  misc_feature 1..20: note = CRISPR gRNA sequence
  source 1..20: mol_type = other DNA
accatctagtaatgccagtc

SEQ ID NO: 79235 - DNA, 20 bp, synthetic construct
  misc_feature 1..20: note = CRISPR gRNA sequence
  source 1..20: mol_type = other DNA
gtaatgccagtctaacagta

SEQ ID NO: 79236 - DNA, 20 bp, synthetic construct
  misc_feature 1..20: note = CRISPR gRNA sequence
  source 1..20: mol_type = other DNA
acagtatctttatgttctcc

SEQ ID NO: 79237 - DNA, 20 bp, synthetic construct
  misc_feature 1..20: note = CRISPR gRNA sequence
  source 1..20: mol_type = other DNA
tatgttctccccaagggttt

SEQ ID NO: 79238 - DNA, 20 bp, synthetic construct
  misc_feature 1..20: note = CRISPR gRNA sequence
  source 1..20: mol_type = other DNA
atgttctccccaagggtttg

SEQ ID NO: 79239 - DNA, 20 bp, synthetic construct
  misc_feature 1..20: note = CRISPR gRNA sequence
  source 1..20: mol_type = other DNA
tgttctccccaagggtttgc

SEQ ID NO: 79240 - DNA, 20 bp, synthetic construct
  misc_feature 1..20: note = CRISPR gRNA sequence
  source 1..20: mol_type = other DNA
tccccaagggtttgccttcc

SEQ ID NO: 79241 - DNA, 20 bp, synthetic construct
  misc_feature 1..20: note = CRISPR gRNA sequence
  source 1..20: mol_type = other DNA
cccaagggtttgccttcctc

SEQ ID NO: 79242 - DNA, 20 bp, synthetic construct
  misc_feature 1..20: note = CRISPR gRNA sequence
  source 1..20: mol_type = other DNA
gccttcctctgagtcttctg

SEQ ID NO: 79243 - DNA, 20 bp, synthetic construct
  misc_feature 1..20: note = CRISPR gRNA sequence
  source 1..20: mol_type = other DNA
ccttcctctgagtcttctgg

SEQ ID NO: 79244 - DNA, 20 bp, synthetic construct
  misc_feature 1..20: note = CRISPR gRNA sequence
  source 1..20: mol_type = other DNA
cctctgagtcttctggggat

SEQ ID NO: 79245 - DNA, 20 bp, synthetic construct
  misc_feature 1..20: note = CRISPR gRNA sequence
  source 1..20: mol_type = other DNA
ctctgagtcttctggggatg

SEQ ID NO: 79246 - DNA, 20 bp, synthetic construct
  misc_feature 1..20: note = CRISPR gRNA sequence
  source 1..20: mol_type = other DNA
tgagtcttctggggatgctt

SEQ ID NO: 79247 - DNA, 20 bp, synthetic construct
  misc_feature 1..20: note = CRISPR gRNA sequence
  source 1..20: mol_type = other DNA
agtcttctggggatgcttcc

SEQ ID NO: 79248 - DNA, 20 bp, synthetic construct
  misc_feature 1..20: note = CRISPR gRNA sequence
  source 1..20: mol_type = other DNA
ctggggatgcttccttccac

SEQ ID NO: 79249 - DNA, 20 bp, synthetic construct
  misc_feature 1..20: note = CRISPR gRNA sequence
  source 1..20: mol_type = other DNA
tggggatgcttccttccaca

SEQ ID NO: 79250 - DNA, 20 bp, synthetic construct
  misc_feature 1..20: note = CRISPR gRNA sequence
  source 1..20: mol_type = other DNA
gggatgcttccttccacagg

SEQ ID NO: 79251 - DNA, 20 bp, synthetic construct
  misc_feature 1..20: note = CRISPR gRNA sequence
  source 1..20: mol_type = other DNA
ccttccacagggaccagatg

SEQ ID NO: 79252 - DNA, 20 bp, synthetic construct
  misc_feature 1..20: note = CRISPR gRNA sequence
  source 1..20: mol_type = other DNA
cttccacagggaccagatgt

SEQ ID NO: 79253 - DNA, 20 bp, synthetic construct
  misc_feature 1..20: note = CRISPR gRNA sequence
  source 1..20: mol_type = other DNA
ccacagggaccagatgtggt

SEQ ID NO: 79254 - DNA, 20 bp, synthetic construct
  misc_feature 1..20: note = CRISPR gRNA sequence
  source 1..20: mol_type = other DNA
cacagggaccagatgtggtc

SEQ ID NO: 79255 - DNA, 20 bp, synthetic construct
  misc_feature 1..20: note = CRISPR gRNA sequence
  source 1..20: mol_type = other DNA
gacacgctagaggaagttaa

SEQ ID NO: 79256 - DNA, 20 bp, synthetic construct
  misc_feature 1..20: note = CRISPR gRNA sequence
  source 1..20: mol_type = other DNA
gaggaagttaaaatcctttg

SEQ ID NO: 79257 - DNA, 20 bp, synthetic construct
  misc_feature 1..20: note = CRISPR gRNA sequence
  source 1..20: mol_type = other DNA
aaatcctttgccaacctaag

SEQ ID NO: 79258 - DNA, 20 bp, synthetic construct
  misc_feature 1..20: note = CRISPR gRNA sequence
  source 1..20: mol_type = other DNA
tgccaacctaagcagtaatt

SEQ ID NO: 79259 - DNA, 20 bp, synthetic construct
  misc_feature 1..20: note = CRISPR gRNA sequence
  source 1..20: mol_type = other DNA
gccaacctaagcagtaattc

SEQ ID NO: 79260 - DNA, 20 bp, synthetic construct
  misc_feature 1..20: note = CRISPR gRNA sequence
  source 1..20: mol_type = other DNA
ccaacctaagcagtaattca

SEQ ID NO: 79261 - DNA, 20 bp, synthetic construct
  misc_feature 1..20: note = CRISPR gRNA sequence
  source 1..20: mol_type = other DNA
agcagtaattcattcctcag

SEQ ID NO: 79262 - DNA, 20 bp, synthetic construct
  misc_feature 1..20: note = CRISPR gRNA sequence
  source 1..20: mol_type = other DNA
attcctcagtgcagcagtag

SEQ ID NO: 79263 - DNA, 20 bp, synthetic construct
  misc_feature 1..20: note = CRISPR gRNA sequence
  source 1..20: mol_type = other DNA
ctcagtgcagcagtagcagg

SEQ ID NO: 79264 - DNA, 20 bp, synthetic construct
  misc_feature 1..20: note = CRISPR gRNA sequence
  source 1..20: mol_type = other DNA
agtgcagcagtagcaggaag

SEQ ID NO: 79265 - DNA, 20 bp, synthetic construct
  misc_feature 1..20: note = CRISPR gRNA sequence
  source 1..20: mol_type = other DNA
ccataccccagctcttccta

SEQ ID NO: 79266 - DNA, 20 bp, synthetic construct
  misc_feature 1..20: note = CRISPR gRNA sequence
  source 1..20: mol_type = other DNA
ttcctagtctcttggtcacc

SEQ ID NO: 79267 - DNA, 20 bp, synthetic construct
  misc_feature 1..20: note = CRISPR gRNA sequence
  source 1..20: mol_type = other DNA
cctagtctcttggtcacctt

SEQ ID NO: 79268 - DNA, 20 bp, synthetic construct
  misc_feature 1..20: note = CRISPR gRNA sequence
  source 1..20: mol_type = other DNA
ctagtctcttggtcaccttt

SEQ ID NO: 79269 - DNA, 20 bp, synthetic construct
  misc_feature 1..20: note = CRISPR gRNA sequence
  source 1..20: mol_type = other DNA
gtctcttggtcacctttccc

SEQ ID NO: 79270 - DNA, 20 bp, synthetic construct
  misc_feature 1..20: note = CRISPR gRNA sequence
  source 1..20: mol_type = other DNA
ttggtcacctttcccctcaa

SEQ ID NO: 79271 - DNA, 20 bp, synthetic construct
  misc_feature 1..20: note = CRISPR gRNA sequence
  source 1..20: mol_type = other DNA
ggtcacctttcccctcaact

SEQ ID NO: 79272 - DNA, 20 bp, synthetic construct
  misc_feature 1..20: note = CRISPR gRNA sequence
  source 1..20: mol_type = other DNA
gtcacctttcccctcaactg

SEQ ID NO: 79273 - DNA, 20 bp, synthetic construct
  misc_feature 1..20: note = CRISPR gRNA sequence
  source 1..20: mol_type = other DNA
tcccctcaactgcctgagcc

SEQ ID NO: 79274 - DNA, 20 bp, synthetic construct
  misc_feature 1..20: note = CRISPR gRNA sequence
  source 1..20: mol_type = other DNA
cccctcaactgcctgagccc

SEQ ID NO: 79275 - DNA, 20 bp, synthetic construct
  misc_feature 1..20: note = CRISPR gRNA sequence
  source 1..20: mol_type = other DNA
ccctcaactgcctgagccca

SEQ ID NO: 79276 - DNA, 20 bp, synthetic construct
  misc_feature 1..20: note = CRISPR gRNA sequence
  source 1..20: mol_type = other DNA
aactgcctgagcccaagttg

SEQ ID NO: 79277 - DNA, 20 bp, synthetic construct
  misc_feature 1..20: note = CRISPR gRNA sequence
  source 1..20: mol_type = other DNA
cctgagcccaagttgcttct

SEQ ID NO: 79278 - DNA, 20 bp, synthetic construct
  misc_feature 1..20: note = CRISPR gRNA sequence
  source 1..20: mol_type = other DNA
agcccaagttgcttctaagg

SEQ ID NO: 79279 - DNA, 20 bp, synthetic construct
  misc_feature 1..20: note = CRISPR gRNA sequence
  source 1..20: mol_type = other DNA
cttctaaggatggccccagg

SEQ ID NO: 79280 - DNA, 20 bp, synthetic construct
  misc_feature 1..20: note = CRISPR gRNA sequence
  source 1..20: mol_type = other DNA
ctaaggatggccccaggccc

SEQ ID NO: 79281 - DNA, 20 bp, synthetic construct
  misc_feature 1..20: note = CRISPR gRNA sequence
  source 1..20: mol_type = other DNA
taaggatggccccaggccca

SEQ ID NO: 79282 - DNA, 20 bp, synthetic construct
  misc_feature 1..20: note = CRISPR gRNA sequence
  source 1..20: mol_type = other DNA
aggatggccccaggcccacc

SEQ ID NO: 79283 - DNA, 20 bp, synthetic construct
  misc_feature 1..20: note = CRISPR gRNA sequence
  source 1..20: mol_type = other DNA
ttggcttcttacctttgtag

SEQ ID NO: 79284 - DNA, 20 bp, synthetic construct
  misc_feature 1..20: note = CRISPR gRNA sequence
  source 1..20: mol_type = other DNA
ggcttcttacctttgtagct

SEQ ID NO: 79285 - DNA, 20 bp, synthetic construct
  misc_feature 1..20: note = CRISPR gRNA sequence
  source 1..20: mol_type = other DNA
gcttcttacctttgtagctc

SEQ ID NO: 79286 - DNA, 20 bp, synthetic construct
  misc_feature 1..20: note = CRISPR gRNA sequence
  source 1..20: mol_type = other DNA
cttacctttgtagctctgca

SEQ ID NO: 79287 - DNA, 20 bp, synthetic construct
  misc_feature 1..20: note = CRISPR gRNA sequence
  source 1..20: mol_type = other DNA
ttacctttgtagctctgcag

SEQ ID NO: 79288 - DNA, 20 bp, synthetic construct
  misc_feature 1..20: note = CRISPR gRNA sequence
  source 1..20: mol_type = other DNA
acctttgtagctctgcagtt

SEQ ID NO: 79289 - DNA, 20 bp, synthetic construct
  misc_feature 1..20: note = CRISPR gRNA sequence
  source 1..20: mol_type = other DNA
cctttgtagctctgcagttg

SEQ ID NO: 79290 - DNA, 20 bp, synthetic construct
  misc_feature 1..20: note = CRISPR gRNA sequence
  source 1..20: mol_type = other DNA
tgtagctctgcagttgtctc

SEQ ID NO: 79291 - DNA, 20 bp, synthetic construct
  misc_feature 1..20: note = CRISPR gRNA sequence
  source 1..20: mol_type = other DNA
gtagctctgcagttgtctct

SEQ ID NO: 79292 - DNA, 20 bp, synthetic construct
  misc_feature 1..20: note = CRISPR gRNA sequence
  source 1..20: mol_type = other DNA
tagctctgcagttgtctctg

SEQ ID NO: 79293 - DNA, 20 bp, synthetic construct
  misc_feature 1..20: note = CRISPR gRNA sequence
  source 1..20: mol_type = other DNA
tgcagttgtctctgtgggcg

SEQ ID NO: 79294 - DNA, 20 bp, synthetic construct
  misc_feature 1..20: note = CRISPR gRNA sequence
  source 1..20: mol_type = other DNA
cagttgtctctgtgggcggg

SEQ ID NO: 79295 - DNA, 20 bp, synthetic construct
  misc_feature 1..20: note = CRISPR gRNA sequence
  source 1..20: mol_type = other DNA
tctctgtgggcggggaaaga

SEQ ID NO: 79296 - DNA, 20 bp, synthetic construct
  misc_feature 1..20: note = CRISPR gRNA sequence
  source 1..20: mol_type = other DNA
tgtgggcggggaaagaagga

SEQ ID NO: 79297 - DNA, 20 bp, synthetic construct
  misc_feature 1..20: note = CRISPR gRNA sequence
  source 1..20: mol_type = other DNA
tgggcggggaaagaaggaag

SEQ ID NO: 79298 - DNA, 20 bp, synthetic construct
  misc_feature 1..20: note = CRISPR gRNA sequence
  source 1..20: mol_type = other DNA
cctgcaggatcagataccaa

SEQ ID NO: 79299 - DNA, 20 bp, synthetic construct
  misc_feature 1..20: note = CRISPR gRNA sequence
  source 1..20: mol_type = other DNA
caggatcagataccaagcca

SEQ ID NO: 79300 - DNA, 20 bp, synthetic construct
  misc_feature 1..20: note = CRISPR gRNA sequence
  source 1..20: mol_type = other DNA
gaaaccagcacatcacccac

SEQ ID NO: 79301 - DNA, 20 bp, synthetic construct
  misc_feature 1..20: note = CRISPR gRNA sequence
  source 1..20: mol_type = other DNA
ttctgccccaaatgttcaaa

SEQ ID NO: 79302 - DNA, 20 bp, synthetic construct
  misc_feature 1..20: note = CRISPR gRNA sequence
  source 1..20: mol_type = other DNA
tctgccccaaatgttcaaac

SEQ ID NO: 79303 - DNA, 20 bp, synthetic construct
  misc_feature 1..20: note = CRISPR gRNA sequence
  source 1..20: mol_type = other DNA
ctgccccaaatgttcaaaca

SEQ ID NO: 79304 - DNA, 20 bp, synthetic construct
  misc_feature 1..20: note = CRISPR gRNA sequence
  source 1..20: mol_type = other DNA
tgccccaaatgttcaaacat

SEQ ID NO: 79305 - DNA, 20 bp, synthetic construct
  misc_feature 1..20: note = CRISPR gRNA sequence
  source 1..20: mol_type = other DNA
ccccaaatgttcaaacatcc

SEQ ID NO: 79306 - DNA, 20 bp, synthetic construct
  misc_feature 1..20: note = CRISPR gRNA sequence
  source 1..20: mol_type = other DNA
aaacatccagataaagctga

SEQ ID NO: 79307 - DNA, 20 bp, synthetic construct
  misc_feature 1..20: note = CRISPR gRNA sequence
  source 1..20: mol_type = other DNA
attttgcaattgacagggaa

SEQ ID NO: 79308 - DNA, 20 bp, synthetic construct
  misc_feature 1..20: note = CRISPR gRNA sequence
  source 1..20: mol_type = other DNA
tgcaattgacagggaaacat

SEQ ID NO: 79309 - DNA, 20 bp, synthetic construct
  misc_feature 1..20: note = CRISPR gRNA sequence
  source 1..20: mol_type = other DNA
gcaattgacagggaaacata

SEQ ID NO: 79310 - DNA, 20 bp, synthetic construct
  misc_feature 1..20: note = CRISPR gRNA sequence
  source 1..20: mol_type = other DNA
caattgacagggaaacataa

SEQ ID NO: 79311 - DNA, 20 bp, synthetic construct
  misc_feature 1..20: note = CRISPR gRNA sequence
  source 1..20: mol_type = other DNA
acagggaaacataacggaac

SEQ ID NO: 79312 - DNA, 20 bp, synthetic construct
  misc_feature 1..20: note = CRISPR gRNA sequence
  source 1..20: mol_type = other DNA
gcaaaagtgttttaaatcag

SEQ ID NO: 79313 - DNA, 20 bp, synthetic construct
  misc_feature 1..20: note = CRISPR gRNA sequence
  source 1..20: mol_type = other DNA
taaatcaggcatgtgaaata

SEQ ID NO: 79314 - DNA, 20 bp, synthetic construct
  misc_feature 1..20: note = CRISPR gRNA sequence
  source 1..20: mol_type = other DNA
aaatcaggcatgtgaaatac

SEQ ID NO: 79315 - DNA, 20 bp, synthetic construct
  misc_feature 1..20: note = CRISPR gRNA sequence
  source 1..20: mol_type = other DNA
aatcaggcatgtgaaatact

SEQ ID NO: 79316 - DNA, 20 bp, synthetic construct
  misc_feature 1..20: note = CRISPR gRNA sequence
  source 1..20: mol_type = other DNA
attatgtctttgcttgatga

SEQ ID NO: 79317 - DNA, 20 bp, synthetic construct
  misc_feature 1..20: note = CRISPR gRNA sequence
  source 1..20: mol_type = other DNA
tgtctttgcttgatgaatcc

SEQ ID NO: 79318 - DNA, 20 bp, synthetic construct
  misc_feature 1..20: note = CRISPR gRNA sequence
  source 1..20: mol_type = other DNA
tgcttgatgaatcctgcaag

SEQ ID NO: 79319 - DNA, 20 bp, synthetic construct
  misc_feature 1..20: note = CRISPR gRNA sequence
  source 1..20: mol_type = other DNA
gcttgatgaatcctgcaaga

SEQ ID NO: 79320 - DNA, 20 bp, synthetic construct
  misc_feature 1..20: note = CRISPR gRNA sequence
  source 1..20: mol_type = other DNA
cttgatgaatcctgcaagag

SEQ ID NO: 79321 - DNA, 20 bp, synthetic construct
  misc_feature 1..20: note = CRISPR gRNA sequence
  source 1..20: mol_type = other DNA
gatgaatcctgcaagagtgt

SEQ ID NO: 79322 - DNA, 20 bp, synthetic construct
  misc_feature 1..20: note = CRISPR gRNA sequence
  source 1..20: mol_type = other DNA
atgaatcctgcaagagtgtt

SEQ ID NO: 79323 - DNA, 20 bp, synthetic construct
  misc_feature 1..20: note = CRISPR gRNA sequence
  source 1..20: mol_type = other DNA
caagagtgttttaaaaagtc

SEQ ID NO: 79324 - DNA, 20 bp, synthetic construct
  misc_feature 1..20: note = CRISPR gRNA sequence
  source 1..20: mol_type = other DNA
taaaaagtcagaaaaacaat

SEQ ID NO: 79325 - DNA, 20 bp, synthetic construct
  misc_feature 1..20: note = CRISPR gRNA sequence
  source 1..20: mol_type = other DNA
aaaaagtcagaaaaacaatt

SEQ ID NO: 79326 - DNA, 20 bp, synthetic construct
  misc_feature 1..20: note = CRISPR gRNA sequence
  source 1..20: mol_type = other DNA
aaaagtcagaaaaacaattt

SEQ ID NO: 79327 - DNA, 20 bp, synthetic construct
  misc_feature 1..20: note = CRISPR gRNA sequence
  source 1..20: mol_type = other DNA
tcacaagaaatataataaaa

SEQ ID NO: 79328 - DNA, 20 bp, synthetic construct
  misc_feature 1..20: note = CRISPR gRNA sequence
  source 1..20: mol_type = other DNA
cacaagaaatataataaaaa

SEQ ID NO: 79329 - DNA, 20 bp, synthetic construct
  misc_feature 1..20: note = CRISPR gRNA sequence
  source 1..20: mol_type = other DNA
acaagaaatataataaaaat

SEQ ID NO: 79330 - DNA, 20 bp, synthetic construct
  misc_feature 1..20: note = CRISPR gRNA sequence
  source 1..20: mol_type = other DNA
agaatgttgtgagttttttt

SEQ ID NO: 79331 - DNA, 20 bp, synthetic construct
  misc_feature 1..20: note = CRISPR gRNA sequence
  source 1..20: mol_type = other DNA
tgagtttttttttttccttt

SEQ ID NO: 79332 - DNA, 20 bp, synthetic construct
  misc_feature 1..20: note = CRISPR gRNA sequence
  source 1..20: mol_type = other DNA
ttttttttcctttcttttta

SEQ ID NO: 79333 - DNA, 20 bp, synthetic construct
  misc_feature 1..20: note = CRISPR gRNA sequence
  source 1..20: mol_type = other DNA
tttttttcctttctttttaa

SEQ ID NO: 79334 - DNA, 20 bp, synthetic construct
  misc_feature 1..20: note = CRISPR gRNA sequence
  source 1..20: mol_type = other DNA
ttttttcctttctttttaaa

SEQ ID NO: 79335 - DNA, 20 bp, synthetic construct
  misc_feature 1..20: note = CRISPR gRNA sequence
  source 1..20: mol_type = other DNA
tttttcctttctttttaaat

SEQ ID NO: 79336 - DNA, 20 bp, synthetic construct
  misc_feature 1..20: note = CRISPR gRNA sequence
  source 1..20: mol_type = other DNA
ttttcctttctttttaaatt

SEQ ID NO: 79337 - DNA, 20 bp, synthetic construct
  misc_feature 1..20: note = CRISPR gRNA sequence
  source 1..20: mol_type = other DNA
tttcctttctttttaaattt

SEQ ID NO: 79338 - DNA, 20 bp, synthetic construct
  misc_feature 1..20: note = CRISPR gRNA sequence
  source 1..20: mol_type = other DNA
ttcctttctttttaaatttg

SEQ ID NO: 79339 - DNA, 20 bp, synthetic construct
  misc_feature 1..20: note = CRISPR gRNA sequence
  source 1..20: mol_type = other DNA
tcctttctttttaaatttga

SEQ ID NO: 79340 - DNA, 20 bp, synthetic construct
  misc_feature 1..20: note = CRISPR gRNA sequence
  source 1..20: mol_type = other DNA
cctttctttttaaatttgag

SEQ ID NO: 79341 - DNA, 20 bp, synthetic construct
  misc_feature 1..20: note = CRISPR gRNA sequence
  source 1..20: mol_type = other DNA
ctttctttttaaatttgaga

SEQ ID NO: 79342 - DNA, 20 bp, synthetic construct
  misc_feature 1..20: note = CRISPR gRNA sequence
  source 1..20: mol_type = other DNA
tctttttaaatttgagatgg

SEQ ID NO: 79343 - DNA, 20 bp, synthetic construct
  misc_feature 1..20: note = CRISPR gRNA sequence
  source 1..20: mol_type = other DNA
ctttttaaatttgagatgga

SEQ ID NO: 79344 - DNA, 20 bp, synthetic construct
  misc_feature 1..20: note = CRISPR gRNA sequence
  source 1..20: mol_type = other DNA
tttttaaatttgagatggag

SEQ ID NO: 79345 - DNA, 20 bp, synthetic construct
  misc_feature 1..20: note = CRISPR gRNA sequence
  source 1..20: mol_type = other DNA
tttaaatttgagatggagat

SEQ ID NO: 79346 - DNA, 20 bp, synthetic construct
  misc_feature 1..20: note = CRISPR gRNA sequence
  source 1..20: mol_type = other DNA
ttaaatttgagatggagatc

SEQ ID NO: 79347 - DNA, 20 bp, synthetic construct
  misc_feature 1..20: note = CRISPR gRNA sequence
  source 1..20: mol_type = other DNA
taaatttgagatggagatct

SEQ ID NO: 79348 - DNA, 20 bp, synthetic construct
  misc_feature 1..20: note = CRISPR gRNA sequence
  source 1..20: mol_type = other DNA
aaatttgagatggagatctc

SEQ ID NO: 79349 - DNA, 20 bp, synthetic construct
  misc_feature 1..20: note = CRISPR gRNA sequence
  source 1..20: mol_type = other DNA
aatttgagatggagatctca

SEQ ID NO: 79350 - DNA, 20 bp, synthetic construct
  misc_feature 1..20: note = CRISPR gRNA sequence
  source 1..20: mol_type = other DNA
gagatggagatctcactctg

SEQ ID NO: 79351 - DNA, 20 bp, synthetic construct
  misc_feature 1..20: note = CRISPR gRNA sequence
  source 1..20: mol_type = other DNA
agatggagatctcactctgc

SEQ ID NO: 79352 - DNA, 20 bp, synthetic construct
  misc_feature 1..20: note = CRISPR gRNA sequence
  source 1..20: mol_type = other DNA
actctgctactcaggctgga

SEQ ID NO: 79353 - DNA, 20 bp, synthetic construct
  misc_feature 1..20: note = CRISPR gRNA sequence
  source 1..20: mol_type = other DNA
tgctactcaggctggagtgc

SEQ ID NO: 79354 - DNA, 20 bp, synthetic construct
  misc_feature 1..20: note = CRISPR gRNA sequence
  source 1..20: mol_type = other DNA
ctactcaggctggagtgcag

SEQ ID NO: 79355 - DNA, 20 bp, synthetic construct
  misc_feature 1..20: note = CRISPR gRNA sequence
  source 1..20: mol_type = other DNA
ctcaggctggagtgcagtgg

SEQ ID NO: 79356 - DNA, 20 bp, synthetic construct
  misc_feature 1..20: note = CRISPR gRNA sequence
  source 1..20: mol_type = other DNA
aggctggagtgcagtggtgt

SEQ ID NO: 79357 - DNA, 20 bp, synthetic construct
  misc_feature 1..20: note = CRISPR gRNA sequence
  source 1..20: mol_type = other DNA
gagtgcagtggtgtgttcac

SEQ ID NO: 79358 - DNA, 20 bp, synthetic construct
  misc_feature 1..20: note = CRISPR gRNA sequence
  source 1..20: mol_type = other DNA
acacctcactgcagcctcaa

SEQ ID NO: 79359 - DNA, 20 bp, synthetic construct
  misc_feature 1..20: note = CRISPR gRNA sequence
  source 1..20: mol_type = other DNA
actgcagcctcaacctccac

SEQ ID NO: 79360 - DNA, 20 bp, synthetic construct
  misc_feature 1..20: note = CRISPR gRNA sequence
  source 1..20: mol_type = other DNA
cagcctcaacctccacggct

SEQ ID NO: 79361 - DNA, 20 bp, synthetic construct
  misc_feature 1..20: note = CRISPR gRNA sequence
  source 1..20: mol_type = other DNA
aacctccacggctcaagcaa

SEQ ID NO: 79362 - DNA, 20 bp, synthetic construct
  misc_feature 1..20: note = CRISPR gRNA sequence
  source 1..20: mol_type = other DNA
cacggctcaagcaatcttcc

SEQ ID NO: 79363 - DNA, 20 bp, synthetic construct
  misc_feature 1..20: note = CRISPR gRNA sequence
  source 1..20: mol_type = other DNA
aagcaatcttcccacctcag

SEQ ID NO: 79364 - DNA, 20 bp, synthetic construct
  misc_feature 1..20: note = CRISPR gRNA sequence
  source 1..20: mol_type = other DNA
cccacctcagcctcccaaat

SEQ ID NO: 79365 - DNA, 20 bp, synthetic construct
  misc_feature 1..20: note = CRISPR gRNA sequence
  source 1..20: mol_type = other DNA
ccacctcagcctcccaaata

SEQ ID NO: 79366 - DNA, 20 bp, synthetic construct
  misc_feature 1..20: note = CRISPR gRNA sequence
  source 1..20: mol_type = other DNA
agcctcccaaatagctggaa

SEQ ID NO: 79367 - DNA, 20 bp, synthetic construct
  misc_feature 1..20: note = CRISPR gRNA sequence
  source 1..20: mol_type = other DNA
ccaaatagctggaaccacag

SEQ ID NO: 79368 - DNA, 20 bp, synthetic construct
  misc_feature 1..20: note = CRISPR gRNA sequence
  source 1..20: mol_type = other DNA
gaaccacaggcatgcaccac

SEQ ID NO: 79369 - DNA, 20 bp, synthetic construct
  misc_feature 1..20: note = CRISPR gRNA sequence
  source 1..20: mol_type = other DNA
attttgttcattttttgtag

SEQ ID NO: 79370 - DNA, 20 bp, synthetic construct
  misc_feature 1..20: note = CRISPR gRNA sequence
  source 1..20: mol_type = other DNA
tgttcattttttgtagagac

SEQ ID NO: 79371 - DNA, 20 bp, synthetic construct
  misc_feature 1..20: note = CRISPR gRNA sequence
  source 1..20: mol_type = other DNA
gttcattttttgtagagact

SEQ ID NO: 79372 - DNA, 20 bp, synthetic construct
  misc_feature 1..20: note = CRISPR gRNA sequence
  source 1..20: mol_type = other DNA
ttcattttttgtagagacta

SEQ ID NO: 79373 - DNA, 20 bp, synthetic construct
  misc_feature 1..20: note = CRISPR gRNA sequence
  source 1..20: mol_type = other DNA
attttttgtagagactatgt

SEQ ID NO: 79374 - DNA, 20 bp, synthetic construct
  misc_feature 1..20: note = CRISPR gRNA sequence
  source 1..20: mol_type = other DNA
tttgtagagactatgttgcc

SEQ ID NO: 79375 - DNA, 20 bp, synthetic construct
  misc_feature 1..20: note = CRISPR gRNA sequence
  source 1..20: mol_type = other DNA
ttgtagagactatgttgccc

SEQ ID NO: 79376 - DNA, 20 bp, synthetic construct
  misc_feature 1..20: note = CRISPR gRNA sequence
  source 1..20: mol_type = other DNA
tgtagagactatgttgccca

SEQ ID NO: 79377 - DNA, 20 bp, synthetic construct
  misc_feature 1..20: note = CRISPR gRNA sequence
  source 1..20: mol_type = other DNA
gtagagactatgttgcccag

SEQ ID NO: 79378 - DNA, 20 bp, synthetic construct
  misc_feature 1..20: note = CRISPR gRNA sequence
  source 1..20: mol_type = other DNA
tagagactatgttgcccagg

SEQ ID NO: 79379 - DNA, 20 bp, synthetic construct
  misc_feature 1..20: note = CRISPR gRNA sequence
  source 1..20: mol_type = other DNA
tgttgcccaggttggtctcg

SEQ ID NO: 79380 - DNA, 20 bp, synthetic construct
  misc_feature 1..20: note = CRISPR gRNA sequence
  source 1..20: mol_type = other DNA
cccaggttggtctcgaactc

SEQ ID NO: 79381 - DNA, 20 bp, synthetic construct
  misc_feature 1..20: note = CRISPR gRNA sequence
  source 1..20: mol_type = other DNA
gtctcgaactcctgagctca

SEQ ID NO: 79382 - DNA, 20 bp, synthetic construct
  misc_feature 1..20: note = CRISPR gRNA sequence
  source 1..20: mol_type = other DNA
gaactcctgagctcaagtaa

SEQ ID NO: 79383 - DNA, 20 bp, synthetic construct
  misc_feature 1..20: note = CRISPR gRNA sequence
  source 1..20: mol_type = other DNA
ctgagctcaagtaatcctct

SEQ ID NO: 79384 - DNA, 20 bp, synthetic construct
  misc_feature 1..20: note = CRISPR gRNA sequence
  source 1..20: mol_type = other DNA
agctcaagtaatcctcttgc

SEQ ID NO: 79385 - DNA, 20 bp, synthetic construct
  misc_feature 1..20: note = CRISPR gRNA sequence
  source 1..20: mol_type = other DNA
aagtaatcctcttgccttgg

SEQ ID NO: 79386 - DNA, 20 bp, synthetic construct
  misc_feature 1..20: note = CRISPR gRNA sequence
  source 1..20: mol_type = other DNA
ttgccttggccttccaaagt

SEQ ID NO: 79387 - DNA, 20 bp, synthetic construct
  misc_feature 1..20: note = CRISPR gRNA sequence
  source 1..20: mol_type = other DNA
gccttggccttccaaagtgt

SEQ ID NO: 79388 - DNA, 20 bp, synthetic construct
  misc_feature 1..20: note = CRISPR gRNA sequence
  source 1..20: mol_type = other DNA
ccttggccttccaaagtgtt

SEQ ID NO: 79389 - DNA, 20 bp, synthetic construct
  misc_feature 1..20: note = CRISPR gRNA sequence
  source 1..20: mol_type = other DNA
ggccttccaaagtgttggaa

SEQ ID NO: 79390 - DNA, 20 bp, synthetic construct
  misc_feature 1..20: note = CRISPR gRNA sequence
  source 1..20: mol_type = other DNA
gccttccaaagtgttggaat

SEQ ID NO: 79391 - DNA, 20 bp, synthetic construct
  misc_feature 1..20: note = CRISPR gRNA sequence
  source 1..20: mol_type = other DNA
ccaaagtgttggaattacag

SEQ ID NO: 79392 - DNA, 20 bp, synthetic construct
  misc_feature 1..20: note = CRISPR gRNA sequence
  source 1..20: mol_type = other DNA
caaagtgttggaattacagg

SEQ ID NO: 79393 - DNA, 20 bp, synthetic construct
  misc_feature 1..20: note = CRISPR gRNA sequence
  source 1..20: mol_type = other DNA
gaattacaggcatgagccac

SEQ ID NO: 79394 - DNA, 20 bp, synthetic construct
  misc_feature 1..20: note = CRISPR gRNA sequence
  source 1..20: mol_type = other DNA
caggcatgagccactgagcc

SEQ ID NO: 79395 - DNA, 20 bp, synthetic construct
  misc_feature 1..20: note = CRISPR gRNA sequence
  source 1..20: mol_type = other DNA
agcccggctgaatttttttt

SEQ ID NO: 79396 - DNA, 20 bp, synthetic construct
  misc_feature 1..20: note = CRISPR gRNA sequence
  source 1..20: mol_type = other DNA
aattttttttaatagaaatt

SEQ ID NO: 79397 - DNA, 20 bp, synthetic construct
  misc_feature 1..20: note = CRISPR gRNA sequence
  source 1..20: mol_type = other DNA
tttttaatagaaatttttat

SEQ ID NO: 79398 - DNA, 20 bp, synthetic construct
  misc_feature 1..20: note = CRISPR gRNA sequence
  source 1..20: mol_type = other DNA
ttttaatagaaatttttatg

SEQ ID NO: 79399 - DNA, 20 bp, synthetic construct
  misc_feature 1..20: note = CRISPR gRNA sequence
  source 1..20: mol_type = other DNA
tttaatagaaatttttatga

SEQ ID NO: 79400 - DNA, 20 bp, synthetic construct
  misc_feature 1..20: note = CRISPR gRNA sequence
  source 1..20: mol_type = other DNA
ttaatagaaatttttatgag

SEQ ID NO: 79401 - DNA, 20 bp, synthetic construct
  misc_feature 1..20: note = CRISPR gRNA sequence
  source 1..20: mol_type = other DNA
taatagaaatttttatgagt

SEQ ID NO: 79402 - DNA, 20 bp, synthetic construct
  misc_feature 1..20: note = CRISPR gRNA sequence
  source 1..20: mol_type = other DNA
aatagaaatttttatgagta

SEQ ID NO: 79403 - DNA, 20 bp, synthetic construct
  misc_feature 1..20: note = CRISPR gRNA sequence
  source 1..20: mol_type = other DNA
atagaaatttttatgagtaa

SEQ ID NO: 79404 - DNA, 20 bp, synthetic construct
  misc_feature 1..20: note = CRISPR gRNA sequence
  source 1..20: mol_type = other DNA
ttatgagtaagaaaaatgac

SEQ ID NO: 79405 - DNA, 20 bp, synthetic construct
  misc_feature 1..20: note = CRISPR gRNA sequence
  source 1..20: mol_type = other DNA
tatgagtaagaaaaatgaca

SEQ ID NO: 79406 - DNA, 20 bp, synthetic construct
  misc_feature 1..20: note = CRISPR gRNA sequence
  source 1..20: mol_type = other DNA
atgagtaagaaaaatgacac

SEQ ID NO: 79407 - DNA, 20 bp, synthetic construct
  misc_feature 1..20: note = CRISPR gRNA sequence
  source 1..20: mol_type = other DNA
tgagtaagaaaaatgacacc

SEQ ID NO: 79408 - DNA, 20 bp, synthetic construct
  misc_feature 1..20: note = CRISPR gRNA sequence
  source 1..20: mol_type = other DNA
acctaccccatgatcaaaac

SEQ ID NO: 79409 - DNA, 20 bp, synthetic construct
  misc_feature 1..20: note = CRISPR gRNA sequence
  source 1..20: mol_type = other DNA
ccccatgatcaaaactggct

SEQ ID NO: 79410 - DNA, 20 bp, synthetic construct
  misc_feature 1..20: note = CRISPR gRNA sequence
  source 1..20: mol_type = other DNA
gctatattggttcagcacca

SEQ ID NO: 79411 - DNA, 20 bp, synthetic construct
  misc_feature 1..20: note = CRISPR gRNA sequence
  source 1..20: mol_type = other DNA
tattggttcagcaccatgga

SEQ ID NO: 79412 - DNA, 20 bp, synthetic construct
  misc_feature 1..20: note = CRISPR gRNA sequence
  source 1..20: mol_type = other DNA
gttcagcaccatggagggca

SEQ ID NO: 79413 - DNA, 20 bp, synthetic construct
  misc_feature 1..20: note = CRISPR gRNA sequence
  source 1..20: mol_type = other DNA
agcaccatggagggcaacac

SEQ ID NO: 79414 - DNA, 20 bp, synthetic construct
  misc_feature 1..20: note = CRISPR gRNA sequence
  source 1..20: mol_type = other DNA
attattcctttggctatgcc

SEQ ID NO: 79415 - DNA, 20 bp, synthetic construct
  misc_feature 1..20: note = CRISPR gRNA sequence
  source 1..20: mol_type = other DNA
ttcctttggctatgcctgtg

SEQ ID NO: 79416 - DNA, 20 bp, synthetic construct
  misc_feature 1..20: note = CRISPR gRNA sequence
  source 1..20: mol_type = other DNA
ctttggctatgcctgtgctt

SEQ ID NO: 79417 - DNA, 20 bp, synthetic construct
  misc_feature 1..20: note = CRISPR gRNA sequence
  source 1..20: mol_type = other DNA
tggctatgcctgtgcttcgt

SEQ ID NO: 79418 - DNA, 20 bp, synthetic construct
  misc_feature 1..20: note = CRISPR gRNA sequence
  source 1..20: mol_type = other DNA
ggctatgcctgtgcttcgta

SEQ ID NO: 79419 - DNA, 20 bp, synthetic construct
  misc_feature 1..20: note = CRISPR gRNA sequence
  source 1..20: mol_type = other DNA
gctatgcctgtgcttcgtag

SEQ ID NO: 79420 - DNA, 20 bp, synthetic construct
  misc_feature 1..20: note = CRISPR gRNA sequence
  source 1..20: mol_type = other DNA
tgcctgtgcttcgtagactt

SEQ ID NO: 79421 - DNA, 20 bp, synthetic construct
  misc_feature 1..20: note = CRISPR gRNA sequence
  source 1..20: mol_type = other DNA
tgcttcgtagacttgttgac

SEQ ID NO: 79422 - DNA, 20 bp, synthetic construct
  misc_feature 1..20: note = CRISPR gRNA sequence
  source 1..20: mol_type = other DNA
cgtagacttgttgactcatt

SEQ ID NO: 79423 - DNA, 20 bp, synthetic construct
  misc_feature 1..20: note = CRISPR gRNA sequence
  source 1..20: mol_type = other DNA
gtagacttgttgactcattc

SEQ ID NO: 79424 - DNA, 20 bp, synthetic construct
  misc_feature 1..20: note = CRISPR gRNA sequence
  source 1..20: mol_type = other DNA
gttgactcattccttcatcc

SEQ ID NO: 79425 - DNA, 20 bp, synthetic construct
  misc_feature 1..20: note = CRISPR gRNA sequence
  source 1..20: mol_type = other DNA
ttgactcattccttcatcca

SEQ ID NO: 79426 - DNA, 20 bp, synthetic construct
  misc_feature 1..20: note = CRISPR gRNA sequence
  source 1..20: mol_type = other DNA
actcattccttcatccatcc

SEQ ID NO: 79427 - DNA, 20 bp, synthetic construct
  misc_feature 1..20: note = CRISPR gRNA sequence
  source 1..20: mol_type = other DNA
attccttcatccatccatcc

SEQ ID NO: 79428 - DNA, 20 bp, synthetic construct
  misc_feature 1..20: note = CRISPR gRNA sequence
  source 1..20: mol_type = other DNA
cttcatccatccatccatcc

SEQ ID NO: 79429 - DNA, 20 bp, synthetic construct
  misc_feature 1..20: note = CRISPR gRNA sequence
  source 1..20: mol_type = other DNA
catccatccatccatccatc

SEQ ID NO: 79430 - DNA, 20 bp, synthetic construct
  misc_feature 1..20: note = CRISPR gRNA sequence
  source 1..20: mol_type = other DNA
atccatccatccatccatcc

SEQ ID NO: 79431 - DNA, 20 bp, synthetic construct
  misc_feature 1..20: note = CRISPR gRNA sequence
  source 1..20: mol_type = other DNA
ttcacacacctatccatctt

SEQ ID NO: 79432 - DNA, 20 bp, synthetic construct
  misc_feature 1..20: note = CRISPR gRNA sequence
  source 1..20: mol_type = other DNA
tcacacacctatccatcttt

SEQ ID NO: 79433 - DNA, 20 bp, synthetic construct
  misc_feature 1..20: note = CRISPR gRNA sequence
  source 1..20: mol_type = other DNA
cacacacctatccatctttt

SEQ ID NO: 79434 - DNA, 20 bp, synthetic construct
  misc_feature 1..20: note = CRISPR gRNA sequence
  source 1..20: mol_type = other DNA
acacacctatccatcttttc

SEQ ID NO: 79435 - DNA, 20 bp, synthetic construct
  misc_feature 1..20: note = CRISPR gRNA sequence
  source 1..20: mol_type = other DNA
tccatcttttcagctagcca

SEQ ID NO: 79436 - DNA, 20 bp, synthetic construct
  misc_feature 1..20: note = CRISPR gRNA sequence
  source 1..20: mol_type = other DNA
ttcagctagccatctatcca

SEQ ID NO: 79437 - DNA, 20 bp, synthetic construct
  misc_feature 1..20: note = CRISPR gRNA sequence
  source 1..20: mol_type = other DNA
tcagctagccatctatccat

SEQ ID NO: 79438 - DNA, 20 bp, synthetic construct
  misc_feature 1..20: note = CRISPR gRNA sequence
  source 1..20: mol_type = other DNA
cagctagccatctatccatc

SEQ ID NO: 79439 - DNA, 20 bp, synthetic construct
  misc_feature 1..20: note = CRISPR gRNA sequence
  source 1..20: mol_type = other DNA
agctagccatctatccatcc

SEQ ID NO: 79440 - DNA, 20 bp, synthetic construct
  misc_feature 1..20: note = CRISPR gRNA sequence
  source 1..20: mol_type = other DNA
gccatctatccatccatcca

SEQ ID NO: 79441 - DNA, 20 bp, synthetic construct
  misc_feature 1..20: note = CRISPR gRNA sequence
  source 1..20: mol_type = other DNA
tccatccatccattcatcta

SEQ ID NO: 79442 - DNA, 20 bp, synthetic construct
  misc_feature 1..20: note = CRISPR gRNA sequence
  source 1..20: mol_type = other DNA
atctatccatccatccattc

SEQ ID NO: 79443 - DNA, 20 bp, synthetic construct
  misc_feature 1..20: note = CRISPR gRNA sequence
  source 1..20: mol_type = other DNA
tccatccatccattcatctt

SEQ ID NO: 79444 - DNA, 20 bp, synthetic construct
  misc_feature 1..20: note = CRISPR gRNA sequence
  source 1..20: mol_type = other DNA
atcttttcatccacccatca

SEQ ID NO: 79445 - DNA, 20 bp, synthetic construct
  misc_feature 1..20: note = CRISPR gRNA sequence
  source 1..20: mol_type = other DNA
ttcatccacccatcaatctt

SEQ ID NO: 79446 - DNA, 20 bp, synthetic construct
  misc_feature 1..20: note = CRISPR gRNA sequence
  source 1..20: mol_type = other DNA
tcatccacccatcaatcttt

SEQ ID NO: 79447 - DNA, 20 bp, synthetic construct
  misc_feature 1..20: note = CRISPR gRNA sequence
  source 1..20: mol_type = other DNA
catccacccatcaatctttc

SEQ ID NO: 79448 - DNA, 20 bp, synthetic construct
  misc_feature 1..20: note = CRISPR gRNA sequence
  source 1..20: mol_type = other DNA
atccacccatcaatctttcc

SEQ ID NO: 79449 - DNA, 20 bp, synthetic construct
  misc_feature 1..20: note = CRISPR gRNA sequence
  source 1..20: mol_type = other DNA
tccatccatccatccatcca

SEQ ID NO: 79450 - DNA, 20 bp, synthetic construct
  misc_feature 1..20: note = CRISPR gRNA sequence
  source 1..20: mol_type = other DNA
ccatccatccatccatccat

SEQ ID NO: 79451 - DNA, 20 bp, synthetic construct
  misc_feature 1..20: note = CRISPR gRNA sequence
  source 1..20: mol_type = other DNA
catccatccatccatccatc

SEQ ID NO: 79452 - DNA, 20 bp, synthetic construct
  misc_feature 1..20: note = CRISPR gRNA sequence
  source 1..20: mol_type = other DNA
ttcatccacccatccatctt

SEQ ID NO: 79453 - DNA, 20 bp, synthetic construct
  misc_feature 1..20: note = CRISPR gRNA sequence
  source 1..20: mol_type = other DNA
tcatccacccatccatcttt

SEQ ID NO: 79454 - DNA, 20 bp, synthetic construct
  misc_feature 1..20: note = CRISPR gRNA sequence
  source 1..20: mol_type = other DNA
catccacccatccatctttt

SEQ ID NO: 79455 - DNA, 20 bp, synthetic construct
  misc_feature 1..20: note = CRISPR gRNA sequence
  source 1..20: mol_type = other DNA
atccacccatccatcttttc

SEQ ID NO: 79456 - DNA, 20 bp, synthetic construct
  misc_feature 1..20: note = CRISPR gRNA sequence
  source 1..20: mol_type = other DNA
ttcatccatccatccatcca

SEQ ID NO: 79457 - DNA, 20 bp, synthetic construct
  misc_feature 1..20: note = CRISPR gRNA sequence
  source 1..20: mol_type = other DNA
tcatccatccatccatccat

SEQ ID NO: 79458 - DNA, 20 bp, synthetic construct
  misc_feature 1..20: note = CRISPR gRNA sequence
  source 1..20: mol_type = other DNA
catccatccatccatccatc

SEQ ID NO: 79459 - DNA, 20 bp, synthetic construct
  misc_feature 1..20: note = CRISPR gRNA sequence
  source 1..20: mol_type = other DNA
atccatccatccatccatcc

SEQ ID NO: 79460 - DNA, 20 bp, synthetic construct
  misc_feature 1..20: note = CRISPR gRNA sequence
  source 1..20: mol_type = other DNA
ttcatccacccatccatctt

SEQ ID NO: 79461 - DNA, 20 bp, synthetic construct
  misc_feature 1..20: note = CRISPR gRNA sequence
  source 1..20: mol_type = other DNA
tcatccacccatccatcttt

SEQ ID NO: 79462 - DNA, 20 bp, synthetic construct
  misc_feature 1..20: note = CRISPR gRNA sequence
  source 1..20: mol_type = other DNA
catccacccatccatctttt

SEQ ID NO: 79463 - DNA, 20 bp, synthetic construct
  misc_feature 1..20: note = CRISPR gRNA sequence
  source 1..20: mol_type = other DNA
atccacccatccatcttttc

SEQ ID NO: 79464 - DNA, 20 bp, synthetic construct
  misc_feature 1..20: note = CRISPR gRNA sequence
  source 1..20: mol_type = other DNA
ttcagccatccatccatcca

SEQ ID NO: 79465 - DNA, 20 bp, synthetic construct
  misc_feature 1..20: note = CRISPR gRNA sequence
  source 1..20: mol_type = other DNA
tcagccatccatccatccat

SEQ ID NO: 79466 - DNA, 20 bp, synthetic construct
  misc_feature 1..20: note = CRISPR gRNA sequence
  source 1..20: mol_type = other DNA
cagccatccatccatccatc

SEQ ID NO: 79467 - DNA, 20 bp, synthetic construct
  misc_feature 1..20: note = CRISPR gRNA sequence
  source 1..20: mol_type = other DNA
agccatccatccatccatcc

SEQ ID NO: 79468 - DNA, 20 bp, synthetic construct
  misc_feature 1..20: note = CRISPR gRNA sequence
  source 1..20: mol_type = other DNA
ttcatccacccatccatctt

SEQ ID NO: 79469 - DNA, 20 bp, synthetic construct
  misc_feature 1..20: note = CRISPR gRNA sequence
  source 1..20: mol_type = other DNA
tcatccacccatccatcttt

SEQ ID NO: 79470 - DNA, 20 bp, synthetic construct
  misc_feature 1..20: note = CRISPR gRNA sequence
  source 1..20: mol_type = other DNA
catccacccatccatctttt

SEQ ID NO: 79471 - DNA, 20 bp, synthetic construct
  misc_feature 1..20: note = CRISPR gRNA sequence
  source 1..20: mol_type = other DNA
atccacccatccatcttttc

SEQ ID NO: 79472 - DNA, 20 bp, synthetic construct
  misc_feature 1..20: note = CRISPR gRNA sequence
  source 1..20: mol_type = other DNA
ttcagccatccattcatcca

SEQ ID NO: 79473 - DNA, 20 bp, synthetic construct
  misc_feature 1..20: note = CRISPR gRNA sequence
  source 1..20: mol_type = other DNA
tcagccatccattcatccat

SEQ ID NO: 79474 - DNA, 20 bp, synthetic construct
  misc_feature 1..20: note = CRISPR gRNA sequence
  source 1..20: mol_type = other DNA
cagccatccattcatccatc

SEQ ID NO: 79475 - DNA, 20 bp, synthetic construct
  misc_feature 1..20: note = CRISPR gRNA sequence
  source 1..20: mol_type = other DNA
agccatccattcatccatcc

SEQ ID NO: 79476 - DNA, 20 bp, synthetic construct
  misc_feature 1..20: note = CRISPR gRNA sequence
  source 1..20: mol_type = other DNA
atccatccatcttttcatcc

SEQ ID NO: 79477 - DNA, 20 bp, synthetic construct
  misc_feature 1..20: note = CRISPR gRNA sequence
  source 1..20: mol_type = other DNA
ttcatccacccatccatctt

SEQ ID NO: 79478 - DNA, 20 bp, synthetic construct
  misc_feature 1..20: note = CRISPR gRNA sequence
  source 1..20: mol_type = other DNA
tcatccacccatccatcttt

SEQ ID NO: 79479 - DNA, 20 bp, synthetic construct
  misc_feature 1..20: note = CRISPR gRNA sequence
  source 1..20: mol_type = other DNA
catccacccatccatctttt

SEQ ID NO: 79480 - DNA, 20 bp, synthetic construct
  misc_feature 1..20: note = CRISPR gRNA sequence
  source 1..20: mol_type = other DNA
atccacccatccatcttttc

SEQ ID NO: 79481 - DNA, 20 bp, synthetic construct
  misc_feature 1..20: note = CRISPR gRNA sequence
  source 1..20: mol_type = other DNA
ttcagccatccatccataca

SEQ ID NO: 79482 - DNA, 20 bp, synthetic construct
  misc_feature 1..20: note = CRISPR gRNA sequence
  source 1..20: mol_type = other DNA
tcagccatccatccatacat

SEQ ID NO: 79483 - DNA, 20 bp, synthetic construct
  misc_feature 1..20: note = CRISPR gRNA sequence
  source 1..20: mol_type = other DNA
cagccatccatccatacatc

SEQ ID NO: 79484 - DNA, 20 bp, synthetic construct
  misc_feature 1..20: note = CRISPR gRNA sequence
  source 1..20: mol_type = other DNA
agccatccatccatacatcc

SEQ ID NO: 79485 - DNA, 20 bp, synthetic construct
  misc_feature 1..20: note = CRISPR gRNA sequence
  source 1..20: mol_type = other DNA
ttcatccatccattaattca

SEQ ID NO: 79486 - DNA, 20 bp, synthetic construct
  misc_feature 1..20: note = CRISPR gRNA sequence
  source 1..20: mol_type = other DNA
tcatccatccattaattcaa

SEQ ID NO: 79487 - DNA, 20 bp, synthetic construct
  misc_feature 1..20: note = CRISPR gRNA sequence
  source 1..20: mol_type = other DNA
catccatccattaattcaat

SEQ ID NO: 79488 - DNA, 20 bp, synthetic construct
  misc_feature 1..20: note = CRISPR gRNA sequence
  source 1..20: mol_type = other DNA
atccatccattaattcaata

SEQ ID NO: 79489 - DNA, 20 bp, synthetic construct
  misc_feature 1..20: note = CRISPR gRNA sequence
  source 1..20: mol_type = other DNA
attcaatatataccaagtac

SEQ ID NO: 79490 - DNA, 20 bp, synthetic construct
  misc_feature 1..20: note = CRISPR gRNA sequence
  source 1..20: mol_type = other DNA
aatatataccaagtaccagg

SEQ ID NO: 79491 - DNA, 20 bp, synthetic construct
  misc_feature 1..20: note = CRISPR gRNA sequence
  source 1..20: mol_type = other DNA
agctaggttctgaaggtaaa

SEQ ID NO: 79492 - DNA, 20 bp, synthetic construct
  misc_feature 1..20: note = CRISPR gRNA sequence
  source 1..20: mol_type = other DNA
ggttctgaaggtaaagctgt

SEQ ID NO: 79493 - DNA, 20 bp, synthetic construct
  misc_feature 1..20: note = CRISPR gRNA sequence
  source 1..20: mol_type = other DNA
tgaaggtaaagctgtgagta

SEQ ID NO: 79494 - DNA, 20 bp, synthetic construct
  misc_feature 1..20: note = CRISPR gRNA sequence
  source 1..20: mol_type = other DNA
aaggtaaagctgtgagtaaa

SEQ ID NO: 79495 - DNA, 20 bp, synthetic construct
  misc_feature 1..20: note = CRISPR gRNA sequence
  source 1..20: mol_type = other DNA
tgagtaaaacagtagggtat

SEQ ID NO: 79496 - DNA, 20 bp, synthetic construct
  misc_feature 1..20: note = CRISPR gRNA sequence
  source 1..20: mol_type = other DNA
atcctgcagacgaggggcct

SEQ ID NO: 79497 - DNA, 20 bp, synthetic construct
  misc_feature 1..20: note = CRISPR gRNA sequence
  source 1..20: mol_type = other DNA
tcctgcagacgaggggcctc

SEQ ID NO: 79498 - DNA, 20 bp, synthetic construct
  misc_feature 1..20: note = CRISPR gRNA sequence
  source 1..20: mol_type = other DNA
cagacgaggggcctcctcca

SEQ ID NO: 79499 - DNA, 20 bp, synthetic construct
  misc_feature 1..20: note = CRISPR gRNA sequence
  source 1..20: mol_type = other DNA
ctccatttcccatcccactt

SEQ ID NO: 79500 - DNA, 20 bp, synthetic construct
  misc_feature 1..20: note = CRISPR gRNA sequence
  source 1..20: mol_type = other DNA
catttcccatcccactttcc

SEQ ID NO: 79501 - DNA, 20 bp, synthetic construct
  misc_feature 1..20: note = CRISPR gRNA sequence
  source 1..20: mol_type = other DNA
cccatcccactttcccctcc

SEQ ID NO: 79502 - DNA, 20 bp, synthetic construct
  misc_feature 1..20: note = CRISPR gRNA sequence
  source 1..20: mol_type = other DNA
ccatcccactttcccctcct

SEQ ID NO: 79503 - DNA, 20 bp, synthetic construct
  misc_feature 1..20: note = CRISPR gRNA sequence
  source 1..20: mol_type = other DNA
tcccctcctcttttctcaag

SEQ ID NO: 79504 - DNA, 20 bp, synthetic construct
  misc_feature 1..20: note = CRISPR gRNA sequence
  source 1..20: mol_type = other DNA
cccctcctcttttctcaagg

SEQ ID NO: 79505 - DNA, 20 bp, synthetic construct
  misc_feature 1..20: note = CRISPR gRNA sequence
  source 1..20: mol_type = other DNA
ccctcctcttttctcaaggc

SEQ ID NO: 79506 - DNA, 20 bp, synthetic construct
  misc_feature 1..20: note = CRISPR gRNA sequence
  source 1..20: mol_type = other DNA
ctcttttctcaaggcccata

SEQ ID NO: 79507 - DNA, 20 bp, synthetic construct
  misc_feature 1..20: note = CRISPR gRNA sequence
  source 1..20: mol_type = other DNA
ttttctcaaggcccataagg

SEQ ID NO: 79508 - DNA, 20 bp, synthetic construct
  misc_feature 1..20: note = CRISPR gRNA sequence
  source 1..20: mol_type = other DNA
ttctcaaggcccataaggcc

SEQ ID NO: 79509 - DNA, 20 bp, synthetic construct
  misc_feature 1..20: note = CRISPR gRNA sequence
  source 1..20: mol_type = other DNA
tctcaaggcccataaggcca

SEQ ID NO: 79510 - DNA, 20 bp, synthetic construct
  misc_feature 1..20: note = CRISPR gRNA sequence
  source 1..20: mol_type = other DNA
ctcaaggcccataaggccaa

SEQ ID NO: 79511 - DNA, 20 bp, synthetic construct
  misc_feature 1..20: note = CRISPR gRNA sequence
  source 1..20: mol_type = other DNA
tcaaggcccataaggccaag

SEQ ID NO: 79512 - DNA, 20 bp, synthetic construct
  misc_feature 1..20: note = CRISPR gRNA sequence
  source 1..20: mol_type = other DNA
aaggcccataaggccaagat

SEQ ID NO: 79513 - DNA, 20 bp, synthetic construct
  misc_feature 1..20: note = CRISPR gRNA sequence
  source 1..20: mol_type = other DNA
tccttctgctcacctggcct

SEQ ID NO: 79514 - DNA, 20 bp, synthetic construct
  misc_feature 1..20: note = CRISPR gRNA sequence
  source 1..20: mol_type = other DNA
ccttctgctcacctggcctg

SEQ ID NO: 79515 - DNA, 20 bp, synthetic construct
  misc_feature 1..20: note = CRISPR gRNA sequence
  source 1..20: mol_type = other DNA
cttctgctcacctggcctga

SEQ ID NO: 79516 - DNA, 20 bp, synthetic construct
  misc_feature 1..20: note = CRISPR gRNA sequence
  source 1..20: mol_type = other DNA
ctgctcacctggcctgaagc

SEQ ID NO: 79517 - DNA, 20 bp, synthetic construct
  misc_feature 1..20: note = CRISPR gRNA sequence
  source 1..20: mol_type = other DNA
tgctcacctggcctgaagca

SEQ ID NO: 79518 - DNA, 20 bp, synthetic construct
  misc_feature 1..20: note = CRISPR gRNA sequence
  source 1..20: mol_type = other DNA
ctcacctggcctgaagcatc

SEQ ID NO: 79519 - DNA, 20 bp, synthetic construct
  misc_feature 1..20: note = CRISPR gRNA sequence
  source 1..20: mol_type = other DNA
acctggcctgaagcatcctg

SEQ ID NO: 79520 - DNA, 20 bp, synthetic construct
  misc_feature 1..20: note = CRISPR gRNA sequence
  source 1..20: mol_type = other DNA
gcctgaagcatcctgacggt

SEQ ID NO: 79521 - DNA, 20 bp, synthetic construct
  misc_feature 1..20: note = CRISPR gRNA sequence
  source 1..20: mol_type = other DNA
aagcatcctgacggtaggac

SEQ ID NO: 79522 - DNA, 20 bp, synthetic construct
  misc_feature 1..20: note = CRISPR gRNA sequence
  source 1..20: mol_type = other DNA
acggtaggacacgtgactgc

SEQ ID NO: 79523 - DNA, 20 bp, synthetic construct
  misc_feature 1..20: note = CRISPR gRNA sequence
  source 1..20: mol_type = other DNA
ccacccttgccaagcagagt

SEQ ID NO: 79524 - DNA, 20 bp, synthetic construct
  misc_feature 1..20: note = CRISPR gRNA sequence
  source 1..20: mol_type = other DNA
gccaagcagagtagggttga

SEQ ID NO: 79525 - DNA, 20 bp, synthetic construct
  misc_feature 1..20: note = CRISPR gRNA sequence
  source 1..20: mol_type = other DNA
ccaagcagagtagggttgac

SEQ ID NO: 79526 - DNA, 20 bp, synthetic construct
  misc_feature 1..20: note = CRISPR gRNA sequence
  source 1..20: mol_type = other DNA
acacgcagatgctgttgctg

SEQ ID NO: 79527 - DNA, 20 bp, synthetic construct
  misc_feature 1..20: note = CRISPR gRNA sequence
  source 1..20: mol_type = other DNA
ttgctgctcaggctgcaaga

SEQ ID NO: 79528 - DNA, 20 bp, synthetic construct
  misc_feature 1..20: note = CRISPR gRNA sequence
  source 1..20: mol_type = other DNA
ctgctcaggctgcaagattg

SEQ ID NO: 79529 - DNA, 20 bp, synthetic construct
  misc_feature 1..20: note = CRISPR gRNA sequence
  source 1..20: mol_type = other DNA
ctcaggctgcaagattgtgg

SEQ ID NO: 79530 - DNA, 20 bp, synthetic construct
  misc_feature 1..20: note = CRISPR gRNA sequence
  source 1..20: mol_type = other DNA
aggctgcaagattgtggcaa

SEQ ID NO: 79531 - DNA, 20 bp, synthetic construct
  misc_feature 1..20: note = CRISPR gRNA sequence
  source 1..20: mol_type = other DNA
caagattgtggcaaaggtgt

SEQ ID NO: 79532 - DNA, 20 bp, synthetic construct
  misc_feature 1..20: note = CRISPR gRNA sequence
  source 1..20: mol_type = other DNA
tggcaaaggtgtcaggagtg

SEQ ID NO: 79533 - DNA, 20 bp, synthetic construct
  misc_feature 1..20: note = CRISPR gRNA sequence
  source 1..20: mol_type = other DNA
ccccaggggccccagacctt

SEQ ID NO: 79534 - DNA, 20 bp, synthetic construct
  misc_feature 1..20: note = CRISPR gRNA sequence
  source 1..20: mol_type = other DNA
ccttgccttgcaagggagtg

SEQ ID NO: 79535 - DNA, 20 bp, synthetic construct
  misc_feature 1..20: note = CRISPR gRNA sequence
  source 1..20: mol_type = other DNA
cttgccttgcaagggagtgg

SEQ ID NO: 79536 - DNA, 20 bp, synthetic construct
  misc_feature 1..20: note = CRISPR gRNA sequence
  source 1..20: mol_type = other DNA
gccttgcaagggagtggggt

SEQ ID NO: 79537 - DNA, 20 bp, synthetic construct
  misc_feature 1..20: note = CRISPR gRNA sequence
  source 1..20: mol_type = other DNA
ccttgcaagggagtggggtg

SEQ ID NO: 79538 - DNA, 20 bp, synthetic construct
  misc_feature 1..20: note = CRISPR gRNA sequence
  source 1..20: mol_type = other DNA
gcaagggagtggggtgaatc

SEQ ID NO: 79539 - DNA, 20 bp, synthetic construct
  misc_feature 1..20: note = CRISPR gRNA sequence
  source 1..20: mol_type = other DNA
caagggagtggggtgaatca

SEQ ID NO: 79540 - DNA, 20 bp, synthetic construct
  misc_feature 1..20: note = CRISPR gRNA sequence
  source 1..20: mol_type = other DNA
ggctgcagaggcagtggaaa

SEQ ID NO: 79541 - DNA, 20 bp, synthetic construct
  misc_feature 1..20: note = CRISPR gRNA sequence
  source 1..20: mol_type = other DNA
cagaggcagtggaaagatca

SEQ ID NO: 79542 - DNA, 20 bp, synthetic construct
  misc_feature 1..20: note = CRISPR gRNA sequence
  source 1..20: mol_type = other DNA
actcaagcttccggagccgt

SEQ ID NO: 79543 - DNA, 20 bp, synthetic construct
  misc_feature 1..20: note = CRISPR gRNA sequence
  source 1..20: mol_type = other DNA
ctcaagcttccggagccgtg

SEQ ID NO: 79544 - DNA, 20 bp, synthetic construct
  misc_feature 1..20: note = CRISPR gRNA sequence
  source 1..20: mol_type = other DNA
aagcttccggagccgtggta

SEQ ID NO: 79545 - DNA, 20 bp, synthetic construct
  misc_feature 1..20: note = CRISPR gRNA sequence
  source 1..20: mol_type = other DNA
ccggagccgtggtaggtgag

SEQ ID NO: 79546 - DNA, 20 bp, synthetic construct
  misc_feature 1..20: note = CRISPR gRNA sequence
  source 1..20: mol_type = other DNA
cggagccgtggtaggtgagg

SEQ ID NO: 79547 - DNA, 20 bp, synthetic construct
  misc_feature 1..20: note = CRISPR gRNA sequence
  source 1..20: mol_type = other DNA
cacaatgttcagcaccacct

SEQ ID NO: 79548 - DNA, 20 bp, synthetic construct
  misc_feature 1..20: note = CRISPR gRNA sequence
  source 1..20: mol_type = other DNA
agcaccacctggtcactgag

SEQ ID NO: 79549 - DNA, 20 bp, synthetic construct
  misc_feature 1..20: note = CRISPR gRNA sequence
  source 1..20: mol_type = other DNA
gtcactgagctggttgtccc

SEQ ID NO: 79550 - DNA, 20 bp, synthetic construct
  misc_feature 1..20: note = CRISPR gRNA sequence
  source 1..20: mol_type = other DNA
agctggttgtcccgaaaact

SEQ ID NO: 79551 - DNA, 20 bp, synthetic construct
  misc_feature 1..20: note = CRISPR gRNA sequence
  source 1..20: mol_type = other DNA
gttgtcccgaaaactgcgag

SEQ ID NO: 79552 - DNA, 20 bp, synthetic construct
  misc_feature 1..20: note = CRISPR gRNA sequence
  source 1..20: mol_type = other DNA
tcccgaaaactgcgaggaga

SEQ ID NO: 79553 - DNA, 20 bp, synthetic construct
  misc_feature 1..20: note = CRISPR gRNA sequence
  source 1..20: mol_type = other DNA
cgaggagaccaaggcccagt

SEQ ID NO: 79554 - DNA, 20 bp, synthetic construct
  misc_feature 1..20: note = CRISPR gRNA sequence
  source 1..20: mol_type = other DNA
tgccctggggttggggcact

SEQ ID NO: 79555 - DNA, 20 bp, synthetic construct
  misc_feature 1..20: note = CRISPR gRNA sequence
  source 1..20: mol_type = other DNA
gccctggggttggggcactt

SEQ ID NO: 79556 - DNA, 20 bp, synthetic construct
  misc_feature 1..20: note = CRISPR gRNA sequence
  source 1..20: mol_type = other DNA
ccctggggttggggcacttg

SEQ ID NO: 79557 - DNA, 20 bp, synthetic construct
  misc_feature 1..20: note = CRISPR gRNA sequence
  source 1..20: mol_type = other DNA
gggttggggcacttgcaagc

SEQ ID NO: 79558 - DNA, 20 bp, synthetic construct
  misc_feature 1..20: note = CRISPR gRNA sequence
  source 1..20: mol_type = other DNA
gggcacttgcaagccccagt

SEQ ID NO: 79559 - DNA, 20 bp, synthetic construct
  misc_feature 1..20: note = CRISPR gRNA sequence
  source 1..20: mol_type = other DNA
gcaagccccagttagcaagt

SEQ ID NO: 79560 - DNA, 20 bp, synthetic construct
  misc_feature 1..20: note = CRISPR gRNA sequence
  source 1..20: mol_type = other DNA
caagccccagttagcaagtg

SEQ ID NO: 79561 - DNA, 20 bp, synthetic construct
  misc_feature 1..20: note = CRISPR gRNA sequence
  source 1..20: mol_type = other DNA
gcaagtgacaggatggccac

SEQ ID NO: 79562 - DNA, 20 bp, synthetic construct
  misc_feature 1..20: note = CRISPR gRNA sequence
  source 1..20: mol_type = other DNA
atgtgggagacataagacag

SEQ ID NO: 79563 - DNA, 20 bp, synthetic construct
  misc_feature 1..20: note = CRISPR gRNA sequence
  source 1..20: mol_type = other DNA
atggcctgctcgccggattc

SEQ ID NO: 79564 - DNA, 20 bp, synthetic construct
  misc_feature 1..20: note = CRISPR gRNA sequence
  source 1..20: mol_type = other DNA
ctcgccggattccagcaggc

SEQ ID NO: 79565 - DNA, 20 bp, synthetic construct
  misc_feature 1..20: note = CRISPR gRNA sequence
  source 1..20: mol_type = other DNA
gccggattccagcaggcacg

SEQ ID NO: 79566 - DNA, 20 bp, synthetic construct
  misc_feature 1..20: note = CRISPR gRNA sequence
  source 1..20: mol_type = other DNA
cagcaggcacggctaggagg

SEQ ID NO: 79567 - DNA, 20 bp, synthetic construct
  misc_feature 1..20: note = CRISPR gRNA sequence
  source 1..20: mol_type = other DNA
ggaggaaagaccctctgctg

SEQ ID NO: 79568 - DNA, 20 bp, synthetic construct
  misc_feature 1..20: note = CRISPR gRNA sequence
  source 1..20: mol_type = other DNA
tgctggcctcaattctgggt

SEQ ID NO: 79569 - DNA, 20 bp, synthetic construct
  misc_feature 1..20: note = CRISPR gRNA sequence
  source 1..20: mol_type = other DNA
ctggcctcaattctgggtct

SEQ ID NO: 79570 - DNA, 20 bp, synthetic construct
  misc_feature 1..20: note = CRISPR gRNA sequence
  source 1..20: mol_type = other DNA
gcctcaattctgggtctatt

SEQ ID NO: 79571 - DNA, 20 bp, synthetic construct
  misc_feature 1..20: note = CRISPR gRNA sequence
  source 1..20: mol_type = other DNA
aattctgggtctattctgtt

SEQ ID NO: 79572 - DNA, 20 bp, synthetic construct
  misc_feature 1..20: note = CRISPR gRNA sequence
  source 1..20: mol_type = other DNA
tgggtctattctgttcctat

SEQ ID NO: 79573 - DNA, 20 bp, synthetic construct
  misc_feature 1..20: note = CRISPR gRNA sequence
  source 1..20: mol_type = other DNA
ggtctattctgttcctatgg

SEQ ID NO: 79574 - DNA, 20 bp, synthetic construct
  misc_feature 1..20: note = CRISPR gRNA sequence
  source 1..20: mol_type = other DNA
ttctgttcctatggggaagt

SEQ ID NO: 79575 - DNA, 20 bp, synthetic construct
  misc_feature 1..20: note = CRISPR gRNA sequence
  source 1..20: mol_type = other DNA
tgttcctatggggaagtttt

SEQ ID NO: 79576 - DNA, 20 bp, synthetic construct
  misc_feature 1..20: note = CRISPR gRNA sequence
  source 1..20: mol_type = other DNA
ttcctatggggaagtttttg

SEQ ID NO: 79577 - DNA, 20 bp, synthetic construct
  misc_feature 1..20: note = CRISPR gRNA sequence
  source 1..20: mol_type = other DNA
ctatggggaagtttttgcct

SEQ ID NO: 79578 - DNA, 20 bp, synthetic construct
  misc_feature 1..20: note = CRISPR gRNA sequence
  source 1..20: mol_type = other DNA
tggggaagtttttgcctggc

SEQ ID NO: 79579 - DNA, 20 bp, synthetic construct
  misc_feature 1..20: note = CRISPR gRNA sequence
  source 1..20: mol_type = other DNA
ttgcctggcggctcaaggga

SEQ ID NO: 79580 - DNA, 20 bp, synthetic construct
  misc_feature 1..20: note = CRISPR gRNA sequence
  source 1..20: mol_type = other DNA
tgcctggcggctcaagggat

SEQ ID NO: 79581 - DNA, 20 bp, synthetic construct
  misc_feature 1..20: note = CRISPR gRNA sequence
  source 1..20: mol_type = other DNA
gcctggcggctcaagggatc

SEQ ID NO: 79582 - DNA, 20 bp, synthetic construct
  misc_feature 1..20: note = CRISPR gRNA sequence
  source 1..20: mol_type = other DNA
cctggcggctcaagggatct

SEQ ID NO: 79583 - DNA, 20 bp, synthetic construct
  misc_feature 1..20: note = CRISPR gRNA sequence
  source 1..20: mol_type = other DNA
gcggctcaagggatctagaa

SEQ ID NO: 79584 - DNA, 20 bp, synthetic construct
  misc_feature 1..20: note = CRISPR gRNA sequence
  source 1..20: mol_type = other DNA
aagggatctagaagacagac

SEQ ID NO: 79585 - DNA, 20 bp, synthetic construct
  misc_feature 1..20: note = CRISPR gRNA sequence
  source 1..20: mol_type = other DNA
gaagacagactgacggcctc

SEQ ID NO: 79586 - DNA, 20 bp, synthetic construct
  misc_feature 1..20: note = CRISPR gRNA sequence
  source 1..20: mol_type = other DNA
acggcctcttcatgaggcac

SEQ ID NO: 79587 - DNA, 20 bp, synthetic construct
  misc_feature 1..20: note = CRISPR gRNA sequence
  source 1..20: mol_type = other DNA
ttcatgaggcacaatgagga

SEQ ID NO: 79588 - DNA, 20 bp, synthetic construct
  misc_feature 1..20: note = CRISPR gRNA sequence
  source 1..20: mol_type = other DNA
catgaggcacaatgaggaga

SEQ ID NO: 79589 - DNA, 20 bp, synthetic construct
  misc_feature 1..20: note = CRISPR gRNA sequence
  source 1..20: mol_type = other DNA
atgaggcacaatgaggagac

SEQ ID NO: 79590 - DNA, 20 bp, synthetic construct
  misc_feature 1..20: note = CRISPR gRNA sequence
  source 1..20: mol_type = other DNA
gcaccctgctcccagggctt

SEQ ID NO: 79591 - DNA, 20 bp, synthetic construct
  misc_feature 1..20: note = CRISPR gRNA sequence
  source 1..20: mol_type = other DNA
ctcccagggcttatgcctgg

SEQ ID NO: 79592 - DNA, 20 bp, synthetic construct
  misc_feature 1..20: note = CRISPR gRNA sequence
  source 1..20: mol_type = other DNA
ccagggcttatgcctgggat

SEQ ID NO: 79593 - DNA, 20 bp, synthetic construct
  misc_feature 1..20: note = CRISPR gRNA sequence
  source 1..20: mol_type = other DNA
atgcctgggatgtgcctggg

SEQ ID NO: 79594 - DNA, 20 bp, synthetic construct
  misc_feature 1..20: note = CRISPR gRNA sequence
  source 1..20: mol_type = other DNA
tgcctgggatgtgcctggga

SEQ ID NO: 79595 - DNA, 20 bp, synthetic construct
  misc_feature 1..20: note = CRISPR gRNA sequence
  source 1..20: mol_type = other DNA
ggatgtgcctgggataggcc

SEQ ID NO: 79596 - DNA, 20 bp, synthetic construct
  misc_feature 1..20: note = CRISPR gRNA sequence
  source 1..20: mol_type = other DNA
ggataggccccccaggcaat

SEQ ID NO: 79597 - DNA, 20 bp, synthetic construct
  misc_feature 1..20: note = CRISPR gRNA sequence
  source 1..20: mol_type = other DNA
gactgggacgctgcagacat

SEQ ID NO: 79598 - DNA, 20 bp, synthetic construct
  misc_feature 1..20: note = CRISPR gRNA sequence
  source 1..20: mol_type = other DNA
ggacgctgcagacatcgctt

SEQ ID NO: 79599 - DNA, 20 bp, synthetic construct
  misc_feature 1..20: note = CRISPR gRNA sequence
  source 1..20: mol_type = other DNA
cagacatcgcttccagcctc

SEQ ID NO: 79600 - DNA, 20 bp, synthetic construct
  misc_feature 1..20: note = CRISPR gRNA sequence
  source 1..20: mol_type = other DNA
ccagcctcggctgtggccct

SEQ ID NO: 79601 - DNA, 20 bp, synthetic construct
  misc_feature 1..20: note = CRISPR gRNA sequence
  source 1..20: mol_type = other DNA
cagcctcggctgtggccctg

SEQ ID NO: 79602 - DNA, 20 bp, synthetic construct
  misc_feature 1..20: note = CRISPR gRNA sequence
  source 1..20: mol_type = other DNA
ggctgtggccctgactcacc

SEQ ID NO: 79603 - DNA, 20 bp, synthetic construct
  misc_feature 1..20: note = CRISPR gRNA sequence
  source 1..20: mol_type = other DNA
tggccctgactcacccagag

SEQ ID NO: 79604 - DNA, 20 bp, synthetic construct
  misc_feature 1..20: note = CRISPR gRNA sequence
  source 1..20: mol_type = other DNA
actcacccagagccctgagc

SEQ ID NO: 79605 - DNA, 20 bp, synthetic construct
  misc_feature 1..20: note = CRISPR gRNA sequence
  source 1..20: mol_type = other DNA
acccagagccctgagccaag

SEQ ID NO: 79606 - DNA, 20 bp, synthetic construct
  misc_feature 1..20: note = CRISPR gRNA sequence
  source 1..20: mol_type = other DNA
agccaagcgcattcctctct

SEQ ID NO: 79607 - DNA, 20 bp, synthetic construct
  misc_feature 1..20: note = CRISPR gRNA sequence
  source 1..20: mol_type = other DNA
ctctctgacctcactttccc

SEQ ID NO: 79608 - DNA, 20 bp, synthetic construct
  misc_feature 1..20: note = CRISPR gRNA sequence
  source 1..20: mol_type = other DNA
tctgacctcactttccccac

SEQ ID NO: 79609 - DNA, 20 bp, synthetic construct
  misc_feature 1..20: note = CRISPR gRNA sequence
  source 1..20: mol_type = other DNA
tgacctcactttccccacct

SEQ ID NO: 79610 - DNA, 20 bp, synthetic construct
  misc_feature 1..20: note = CRISPR gRNA sequence
  source 1..20: mol_type = other DNA
acctcactttccccacctgt

SEQ ID NO: 79611 - DNA, 20 bp, synthetic construct
  misc_feature 1..20: note = CRISPR gRNA sequence
  source 1..20: mol_type = other DNA
actttccccacctgttcaca

SEQ ID NO: 79612 - DNA, 20 bp, synthetic construct
  misc_feature 1..20: note = CRISPR gRNA sequence
  source 1..20: mol_type = other DNA
tccccacctgttcacaagcc

SEQ ID NO: 79613 - DNA, 20 bp, synthetic construct
  misc_feature 1..20: note = CRISPR gRNA sequence
  source 1..20: mol_type = other DNA
ccccacctgttcacaagcca

SEQ ID NO: 79614 - DNA, 20 bp, synthetic construct
  misc_feature 1..20: note = CRISPR gRNA sequence
  source 1..20: mol_type = other DNA
cccacctgttcacaagccag

SEQ ID NO: 79615 - DNA, 20 bp, synthetic construct
  misc_feature 1..20: note = CRISPR gRNA sequence
  source 1..20: mol_type = other DNA
ttcacaagccagccttgcct

SEQ ID NO: 79616 - DNA, 20 bp, synthetic construct
  misc_feature 1..20: note = CRISPR gRNA sequence
  source 1..20: mol_type = other DNA
acaagccagccttgcctggg

SEQ ID NO: 79617 - DNA, 20 bp, synthetic construct
  misc_feature 1..20: note = CRISPR gRNA sequence
  source 1..20: mol_type = other DNA
gcctgggttcctagctgggg

SEQ ID NO: 79618 - DNA, 20 bp, synthetic construct
  misc_feature 1..20: note = CRISPR gRNA sequence
  source 1..20: mol_type = other DNA
cctgggttcctagctgggga

SEQ ID NO: 79619 - DNA, 20 bp, synthetic construct
  misc_feature 1..20: note = CRISPR gRNA sequence
  source 1..20: mol_type = other DNA
ggttcctagctggggagaca

SEQ ID NO: 79620 - DNA, 20 bp, synthetic construct
  misc_feature 1..20: note = CRISPR gRNA sequence
  source 1..20: mol_type = other DNA
ctagctggggagacagatga

SEQ ID NO: 79621 - DNA, 20 bp, synthetic construct
  misc_feature 1..20: note = CRISPR gRNA sequence
  source 1..20: mol_type = other DNA
gctggggagacagatgagtt

SEQ ID NO: 79622 - DNA, 20 bp, synthetic construct
  misc_feature 1..20: note = CRISPR gRNA sequence
  source 1..20: mol_type = other DNA
gggagacagatgagttgagg

SEQ ID NO: 79623 - DNA, 20 bp, synthetic construct
  misc_feature 1..20: note = CRISPR gRNA sequence
  source 1..20: mol_type = other DNA
aggggagtgagggtgattaa

SEQ ID NO: 79624 - DNA, 20 bp, synthetic construct
  misc_feature 1..20: note = CRISPR gRNA sequence
  source 1..20: mol_type = other DNA
agaacaatggtgggtgatga

SEQ ID NO: 79625 - DNA, 20 bp, synthetic construct
  misc_feature 1..20: note = CRISPR gRNA sequence
  source 1..20: mol_type = other DNA
aagtcactttcaatagccag

SEQ ID NO: 79626 - DNA, 20 bp, synthetic construct
  misc_feature 1..20: note = CRISPR gRNA sequence
  source 1..20: mol_type = other DNA
tcaatagccagggaagaaaa

SEQ ID NO: 79627 - DNA, 20 bp, synthetic construct
  misc_feature 1..20: note = CRISPR gRNA sequence
  source 1..20: mol_type = other DNA
caatagccagggaagaaaaa

SEQ ID NO: 79628 - DNA, 20 bp, synthetic construct
  misc_feature 1..20: note = CRISPR gRNA sequence
  source 1..20: mol_type = other DNA
aatagccagggaagaaaaat

SEQ ID NO: 79629 - DNA, 20 bp, synthetic construct
  misc_feature 1..20: note = CRISPR gRNA sequence
  source 1..20: mol_type = other DNA
agtacttctgaaccttggct

SEQ ID NO: 79630 - DNA, 20 bp, synthetic construct
  misc_feature 1..20: note = CRISPR gRNA sequence
  source 1..20: mol_type = other DNA
ctgaaccttggcttaatcac

SEQ ID NO: 79631 - DNA, 20 bp, synthetic construct
  misc_feature 1..20: note = CRISPR gRNA sequence
  source 1..20: mol_type = other DNA
tgaaccttggcttaatcacg

SEQ ID NO: 79632 - DNA, 20 bp, synthetic construct
  misc_feature 1..20: note = CRISPR gRNA sequence
  source 1..20: mol_type = other DNA
aaccttggcttaatcacggt

SEQ ID NO: 79633 - DNA, 20 bp, synthetic construct
  misc_feature 1..20: note = CRISPR gRNA sequence
  source 1..20: mol_type = other DNA
ggcttaatcacggttcacag

SEQ ID NO: 79634 - DNA, 20 bp, synthetic construct
  misc_feature 1..20: note = CRISPR gRNA sequence
  source 1..20: mol_type = other DNA
gcttaatcacggttcacaga

SEQ ID NO: 79635 - DNA, 20 bp, synthetic construct
  misc_feature 1..20: note = CRISPR gRNA sequence
  source 1..20: mol_type = other DNA
aatcacggttcacagatgcc

SEQ ID NO: 79636 - DNA, 20 bp, synthetic construct
  misc_feature 1..20: note = CRISPR gRNA sequence
  source 1..20: mol_type = other DNA
atcacggttcacagatgccc

SEQ ID NO: 79637 - DNA, 20 bp, synthetic construct
  misc_feature 1..20: note = CRISPR gRNA sequence
  source 1..20: mol_type = other DNA
acagatgcccagccgagacg

SEQ ID NO: 79638 - DNA, 20 bp, synthetic construct
  misc_feature 1..20: note = CRISPR gRNA sequence
  source 1..20: mol_type = other DNA
tggtccaacttattattttc

SEQ ID NO: 79639 - DNA, 20 bp, synthetic construct
  misc_feature 1..20: note = CRISPR gRNA sequence
  source 1..20: mol_type = other DNA
attattttcactcaacaagt

SEQ ID NO: 79640 - DNA, 20 bp, synthetic construct
  misc_feature 1..20: note = CRISPR gRNA sequence
  source 1..20: mol_type = other DNA
ttattttcactcaacaagtg

SEQ ID NO: 79641 - DNA, 20 bp, synthetic construct
  misc_feature 1..20: note = CRISPR gRNA sequence
  source 1..20: mol_type = other DNA
ttttcactcaacaagtgctg

SEQ ID NO: 79642 - DNA, 20 bp, synthetic construct
  misc_feature 1..20: note = CRISPR gRNA sequence
  source 1..20: mol_type = other DNA
tcactcaacaagtgctgaac

SEQ ID NO: 79643 - DNA, 20 bp, synthetic construct
  misc_feature 1..20: note = CRISPR gRNA sequence
  source 1..20: mol_type = other DNA
cactcaacaagtgctgaacc

SEQ ID NO: 79644 - DNA, 20 bp, synthetic construct
  misc_feature 1..20: note = CRISPR gRNA sequence
  source 1..20: mol_type = other DNA
actcaacaagtgctgaacct

SEQ ID NO: 79645 - DNA, 20 bp, synthetic construct
  misc_feature 1..20: note = CRISPR gRNA sequence
  source 1..20: mol_type = other DNA
aacaagtgctgaaccttagt

SEQ ID NO: 79646 - DNA, 20 bp, synthetic construct
  misc_feature 1..20: note = CRISPR gRNA sequence
  source 1..20: mol_type = other DNA
aaccttagtgacaggctgca

SEQ ID NO: 79647 - DNA, 20 bp, synthetic construct
  misc_feature 1..20: note = CRISPR gRNA sequence
  source 1..20: mol_type = other DNA
agtgacaggctgcatctgtg

SEQ ID NO: 79648 - DNA, 20 bp, synthetic construct
  misc_feature 1..20: note = CRISPR gRNA sequence
  source 1..20: mol_type = other DNA
gtgacaggctgcatctgtgt

SEQ ID NO: 79649 - DNA, 20 bp, synthetic construct
  misc_feature 1..20: note = CRISPR gRNA sequence
  source 1..20: mol_type = other DNA
catctgtgtggatgaagtgg

SEQ ID NO: 79650 - DNA, 20 bp, synthetic construct
  misc_feature 1..20: note = CRISPR gRNA sequence
  source 1..20: mol_type = other DNA
tgtggatgaagtggtgcctt

SEQ ID NO: 79651 - DNA, 20 bp, synthetic construct
  misc_feature 1..20: note = CRISPR gRNA sequence
  source 1..20: mol_type = other DNA
ctctaaatgtcataaaggtg

SEQ ID NO: 79652 - DNA, 20 bp, synthetic construct
  misc_feature 1..20: note = CRISPR gRNA sequence
  source 1..20: mol_type = other DNA
tctaaatgtcataaaggtgc

SEQ ID NO: 79653 - DNA, 20 bp, synthetic construct
  misc_feature 1..20: note = CRISPR gRNA sequence
  source 1..20: mol_type = other DNA
taaatgtcataaaggtgcca

SEQ ID NO: 79654 - DNA, 20 bp, synthetic construct
  misc_feature 1..20: note = CRISPR gRNA sequence
  source 1..20: mol_type = other DNA
aatgtcataaaggtgccata

SEQ ID NO: 79655 - DNA, 20 bp, synthetic construct
  misc_feature 1..20: note = CRISPR gRNA sequence
  source 1..20: mol_type = other DNA
gcagcgttctgccagggagg

SEQ ID NO: 79656 - DNA, 20 bp, synthetic construct
  misc_feature 1..20: note = CRISPR gRNA sequence
  source 1..20: mol_type = other DNA
tgccagggaggagggtcact

SEQ ID NO: 79657 - DNA, 20 bp, synthetic construct
  misc_feature 1..20: note = CRISPR gRNA sequence
  source 1..20: mol_type = other DNA
ccagggaggagggtcactgg

SEQ ID NO: 79658 - DNA, 20 bp, synthetic construct
  misc_feature 1..20: note = CRISPR gRNA sequence
  source 1..20: mol_type = other DNA
gtcccactcctccccatggt

SEQ ID NO: 79659 - DNA, 20 bp, synthetic construct
  misc_feature 1..20: note = CRISPR gRNA sequence
  source 1..20: mol_type = other DNA
ctccccatggtactgagtcc

SEQ ID NO: 79660 - DNA, 20 bp, synthetic construct
  misc_feature 1..20: note = CRISPR gRNA sequence
  source 1..20: mol_type = other DNA
cccatggtactgagtcccag

SEQ ID NO: 79661 - DNA, 20 bp, synthetic construct
  misc_feature 1..20: note = CRISPR gRNA sequence
  source 1..20: mol_type = other DNA
agtcccagacacagggcagg

SEQ ID NO: 79662 - DNA, 20 bp, synthetic construct
  misc_feature 1..20: note = CRISPR gRNA sequence
  source 1..20: mol_type = other DNA
gtgcatacaagcttagttag

SEQ ID NO: 79663 - DNA, 20 bp, synthetic construct
  misc_feature 1..20: note = CRISPR gRNA sequence
  source 1..20: mol_type = other DNA
tgcatacaagcttagttagt

SEQ ID NO: 79664 - DNA, 20 bp, synthetic construct
  misc_feature 1..20: note = CRISPR gRNA sequence
  source 1..20: mol_type = other DNA
agttagttagagtgtgctgg

SEQ ID NO: 79665 - DNA, 20 bp, synthetic construct
  misc_feature 1..20: note = CRISPR gRNA sequence
  source 1..20: mol_type = other DNA
gttagttagagtgtgctggc

SEQ ID NO: 79666 - DNA, 20 bp, synthetic construct
  misc_feature 1..20: note = CRISPR gRNA sequence
  source 1..20: mol_type = other DNA
gttagagtgtgctggcatca

SEQ ID NO: 79667 - DNA, 20 bp, synthetic construct
  misc_feature 1..20: note = CRISPR gRNA sequence
  source 1..20: mol_type = other DNA
gagtgtgctggcatcaaaat

SEQ ID NO: 79668 - DNA, 20 bp, synthetic construct
  misc_feature 1..20: note = CRISPR gRNA sequence
  source 1..20: mol_type = other DNA
gcatcaaaatgtgtacatgt

SEQ ID NO: 79669 - DNA, 20 bp, synthetic construct
  misc_feature 1..20: note = CRISPR gRNA sequence
  source 1..20: mol_type = other DNA
aaggtgcatgtgtgcgctgc

SEQ ID NO: 79670 - DNA, 20 bp, synthetic construct
  misc_feature 1..20: note = CRISPR gRNA sequence
  source 1..20: mol_type = other DNA
catacatgtgcacacctatg

SEQ ID NO: 79671 - DNA, 20 bp, synthetic construct
  misc_feature 1..20: note = CRISPR gRNA sequence
  source 1..20: mol_type = other DNA
tgagtgggcatgtgtgggtg

SEQ ID NO: 79672 - DNA, 20 bp, synthetic construct
  misc_feature 1..20: note = CRISPR gRNA sequence
  source 1..20: mol_type = other DNA
ttgcatatgcctgtgtactt

SEQ ID NO: 79673 - DNA, 20 bp, synthetic construct
  misc_feature 1..20: note = CRISPR gRNA sequence
  source 1..20: mol_type = other DNA
gcatatgcctgtgtacttct

SEQ ID NO: 79674 - DNA, 20 bp, synthetic construct
  misc_feature 1..20: note = CRISPR gRNA sequence
  source 1..20: mol_type = other DNA
catatgcctgtgtacttctg

SEQ ID NO: 79675 - DNA, 20 bp, synthetic construct
  misc_feature 1..20: note = CRISPR gRNA sequence
  source 1..20: mol_type = other DNA
tgtacttctgtgcaagtgta

SEQ ID NO: 79676 - DNA, 20 bp, synthetic construct
  misc_feature 1..20: note = CRISPR gRNA sequence
  source 1..20: mol_type = other DNA
ctgtgcaagtgtagacatgt

SEQ ID NO: 79677 - DNA, 20 bp, synthetic construct
  misc_feature 1..20: note = CRISPR gRNA sequence
  source 1..20: mol_type = other DNA
tgtgcaagtgtagacatgtg

SEQ ID NO: 79678 - DNA, 20 bp, synthetic construct
  misc_feature 1..20: note = CRISPR gRNA sequence
  source 1..20: mol_type = other DNA
tgcaagtgtagacatgtgtg

SEQ ID NO: 79679 - DNA, 20 bp, synthetic construct
  misc_feature 1..20: note = CRISPR gRNA sequence
  source 1..20: mol_type = other DNA
catgtagttatgtgtaccca

SEQ ID NO: 79680 - DNA, 20 bp, synthetic construct
  misc_feature 1..20: note = CRISPR gRNA sequence
  source 1..20: mol_type = other DNA
atgtagttatgtgtacccac

SEQ ID NO: 79681 - DNA, 20 bp, synthetic construct
  misc_feature 1..20: note = CRISPR gRNA sequence
  source 1..20: mol_type = other DNA
tgtgtacccacagtgcctga

SEQ ID NO: 79682 - DNA, 20 bp, synthetic construct
  misc_feature 1..20: note = CRISPR gRNA sequence
  source 1..20: mol_type = other DNA
attcctgcctacgcactgct

SEQ ID NO: 79683 - DNA, 20 bp, synthetic construct
  misc_feature 1..20: note = CRISPR gRNA sequence
  source 1..20: mol_type = other DNA
ctgcctacgcactgctatcc

SEQ ID NO: 79684 - DNA, 20 bp, synthetic construct
  misc_feature 1..20: note = CRISPR gRNA sequence
  source 1..20: mol_type = other DNA
cctacgcactgctatccctt

SEQ ID NO: 79685 - DNA, 20 bp, synthetic construct
  misc_feature 1..20: note = CRISPR gRNA sequence
  source 1..20: mol_type = other DNA
cgcactgctatcccttctcc

SEQ ID NO: 79686 - DNA, 20 bp, synthetic construct
  misc_feature 1..20: note = CRISPR gRNA sequence
  source 1..20: mol_type = other DNA
ctatcccttctcctgggatt

SEQ ID NO: 79687 - DNA, 20 bp, synthetic construct
  misc_feature 1..20: note = CRISPR gRNA sequence
  source 1..20: mol_type = other DNA
tcccttctcctgggatttca

SEQ ID NO: 79688 - DNA, 20 bp, synthetic construct
  misc_feature 1..20: note = CRISPR gRNA sequence
  source 1..20: mol_type = other DNA
ctcctgggatttcagaaaga

SEQ ID NO: 79689 - DNA, 20 bp, synthetic construct
  misc_feature 1..20: note = CRISPR gRNA sequence
  source 1..20: mol_type = other DNA
tcctgggatttcagaaagag

SEQ ID NO: 79690 - DNA, 20 bp, synthetic construct
  misc_feature 1..20: note = CRISPR gRNA sequence
  source 1..20: mol_type = other DNA
ctgggatttcagaaagaggg

SEQ ID NO: 79691 - DNA, 20 bp, synthetic construct
  misc_feature 1..20: note = CRISPR gRNA sequence
  source 1..20: mol_type = other DNA
ggatttcagaaagagggagg

SEQ ID NO: 79692 - DNA, 20 bp, synthetic construct
  misc_feature 1..20: note = CRISPR gRNA sequence
  source 1..20: mol_type = other DNA
cagaaagagggagggagcct

SEQ ID NO: 79693 - DNA, 20 bp, synthetic construct
  misc_feature 1..20: note = CRISPR gRNA sequence
  source 1..20: mol_type = other DNA
agaaagagggagggagcctt

SEQ ID NO: 79694 - DNA, 20 bp, synthetic construct
  misc_feature 1..20: note = CRISPR gRNA sequence
  source 1..20: mol_type = other DNA
aacactcatgctcctccaag

SEQ ID NO: 79695 - DNA, 20 bp, synthetic construct
  misc_feature 1..20: note = CRISPR gRNA sequence
  source 1..20: mol_type = other DNA
acactcatgctcctccaaga

SEQ ID NO: 79696 - DNA, 20 bp, synthetic construct
  misc_feature 1..20: note = CRISPR gRNA sequence
  source 1..20: mol_type = other DNA
atgctcctccaagacagtct

SEQ ID NO: 79697 - DNA, 20 bp, synthetic construct
  misc_feature 1..20: note = CRISPR gRNA sequence
  source 1..20: mol_type = other DNA
ctccaagacagtctaaaata

SEQ ID NO: 79698 - DNA, 20 bp, synthetic construct
  misc_feature 1..20: note = CRISPR gRNA sequence
  source 1..20: mol_type = other DNA
caagacagtctaaaatatta

SEQ ID NO: 79699 - DNA, 20 bp, synthetic construct
  misc_feature 1..20: note = CRISPR gRNA sequence
  source 1..20: mol_type = other DNA
aaatattagatgaaggaagc

SEQ ID NO: 79700 - DNA, 20 bp, synthetic construct
  misc_feature 1..20: note = CRISPR gRNA sequence
  source 1..20: mol_type = other DNA
gatgaaggaagccttgctct

SEQ ID NO: 79701 - DNA, 20 bp, synthetic construct
  misc_feature 1..20: note = CRISPR gRNA sequence
  source 1..20: mol_type = other DNA
gctctggggactctgggagc

SEQ ID NO: 79702 - DNA, 20 bp, synthetic construct
  misc_feature 1..20: note = CRISPR gRNA sequence
  source 1..20: mol_type = other DNA
ctctggggactctgggagcc

SEQ ID NO: 79703 - DNA, 20 bp, synthetic construct
  misc_feature 1..20: note = CRISPR gRNA sequence
  source 1..20: mol_type = other DNA
tggggactctgggagccttg

SEQ ID NO: 79704 - DNA, 20 bp, synthetic construct
  misc_feature 1..20: note = CRISPR gRNA sequence
  source 1..20: mol_type = other DNA
gggactctgggagccttggg

SEQ ID NO: 79705 - DNA, 20 bp, synthetic construct
  misc_feature 1..20: note = CRISPR gRNA sequence
  source 1..20: mol_type = other DNA
tgggagccttgggtttggac

SEQ ID NO: 79706 - DNA, 20 bp, synthetic construct
  misc_feature 1..20: note = CRISPR gRNA sequence
  source 1..20: mol_type = other DNA
ggagccttgggtttggactc

SEQ ID NO: 79707 - DNA, 20 bp, synthetic construct
  misc_feature 1..20: note = CRISPR gRNA sequence
  source 1..20: mol_type = other DNA
gggtttggactcagccctac

SEQ ID NO: 79708 - DNA, 20 bp, synthetic construct
  misc_feature 1..20: note = CRISPR gRNA sequence
  source 1..20: mol_type = other DNA
ggtttggactcagccctact

SEQ ID NO: 79709 - DNA, 20 bp, synthetic construct
  misc_feature 1..20: note = CRISPR gRNA sequence
  source 1..20: mol_type = other DNA
ggactcagccctactgagta

SEQ ID NO: 79710 - DNA, 20 bp, synthetic construct
  misc_feature 1..20: note = CRISPR gRNA sequence
  source 1..20: mol_type = other DNA
gactcagccctactgagtac

SEQ ID NO: 79711 - DNA, 20 bp, synthetic construct
  misc_feature 1..20: note = CRISPR gRNA sequence
  source 1..20: mol_type = other DNA
agccctactgagtacttgga

SEQ ID NO: 79712 - DNA, 20 bp, synthetic construct
  misc_feature 1..20: note = CRISPR gRNA sequence
  source 1..20: mol_type = other DNA
ctgagtacttggactgatgc

SEQ ID NO: 79713 - DNA, 20 bp, synthetic construct
  misc_feature 1..20: note = CRISPR gRNA sequence
  source 1..20: mol_type = other DNA
agtacttggactgatgcctt

SEQ ID NO: 79714 - DNA, 20 bp, synthetic construct
  misc_feature 1..20: note = CRISPR gRNA sequence
  source 1..20: mol_type = other DNA
ggactgatgccttccctctc

SEQ ID NO: 79715 - DNA, 20 bp, synthetic construct
  misc_feature 1..20: note = CRISPR gRNA sequence
  source 1..20: mol_type = other DNA
gactgatgccttccctctct

SEQ ID NO: 79716 - DNA, 20 bp, synthetic construct
  misc_feature 1..20: note = CRISPR gRNA sequence
  source 1..20: mol_type = other DNA
atgccttccctctctgggtc

SEQ ID NO: 79717 - DNA, 20 bp, synthetic construct
  misc_feature 1..20: note = CRISPR gRNA sequence
  source 1..20: mol_type = other DNA
ccctctctgggtctcactga

SEQ ID NO: 79718 - DNA, 20 bp, synthetic construct
  misc_feature 1..20: note = CRISPR gRNA sequence
  source 1..20: mol_type = other DNA
cctctctgggtctcactgaa

SEQ ID NO: 79719 - DNA, 20 bp, synthetic construct
  misc_feature 1..20: note = CRISPR gRNA sequence
  source 1..20: mol_type = other DNA
tctgggtctcactgaaaaac

SEQ ID NO: 79720 - DNA, 20 bp, synthetic construct
  misc_feature 1..20: note = CRISPR gRNA sequence
  source 1..20: mol_type = other DNA
tgggtctcactgaaaaacta

SEQ ID NO: 79721 - DNA, 20 bp, synthetic construct
  misc_feature 1..20: note = CRISPR gRNA sequence
  source 1..20: mol_type = other DNA
ggtctcactgaaaaactact

SEQ ID NO: 79722 - DNA, 20 bp, synthetic construct
  misc_feature 1..20: note = CRISPR gRNA sequence
  source 1..20: mol_type = other DNA
actgaaaaactactggtcag

SEQ ID NO: 79723 - DNA, 20 bp, synthetic construct
  misc_feature 1..20: note = CRISPR gRNA sequence
  source 1..20: mol_type = other DNA
aaaaactactggtcagactt

SEQ ID NO: 79724 - DNA, 20 bp, synthetic construct
  misc_feature 1..20: note = CRISPR gRNA sequence
  source 1..20: mol_type = other DNA
ctggtcagacttggaggaac

SEQ ID NO: 79725 - DNA, 20 bp, synthetic construct
  misc_feature 1..20: note = CRISPR gRNA sequence
  source 1..20: mol_type = other DNA
gtcagacttggaggaacatg

SEQ ID NO: 79726 - DNA, 20 bp, synthetic construct
  misc_feature 1..20: note = CRISPR gRNA sequence
  source 1..20: mol_type = other DNA
ggaggaacatgcaggcccca

SEQ ID NO: 79727 - DNA, 20 bp, synthetic construct
  misc_feature 1..20: note = CRISPR gRNA sequence
  source 1..20: mol_type = other DNA
gaggaacatgcaggccccag

SEQ ID NO: 79728 - DNA, 20 bp, synthetic construct
  misc_feature 1..20: note = CRISPR gRNA sequence
  source 1..20: mol_type = other DNA
tgggacctgggcagtggctc

SEQ ID NO: 79729 - DNA, 20 bp, synthetic construct
  misc_feature 1..20: note = CRISPR gRNA sequence
  source 1..20: mol_type = other DNA
ggacctgggcagtggctcat

SEQ ID NO: 79730 - DNA, 20 bp, synthetic construct
  misc_feature 1..20: note = CRISPR gRNA sequence
  source 1..20: mol_type = other DNA
ggcagtggctcatctcccca

SEQ ID NO: 79731 - DNA, 20 bp, synthetic construct
  misc_feature 1..20: note = CRISPR gRNA sequence
  source 1..20: mol_type = other DNA
atctccccagtcagtgagcc

SEQ ID NO: 79732 - DNA, 20 bp, synthetic construct
  misc_feature 1..20: note = CRISPR gRNA sequence
  source 1..20: mol_type = other DNA
cccagtcagtgagccctcct

SEQ ID NO: 79733 - DNA, 20 bp, synthetic construct
  misc_feature 1..20: note = CRISPR gRNA sequence
  source 1..20: mol_type = other DNA
ctggagatcactcacctgac

SEQ ID NO: 79734 - DNA, 20 bp, synthetic construct
  misc_feature 1..20: note = CRISPR gRNA sequence
  source 1..20: mol_type = other DNA
gagatcactcacctgacttc

SEQ ID NO: 79735 - DNA, 20 bp, synthetic construct
  misc_feature 1..20: note = CRISPR gRNA sequence
  source 1..20: mol_type = other DNA
acctgacttctttcagctgt

SEQ ID NO: 79736 - DNA, 20 bp, synthetic construct
  misc_feature 1..20: note = CRISPR gRNA sequence
  source 1..20: mol_type = other DNA
acttctttcagctgtggaca

SEQ ID NO: 79737 - DNA, 20 bp, synthetic construct
  misc_feature 1..20: note = CRISPR gRNA sequence
  source 1..20: mol_type = other DNA
ctttcagctgtggacagaga

SEQ ID NO: 79738 - DNA, 20 bp, synthetic construct
  misc_feature 1..20: note = CRISPR gRNA sequence
  source 1..20: mol_type = other DNA
tttcagctgtggacagagag

SEQ ID NO: 79739 - DNA, 20 bp, synthetic construct
  misc_feature 1..20: note = CRISPR gRNA sequence
  source 1..20: mol_type = other DNA
tcagctgtggacagagaggc

SEQ ID NO: 79740 - DNA, 20 bp, synthetic construct
  misc_feature 1..20: note = CRISPR gRNA sequence
  source 1..20: mol_type = other DNA
cagctgtggacagagaggca

SEQ ID NO: 79741 - DNA, 20 bp, synthetic construct
  misc_feature 1..20: note = CRISPR gRNA sequence
  source 1..20: mol_type = other DNA
agctgtggacagagaggcaa

SEQ ID NO: 79742 - DNA, 20 bp, synthetic construct
  misc_feature 1..20: note = CRISPR gRNA sequence
  source 1..20: mol_type = other DNA
tggacagagaggcaaagctt

SEQ ID NO: 79743 - DNA, 20 bp, synthetic construct
  misc_feature 1..20: note = CRISPR gRNA sequence
  source 1..20: mol_type = other DNA
tcaccaggtggctgatgcct

SEQ ID NO: 79744 - DNA, 20 bp, synthetic construct
  misc_feature 1..20: note = CRISPR gRNA sequence
  source 1..20: mol_type = other DNA
caccaggtggctgatgcctc

SEQ ID NO: 79745 - DNA, 20 bp, synthetic construct
  misc_feature 1..20: note = CRISPR gRNA sequence
  source 1..20: mol_type = other DNA
accaggtggctgatgcctcg

SEQ ID NO: 79746 - DNA, 20 bp, synthetic construct
  misc_feature 1..20: note = CRISPR gRNA sequence
  source 1..20: mol_type = other DNA
atgcctcgggcagtgatttt

SEQ ID NO: 79747 - DNA, 20 bp, synthetic construct
  misc_feature 1..20: note = CRISPR gRNA sequence
  source 1..20: mol_type = other DNA
gggcagtgattttacttcct

SEQ ID NO: 79748 - DNA, 20 bp, synthetic construct
  misc_feature 1..20: note = CRISPR gRNA sequence
  source 1..20: mol_type = other DNA
tacttcctgctaacctacag

SEQ ID NO: 79749 - DNA, 20 bp, synthetic construct
  misc_feature 1..20: note = CRISPR gRNA sequence
  source 1..20: mol_type = other DNA
acttcctgctaacctacaga

SEQ ID NO: 79750 - DNA, 20 bp, synthetic construct
  misc_feature 1..20: note = CRISPR gRNA sequence
  source 1..20: mol_type = other DNA
cttcctgctaacctacagag

SEQ ID NO: 79751 - DNA, 20 bp, synthetic construct
  misc_feature 1..20: note = CRISPR gRNA sequence
  source 1..20: mol_type = other DNA
cctgctaacctacagagtaa

SEQ ID NO: 79752 - DNA, 20 bp, synthetic construct
  misc_feature 1..20: note = CRISPR gRNA sequence
  source 1..20: mol_type = other DNA
ctgctaacctacagagtaag

SEQ ID NO: 79753 - DNA, 20 bp, synthetic construct
  misc_feature 1..20: note = CRISPR gRNA sequence
  source 1..20: mol_type = other DNA
ctaacctacagagtaagcaa

SEQ ID NO: 79754 - DNA, 20 bp, synthetic construct
  misc_feature 1..20: note = CRISPR gRNA sequence
  source 1..20: mol_type = other DNA
acctacagagtaagcaaaga

SEQ ID NO: 79755 - DNA, 20 bp, synthetic construct
  misc_feature 1..20: note = CRISPR gRNA sequence
  source 1..20: mol_type = other DNA
cagagtaagcaaagatggtg

SEQ ID NO: 79756 - DNA, 20 bp, synthetic construct
  misc_feature 1..20: note = CRISPR gRNA sequence
  source 1..20: mol_type = other DNA
ccttgtgtaggattaaggag

SEQ ID NO: 79757 - DNA, 20 bp, synthetic construct
  misc_feature 1..20: note = CRISPR gRNA sequence
  source 1..20: mol_type = other DNA
gtgtaggattaaggagaggg

SEQ ID NO: 79758 - DNA, 20 bp, synthetic construct
  misc_feature 1..20: note = CRISPR gRNA sequence
  source 1..20: mol_type = other DNA
tgtaggattaaggagaggga

SEQ ID NO: 79759 - DNA, 20 bp, synthetic construct
  misc_feature 1..20: note = CRISPR gRNA sequence
  source 1..20: mol_type = other DNA
aggagagggaggagagtacc

SEQ ID NO: 79760 - DNA, 20 bp, synthetic construct
  misc_feature 1..20: note = CRISPR gRNA sequence
  source 1..20: mol_type = other DNA
aagacccttctcagctccaa

SEQ ID NO: 79761 - DNA, 20 bp, synthetic construct
  misc_feature 1..20: note = CRISPR gRNA sequence
  source 1..20: mol_type = other DNA
ctcagctccaaggcctggct

SEQ ID NO: 79762 - DNA, 20 bp, synthetic construct
  misc_feature 1..20: note = CRISPR gRNA sequence
  source 1..20: mol_type = other DNA
tcagctccaaggcctggctc

SEQ ID NO: 79763 - DNA, 20 bp, synthetic construct
  misc_feature 1..20: note = CRISPR gRNA sequence
  source 1..20: mol_type = other DNA
agctccaaggcctggctcac

SEQ ID NO: 79764 - DNA, 20 bp, synthetic construct
  misc_feature 1..20: note = CRISPR gRNA sequence
  source 1..20: mol_type = other DNA
caaggcctggctcaccccag

SEQ ID NO: 79765 - DNA, 20 bp, synthetic construct
  misc_feature 1..20: note = CRISPR gRNA sequence
  source 1..20: mol_type = other DNA
gctcaccccagcatctgcag

SEQ ID NO: 79766 - DNA, 20 bp, synthetic construct
  misc_feature 1..20: note = CRISPR gRNA sequence
  source 1..20: mol_type = other DNA
accccagcatctgcagcctc

SEQ ID NO: 79767 - DNA, 20 bp, synthetic construct
  misc_feature 1..20: note = CRISPR gRNA sequence
  source 1..20: mol_type = other DNA
cagcctccccattgtcggca

SEQ ID NO: 79768 - DNA, 20 bp, synthetic construct
  misc_feature 1..20: note = CRISPR gRNA sequence
  source 1..20: mol_type = other DNA
cccattgtcggcaagctcct

SEQ ID NO: 79769 - DNA, 20 bp, synthetic construct
  misc_feature 1..20: note = CRISPR gRNA sequence
  source 1..20: mol_type = other DNA
tcggcaagctcctggagagg

SEQ ID NO: 79770 - DNA, 20 bp, synthetic construct
  misc_feature 1..20: note = CRISPR gRNA sequence
  source 1..20: mol_type = other DNA
ctggagagggcttctgcaaa

SEQ ID NO: 79771 - DNA, 20 bp, synthetic construct
  misc_feature 1..20: note = CRISPR gRNA sequence
  source 1..20: mol_type = other DNA
gagagggcttctgcaaaggc

SEQ ID NO: 79772 - DNA, 20 bp, synthetic construct
  misc_feature 1..20: note = CRISPR gRNA sequence
  source 1..20: mol_type = other DNA
ctgcaaaggcatccccacac

SEQ ID NO: 79773 - DNA, 20 bp, synthetic construct
  misc_feature 1..20: note = CRISPR gRNA sequence
  source 1..20: mol_type = other DNA
tgcaaaggcatccccacact

SEQ ID NO: 79774 - DNA, 20 bp, synthetic construct
  misc_feature 1..20: note = CRISPR gRNA sequence
  source 1..20: mol_type = other DNA
caaaggcatccccacacttc

SEQ ID NO: 79775 - DNA, 20 bp, synthetic construct
  misc_feature 1..20: note = CRISPR gRNA sequence
  source 1..20: mol_type = other DNA
cctgctcttaaagctgccat

SEQ ID NO: 79776 - DNA, 20 bp, synthetic construct
  misc_feature 1..20: note = CRISPR gRNA sequence
  source 1..20: mol_type = other DNA
ctgctcttaaagctgccata

SEQ ID NO: 79777 - DNA, 20 bp, synthetic construct
  misc_feature 1..20: note = CRISPR gRNA sequence
  source 1..20: mol_type = other DNA
ctcttaaagctgccataaga

SEQ ID NO: 79778 - DNA, 20 bp, synthetic construct
  misc_feature 1..20: note = CRISPR gRNA sequence
  source 1..20: mol_type = other DNA
ttaaagctgccataagaaga

SEQ ID NO: 79779 - DNA, 20 bp, synthetic construct
  misc_feature 1..20: note = CRISPR gRNA sequence
  source 1..20: mol_type = other DNA
aaagctgccataagaagaag

SEQ ID NO: 79780 - DNA, 20 bp, synthetic construct
  misc_feature 1..20: note = CRISPR gRNA sequence
  source 1..20: mol_type = other DNA
aagctgccataagaagaagc

SEQ ID NO: 79781 - DNA, 20 bp, synthetic construct
  misc_feature 1..20: note = CRISPR gRNA sequence
  source 1..20: mol_type = other DNA
ccataagaagaagcgaagtg

SEQ ID NO: 79782 - DNA, 20 bp, synthetic construct
  misc_feature 1..20: note = CRISPR gRNA sequence
  source 1..20: mol_type = other DNA
ggcagagctgagaagtcatc

SEQ ID NO: 79783 - DNA, 20 bp, synthetic construct
  misc_feature 1..20: note = CRISPR gRNA sequence
  source 1..20: mol_type = other DNA
agaagtcatcgccatcccct

SEQ ID NO: 79784 - DNA, 20 bp, synthetic construct
  misc_feature 1..20: note = CRISPR gRNA sequence
  source 1..20: mol_type = other DNA
agagagatggggcttaatac

SEQ ID NO: 79785 - DNA, 20 bp, synthetic construct
  misc_feature 1..20: note = CRISPR gRNA sequence
  source 1..20: mol_type = other DNA
aatacagtagtactaacaaa

SEQ ID NO: 79786 - DNA, 20 bp, synthetic construct
  misc_feature 1..20: note = CRISPR gRNA sequence
  source 1..20: mol_type = other DNA
atacagtagtactaacaaat

SEQ ID NO: 79787 - DNA, 20 bp, synthetic construct
  misc_feature 1..20: note = CRISPR gRNA sequence
  source 1..20: mol_type = other DNA
acaaatacatattatggccg

SEQ ID NO: 79788 - DNA, 20 bp, synthetic construct
  misc_feature 1..20: note = CRISPR gRNA sequence
  source 1..20: mol_type = other DNA
tggccgagacttctaatcgt

SEQ ID NO: 79789 - DNA, 20 bp, synthetic construct
  misc_feature 1..20: note = CRISPR gRNA sequence
  source 1..20: mol_type = other DNA
ctaatcgtccaccaaagccc

SEQ ID NO: 79790 - DNA, 20 bp, synthetic construct
  misc_feature 1..20: note = CRISPR gRNA sequence
  source 1..20: mol_type = other DNA
taatcgtccaccaaagccca

SEQ ID NO: 79791 - DNA, 20 bp, synthetic construct
  misc_feature 1..20: note = CRISPR gRNA sequence
  source 1..20: mol_type = other DNA
atcgtccaccaaagcccatt

SEQ ID NO: 79792 - DNA, 20 bp, synthetic construct
  misc_feature 1..20: note = CRISPR gRNA sequence
  source 1..20: mol_type = other DNA
tccacttcatctacagcaat

SEQ ID NO: 79793 - DNA, 20 bp, synthetic construct
  misc_feature 1..20: note = CRISPR gRNA sequence
  source 1..20: mol_type = other DNA
cacttcatctacagcaatag

SEQ ID NO: 79794 - DNA, 20 bp, synthetic construct
  misc_feature 1..20: note = CRISPR gRNA sequence
  source 1..20: mol_type = other DNA
catctacagcaatagagcta

SEQ ID NO: 79795 - DNA, 20 bp, synthetic construct
  misc_feature 1..20: note = CRISPR gRNA sequence
  source 1..20: mol_type = other DNA
atctacagcaatagagctat

SEQ ID NO: 79796 - DNA, 20 bp, synthetic construct
  misc_feature 1..20: note = CRISPR gRNA sequence
  source 1..20: mol_type = other DNA
cagcaatagagctatcatga

SEQ ID NO: 79797 - DNA, 20 bp, synthetic construct
  misc_feature 1..20: note = CRISPR gRNA sequence
  source 1..20: mol_type = other DNA
tcatgaggaacatggtttcc

SEQ ID NO: 79798 - DNA, 20 bp, synthetic construct
  misc_feature 1..20: note = CRISPR gRNA sequence
  source 1..20: mol_type = other DNA
cccagccagagatcacattt

SEQ ID NO: 79799 - DNA, 20 bp, synthetic construct
  misc_feature 1..20: note = CRISPR gRNA sequence
  source 1..20: mol_type = other DNA
ccagccagagatcacatttc

SEQ ID NO: 79800 - DNA, 20 bp, synthetic construct
  misc_feature 1..20: note = CRISPR gRNA sequence
  source 1..20: mol_type = other DNA
cccagcctcccttgcagctc

SEQ ID NO: 79801 - DNA, 20 bp, synthetic construct
  misc_feature 1..20: note = CRISPR gRNA sequence
  source 1..20: mol_type = other DNA
ccagcctcccttgcagctca

SEQ ID NO: 79802 - DNA, 20 bp, synthetic construct
  misc_feature 1..20: note = CRISPR gRNA sequence
  source 1..20: mol_type = other DNA
ccttgcagctcagtgtggcc

SEQ ID NO: 79803 - DNA, 20 bp, synthetic construct
  misc_feature 1..20: note = CRISPR gRNA sequence
  source 1..20: mol_type = other DNA
gcagctcagtgtggccaggt

SEQ ID NO: 79804 - DNA, 20 bp, synthetic construct
  misc_feature 1..20: note = CRISPR gRNA sequence
  source 1..20: mol_type = other DNA
cagctcagtgtggccaggtg

SEQ ID NO: 79805 - DNA, 20 bp, synthetic construct
  misc_feature 1..20: note = CRISPR gRNA sequence
  source 1..20: mol_type = other DNA
agtgtggccaggtgactatg

SEQ ID NO: 79806 - DNA, 20 bp, synthetic construct
  misc_feature 1..20: note = CRISPR gRNA sequence
  source 1..20: mol_type = other DNA
tgttctcaccaatggaatgt

SEQ ID NO: 79807 - DNA, 20 bp, synthetic construct
  misc_feature 1..20: note = CRISPR gRNA sequence
  source 1..20: mol_type = other DNA
tcaccaatggaatgtgagtg

SEQ ID NO: 79808 - DNA, 20 bp, synthetic construct
  misc_feature 1..20: note = CRISPR gRNA sequence
  source 1..20: mol_type = other DNA
accaatggaatgtgagtgga

SEQ ID NO: 79809 - DNA, 20 bp, synthetic construct
  misc_feature 1..20: note = CRISPR gRNA sequence
  source 1..20: mol_type = other DNA
gtttcaggactgaactttaa

SEQ ID NO: 79810 - DNA, 20 bp, synthetic construct
  misc_feature 1..20: note = CRISPR gRNA sequence
  source 1..20: mol_type = other DNA
caggactgaactttaatgca

SEQ ID NO: 79811 - DNA, 20 bp, synthetic construct
  misc_feature 1..20: note = CRISPR gRNA sequence
  source 1..20: mol_type = other DNA
aggactgaactttaatgcat

SEQ ID NO: 79812 - DNA, 20 bp, synthetic construct
  misc_feature 1..20: note = CRISPR gRNA sequence
  source 1..20: mol_type = other DNA
aactttaatgcattgacatg

SEQ ID NO: 79813 - DNA, 20 bp, synthetic construct
  misc_feature 1..20: note = CRISPR gRNA sequence
  source 1..20: mol_type = other DNA
taatgcattgacatgttcct

SEQ ID NO: 79814 - DNA, 20 bp, synthetic construct
  misc_feature 1..20: note = CRISPR gRNA sequence
  source 1..20: mol_type = other DNA
aatgcattgacatgttcctc

SEQ ID NO: 79815 - DNA, 20 bp, synthetic construct
  misc_feature 1..20: note = CRISPR gRNA sequence
  source 1..20: mol_type = other DNA
atgcattgacatgttcctcc

SEQ ID NO: 79816 - DNA, 20 bp, synthetic construct
  misc_feature 1..20: note = CRISPR gRNA sequence
  source 1..20: mol_type = other DNA
acatgttcctccatgctctt

SEQ ID NO: 79817 - DNA, 20 bp, synthetic construct
  misc_feature 1..20: note = CRISPR gRNA sequence
  source 1..20: mol_type = other DNA
ctccatgctctttccttgtt

SEQ ID NO: 79818 - DNA, 20 bp, synthetic construct
  misc_feature 1..20: note = CRISPR gRNA sequence
  source 1..20: mol_type = other DNA
catgctctttccttgttccc

SEQ ID NO: 79819 - DNA, 20 bp, synthetic construct
  misc_feature 1..20: note = CRISPR gRNA sequence
  source 1..20: mol_type = other DNA
tttccttgttcccaagccag

SEQ ID NO: 79820 - DNA, 20 bp, synthetic construct
  misc_feature 1..20: note = CRISPR gRNA sequence
  source 1..20: mol_type = other DNA
tccttgttcccaagccagag

SEQ ID NO: 79821 - DNA, 20 bp, synthetic construct
  misc_feature 1..20: note = CRISPR gRNA sequence
  source 1..20: mol_type = other DNA
ccttgttcccaagccagagc

SEQ ID NO: 79822 - DNA, 20 bp, synthetic construct
  misc_feature 1..20: note = CRISPR gRNA sequence
  source 1..20: mol_type = other DNA
cttgttcccaagccagagca

SEQ ID NO: 79823 - DNA, 20 bp, synthetic construct
  misc_feature 1..20: note = CRISPR gRNA sequence
  source 1..20: mol_type = other DNA
gttcccaagccagagcacag

SEQ ID NO: 79824 - DNA, 20 bp, synthetic construct
  misc_feature 1..20: note = CRISPR gRNA sequence
  source 1..20: mol_type = other DNA
ttcccaagccagagcacaga

SEQ ID NO: 79825 - DNA, 20 bp, synthetic construct
  misc_feature 1..20: note = CRISPR gRNA sequence
  source 1..20: mol_type = other DNA
ccaagccagagcacagatat

SEQ ID NO: 79826 - DNA, 20 bp, synthetic construct
  misc_feature 1..20: note = CRISPR gRNA sequence
  source 1..20: mol_type = other DNA
tgactgtgcagataggattc

SEQ ID NO: 79827 - DNA, 20 bp, synthetic construct
  misc_feature 1..20: note = CRISPR gRNA sequence
  source 1..20: mol_type = other DNA
gactgtgcagataggattcc

SEQ ID NO: 79828 - DNA, 20 bp, synthetic construct
  misc_feature 1..20: note = CRISPR gRNA sequence
  source 1..20: mol_type = other DNA
actgtgcagataggattccc

SEQ ID NO: 79829 - DNA, 20 bp, synthetic construct
  misc_feature 1..20: note = CRISPR gRNA sequence
  source 1..20: mol_type = other DNA
tgcagataggattcccaagg

SEQ ID NO: 79830 - DNA, 20 bp, synthetic construct
  misc_feature 1..20: note = CRISPR gRNA sequence
  source 1..20: mol_type = other DNA
ccaaggggataatggagcaa

SEQ ID NO: 79831 - DNA, 20 bp, synthetic construct
  misc_feature 1..20: note = CRISPR gRNA sequence
  source 1..20: mol_type = other DNA
ggtacctgcatgactgcgtg

SEQ ID NO: 79832 - DNA, 20 bp, synthetic construct
  misc_feature 1..20: note = CRISPR gRNA sequence
  source 1..20: mol_type = other DNA
catgactgcgtggagctgag

SEQ ID NO: 79833 - DNA, 20 bp, synthetic construct
  misc_feature 1..20: note = CRISPR gRNA sequence
  source 1..20: mol_type = other DNA
cgtggagctgagccattcca

SEQ ID NO: 79834 - DNA, 20 bp, synthetic construct
  misc_feature 1..20: note = CRISPR gRNA sequence
  source 1..20: mol_type = other DNA
agccattccactgacctgga

SEQ ID NO: 79835 - DNA, 20 bp, synthetic construct
  misc_feature 1..20: note = CRISPR gRNA sequence
  source 1..20: mol_type = other DNA
cactgacctggaccacctac

SEQ ID NO: 79836 - DNA, 20 bp, synthetic construct
  misc_feature 1..20: note = CRISPR gRNA sequence
  source 1..20: mol_type = other DNA
acctggaccacctacctctg

SEQ ID NO: 79837 - DNA, 20 bp, synthetic construct
  misc_feature 1..20: note = CRISPR gRNA sequence
  source 1..20: mol_type = other DNA
gaccacctacctctgactct

SEQ ID NO: 79838 - DNA, 20 bp, synthetic construct
  misc_feature 1..20: note = CRISPR gRNA sequence
  source 1..20: mol_type = other DNA
cctctgactcttccatgaga

SEQ ID NO: 79839 - DNA, 20 bp, synthetic construct
  misc_feature 1..20: note = CRISPR gRNA sequence
  source 1..20: mol_type = other DNA
tgactcttccatgagagaga

SEQ ID NO: 79840 - DNA, 20 bp, synthetic construct
  misc_feature 1..20: note = CRISPR gRNA sequence
  source 1..20: mol_type = other DNA
actcttccatgagagagaaa

SEQ ID NO: 79841 - DNA, 20 bp, synthetic construct
  misc_feature 1..20: note = CRISPR gRNA sequence
  source 1..20: mol_type = other DNA
ttccatgagagagaaataaa

SEQ ID NO: 79842 - DNA, 20 bp, synthetic construct
  misc_feature 1..20: note = CRISPR gRNA sequence
  source 1..20: mol_type = other DNA
ccatgagagagaaataaaat

SEQ ID NO: 79843 - DNA, 20 bp, synthetic construct
  misc_feature 1..20: note = CRISPR gRNA sequence
  source 1..20: mol_type = other DNA
catgagagagaaataaaatt

SEQ ID NO: 79844 - DNA, 20 bp, synthetic construct
  misc_feature 1..20: note = CRISPR gRNA sequence
  source 1..20: mol_type = other DNA
tacattatttaacctactgt

SEQ ID NO: 79845 - DNA, 20 bp, synthetic construct
  misc_feature 1..20: note = CRISPR gRNA sequence
  source 1..20: mol_type = other DNA
cattatttaacctactgtat

SEQ ID NO: 79846 - DNA, 20 bp, synthetic construct
  misc_feature 1..20: note = CRISPR gRNA sequence
  source 1..20: mol_type = other DNA
tttaacctactgtatttggg

SEQ ID NO: 79847 - DNA, 20 bp, synthetic construct
  misc_feature 1..20: note = CRISPR gRNA sequence
  source 1..20: mol_type = other DNA
aacctactgtatttggggag

SEQ ID NO: 79848 - DNA, 20 bp, synthetic construct
  misc_feature 1..20: note = CRISPR gRNA sequence
  source 1..20: mol_type = other DNA
acctactgtatttggggagg

SEQ ID NO: 79849 - DNA, 20 bp, synthetic construct
  misc_feature 1..20: note = CRISPR gRNA sequence
  source 1..20: mol_type = other DNA
ctgtatttggggaggaggtt

SEQ ID NO: 79850 - DNA, 20 bp, synthetic construct
  misc_feature 1..20: note = CRISPR gRNA sequence
  source 1..20: mol_type = other DNA
tatttggggaggaggtttct

SEQ ID NO: 79851 - DNA, 20 bp, synthetic construct
  misc_feature 1..20: note = CRISPR gRNA sequence
  source 1..20: mol_type = other DNA
ggggaggaggtttctctgtt

SEQ ID NO: 79852 - DNA, 20 bp, synthetic construct
  misc_feature 1..20: note = CRISPR gRNA sequence
  source 1..20: mol_type = other DNA
gggaggaggtttctctgtta

SEQ ID NO: 79853 - DNA, 20 bp, synthetic construct
  misc_feature 1..20: note = CRISPR gRNA sequence
  source 1..20: mol_type = other DNA
ctctgttactgcagcctagc

SEQ ID NO: 79854 - DNA, 20 bp, synthetic construct
  misc_feature 1..20: note = CRISPR gRNA sequence
  source 1..20: mol_type = other DNA
tctgttactgcagcctagcc

SEQ ID NO: 79855 - DNA, 20 bp, synthetic construct
  misc_feature 1..20: note = CRISPR gRNA sequence
  source 1..20: mol_type = other DNA
tgttactgcagcctagcctt

SEQ ID NO: 79856 - DNA, 20 bp, synthetic construct
  misc_feature 1..20: note = CRISPR gRNA sequence
  source 1..20: mol_type = other DNA
ttactgcagcctagcctttt

SEQ ID NO: 79857 - DNA, 20 bp, synthetic construct
  misc_feature 1..20: note = CRISPR gRNA sequence
  source 1..20: mol_type = other DNA
ctgcagcctagccttttctc

SEQ ID NO: 79858 - DNA, 20 bp, synthetic construct
  misc_feature 1..20: note = CRISPR gRNA sequence
  source 1..20: mol_type = other DNA
cagcctagccttttctctag

SEQ ID NO: 79859 - DNA, 20 bp, synthetic construct
  misc_feature 1..20: note = CRISPR gRNA sequence
  source 1..20: mol_type = other DNA
gccttttctctagctaatat

SEQ ID NO: 79860 - DNA, 20 bp, synthetic construct
  misc_feature 1..20: note = CRISPR gRNA sequence
  source 1..20: mol_type = other DNA
ttctctagctaatatgcaca

SEQ ID NO: 79861 - DNA, 20 bp, synthetic construct
  misc_feature 1..20: note = CRISPR gRNA sequence
  source 1..20: mol_type = other DNA
tctctagctaatatgcacac

SEQ ID NO: 79862 - DNA, 20 bp, synthetic construct
  misc_feature 1..20: note = CRISPR gRNA sequence
  source 1..20: mol_type = other DNA
ctctagctaatatgcacact

SEQ ID NO: 79863 - DNA, 20 bp, synthetic construct
  misc_feature 1..20: note = CRISPR gRNA sequence
  source 1..20: mol_type = other DNA
tctagctaatatgcacactg

SEQ ID NO: 79864 - DNA, 20 bp, synthetic construct
  misc_feature 1..20: note = CRISPR gRNA sequence
  source 1..20: mol_type = other DNA
tagctaatatgcacactgag

SEQ ID NO: 79865 - DNA, 20 bp, synthetic construct
  misc_feature 1..20: note = CRISPR gRNA sequence
  source 1..20: mol_type = other DNA
gctaatatgcacactgagcc

SEQ ID NO: 79866 - DNA, 20 bp, synthetic construct
  misc_feature 1..20: note = CRISPR gRNA sequence
  source 1..20: mol_type = other DNA
atatgcacactgagcctttg

SEQ ID NO: 79867 - DNA, 20 bp, synthetic construct
  misc_feature 1..20: note = CRISPR gRNA sequence
  source 1..20: mol_type = other DNA
agcctttgctctgtgctagg

SEQ ID NO: 79868 - DNA, 20 bp, synthetic construct
  misc_feature 1..20: note = CRISPR gRNA sequence
  source 1..20: mol_type = other DNA
tgctctgtgctaggcactgt

SEQ ID NO: 79869 - DNA, 20 bp, synthetic construct
  misc_feature 1..20: note = CRISPR gRNA sequence
  source 1..20: mol_type = other DNA
gctctgtgctaggcactgtg

SEQ ID NO: 79870 - DNA, 20 bp, synthetic construct
  misc_feature 1..20: note = CRISPR gRNA sequence
  source 1..20: mol_type = other DNA
ctctgtgctaggcactgtgc

SEQ ID NO: 79871 - DNA, 20 bp, synthetic construct
  misc_feature 1..20: note = CRISPR gRNA sequence
  source 1..20: mol_type = other DNA
tgtgctaggcactgtgctac

SEQ ID NO: 79872 - DNA, 20 bp, synthetic construct
  misc_feature 1..20: note = CRISPR gRNA sequence
  source 1..20: mol_type = other DNA
tgctaggcactgtgctacaa

SEQ ID NO: 79873 - DNA, 20 bp, synthetic construct
  misc_feature 1..20: note = CRISPR gRNA sequence
  source 1..20: mol_type = other DNA
ggcactgtgctacaaaatgt

SEQ ID NO: 79874 - DNA, 20 bp, synthetic construct
  misc_feature 1..20: note = CRISPR gRNA sequence
  source 1..20: mol_type = other DNA
tgctacaaaatgtttttcat

SEQ ID NO: 79875 - DNA, 20 bp, synthetic construct
  misc_feature 1..20: note = CRISPR gRNA sequence
  source 1..20: mol_type = other DNA
caaaatgtttttcatgcacc

SEQ ID NO: 79876 - DNA, 20 bp, synthetic construct
  misc_feature 1..20: note = CRISPR gRNA sequence
  source 1..20: mol_type = other DNA
ttcatgcaccatcccatctc

SEQ ID NO: 79877 - DNA, 20 bp, synthetic construct
  misc_feature 1..20: note = CRISPR gRNA sequence
  source 1..20: mol_type = other DNA
tcatgcaccatcccatctca

SEQ ID NO: 79878 - DNA, 20 bp, synthetic construct
  misc_feature 1..20: note = CRISPR gRNA sequence
  source 1..20: mol_type = other DNA
catgcaccatcccatctcat

SEQ ID NO: 79879 - DNA, 20 bp, synthetic construct
  misc_feature 1..20: note = CRISPR gRNA sequence
  source 1..20: mol_type = other DNA
atgcaccatcccatctcatt

SEQ ID NO: 79880 - DNA, 20 bp, synthetic construct
  misc_feature 1..20: note = CRISPR gRNA sequence
  source 1..20: mol_type = other DNA
attcttgcaatgaccatatg

SEQ ID NO: 79881 - DNA, 20 bp, synthetic construct
  misc_feature 1..20: note = CRISPR gRNA sequence
  source 1..20: mol_type = other DNA
ttgcaatgaccatatgagtt

SEQ ID NO: 79882 - DNA, 20 bp, synthetic construct
  misc_feature 1..20: note = CRISPR gRNA sequence
  source 1..20: mol_type = other DNA
gcaatgaccatatgagttgg

SEQ ID NO: 79883 - DNA, 20 bp, synthetic construct
  misc_feature 1..20: note = CRISPR gRNA sequence
  source 1..20: mol_type = other DNA
caatgaccatatgagttggc

SEQ ID NO: 79884 - DNA, 20 bp, synthetic construct
  misc_feature 1..20: note = CRISPR gRNA sequence
  source 1..20: mol_type = other DNA
gctattgttacagattcgtt

SEQ ID NO: 79885 - DNA, 20 bp, synthetic construct
  misc_feature 1..20: note = CRISPR gRNA sequence
  source 1..20: mol_type = other DNA
ttgttacagattcgttttag

SEQ ID NO: 79886 - DNA, 20 bp, synthetic construct
  misc_feature 1..20: note = CRISPR gRNA sequence
  source 1..20: mol_type = other DNA
ttacagattcgttttaggaa

SEQ ID NO: 79887 - DNA, 20 bp, synthetic construct
  misc_feature 1..20: note = CRISPR gRNA sequence
  source 1..20: mol_type = other DNA
cagattcgttttaggaacga

SEQ ID NO: 79888 - DNA, 20 bp, synthetic construct
  misc_feature 1..20: note = CRISPR gRNA sequence
  source 1..20: mol_type = other DNA
gttttaggaacgaagaaact

SEQ ID NO: 79889 - DNA, 20 bp, synthetic construct
  misc_feature 1..20: note = CRISPR gRNA sequence
  source 1..20: mol_type = other DNA
taggaacgaagaaactctgg

SEQ ID NO: 79890 - DNA, 20 bp, synthetic construct
  misc_feature 1..20: note = CRISPR gRNA sequence
  source 1..20: mol_type = other DNA
aggaacgaagaaactctggc

SEQ ID NO: 79891 - DNA, 20 bp, synthetic construct
  misc_feature 1..20: note = CRISPR gRNA sequence
  source 1..20: mol_type = other DNA
ggaacgaagaaactctggcc

SEQ ID NO: 79892 - DNA, 20 bp, synthetic construct
  misc_feature 1..20: note = CRISPR gRNA sequence
  source 1..20: mol_type = other DNA
tggcctagacagtgtgcatg

SEQ ID NO: 79893 - DNA, 20 bp, synthetic construct
  misc_feature 1..20: note = CRISPR gRNA sequence
  source 1..20: mol_type = other DNA
gcctagacagtgtgcatgtg

SEQ ID NO: 79894 - DNA, 20 bp, synthetic construct
  misc_feature 1..20: note = CRISPR gRNA sequence
  source 1..20: mol_type = other DNA
gacagtgtgcatgtgtgtgc

SEQ ID NO: 79895 - DNA, 20 bp, synthetic construct
  misc_feature 1..20: note = CRISPR gRNA sequence
  source 1..20: mol_type = other DNA
catatacttgcccaaagtcc

SEQ ID NO: 79896 - DNA, 20 bp, synthetic construct
  misc_feature 1..20: note = CRISPR gRNA sequence
  source 1..20: mol_type = other DNA
gcccaaagtccaccagcctc

SEQ ID NO: 79897 - DNA, 20 bp, synthetic construct
  misc_feature 1..20: note = CRISPR gRNA sequence
  source 1..20: mol_type = other DNA
cccaaagtccaccagcctct

SEQ ID NO: 79898 - DNA, 20 bp, synthetic construct
  misc_feature 1..20: note = CRISPR gRNA sequence
  source 1..20: mol_type = other DNA
tatagacagcctggatctgt

SEQ ID NO: 79899 - DNA, 20 bp, synthetic construct
  misc_feature 1..20: note = CRISPR gRNA sequence
  source 1..20: mol_type = other DNA
tagacagcctggatctgtgg

SEQ ID NO: 79900 - DNA, 20 bp, synthetic construct
  misc_feature 1..20: note = CRISPR gRNA sequence
  source 1..20: mol_type = other DNA
gatctgtggtttcagcccat

SEQ ID NO: 79901 - DNA, 20 bp, synthetic construct
  misc_feature 1..20: note = CRISPR gRNA sequence
  source 1..20: mol_type = other DNA
tggtttcagcccatgattga

SEQ ID NO: 79902 - DNA, 20 bp, synthetic construct
  misc_feature 1..20: note = CRISPR gRNA sequence
  source 1..20: mol_type = other DNA
cagcccatgattgacagaga

SEQ ID NO: 79903 - DNA, 20 bp, synthetic construct
  misc_feature 1..20: note = CRISPR gRNA sequence
  source 1..20: mol_type = other DNA
agcccatgattgacagagag

SEQ ID NO: 79904 - DNA, 20 bp, synthetic construct
  misc_feature 1..20: note = CRISPR gRNA sequence
  source 1..20: mol_type = other DNA
acagagagactgagagtcca

SEQ ID NO: 79905 - DNA, 20 bp, synthetic construct
  misc_feature 1..20: note = CRISPR gRNA sequence
  source 1..20: mol_type = other DNA
agagtccagaaaccacagac

SEQ ID NO: 79906 - DNA, 20 bp, synthetic construct
  misc_feature 1..20: note = CRISPR gRNA sequence
  source 1..20: mol_type = other DNA
ggactccagaggtcctgtca

SEQ ID NO: 79907 - DNA, 20 bp, synthetic construct
  misc_feature 1..20: note = CRISPR gRNA sequence
  source 1..20: mol_type = other DNA
gactccagaggtcctgtcaa

SEQ ID NO: 79908 - DNA, 20 bp, synthetic construct
  misc_feature 1..20: note = CRISPR gRNA sequence
  source 1..20: mol_type = other DNA
cagaggtcctgtcaaggtat

SEQ ID NO: 79909 - DNA, 20 bp, synthetic construct
  misc_feature 1..20: note = CRISPR gRNA sequence
  source 1..20: mol_type = other DNA
tcaaggtatggagcttcctc

SEQ ID NO: 79910 - DNA, 20 bp, synthetic construct
  misc_feature 1..20: note = CRISPR gRNA sequence
  source 1..20: mol_type = other DNA
cctctcttgcattgcaggcc

SEQ ID NO: 79911 - DNA, 20 bp, synthetic construct
  misc_feature 1..20: note = CRISPR gRNA sequence
  source 1..20: mol_type = other DNA
ctctcttgcattgcaggcca

SEQ ID NO: 79912 - DNA, 20 bp, synthetic construct
  misc_feature 1..20: note = CRISPR gRNA sequence
  source 1..20: mol_type = other DNA
tcttgcattgcaggccatta

SEQ ID NO: 79913 - DNA, 20 bp, synthetic construct
  misc_feature 1..20: note = CRISPR gRNA sequence
  source 1..20: mol_type = other DNA
ttgcattgcaggccattatg

SEQ ID NO: 79914 - DNA, 20 bp, synthetic construct
  misc_feature 1..20: note = CRISPR gRNA sequence
  source 1..20: mol_type = other DNA
gcattgcaggccattatgtt

SEQ ID NO: 79915 - DNA, 20 bp, synthetic construct
  misc_feature 1..20: note = CRISPR gRNA sequence
  source 1..20: mol_type = other DNA
cattgcaggccattatgttc

SEQ ID NO: 79916 - DNA, 20 bp, synthetic construct
  misc_feature 1..20: note = CRISPR gRNA sequence
  source 1..20: mol_type = other DNA
caggccattatgttctgata

SEQ ID NO: 79917 - DNA, 20 bp, synthetic construct
  misc_feature 1..20: note = CRISPR gRNA sequence
  source 1..20: mol_type = other DNA
tgttctgatattcaagattc

SEQ ID NO: 79918 - DNA, 20 bp, synthetic construct
  misc_feature 1..20: note = CRISPR gRNA sequence
  source 1..20: mol_type = other DNA
tgatattcaagattcttatc

SEQ ID NO: 79919 - DNA, 20 bp, synthetic construct
  misc_feature 1..20: note = CRISPR gRNA sequence
  source 1..20: mol_type = other DNA
atattcaagattcttatcca

SEQ ID NO: 79920 - DNA, 20 bp, synthetic construct
  misc_feature 1..20: note = CRISPR gRNA sequence
  source 1..20: mol_type = other DNA
aagattcttatccagtcctc

SEQ ID NO: 79921 - DNA, 20 bp, synthetic construct
  misc_feature 1..20: note = CRISPR gRNA sequence
  source 1..20: mol_type = other DNA
ttatccagtcctcttggcag

SEQ ID NO: 79922 - DNA, 20 bp, synthetic construct
  misc_feature 1..20: note = CRISPR gRNA sequence
  source 1..20: mol_type = other DNA
atccagtcctcttggcagag

SEQ ID NO: 79923 - DNA, 20 bp, synthetic construct
  misc_feature 1..20: note = CRISPR gRNA sequence
  source 1..20: mol_type = other DNA
tccagtcctcttggcagagg

SEQ ID NO: 79924 - DNA, 20 bp, synthetic construct
  misc_feature 1..20: note = CRISPR gRNA sequence
  source 1..20: mol_type = other DNA
ttggcagaggtttgctagac

SEQ ID NO: 79925 - DNA, 20 bp, synthetic construct
  misc_feature 1..20: note = CRISPR gRNA sequence
  source 1..20: mol_type = other DNA
ggcagaggtttgctagactg

SEQ ID NO: 79926 - DNA, 20 bp, synthetic construct
  misc_feature 1..20: note = CRISPR gRNA sequence
  source 1..20: mol_type = other DNA
gcagaggtttgctagactgg

SEQ ID NO: 79927 - DNA, 20 bp, synthetic construct
  misc_feature 1..20: note = CRISPR gRNA sequence
  source 1..20: mol_type = other DNA
gctagactggttggcctctg

SEQ ID NO: 79928 - DNA, 20 bp, synthetic construct
  misc_feature 1..20: note = CRISPR gRNA sequence
  source 1..20: mol_type = other DNA
ctagactggttggcctctgc

SEQ ID NO: 79929 - DNA, 20 bp, synthetic construct
  misc_feature 1..20: note = CRISPR gRNA sequence
  source 1..20: mol_type = other DNA
gactggttggcctctgctcc

SEQ ID NO: 79930 - DNA, 20 bp, synthetic construct
  misc_feature 1..20: note = CRISPR gRNA sequence
  source 1..20: mol_type = other DNA
gttggcctctgctcccccaa

SEQ ID NO: 79931 - DNA, 20 bp, synthetic construct
  misc_feature 1..20: note = CRISPR gRNA sequence
  source 1..20: mol_type = other DNA
gcctctgctcccccaaaagc

SEQ ID NO: 79932 - DNA, 20 bp, synthetic construct
  misc_feature 1..20: note = CRISPR gRNA sequence
  source 1..20: mol_type = other DNA
tgctcccccaaaagcccaat

SEQ ID NO: 79933 - DNA, 20 bp, synthetic construct
  misc_feature 1..20: note = CRISPR gRNA sequence
  source 1..20: mol_type = other DNA
ctcccccaaaagcccaatcc

SEQ ID NO: 79934 - DNA, 20 bp, synthetic construct
  misc_feature 1..20: note = CRISPR gRNA sequence
  source 1..20: mol_type = other DNA
ccccaaaagcccaatcccct

SEQ ID NO: 79935 - DNA, 20 bp, synthetic construct
  misc_feature 1..20: note = CRISPR gRNA sequence
  source 1..20: mol_type = other DNA
cccggtcctcctccactctt

SEQ ID NO: 79936 - DNA, 20 bp, synthetic construct
  misc_feature 1..20: note = CRISPR gRNA sequence
  source 1..20: mol_type = other DNA
ctccactcttactcacctga

SEQ ID NO: 79937 - DNA, 20 bp, synthetic construct
  misc_feature 1..20: note = CRISPR gRNA sequence
  source 1..20: mol_type = other DNA
cactcttactcacctgagat

SEQ ID NO: 79938 - DNA, 20 bp, synthetic construct
  misc_feature 1..20: note = CRISPR gRNA sequence
  source 1..20: mol_type = other DNA
ttactcacctgagattctct

SEQ ID NO: 79939 - DNA, 20 bp, synthetic construct
  misc_feature 1..20: note = CRISPR gRNA sequence
  source 1..20: mol_type = other DNA
actcacctgagattctctat

SEQ ID NO: 79940 - DNA, 20 bp, synthetic construct
  misc_feature 1..20: note = CRISPR gRNA sequence
  source 1..20: mol_type = other DNA
ctcacctgagattctctatc

SEQ ID NO: 79941 - DNA, 20 bp, synthetic construct
  misc_feature 1..20: note = CRISPR gRNA sequence
  source 1..20: mol_type = other DNA
acctgagattctctatctgc

SEQ ID NO: 79942 - DNA, 20 bp, synthetic construct
  misc_feature 1..20: note = CRISPR gRNA sequence
  source 1..20: mol_type = other DNA
agattctctatctgcccaca

SEQ ID NO: 79943 - DNA, 20 bp, synthetic construct
  misc_feature 1..20: note = CRISPR gRNA sequence
  source 1..20: mol_type = other DNA
tctatctgcccacagcctac

SEQ ID NO: 79944 - DNA, 20 bp, synthetic construct
  misc_feature 1..20: note = CRISPR gRNA sequence
  source 1..20: mol_type = other DNA
tatctgcccacagcctacca

SEQ ID NO: 79945 - DNA, 20 bp, synthetic construct
  misc_feature 1..20: note = CRISPR gRNA sequence
  source 1..20: mol_type = other DNA
tctgcccacagcctaccaga

SEQ ID NO: 79946 - DNA, 20 bp, synthetic construct
  misc_feature 1..20: note = CRISPR gRNA sequence
  source 1..20: mol_type = other DNA
cccacagcctaccagagcct

SEQ ID NO: 79947 - DNA, 20 bp, synthetic construct
  misc_feature 1..20: note = CRISPR gRNA sequence
  source 1..20: mol_type = other DNA
ccagagcctcagggcagtgg

SEQ ID NO: 79948 - DNA, 20 bp, synthetic construct
  misc_feature 1..20: note = CRISPR gRNA sequence
  source 1..20: mol_type = other DNA
agggcagtggggctccaggg

SEQ ID NO: 79949 - DNA, 20 bp, synthetic construct
  misc_feature 1..20: note = CRISPR gRNA sequence
  source 1..20: mol_type = other DNA
caggggacagccatcaaaat

SEQ ID NO: 79950 - DNA, 20 bp, synthetic construct
  misc_feature 1..20: note = CRISPR gRNA sequence
  source 1..20: mol_type = other DNA
cctgtgctctaggatgttgg

SEQ ID NO: 79951 - DNA, 20 bp, synthetic construct
  misc_feature 1..20: note = CRISPR gRNA sequence
  source 1..20: mol_type = other DNA
tgctctaggatgttggtcag

SEQ ID NO: 79952 - DNA, 20 bp, synthetic construct
  misc_feature 1..20: note = CRISPR gRNA sequence
  source 1..20: mol_type = other DNA
taggatgttggtcagggtgg

SEQ ID NO: 79953 - DNA, 20 bp, synthetic construct
  misc_feature 1..20: note = CRISPR gRNA sequence
  source 1..20: mol_type = other DNA
ggatgttggtcagggtggcc

SEQ ID NO: 79954 - DNA, 20 bp, synthetic construct
  misc_feature 1..20: note = CRISPR gRNA sequence
  source 1..20: mol_type = other DNA
gtcagggtggccaggtcggt

SEQ ID NO: 79955 - DNA, 20 bp, synthetic construct
  misc_feature 1..20: note = CRISPR gRNA sequence
  source 1..20: mol_type = other DNA
tggaagggcagttgataggg

SEQ ID NO: 79956 - DNA, 20 bp, synthetic construct
  misc_feature 1..20: note = CRISPR gRNA sequence
  source 1..20: mol_type = other DNA
ataggggaggctttgtgcgg

SEQ ID NO: 79957 - DNA, 20 bp, synthetic construct
  misc_feature 1..20: note = CRISPR gRNA sequence
  source 1..20: mol_type = other DNA
tgtgcggtgagactggccag

SEQ ID NO: 79958 - DNA, 20 bp, synthetic construct
  misc_feature 1..20: note = CRISPR gRNA sequence
  source 1..20: mol_type = other DNA
gtgcggtgagactggccagc

SEQ ID NO: 79959 - DNA, 20 bp, synthetic construct
  misc_feature 1..20: note = CRISPR gRNA sequence
  source 1..20: mol_type = other DNA
tgcggtgagactggccagct

SEQ ID NO: 79960 - DNA, 20 bp, synthetic construct
  misc_feature 1..20: note = CRISPR gRNA sequence
  source 1..20: mol_type = other DNA
gccagctcaggctcctgtgt

SEQ ID NO: 79961 - DNA, 20 bp, synthetic construct
  misc_feature 1..20: note = CRISPR gRNA sequence
  source 1..20: mol_type = other DNA
aggctcctgtgtctcatcca

SEQ ID NO: 79962 - DNA, 20 bp, synthetic construct
  misc_feature 1..20: note = CRISPR gRNA sequence
  source 1..20: mol_type = other DNA
ctgtgtctcatccacacagt

SEQ ID NO: 79963 - DNA, 20 bp, synthetic construct
  misc_feature 1..20: note = CRISPR gRNA sequence
  source 1..20: mol_type = other DNA
tgtctcatccacacagtgac

SEQ ID NO: 79964 - DNA, 20 bp, synthetic construct
  misc_feature 1..20: note = CRISPR gRNA sequence
  source 1..20: mol_type = other DNA
atccacacagtgacacagct

SEQ ID NO: 79965 - DNA, 20 bp, synthetic construct
  misc_feature 1..20: note = CRISPR gRNA sequence
  source 1..20: mol_type = other DNA
tacaacctttggccctgtga

SEQ ID NO: 79966 - DNA, 20 bp, synthetic construct
  misc_feature 1..20: note = CRISPR gRNA sequence
  source 1..20: mol_type = other DNA
caacctttggccctgtgagc

SEQ ID NO: 79967 - DNA, 20 bp, synthetic construct
  misc_feature 1..20: note = CRISPR gRNA sequence
  source 1..20: mol_type = other DNA
tggccctgtgagcttgcggg

SEQ ID NO: 79968 - DNA, 20 bp, synthetic construct
  misc_feature 1..20: note = CRISPR gRNA sequence
  source 1..20: mol_type = other DNA
ggccctgtgagcttgcgggt

SEQ ID NO: 79969 - DNA, 20 bp, synthetic construct
  misc_feature 1..20: note = CRISPR gRNA sequence
  source 1..20: mol_type = other DNA
gccctgtgagcttgcgggtg

SEQ ID NO: 79970 - DNA, 20 bp, synthetic construct
  misc_feature 1..20: note = CRISPR gRNA sequence
  source 1..20: mol_type = other DNA
tgagcttgcgggtggccaac

SEQ ID NO: 79971 - DNA, 20 bp, synthetic construct
  misc_feature 1..20: note = CRISPR gRNA sequence
  source 1..20: mol_type = other DNA
gcgggtggccaacttcttca

SEQ ID NO: 79972 - DNA, 20 bp, synthetic construct
  misc_feature 1..20: note = CRISPR gRNA sequence
  source 1..20: mol_type = other DNA
cgggtggccaacttcttcaa

SEQ ID NO: 79973 - DNA, 20 bp, synthetic construct
  misc_feature 1..20: note = CRISPR gRNA sequence
  source 1..20: mol_type = other DNA
cttcaacacctgcactacag

SEQ ID NO: 79974 - DNA, 20 bp, synthetic construct
  misc_feature 1..20: note = CRISPR gRNA sequence
  source 1..20: mol_type = other DNA
ttcaacacctgcactacagc

SEQ ID NO: 79975 - DNA, 20 bp, synthetic construct
  misc_feature 1..20: note = CRISPR gRNA sequence
  source 1..20: mol_type = other DNA
caacacctgcactacagcag

SEQ ID NO: 79976 - DNA, 20 bp, synthetic construct
  misc_feature 1..20: note = CRISPR gRNA sequence
  source 1..20: mol_type = other DNA
aacacctgcactacagcagc

SEQ ID NO: 79977 - DNA, 20 bp, synthetic construct
  misc_feature 1..20: note = CRISPR gRNA sequence
  source 1..20: mol_type = other DNA
cactacagcagcctgcttgg

SEQ ID NO: 79978 - DNA, 20 bp, synthetic construct
  misc_feature 1..20: note = CRISPR gRNA sequence
  source 1..20: mol_type = other DNA
cagcagcctgcttggcaccc

SEQ ID NO: 79979 - DNA, 20 bp, synthetic construct
  misc_feature 1..20: note = CRISPR gRNA sequence
  source 1..20: mol_type = other DNA
cttggcacccacacagtcct

SEQ ID NO: 79980 - DNA, 20 bp, synthetic construct
  misc_feature 1..20: note = CRISPR gRNA sequence
  source 1..20: mol_type = other DNA
ggcacccacacagtcctcat

SEQ ID NO: 79981 - DNA, 20 bp, synthetic construct
  misc_feature 1..20: note = CRISPR gRNA sequence
  source 1..20: mol_type = other DNA
gcacccacacagtcctcatt

SEQ ID NO: 79982 - DNA, 20 bp, synthetic construct
  misc_feature 1..20: note = CRISPR gRNA sequence
  source 1..20: mol_type = other DNA
attgccctgcgccaggtggc

SEQ ID NO: 79983 - DNA, 20 bp, synthetic construct
  misc_feature 1..20: note = CRISPR gRNA sequence
  source 1..20: mol_type = other DNA
ccctgcgccaggtggctaag

SEQ ID NO: 79984 - DNA, 20 bp, synthetic construct
  misc_feature 1..20: note = CRISPR gRNA sequence
  source 1..20: mol_type = other DNA
cgccaggtggctaaggaagg

SEQ ID NO: 79985 - DNA, 20 bp, synthetic construct
  misc_feature 1..20: note = CRISPR gRNA sequence
  source 1..20: mol_type = other DNA
aggaaggggcggcaggtgca

SEQ ID NO: 79986 - DNA, 20 bp, synthetic construct
  misc_feature 1..20: note = CRISPR gRNA sequence
  source 1..20: mol_type = other DNA
agaggcccagtctagctttg

SEQ ID NO: 79987 - DNA, 20 bp, synthetic construct
  misc_feature 1..20: note = CRISPR gRNA sequence
  source 1..20: mol_type = other DNA
gctttggtccgctgtaccca

SEQ ID NO: 79988 - DNA, 20 bp, synthetic construct
  misc_feature 1..20: note = CRISPR gRNA sequence
  source 1..20: mol_type = other DNA
tggtccgctgtacccagcgg

SEQ ID NO: 79989 - DNA, 20 bp, synthetic construct
  misc_feature 1..20: note = CRISPR gRNA sequence
  source 1..20: mol_type = other DNA
ggtccgctgtacccagcggg

SEQ ID NO: 79990 - DNA, 20 bp, synthetic construct
  misc_feature 1..20: note = CRISPR gRNA sequence
  source 1..20: mol_type = other DNA
gtccgctgtacccagcggga

SEQ ID NO: 79991 - DNA, 20 bp, synthetic construct
  misc_feature 1..20: note = CRISPR gRNA sequence
  source 1..20: mol_type = other DNA
tacccagcgggaatggaggg

SEQ ID NO: 79992 - DNA, 20 bp, synthetic construct
  misc_feature 1..20: note = CRISPR gRNA sequence
  source 1..20: mol_type = other DNA
ggtaagtgtgtctttgttca

SEQ ID NO: 79993 - DNA, 20 bp, synthetic construct
  misc_feature 1..20: note = CRISPR gRNA sequence
  source 1..20: mol_type = other DNA
tgttcaccttggggctggcc

SEQ ID NO: 79994 - DNA, 20 bp, synthetic construct
  misc_feature 1..20: note = CRISPR gRNA sequence
  source 1..20: mol_type = other DNA
gttcaccttggggctggcca

SEQ ID NO: 79995 - DNA, 20 bp, synthetic construct
  misc_feature 1..20: note = CRISPR gRNA sequence
  source 1..20: mol_type = other DNA
ttcaccttggggctggccat

SEQ ID NO: 79996 - DNA, 20 bp, synthetic construct
  misc_feature 1..20: note = CRISPR gRNA sequence
  source 1..20: mol_type = other DNA
accttggggctggccatcag

SEQ ID NO: 79997 - DNA, 20 bp, synthetic construct
  misc_feature 1..20: note = CRISPR gRNA sequence
  source 1..20: mol_type = other DNA
ggggctggccatcaggtgca

SEQ ID NO: 79998 - DNA, 20 bp, synthetic construct
  misc_feature 1..20: note = CRISPR gRNA sequence
  source 1..20: mol_type = other DNA
gggctggccatcaggtgcag

SEQ ID NO: 79999 - DNA, 20 bp, synthetic construct
  misc_feature 1..20: note = CRISPR gRNA sequence
  source 1..20: mol_type = other DNA
gccatcaggtgcagggcagc

SEQ ID NO: 80000 - DNA, 20 bp, synthetic construct
  misc_feature 1..20: note = CRISPR gRNA sequence
  source 1..20: mol_type = other DNA
ctgcaggctgaggtgggtga

SEQ ID NO: 80001 - DNA, 20 bp, synthetic construct
  misc_feature 1..20: note = CRISPR gRNA sequence
  source 1..20: mol_type = other DNA
caggctgaggtgggtgaaag

SEQ ID NO: 80002 - DNA, 20 bp, synthetic construct
  misc_feature 1..20: note = CRISPR gRNA sequence
  source 1..20: mol_type = other DNA
aggtgggtgaaagcatagcc

SEQ ID NO: 80003 - DNA, 20 bp, synthetic construct
  misc_feature 1..20: note = CRISPR gRNA sequence
  source 1..20: mol_type = other DNA
tctgctggtgcccagggcct

SEQ ID NO: 80004 - DNA, 20 bp, synthetic construct
  misc_feature 1..20: note = CRISPR gRNA sequence
  source 1..20: mol_type = other DNA
ctggtgcccagggcctgtgc

SEQ ID NO: 80005 - DNA, 20 bp, synthetic construct
  misc_feature 1..20: note = CRISPR gRNA sequence
  source 1..20: mol_type = other DNA
gtgcccagggcctgtgcaga

SEQ ID NO: 80006 - DNA, 20 bp, synthetic construct
  misc_feature 1..20: note = CRISPR gRNA sequence
  source 1..20: mol_type = other DNA
tgcagacgcagaaggaagtc

SEQ ID NO: 80007 - DNA, 20 bp, synthetic construct
  misc_feature 1..20: note = CRISPR gRNA sequence
  source 1..20: mol_type = other DNA
tgagtggccccaaaagctat

SEQ ID NO: 80008 - DNA, 20 bp, synthetic construct
  misc_feature 1..20: note = CRISPR gRNA sequence
  source 1..20: mol_type = other DNA
tcaagggtggagcaatatct

SEQ ID NO: 80009 - DNA, 20 bp, synthetic construct
  misc_feature 1..20: note = CRISPR gRNA sequence
  source 1..20: mol_type = other DNA
ttgcatagaagataaccttc

SEQ ID NO: 80010 - DNA, 20 bp, synthetic construct
  misc_feature 1..20: note = CRISPR gRNA sequence
  source 1..20: mol_type = other DNA
tgcatagaagataaccttcc

SEQ ID NO: 80011 - DNA, 20 bp, synthetic construct
  misc_feature 1..20: note = CRISPR gRNA sequence
  source 1..20: mol_type = other DNA
gcatagaagataaccttccc

SEQ ID NO: 80012 - DNA, 20 bp, synthetic construct
  misc_feature 1..20: note = CRISPR gRNA sequence
  source 1..20: mol_type = other DNA
catagaagataaccttccct

SEQ ID NO: 80013 - DNA, 20 bp, synthetic construct
  misc_feature 1..20: note = CRISPR gRNA sequence
  source 1..20: mol_type = other DNA
ccctgtctccaggcccctca

SEQ ID NO: 80014 - DNA, 20 bp, synthetic construct
  misc_feature 1..20: note = CRISPR gRNA sequence
  source 1..20: mol_type = other DNA
cctgtctccaggcccctcag

SEQ ID NO: 80015 - DNA, 20 bp, synthetic construct
  misc_feature 1..20: note = CRISPR gRNA sequence
  source 1..20: mol_type = other DNA
tctccaggcccctcagggcc

SEQ ID NO: 80016 - DNA, 20 bp, synthetic construct
  misc_feature 1..20: note = CRISPR gRNA sequence
  source 1..20: mol_type = other DNA
caggcccctcagggccacct

SEQ ID NO: 80017 - DNA, 20 bp, synthetic construct
  misc_feature 1..20: note = CRISPR gRNA sequence
  source 1..20: mol_type = other DNA
agggccacctcccccaggtc

SEQ ID NO: 80018 - DNA, 20 bp, synthetic construct
  misc_feature 1..20: note = CRISPR gRNA sequence
  source 1..20: mol_type = other DNA
ccccaggtccagtagggacg

SEQ ID NO: 80019 - DNA, 20 bp, synthetic construct
  misc_feature 1..20: note = CRISPR gRNA sequence
  source 1..20: mol_type = other DNA
agggcgagcaccatctgcat

SEQ ID NO: 80020 - DNA, 20 bp, synthetic construct
  misc_feature 1..20: note = CRISPR gRNA sequence
  source 1..20: mol_type = other DNA
catatagagctgagtcatgt

SEQ ID NO: 80021 - DNA, 20 bp, synthetic construct
  misc_feature 1..20: note = CRISPR gRNA sequence
  source 1..20: mol_type = other DNA
agtcatgttgggcaggaggg

SEQ ID NO: 80022 - DNA, 20 bp, synthetic construct
  misc_feature 1..20: note = CRISPR gRNA sequence
  source 1..20: mol_type = other DNA
ggcaggagggccacagactg

SEQ ID NO: 80023 - DNA, 20 bp, synthetic construct
  misc_feature 1..20: note = CRISPR gRNA sequence
  source 1..20: mol_type = other DNA
gcctggggcgtggtcaggaa

SEQ ID NO: 80024 - DNA, 20 bp, synthetic construct
  misc_feature 1..20: note = CRISPR gRNA sequence
  source 1..20: mol_type = other DNA
gggcgtggtcaggaagcaga

SEQ ID NO: 80025 - DNA, 20 bp, synthetic construct
  misc_feature 1..20: note = CRISPR gRNA sequence
  source 1..20: mol_type = other DNA
ggcacagtgcgggcaccgca

SEQ ID NO: 80026 - DNA, 20 bp, synthetic construct
  misc_feature 1..20: note = CRISPR gRNA sequence
  source 1..20: mol_type = other DNA
gcacagtgcgggcaccgcac

SEQ ID NO: 80027 - DNA, 20 bp, synthetic construct
  misc_feature 1..20: note = CRISPR gRNA sequence
  source 1..20: mol_type = other DNA
cggagacgtccatttgtctg

SEQ ID NO: 80028 - DNA, 20 bp, synthetic construct
  misc_feature 1..20: note = CRISPR gRNA sequence
  source 1..20: mol_type = other DNA
ggagacgtccatttgtctgt

SEQ ID NO: 80029 - DNA, 20 bp, synthetic construct
  misc_feature 1..20: note = CRISPR gRNA sequence
  source 1..20: mol_type = other DNA
gtctgtaactccaccagggc

SEQ ID NO: 80030 - DNA, 20 bp, synthetic construct
  misc_feature 1..20: note = CRISPR gRNA sequence
  source 1..20: mol_type = other DNA
tctgtaactccaccagggcc

SEQ ID NO: 80031 - DNA, 20 bp, synthetic construct
  misc_feature 1..20: note = CRISPR gRNA sequence
  source 1..20: mol_type = other DNA
taactccaccagggccccct

SEQ ID NO: 80032 - DNA, 20 bp, synthetic construct
  misc_feature 1..20: note = CRISPR gRNA sequence
  source 1..20: mol_type = other DNA
caccagggccccctcccgcg

SEQ ID NO: 80033 - DNA, 20 bp, synthetic construct
  misc_feature 1..20: note = CRISPR gRNA sequence
  source 1..20: mol_type = other DNA
ccgcgatggctgggcgctga

SEQ ID NO: 80034 - DNA, 20 bp, synthetic construct
  misc_feature 1..20: note = CRISPR gRNA sequence
  source 1..20: mol_type = other DNA
ggcgctgaagaagtgattca

SEQ ID NO: 80035 - DNA, 20 bp, synthetic construct
  misc_feature 1..20: note = CRISPR gRNA sequence
  source 1..20: mol_type = other DNA
aagaagtgattcacatattc

SEQ ID NO: 80036 - DNA, 20 bp, synthetic construct
  misc_feature 1..20: note = CRISPR gRNA sequence
  source 1..20: mol_type = other DNA
acatattcttccacccgtgg

SEQ ID NO: 80037 - DNA, 20 bp, synthetic construct
  misc_feature 1..20: note = CRISPR gRNA sequence
  source 1..20: mol_type = other DNA
ttccacccgtggcccatcaa

SEQ ID NO: 80038 - DNA, 20 bp, synthetic construct
  misc_feature 1..20: note = CRISPR gRNA sequence
  source 1..20: mol_type = other DNA
ccacccgtggcccatcaaag

SEQ ID NO: 80039 - DNA, 20 bp, synthetic construct
  misc_feature 1..20: note = CRISPR gRNA sequence
  source 1..20: mol_type = other DNA
cacccgtggcccatcaaagc

SEQ ID NO: 80040 - DNA, 20 bp, synthetic construct
  misc_feature 1..20: note = CRISPR gRNA sequence
  source 1..20: mol_type = other DNA
cctctgcaggcaggcaggca

SEQ ID NO: 80041 - DNA, 20 bp, synthetic construct
  misc_feature 1..20: note = CRISPR gRNA sequence
  source 1..20: mol_type = other DNA
tgcaggcaggcaggcaggca

SEQ ID NO: 80042 - DNA, 20 bp, synthetic construct
  misc_feature 1..20: note = CRISPR gRNA sequence
  source 1..20: mol_type = other DNA
caggcaggcaggcaggcagc

SEQ ID NO: 80043 - DNA, 20 bp, synthetic construct
  misc_feature 1..20: note = CRISPR gRNA sequence
  source 1..20: mol_type = other DNA
ccctggacgggaggtagcca

SEQ ID NO: 80044 - DNA, 20 bp, synthetic construct
  misc_feature 1..20: note = CRISPR gRNA sequence
  source 1..20: mol_type = other DNA
cctggacgggaggtagccat

SEQ ID NO: 80045 - DNA, 20 bp, synthetic construct
  misc_feature 1..20: note = CRISPR gRNA sequence
  source 1..20: mol_type = other DNA
gacgggaggtagccatcacc

SEQ ID NO: 80046 - DNA, 20 bp, synthetic construct
  misc_feature 1..20: note = CRISPR gRNA sequence
  source 1..20: mol_type = other DNA
cagagatgggagaaaagggt

SEQ ID NO: 80047 - DNA, 20 bp, synthetic construct
  misc_feature 1..20: note = CRISPR gRNA sequence
  source 1..20: mol_type = other DNA
ggcctgggccatcaggaccc

SEQ ID NO: 80048 - DNA, 20 bp, synthetic construct
  misc_feature 1..20: note = CRISPR gRNA sequence
  source 1..20: mol_type = other DNA
ggccatcaggacccataggc

SEQ ID NO: 80049 - DNA, 20 bp, synthetic construct
  misc_feature 1..20: note = CRISPR gRNA sequence
  source 1..20: mol_type = other DNA
gagggcctcatctagcccat

SEQ ID NO: 80050 - DNA, 20 bp, synthetic construct
  misc_feature 1..20: note = CRISPR gRNA sequence
  source 1..20: mol_type = other DNA
atctagcccatcaaagatca

SEQ ID NO: 80051 - DNA, 20 bp, synthetic construct
  misc_feature 1..20: note = CRISPR gRNA sequence
  source 1..20: mol_type = other DNA
gcccatcaaagatcagcagg

SEQ ID NO: 80052 - DNA, 20 bp, synthetic construct
  misc_feature 1..20: note = CRISPR gRNA sequence
  source 1..20: mol_type = other DNA
ggtcagcgttcttctccagg

SEQ ID NO: 80053 - DNA, 20 bp, synthetic construct
  misc_feature 1..20: note = CRISPR gRNA sequence
  source 1..20: mol_type = other DNA
gtcagcgttcttctccaggt

SEQ ID NO: 80054 - DNA, 20 bp, synthetic construct
  misc_feature 1..20: note = CRISPR gRNA sequence
  source 1..20: mol_type = other DNA
ttctccaggtactggaagac

SEQ ID NO: 80055 - DNA, 20 bp, synthetic construct
  misc_feature 1..20: note = CRISPR gRNA sequence
  source 1..20: mol_type = other DNA
ctccaggtactggaagacag

SEQ ID NO: 80056 - DNA, 20 bp, synthetic construct
  misc_feature 1..20: note = CRISPR gRNA sequence
  source 1..20: mol_type = other DNA
tccaggtactggaagacagt

SEQ ID NO: 80057 - DNA, 20 bp, synthetic construct
  misc_feature 1..20: note = CRISPR gRNA sequence
  source 1..20: mol_type = other DNA
caggtactggaagacagtgt

SEQ ID NO: 80058 - DNA, 20 bp, synthetic construct
  misc_feature 1..20: note = CRISPR gRNA sequence
  source 1..20: mol_type = other DNA
gaagacagtgtcgtggtccg

SEQ ID NO: 80059 - DNA, 20 bp, synthetic construct
  misc_feature 1..20: note = CRISPR gRNA sequence
  source 1..20: mol_type = other DNA
agggctcaggtacagatcaa

SEQ ID NO: 80060 - DNA, 20 bp, synthetic construct
  misc_feature 1..20: note = CRISPR gRNA sequence
  source 1..20: mol_type = other DNA
aggtacagatcaaaaaggag

SEQ ID NO: 80061 - DNA, 20 bp, synthetic construct
  misc_feature 1..20: note = CRISPR gRNA sequence
  source 1..20: mol_type = other DNA
ggacggtgtcaggaacctcg

SEQ ID NO: 80062 - DNA, 20 bp, synthetic construct
  misc_feature 1..20: note = CRISPR gRNA sequence
  source 1..20: mol_type = other DNA
gtgatcaagttgagctggcg

SEQ ID NO: 80063 - DNA, 20 bp, synthetic construct
  misc_feature 1..20: note = CRISPR gRNA sequence
  source 1..20: mol_type = other DNA
agctggcggaattcaaaaag

SEQ ID NO: 80064 - DNA, 20 bp, synthetic construct
  misc_feature 1..20: note = CRISPR gRNA sequence
  source 1..20: mol_type = other DNA
gcggaattcaaaaaggaaca

SEQ ID NO: 80065 - DNA, 20 bp, synthetic construct
  misc_feature 1..20: note = CRISPR gRNA sequence
  source 1..20: mol_type = other DNA
aaaaaggaacagggcctgga

SEQ ID NO: 80066 - DNA, 20 bp, synthetic construct
  misc_feature 1..20: note = CRISPR gRNA sequence
  source 1..20: mol_type = other DNA
gaaacagttcagatggccct

SEQ ID NO: 80067 - DNA, 20 bp, synthetic construct
  misc_feature 1..20: note = CRISPR gRNA sequence
  source 1..20: mol_type = other DNA
agatggccctctgcccactt

SEQ ID NO: 80068 - DNA, 20 bp, synthetic construct
  misc_feature 1..20: note = CRISPR gRNA sequence
  source 1..20: mol_type = other DNA
tgcccacttctggcagagcc

SEQ ID NO: 80069 - DNA, 20 bp, synthetic construct
  misc_feature 1..20: note = CRISPR gRNA sequence
  source 1..20: mol_type = other DNA
cccacttctggcagagccgg

SEQ ID NO: 80070 - DNA, 20 bp, synthetic construct
  misc_feature 1..20: note = CRISPR gRNA sequence
  source 1..20: mol_type = other DNA
ctggcagagccggtgggcca

SEQ ID NO: 80071 - DNA, 20 bp, synthetic construct
  misc_feature 1..20: note = CRISPR gRNA sequence
  source 1..20: mol_type = other DNA
tggcagagccggtgggccag

SEQ ID NO: 80072 - DNA, 20 bp, synthetic construct
  misc_feature 1..20: note = CRISPR gRNA sequence
  source 1..20: mol_type = other DNA
gcagagccggtgggccagcg

SEQ ID NO: 80073 - DNA, 20 bp, synthetic construct
  misc_feature 1..20: note = CRISPR gRNA sequence
  source 1..20: mol_type = other DNA
gcccatgccagccttcccca

SEQ ID NO: 80074 - DNA, 20 bp, synthetic construct
  misc_feature 1..20: note = CRISPR gRNA sequence
  source 1..20: mol_type = other DNA
cccatgccagccttccccaa

SEQ ID NO: 80075 - DNA, 20 bp, synthetic construct
  misc_feature 1..20: note = CRISPR gRNA sequence
  source 1..20: mol_type = other DNA
ccccaaaagcacggtcaccc

SEQ ID NO: 80076 - DNA, 20 bp, synthetic construct
  misc_feature 1..20: note = CRISPR gRNA sequence
  source 1..20: mol_type = other DNA
cccaaaagcacggtcaccct

SEQ ID NO: 80077 - DNA, 20 bp, synthetic construct
  misc_feature 1..20: note = CRISPR gRNA sequence
  source 1..20: mol_type = other DNA
gggcccttgttaaccctggt

SEQ ID NO: 80078 - DNA, 20 bp, synthetic construct
  misc_feature 1..20: note = CRISPR gRNA sequence
  source 1..20: mol_type = other DNA
gttaaccctggtgttgaaga

SEQ ID NO: 80079 - DNA, 20 bp, synthetic construct
  misc_feature 1..20: note = CRISPR gRNA sequence
  source 1..20: mol_type = other DNA
ttaaccctggtgttgaagag

SEQ ID NO: 80080 - DNA, 20 bp, synthetic construct
  misc_feature 1..20: note = CRISPR gRNA sequence
  source 1..20: mol_type = other DNA
accctggtgttgaagaggtc

SEQ ID NO: 80081 - DNA, 20 bp, synthetic construct
  misc_feature 1..20: note = CRISPR gRNA sequence
  source 1..20: mol_type = other DNA
gtgttgaagaggtccgagat

SEQ ID NO: 80082 - DNA, 20 bp, synthetic construct
  misc_feature 1..20: note = CRISPR gRNA sequence
  source 1..20: mol_type = other DNA
aagaggtccgagatgctcac

SEQ ID NO: 80083 - DNA, 20 bp, synthetic construct
  misc_feature 1..20: note = CRISPR gRNA sequence
  source 1..20: mol_type = other DNA
acgtcagcaccatcttccac

SEQ ID NO: 80084 - DNA, 20 bp, synthetic construct
  misc_feature 1..20: note = CRISPR gRNA sequence
  source 1..20: mol_type = other DNA
ccaccttgacgtcccccata

SEQ ID NO: 80085 - DNA, 20 bp, synthetic construct
  misc_feature 1..20: note = CRISPR gRNA sequence
  source 1..20: mol_type = other DNA
caccttgacgtcccccataa

SEQ ID NO: 80086 - DNA, 20 bp, synthetic construct
  misc_feature 1..20: note = CRISPR gRNA sequence
  source 1..20: mol_type = other DNA
gacgtcccccataatggccc

SEQ ID NO: 80087 - DNA, 20 bp, synthetic construct
  misc_feature 1..20: note = CRISPR gRNA sequence
  source 1..20: mol_type = other DNA
acgtcccccataatggcccc

SEQ ID NO: 80088 - DNA, 20 bp, synthetic construct
  misc_feature 1..20: note = CRISPR gRNA sequence
  source 1..20: mol_type = other DNA
cggagtgtctaaggatgctg

SEQ ID NO: 80089 - DNA, 20 bp, synthetic construct
  misc_feature 1..20: note = CRISPR gRNA sequence
  source 1..20: mol_type = other DNA
aggatgctgtggcccggcgc

SEQ ID NO: 80090 - DNA, 20 bp, synthetic construct
  misc_feature 1..20: note = CRISPR gRNA sequence
  source 1..20: mol_type = other DNA
tggcccggcgcaggattgga

SEQ ID NO: 80091 - DNA, 20 bp, synthetic construct
  misc_feature 1..20: note = CRISPR gRNA sequence
  source 1..20: mol_type = other DNA
gagggacatagacctggtgg

SEQ ID NO: 80092 - DNA, 20 bp, synthetic construct
  misc_feature 1..20: note = CRISPR gRNA sequence
  source 1..20: mol_type = other DNA
gtggaaggcgtggggctgcc

SEQ ID NO: 80093 - DNA, 20 bp, synthetic construct
  misc_feature 1..20: note = CRISPR gRNA sequence
  source 1..20: mol_type = other DNA
ccctgacccagggatttggc

SEQ ID NO: 80094 - DNA, 20 bp, synthetic construct
  misc_feature 1..20: note = CRISPR gRNA sequence
  source 1..20: mol_type = other DNA
acccagggatttggctcctg

SEQ ID NO: 80095 - DNA, 20 bp, synthetic construct
  misc_feature 1..20: note = CRISPR gRNA sequence
  source 1..20: mol_type = other DNA
ggctcctgtagcgctgctgg

SEQ ID NO: 80096 - DNA, 20 bp, synthetic construct
  misc_feature 1..20: note = CRISPR gRNA sequence
  source 1..20: mol_type = other DNA
gctcctgtagcgctgctggg

SEQ ID NO: 80097 - DNA, 20 bp, synthetic construct
  misc_feature 1..20: note = CRISPR gRNA sequence
  source 1..20: mol_type = other DNA
ctgtagcgctgctgggcaga

SEQ ID NO: 80098 - DNA, 20 bp, synthetic construct
  misc_feature 1..20: note = CRISPR gRNA sequence
  source 1..20: mol_type = other DNA
tagcgctgctgggcagaggt

SEQ ID NO: 80099 - DNA, 20 bp, synthetic construct
  misc_feature 1..20: note = CRISPR gRNA sequence
  source 1..20: mol_type = other DNA
ctgggcagaggtccgcagga

SEQ ID NO: 80100 - DNA, 20 bp, synthetic construct
  misc_feature 1..20: note = CRISPR gRNA sequence
  source 1..20: mol_type = other DNA
ggcagaggtccgcaggagct

SEQ ID NO: 80101 - DNA, 20 bp, synthetic construct
  misc_feature 1..20: note = CRISPR gRNA sequence
  source 1..20: mol_type = other DNA
caggtacttcttggccaact

SEQ ID NO: 80102 - DNA, 20 bp, synthetic construct
  misc_feature 1..20: note = CRISPR gRNA sequence
  source 1..20: mol_type = other DNA
cttggccaactctgcaaggg

SEQ ID NO: 80103 - DNA, 20 bp, synthetic construct
  misc_feature 1..20: note = CRISPR gRNA sequence
  source 1..20: mol_type = other DNA
ttggccaactctgcaagggg

SEQ ID NO: 80104 - DNA, 20 bp, synthetic construct
  misc_feature 1..20: note = CRISPR gRNA sequence
  source 1..20: mol_type = other DNA
ggccaactctgcaaggggca

SEQ ID NO: 80105 - DNA, 20 bp, synthetic construct
  misc_feature 1..20: note = CRISPR gRNA sequence
  source 1..20: mol_type = other DNA
gccaactctgcaaggggcag

SEQ ID NO: 80106 - DNA, 20 bp, synthetic construct
  misc_feature 1..20: note = CRISPR gRNA sequence
  source 1..20: mol_type = other DNA
tgcaaggggcagggacatgg

SEQ ID NO: 80107 - DNA, 20 bp, synthetic construct
  misc_feature 1..20: note = CRISPR gRNA sequence
  source 1..20: mol_type = other DNA
caaggggcagggacatggca

SEQ ID NO: 80108 - DNA, 20 bp, synthetic construct
  misc_feature 1..20: note = CRISPR gRNA sequence
  source 1..20: mol_type = other DNA
tgctcatgtcttcttgcccc

SEQ ID NO: 80109 - DNA, 20 bp, synthetic construct
  misc_feature 1..20: note = CRISPR gRNA sequence
  source 1..20: mol_type = other DNA
ctcatgtcttcttgccccag

SEQ ID NO: 80110 - DNA, 20 bp, synthetic construct
  misc_feature 1..20: note = CRISPR gRNA sequence
  source 1..20: mol_type = other DNA
atgtcttcttgccccagtat

SEQ ID NO: 80111 - DNA, 20 bp, synthetic construct
  misc_feature 1..20: note = CRISPR gRNA sequence
  source 1..20: mol_type = other DNA
cttgccccagtattgggctg

SEQ ID NO: 80112 - DNA, 20 bp, synthetic construct
  misc_feature 1..20: note = CRISPR gRNA sequence
  source 1..20: mol_type = other DNA
ttgccccagtattgggctgt

SEQ ID NO: 80113 - DNA, 20 bp, synthetic construct
  misc_feature 1..20: note = CRISPR gRNA sequence
  source 1..20: mol_type = other DNA
gccccagtattgggctgttg

SEQ ID NO: 80114 - DNA, 20 bp, synthetic construct
  misc_feature 1..20: note = CRISPR gRNA sequence
  source 1..20: mol_type = other DNA
ccccagtattgggctgttgg

SEQ ID NO: 80115 - DNA, 20 bp, synthetic construct
  misc_feature 1..20: note = CRISPR gRNA sequence
  source 1..20: mol_type = other DNA
ggctgttgggagcctgtagc

SEQ ID NO: 80116 - DNA, 20 bp, synthetic construct
  misc_feature 1..20: note = CRISPR gRNA sequence
  source 1..20: mol_type = other DNA
ttgggagcctgtagccccag

SEQ ID NO: 80117 - DNA, 20 bp, synthetic construct
  misc_feature 1..20: note = CRISPR gRNA sequence
  source 1..20: mol_type = other DNA
ggagcctgtagccccagatg

SEQ ID NO: 80118 - DNA, 20 bp, synthetic construct
  misc_feature 1..20: note = CRISPR gRNA sequence
  source 1..20: mol_type = other DNA
tagccccagatgtgtatgta

SEQ ID NO: 80119 - DNA, 20 bp, synthetic construct
  misc_feature 1..20: note = CRISPR gRNA sequence
  source 1..20: mol_type = other DNA
tgccaccccaacttccagaa

SEQ ID NO: 80120 - DNA, 20 bp, synthetic construct
  misc_feature 1..20: note = CRISPR gRNA sequence
  source 1..20: mol_type = other DNA
ccagaaggaatcagttctaa

SEQ ID NO: 80121 - DNA, 20 bp, synthetic construct
  misc_feature 1..20: note = CRISPR gRNA sequence
  source 1..20: mol_type = other DNA
cagaaggaatcagttctaag

SEQ ID NO: 80122 - DNA, 20 bp, synthetic construct
  misc_feature 1..20: note = CRISPR gRNA sequence
  source 1..20: mol_type = other DNA
taagggagcataggctctcc

SEQ ID NO: 80123 - DNA, 20 bp, synthetic construct
  misc_feature 1..20: note = CRISPR gRNA sequence
  source 1..20: mol_type = other DNA
agggagcataggctctccgg

SEQ ID NO: 80124 - DNA, 20 bp, synthetic construct
  misc_feature 1..20: note = CRISPR gRNA sequence
  source 1..20: mol_type = other DNA
tccggtagctatttaaacag

SEQ ID NO: 80125 - DNA, 20 bp, synthetic construct
  misc_feature 1..20: note = CRISPR gRNA sequence
  source 1..20: mol_type = other DNA
cggtagctatttaaacaggc

SEQ ID NO: 80126 - DNA, 20 bp, synthetic construct
  misc_feature 1..20: note = CRISPR gRNA sequence
  source 1..20: mol_type = other DNA
tttaaacaggcaggtgggaa

SEQ ID NO: 80127 - DNA, 20 bp, synthetic construct
  misc_feature 1..20: note = CRISPR gRNA sequence
  source 1..20: mol_type = other DNA
aaacaggcaggtgggaatgg

SEQ ID NO: 80128 - DNA, 20 bp, synthetic construct
  misc_feature 1..20: note = CRISPR gRNA sequence
  source 1..20: mol_type = other DNA
aacaggcaggtgggaatggg

SEQ ID NO: 80129 - DNA, 20 bp, synthetic construct
  misc_feature 1..20: note = CRISPR gRNA sequence
  source 1..20: mol_type = other DNA
tatccattctgcaatagtac

SEQ ID NO: 80130 - DNA, 20 bp, synthetic construct
  misc_feature 1..20: note = CRISPR gRNA sequence
  source 1..20: mol_type = other DNA
tccattctgcaatagtacac

SEQ ID NO: 80131 - DNA, 20 bp, synthetic construct
  misc_feature 1..20: note = CRISPR gRNA sequence
  source 1..20: mol_type = other DNA
tgcaatagtacacgtggtgt

SEQ ID NO: 80132 - DNA, 20 bp, synthetic construct
  misc_feature 1..20: note = CRISPR gRNA sequence
  source 1..20: mol_type = other DNA
caatagtacacgtggtgtaa

SEQ ID NO: 80133 - DNA, 20 bp, synthetic construct
  misc_feature 1..20: note = CRISPR gRNA sequence
  source 1..20: mol_type = other DNA
agtaagatggggggagggga

SEQ ID NO: 80134 - DNA, 20 bp, synthetic construct
  misc_feature 1..20: note = CRISPR gRNA sequence
  source 1..20: mol_type = other DNA
ctttgcaacatctctttttt

SEQ ID NO: 80135 - DNA, 20 bp, synthetic construct
  misc_feature 1..20: note = CRISPR gRNA sequence
  source 1..20: mol_type = other DNA
tgcaacatctcttttttttc

SEQ ID NO: 80136 - DNA, 20 bp, synthetic construct
  misc_feature 1..20: note = CRISPR gRNA sequence
  source 1..20: mol_type = other DNA
gcaacatctcttttttttct

SEQ ID NO: 80137 - DNA, 20 bp, synthetic construct
  misc_feature 1..20: note = CRISPR gRNA sequence
  source 1..20: mol_type = other DNA
caacatctcttttttttctt

SEQ ID NO: 80138 - DNA, 20 bp, synthetic construct
  misc_feature 1..20: note = CRISPR gRNA sequence
  source 1..20: mol_type = other DNA
ttttttttcttttttcccag

SEQ ID NO: 80139 - DNA, 20 bp, synthetic construct
  misc_feature 1..20: note = CRISPR gRNA sequence
  source 1..20: mol_type = other DNA
ttttttcttttttcccagag

SEQ ID NO: 80140 - DNA, 20 bp, synthetic construct
  misc_feature 1..20: note = CRISPR gRNA sequence
  source 1..20: mol_type = other DNA
tttttcttttttcccagaga

SEQ ID NO: 80141 - DNA, 20 bp, synthetic construct
  misc_feature 1..20: note = CRISPR gRNA sequence
  source 1..20: mol_type = other DNA
ttttcttttttcccagagac

SEQ ID NO: 80142 - DNA, 20 bp, synthetic construct
  misc_feature 1..20: note = CRISPR gRNA sequence
  source 1..20: mol_type = other DNA
tttcttttttcccagagaca

SEQ ID NO: 80143 - DNA, 20 bp, synthetic construct
  misc_feature 1..20: note = CRISPR gRNA sequence
  source 1..20: mol_type = other DNA
ttcttttttcccagagacag

SEQ ID NO: 80144 - DNA, 20 bp, synthetic construct
  misc_feature 1..20: note = CRISPR gRNA sequence
  source 1..20: mol_type = other DNA
tcttttttcccagagacaga

SEQ ID NO: 80145 - DNA, 20 bp, synthetic construct
  misc_feature 1..20: note = CRISPR gRNA sequence
  source 1..20: mol_type = other DNA
cttttttcccagagacagag

SEQ ID NO: 80146 - DNA, 20 bp, synthetic construct
  misc_feature 1..20: note = CRISPR gRNA sequence
  source 1..20: mol_type = other DNA
ttttttcccagagacagagt

SEQ ID NO: 80147 - DNA, 20 bp, synthetic construct
  misc_feature 1..20: note = CRISPR gRNA sequence
  source 1..20: mol_type = other DNA
ttttcccagagacagagtct

SEQ ID NO: 80148 - DNA, 20 bp, synthetic construct
  misc_feature 1..20: note = CRISPR gRNA sequence
  source 1..20: mol_type = other DNA
tttcccagagacagagtctc

SEQ ID NO: 80149 - DNA, 20 bp, synthetic construct
  misc_feature 1..20: note = CRISPR gRNA sequence
  source 1..20: mol_type = other DNA
ttcccagagacagagtctca

SEQ ID NO: 80150 - DNA, 20 bp, synthetic construct
  misc_feature 1..20: note = CRISPR gRNA sequence
  source 1..20: mol_type = other DNA
tcccagagacagagtctcag

SEQ ID NO: 80151 - DNA, 20 bp, synthetic construct
  misc_feature 1..20: note = CRISPR gRNA sequence
  source 1..20: mol_type = other DNA
cccagagacagagtctcagt

SEQ ID NO: 80152 - DNA, 20 bp, synthetic construct
  misc_feature 1..20: note = CRISPR gRNA sequence
  source 1..20: mol_type = other DNA
ccagagacagagtctcagtc

SEQ ID NO: 80153 - DNA, 20 bp, synthetic construct
  misc_feature 1..20: note = CRISPR gRNA sequence
  source 1..20: mol_type = other DNA
agtcttgcccaggctccagt

SEQ ID NO: 80154 - DNA, 20 bp, synthetic construct
  misc_feature 1..20: note = CRISPR gRNA sequence
  source 1..20: mol_type = other DNA
gcccaggctccagtgcagtg

SEQ ID NO: 80155 - DNA, 20 bp, synthetic construct
  misc_feature 1..20: note = CRISPR gRNA sequence
  source 1..20: mol_type = other DNA
cccaggctccagtgcagtgg

SEQ ID NO: 80156 - DNA, 20 bp, synthetic construct
  misc_feature 1..20: note = CRISPR gRNA sequence
  source 1..20: mol_type = other DNA
cagtgcagtggcacgatcct

SEQ ID NO: 80157 - DNA, 20 bp, synthetic construct
  misc_feature 1..20: note = CRISPR gRNA sequence
  source 1..20: mol_type = other DNA
gcttactgtagccgcaaact

SEQ ID NO: 80158 - DNA, 20 bp, synthetic construct
  misc_feature 1..20: note = CRISPR gRNA sequence
  source 1..20: mol_type = other DNA
actgtagccgcaaactcctg

SEQ ID NO: 80159 - DNA, 20 bp, synthetic construct
  misc_feature 1..20: note = CRISPR gRNA sequence
  source 1..20: mol_type = other DNA
ctgtagccgcaaactcctgg

SEQ ID NO: 80160 - DNA, 20 bp, synthetic construct
  misc_feature 1..20: note = CRISPR gRNA sequence
  source 1..20: mol_type = other DNA
tagccgcaaactcctggtct

SEQ ID NO: 80161 - DNA, 20 bp, synthetic construct
  misc_feature 1..20: note = CRISPR gRNA sequence
  source 1..20: mol_type = other DNA
ctggtctcaagtgatcctcc

SEQ ID NO: 80162 - DNA, 20 bp, synthetic construct
  misc_feature 1..20: note = CRISPR gRNA sequence
  source 1..20: mol_type = other DNA
gtctcaagtgatcctcctgc

SEQ ID NO: 80163 - DNA, 20 bp, synthetic construct
  misc_feature 1..20: note = CRISPR gRNA sequence
  source 1..20: mol_type = other DNA
aagtgatcctcctgcctcag

SEQ ID NO: 80164 - DNA, 20 bp, synthetic construct
  misc_feature 1..20: note = CRISPR gRNA sequence
  source 1..20: mol_type = other DNA
ctgcctcagcctcctgagta

SEQ ID NO: 80165 - DNA, 20 bp, synthetic construct
  misc_feature 1..20: note = CRISPR gRNA sequence
  source 1..20: mol_type = other DNA
cctcagcctcctgagtagct

SEQ ID NO: 80166 - DNA, 20 bp, synthetic construct
  misc_feature 1..20: note = CRISPR gRNA sequence
  source 1..20: mol_type = other DNA
agcctcctgagtagctggga

SEQ ID NO: 80167 - DNA, 20 bp, synthetic construct
  misc_feature 1..20: note = CRISPR gRNA sequence
  source 1..20: mol_type = other DNA
ctgagtagctgggactacag

SEQ ID NO: 80168 - DNA, 20 bp, synthetic construct
  misc_feature 1..20: note = CRISPR gRNA sequence
  source 1..20: mol_type = other DNA
agtagctgggactacaggtg

SEQ ID NO: 80169 - DNA, 20 bp, synthetic construct
  misc_feature 1..20: note = CRISPR gRNA sequence
  source 1..20: mol_type = other DNA
ggactacaggtgcacaccac

SEQ ID NO: 80170 - DNA, 20 bp, synthetic construct
  misc_feature 1..20: note = CRISPR gRNA sequence
  source 1..20: mol_type = other DNA
caggtgcacaccaccacacc

SEQ ID NO: 80171 - DNA, 20 bp, synthetic construct
  misc_feature 1..20: note = CRISPR gRNA sequence
  source 1..20: mol_type = other DNA
atttttgtatttttagtaga

SEQ ID NO: 80172 - DNA, 20 bp, synthetic construct
  misc_feature 1..20: note = CRISPR gRNA sequence
  source 1..20: mol_type = other DNA
ttgtatttttagtagagaca

SEQ ID NO: 80173 - DNA, 20 bp, synthetic construct
  misc_feature 1..20: note = CRISPR gRNA sequence
  source 1..20: mol_type = other DNA
tgtatttttagtagagacaa

SEQ ID NO: 80174 - DNA, 20 bp, synthetic construct
  misc_feature 1..20: note = CRISPR gRNA sequence
  source 1..20: mol_type = other DNA
gtatttttagtagagacaag

SEQ ID NO: 80175 - DNA, 20 bp, synthetic construct
  misc_feature 1..20: note = CRISPR gRNA sequence
  source 1..20: mol_type = other DNA
tatttttagtagagacaagg

SEQ ID NO: 80176 - DNA, 20 bp, synthetic construct
  misc_feature 1..20: note = CRISPR gRNA sequence
  source 1..20: mol_type = other DNA
ttagtagagacaaggttttg

SEQ ID NO: 80177 - DNA, 20 bp, synthetic construct
  misc_feature 1..20: note = CRISPR gRNA sequence
  source 1..20: mol_type = other DNA
tagtagagacaaggttttgt

SEQ ID NO: 80178 - DNA, 20 bp, synthetic construct
  misc_feature 1..20: note = CRISPR gRNA sequence
  source 1..20: mol_type = other DNA
agtagagacaaggttttgtc

SEQ ID NO: 80179 - DNA, 20 bp, synthetic construct
  misc_feature 1..20: note = CRISPR gRNA sequence
  source 1..20: mol_type = other DNA
gtagagacaaggttttgtca

SEQ ID NO: 80180 - DNA, 20 bp, synthetic construct
  misc_feature 1..20: note = CRISPR gRNA sequence
  source 1..20: mol_type = other DNA
tgtcacgttggccaggctag

SEQ ID NO: 80181 - DNA, 20 bp, synthetic construct
  misc_feature 1..20: note = CRISPR gRNA sequence
  source 1..20: mol_type = other DNA
gtcacgttggccaggctagt

SEQ ID NO: 80182 - DNA, 20 bp, synthetic construct
  misc_feature 1..20: note = CRISPR gRNA sequence
  source 1..20: mol_type = other DNA
tcacgttggccaggctagta

SEQ ID NO: 80183 - DNA, 20 bp, synthetic construct
  misc_feature 1..20: note = CRISPR gRNA sequence
  source 1..20: mol_type = other DNA
gccaggctagtattgaattc

SEQ ID NO: 80184 - DNA, 20 bp, synthetic construct
  misc_feature 1..20: note = CRISPR gRNA sequence
  source 1..20: mol_type = other DNA
gtattgaattcctgggctca

SEQ ID NO: 80185 - DNA, 20 bp, synthetic construct
  misc_feature 1..20: note = CRISPR gRNA sequence
  source 1..20: mol_type = other DNA
aattcctgggctcaactgat

SEQ ID NO: 80186 - DNA, 20 bp, synthetic construct
  misc_feature 1..20: note = CRISPR gRNA sequence
  source 1..20: mol_type = other DNA
ctgggctcaactgatccacc

SEQ ID NO: 80187 - DNA, 20 bp, synthetic construct
  misc_feature 1..20: note = CRISPR gRNA sequence
  source 1..20: mol_type = other DNA
ggctcaactgatccacctgc

SEQ ID NO: 80188 - DNA, 20 bp, synthetic construct
  misc_feature 1..20: note = CRISPR gRNA sequence
  source 1..20: mol_type = other DNA
aactgatccacctgcctcag

SEQ ID NO: 80189 - DNA, 20 bp, synthetic construct
  misc_feature 1..20: note = CRISPR gRNA sequence
  source 1..20: mol_type = other DNA
atccacctgcctcagccctc

SEQ ID NO: 80190 - DNA, 20 bp, synthetic construct
  misc_feature 1..20: note = CRISPR gRNA sequence
  source 1..20: mol_type = other DNA
cctcagccctccaaagtgct

SEQ ID NO: 80191 - DNA, 20 bp, synthetic construct
  misc_feature 1..20: note = CRISPR gRNA sequence
  source 1..20: mol_type = other DNA
agccctccaaagtgctggga

SEQ ID NO: 80192 - DNA, 20 bp, synthetic construct
  misc_feature 1..20: note = CRISPR gRNA sequence
  source 1..20: mol_type = other DNA
caaagtgctgggattacagg

SEQ ID NO: 80193 - DNA, 20 bp, synthetic construct
  misc_feature 1..20: note = CRISPR gRNA sequence
  source 1..20: mol_type = other DNA
ggattacaggtgtgagccac

SEQ ID NO: 80194 - DNA, 20 bp, synthetic construct
  misc_feature 1..20: note = CRISPR gRNA sequence
  source 1..20: mol_type = other DNA
caggtgtgagccaccgcgcc

SEQ ID NO: 80195 - DNA, 20 bp, synthetic construct
  misc_feature 1..20: note = CRISPR gRNA sequence
  source 1..20: mol_type = other DNA
ctttgcaatatcttattgaa

SEQ ID NO: 80196 - DNA, 20 bp, synthetic construct
  misc_feature 1..20: note = CRISPR gRNA sequence
  source 1..20: mol_type = other DNA
tgcaatatcttattgaaaca

SEQ ID NO: 80197 - DNA, 20 bp, synthetic construct
  misc_feature 1..20: note = CRISPR gRNA sequence
  source 1..20: mol_type = other DNA
gcaatatcttattgaaacaa

SEQ ID NO: 80198 - DNA, 20 bp, synthetic construct
  misc_feature 1..20: note = CRISPR gRNA sequence
  source 1..20: mol_type = other DNA
caatatcttattgaaacaac

SEQ ID NO: 80199 - DNA, 20 bp, synthetic construct
  misc_feature 1..20: note = CRISPR gRNA sequence
  source 1..20: mol_type = other DNA
attgaaacaacctctttctg

SEQ ID NO: 80200 - DNA, 20 bp, synthetic construct
  misc_feature 1..20: note = CRISPR gRNA sequence
  source 1..20: mol_type = other DNA
ttgaaacaacctctttctgt

SEQ ID NO: 80201 - DNA, 20 bp, synthetic construct
  misc_feature 1..20: note = CRISPR gRNA sequence
  source 1..20: mol_type = other DNA
aaacaacctctttctgtaat

SEQ ID NO: 80202 - DNA, 20 bp, synthetic construct
  misc_feature 1..20: note = CRISPR gRNA sequence
  source 1..20: mol_type = other DNA
tttctgtaatatctggatcc

SEQ ID NO: 80203 - DNA, 20 bp, synthetic construct
  misc_feature 1..20: note = CRISPR gRNA sequence
  source 1..20: mol_type = other DNA
tctgtaatatctggatcccc

SEQ ID NO: 80204 - DNA, 20 bp, synthetic construct
  misc_feature 1..20: note = CRISPR gRNA sequence
  source 1..20: mol_type = other DNA
ctgtaatatctggatcccca

SEQ ID NO: 80205 - DNA, 20 bp, synthetic construct
  misc_feature 1..20: note = CRISPR gRNA sequence
  source 1..20: mol_type = other DNA
tgtaatatctggatccccag

SEQ ID NO: 80206 - DNA, 20 bp, synthetic construct
  misc_feature 1..20: note = CRISPR gRNA sequence
  source 1..20: mol_type = other DNA
taatatctggatccccagtg

SEQ ID NO: 80207 - DNA, 20 bp, synthetic construct
  misc_feature 1..20: note = CRISPR gRNA sequence
  source 1..20: mol_type = other DNA
gatccccagtgcctcttccc

SEQ ID NO: 80208 - DNA, 20 bp, synthetic construct
  misc_feature 1..20: note = CRISPR gRNA sequence
  source 1..20: mol_type = other DNA
ttcccaatatttcagttctg

SEQ ID NO: 80209 - DNA, 20 bp, synthetic construct
  misc_feature 1..20: note = CRISPR gRNA sequence
  source 1..20: mol_type = other DNA
cccaatatttcagttctgca

SEQ ID NO: 80210 - DNA, 20 bp, synthetic construct
  misc_feature 1..20: note = CRISPR gRNA sequence
  source 1..20: mol_type = other DNA
ccaatatttcagttctgcaa

SEQ ID NO: 80211 - DNA, 20 bp, synthetic construct
  misc_feature 1..20: note = CRISPR gRNA sequence
  source 1..20: mol_type = other DNA
cagttctgcaatgcccaggg

SEQ ID NO: 80212 - DNA, 20 bp, synthetic construct
  misc_feature 1..20: note = CRISPR gRNA sequence
  source 1..20: mol_type = other DNA
agttctgcaatgcccagggg

SEQ ID NO: 80213 - DNA, 20 bp, synthetic construct
  misc_feature 1..20: note = CRISPR gRNA sequence
  source 1..20: mol_type = other DNA
tgcaatgcccaggggtgagc

SEQ ID NO: 80214 - DNA, 20 bp, synthetic construct
  misc_feature 1..20: note = CRISPR gRNA sequence
  source 1..20: mol_type = other DNA
caatgcccaggggtgagcac

SEQ ID NO: 80215 - DNA, 20 bp, synthetic construct
  misc_feature 1..20: note = CRISPR gRNA sequence
  source 1..20: mol_type = other DNA
acaacctgtaggcctaggca

SEQ ID NO: 80216 - DNA, 20 bp, synthetic construct
  misc_feature 1..20: note = CRISPR gRNA sequence
  source 1..20: mol_type = other DNA
taggcctaggcattaccgat

SEQ ID NO: 80217 - DNA, 20 bp, synthetic construct
  misc_feature 1..20: note = CRISPR gRNA sequence
  source 1..20: mol_type = other DNA
ggcattaccgatcggaactg

SEQ ID NO: 80218 - DNA, 20 bp, synthetic construct
  misc_feature 1..20: note = CRISPR gRNA sequence
  source 1..20: mol_type = other DNA
ccgatcggaactgtgggagc

SEQ ID NO: 80219 - DNA, 20 bp, synthetic construct
  misc_feature 1..20: note = CRISPR gRNA sequence
  source 1..20: mol_type = other DNA
tgggagctgggcccctacag

SEQ ID NO: 80220 - DNA, 20 bp, synthetic construct
  misc_feature 1..20: note = CRISPR gRNA sequence
  source 1..20: mol_type = other DNA
ggcccctacagtgccagatg

SEQ ID NO: 80221 - DNA, 20 bp, synthetic construct
  misc_feature 1..20: note = CRISPR gRNA sequence
  source 1..20: mol_type = other DNA
cagtgccagatgttaacctt

SEQ ID NO: 80222 - DNA, 20 bp, synthetic construct
  misc_feature 1..20: note = CRISPR gRNA sequence
  source 1..20: mol_type = other DNA
accttttaattcctgggtca

SEQ ID NO: 80223 - DNA, 20 bp, synthetic construct
  misc_feature 1..20: note = CRISPR gRNA sequence
  source 1..20: mol_type = other DNA
ttaattcctgggtcattgag

SEQ ID NO: 80224 - DNA, 20 bp, synthetic construct
  misc_feature 1..20: note = CRISPR gRNA sequence
  source 1..20: mol_type = other DNA
taattcctgggtcattgaga

SEQ ID NO: 80225 - DNA, 20 bp, synthetic construct
  misc_feature 1..20: note = CRISPR gRNA sequence
  source 1..20: mol_type = other DNA
aattcctgggtcattgagag

SEQ ID NO: 80226 - DNA, 20 bp, synthetic construct
  misc_feature 1..20: note = CRISPR gRNA sequence
  source 1..20: mol_type = other DNA
attcctgggtcattgagagg

SEQ ID NO: 80227 - DNA, 20 bp, synthetic construct
  misc_feature 1..20: note = CRISPR gRNA sequence
  source 1..20: mol_type = other DNA
ctgggtcattgagaggtctc

SEQ ID NO: 80228 - DNA, 20 bp, synthetic construct
  misc_feature 1..20: note = CRISPR gRNA sequence
  source 1..20: mol_type = other DNA
ggtcattgagaggtctcagg

SEQ ID NO: 80229 - DNA, 20 bp, synthetic construct
  misc_feature 1..20: note = CRISPR gRNA sequence
  source 1..20: mol_type = other DNA
agaggtctcaggtgacccag

SEQ ID NO: 80230 - DNA, 20 bp, synthetic construct
  misc_feature 1..20: note = CRISPR gRNA sequence
  source 1..20: mol_type = other DNA
aggtgacccagggaaagggc

SEQ ID NO: 80231 - DNA, 20 bp, synthetic construct
  misc_feature 1..20: note = CRISPR gRNA sequence
  source 1..20: mol_type = other DNA
gggctgcttttgggggaacc

SEQ ID NO: 80232 - DNA, 20 bp, synthetic construct
  misc_feature 1..20: note = CRISPR gRNA sequence
  source 1..20: mol_type = other DNA
cttttgggggaaccctatgg

SEQ ID NO: 80233 - DNA, 20 bp, synthetic construct
  misc_feature 1..20: note = CRISPR gRNA sequence
  source 1..20: mol_type = other DNA
ttgggggaaccctatgggga

SEQ ID NO: 80234 - DNA, 20 bp, synthetic construct
  misc_feature 1..20: note = CRISPR gRNA sequence
  source 1..20: mol_type = other DNA
tgggggaaccctatggggaa

SEQ ID NO: 80235 - DNA, 20 bp, synthetic construct
  misc_feature 1..20: note = CRISPR gRNA sequence
  source 1..20: mol_type = other DNA
gggggaaccctatggggaaa

SEQ ID NO: 80236 - DNA, 20 bp, synthetic construct
  misc_feature 1..20: note = CRISPR gRNA sequence
  source 1..20: mol_type = other DNA
ggggaaccctatggggaaag

SEQ ID NO: 80237 - DNA, 20 bp, synthetic construct
  misc_feature 1..20: note = CRISPR gRNA sequence
  source 1..20: mol_type = other DNA
tggggaaaggccaaggtagt

SEQ ID NO: 80238 - DNA, 20 bp, synthetic construct
  misc_feature 1..20: note = CRISPR gRNA sequence
  source 1..20: mol_type = other DNA
ttttgagcggatgtgaatcc

SEQ ID NO: 80239 - DNA, 20 bp, synthetic construct
  misc_feature 1..20: note = CRISPR gRNA sequence
  source 1..20: mol_type = other DNA
tgagcggatgtgaatcctct

SEQ ID NO: 80240 - DNA, 20 bp, synthetic construct
  misc_feature 1..20: note = CRISPR gRNA sequence
  source 1..20: mol_type = other DNA
gagcggatgtgaatcctctg

SEQ ID NO: 80241 - DNA, 20 bp, synthetic construct
  misc_feature 1..20: note = CRISPR gRNA sequence
  source 1..20: mol_type = other DNA
agcggatgtgaatcctctgg

SEQ ID NO: 80242 - DNA, 20 bp, synthetic construct
  misc_feature 1..20: note = CRISPR gRNA sequence
  source 1..20: mol_type = other DNA
tggttatagccatggttggc

SEQ ID NO: 80243 - DNA, 20 bp, synthetic construct
  misc_feature 1..20: note = CRISPR gRNA sequence
  source 1..20: mol_type = other DNA
gttatagccatggttggcag

SEQ ID NO: 80244 - DNA, 20 bp, synthetic construct
  misc_feature 1..20: note = CRISPR gRNA sequence
  source 1..20: mol_type = other DNA
tagccatggttggcagcagt

SEQ ID NO: 80245 - DNA, 20 bp, synthetic construct
  misc_feature 1..20: note = CRISPR gRNA sequence
  source 1..20: mol_type = other DNA
gcagcagtgggggcagagaa

SEQ ID NO: 80246 - DNA, 20 bp, synthetic construct
  misc_feature 1..20: note = CRISPR gRNA sequence
  source 1..20: mol_type = other DNA
tagttagtgggacaactcgt

SEQ ID NO: 80247 - DNA, 20 bp, synthetic construct
  misc_feature 1..20: note = CRISPR gRNA sequence
  source 1..20: mol_type = other DNA
gttagtgggacaactcgtgg

SEQ ID NO: 80248 - DNA, 20 bp, synthetic construct
  misc_feature 1..20: note = CRISPR gRNA sequence
  source 1..20: mol_type = other DNA
gtgggacaactcgtggagaa

SEQ ID NO: 80249 - DNA, 20 bp, synthetic construct
  misc_feature 1..20: note = CRISPR gRNA sequence
  source 1..20: mol_type = other DNA
gtggagaacgaggaccattc

SEQ ID NO: 80250 - DNA, 20 bp, synthetic construct
  misc_feature 1..20: note = CRISPR gRNA sequence
  source 1..20: mol_type = other DNA
tgagaactggtcaagaatga

SEQ ID NO: 80251 - DNA, 20 bp, synthetic construct
  misc_feature 1..20: note = CRISPR gRNA sequence
  source 1..20: mol_type = other DNA
agaactggtcaagaatgaga

SEQ ID NO: 80252 - DNA, 20 bp, synthetic construct
  misc_feature 1..20: note = CRISPR gRNA sequence
  source 1..20: mol_type = other DNA
gtcaagaatgagagaagtcc

SEQ ID NO: 80253 - DNA, 20 bp, synthetic construct
  misc_feature 1..20: note = CRISPR gRNA sequence
  source 1..20: mol_type = other DNA
tcttctctcactggcctggc

SEQ ID NO: 80254 - DNA, 20 bp, synthetic construct
  misc_feature 1..20: note = CRISPR gRNA sequence
  source 1..20: mol_type = other DNA
cttctctcactggcctggcc

SEQ ID NO: 80255 - DNA, 20 bp, synthetic construct
  misc_feature 1..20: note = CRISPR gRNA sequence
  source 1..20: mol_type = other DNA
ttctctcactggcctggcct

SEQ ID NO: 80256 - DNA, 20 bp, synthetic construct
  misc_feature 1..20: note = CRISPR gRNA sequence
  source 1..20: mol_type = other DNA
ctctcactggcctggcctgc

SEQ ID NO: 80257 - DNA, 20 bp, synthetic construct
  misc_feature 1..20: note = CRISPR gRNA sequence
  source 1..20: mol_type = other DNA
tctcactggcctggcctgcc

SEQ ID NO: 80258 - DNA, 20 bp, synthetic construct
  misc_feature 1..20: note = CRISPR gRNA sequence
  source 1..20: mol_type = other DNA
tcactggcctggcctgccct

SEQ ID NO: 80259 - DNA, 20 bp, synthetic construct
  misc_feature 1..20: note = CRISPR gRNA sequence
  source 1..20: mol_type = other DNA
actggcctggcctgccctaa

SEQ ID NO: 80260 - DNA, 20 bp, synthetic construct
  misc_feature 1..20: note = CRISPR gRNA sequence
  source 1..20: mol_type = other DNA
gcctggcctgccctaagcag

SEQ ID NO: 80261 - DNA, 20 bp, synthetic construct
  misc_feature 1..20: note = CRISPR gRNA sequence
  source 1..20: mol_type = other DNA
gcctgccctaagcagctcca

SEQ ID NO: 80262 - DNA, 20 bp, synthetic construct
  misc_feature 1..20: note = CRISPR gRNA sequence
  source 1..20: mol_type = other DNA
ccctaagcagctccatgtct

SEQ ID NO: 80263 - DNA, 20 bp, synthetic construct
  misc_feature 1..20: note = CRISPR gRNA sequence
  source 1..20: mol_type = other DNA
agcagctccatgtctcccca

SEQ ID NO: 80264 - DNA, 20 bp, synthetic construct
  misc_feature 1..20: note = CRISPR gRNA sequence
  source 1..20: mol_type = other DNA
catgtctccccatgggcccc

SEQ ID NO: 80265 - DNA, 20 bp, synthetic construct
  misc_feature 1..20: note = CRISPR gRNA sequence
  source 1..20: mol_type = other DNA
cccatgggcccccagggcct

SEQ ID NO: 80266 - DNA, 20 bp, synthetic construct
  misc_feature 1..20: note = CRISPR gRNA sequence
  source 1..20: mol_type = other DNA
tgtcttgaaggtttctccca

SEQ ID NO: 80267 - DNA, 20 bp, synthetic construct
  misc_feature 1..20: note = CRISPR gRNA sequence
  source 1..20: mol_type = other DNA
tcttgaaggtttctcccagg

SEQ ID NO: 80268 - DNA, 20 bp, synthetic construct
  misc_feature 1..20: note = CRISPR gRNA sequence
  source 1..20: mol_type = other DNA
gaaggtttctcccaggcctc

SEQ ID NO: 80269 - DNA, 20 bp, synthetic construct
  misc_feature 1..20: note = CRISPR gRNA sequence
  source 1..20: mol_type = other DNA
aaggtttctcccaggcctcc

SEQ ID NO: 80270 - DNA, 20 bp, synthetic construct
  misc_feature 1..20: note = CRISPR gRNA sequence
  source 1..20: mol_type = other DNA
ctcccaggcctcctcacccc

SEQ ID NO: 80271 - DNA, 20 bp, synthetic construct
  misc_feature 1..20: note = CRISPR gRNA sequence
  source 1..20: mol_type = other DNA
tcccaggcctcctcacccct

SEQ ID NO: 80272 - DNA, 20 bp, synthetic construct
  misc_feature 1..20: note = CRISPR gRNA sequence
  source 1..20: mol_type = other DNA
ccaggcctcctcacccctcc

SEQ ID NO: 80273 - DNA, 20 bp, synthetic construct
  misc_feature 1..20: note = CRISPR gRNA sequence
  source 1..20: mol_type = other DNA
ctcacccctccccatccctg

SEQ ID NO: 80274 - DNA, 20 bp, synthetic construct
  misc_feature 1..20: note = CRISPR gRNA sequence
  source 1..20: mol_type = other DNA
acccctccccatccctgctc

SEQ ID NO: 80275 - DNA, 20 bp, synthetic construct
  misc_feature 1..20: note = CRISPR gRNA sequence
  source 1..20: mol_type = other DNA
cccatccctgctcaccccca

SEQ ID NO: 80276 - DNA, 20 bp, synthetic construct
  misc_feature 1..20: note = CRISPR gRNA sequence
  source 1..20: mol_type = other DNA
ctcacccccaaactggtctc

SEQ ID NO: 80277 - DNA, 20 bp, synthetic construct
  misc_feature 1..20: note = CRISPR gRNA sequence
  source 1..20: mol_type = other DNA
acccccaaactggtctcctc

SEQ ID NO: 80278 - DNA, 20 bp, synthetic construct
  misc_feature 1..20: note = CRISPR gRNA sequence
  source 1..20: mol_type = other DNA
gtctcctccctgggtctcct

SEQ ID NO: 80279 - DNA, 20 bp, synthetic construct
  misc_feature 1..20: note = CRISPR gRNA sequence
  source 1..20: mol_type = other DNA
ctccctgggtctccttcaac

SEQ ID NO: 80280 - DNA, 20 bp, synthetic construct
  misc_feature 1..20: note = CRISPR gRNA sequence
  source 1..20: mol_type = other DNA
cctgggtctccttcaacact

SEQ ID NO: 80281 - DNA, 20 bp, synthetic construct
  misc_feature 1..20: note = CRISPR gRNA sequence
  source 1..20: mol_type = other DNA
ggtctccttcaacactgagg

SEQ ID NO: 80282 - DNA, 20 bp, synthetic construct
  misc_feature 1..20: note = CRISPR gRNA sequence
  source 1..20: mol_type = other DNA
cttcaacactgaggacatag

SEQ ID NO: 80283 - DNA, 20 bp, synthetic construct
  misc_feature 1..20: note = CRISPR gRNA sequence
  source 1..20: mol_type = other DNA
caacactgaggacatagggt

SEQ ID NO: 80284 - DNA, 20 bp, synthetic construct
  misc_feature 1..20: note = CRISPR gRNA sequence
  source 1..20: mol_type = other DNA
aacactgaggacatagggtg

SEQ ID NO: 80285 - DNA, 20 bp, synthetic construct
  misc_feature 1..20: note = CRISPR gRNA sequence
  source 1..20: mol_type = other DNA
aggacatagggtgtccctgg

SEQ ID NO: 80286 - DNA, 20 bp, synthetic construct
  misc_feature 1..20: note = CRISPR gRNA sequence
  source 1..20: mol_type = other DNA
gaaaagcctggacagcgaag

SEQ ID NO: 80287 - DNA, 20 bp, synthetic construct
  misc_feature 1..20: note = CRISPR gRNA sequence
  source 1..20: mol_type = other DNA
gacagcgaagctgagacctg

SEQ ID NO: 80288 - DNA, 20 bp, synthetic construct
  misc_feature 1..20: note = CRISPR gRNA sequence
  source 1..20: mol_type = other DNA
agacctgtatggtgcttcca

SEQ ID NO: 80289 - DNA, 20 bp, synthetic construct
  misc_feature 1..20: note = CRISPR gRNA sequence
  source 1..20: mol_type = other DNA
tatggtgcttccagctcctt

SEQ ID NO: 80290 - DNA, 20 bp, synthetic construct
  misc_feature 1..20: note = CRISPR gRNA sequence
  source 1..20: mol_type = other DNA
ccagctccttcagcggagcc

SEQ ID NO: 80291 - DNA, 20 bp, synthetic construct
  misc_feature 1..20: note = CRISPR gRNA sequence
  source 1..20: mol_type = other DNA
cagctccttcagcggagccc

SEQ ID NO: 80292 - DNA, 20 bp, synthetic construct
  misc_feature 1..20: note = CRISPR gRNA sequence
  source 1..20: mol_type = other DNA
cttcagcggagccctcttca

SEQ ID NO: 80293 - DNA, 20 bp, synthetic construct
  misc_feature 1..20: note = CRISPR gRNA sequence
  source 1..20: mol_type = other DNA
cagcggagccctcttcagag

SEQ ID NO: 80294 - DNA, 20 bp, synthetic construct
  misc_feature 1..20: note = CRISPR gRNA sequence
  source 1..20: mol_type = other DNA
agcggagccctcttcagaga

SEQ ID NO: 80295 - DNA, 20 bp, synthetic construct
  misc_feature 1..20: note = CRISPR gRNA sequence
  source 1..20: mol_type = other DNA
ttcagagaagtccccatgca

SEQ ID NO: 80296 - DNA, 20 bp, synthetic construct
  misc_feature 1..20: note = CRISPR gRNA sequence
  source 1..20: mol_type = other DNA
cagagaagtccccatgcagc

SEQ ID NO: 80297 - DNA, 20 bp, synthetic construct
  misc_feature 1..20: note = CRISPR gRNA sequence
  source 1..20: mol_type = other DNA
agagaagtccccatgcagcc

SEQ ID NO: 80298 - DNA, 20 bp, synthetic construct
  misc_feature 1..20: note = CRISPR gRNA sequence
  source 1..20: mol_type = other DNA
cgctgccagcccaggcctct

SEQ ID NO: 80299 - DNA, 20 bp, synthetic construct
  misc_feature 1..20: note = CRISPR gRNA sequence
  source 1..20: mol_type = other DNA
gctgccagcccaggcctctc

SEQ ID NO: 80300 - DNA, 20 bp, synthetic construct
  misc_feature 1..20: note = CRISPR gRNA sequence
  source 1..20: mol_type = other DNA
ccagcccaggcctctcctct

SEQ ID NO: 80301 - DNA, 20 bp, synthetic construct
  misc_feature 1..20: note = CRISPR gRNA sequence
  source 1..20: mol_type = other DNA
tcctctgcctgtgcaagacc

SEQ ID NO: 80302 - DNA, 20 bp, synthetic construct
  misc_feature 1..20: note = CRISPR gRNA sequence
  source 1..20: mol_type = other DNA
ctctgcctgtgcaagacctc

SEQ ID NO: 80303 - DNA, 20 bp, synthetic construct
  misc_feature 1..20: note = CRISPR gRNA sequence
  source 1..20: mol_type = other DNA
tgcctgtgcaagacctccag

SEQ ID NO: 80304 - DNA, 20 bp, synthetic construct
  misc_feature 1..20: note = CRISPR gRNA sequence
  source 1..20: mol_type = other DNA
cctgtgcaagacctccagtc

SEQ ID NO: 80305 - DNA, 20 bp, synthetic construct
  misc_feature 1..20: note = CRISPR gRNA sequence
  source 1..20: mol_type = other DNA
tgcaagacctccagtccttt

SEQ ID NO: 80306 - DNA, 20 bp, synthetic construct
  misc_feature 1..20: note = CRISPR gRNA sequence
  source 1..20: mol_type = other DNA
cagtccttttctcctggaaa

SEQ ID NO: 80307 - DNA, 20 bp, synthetic construct
  misc_feature 1..20: note = CRISPR gRNA sequence
  source 1..20: mol_type = other DNA
ttctcctggaaacttgcgag

SEQ ID NO: 80308 - DNA, 20 bp, synthetic construct
  misc_feature 1..20: note = CRISPR gRNA sequence
  source 1..20: mol_type = other DNA
tctcctggaaacttgcgaga

SEQ ID NO: 80309 - DNA, 20 bp, synthetic construct
  misc_feature 1..20: note = CRISPR gRNA sequence
  source 1..20: mol_type = other DNA
ctcctggaaacttgcgagac

SEQ ID NO: 80310 - DNA, 20 bp, synthetic construct
  misc_feature 1..20: note = CRISPR gRNA sequence
  source 1..20: mol_type = other DNA
tcctggaaacttgcgagaca

SEQ ID NO: 80311 - DNA, 20 bp, synthetic construct
  misc_feature 1..20: note = CRISPR gRNA sequence
  source 1..20: mol_type = other DNA
ctggaaacttgcgagacaag

SEQ ID NO: 80312 - DNA, 20 bp, synthetic construct
  misc_feature 1..20: note = CRISPR gRNA sequence
  source 1..20: mol_type = other DNA
gaaacttgcgagacaagagt

SEQ ID NO: 80313 - DNA, 20 bp, synthetic construct
  misc_feature 1..20: note = CRISPR gRNA sequence
  source 1..20: mol_type = other DNA
gcgagacaagagtcactggg

SEQ ID NO: 80314 - DNA, 20 bp, synthetic construct
  misc_feature 1..20: note = CRISPR gRNA sequence
  source 1..20: mol_type = other DNA
cgagacaagagtcactgggc

SEQ ID NO: 80315 - DNA, 20 bp, synthetic construct
  misc_feature 1..20: note = CRISPR gRNA sequence
  source 1..20: mol_type = other DNA
ggcctctggaggcttattgg

SEQ ID NO: 80316 - DNA, 20 bp, synthetic construct
  misc_feature 1..20: note = CRISPR gRNA sequence
  source 1..20: mol_type = other DNA
tggaggcttattggcagggg

SEQ ID NO: 80317 - DNA, 20 bp, synthetic construct
  misc_feature 1..20: note = CRISPR gRNA sequence
  source 1..20: mol_type = other DNA
gaggcttattggcaggggac

SEQ ID NO: 80318 - DNA, 20 bp, synthetic construct
  misc_feature 1..20: note = CRISPR gRNA sequence
  source 1..20: mol_type = other DNA
attggcaggggacaaggtcc

SEQ ID NO: 80319 - DNA, 20 bp, synthetic construct
  misc_feature 1..20: note = CRISPR gRNA sequence
  source 1..20: mol_type = other DNA
ttggcaggggacaaggtcca

SEQ ID NO: 80320 - DNA, 20 bp, synthetic construct
  misc_feature 1..20: note = CRISPR gRNA sequence
  source 1..20: mol_type = other DNA
gcaggggacaaggtccaggg

SEQ ID NO: 80321 - DNA, 20 bp, synthetic construct
  misc_feature 1..20: note = CRISPR gRNA sequence
  source 1..20: mol_type = other DNA
ggcccccaggcaaccccatc

SEQ ID NO: 80322 - DNA, 20 bp, synthetic construct
  misc_feature 1..20: note = CRISPR gRNA sequence
  source 1..20: mol_type = other DNA
gcccccaggcaaccccatct

SEQ ID NO: 80323 - DNA, 20 bp, synthetic construct
  misc_feature 1..20: note = CRISPR gRNA sequence
  source 1..20: mol_type = other DNA
tctgtttatgttcctcccca

SEQ ID NO: 80324 - DNA, 20 bp, synthetic construct
  misc_feature 1..20: note = CRISPR gRNA sequence
  source 1..20: mol_type = other DNA
tgtttatgttcctccccaca

SEQ ID NO: 80325 - DNA, 20 bp, synthetic construct
  misc_feature 1..20: note = CRISPR gRNA sequence
  source 1..20: mol_type = other DNA
tttatgttcctccccacact

SEQ ID NO: 80326 - DNA, 20 bp, synthetic construct
  misc_feature 1..20: note = CRISPR gRNA sequence
  source 1..20: mol_type = other DNA
atgttcctccccacactggt

SEQ ID NO: 80327 - DNA, 20 bp, synthetic construct
  misc_feature 1..20: note = CRISPR gRNA sequence
  source 1..20: mol_type = other DNA
tgttcctccccacactggta

SEQ ID NO: 80328 - DNA, 20 bp, synthetic construct
  misc_feature 1..20: note = CRISPR gRNA sequence
  source 1..20: mol_type = other DNA
ctccccacactggtacccac

SEQ ID NO: 80329 - DNA, 20 bp, synthetic construct
  misc_feature 1..20: note = CRISPR gRNA sequence
  source 1..20: mol_type = other DNA
cccacactggtacccaccta

SEQ ID NO: 80330 - DNA, 20 bp, synthetic construct
  misc_feature 1..20: note = CRISPR gRNA sequence
  source 1..20: mol_type = other DNA
gtacccacctagctgctgct

SEQ ID NO: 80331 - DNA, 20 bp, synthetic construct
  misc_feature 1..20: note = CRISPR gRNA sequence
  source 1..20: mol_type = other DNA
gctgctgcttcttgcactgc

SEQ ID NO: 80332 - DNA, 20 bp, synthetic construct
  misc_feature 1..20: note = CRISPR gRNA sequence
  source 1..20: mol_type = other DNA
ctgcttcttgcactgcttcc

SEQ ID NO: 80333 - DNA, 20 bp, synthetic construct
  misc_feature 1..20: note = CRISPR gRNA sequence
  source 1..20: mol_type = other DNA
cttcttgcactgcttccggc

SEQ ID NO: 80334 - DNA, 20 bp, synthetic construct
  misc_feature 1..20: note = CRISPR gRNA sequence
  source 1..20: mol_type = other DNA
cttgcactgcttccggcggg

SEQ ID NO: 80335 - DNA, 20 bp, synthetic construct
  misc_feature 1..20: note = CRISPR gRNA sequence
  source 1..20: mol_type = other DNA
ttgcactgcttccggcgggg

SEQ ID NO: 80336 - DNA, 20 bp, synthetic construct
  misc_feature 1..20: note = CRISPR gRNA sequence
  source 1..20: mol_type = other DNA
gcactgcttccggcggggtg

SEQ ID NO: 80337 - DNA, 20 bp, synthetic construct
  misc_feature 1..20: note = CRISPR gRNA sequence
  source 1..20: mol_type = other DNA
cactgcttccggcggggtga

SEQ ID NO: 80338 - DNA, 20 bp, synthetic construct
  misc_feature 1..20: note = CRISPR gRNA sequence
  source 1..20: mol_type = other DNA
cttccggcggggtgaggacc

SEQ ID NO: 80339 - DNA, 20 bp, synthetic construct
  misc_feature 1..20: note = CRISPR gRNA sequence
  source 1..20: mol_type = other DNA
ccggcggggtgaggacccac

SEQ ID NO: 80340 - DNA, 20 bp, synthetic construct
  misc_feature 1..20: note = CRISPR gRNA sequence
  source 1..20: mol_type = other DNA
cggcggggtgaggacccaca

SEQ ID NO: 80341 - DNA, 20 bp, synthetic construct
  misc_feature 1..20: note = CRISPR gRNA sequence
  source 1..20: mol_type = other DNA
tgatgtgggcgcttcaggcc

SEQ ID NO: 80342 - DNA, 20 bp, synthetic construct
  misc_feature 1..20: note = CRISPR gRNA sequence
  source 1..20: mol_type = other DNA
atgtgggcgcttcaggcctg

SEQ ID NO: 80343 - DNA, 20 bp, synthetic construct
  misc_feature 1..20: note = CRISPR gRNA sequence
  source 1..20: mol_type = other DNA
caggcctgaaaaagcaaagg

SEQ ID NO: 80344 - DNA, 20 bp, synthetic construct
  misc_feature 1..20: note = CRISPR gRNA sequence
  source 1..20: mol_type = other DNA
aggcctgaaaaagcaaagga

SEQ ID NO: 80345 - DNA, 20 bp, synthetic construct
  misc_feature 1..20: note = CRISPR gRNA sequence
  source 1..20: mol_type = other DNA
aaaaagcaaaggaaggggtg

SEQ ID NO: 80346 - DNA, 20 bp, synthetic construct
  misc_feature 1..20: note = CRISPR gRNA sequence
  source 1..20: mol_type = other DNA
gggatctgggctgaggggtt

SEQ ID NO: 80347 - DNA, 20 bp, synthetic construct
  misc_feature 1..20: note = CRISPR gRNA sequence
  source 1..20: mol_type = other DNA
ggctgaggggttacccagaa

SEQ ID NO: 80348 - DNA, 20 bp, synthetic construct
  misc_feature 1..20: note = CRISPR gRNA sequence
  source 1..20: mol_type = other DNA
aggggttacccagaaccttt

SEQ ID NO: 80349 - DNA, 20 bp, synthetic construct
  misc_feature 1..20: note = CRISPR gRNA sequence
  source 1..20: mol_type = other DNA
cccagaacctttggggaact

SEQ ID NO: 80350 - DNA, 20 bp, synthetic construct
  misc_feature 1..20: note = CRISPR gRNA sequence
  source 1..20: mol_type = other DNA
tggggaactccagtccacag

SEQ ID NO: 80351 - DNA, 20 bp, synthetic construct
  misc_feature 1..20: note = CRISPR gRNA sequence
  source 1..20: mol_type = other DNA
ggggaactccagtccacaga

SEQ ID NO: 80352 - DNA, 20 bp, synthetic construct
  misc_feature 1..20: note = CRISPR gRNA sequence
  source 1..20: mol_type = other DNA
gggaactccagtccacagac

SEQ ID NO: 80353 - DNA, 20 bp, synthetic construct
  misc_feature 1..20: note = CRISPR gRNA sequence
  source 1..20: mol_type = other DNA
cagtccacagacaggtggca

SEQ ID NO: 80354 - DNA, 20 bp, synthetic construct
  misc_feature 1..20: note = CRISPR gRNA sequence
  source 1..20: mol_type = other DNA
gaaaggcaggcagcaggcag

SEQ ID NO: 80355 - DNA, 20 bp, synthetic construct
  misc_feature 1..20: note = CRISPR gRNA sequence
  source 1..20: mol_type = other DNA
ggtcaacaccagcttctatt

SEQ ID NO: 80356 - DNA, 20 bp, synthetic construct
  misc_feature 1..20: note = CRISPR gRNA sequence
  source 1..20: mol_type = other DNA
ctatttgcagagtggacttc

SEQ ID NO: 80357 - DNA, 20 bp, synthetic construct
  misc_feature 1..20: note = CRISPR gRNA sequence
  source 1..20: mol_type = other DNA
tatttgcagagtggacttct

SEQ ID NO: 80358 - DNA, 20 bp, synthetic construct
  misc_feature 1..20: note = CRISPR gRNA sequence
  source 1..20: mol_type = other DNA
tttgcagagtggacttctag

SEQ ID NO: 80359 - DNA, 20 bp, synthetic construct
  misc_feature 1..20: note = CRISPR gRNA sequence
  source 1..20: mol_type = other DNA
gcagagtggacttctaggca

SEQ ID NO: 80360 - DNA, 20 bp, synthetic construct
  misc_feature 1..20: note = CRISPR gRNA sequence
  source 1..20: mol_type = other DNA
cagagtggacttctaggcac

SEQ ID NO: 80361 - DNA, 20 bp, synthetic construct
  misc_feature 1..20: note = CRISPR gRNA sequence
  source 1..20: mol_type = other DNA
ctaggcacccccattggaag

SEQ ID NO: 80362 - DNA, 20 bp, synthetic construct
  misc_feature 1..20: note = CRISPR gRNA sequence
  source 1..20: mol_type = other DNA
taggcacccccattggaagg

SEQ ID NO: 80363 - DNA, 20 bp, synthetic construct
  misc_feature 1..20: note = CRISPR gRNA sequence
  source 1..20: mol_type = other DNA
ggcacccccattggaaggtg

SEQ ID NO: 80364 - DNA, 20 bp, synthetic construct
  misc_feature 1..20: note = CRISPR gRNA sequence
  source 1..20: mol_type = other DNA
gaaggtggatgttctgggcc

SEQ ID NO: 80365 - DNA, 20 bp, synthetic construct
  misc_feature 1..20: note = CRISPR gRNA sequence
  source 1..20: mol_type = other DNA
tgggcctggcagtcttgcag

SEQ ID NO: 80366 - DNA, 20 bp, synthetic construct
  misc_feature 1..20: note = CRISPR gRNA sequence
  source 1..20: mol_type = other DNA
ggcctggcagtcttgcagtc

SEQ ID NO: 80367 - DNA, 20 bp, synthetic construct
  misc_feature 1..20: note = CRISPR gRNA sequence
  source 1..20: mol_type = other DNA
gcagtcttgcagtccaggat

SEQ ID NO: 80368 - DNA, 20 bp, synthetic construct
  misc_feature 1..20: note = CRISPR gRNA sequence
  source 1..20: mol_type = other DNA
gcagtccaggatgcaggaag

SEQ ID NO: 80369 - DNA, 20 bp, synthetic construct
  misc_feature 1..20: note = CRISPR gRNA sequence
  source 1..20: mol_type = other DNA
cagtccaggatgcaggaagc

SEQ ID NO: 80370 - DNA, 20 bp, synthetic construct
  misc_feature 1..20: note = CRISPR gRNA sequence
  source 1..20: mol_type = other DNA
agctccaagcactaaatggc

SEQ ID NO: 80371 - DNA, 20 bp, synthetic construct
  misc_feature 1..20: note = CRISPR gRNA sequence
  source 1..20: mol_type = other DNA
caagcactaaatggccatct

SEQ ID NO: 80372 - DNA, 20 bp, synthetic construct
  misc_feature 1..20: note = CRISPR gRNA sequence
  source 1..20: mol_type = other DNA
aatggccatctgtccatcag

SEQ ID NO: 80373 - DNA, 20 bp, synthetic construct
  misc_feature 1..20: note = CRISPR gRNA sequence
  source 1..20: mol_type = other DNA
tccatcagggaaggaccaag

SEQ ID NO: 80374 - DNA, 20 bp, synthetic construct
  misc_feature 1..20: note = CRISPR gRNA sequence
  source 1..20: mol_type = other DNA
tatggaagccgccggtggtc

SEQ ID NO: 80375 - DNA, 20 bp, synthetic construct
  misc_feature 1..20: note = CRISPR gRNA sequence
  source 1..20: mol_type = other DNA
tggaagccgccggtggtcat

SEQ ID NO: 80376 - DNA, 20 bp, synthetic construct
  misc_feature 1..20: note = CRISPR gRNA sequence
  source 1..20: mol_type = other DNA
ccagtgagtttggccaggcc

SEQ ID NO: 80377 - DNA, 20 bp, synthetic construct
  misc_feature 1..20: note = CRISPR gRNA sequence
  source 1..20: mol_type = other DNA
ggccaggcctgcaacctccc

SEQ ID NO: 80378 - DNA, 20 bp, synthetic construct
  misc_feature 1..20: note = CRISPR gRNA sequence
  source 1..20: mol_type = other DNA
gccaggcctgcaacctccct

SEQ ID NO: 80379 - DNA, 20 bp, synthetic construct
  misc_feature 1..20: note = CRISPR gRNA sequence
  source 1..20: mol_type = other DNA
caacctccctcctctgttag

SEQ ID NO: 80380 - DNA, 20 bp, synthetic construct
  misc_feature 1..20: note = CRISPR gRNA sequence
  source 1..20: mol_type = other DNA
cctcctctgttagggtttta

SEQ ID NO: 80381 - DNA, 20 bp, synthetic construct
  misc_feature 1..20: note = CRISPR gRNA sequence
  source 1..20: mol_type = other DNA
ctctgttagggttttatcat

SEQ ID NO: 80382 - DNA, 20 bp, synthetic construct
  misc_feature 1..20: note = CRISPR gRNA sequence
  source 1..20: mol_type = other DNA
tgttagggttttatcatccc

SEQ ID NO: 80383 - DNA, 20 bp, synthetic construct
  misc_feature 1..20: note = CRISPR gRNA sequence
  source 1..20: mol_type = other DNA
ttagggttttatcatcccga

SEQ ID NO: 80384 - DNA, 20 bp, synthetic construct
  misc_feature 1..20: note = CRISPR gRNA sequence
  source 1..20: mol_type = other DNA
gggttttatcatcccgattt

SEQ ID NO: 80385 - DNA, 20 bp, synthetic construct
  misc_feature 1..20: note = CRISPR gRNA sequence
  source 1..20: mol_type = other DNA
tatcatcccgatttcttatc

SEQ ID NO: 80386 - DNA, 20 bp, synthetic construct
  misc_feature 1..20: note = CRISPR gRNA sequence
  source 1..20: mol_type = other DNA
atcatcccgatttcttatca

SEQ ID NO: 80387 - DNA, 20 bp, synthetic construct
  misc_feature 1..20: note = CRISPR gRNA sequence
  source 1..20: mol_type = other DNA
tcatcccgatttcttatcac

SEQ ID NO: 80388 - DNA, 20 bp, synthetic construct
  misc_feature 1..20: note = CRISPR gRNA sequence
  source 1..20: mol_type = other DNA
cttatcacccacatttcctc

SEQ ID NO: 80389 - DNA, 20 bp, synthetic construct
  misc_feature 1..20: note = CRISPR gRNA sequence
  source 1..20: mol_type = other DNA
ttatcacccacatttcctca

SEQ ID NO: 80390 - DNA, 20 bp, synthetic construct
  misc_feature 1..20: note = CRISPR gRNA sequence
  source 1..20: mol_type = other DNA
atcacccacatttcctcact

SEQ ID NO: 80391 - DNA, 20 bp, synthetic construct
  misc_feature 1..20: note = CRISPR gRNA sequence
  source 1..20: mol_type = other DNA
tcacccacatttcctcactt

SEQ ID NO: 80392 - DNA, 20 bp, synthetic construct
  misc_feature 1..20: note = CRISPR gRNA sequence
  source 1..20: mol_type = other DNA
cctcacttcccttaatagtt

SEQ ID NO: 80393 - DNA, 20 bp, synthetic construct
  misc_feature 1..20: note = CRISPR gRNA sequence
  source 1..20: mol_type = other DNA
ctcacttcccttaatagttt

SEQ ID NO: 80394 - DNA, 20 bp, synthetic construct
  misc_feature 1..20: note = CRISPR gRNA sequence
  source 1..20: mol_type = other DNA
acttcccttaatagtttctg

SEQ ID NO: 80395 - DNA, 20 bp, synthetic construct
  misc_feature 1..20: note = CRISPR gRNA sequence
  source 1..20: mol_type = other DNA
cccttaatagtttctggagt

SEQ ID NO: 80396 - DNA, 20 bp, synthetic construct
  misc_feature 1..20: note = CRISPR gRNA sequence
  source 1..20: mol_type = other DNA
ccttaatagtttctggagtc

SEQ ID NO: 80397 - DNA, 20 bp, synthetic construct
  misc_feature 1..20: note = CRISPR gRNA sequence
  source 1..20: mol_type = other DNA
aatagtttctggagtcttgt

SEQ ID NO: 80398 - DNA, 20 bp, synthetic construct
  misc_feature 1..20: note = CRISPR gRNA sequence
  source 1..20: mol_type = other DNA
atagtttctggagtcttgtc

SEQ ID NO: 80399 - DNA, 20 bp, synthetic construct
  misc_feature 1..20: note = CRISPR gRNA sequence
  source 1..20: mol_type = other DNA
ctggagtcttgtctcattgt

SEQ ID NO: 80400 - DNA, 20 bp, synthetic construct
  misc_feature 1..20: note = CRISPR gRNA sequence
  source 1..20: mol_type = other DNA
tggagtcttgtctcattgta

SEQ ID NO: 80401 - DNA, 20 bp, synthetic construct
  misc_feature 1..20: note = CRISPR gRNA sequence
  source 1..20: mol_type = other DNA
gagtcttgtctcattgtatg

SEQ ID NO: 80402 - DNA, 20 bp, synthetic construct
  misc_feature 1..20: note = CRISPR gRNA sequence
  source 1..20: mol_type = other DNA
gtctcattgtatggattttc

SEQ ID NO: 80403 - DNA, 20 bp, synthetic construct
  misc_feature 1..20: note = CRISPR gRNA sequence
  source 1..20: mol_type = other DNA
tctcattgtatggattttca

SEQ ID NO: 80404 - DNA, 20 bp, synthetic construct
  misc_feature 1..20: note = CRISPR gRNA sequence
  source 1..20: mol_type = other DNA
attgtatggattttcaacaa

SEQ ID NO: 80405 - DNA, 20 bp, synthetic construct
  misc_feature 1..20: note = CRISPR gRNA sequence
  source 1..20: mol_type = other DNA
tatggattttcaacaatcac

SEQ ID NO: 80406 - DNA, 20 bp, synthetic construct
  misc_feature 1..20: note = CRISPR gRNA sequence
  source 1..20: mol_type = other DNA
tcaacaatcactttaatgcc

SEQ ID NO: 80407 - DNA, 20 bp, synthetic construct
  misc_feature 1..20: note = CRISPR gRNA sequence
  source 1..20: mol_type = other DNA
caacaatcactttaatgcct

SEQ ID NO: 80408 - DNA, 20 bp, synthetic construct
  misc_feature 1..20: note = CRISPR gRNA sequence
  source 1..20: mol_type = other DNA
aacaatcactttaatgcctt

SEQ ID NO: 80409 - DNA, 20 bp, synthetic construct
  misc_feature 1..20: note = CRISPR gRNA sequence
  source 1..20: mol_type = other DNA
taatgcctttctggaagagt

SEQ ID NO: 80410 - DNA, 20 bp, synthetic construct
  misc_feature 1..20: note = CRISPR gRNA sequence
  source 1..20: mol_type = other DNA
aatgcctttctggaagagtt

SEQ ID NO: 80411 - DNA, 20 bp, synthetic construct
  misc_feature 1..20: note = CRISPR gRNA sequence
  source 1..20: mol_type = other DNA
atgcctttctggaagagttt

SEQ ID NO: 80412 - DNA, 20 bp, synthetic construct
  misc_feature 1..20: note = CRISPR gRNA sequence
  source 1..20: mol_type = other DNA
tctggaagagtttgagaaag

SEQ ID NO: 80413 - DNA, 20 bp, synthetic construct
  misc_feature 1..20: note = CRISPR gRNA sequence
  source 1..20: mol_type = other DNA
ctggaagagtttgagaaagg

SEQ ID NO: 80414 - DNA, 20 bp, synthetic construct
  misc_feature 1..20: note = CRISPR gRNA sequence
  source 1..20: mol_type = other DNA
tggaagagtttgagaaagga

SEQ ID NO: 80415 - DNA, 20 bp, synthetic construct
  misc_feature 1..20: note = CRISPR gRNA sequence
  source 1..20: mol_type = other DNA
gaagagtttgagaaaggaag

SEQ ID NO: 80416 - DNA, 20 bp, synthetic construct
  misc_feature 1..20: note = CRISPR gRNA sequence
  source 1..20: mol_type = other DNA
gagaaaggaagaaggaaaac

SEQ ID NO: 80417 - DNA, 20 bp, synthetic construct
  misc_feature 1..20: note = CRISPR gRNA sequence
  source 1..20: mol_type = other DNA
agaaaggaagaaggaaaaca

SEQ ID NO: 80418 - DNA, 20 bp, synthetic construct
  misc_feature 1..20: note = CRISPR gRNA sequence
  source 1..20: mol_type = other DNA
aggaaagaattttaagaagt

SEQ ID NO: 80419 - DNA, 20 bp, synthetic construct
  misc_feature 1..20: note = CRISPR gRNA sequence
  source 1..20: mol_type = other DNA
taagaagtcaagcagggtcc

SEQ ID NO: 80420 - DNA, 20 bp, synthetic construct
  misc_feature 1..20: note = CRISPR gRNA sequence
  source 1..20: mol_type = other DNA
aagaagtcaagcagggtcct

SEQ ID NO: 80421 - DNA, 20 bp, synthetic construct
  misc_feature 1..20: note = CRISPR gRNA sequence
  source 1..20: mol_type = other DNA
agaagtcaagcagggtcctc

SEQ ID NO: 80422 - DNA, 20 bp, synthetic construct
  misc_feature 1..20: note = CRISPR gRNA sequence
  source 1..20: mol_type = other DNA
ctacagctaagctaagtgac

SEQ ID NO: 80423 - DNA, 20 bp, synthetic construct
  misc_feature 1..20: note = CRISPR gRNA sequence
  source 1..20: mol_type = other DNA
cagctaagctaagtgaccaa

SEQ ID NO: 80424 - DNA, 20 bp, synthetic construct
  misc_feature 1..20: note = CRISPR gRNA sequence
  source 1..20: mol_type = other DNA
agctaagtgaccaataggaa

SEQ ID NO: 80425 - DNA, 20 bp, synthetic construct
  misc_feature 1..20: note = CRISPR gRNA sequence
  source 1..20: mol_type = other DNA
agtgaccaataggaacagcc

SEQ ID NO: 80426 - DNA, 20 bp, synthetic construct
  misc_feature 1..20: note = CRISPR gRNA sequence
  source 1..20: mol_type = other DNA
gagcagggccctgggctcct

SEQ ID NO: 80427 - DNA, 20 bp, synthetic construct
  misc_feature 1..20: note = CRISPR gRNA sequence
  source 1..20: mol_type = other DNA
ggctccttgtccagctagga

SEQ ID NO: 80428 - DNA, 20 bp, synthetic construct
  misc_feature 1..20: note = CRISPR gRNA sequence
  source 1..20: mol_type = other DNA
cttgtccagctaggaggctg

SEQ ID NO: 80429 - DNA, 20 bp, synthetic construct
  misc_feature 1..20: note = CRISPR gRNA sequence
  source 1..20: mol_type = other DNA
gtccagctaggaggctggaa

SEQ ID NO: 80430 - DNA, 20 bp, synthetic construct
  misc_feature 1..20: note = CRISPR gRNA sequence
  source 1..20: mol_type = other DNA
tccagctaggaggctggaac

SEQ ID NO: 80431 - DNA, 20 bp, synthetic construct
  misc_feature 1..20: note = CRISPR gRNA sequence
  source 1..20: mol_type = other DNA
ggaggctggaaccagttcga

SEQ ID NO: 80432 - DNA, 20 bp, synthetic construct
  misc_feature 1..20: note = CRISPR gRNA sequence
  source 1..20: mol_type = other DNA
gaaccagttcgagagcactt

SEQ ID NO: 80433 - DNA, 20 bp, synthetic construct
  misc_feature 1..20: note = CRISPR gRNA sequence
  source 1..20: mol_type = other DNA
gagagcacttcaatatctta

SEQ ID NO: 80434 - DNA, 20 bp, synthetic construct
  misc_feature 1..20: note = CRISPR gRNA sequence
  source 1..20: mol_type = other DNA
caatatcttaacaaatccta

SEQ ID NO: 80435 - DNA, 20 bp, synthetic construct
  misc_feature 1..20: note = CRISPR gRNA sequence
  source 1..20: mol_type = other DNA
aatatcttaacaaatcctat

SEQ ID NO: 80436 - DNA, 20 bp, synthetic construct
  misc_feature 1..20: note = CRISPR gRNA sequence
  source 1..20: mol_type = other DNA
aacaaatcctatattaaaaa

SEQ ID NO: 80437 - DNA, 20 bp, synthetic construct
  misc_feature 1..20: note = CRISPR gRNA sequence
  source 1..20: mol_type = other DNA
acaaatcctatattaaaaag

SEQ ID NO: 80438 - DNA, 20 bp, synthetic construct
  misc_feature 1..20: note = CRISPR gRNA sequence
  source 1..20: mol_type = other DNA
tattaaaaagggactcactg

SEQ ID NO: 80439 - DNA, 20 bp, synthetic construct
  misc_feature 1..20: note = CRISPR gRNA sequence
  source 1..20: mol_type = other DNA
aaaagggactcactggccaa

SEQ ID NO: 80440 - DNA, 20 bp, synthetic construct
  misc_feature 1..20: note = CRISPR gRNA sequence
  source 1..20: mol_type = other DNA
actggccaaatatcaatcag

SEQ ID NO: 80441 - DNA, 20 bp, synthetic construct
  misc_feature 1..20: note = CRISPR gRNA sequence
  source 1..20: mol_type = other DNA
gccaaatatcaatcagatct

SEQ ID NO: 80442 - DNA, 20 bp, synthetic construct
  misc_feature 1..20: note = CRISPR gRNA sequence
  source 1..20: mol_type = other DNA
gttacagccatgagataatg

SEQ ID NO: 80443 - DNA, 20 bp, synthetic construct
  misc_feature 1..20: note = CRISPR gRNA sequence
  source 1..20: mol_type = other DNA
cagccatgagataatgatgc

SEQ ID NO: 80444 - DNA, 20 bp, synthetic construct
  misc_feature 1..20: note = CRISPR gRNA sequence
  source 1..20: mol_type = other DNA
agtgatgcgggcctattgga

SEQ ID NO: 80445 - DNA, 20 bp, synthetic construct
  misc_feature 1..20: note = CRISPR gRNA sequence
  source 1..20: mol_type = other DNA
ttggaccagggacttggaca

SEQ ID NO: 80446 - DNA, 20 bp, synthetic construct
  misc_feature 1..20: note = CRISPR gRNA sequence
  source 1..20: mol_type = other DNA
gaccagggacttggacagtt

SEQ ID NO: 80447 - DNA, 20 bp, synthetic construct
  misc_feature 1..20: note = CRISPR gRNA sequence
  source 1..20: mol_type = other DNA
ggacagttttgattcactgg

SEQ ID NO: 80448 - DNA, 20 bp, synthetic construct
  misc_feature 1..20: note = CRISPR gRNA sequence
  source 1..20: mol_type = other DNA
gacagttttgattcactggg

SEQ ID NO: 80449 - DNA, 20 bp, synthetic construct
  misc_feature 1..20: note = CRISPR gRNA sequence
  source 1..20: mol_type = other DNA
tgattcactggggagctgag

SEQ ID NO: 80450 - DNA, 20 bp, synthetic construct
  misc_feature 1..20: note = CRISPR gRNA sequence
  source 1..20: mol_type = other DNA
gattcactggggagctgagg

SEQ ID NO: 80451 - DNA, 20 bp, synthetic construct
  misc_feature 1..20: note = CRISPR gRNA sequence
  source 1..20: mol_type = other DNA
attcactggggagctgaggt

SEQ ID NO: 80452 - DNA, 20 bp, synthetic construct
  misc_feature 1..20: note = CRISPR gRNA sequence
  source 1..20: mol_type = other DNA
actggggagctgaggttata

SEQ ID NO: 80453 - DNA, 20 bp, synthetic construct
  misc_feature 1..20: note = CRISPR gRNA sequence
  source 1..20: mol_type = other DNA
gggagctgaggttatagggt

SEQ ID NO: 80454 - DNA, 20 bp, synthetic construct
  misc_feature 1..20: note = CRISPR gRNA sequence
  source 1..20: mol_type = other DNA
aggttatagggtgggttttc

SEQ ID NO: 80455 - DNA, 20 bp, synthetic construct
  misc_feature 1..20: note = CRISPR gRNA sequence
  source 1..20: mol_type = other DNA
tagggtgggttttctgttgg

SEQ ID NO: 80456 - DNA, 20 bp, synthetic construct
  misc_feature 1..20: note = CRISPR gRNA sequence
  source 1..20: mol_type = other DNA
tctgttggcattactgccat

SEQ ID NO: 80457 - DNA, 20 bp, synthetic construct
  misc_feature 1..20: note = CRISPR gRNA sequence
  source 1..20: mol_type = other DNA
ctgttggcattactgccatg

SEQ ID NO: 80458 - DNA, 20 bp, synthetic construct
  misc_feature 1..20: note = CRISPR gRNA sequence
  source 1..20: mol_type = other DNA
tgttggcattactgccatgc

SEQ ID NO: 80459 - DNA, 20 bp, synthetic construct
  misc_feature 1..20: note = CRISPR gRNA sequence
  source 1..20: mol_type = other DNA
ttggcattactgccatgcac

SEQ ID NO: 80460 - DNA, 20 bp, synthetic construct
  misc_feature 1..20: note = CRISPR gRNA sequence
  source 1..20: mol_type = other DNA
gcattactgccatgcacagc

SEQ ID NO: 80461 - DNA, 20 bp, synthetic construct
  misc_feature 1..20: note = CRISPR gRNA sequence
  source 1..20: mol_type = other DNA
ctgccatgcacagcgataag

SEQ ID NO: 80462 - DNA, 20 bp, synthetic construct
  misc_feature 1..20: note = CRISPR gRNA sequence
  source 1..20: mol_type = other DNA
ccatgcacagcgataagtaa

SEQ ID NO: 80463 - DNA, 20 bp, synthetic construct
  misc_feature 1..20: note = CRISPR gRNA sequence
  source 1..20: mol_type = other DNA
ctgtagaaatcaaggtgctg

SEQ ID NO: 80464 - DNA, 20 bp, synthetic construct
  misc_feature 1..20: note = CRISPR gRNA sequence
  source 1..20: mol_type = other DNA
tgtagaaatcaaggtgctga

SEQ ID NO: 80465 - DNA, 20 bp, synthetic construct
  misc_feature 1..20: note = CRISPR gRNA sequence
  source 1..20: mol_type = other DNA
tagaaatcaaggtgctgaga

SEQ ID NO: 80466 - DNA, 20 bp, synthetic construct
  misc_feature 1..20: note = CRISPR gRNA sequence
  source 1..20: mol_type = other DNA
agatgaaagtgtgacccacg

SEQ ID NO: 80467 - DNA, 20 bp, synthetic construct
  misc_feature 1..20: note = CRISPR gRNA sequence
  source 1..20: mol_type = other DNA
tttaatcactggcccttccg

SEQ ID NO: 80468 - DNA, 20 bp, synthetic construct
  misc_feature 1..20: note = CRISPR gRNA sequence
  source 1..20: mol_type = other DNA
aatcactggcccttccgagc

SEQ ID NO: 80469 - DNA, 20 bp, synthetic construct
  misc_feature 1..20: note = CRISPR gRNA sequence
  source 1..20: mol_type = other DNA
atcactggcccttccgagct

SEQ ID NO: 80470 - DNA, 20 bp, synthetic construct
  misc_feature 1..20: note = CRISPR gRNA sequence
  source 1..20: mol_type = other DNA
gcccttccgagctccttcag

SEQ ID NO: 80471 - DNA, 20 bp, synthetic construct
  misc_feature 1..20: note = CRISPR gRNA sequence
  source 1..20: mol_type = other DNA
ccgagctccttcagaaaatc

SEQ ID NO: 80472 - DNA, 20 bp, synthetic construct
  misc_feature 1..20: note = CRISPR gRNA sequence
  source 1..20: mol_type = other DNA
cgagctccttcagaaaatca

SEQ ID NO: 80473 - DNA, 20 bp, synthetic construct
  misc_feature 1..20: note = CRISPR gRNA sequence
  source 1..20: mol_type = other DNA
cttcagaaaatcagccaaag

SEQ ID NO: 80474 - DNA, 20 bp, synthetic construct
  misc_feature 1..20: note = CRISPR gRNA sequence
  source 1..20: mol_type = other DNA
cagaaaatcagccaaaggct

SEQ ID NO: 80475 - DNA, 20 bp, synthetic construct
  misc_feature 1..20: note = CRISPR gRNA sequence
  source 1..20: mol_type = other DNA
agaaaatcagccaaaggctc

SEQ ID NO: 80476 - DNA, 20 bp, synthetic construct
  misc_feature 1..20: note = CRISPR gRNA sequence
  source 1..20: mol_type = other DNA
ccccgctgaagacagcagct

SEQ ID NO: 80477 - DNA, 20 bp, synthetic construct
  misc_feature 1..20: note = CRISPR gRNA sequence
  source 1..20: mol_type = other DNA
aagacagcagctgtgggtga

SEQ ID NO: 80478 - DNA, 20 bp, synthetic construct
  misc_feature 1..20: note = CRISPR gRNA sequence
  source 1..20: mol_type = other DNA
tgggtgagtgtcaagtccaa

SEQ ID NO: 80479 - DNA, 20 bp, synthetic construct
  misc_feature 1..20: note = CRISPR gRNA sequence
  source 1..20: mol_type = other DNA
gggcttccccatgaagcctg

SEQ ID NO: 80480 - DNA, 20 bp, synthetic construct
  misc_feature 1..20: note = CRISPR gRNA sequence
  source 1..20: mol_type = other DNA
ccccatgaagcctgacactt

SEQ ID NO: 80481 - DNA, 20 bp, synthetic construct
  misc_feature 1..20: note = CRISPR gRNA sequence
  source 1..20: mol_type = other DNA
cccatgaagcctgacacttt

SEQ ID NO: 80482 - DNA, 20 bp, synthetic construct
  misc_feature 1..20: note = CRISPR gRNA sequence
  source 1..20: mol_type = other DNA
acactttggggctgggagat

SEQ ID NO: 80483 - DNA, 20 bp, synthetic construct
  misc_feature 1..20: note = CRISPR gRNA sequence
  source 1..20: mol_type = other DNA
tggggctgggagatgaggcc

SEQ ID NO: 80484 - DNA, 20 bp, synthetic construct
  misc_feature 1..20: note = CRISPR gRNA sequence
  source 1..20: mol_type = other DNA
ggggctgggagatgaggccc

SEQ ID NO: 80485 - DNA, 20 bp, synthetic construct
  misc_feature 1..20: note = CRISPR gRNA sequence
  source 1..20: mol_type = other DNA
gggctgggagatgaggccct

SEQ ID NO: 80486 - DNA, 20 bp, synthetic construct
  misc_feature 1..20: note = CRISPR gRNA sequence
  source 1..20: mol_type = other DNA
ggagatgaggccctgcgggt

SEQ ID NO: 80487 - DNA, 20 bp, synthetic construct
  misc_feature 1..20: note = CRISPR gRNA sequence
  source 1..20: mol_type = other DNA
cgggttgcgggcaggaaagt

SEQ ID NO: 80488 - DNA, 20 bp, synthetic construct
  misc_feature 1..20: note = CRISPR gRNA sequence
  source 1..20: mol_type = other DNA
cgggcaggaaagtgagaaca

SEQ ID NO: 80489 - DNA, 20 bp, synthetic construct
  misc_feature 1..20: note = CRISPR gRNA sequence
  source 1..20: mol_type = other DNA
cctgaggggttccaggttag

SEQ ID NO: 80490 - DNA, 20 bp, synthetic construct
  misc_feature 1..20: note = CRISPR gRNA sequence
  source 1..20: mol_type = other DNA
ctgaggggttccaggttaga

SEQ ID NO: 80491 - DNA, 20 bp, synthetic construct
  misc_feature 1..20: note = CRISPR gRNA sequence
  source 1..20: mol_type = other DNA
aggggttccaggttagaccc

SEQ ID NO: 80492 - DNA, 20 bp, synthetic construct
  misc_feature 1..20: note = CRISPR gRNA sequence
  source 1..20: mol_type = other DNA
caggttagaccctttagaat

SEQ ID NO: 80493 - DNA, 20 bp, synthetic construct
  misc_feature 1..20: note = CRISPR gRNA sequence
  source 1..20: mol_type = other DNA
gaccctttagaattggtaac

SEQ ID NO: 80494 - DNA, 20 bp, synthetic construct
  misc_feature 1..20: note = CRISPR gRNA sequence
  source 1..20: mol_type = other DNA
tagaattggtaacgggacaa

SEQ ID NO: 80495 - DNA, 20 bp, synthetic construct
  misc_feature 1..20: note = CRISPR gRNA sequence
  source 1..20: mol_type = other DNA
agaattggtaacgggacaag

SEQ ID NO: 80496 - DNA, 20 bp, synthetic construct
  misc_feature 1..20: note = CRISPR gRNA sequence
  source 1..20: mol_type = other DNA
gaattggtaacgggacaagc

SEQ ID NO: 80497 - DNA, 20 bp, synthetic construct
  misc_feature 1..20: note = CRISPR gRNA sequence
  source 1..20: mol_type = other DNA
gtaacgggacaagctaaagc

SEQ ID NO: 80498 - DNA, 20 bp, synthetic construct
  misc_feature 1..20: note = CRISPR gRNA sequence
  source 1..20: mol_type = other DNA
aagccttgaaagtcactgca

SEQ ID NO: 80499 - DNA, 20 bp, synthetic construct
  misc_feature 1..20: note = CRISPR gRNA sequence
  source 1..20: mol_type = other DNA
gaaagtcactgcaggaggag

SEQ ID NO: 80500 - DNA, 20 bp, synthetic construct
  misc_feature 1..20: note = CRISPR gRNA sequence
  source 1..20: mol_type = other DNA
aaagtcactgcaggaggagg

SEQ ID NO: 80501 - DNA, 20 bp, synthetic construct
  misc_feature 1..20: note = CRISPR gRNA sequence
  source 1..20: mol_type = other DNA
caggaggaggtggggctggg

SEQ ID NO: 80502 - DNA, 20 bp, synthetic construct
  misc_feature 1..20: note = CRISPR gRNA sequence
  source 1..20: mol_type = other DNA
ggagacacagttaggggctt

SEQ ID NO: 80503 - DNA, 20 bp, synthetic construct
  misc_feature 1..20: note = CRISPR gRNA sequence
  source 1..20: mol_type = other DNA
ggggcttgacacacttgcaa

SEQ ID NO: 80504 - DNA, 20 bp, synthetic construct
  misc_feature 1..20: note = CRISPR gRNA sequence
  source 1..20: mol_type = other DNA
gacacacttgcaaatgggtc

SEQ ID NO: 80505 - DNA, 20 bp, synthetic construct
  misc_feature 1..20: note = CRISPR gRNA sequence
  source 1..20: mol_type = other DNA
acacacttgcaaatgggtca

SEQ ID NO: 80506 - DNA, 20 bp, synthetic construct
  misc_feature 1..20: note = CRISPR gRNA sequence
  source 1..20: mol_type = other DNA
gcaaatgggtcagggacaga

SEQ ID NO: 80507 - DNA, 20 bp, synthetic construct
  misc_feature 1..20: note = CRISPR gRNA sequence
  source 1..20: mol_type = other DNA
caaatgggtcagggacagac

SEQ ID NO: 80508 - DNA, 20 bp, synthetic construct
  misc_feature 1..20: note = CRISPR gRNA sequence
  source 1..20: mol_type = other DNA
tgagaaatggctgtgaccag

SEQ ID NO: 80509 - DNA, 20 bp, synthetic construct
  misc_feature 1..20: note = CRISPR gRNA sequence
  source 1..20: mol_type = other DNA
tgaccagccaccacagcctc

SEQ ID NO: 80510 - DNA, 20 bp, synthetic construct
  misc_feature 1..20: note = CRISPR gRNA sequence
  source 1..20: mol_type = other DNA
cacagcctcctccagcttgg

SEQ ID NO: 80511 - DNA, 20 bp, synthetic construct
  misc_feature 1..20: note = CRISPR gRNA sequence
  source 1..20: mol_type = other DNA
ctccagcttggaagtgggga

SEQ ID NO: 80512 - DNA, 20 bp, synthetic construct
  misc_feature 1..20: note = CRISPR gRNA sequence
  source 1..20: mol_type = other DNA
cagcttggaagtggggactt

SEQ ID NO: 80513 - DNA, 20 bp, synthetic construct
  misc_feature 1..20: note = CRISPR gRNA sequence
  source 1..20: mol_type = other DNA
ggaagtggggacttcacagt

SEQ ID NO: 80514 - DNA, 20 bp, synthetic construct
  misc_feature 1..20: note = CRISPR gRNA sequence
  source 1..20: mol_type = other DNA
gaagtggggacttcacagtg

SEQ ID NO: 80515 - DNA, 20 bp, synthetic construct
  misc_feature 1..20: note = CRISPR gRNA sequence
  source 1..20: mol_type = other DNA
cacagtgctcaccaccccct

SEQ ID NO: 80516 - DNA, 20 bp, synthetic construct
  misc_feature 1..20: note = CRISPR gRNA sequence
  source 1..20: mol_type = other DNA
acagtgctcaccaccccctt

SEQ ID NO: 80517 - DNA, 20 bp, synthetic construct
  misc_feature 1..20: note = CRISPR gRNA sequence
  source 1..20: mol_type = other DNA
accacccccttcccaccccc

SEQ ID NO: 80518 - DNA, 20 bp, synthetic construct
  misc_feature 1..20: note = CRISPR gRNA sequence
  source 1..20: mol_type = other DNA
cccaccccccaactccagtc

SEQ ID NO: 80519 - DNA, 20 bp, synthetic construct
  misc_feature 1..20: note = CRISPR gRNA sequence
  source 1..20: mol_type = other DNA
ccaccccccaactccagtcc

SEQ ID NO: 80520 - DNA, 20 bp, synthetic construct
  misc_feature 1..20: note = CRISPR gRNA sequence
  source 1..20: mol_type = other DNA
cagtcctcaccatggtggag

SEQ ID NO: 80521 - DNA, 20 bp, synthetic construct
  misc_feature 1..20: note = CRISPR gRNA sequence
  source 1..20: mol_type = other DNA
accatggtggagctgagatt

SEQ ID NO: 80522 - DNA, 20 bp, synthetic construct
  misc_feature 1..20: note = CRISPR gRNA sequence
  source 1..20: mol_type = other DNA
agattcaggttggcttttcc

SEQ ID NO: 80523 - DNA, 20 bp, synthetic construct
  misc_feature 1..20: note = CRISPR gRNA sequence
  source 1..20: mol_type = other DNA
aggttggcttttcccctcag

SEQ ID NO: 80524 - DNA, 20 bp, synthetic construct
  misc_feature 1..20: note = CRISPR gRNA sequence
  source 1..20: mol_type = other DNA
gcttttcccctcagctccca

SEQ ID NO: 80525 - DNA, 20 bp, synthetic construct
  misc_feature 1..20: note = CRISPR gRNA sequence
  source 1..20: mol_type = other DNA
ttcccctcagctcccagctg

SEQ ID NO: 80526 - DNA, 20 bp, synthetic construct
  misc_feature 1..20: note = CRISPR gRNA sequence
  source 1..20: mol_type = other DNA
tcccctcagctcccagctgg

SEQ ID NO: 80527 - DNA, 20 bp, synthetic construct
  misc_feature 1..20: note = CRISPR gRNA sequence
  source 1..20: mol_type = other DNA
cccctcagctcccagctggc

SEQ ID NO: 80528 - DNA, 20 bp, synthetic construct
  misc_feature 1..20: note = CRISPR gRNA sequence
  source 1..20: mol_type = other DNA
ccctcagctcccagctggct

SEQ ID NO: 80529 - DNA, 20 bp, synthetic construct
  misc_feature 1..20: note = CRISPR gRNA sequence
  source 1..20: mol_type = other DNA
agctcccagctggctggtga

SEQ ID NO: 80530 - DNA, 20 bp, synthetic construct
  misc_feature 1..20: note = CRISPR gRNA sequence
  source 1..20: mol_type = other DNA
ccagctggctggtgaaccct

SEQ ID NO: 80531 - DNA, 20 bp, synthetic construct
  misc_feature 1..20: note = CRISPR gRNA sequence
  source 1..20: mol_type = other DNA
gctggtgaaccctgcaagag

SEQ ID NO: 80532 - DNA, 20 bp, synthetic construct
  misc_feature 1..20: note = CRISPR gRNA sequence
  source 1..20: mol_type = other DNA
gtgaaccctgcaagagaggg

SEQ ID NO: 80533 - DNA, 20 bp, synthetic construct
  misc_feature 1..20: note = CRISPR gRNA sequence
  source 1..20: mol_type = other DNA
caagagaggggagagtataa

SEQ ID NO: 80534 - DNA, 20 bp, synthetic construct
  misc_feature 1..20: note = CRISPR gRNA sequence
  source 1..20: mol_type = other DNA
tcgagggatgctggggacca

SEQ ID NO: 80535 - DNA, 20 bp, synthetic construct
  misc_feature 1..20: note = CRISPR gRNA sequence
  source 1..20: mol_type = other DNA
gggaccagctctggcctggc

SEQ ID NO: 80536 - DNA, 20 bp, synthetic construct
  misc_feature 1..20: note = CRISPR gRNA sequence
  source 1..20: mol_type = other DNA
tggcctggcgcctggctcag

SEQ ID NO: 80537 - DNA, 20 bp, synthetic construct
  misc_feature 1..20: note = CRISPR gRNA sequence
  source 1..20: mol_type = other DNA
gcctggcgcctggctcaggg

SEQ ID NO: 80538 - DNA, 20 bp, synthetic construct
  misc_feature 1..20: note = CRISPR gRNA sequence
  source 1..20: mol_type = other DNA
gcgcctggctcagggctcat

SEQ ID NO: 80539 - DNA, 20 bp, synthetic construct
  misc_feature 1..20: note = CRISPR gRNA sequence
  source 1..20: mol_type = other DNA
gctcagggctcatctcacag

SEQ ID NO: 80540 - DNA, 20 bp, synthetic construct
  misc_feature 1..20: note = CRISPR gRNA sequence
  source 1..20: mol_type = other DNA
agggctcatctcacagggag

SEQ ID NO: 80541 - DNA, 20 bp, synthetic construct
  misc_feature 1..20: note = CRISPR gRNA sequence
  source 1..20: mol_type = other DNA
atctcacagggagataccca

SEQ ID NO: 80542 - DNA, 20 bp, synthetic construct
  misc_feature 1..20: note = CRISPR gRNA sequence
  source 1..20: mol_type = other DNA
acagggagatacccagcaag

SEQ ID NO: 80543 - DNA, 20 bp, synthetic construct
  misc_feature 1..20: note = CRISPR gRNA sequence
  source 1..20: mol_type = other DNA
aatggaacactcagttatct

SEQ ID NO: 80544 - DNA, 20 bp, synthetic construct
  misc_feature 1..20: note = CRISPR gRNA sequence
  source 1..20: mol_type = other DNA
agttatctgttgtggagaaa

SEQ ID NO: 80545 - DNA, 20 bp, synthetic construct
  misc_feature 1..20: note = CRISPR gRNA sequence
  source 1..20: mol_type = other DNA
tctgttgtggagaaaatgtg

SEQ ID NO: 80546 - DNA, 20 bp, synthetic construct
  misc_feature 1..20: note = CRISPR gRNA sequence
  source 1..20: mol_type = other DNA
ttgtggagaaaatgtggtgg

SEQ ID NO: 80547 - DNA, 20 bp, synthetic construct
  misc_feature 1..20: note = CRISPR gRNA sequence
  source 1..20: mol_type = other DNA
tggagaaaatgtggtggtga

SEQ ID NO: 80548 - DNA, 20 bp, synthetic construct
  misc_feature 1..20: note = CRISPR gRNA sequence
  source 1..20: mol_type = other DNA
tgaaggcagtgctgggcaga

SEQ ID NO: 80549 - DNA, 20 bp, synthetic construct
  misc_feature 1..20: note = CRISPR gRNA sequence
  source 1..20: mol_type = other DNA
gaaggcagtgctgggcagaa

SEQ ID NO: 80550 - DNA, 20 bp, synthetic construct
  misc_feature 1..20: note = CRISPR gRNA sequence
  source 1..20: mol_type = other DNA
aaggcagtgctgggcagaaa

SEQ ID NO: 80551 - DNA, 20 bp, synthetic construct
  misc_feature 1..20: note = CRISPR gRNA sequence
  source 1..20: mol_type = other DNA
ggcagaaatgtgtgtatatg

SEQ ID NO: 80552 - DNA, 20 bp, synthetic construct
  misc_feature 1..20: note = CRISPR gRNA sequence
  source 1..20: mol_type = other DNA
atgtatgtgtgtgcacaggc

SEQ ID NO: 80553 - DNA, 20 bp, synthetic construct
  misc_feature 1..20: note = CRISPR gRNA sequence
  source 1..20: mol_type = other DNA
tgtatgtgtgtgcacaggca

SEQ ID NO: 80554 - DNA, 20 bp, synthetic construct
  misc_feature 1..20: note = CRISPR gRNA sequence
  source 1..20: mol_type = other DNA
tgcatgtgggcacacttgca

SEQ ID NO: 80555 - DNA, 20 bp, synthetic construct
  misc_feature 1..20: note = CRISPR gRNA sequence
  source 1..20: mol_type = other DNA
gcatgcatgtgtacatgggt

SEQ ID NO: 80556 - DNA, 20 bp, synthetic construct
  misc_feature 1..20: note = CRISPR gRNA sequence
  source 1..20: mol_type = other DNA
catgcatgtgtacatgggtt

SEQ ID NO: 80557 - DNA, 20 bp, synthetic construct
  misc_feature 1..20: note = CRISPR gRNA sequence
  source 1..20: mol_type = other DNA
acgcacatacccacatgtat

SEQ ID NO: 80558 - DNA, 20 bp, synthetic construct
  misc_feature 1..20: note = CRISPR gRNA sequence
  source 1..20: mol_type = other DNA
cgcacatacccacatgtata

SEQ ID NO: 80559 - DNA, 20 bp, synthetic construct
  misc_feature 1..20: note = CRISPR gRNA sequence
  source 1..20: mol_type = other DNA
tgtgtatctgcatatgtctg

SEQ ID NO: 80560 - DNA, 20 bp, synthetic construct
  misc_feature 1..20: note = CRISPR gRNA sequence
  source 1..20: mol_type = other DNA
catatgtctgcacatatgtg

SEQ ID NO: 80561 - DNA, 20 bp, synthetic construct
  misc_feature 1..20: note = CRISPR gRNA sequence
  source 1..20: mol_type = other DNA
cacatatgtgcatgcgccgc

SEQ ID NO: 80562 - DNA, 20 bp, synthetic construct
  misc_feature 1..20: note = CRISPR gRNA sequence
  source 1..20: mol_type = other DNA
ccacactctgccttgaagta

SEQ ID NO: 80563 - DNA, 20 bp, synthetic construct
  misc_feature 1..20: note = CRISPR gRNA sequence
  source 1..20: mol_type = other DNA
tgccttgaagtagggttctt

SEQ ID NO: 80564 - DNA, 20 bp, synthetic construct
  misc_feature 1..20: note = CRISPR gRNA sequence
  source 1..20: mol_type = other DNA
ccttgaagtagggttcttaa

SEQ ID NO: 80565 - DNA, 20 bp, synthetic construct
  misc_feature 1..20: note = CRISPR gRNA sequence
  source 1..20: mol_type = other DNA
gaagtagggttcttaagtga

SEQ ID NO: 80566 - DNA, 20 bp, synthetic construct
  misc_feature 1..20: note = CRISPR gRNA sequence
  source 1..20: mol_type = other DNA
aagtagggttcttaagtgag

SEQ ID NO: 80567 - DNA, 20 bp, synthetic construct
  misc_feature 1..20: note = CRISPR gRNA sequence
  source 1..20: mol_type = other DNA
ttaagtgagttcccattttc

SEQ ID NO: 80568 - DNA, 20 bp, synthetic construct
  misc_feature 1..20: note = CRISPR gRNA sequence
  source 1..20: mol_type = other DNA
aagtgagttcccattttctc

SEQ ID NO: 80569 - DNA, 20 bp, synthetic construct
  misc_feature 1..20: note = CRISPR gRNA sequence
  source 1..20: mol_type = other DNA
agtgagttcccattttctct

SEQ ID NO: 80570 - DNA, 20 bp, synthetic construct
  misc_feature 1..20: note = CRISPR gRNA sequence
  source 1..20: mol_type = other DNA
ccattttctctccaaaaacg

SEQ ID NO: 80571 - DNA, 20 bp, synthetic construct
  misc_feature 1..20: note = CRISPR gRNA sequence
  source 1..20: mol_type = other DNA
tctctccaaaaacgctgttg

SEQ ID NO: 80572 - DNA, 20 bp, synthetic construct
  misc_feature 1..20: note = CRISPR gRNA sequence
  source 1..20: mol_type = other DNA
ctctccaaaaacgctgttgc

SEQ ID NO: 80573 - DNA, 20 bp, synthetic construct
  misc_feature 1..20: note = CRISPR gRNA sequence
  source 1..20: mol_type = other DNA
tctccaaaaacgctgttgcc

SEQ ID NO: 80574 - DNA, 20 bp, synthetic construct
  misc_feature 1..20: note = CRISPR gRNA sequence
  source 1..20: mol_type = other DNA
tccaaaaacgctgttgcccc

SEQ ID NO: 80575 - DNA, 20 bp, synthetic construct
  misc_feature 1..20: note = CRISPR gRNA sequence
  source 1..20: mol_type = other DNA
caaaaacgctgttgcccctc

SEQ ID NO: 80576 - DNA, 20 bp, synthetic construct
  misc_feature 1..20: note = CRISPR gRNA sequence
  source 1..20: mol_type = other DNA
ttgcccctcaatgtcctgtg

SEQ ID NO: 80577 - DNA, 20 bp, synthetic construct
  misc_feature 1..20: note = CRISPR gRNA sequence
  source 1..20: mol_type = other DNA
cccctcaatgtcctgtgttt

SEQ ID NO: 80578 - DNA, 20 bp, synthetic construct
  misc_feature 1..20: note = CRISPR gRNA sequence
  source 1..20: mol_type = other DNA
aatgtcctgtgtttcccctc

SEQ ID NO: 80579 - DNA, 20 bp, synthetic construct
  misc_feature 1..20: note = CRISPR gRNA sequence
  source 1..20: mol_type = other DNA
tgtttcccctcagtgctgtg

SEQ ID NO: 80580 - DNA, 20 bp, synthetic construct
  misc_feature 1..20: note = CRISPR gRNA sequence
  source 1..20: mol_type = other DNA
cccctcagtgctgtgcaaac

SEQ ID NO: 80581 - DNA, 20 bp, synthetic construct
  misc_feature 1..20: note = CRISPR gRNA sequence
  source 1..20: mol_type = other DNA
ccctcagtgctgtgcaaaca

SEQ ID NO: 80582 - DNA, 20 bp, synthetic construct
  misc_feature 1..20: note = CRISPR gRNA sequence
  source 1..20: mol_type = other DNA
agtgctgtgcaaacagaagg

SEQ ID NO: 80583 - DNA, 20 bp, synthetic construct
  misc_feature 1..20: note = CRISPR gRNA sequence
  source 1..20: mol_type = other DNA
tgcaaacagaaggtgcccaa

SEQ ID NO: 80584 - DNA, 20 bp, synthetic construct
  misc_feature 1..20: note = CRISPR gRNA sequence
  source 1..20: mol_type = other DNA
cccgtcactgtttctgacca

SEQ ID NO: 80585 - DNA, 20 bp, synthetic construct
  misc_feature 1..20: note = CRISPR gRNA sequence
  source 1..20: mol_type = other DNA
tttctgaccatgttgcaaaa

SEQ ID NO: 80586 - DNA, 20 bp, synthetic construct
  misc_feature 1..20: note = CRISPR gRNA sequence
  source 1..20: mol_type = other DNA
ctgaccatgttgcaaaacaa

SEQ ID NO: 80587 - DNA, 20 bp, synthetic construct
  misc_feature 1..20: note = CRISPR gRNA sequence
  source 1..20: mol_type = other DNA
tgaccatgttgcaaaacaaa

SEQ ID NO: 80588 - DNA, 20 bp, synthetic construct
  misc_feature 1..20: note = CRISPR gRNA sequence
  source 1..20: mol_type = other DNA
accatgttgcaaaacaaaca

SEQ ID NO: 80589 - DNA, 20 bp, synthetic construct
  misc_feature 1..20: note = CRISPR gRNA sequence
  source 1..20: mol_type = other DNA
caaaacaaacaaacaaacaa

SEQ ID NO: 80590 - DNA, 20 bp, synthetic construct
  misc_feature 1..20: note = CRISPR gRNA sequence
  source 1..20: mol_type = other DNA
tagccaggtgtgatggctca

SEQ ID NO: 80591 - DNA, 20 bp, synthetic construct
  misc_feature 1..20: note = CRISPR gRNA sequence
  source 1..20: mol_type = other DNA
gccaggtgtgatggctcaca

SEQ ID NO: 80592 - DNA, 20 bp, synthetic construct
  misc_feature 1..20: note = CRISPR gRNA sequence
  source 1..20: mol_type = other DNA
acatctataatcccagcact

SEQ ID NO: 80593 - DNA, 20 bp, synthetic construct
  misc_feature 1..20: note = CRISPR gRNA sequence
  source 1..20: mol_type = other DNA
taatcccagcactttgggag

SEQ ID NO: 80594 - DNA, 20 bp, synthetic construct
  misc_feature 1..20: note = CRISPR gRNA sequence
  source 1..20: mol_type = other DNA
tgggaggccaagggaggagg

SEQ ID NO: 80595 - DNA, 20 bp, synthetic construct
  misc_feature 1..20: note = CRISPR gRNA sequence
  source 1..20: mol_type = other DNA
gggaggccaagggaggagga

SEQ ID NO: 80596 - DNA, 20 bp, synthetic construct
  misc_feature 1..20: note = CRISPR gRNA sequence
  source 1..20: mol_type = other DNA
ggaggccaagggaggaggat

SEQ ID NO: 80597 - DNA, 20 bp, synthetic construct
  misc_feature 1..20: note = CRISPR gRNA sequence
  source 1..20: mol_type = other DNA
aaggccaggagttcaagacc

SEQ ID NO: 80598 - DNA, 20 bp, synthetic construct
  misc_feature 1..20: note = CRISPR gRNA sequence
  source 1..20: mol_type = other DNA
aggccaggagttcaagacca

SEQ ID NO: 80599 - DNA, 20 bp, synthetic construct
  misc_feature 1..20: note = CRISPR gRNA sequence
  source 1..20: mol_type = other DNA
aagaccagcctgggcaacac

SEQ ID NO: 80600 - DNA, 20 bp, synthetic construct
  misc_feature 1..20: note = CRISPR gRNA sequence
  source 1..20: mol_type = other DNA
ggcaacacagtgatgtcctg

SEQ ID NO: 80601 - DNA, 20 bp, synthetic construct
  misc_feature 1..20: note = CRISPR gRNA sequence
  source 1..20: mol_type = other DNA
tctctacaaaagaatgaaaa

SEQ ID NO: 80602 - DNA, 20 bp, synthetic construct
  misc_feature 1..20: note = CRISPR gRNA sequence
  source 1..20: mol_type = other DNA
tacaaaagaatgaaaaatta

SEQ ID NO: 80603 - DNA, 20 bp, synthetic construct
  misc_feature 1..20: note = CRISPR gRNA sequence
  source 1..20: mol_type = other DNA
caaaagaatgaaaaattagc

SEQ ID NO: 80604 - DNA, 20 bp, synthetic construct
  misc_feature 1..20: note = CRISPR gRNA sequence
  source 1..20: mol_type = other DNA
gcctaatgtggtggcatgca

SEQ ID NO: 80605 - DNA, 20 bp, synthetic construct
  misc_feature 1..20: note = CRISPR gRNA sequence
  source 1..20: mol_type = other DNA
atgtggtggcatgcacctat

SEQ ID NO: 80606 - DNA, 20 bp, synthetic construct
  misc_feature 1..20: note = CRISPR gRNA sequence
  source 1..20: mol_type = other DNA
tagttctactgtagtctcag

SEQ ID NO: 80607 - DNA, 20 bp, synthetic construct
  misc_feature 1..20: note = CRISPR gRNA sequence
  source 1..20: mol_type = other DNA
tactgtagtctcagctactt

SEQ ID NO: 80608 - DNA, 20 bp, synthetic construct
  misc_feature 1..20: note = CRISPR gRNA sequence
  source 1..20: mol_type = other DNA
ctgtagtctcagctacttgg

SEQ ID NO: 80609 - DNA, 20 bp, synthetic construct
  misc_feature 1..20: note = CRISPR gRNA sequence
  source 1..20: mol_type = other DNA
tagtctcagctacttgggag

SEQ ID NO: 80610 - DNA, 20 bp, synthetic construct
  misc_feature 1..20: note = CRISPR gRNA sequence
  source 1..20: mol_type = other DNA
agctacttgggaggctgaag

SEQ ID NO: 80611 - DNA, 20 bp, synthetic construct
  misc_feature 1..20: note = CRISPR gRNA sequence
  source 1..20: mol_type = other DNA
cttgggaggctgaagtggga

SEQ ID NO: 80612 - DNA, 20 bp, synthetic construct
  misc_feature 1..20: note = CRISPR gRNA sequence
  source 1..20: mol_type = other DNA
gggaggctgaagtgggaagg

SEQ ID NO: 80613 - DNA, 20 bp, synthetic construct
  misc_feature 1..20: note = CRISPR gRNA sequence
  source 1..20: mol_type = other DNA
ggaggctgaagtgggaagga

SEQ ID NO: 80614 - DNA, 20 bp, synthetic construct
  misc_feature 1..20: note = CRISPR gRNA sequence
  source 1..20: mol_type = other DNA
aagtgggaaggatcacctga

SEQ ID NO: 80615 - DNA, 20 bp, synthetic construct
  misc_feature 1..20: note = CRISPR gRNA sequence
  source 1..20: mol_type = other DNA
agtcctggagttggatgctg

SEQ ID NO: 80616 - DNA, 20 bp, synthetic construct
  misc_feature 1..20: note = CRISPR gRNA sequence
  source 1..20: mol_type = other DNA
gagttggatgctgtagtgag

SEQ ID NO: 80617 - DNA, 20 bp, synthetic construct
  misc_feature 1..20: note = CRISPR gRNA sequence
  source 1..20: mol_type = other DNA
gatgctgtagtgagctatga

SEQ ID NO: 80618 - DNA, 20 bp, synthetic construct
  misc_feature 1..20: note = CRISPR gRNA sequence
  source 1..20: mol_type = other DNA
tagtgagctatgattgtgcc

SEQ ID NO: 80619 - DNA, 20 bp, synthetic construct
  misc_feature 1..20: note = CRISPR gRNA sequence
  source 1..20: mol_type = other DNA
tgattgtgccactgcactcc

SEQ ID NO: 80620 - DNA, 20 bp, synthetic construct
  misc_feature 1..20: note = CRISPR gRNA sequence
  source 1..20: mol_type = other DNA
tgccactgcactccagccta

SEQ ID NO: 80621 - DNA, 20 bp, synthetic construct
  misc_feature 1..20: note = CRISPR gRNA sequence
  source 1..20: mol_type = other DNA
cactccagcctaggcaacag

SEQ ID NO: 80622 - DNA, 20 bp, synthetic construct
  misc_feature 1..20: note = CRISPR gRNA sequence
  source 1..20: mol_type = other DNA
cagcctaggcaacagagcaa

SEQ ID NO: 80623 - DNA, 20 bp, synthetic construct
  misc_feature 1..20: note = CRISPR gRNA sequence
  source 1..20: mol_type = other DNA
ggcaacagagcaagaccttg

SEQ ID NO: 80624 - DNA, 20 bp, synthetic construct
  misc_feature 1..20: note = CRISPR gRNA sequence
  source 1..20: mol_type = other DNA
gtctcaaaaataaaaaacaa

SEQ ID NO: 80625 - DNA, 20 bp, synthetic construct
  misc_feature 1..20: note = CRISPR gRNA sequence
  source 1..20: mol_type = other DNA
tctcaaaaataaaaaacaaa

SEQ ID NO: 80626 - DNA, 20 bp, synthetic construct
  misc_feature 1..20: note = CRISPR gRNA sequence
  source 1..20: mol_type = other DNA
aaaaataaaaaacaaacaaa

SEQ ID NO: 80627 - DNA, 20 bp, synthetic construct
  misc_feature 1..20: note = CRISPR gRNA sequence
  source 1..20: mol_type = other DNA
tcgggcattatgggctatgt

SEQ ID NO: 80628 - DNA, 20 bp, synthetic construct
  misc_feature 1..20: note = CRISPR gRNA sequence
  source 1..20: mol_type = other DNA
gggcattatgggctatgtgg

SEQ ID NO: 80629 - DNA, 20 bp, synthetic construct
  misc_feature 1..20: note = CRISPR gRNA sequence
  source 1..20: mol_type = other DNA
tgggctatgtgggattttgt

SEQ ID NO: 80630 - DNA, 20 bp, synthetic construct
  misc_feature 1..20: note = CRISPR gRNA sequence
  source 1..20: mol_type = other DNA
tgtgggattttgtggctgga

SEQ ID NO: 80631 - DNA, 20 bp, synthetic construct
  misc_feature 1..20: note = CRISPR gRNA sequence
  source 1..20: mol_type = other DNA
tgtggctggaagcagtcact

SEQ ID NO: 80632 - DNA, 20 bp, synthetic construct
  misc_feature 1..20: note = CRISPR gRNA sequence
  source 1..20: mol_type = other DNA
gtggctggaagcagtcactc

SEQ ID NO: 80633 - DNA, 20 bp, synthetic construct
  misc_feature 1..20: note = CRISPR gRNA sequence
  source 1..20: mol_type = other DNA
tggctggaagcagtcactca

SEQ ID NO: 80634 - DNA, 20 bp, synthetic construct
  misc_feature 1..20: note = CRISPR gRNA sequence
  source 1..20: mol_type = other DNA
gaagcagtcactcagcaatt

SEQ ID NO: 80635 - DNA, 20 bp, synthetic construct
  misc_feature 1..20: note = CRISPR gRNA sequence
  source 1..20: mol_type = other DNA
agcaattcgagcaattcgag

SEQ ID NO: 80636 - DNA, 20 bp, synthetic construct
  misc_feature 1..20: note = CRISPR gRNA sequence
  source 1..20: mol_type = other DNA
gagcaattcgagtgaagcca

SEQ ID NO: 80637 - DNA, 20 bp, synthetic construct
  misc_feature 1..20: note = CRISPR gRNA sequence
  source 1..20: mol_type = other DNA
gagtgaagccaggtagaagg

SEQ ID NO: 80638 - DNA, 20 bp, synthetic construct
  misc_feature 1..20: note = CRISPR gRNA sequence
  source 1..20: mol_type = other DNA
caggccccagcagatttggg

SEQ ID NO: 80639 - DNA, 20 bp, synthetic construct
  misc_feature 1..20: note = CRISPR gRNA sequence
  source 1..20: mol_type = other DNA
gggcgcattaggaaatttgt

SEQ ID NO: 80640 - DNA, 20 bp, synthetic construct
  misc_feature 1..20: note = CRISPR gRNA sequence
  source 1..20: mol_type = other DNA
ggcgcattaggaaatttgtt

SEQ ID NO: 80641 - DNA, 20 bp, synthetic construct
  misc_feature 1..20: note = CRISPR gRNA sequence
  source 1..20: mol_type = other DNA
ggaaatttgttctgggaagt

SEQ ID NO: 80642 - DNA, 20 bp, synthetic construct
  misc_feature 1..20: note = CRISPR gRNA sequence
  source 1..20: mol_type = other DNA
gttctgggaagtgtccagaa

SEQ ID NO: 80643 - DNA, 20 bp, synthetic construct
  misc_feature 1..20: note = CRISPR gRNA sequence
  source 1..20: mol_type = other DNA
ttctgggaagtgtccagaaa

SEQ ID NO: 80644 - DNA, 20 bp, synthetic construct
  misc_feature 1..20: note = CRISPR gRNA sequence
  source 1..20: mol_type = other DNA
tgggaagtgtccagaaatat

SEQ ID NO: 80645 - DNA, 20 bp, synthetic construct
  misc_feature 1..20: note = CRISPR gRNA sequence
  source 1..20: mol_type = other DNA
ggaagtgtccagaaatatag

SEQ ID NO: 80646 - DNA, 20 bp, synthetic construct
  misc_feature 1..20: note = CRISPR gRNA sequence
  source 1..20: mol_type = other DNA
agatcgtggctgggctacac

SEQ ID NO: 80647 - DNA, 20 bp, synthetic construct
  misc_feature 1..20: note = CRISPR gRNA sequence
  source 1..20: mol_type = other DNA
ggctacaccctctctctgac

SEQ ID NO: 80648 - DNA, 20 bp, synthetic construct
  misc_feature 1..20: note = CRISPR gRNA sequence
  source 1..20: mol_type = other DNA
caccctctctctgacttagg

SEQ ID NO: 80649 - DNA, 20 bp, synthetic construct
  misc_feature 1..20: note = CRISPR gRNA sequence
  source 1..20: mol_type = other DNA
tctctgacttaggtgggtcc

SEQ ID NO: 80650 - DNA, 20 bp, synthetic construct
  misc_feature 1..20: note = CRISPR gRNA sequence
  source 1..20: mol_type = other DNA
tctgacttaggtgggtccct

SEQ ID NO: 80651 - DNA, 20 bp, synthetic construct
  misc_feature 1..20: note = CRISPR gRNA sequence
  source 1..20: mol_type = other DNA
tgacttaggtgggtccctgg

SEQ ID NO: 80652 - DNA, 20 bp, synthetic construct
  misc_feature 1..20: note = CRISPR gRNA sequence
  source 1..20: mol_type = other DNA
acttaggtgggtccctgggc

SEQ ID NO: 80653 - DNA, 20 bp, synthetic construct
  misc_feature 1..20: note = CRISPR gRNA sequence
  source 1..20: mol_type = other DNA
aggtgggtccctgggctcct

SEQ ID NO: 80654 - DNA, 20 bp, synthetic construct
  misc_feature 1..20: note = CRISPR gRNA sequence
  source 1..20: mol_type = other DNA
ggtgggtccctgggctcctc

SEQ ID NO: 80655 - DNA, 20 bp, synthetic construct
  misc_feature 1..20: note = CRISPR gRNA sequence
  source 1..20: mol_type = other DNA
ggctcctcccggctccccat

SEQ ID NO: 80656 - DNA, 20 bp, synthetic construct
  misc_feature 1..20: note = CRISPR gRNA sequence
  source 1..20: mol_type = other DNA
ctcccggctccccatgacgc

SEQ ID NO: 80657 - DNA, 20 bp, synthetic construct
  misc_feature 1..20: note = CRISPR gRNA sequence
  source 1..20: mol_type = other DNA
ccggctccccatgacgcagg

SEQ ID NO: 80658 - DNA, 20 bp, synthetic construct
  misc_feature 1..20: note = CRISPR gRNA sequence
  source 1..20: mol_type = other DNA
cccatgacgcaggtactggc

SEQ ID NO: 80659 - DNA, 20 bp, synthetic construct
  misc_feature 1..20: note = CRISPR gRNA sequence
  source 1..20: mol_type = other DNA
gcccggctgctttgcgtctc

SEQ ID NO: 80660 - DNA, 20 bp, synthetic construct
  misc_feature 1..20: note = CRISPR gRNA sequence
  source 1..20: mol_type = other DNA
ctttgcgtctctcacacctg

SEQ ID NO: 80661 - DNA, 20 bp, synthetic construct
  misc_feature 1..20: note = CRISPR gRNA sequence
  source 1..20: mol_type = other DNA
tgcgtctctcacacctgccc

SEQ ID NO: 80662 - DNA, 20 bp, synthetic construct
  misc_feature 1..20: note = CRISPR gRNA sequence
  source 1..20: mol_type = other DNA
gcgtctctcacacctgccct

SEQ ID NO: 80663 - DNA, 20 bp, synthetic construct
  misc_feature 1..20: note = CRISPR gRNA sequence
  source 1..20: mol_type = other DNA
cgtctctcacacctgccctt

SEQ ID NO: 80664 - DNA, 20 bp, synthetic construct
  misc_feature 1..20: note = CRISPR gRNA sequence
  source 1..20: mol_type = other DNA
tcacacctgcccttaccatc

SEQ ID NO: 80665 - DNA, 20 bp, synthetic construct
  misc_feature 1..20: note = CRISPR gRNA sequence
  source 1..20: mol_type = other DNA
acacctgcccttaccatcat

SEQ ID NO: 80666 - DNA, 20 bp, synthetic construct
  misc_feature 1..20: note = CRISPR gRNA sequence
  source 1..20: mol_type = other DNA
cccttaccatcatcatagcc

SEQ ID NO: 80667 - DNA, 20 bp, synthetic construct
  misc_feature 1..20: note = CRISPR gRNA sequence
  source 1..20: mol_type = other DNA
accatcatcatagccaaaag

SEQ ID NO: 80668 - DNA, 20 bp, synthetic construct
  misc_feature 1..20: note = CRISPR gRNA sequence
  source 1..20: mol_type = other DNA
ccatcatcatagccaaaagt

SEQ ID NO: 80669 - DNA, 20 bp, synthetic construct
  misc_feature 1..20: note = CRISPR gRNA sequence
  source 1..20: mol_type = other DNA
agcagcagcacctccaggtc

SEQ ID NO: 80670 - DNA, 20 bp, synthetic construct
  misc_feature 1..20: note = CRISPR gRNA sequence
  source 1..20: mol_type = other DNA
caggtccagaggcacctcca

SEQ ID NO: 80671 - DNA, 20 bp, synthetic construct
  misc_feature 1..20: note = CRISPR gRNA sequence
  source 1..20: mol_type = other DNA
cagctgcatgcacacacaat

SEQ ID NO: 80672 - DNA, 20 bp, synthetic construct
  misc_feature 1..20: note = CRISPR gRNA sequence
  source 1..20: mol_type = other DNA
catgcacacacaatgaatga

SEQ ID NO: 80673 - DNA, 20 bp, synthetic construct
  misc_feature 1..20: note = CRISPR gRNA sequence
  source 1..20: mol_type = other DNA
ccaggtgtccgaaccctgga

SEQ ID NO: 80674 - DNA, 20 bp, synthetic construct
  misc_feature 1..20: note = CRISPR gRNA sequence
  source 1..20: mol_type = other DNA
gacatgcagcttgttgagtt

SEQ ID NO: 80675 - DNA, 20 bp, synthetic construct
  misc_feature 1..20: note = CRISPR gRNA sequence
  source 1..20: mol_type = other DNA
gttgagttgcaggatgactc

SEQ ID NO: 80676 - DNA, 20 bp, synthetic construct
  misc_feature 1..20: note = CRISPR gRNA sequence
  source 1..20: mol_type = other DNA
ttgagttgcaggatgactct

SEQ ID NO: 80677 - DNA, 20 bp, synthetic construct
  misc_feature 1..20: note = CRISPR gRNA sequence
  source 1..20: mol_type = other DNA
agttgcaggatgactctctg

SEQ ID NO: 80678 - DNA, 20 bp, synthetic construct
  misc_feature 1..20: note = CRISPR gRNA sequence
  source 1..20: mol_type = other DNA
caggatgactctctgttcag

SEQ ID NO: 80679 - DNA, 20 bp, synthetic construct
  misc_feature 1..20: note = CRISPR gRNA sequence
  source 1..20: mol_type = other DNA
tctgttcagggtccaaggtc

SEQ ID NO: 80680 - DNA, 20 bp, synthetic construct
  misc_feature 1..20: note = CRISPR gRNA sequence
  source 1..20: mol_type = other DNA
tgttcagggtccaaggtctc

SEQ ID NO: 80681 - DNA, 20 bp, synthetic construct
  misc_feature 1..20: note = CRISPR gRNA sequence
  source 1..20: mol_type = other DNA
ttcagggtccaaggtctcgt

SEQ ID NO: 80682 - DNA, 20 bp, synthetic construct
  misc_feature 1..20: note = CRISPR gRNA sequence
  source 1..20: mol_type = other DNA
agggtccaaggtctcgttcc

SEQ ID NO: 80683 - DNA, 20 bp, synthetic construct
  misc_feature 1..20: note = CRISPR gRNA sequence
  source 1..20: mol_type = other DNA
gttcctggaatccaggtccg

SEQ ID NO: 80684 - DNA, 20 bp, synthetic construct
  misc_feature 1..20: note = CRISPR gRNA sequence
  source 1..20: mol_type = other DNA
ctggaatccaggtccgtgtt

SEQ ID NO: 80685 - DNA, 20 bp, synthetic construct
  misc_feature 1..20: note = CRISPR gRNA sequence
  source 1..20: mol_type = other DNA
gaatccaggtccgtgttggg

SEQ ID NO: 80686 - DNA, 20 bp, synthetic construct
  misc_feature 1..20: note = CRISPR gRNA sequence
  source 1..20: mol_type = other DNA
gggaggaagaacttcatctt

SEQ ID NO: 80687 - DNA, 20 bp, synthetic construct
  misc_feature 1..20: note = CRISPR gRNA sequence
  source 1..20: mol_type = other DNA
catcttggcgttcagccatt

SEQ ID NO: 80688 - DNA, 20 bp, synthetic construct
  misc_feature 1..20: note = CRISPR gRNA sequence
  source 1..20: mol_type = other DNA
atcttggcgttcagccattc

SEQ ID NO: 80689 - DNA, 20 bp, synthetic construct
  misc_feature 1..20: note = CRISPR gRNA sequence
  source 1..20: mol_type = other DNA
ggcgttcagccattctgggt

SEQ ID NO: 80690 - DNA, 20 bp, synthetic construct
  misc_feature 1..20: note = CRISPR gRNA sequence
  source 1..20: mol_type = other DNA
gcgttcagccattctgggtc

SEQ ID NO: 80691 - DNA, 20 bp, synthetic construct
  misc_feature 1..20: note = CRISPR gRNA sequence
  source 1..20: mol_type = other DNA
agccattctgggtctttggt

SEQ ID NO: 80692 - DNA, 20 bp, synthetic construct
  misc_feature 1..20: note = CRISPR gRNA sequence
  source 1..20: mol_type = other DNA
tgggtctttggtgagcagcc

SEQ ID NO: 80693 - DNA, 20 bp, synthetic construct
  misc_feature 1..20: note = CRISPR gRNA sequence
  source 1..20: mol_type = other DNA
ggtctttggtgagcagcctc

SEQ ID NO: 80694 - DNA, 20 bp, synthetic construct
  misc_feature 1..20: note = CRISPR gRNA sequence
  source 1..20: mol_type = other DNA
tggtgagcagcctcacaaga

SEQ ID NO: 80695 - DNA, 20 bp, synthetic construct
  misc_feature 1..20: note = CRISPR gRNA sequence
  source 1..20: mol_type = other DNA
ggtgagcagcctcacaagac

SEQ ID NO: 80696 - DNA, 20 bp, synthetic construct
  misc_feature 1..20: note = CRISPR gRNA sequence
  source 1..20: mol_type = other DNA
gtgagcagcctcacaagaca

SEQ ID NO: 80697 - DNA, 20 bp, synthetic construct
  misc_feature 1..20: note = CRISPR gRNA sequence
  source 1..20: mol_type = other DNA
acaagacagctccacaggtt

SEQ ID NO: 80698 - DNA, 20 bp, synthetic construct
  misc_feature 1..20: note = CRISPR gRNA sequence
  source 1..20: mol_type = other DNA
cacaggttcttgttgccgag

SEQ ID NO: 80699 - DNA, 20 bp, synthetic construct
  misc_feature 1..20: note = CRISPR gRNA sequence
  source 1..20: mol_type = other DNA
ttgttgccgagctggaggcc

SEQ ID NO: 80700 - DNA, 20 bp, synthetic construct
  misc_feature 1..20: note = CRISPR gRNA sequence
  source 1..20: mol_type = other DNA
gttgccgagctggaggccaa

SEQ ID NO: 80701 - DNA, 20 bp, synthetic construct
  misc_feature 1..20: note = CRISPR gRNA sequence
  source 1..20: mol_type = other DNA
ttgccgagctggaggccaac

SEQ ID NO: 80702 - DNA, 20 bp, synthetic construct
  misc_feature 1..20: note = CRISPR gRNA sequence
  source 1..20: mol_type = other DNA
ccgagctggaggccaacggg

SEQ ID NO: 80703 - DNA, 20 bp, synthetic construct
  misc_feature 1..20: note = CRISPR gRNA sequence
  source 1..20: mol_type = other DNA
gaggccaacggggtccatga

SEQ ID NO: 80704 - DNA, 20 bp, synthetic construct
  misc_feature 1..20: note = CRISPR gRNA sequence
  source 1..20: mol_type = other DNA
gagggacagggaagataggt

SEQ ID NO: 80705 - DNA, 20 bp, synthetic construct
  misc_feature 1..20: note = CRISPR gRNA sequence
  source 1..20: mol_type = other DNA
agggggacaggtaaactggg

SEQ ID NO: 80706 - DNA, 20 bp, synthetic construct
  misc_feature 1..20: note = CRISPR gRNA sequence
  source 1..20: mol_type = other DNA
ggggcagatgagctgaggga

SEQ ID NO: 80707 - DNA, 20 bp, synthetic construct
  misc_feature 1..20: note = CRISPR gRNA sequence
  source 1..20: mol_type = other DNA
agggacaggggaacttgggg

SEQ ID NO: 80708 - DNA, 20 bp, synthetic construct
  misc_feature 1..20: note = CRISPR gRNA sequence
  source 1..20: mol_type = other DNA
ggggggagttgagctggggg

SEQ ID NO: 80709 - DNA, 20 bp, synthetic construct
  misc_feature 1..20: note = CRISPR gRNA sequence
  source 1..20: mol_type = other DNA
gggggagttgagctggggga

SEQ ID NO: 80710 - DNA, 20 bp, synthetic construct
  misc_feature 1..20: note = CRISPR gRNA sequence
  source 1..20: mol_type = other DNA
agctgggggacaggcaaact

SEQ ID NO: 80711 - DNA, 20 bp, synthetic construct
  misc_feature 1..20: note = CRISPR gRNA sequence
  source 1..20: mol_type = other DNA
ggggacaggcaaactggggg

SEQ ID NO: 80712 - DNA, 20 bp, synthetic construct
  misc_feature 1..20: note = CRISPR gRNA sequence
  source 1..20: mol_type = other DNA
gggggaggtgagctggggga

SEQ ID NO: 80713 - DNA, 20 bp, synthetic construct
  misc_feature 1..20: note = CRISPR gRNA sequence
  source 1..20: mol_type = other DNA
ggggacaggtaaactggggg

SEQ ID NO: 80714 - DNA, 20 bp, synthetic construct
  misc_feature 1..20: note = CRISPR gRNA sequence
  source 1..20: mol_type = other DNA
ggggggaggtgagctagggg

SEQ ID NO: 80715 - DNA, 20 bp, synthetic construct
  misc_feature 1..20: note = CRISPR gRNA sequence
  source 1..20: mol_type = other DNA
ggggacaggtaaactggggg

SEQ ID NO: 80716 - DNA, 20 bp, synthetic construct
  misc_feature 1..20: note = CRISPR gRNA sequence
  source 1..20: mol_type = other DNA
ggggcagatgagctggggga

SEQ ID NO: 80717 - DNA, 20 bp, synthetic construct
  misc_feature 1..20: note = CRISPR gRNA sequence
  source 1..20: mol_type = other DNA
ggggacaggagagctgaggg

SEQ ID NO: 80718 - DNA, 20 bp, synthetic construct
  misc_feature 1..20: note = CRISPR gRNA sequence
  source 1..20: mol_type = other DNA
agggggaggtgagctggggg

SEQ ID NO: 80719 - DNA, 20 bp, synthetic construct
  misc_feature 1..20: note = CRISPR gRNA sequence
  source 1..20: mol_type = other DNA
ggggacaggggaactggggg

SEQ ID NO: 80720 - DNA, 20 bp, synthetic construct
  misc_feature 1..20: note = CRISPR gRNA sequence
  source 1..20: mol_type = other DNA
ggggacaggggagctggggc

SEQ ID NO: 80721 - DNA, 20 bp, synthetic construct
  misc_feature 1..20: note = CRISPR gRNA sequence
  source 1..20: mol_type = other DNA
gggcacaggtgagctagggg

SEQ ID NO: 80722 - DNA, 20 bp, synthetic construct
  misc_feature 1..20: note = CRISPR gRNA sequence
  source 1..20: mol_type = other DNA
ggggacaggggagctaggag

SEQ ID NO: 80723 - DNA, 20 bp, synthetic construct
  misc_feature 1..20: note = CRISPR gRNA sequence
  source 1..20: mol_type = other DNA
ggaggaagatgaactggggg

SEQ ID NO: 80724 - DNA, 20 bp, synthetic construct
  misc_feature 1..20: note = CRISPR gRNA sequence
  source 1..20: mol_type = other DNA
ggggacaggtgaactgaggg

SEQ ID NO: 80725 - DNA, 20 bp, synthetic construct
  misc_feature 1..20: note = CRISPR gRNA sequence
  source 1..20: mol_type = other DNA
agggcaggcaggtgagctgg

SEQ ID NO: 80726 - DNA, 20 bp, synthetic construct
  misc_feature 1..20: note = CRISPR gRNA sequence
  source 1..20: mol_type = other DNA
ggggacaggggaactggaag

SEQ ID NO: 80727 - DNA, 20 bp, synthetic construct
  misc_feature 1..20: note = CRISPR gRNA sequence
  source 1..20: mol_type = other DNA
gaaggaagatgagctgggga

SEQ ID NO: 80728 - DNA, 20 bp, synthetic construct
  misc_feature 1..20: note = CRISPR gRNA sequence
  source 1..20: mol_type = other DNA
gggaaccggtgagctggagg

SEQ ID NO: 80729 - DNA, 20 bp, synthetic construct
  misc_feature 1..20: note = CRISPR gRNA sequence
  source 1..20: mol_type = other DNA
gaggacaagcaaattggggg

SEQ ID NO: 80730 - DNA, 20 bp, synthetic construct
  misc_feature 1..20: note = CRISPR gRNA sequence
  source 1..20: mol_type = other DNA
ggggcaggtgatttggggga

SEQ ID NO: 80731 - DNA, 20 bp, synthetic construct
  misc_feature 1..20: note = CRISPR gRNA sequence
  source 1..20: mol_type = other DNA
gggggacaggggagctggga

SEQ ID NO: 80732 - DNA, 20 bp, synthetic construct
  misc_feature 1..20: note = CRISPR gRNA sequence
  source 1..20: mol_type = other DNA
ggggacaggggagctgggag

SEQ ID NO: 80733 - DNA, 20 bp, synthetic construct
  misc_feature 1..20: note = CRISPR gRNA sequence
  source 1..20: mol_type = other DNA
ggaggaagattagatggaga

SEQ ID NO: 80734 - DNA, 20 bp, synthetic construct
  misc_feature 1..20: note = CRISPR gRNA sequence
  source 1..20: mol_type = other DNA
gatggagaacaggtgagttg

SEQ ID NO: 80735 - DNA, 20 bp, synthetic construct
  misc_feature 1..20: note = CRISPR gRNA sequence
  source 1..20: mol_type = other DNA
tggggcaggtgacctgaggg

SEQ ID NO: 80736 - DNA, 20 bp, synthetic construct
  misc_feature 1..20: note = CRISPR gRNA sequence
  source 1..20: mol_type = other DNA
agggcaggtgagtggggtac

SEQ ID NO: 80737 - DNA, 20 bp, synthetic construct
  misc_feature 1..20: note = CRISPR gRNA sequence
  source 1..20: mol_type = other DNA
gggggaaggtgatctgggga

SEQ ID NO: 80738 - DNA, 20 bp, synthetic construct
  misc_feature 1..20: note = CRISPR gRNA sequence
  source 1..20: mol_type = other DNA
gggaaggtgagttgggggat

SEQ ID NO: 80739 - DNA, 20 bp, synthetic construct
  misc_feature 1..20: note = CRISPR gRNA sequence
  source 1..20: mol_type = other DNA
ggggataagggagtttctag

SEQ ID NO: 80740 - DNA, 20 bp, synthetic construct
  misc_feature 1..20: note = CRISPR gRNA sequence
  source 1..20: mol_type = other DNA
ctagggaagtcaagcagtca

SEQ ID NO: 80741 - DNA, 20 bp, synthetic construct
  misc_feature 1..20: note = CRISPR gRNA sequence
  source 1..20: mol_type = other DNA
tagggaagtcaagcagtcaa

SEQ ID NO: 80742 - DNA, 20 bp, synthetic construct
  misc_feature 1..20: note = CRISPR gRNA sequence
  source 1..20: mol_type = other DNA
gggaagtcaagcagtcaaga

SEQ ID NO: 80743 - DNA, 20 bp, synthetic construct
  misc_feature 1..20: note = CRISPR gRNA sequence
  source 1..20: mol_type = other DNA
catttgagcgacataaaata

SEQ ID NO: 80744 - DNA, 20 bp, synthetic construct
  misc_feature 1..20: note = CRISPR gRNA sequence
  source 1..20: mol_type = other DNA
gagcgacataaaataggcag

SEQ ID NO: 80745 - DNA, 20 bp, synthetic construct
  misc_feature 1..20: note = CRISPR gRNA sequence
  source 1..20: mol_type = other DNA
agcgacataaaataggcagg

SEQ ID NO: 80746 - DNA, 20 bp, synthetic construct
  misc_feature 1..20: note = CRISPR gRNA sequence
  source 1..20: mol_type = other DNA
tccatggagtcttgatgtct

SEQ ID NO: 80747 - DNA, 20 bp, synthetic construct
  misc_feature 1..20: note = CRISPR gRNA sequence
  source 1..20: mol_type = other DNA
catggagtcttgatgtctct

SEQ ID NO: 80748 - DNA, 20 bp, synthetic construct
  misc_feature 1..20: note = CRISPR gRNA sequence
  source 1..20: mol_type = other DNA
gatgtctctgcccagggatc

SEQ ID NO: 80749 - DNA, 20 bp, synthetic construct
  misc_feature 1..20: note = CRISPR gRNA sequence
  source 1..20: mol_type = other DNA
atgtctctgcccagggatca

SEQ ID NO: 80750 - DNA, 20 bp, synthetic construct
  misc_feature 1..20: note = CRISPR gRNA sequence
  source 1..20: mol_type = other DNA
tgcccagggatcagctccag

SEQ ID NO: 80751 - DNA, 20 bp, synthetic construct
  misc_feature 1..20: note = CRISPR gRNA sequence
  source 1..20: mol_type = other DNA
cccagggatcagctccagag

SEQ ID NO: 80752 - DNA, 20 bp, synthetic construct
  misc_feature 1..20: note = CRISPR gRNA sequence
  source 1..20: mol_type = other DNA
cagagatcagtctgtttctt

SEQ ID NO: 80753 - DNA, 20 bp, synthetic construct
  misc_feature 1..20: note = CRISPR gRNA sequence
  source 1..20: mol_type = other DNA
tttcttctgcaccccctccc

SEQ ID NO: 80754 - DNA, 20 bp, synthetic construct
  misc_feature 1..20: note = CRISPR gRNA sequence
  source 1..20: mol_type = other DNA
cttctgcaccccctccctac

SEQ ID NO: 80755 - DNA, 20 bp, synthetic construct
  misc_feature 1..20: note = CRISPR gRNA sequence
  source 1..20: mol_type = other DNA
ttctgcaccccctccctact

SEQ ID NO: 80756 - DNA, 20 bp, synthetic construct
  misc_feature 1..20: note = CRISPR gRNA sequence
  source 1..20: mol_type = other DNA
ctgcaccccctccctactcc

SEQ ID NO: 80757 - DNA, 20 bp, synthetic construct
  misc_feature 1..20: note = CRISPR gRNA sequence
  source 1..20: mol_type = other DNA
tgcaccccctccctactcca

SEQ ID NO: 80758 - DNA, 20 bp, synthetic construct
  misc_feature 1..20: note = CRISPR gRNA sequence
  source 1..20: mol_type = other DNA
caccccctccctactccatt

SEQ ID NO: 80759 - DNA, 20 bp, synthetic construct
  misc_feature 1..20: note = CRISPR gRNA sequence
  source 1..20: mol_type = other DNA
cctactccatttgtgcctgc

SEQ ID NO: 80760 - DNA, 20 bp, synthetic construct
  misc_feature 1..20: note = CRISPR gRNA sequence
  source 1..20: mol_type = other DNA
ctccatttgtgcctgcaccc

SEQ ID NO: 80761 - DNA, 20 bp, synthetic construct
  misc_feature 1..20: note = CRISPR gRNA sequence
  source 1..20: mol_type = other DNA
catttgtgcctgcaccctgg

SEQ ID NO: 80762 - DNA, 20 bp, synthetic construct
  misc_feature 1..20: note = CRISPR gRNA sequence
  source 1..20: mol_type = other DNA
gtgcctgcaccctggctctc

SEQ ID NO: 80763 - DNA, 20 bp, synthetic construct
  misc_feature 1..20: note = CRISPR gRNA sequence
  source 1..20: mol_type = other DNA
tgcctgcaccctggctctct

SEQ ID NO: 80764 - DNA, 20 bp, synthetic construct
  misc_feature 1..20: note = CRISPR gRNA sequence
  source 1..20: mol_type = other DNA
caccctggctctctggaatg

SEQ ID NO: 80765 - DNA, 20 bp, synthetic construct
  misc_feature 1..20: note = CRISPR gRNA sequence
  source 1..20: mol_type = other DNA
gctctctggaatggtcttgt

SEQ ID NO: 80766 - DNA, 20 bp, synthetic construct
  misc_feature 1..20: note = CRISPR gRNA sequence
  source 1..20: mol_type = other DNA
tctggaatggtcttgttcat

SEQ ID NO: 80767 - DNA, 20 bp, synthetic construct
  misc_feature 1..20: note = CRISPR gRNA sequence
  source 1..20: mol_type = other DNA
tggaatggtcttgttcatcc

SEQ ID NO: 80768 - DNA, 20 bp, synthetic construct
  misc_feature 1..20: note = CRISPR gRNA sequence
  source 1..20: mol_type = other DNA
gaatggtcttgttcatcccc

SEQ ID NO: 80769 - DNA, 20 bp, synthetic construct
  misc_feature 1..20: note = CRISPR gRNA sequence
  source 1..20: mol_type = other DNA
gttcatcccctgtggacagt

SEQ ID NO: 80770 - DNA, 20 bp, synthetic construct
  misc_feature 1..20: note = CRISPR gRNA sequence
  source 1..20: mol_type = other DNA
ttcatcccctgtggacagtc

SEQ ID NO: 80771 - DNA, 20 bp, synthetic construct
  misc_feature 1..20: note = CRISPR gRNA sequence
  source 1..20: mol_type = other DNA
atcccctgtggacagtcccg

SEQ ID NO: 80772 - DNA, 20 bp, synthetic construct
  misc_feature 1..20: note = CRISPR gRNA sequence
  source 1..20: mol_type = other DNA
tggacagtcccgtgaggatg

SEQ ID NO: 80773 - DNA, 20 bp, synthetic construct
  misc_feature 1..20: note = CRISPR gRNA sequence
  source 1..20: mol_type = other DNA
ctcattcttatttccatgaa

SEQ ID NO: 80774 - DNA, 20 bp, synthetic construct
  misc_feature 1..20: note = CRISPR gRNA sequence
  source 1..20: mol_type = other DNA
attcttatttccatgaacca

SEQ ID NO: 80775 - DNA, 20 bp, synthetic construct
  misc_feature 1..20: note = CRISPR gRNA sequence
  source 1..20: mol_type = other DNA
ttatttccatgaaccattta

SEQ ID NO: 80776 - DNA, 20 bp, synthetic construct
  misc_feature 1..20: note = CRISPR gRNA sequence
  source 1..20: mol_type = other DNA
atttccatgaaccatttatg

SEQ ID NO: 80777 - DNA, 20 bp, synthetic construct
  misc_feature 1..20: note = CRISPR gRNA sequence
  source 1..20: mol_type = other DNA
tttccatgaaccatttatgc

SEQ ID NO: 80778 - DNA, 20 bp, synthetic construct
  misc_feature 1..20: note = CRISPR gRNA sequence
  source 1..20: mol_type = other DNA
ccatgaaccatttatgctgc

SEQ ID NO: 80779 - DNA, 20 bp, synthetic construct
  misc_feature 1..20: note = CRISPR gRNA sequence
  source 1..20: mol_type = other DNA
catgaaccatttatgctgct

SEQ ID NO: 80780 - DNA, 20 bp, synthetic construct
  misc_feature 1..20: note = CRISPR gRNA sequence
  source 1..20: mol_type = other DNA
atgctgctctcagtctgagc

SEQ ID NO: 80781 - DNA, 20 bp, synthetic construct
  misc_feature 1..20: note = CRISPR gRNA sequence
  source 1..20: mol_type = other DNA
tgctgctctcagtctgagct

SEQ ID NO: 80782 - DNA, 20 bp, synthetic construct
  misc_feature 1..20: note = CRISPR gRNA sequence
  source 1..20: mol_type = other DNA
ctctcagtctgagctaacct

SEQ ID NO: 80783 - DNA, 20 bp, synthetic construct
  misc_feature 1..20: note = CRISPR gRNA sequence
  source 1..20: mol_type = other DNA
tcagtctgagctaacctcat

SEQ ID NO: 80784 - DNA, 20 bp, synthetic construct
  misc_feature 1..20: note = CRISPR gRNA sequence
  source 1..20: mol_type = other DNA
agtctgagctaacctcatgg

SEQ ID NO: 80785 - DNA, 20 bp, synthetic construct
  misc_feature 1..20: note = CRISPR gRNA sequence
  source 1..20: mol_type = other DNA
agctaacctcatggcagaga

SEQ ID NO: 80786 - DNA, 20 bp, synthetic construct
  misc_feature 1..20: note = CRISPR gRNA sequence
  source 1..20: mol_type = other DNA
acctcatggcagagacaact

SEQ ID NO: 80787 - DNA, 20 bp, synthetic construct
  misc_feature 1..20: note = CRISPR gRNA sequence
  source 1..20: mol_type = other DNA
atggcagagacaactagttg

SEQ ID NO: 80788 - DNA, 20 bp, synthetic construct
  misc_feature 1..20: note = CRISPR gRNA sequence
  source 1..20: mol_type = other DNA
gttgtctcccaaaatctgtt

SEQ ID NO: 80789 - DNA, 20 bp, synthetic construct
  misc_feature 1..20: note = CRISPR gRNA sequence
  source 1..20: mol_type = other DNA
tctcccaaaatctgttcttc

SEQ ID NO: 80790 - DNA, 20 bp, synthetic construct
  misc_feature 1..20: note = CRISPR gRNA sequence
  source 1..20: mol_type = other DNA
ccaaaatctgttcttccctt

SEQ ID NO: 80791 - DNA, 20 bp, synthetic construct
  misc_feature 1..20: note = CRISPR gRNA sequence
  source 1..20: mol_type = other DNA
ttcttcccttcttcctcagt

SEQ ID NO: 80792 - DNA, 20 bp, synthetic construct
  misc_feature 1..20: note = CRISPR gRNA sequence
  source 1..20: mol_type = other DNA
ttcccttcttcctcagtatt

SEQ ID NO: 80793 - DNA, 20 bp, synthetic construct
  misc_feature 1..20: note = CRISPR gRNA sequence
  source 1..20: mol_type = other DNA
cccttcttcctcagtattag

SEQ ID NO: 80794 - DNA, 20 bp, synthetic construct
  misc_feature 1..20: note = CRISPR gRNA sequence
  source 1..20: mol_type = other DNA
ccttcttcctcagtattaga

SEQ ID NO: 80795 - DNA, 20 bp, synthetic construct
  misc_feature 1..20: note = CRISPR gRNA sequence
  source 1..20: mol_type = other DNA
cttcctcagtattagaacta

SEQ ID NO: 80796 - DNA, 20 bp, synthetic construct
  misc_feature 1..20: note = CRISPR gRNA sequence
  source 1..20: mol_type = other DNA
ttcctcagtattagaactac

SEQ ID NO: 80797 - DNA, 20 bp, synthetic construct
  misc_feature 1..20: note = CRISPR gRNA sequence
  source 1..20: mol_type = other DNA
cctcagtattagaactacta

SEQ ID NO: 80798 - DNA, 20 bp, synthetic construct
  misc_feature 1..20: note = CRISPR gRNA sequence
  source 1..20: mol_type = other DNA
ctcagtattagaactactaa

SEQ ID NO: 80799 - DNA, 20 bp, synthetic construct
  misc_feature 1..20: note = CRISPR gRNA sequence
  source 1..20: mol_type = other DNA
agtattagaactactaaata

SEQ ID NO: 80800 - DNA, 20 bp, synthetic construct
  misc_feature 1..20: note = CRISPR gRNA sequence
  source 1..20: mol_type = other DNA
gaactactaaatattctctg

SEQ ID NO: 80801 - DNA, 20 bp, synthetic construct
  misc_feature 1..20: note = CRISPR gRNA sequence
  source 1..20: mol_type = other DNA
ctaaatattctctggtcatc

SEQ ID NO: 80802 - DNA, 20 bp, synthetic construct
  misc_feature 1..20: note = CRISPR gRNA sequence
  source 1..20: mol_type = other DNA
aatattctctggtcatctag

SEQ ID NO: 80803 - DNA, 20 bp, synthetic construct
  misc_feature 1..20: note = CRISPR gRNA sequence
  source 1..20: mol_type = other DNA
tctggtcatctagaatagat

SEQ ID NO: 80804 - DNA, 20 bp, synthetic construct
  misc_feature 1..20: note = CRISPR gRNA sequence
  source 1..20: mol_type = other DNA
tggtcatctagaatagatta

SEQ ID NO: 80805 - DNA, 20 bp, synthetic construct
  misc_feature 1..20: note = CRISPR gRNA sequence
  source 1..20: mol_type = other DNA
gtcatctagaatagattatt

SEQ ID NO: 80806 - DNA, 20 bp, synthetic construct
  misc_feature 1..20: note = CRISPR gRNA sequence
  source 1..20: mol_type = other DNA
gaatagattattatatccca

SEQ ID NO: 80807 - DNA, 20 bp, synthetic construct
  misc_feature 1..20: note = CRISPR gRNA sequence
  source 1..20: mol_type = other DNA
ttatatcccagtctcccttg

SEQ ID NO: 80808 - DNA, 20 bp, synthetic construct
  misc_feature 1..20: note = CRISPR gRNA sequence
  source 1..20: mol_type = other DNA
tatcccagtctcccttgcag

SEQ ID NO: 80809 - DNA, 20 bp, synthetic construct
  misc_feature 1..20: note = CRISPR gRNA sequence
  source 1..20: mol_type = other DNA
ccttgcagttatatgtagcc

SEQ ID NO: 80810 - DNA, 20 bp, synthetic construct
  misc_feature 1..20: note = CRISPR gRNA sequence
  source 1..20: mol_type = other DNA
gcagttatatgtagccatgt

SEQ ID NO: 80811 - DNA, 20 bp, synthetic construct
  misc_feature 1..20: note = CRISPR gRNA sequence
  source 1..20: mol_type = other DNA
cagttatatgtagccatgta

SEQ ID NO: 80812 - DNA, 20 bp, synthetic construct
  misc_feature 1..20: note = CRISPR gRNA sequence
  source 1..20: mol_type = other DNA
tatgtagccatgtaatttgg

SEQ ID NO: 80813 - DNA, 20 bp, synthetic construct
  misc_feature 1..20: note = CRISPR gRNA sequence
  source 1..20: mol_type = other DNA
ggccagtggaatgtaagtag

SEQ ID NO: 80814 - DNA, 20 bp, synthetic construct
  misc_feature 1..20: note = CRISPR gRNA sequence
  source 1..20: mol_type = other DNA
gccagtggaatgtaagtaga

SEQ ID NO: 80815 - DNA, 20 bp, synthetic construct
  misc_feature 1..20: note = CRISPR gRNA sequence
  source 1..20: mol_type = other DNA
tctattcttctttgctcctt

SEQ ID NO: 80816 - DNA, 20 bp, synthetic construct
  misc_feature 1..20: note = CRISPR gRNA sequence
  source 1..20: mol_type = other DNA
ttcttctttgctccttcctg

SEQ ID NO: 80817 - DNA, 20 bp, synthetic construct
  misc_feature 1..20: note = CRISPR gRNA sequence
  source 1..20: mol_type = other DNA
ttctttgctccttcctgttg

SEQ ID NO: 80818 - DNA, 20 bp, synthetic construct
  misc_feature 1..20: note = CRISPR gRNA sequence
  source 1..20: mol_type = other DNA
ctttgctccttcctgttgtc

SEQ ID NO: 80819 - DNA, 20 bp, synthetic construct
  misc_feature 1..20: note = CRISPR gRNA sequence
  source 1..20: mol_type = other DNA
tttgctccttcctgttgtct

SEQ ID NO: 80820 - DNA, 20 bp, synthetic construct
  misc_feature 1..20: note = CRISPR gRNA sequence
  source 1..20: mol_type = other DNA
tgctccttcctgttgtctgg

SEQ ID NO: 80821 - DNA, 20 bp, synthetic construct
  misc_feature 1..20: note = CRISPR gRNA sequence
  source 1..20: mol_type = other DNA
gctccttcctgttgtctgga

SEQ ID NO: 80822 - DNA, 20 bp, synthetic construct
  misc_feature 1..20: note = CRISPR gRNA sequence
  source 1..20: mol_type = other DNA
ctccttcctgttgtctggat

SEQ ID NO: 80823 - DNA, 20 bp, synthetic construct
  misc_feature 1..20: note = CRISPR gRNA sequence
  source 1..20: mol_type = other DNA
cttcctgttgtctggattgt

SEQ ID NO: 80824 - DNA, 20 bp, synthetic construct
  misc_feature 1..20: note = CRISPR gRNA sequence
  source 1..20: mol_type = other DNA
cctgttgtctggattgttga

SEQ ID NO: 80825 - DNA, 20 bp, synthetic construct
  misc_feature 1..20: note = CRISPR gRNA sequence
  source 1..20: mol_type = other DNA
ctgttgtctggattgttgat

SEQ ID NO: 80826 - DNA, 20 bp, synthetic construct
  misc_feature 1..20: note = CRISPR gRNA sequence
  source 1..20: mol_type = other DNA
ttgtctggattgttgatggg

SEQ ID NO: 80827 - DNA, 20 bp, synthetic construct
  misc_feature 1..20: note = CRISPR gRNA sequence
  source 1..20: mol_type = other DNA
tctggattgttgatgggatg

SEQ ID NO: 80828 - DNA, 20 bp, synthetic construct
  misc_feature 1..20: note = CRISPR gRNA sequence
  source 1..20: mol_type = other DNA
gattgttgatgggatggctg

SEQ ID NO: 80829 - DNA, 20 bp, synthetic construct
  misc_feature 1..20: note = CRISPR gRNA sequence
  source 1..20: mol_type = other DNA
ttgatgggatggctggatct

SEQ ID NO: 80830 - DNA, 20 bp, synthetic construct
  misc_feature 1..20: note = CRISPR gRNA sequence
  source 1..20: mol_type = other DNA
atgggatggctggatcttgg

SEQ ID NO: 80831 - DNA, 20 bp, synthetic construct
  misc_feature 1..20: note = CRISPR gRNA sequence
  source 1..20: mol_type = other DNA
gatcttgggcagccatattg

SEQ ID NO: 80832 - DNA, 20 bp, synthetic construct
  misc_feature 1..20: note = CRISPR gRNA sequence
  source 1..20: mol_type = other DNA
gggcagccatattgaatcat

SEQ ID NO: 80833 - DNA, 20 bp, synthetic construct
  misc_feature 1..20: note = CRISPR gRNA sequence
  source 1..20: mol_type = other DNA
ggcagccatattgaatcatg

SEQ ID NO: 80834 - DNA, 20 bp, synthetic construct
  misc_feature 1..20: note = CRISPR gRNA sequence
  source 1..20: mol_type = other DNA
aatcatgaggtggaacccat

SEQ ID NO: 80835 - DNA, 20 bp, synthetic construct
  misc_feature 1..20: note = CRISPR gRNA sequence
  source 1..20: mol_type = other DNA
aggaaggtggaaggtaaagc

SEQ ID NO: 80836 - DNA, 20 bp, synthetic construct
  misc_feature 1..20: note = CRISPR gRNA sequence
  source 1..20: mol_type = other DNA
cccatctgccctgtgctcac

SEQ ID NO: 80837 - DNA, 20 bp, synthetic construct
  misc_feature 1..20: note = CRISPR gRNA sequence
  source 1..20: mol_type = other DNA
ccctgtgctcactgactttg

SEQ ID NO: 80838 - DNA, 20 bp, synthetic construct
  misc_feature 1..20: note = CRISPR gRNA sequence
  source 1..20: mol_type = other DNA
tgctcactgactttggactt

SEQ ID NO: 80839 - DNA, 20 bp, synthetic construct
  misc_feature 1..20: note = CRISPR gRNA sequence
  source 1..20: mol_type = other DNA
actgactttggacttctgtt

SEQ ID NO: 80840 - DNA, 20 bp, synthetic construct
  misc_feature 1..20: note = CRISPR gRNA sequence
  source 1..20: mol_type = other DNA
actttggacttctgttacat

SEQ ID NO: 80841 - DNA, 20 bp, synthetic construct
  misc_feature 1..20: note = CRISPR gRNA sequence
  source 1..20: mol_type = other DNA
tggacttctgttacatggca

SEQ ID NO: 80842 - DNA, 20 bp, synthetic construct
  misc_feature 1..20: note = CRISPR gRNA sequence
  source 1..20: mol_type = other DNA
ggacttctgttacatggcag

SEQ ID NO: 80843 - DNA, 20 bp, synthetic construct
  misc_feature 1..20: note = CRISPR gRNA sequence
  source 1..20: mol_type = other DNA
gacttctgttacatggcagg

SEQ ID NO: 80844 - DNA, 20 bp, synthetic construct
  misc_feature 1..20: note = CRISPR gRNA sequence
  source 1..20: mol_type = other DNA
ctgttacatggcagggaaat

SEQ ID NO: 80845 - DNA, 20 bp, synthetic construct
  misc_feature 1..20: note = CRISPR gRNA sequence
  source 1..20: mol_type = other DNA
tgttacatggcagggaaata

SEQ ID NO: 80846 - DNA, 20 bp, synthetic construct
  misc_feature 1..20: note = CRISPR gRNA sequence
  source 1..20: mol_type = other DNA
ttacatggcagggaaataca

SEQ ID NO: 80847 - DNA, 20 bp, synthetic construct
  misc_feature 1..20: note = CRISPR gRNA sequence
  source 1..20: mol_type = other DNA
catggcagggaaatacactt

SEQ ID NO: 80848 - DNA, 20 bp, synthetic construct
  misc_feature 1..20: note = CRISPR gRNA sequence
  source 1..20: mol_type = other DNA
ccattctggttaagccactg

SEQ ID NO: 80849 - DNA, 20 bp, synthetic construct
  misc_feature 1..20: note = CRISPR gRNA sequence
  source 1..20: mol_type = other DNA
cattctggttaagccactgt

SEQ ID NO: 80850 - DNA, 20 bp, synthetic construct
  misc_feature 1..20: note = CRISPR gRNA sequence
  source 1..20: mol_type = other DNA
tggttaagccactgttgttt

SEQ ID NO: 80851 - DNA, 20 bp, synthetic construct
  misc_feature 1..20: note = CRISPR gRNA sequence
  source 1..20: mol_type = other DNA
gttaagccactgttgtttag

SEQ ID NO: 80852 - DNA, 20 bp, synthetic construct
  misc_feature 1..20: note = CRISPR gRNA sequence
  source 1..20: mol_type = other DNA
agccactgttgtttagtgct

SEQ ID NO: 80853 - DNA, 20 bp, synthetic construct
  misc_feature 1..20: note = CRISPR gRNA sequence
  source 1..20: mol_type = other DNA
ttgtttagtgctttctgcta

SEQ ID NO: 80854 - DNA, 20 bp, synthetic construct
  misc_feature 1..20: note = CRISPR gRNA sequence
  source 1..20: mol_type = other DNA
tttagtgctttctgctactc

SEQ ID NO: 80855 - DNA, 20 bp, synthetic construct
  misc_feature 1..20: note = CRISPR gRNA sequence
  source 1..20: mol_type = other DNA
agtgctttctgctactcaca

SEQ ID NO: 80856 - DNA, 20 bp, synthetic construct
  misc_feature 1..20: note = CRISPR gRNA sequence
  source 1..20: mol_type = other DNA
gtgctttctgctactcacag

SEQ ID NO: 80857 - DNA, 20 bp, synthetic construct
  misc_feature 1..20: note = CRISPR gRNA sequence
  source 1..20: mol_type = other DNA
tctgctactcacagtgaact

SEQ ID NO: 80858 - DNA, 20 bp, synthetic construct
  misc_feature 1..20: note = CRISPR gRNA sequence
  source 1..20: mol_type = other DNA
ctgctactcacagtgaactc

SEQ ID NO: 80859 - DNA, 20 bp, synthetic construct
  misc_feature 1..20: note = CRISPR gRNA sequence
  source 1..20: mol_type = other DNA
tgctactcacagtgaactct

SEQ ID NO: 80860 - DNA, 20 bp, synthetic construct
  misc_feature 1..20: note = CRISPR gRNA sequence
  source 1..20: mol_type = other DNA
ctactcacagtgaactctaa

SEQ ID NO: 80861 - DNA, 20 bp, synthetic construct
  misc_feature 1..20: note = CRISPR gRNA sequence
  source 1..20: mol_type = other DNA
ctcacagtgaactctaatcc

SEQ ID NO: 80862 - DNA, 20 bp, synthetic construct
  misc_feature 1..20: note = CRISPR gRNA sequence
  source 1..20: mol_type = other DNA
acagtgaactctaatcctag

SEQ ID NO: 80863 - DNA, 20 bp, synthetic construct
  misc_feature 1..20: note = CRISPR gRNA sequence
  source 1..20: mol_type = other DNA
taatcctagctaacacagac

SEQ ID NO: 80864 - DNA, 20 bp, synthetic construct
  misc_feature 1..20: note = CRISPR gRNA sequence
  source 1..20: mol_type = other DNA
atcctagctaacacagacca

SEQ ID NO: 80865 - DNA, 20 bp, synthetic construct
  misc_feature 1..20: note = CRISPR gRNA sequence
  source 1..20: mol_type = other DNA
gctaacacagaccatcacct

SEQ ID NO: 80866 - DNA, 20 bp, synthetic construct
  misc_feature 1..20: note = CRISPR gRNA sequence
  source 1..20: mol_type = other DNA
acacagaccatcacctcttt

SEQ ID NO: 80867 - DNA, 20 bp, synthetic construct
  misc_feature 1..20: note = CRISPR gRNA sequence
  source 1..20: mol_type = other DNA
ttttgctaagcaaattcttc

SEQ ID NO: 80868 - DNA, 20 bp, synthetic construct
  misc_feature 1..20: note = CRISPR gRNA sequence
  source 1..20: mol_type = other DNA
ttgctaagcaaattcttccc

SEQ ID NO: 80869 - DNA, 20 bp, synthetic construct
  misc_feature 1..20: note = CRISPR gRNA sequence
  source 1..20: mol_type = other DNA
tgctaagcaaattcttccct

SEQ ID NO: 80870 - DNA, 20 bp, synthetic construct
  misc_feature 1..20: note = CRISPR gRNA sequence
  source 1..20: mol_type = other DNA
gctaagcaaattcttccctt

SEQ ID NO: 80871 - DNA, 20 bp, synthetic construct
  misc_feature 1..20: note = CRISPR gRNA sequence
  source 1..20: mol_type = other DNA
ctaagcaaattcttcccttc

SEQ ID NO: 80872 - DNA, 20 bp, synthetic construct
  misc_feature 1..20: note = CRISPR gRNA sequence
  source 1..20: mol_type = other DNA
agcaaattcttcccttctga

SEQ ID NO: 80873 - DNA, 20 bp, synthetic construct
  misc_feature 1..20: note = CRISPR gRNA sequence
  source 1..20: mol_type = other DNA
ttcccttctgaactggaact

SEQ ID NO: 80874 - DNA, 20 bp, synthetic construct
  misc_feature 1..20: note = CRISPR gRNA sequence
  source 1..20: mol_type = other DNA
cccttctgaactggaactct

SEQ ID NO: 80875 - DNA, 20 bp, synthetic construct
  misc_feature 1..20: note = CRISPR gRNA sequence
  source 1..20: mol_type = other DNA
ccttctgaactggaactctt

SEQ ID NO: 80876 - DNA, 20 bp, synthetic construct
  misc_feature 1..20: note = CRISPR gRNA sequence
  source 1..20: mol_type = other DNA
ctgaactggaactctttttt

SEQ ID NO: 80877 - DNA, 20 bp, synthetic construct
  misc_feature 1..20: note = CRISPR gRNA sequence
  source 1..20: mol_type = other DNA
tgaactggaactcttttttt

SEQ ID NO: 80878 - DNA, 20 bp, synthetic construct
  misc_feature 1..20: note = CRISPR gRNA sequence
  source 1..20: mol_type = other DNA
aactggaactcttttttttt

SEQ ID NO: 80879 - DNA, 20 bp, synthetic construct
  misc_feature 1..20: note = CRISPR gRNA sequence
  source 1..20: mol_type = other DNA
gaactcttttttttttgaga

SEQ ID NO: 80880 - DNA, 20 bp, synthetic construct
  misc_feature 1..20: note = CRISPR gRNA sequence
  source 1..20: mol_type = other DNA
ttttttttttgagacagagt

SEQ ID NO: 80881 - DNA, 20 bp, synthetic construct
  misc_feature 1..20: note = CRISPR gRNA sequence
  source 1..20: mol_type = other DNA
ttttttttgagacagagtct

SEQ ID NO: 80882 - DNA, 20 bp, synthetic construct
  misc_feature 1..20: note = CRISPR gRNA sequence
  source 1..20: mol_type = other DNA
tttttttgagacagagtctc

SEQ ID NO: 80883 - DNA, 20 bp, synthetic construct
  misc_feature 1..20: note = CRISPR gRNA sequence
  source 1..20: mol_type = other DNA
ttttttgagacagagtctcg

SEQ ID NO: 80884 - DNA, 20 bp, synthetic construct
  misc_feature 1..20: note = CRISPR gRNA sequence
  source 1..20: mol_type = other DNA
tttttgagacagagtctcgc

SEQ ID NO: 80885 - DNA, 20 bp, synthetic construct
  misc_feature 1..20: note = CRISPR gRNA sequence
  source 1..20: mol_type = other DNA
ttttgagacagagtctcgct

SEQ ID NO: 80886 - DNA, 20 bp, synthetic construct
  misc_feature 1..20: note = CRISPR gRNA sequence
  source 1..20: mol_type = other DNA
tttgagacagagtctcgctc

SEQ ID NO: 80887 - DNA, 20 bp, synthetic construct
  misc_feature 1..20: note = CRISPR gRNA sequence
  source 1..20: mol_type = other DNA
ttgagacagagtctcgctct

SEQ ID NO: 80888 - DNA, 20 bp, synthetic construct
  misc_feature 1..20: note = CRISPR gRNA sequence
  source 1..20: mol_type = other DNA
tgagacagagtctcgctctg

SEQ ID NO: 80889 - DNA, 20 bp, synthetic construct
  misc_feature 1..20: note = CRISPR gRNA sequence
  source 1..20: mol_type = other DNA
gagacagagtctcgctctgt

SEQ ID NO: 80890 - DNA, 20 bp, synthetic construct
  misc_feature 1..20: note = CRISPR gRNA sequence
  source 1..20: mol_type = other DNA
agacagagtctcgctctgtc

SEQ ID NO: 80891 - DNA, 20 bp, synthetic construct
  misc_feature 1..20: note = CRISPR gRNA sequence
  source 1..20: mol_type = other DNA
gctctgtcacccaggctgga

SEQ ID NO: 80892 - DNA, 20 bp, synthetic construct
  misc_feature 1..20: note = CRISPR gRNA sequence
  source 1..20: mol_type = other DNA
tgtcacccaggctggagtgc

SEQ ID NO: 80893 - DNA, 20 bp, synthetic construct
  misc_feature 1..20: note = CRISPR gRNA sequence
  source 1..20: mol_type = other DNA
tcacccaggctggagtgcaa

SEQ ID NO: 80894 - DNA, 20 bp, synthetic construct
  misc_feature 1..20: note = CRISPR gRNA sequence
  source 1..20: mol_type = other DNA
gagtgcaatggtgcaatctc

SEQ ID NO: 80895 - DNA, 20 bp, synthetic construct
  misc_feature 1..20: note = CRISPR gRNA sequence
  source 1..20: mol_type = other DNA
ggctcactgcagcctccgcc

SEQ ID NO: 80896 - DNA, 20 bp, synthetic construct
  misc_feature 1..20: note = CRISPR gRNA sequence
  source 1..20: mol_type = other DNA
actgcagcctccgcctcccg

SEQ ID NO: 80897 - DNA, 20 bp, synthetic construct
  misc_feature 1..20: note = CRISPR gRNA sequence
  source 1..20: mol_type = other DNA
cagcctccgcctcccgggtt

SEQ ID NO: 80898 - DNA, 20 bp, synthetic construct
  misc_feature 1..20: note = CRISPR gRNA sequence
  source 1..20: mol_type = other DNA
cgcctcccgggttcaagcga

SEQ ID NO: 80899 - DNA, 20 bp, synthetic construct
  misc_feature 1..20: note = CRISPR gRNA sequence
  source 1..20: mol_type = other DNA
ccgggttcaagcgattcttc

SEQ ID NO: 80900 - DNA, 20 bp, synthetic construct
  misc_feature 1..20: note = CRISPR gRNA sequence
  source 1..20: mol_type = other DNA
aagcgattcttctgcctcag

SEQ ID NO: 80901 - DNA, 20 bp, synthetic construct
  misc_feature 1..20: note = CRISPR gRNA sequence
  source 1..20: mol_type = other DNA
ttctgcctcagcctcccgag

SEQ ID NO: 80902 - DNA, 20 bp, synthetic construct
  misc_feature 1..20: note = CRISPR gRNA sequence
  source 1..20: mol_type = other DNA
ctgcctcagcctcccgagta

SEQ ID NO: 80903 - DNA, 20 bp, synthetic construct
  misc_feature 1..20: note = CRISPR gRNA sequence
  source 1..20: mol_type = other DNA
tgcctcagcctcccgagtag

SEQ ID NO: 80904 - DNA, 20 bp, synthetic construct
  misc_feature 1..20: note = CRISPR gRNA sequence
  source 1..20: mol_type = other DNA
cctcagcctcccgagtagct

SEQ ID NO: 80905 - DNA, 20 bp, synthetic construct
  misc_feature 1..20: note = CRISPR gRNA sequence
  source 1..20: mol_type = other DNA
agcctcccgagtagctggga

SEQ ID NO: 80906 - DNA, 20 bp, synthetic construct
  misc_feature 1..20: note = CRISPR gRNA sequence
  source 1..20: mol_type = other DNA
ccgagtagctgggattacag

SEQ ID NO: 80907 - DNA, 20 bp, synthetic construct
  misc_feature 1..20: note = CRISPR gRNA sequence
  source 1..20: mol_type = other DNA
ggattacaggtgcacaccac

SEQ ID NO: 80908 - DNA, 20 bp, synthetic construct
  misc_feature 1..20: note = CRISPR gRNA sequence
  source 1..20: mol_type = other DNA
caggtgcacaccacaatgcc

SEQ ID NO: 80909 - DNA, 20 bp, synthetic construct
  misc_feature 1..20: note = CRISPR gRNA sequence
  source 1..20: mol_type = other DNA
atttttgtaatttttagtac

SEQ ID NO: 80910 - DNA, 20 bp, synthetic construct
  misc_feature 1..20: note = CRISPR gRNA sequence
  source 1..20: mol_type = other DNA
ttgtaatttttagtacagat

SEQ ID NO: 80911 - DNA, 20 bp, synthetic construct
  misc_feature 1..20: note = CRISPR gRNA sequence
  source 1..20: mol_type = other DNA
tgtaatttttagtacagatg

SEQ ID NO: 80912 - DNA, 20 bp, synthetic construct
  misc_feature 1..20: note = CRISPR gRNA sequence
  source 1..20: mol_type = other DNA
gtaatttttagtacagatgg

SEQ ID NO: 80913 - DNA, 20 bp, synthetic construct
  misc_feature 1..20: note = CRISPR gRNA sequence
  source 1..20: mol_type = other DNA
taatttttagtacagatggg

SEQ ID NO: 80914 - DNA, 20 bp, synthetic construct
  misc_feature 1..20: note = CRISPR gRNA sequence
  source 1..20: mol_type = other DNA
ttagtacagatggggtttca

SEQ ID NO: 80915 - DNA, 20 bp, synthetic construct
  misc_feature 1..20: note = CRISPR gRNA sequence
  source 1..20: mol_type = other DNA
tagtacagatggggtttcac

SEQ ID NO: 80916 - DNA, 20 bp, synthetic construct
  misc_feature 1..20: note = CRISPR gRNA sequence
  source 1..20: mol_type = other DNA
agtacagatggggtttcacc

SEQ ID NO: 80917 - DNA, 20 bp, synthetic construct
  misc_feature 1..20: note = CRISPR gRNA sequence
  source 1..20: mol_type = other DNA
gtacagatggggtttcacca

SEQ ID NO: 80918 - DNA, 20 bp, synthetic construct
  misc_feature 1..20: note = CRISPR gRNA sequence
  source 1..20: mol_type = other DNA
caccatgttggccaggctgg

SEQ ID NO: 80919 - DNA, 20 bp, synthetic construct
  misc_feature 1..20: note = CRISPR gRNA sequence
  source 1..20: mol_type = other DNA
accatgttggccaggctggg

SEQ ID NO: 80920 - DNA, 20 bp, synthetic construct
  misc_feature 1..20: note = CRISPR gRNA sequence
  source 1..20: mol_type = other DNA
gccaggctgggctcaaactc

SEQ ID NO: 80921 - DNA, 20 bp, synthetic construct
  misc_feature 1..20: note = CRISPR gRNA sequence
  source 1..20: mol_type = other DNA
ggctcaaactcctgacctca

SEQ ID NO: 80922 - DNA, 20 bp, synthetic construct
  misc_feature 1..20: note = CRISPR gRNA sequence
  source 1..20: mol_type = other DNA
aaactcctgacctcagggtg

SEQ ID NO: 80923 - DNA, 20 bp, synthetic construct
  misc_feature 1..20: note = CRISPR gRNA sequence
  source 1..20: mol_type = other DNA
ctgacctcagggtgatctgc

SEQ ID NO: 80924 - DNA, 20 bp, synthetic construct
  misc_feature 1..20: note = CRISPR gRNA sequence
  source 1..20: mol_type = other DNA
acctcagggtgatctgccca

SEQ ID NO: 80925 - DNA, 20 bp, synthetic construct
  misc_feature 1..20: note = CRISPR gRNA sequence
  source 1..20: mol_type = other DNA
agggtgatctgcccacctcg

SEQ ID NO: 80926 - DNA, 20 bp, synthetic construct
  misc_feature 1..20: note = CRISPR gRNA sequence
  source 1..20: mol_type = other DNA
cccacctcggcctcccaaag

SEQ ID NO: 80927 - DNA, 20 bp, synthetic construct
  misc_feature 1..20: note = CRISPR gRNA sequence
  source 1..20: mol_type = other DNA
ggcctcccaaagtgctggga

SEQ ID NO: 80928 - DNA, 20 bp, synthetic construct
  misc_feature 1..20: note = CRISPR gRNA sequence
  source 1..20: mol_type = other DNA
ccaaagtgctgggattacag

SEQ ID NO: 80929 - DNA, 20 bp, synthetic construct
  misc_feature 1..20: note = CRISPR gRNA sequence
  source 1..20: mol_type = other DNA
ggattacaggtgtgagccat

SEQ ID NO: 80930 - DNA, 20 bp, synthetic construct
  misc_feature 1..20: note = CRISPR gRNA sequence
  source 1..20: mol_type = other DNA
caggtgtgagccatcatgat

SEQ ID NO: 80931 - DNA, 20 bp, synthetic construct
  misc_feature 1..20: note = CRISPR gRNA sequence
  source 1..20: mol_type = other DNA
gaactcttaaaccacctcct

SEQ ID NO: 80932 - DNA, 20 bp, synthetic construct
  misc_feature 1..20: note = CRISPR gRNA sequence
  source 1..20: mol_type = other DNA
ttaaaccacctccttctaga

SEQ ID NO: 80933 - DNA, 20 bp, synthetic construct
  misc_feature 1..20: note = CRISPR gRNA sequence
  source 1..20: mol_type = other DNA
aaaccacctccttctagaag

SEQ ID NO: 80934 - DNA, 20 bp, synthetic construct
  misc_feature 1..20: note = CRISPR gRNA sequence
  source 1..20: mol_type = other DNA
aaccacctccttctagaagt

SEQ ID NO: 80935 - DNA, 20 bp, synthetic construct
  misc_feature 1..20: note = CRISPR gRNA sequence
  source 1..20: mol_type = other DNA
cttctagaagtaccaataga

SEQ ID NO: 80936 - DNA, 20 bp, synthetic construct
  misc_feature 1..20: note = CRISPR gRNA sequence
  source 1..20: mol_type = other DNA
ctagaagtaccaatagaggg

SEQ ID NO: 80937 - DNA, 20 bp, synthetic construct
  misc_feature 1..20: note = CRISPR gRNA sequence
  source 1..20: mol_type = other DNA
tagaagtaccaatagagggc

SEQ ID NO: 80938 - DNA, 20 bp, synthetic construct
  misc_feature 1..20: note = CRISPR gRNA sequence
  source 1..20: mol_type = other DNA
gaagtaccaatagagggcac

SEQ ID NO: 80939 - DNA, 20 bp, synthetic construct
  misc_feature 1..20: note = CRISPR gRNA sequence
  source 1..20: mol_type = other DNA
acacagcaaaagcctaaata

SEQ ID NO: 80940 - DNA, 20 bp, synthetic construct
  misc_feature 1..20: note = CRISPR gRNA sequence
  source 1..20: mol_type = other DNA
cacagcaaaagcctaaataa

SEQ ID NO: 80941 - DNA, 20 bp, synthetic construct
  misc_feature 1..20: note = CRISPR gRNA sequence
  source 1..20: mol_type = other DNA
aataatgtgcagttcctttg

SEQ ID NO: 80942 - DNA, 20 bp, synthetic construct
  misc_feature 1..20: note = CRISPR gRNA sequence
  source 1..20: mol_type = other DNA
ctttgattcagtaattccat

SEQ ID NO: 80943 - DNA, 20 bp, synthetic construct
  misc_feature 1..20: note = CRISPR gRNA sequence
  source 1..20: mol_type = other DNA
tgattcagtaattccatttc

SEQ ID NO: 80944 - DNA, 20 bp, synthetic construct
  misc_feature 1..20: note = CRISPR gRNA sequence
  source 1..20: mol_type = other DNA
gattcagtaattccatttct

SEQ ID NO: 80945 - DNA, 20 bp, synthetic construct
  misc_feature 1..20: note = CRISPR gRNA sequence
  source 1..20: mol_type = other DNA
attcagtaattccatttcta

SEQ ID NO: 80946 - DNA, 20 bp, synthetic construct
  misc_feature 1..20: note = CRISPR gRNA sequence
  source 1..20: mol_type = other DNA
agtaattccatttctaggac

SEQ ID NO: 80947 - DNA, 20 bp, synthetic construct
  misc_feature 1..20: note = CRISPR gRNA sequence
  source 1..20: mol_type = other DNA
catttctaggactctaacct

SEQ ID NO: 80948 - DNA, 20 bp, synthetic construct
  misc_feature 1..20: note = CRISPR gRNA sequence
  source 1..20: mol_type = other DNA
ctaggactctaaccttggca

SEQ ID NO: 80949 - DNA, 20 bp, synthetic construct
  misc_feature 1..20: note = CRISPR gRNA sequence
  source 1..20: mol_type = other DNA
taggactctaaccttggcaa

SEQ ID NO: 80950 - DNA, 20 bp, synthetic construct
  misc_feature 1..20: note = CRISPR gRNA sequence
  source 1..20: mol_type = other DNA
ggactctaaccttggcaaac

SEQ ID NO: 80951 - DNA, 20 bp, synthetic construct
  misc_feature 1..20: note = CRISPR gRNA sequence
  source 1..20: mol_type = other DNA
taaccttggcaaacgatcat

SEQ ID NO: 80952 - DNA, 20 bp, synthetic construct
  misc_feature 1..20: note = CRISPR gRNA sequence
  source 1..20: mol_type = other DNA
accttggcaaacgatcatga

SEQ ID NO: 80953 - DNA, 20 bp, synthetic construct
  misc_feature 1..20: note = CRISPR gRNA sequence
  source 1..20: mol_type = other DNA
ggcaaacgatcatgaacgta

SEQ ID NO: 80954 - DNA, 20 bp, synthetic construct
  misc_feature 1..20: note = CRISPR gRNA sequence
  source 1..20: mol_type = other DNA
gcaaacgatcatgaacgtat

SEQ ID NO: 80955 - DNA, 20 bp, synthetic construct
  misc_feature 1..20: note = CRISPR gRNA sequence
  source 1..20: mol_type = other DNA
aattgcaaagatgctcactg

SEQ ID NO: 80956 - DNA, 20 bp, synthetic construct
  misc_feature 1..20: note = CRISPR gRNA sequence
  source 1..20: mol_type = other DNA
attgcaaagatgctcactgc

SEQ ID NO: 80957 - DNA, 20 bp, synthetic construct
  misc_feature 1..20: note = CRISPR gRNA sequence
  source 1..20: mol_type = other DNA
caaagatgctcactgcaaga

SEQ ID NO: 80958 - DNA, 20 bp, synthetic construct
  misc_feature 1..20: note = CRISPR gRNA sequence
  source 1..20: mol_type = other DNA
actgcaagattatttataat

SEQ ID NO: 80959 - DNA, 20 bp, synthetic construct
  misc_feature 1..20: note = CRISPR gRNA sequence
  source 1..20: mol_type = other DNA
caagattatttataattatt

SEQ ID NO: 80960 - DNA, 20 bp, synthetic construct
  misc_feature 1..20: note = CRISPR gRNA sequence
  source 1..20: mol_type = other DNA
tttataattattaaaaattg

SEQ ID NO: 80961 - DNA, 20 bp, synthetic construct
  misc_feature 1..20: note = CRISPR gRNA sequence
  source 1..20: mol_type = other DNA
ataattattaaaaattggaa

SEQ ID NO: 80962 - DNA, 20 bp, synthetic construct
  misc_feature 1..20: note = CRISPR gRNA sequence
  source 1..20: mol_type = other DNA
taattattaaaaattggaaa

SEQ ID NO: 80963 - DNA, 20 bp, synthetic construct
  misc_feature 1..20: note = CRISPR gRNA sequence
  source 1..20: mol_type = other DNA
ttaaaaattggaaacaacct

SEQ ID NO: 80964 - DNA, 20 bp, synthetic construct
  misc_feature 1..20: note = CRISPR gRNA sequence
  source 1..20: mol_type = other DNA
aaaattggaaacaacctaaa

SEQ ID NO: 80965 - DNA, 20 bp, synthetic construct
  misc_feature 1..20: note = CRISPR gRNA sequence
  source 1..20: mol_type = other DNA
gaaacaacctaaatgtccaa

SEQ ID NO: 80966 - DNA, 20 bp, synthetic construct
  misc_feature 1..20: note = CRISPR gRNA sequence
  source 1..20: mol_type = other DNA
aatgtccaacagttggggat

SEQ ID NO: 80967 - DNA, 20 bp, synthetic construct
  misc_feature 1..20: note = CRISPR gRNA sequence
  source 1..20: mol_type = other DNA
gggattggccaactaaatgg

SEQ ID NO: 80968 - DNA, 20 bp, synthetic construct
  misc_feature 1..20: note = CRISPR gRNA sequence
  source 1..20: mol_type = other DNA
gccaactaaatggtggtcca

SEQ ID NO: 80969 - DNA, 20 bp, synthetic construct
  misc_feature 1..20: note = CRISPR gRNA sequence
  source 1..20: mol_type = other DNA
aatggtggtccatcatctag

SEQ ID NO: 80970 - DNA, 20 bp, synthetic construct
  misc_feature 1..20: note = CRISPR gRNA sequence
  source 1..20: mol_type = other DNA
gtggactatgctatcacatt

SEQ ID NO: 80971 - DNA, 20 bp, synthetic construct
  misc_feature 1..20: note = CRISPR gRNA sequence
  source 1..20: mol_type = other DNA
tgctatcacatttccggatg

SEQ ID NO: 80972 - DNA, 20 bp, synthetic construct
  misc_feature 1..20: note = CRISPR gRNA sequence
  source 1..20: mol_type = other DNA
tcacatttccggatgtactt

SEQ ID NO: 80973 - DNA, 20 bp, synthetic construct
  misc_feature 1..20: note = CRISPR gRNA sequence
  source 1..20: mol_type = other DNA
ccggatgtactttctggtac

SEQ ID NO: 80974 - DNA, 20 bp, synthetic construct
  misc_feature 1..20: note = CRISPR gRNA sequence
  source 1..20: mol_type = other DNA
cggatgtactttctggtact

SEQ ID NO: 80975 - DNA, 20 bp, synthetic construct
  misc_feature 1..20: note = CRISPR gRNA sequence
  source 1..20: mol_type = other DNA
tctggtactatgtccttcct

SEQ ID NO: 80976 - DNA, 20 bp, synthetic construct
  misc_feature 1..20: note = CRISPR gRNA sequence
  source 1..20: mol_type = other DNA
ctggtactatgtccttcctc

SEQ ID NO: 80977 - DNA, 20 bp, synthetic construct
  misc_feature 1..20: note = CRISPR gRNA sequence
  source 1..20: mol_type = other DNA
tggtactatgtccttcctca

SEQ ID NO: 80978 - DNA, 20 bp, synthetic construct
  misc_feature 1..20: note = CRISPR gRNA sequence
  source 1..20: mol_type = other DNA
gtactatgtccttcctcata

SEQ ID NO: 80979 - DNA, 20 bp, synthetic construct
  misc_feature 1..20: note = CRISPR gRNA sequence
  source 1..20: mol_type = other DNA
tgtccttcctcatagcagta

SEQ ID NO: 80980 - DNA, 20 bp, synthetic construct
  misc_feature 1..20: note = CRISPR gRNA sequence
  source 1..20: mol_type = other DNA
cctcatagcagtacacactt

SEQ ID NO: 80981 - DNA, 20 bp, synthetic construct
  misc_feature 1..20: note = CRISPR gRNA sequence
  source 1..20: mol_type = other DNA
ctcatagcagtacacacttg

SEQ ID NO: 80982 - DNA, 20 bp, synthetic construct
  misc_feature 1..20: note = CRISPR gRNA sequence
  source 1..20: mol_type = other DNA
atagcagtacacacttggaa

SEQ ID NO: 80983 - DNA, 20 bp, synthetic construct
  misc_feature 1..20: note = CRISPR gRNA sequence
  source 1..20: mol_type = other DNA
ggaaagcactcactgtgtat

SEQ ID NO: 80984 - DNA, 20 bp, synthetic construct
  misc_feature 1..20: note = CRISPR gRNA sequence
  source 1..20: mol_type = other DNA
gaaagcactcactgtgtatt

SEQ ID NO: 80985 - DNA, 20 bp, synthetic construct
  misc_feature 1..20: note = CRISPR gRNA sequence
  source 1..20: mol_type = other DNA
actgtgtattaggcactgtc

SEQ ID NO: 80986 - DNA, 20 bp, synthetic construct
  misc_feature 1..20: note = CRISPR gRNA sequence
  source 1..20: mol_type = other DNA
tgtattaggcactgtctaag

SEQ ID NO: 80987 - DNA, 20 bp, synthetic construct
  misc_feature 1..20: note = CRISPR gRNA sequence
  source 1..20: mol_type = other DNA
ggcactgtctaagtgcttta

SEQ ID NO: 80988 - DNA, 20 bp, synthetic construct
  misc_feature 1..20: note = CRISPR gRNA sequence
  source 1..20: mol_type = other DNA
tctaagtgctttatatacct

SEQ ID NO: 80989 - DNA, 20 bp, synthetic construct
  misc_feature 1..20: note = CRISPR gRNA sequence
  source 1..20: mol_type = other DNA
agtgctttatataccttatt

SEQ ID NO: 80990 - DNA, 20 bp, synthetic construct
  misc_feature 1..20: note = CRISPR gRNA sequence
  source 1..20: mol_type = other DNA
tatataccttattttatcct

SEQ ID NO: 80991 - DNA, 20 bp, synthetic construct
  misc_feature 1..20: note = CRISPR gRNA sequence
  source 1..20: mol_type = other DNA
atataccttattttatcctc

SEQ ID NO: 80992 - DNA, 20 bp, synthetic construct
  misc_feature 1..20: note = CRISPR gRNA sequence
  source 1..20: mol_type = other DNA
tataccttattttatcctca

SEQ ID NO: 80993 - DNA, 20 bp, synthetic construct
  misc_feature 1..20: note = CRISPR gRNA sequence
  source 1..20: mol_type = other DNA
attttatcctcacaactcca

SEQ ID NO: 80994 - DNA, 20 bp, synthetic construct
  misc_feature 1..20: note = CRISPR gRNA sequence
  source 1..20: mol_type = other DNA
ttttatcctcacaactccag

SEQ ID NO: 80995 - DNA, 20 bp, synthetic construct
  misc_feature 1..20: note = CRISPR gRNA sequence
  source 1..20: mol_type = other DNA
tatcctcacaactccagaga

SEQ ID NO: 80996 - DNA, 20 bp, synthetic construct
  misc_feature 1..20: note = CRISPR gRNA sequence
  source 1..20: mol_type = other DNA
atcctcacaactccagagag

SEQ ID NO: 80997 - DNA, 20 bp, synthetic construct
  misc_feature 1..20: note = CRISPR gRNA sequence
  source 1..20: mol_type = other DNA
tcctcacaactccagagagt

SEQ ID NO: 80998 - DNA, 20 bp, synthetic construct
  misc_feature 1..20: note = CRISPR gRNA sequence
  source 1..20: mol_type = other DNA
acaactccagagagtccacc

SEQ ID NO: 80999 - DNA, 20 bp, synthetic construct
  misc_feature 1..20: note = CRISPR gRNA sequence
  source 1..20: mol_type = other DNA
cagagagtccacctctaact

SEQ ID NO: 81000 - DNA, 20 bp, synthetic construct
  misc_feature 1..20: note = CRISPR gRNA sequence
  source 1..20: mol_type = other DNA
taactctgaaaagagtagga

SEQ ID NO: 81001 - DNA, 20 bp, synthetic construct
  misc_feature 1..20: note = CRISPR gRNA sequence
  source 1..20: mol_type = other DNA
actctgaaaagagtaggagg

SEQ ID NO: 81002 - DNA, 20 bp, synthetic construct
  misc_feature 1..20: note = CRISPR gRNA sequence
  source 1..20: mol_type = other DNA
tgaaaagagtaggaggtcca

SEQ ID NO: 81003 - DNA, 20 bp, synthetic construct
  misc_feature 1..20: note = CRISPR gRNA sequence
  source 1..20: mol_type = other DNA
aaaagagtaggaggtccacc

SEQ ID NO: 81004 - DNA, 20 bp, synthetic construct
  misc_feature 1..20: note = CRISPR gRNA sequence
  source 1..20: mol_type = other DNA
cccaattcccagaggctgag

SEQ ID NO: 81005 - DNA, 20 bp, synthetic construct
  misc_feature 1..20: note = CRISPR gRNA sequence
  source 1..20: mol_type = other DNA
ccaattcccagaggctgagg

SEQ ID NO: 81006 - DNA, 20 bp, synthetic construct
  misc_feature 1..20: note = CRISPR gRNA sequence
  source 1..20: mol_type = other DNA
ccagaggctgaggccagtac

SEQ ID NO: 81007 - DNA, 20 bp, synthetic construct
  misc_feature 1..20: note = CRISPR gRNA sequence
  source 1..20: mol_type = other DNA
aggccagtactatgcgtcct

SEQ ID NO: 81008 - DNA, 20 bp, synthetic construct
  misc_feature 1..20: note = CRISPR gRNA sequence
  source 1..20: mol_type = other DNA
tgcgtcctggggtttagagc

SEQ ID NO: 81009 - DNA, 20 bp, synthetic construct
  misc_feature 1..20: note = CRISPR gRNA sequence
  source 1..20: mol_type = other DNA
gggtttagagcccagctgct

SEQ ID NO: 81010 - DNA, 20 bp, synthetic construct
  misc_feature 1..20: note = CRISPR gRNA sequence
  source 1..20: mol_type = other DNA
agagcccagctgctccctgg

SEQ ID NO: 81011 - DNA, 20 bp, synthetic construct
  misc_feature 1..20: note = CRISPR gRNA sequence
  source 1..20: mol_type = other DNA
gagcccagctgctccctggg

SEQ ID NO: 81012 - DNA, 20 bp, synthetic construct
  misc_feature 1..20: note = CRISPR gRNA sequence
  source 1..20: mol_type = other DNA
ctccctgggcatgcagtaga

SEQ ID NO: 81013 - DNA, 20 bp, synthetic construct
  misc_feature 1..20: note = CRISPR gRNA sequence
  source 1..20: mol_type = other DNA
cctgggcatgcagtagagac

SEQ ID NO: 81014 - DNA, 20 bp, synthetic construct
  misc_feature 1..20: note = CRISPR gRNA sequence
  source 1..20: mol_type = other DNA
ggcatgcagtagagacatac

SEQ ID NO: 81015 - DNA, 20 bp, synthetic construct
  misc_feature 1..20: note = CRISPR gRNA sequence
  source 1..20: mol_type = other DNA
ggatgtactgtcagccccac

SEQ ID NO: 81016 - DNA, 20 bp, synthetic construct
  misc_feature 1..20: note = CRISPR gRNA sequence
  source 1..20: mol_type = other DNA
gatgtactgtcagccccact

SEQ ID NO: 81017 - DNA, 20 bp, synthetic construct
  misc_feature 1..20: note = CRISPR gRNA sequence
  source 1..20: mol_type = other DNA
tcagccccactggtcatttc

SEQ ID NO: 81018 - DNA, 20 bp, synthetic construct
  misc_feature 1..20: note = CRISPR gRNA sequence
  source 1..20: mol_type = other DNA
gtcatttctcctcaactggg

SEQ ID NO: 81019 - DNA, 20 bp, synthetic construct
  misc_feature 1..20: note = CRISPR gRNA sequence
  source 1..20: mol_type = other DNA
ctcctcaactgggctaatag

SEQ ID NO: 81020 - DNA, 20 bp, synthetic construct
  misc_feature 1..20: note = CRISPR gRNA sequence
  source 1..20: mol_type = other DNA
tcctcaactgggctaatagc

SEQ ID NO: 81021 - DNA, 20 bp, synthetic construct
  misc_feature 1..20: note = CRISPR gRNA sequence
  source 1..20: mol_type = other DNA
ctcaactgggctaatagcaa

SEQ ID NO: 81022 - DNA, 20 bp, synthetic construct
  misc_feature 1..20: note = CRISPR gRNA sequence
  source 1..20: mol_type = other DNA
aactgggctaatagcaatag

SEQ ID NO: 81023 - DNA, 20 bp, synthetic construct
  misc_feature 1..20: note = CRISPR gRNA sequence
  source 1..20: mol_type = other DNA
ggctaatagcaataggtcct

SEQ ID NO: 81024 - DNA, 20 bp, synthetic construct
  misc_feature 1..20: note = CRISPR gRNA sequence
  source 1..20: mol_type = other DNA
atagcaataggtcctcactc

SEQ ID NO: 81025 - DNA, 20 bp, synthetic construct
  misc_feature 1..20: note = CRISPR gRNA sequence
  source 1..20: mol_type = other DNA
actcaggcagagagtcttag

SEQ ID NO: 81026 - DNA, 20 bp, synthetic construct
  misc_feature 1..20: note = CRISPR gRNA sequence
  source 1..20: mol_type = other DNA
aggcagagagtcttagaatt

SEQ ID NO: 81027 - DNA, 20 bp, synthetic construct
  misc_feature 1..20: note = CRISPR gRNA sequence
  source 1..20: mol_type = other DNA
agaatttatgaaacatgctc

SEQ ID NO: 81028 - DNA, 20 bp, synthetic construct
  misc_feature 1..20: note = CRISPR gRNA sequence
  source 1..20: mol_type = other DNA
gaatttatgaaacatgctca

SEQ ID NO: 81029 - DNA, 20 bp, synthetic construct
  misc_feature 1..20: note = CRISPR gRNA sequence
  source 1..20: mol_type = other DNA
atgaaacatgctcacaccat

SEQ ID NO: 81030 - DNA, 20 bp, synthetic construct
  misc_feature 1..20: note = CRISPR gRNA sequence
  source 1..20: mol_type = other DNA
tgaaacatgctcacaccatg

SEQ ID NO: 81031 - DNA, 20 bp, synthetic construct
  misc_feature 1..20: note = CRISPR gRNA sequence
  source 1..20: mol_type = other DNA
acaccatgatcctcaggcag

SEQ ID NO: 81032 - DNA, 20 bp, synthetic construct
  misc_feature 1..20: note = CRISPR gRNA sequence
  source 1..20: mol_type = other DNA
aggcagggatcaccacctcc

SEQ ID NO: 81033 - DNA, 20 bp, synthetic construct
  misc_feature 1..20: note = CRISPR gRNA sequence
  source 1..20: mol_type = other DNA
cactaagcagacggaaagac

SEQ ID NO: 81034 - DNA, 20 bp, synthetic construct
  misc_feature 1..20: note = CRISPR gRNA sequence
  source 1..20: mol_type = other DNA
agcagacggaaagaccatgg

SEQ ID NO: 81035 - DNA, 20 bp, synthetic construct
  misc_feature 1..20: note = CRISPR gRNA sequence
  source 1..20: mol_type = other DNA
aggtttcttgcctcccaggc

SEQ ID NO: 81036 - DNA, 20 bp, synthetic construct
  misc_feature 1..20: note = CRISPR gRNA sequence
  source 1..20: mol_type = other DNA
cttgcctcccaggccagtaa

SEQ ID NO: 81037 - DNA, 20 bp, synthetic construct
  misc_feature 1..20: note = CRISPR gRNA sequence
  source 1..20: mol_type = other DNA
ttgcctcccaggccagtaaa

SEQ ID NO: 81038 - DNA, 20 bp, synthetic construct
  misc_feature 1..20: note = CRISPR gRNA sequence
  source 1..20: mol_type = other DNA
gcctcccaggccagtaaatt

SEQ ID NO: 81039 - DNA, 20 bp, synthetic construct
  misc_feature 1..20: note = CRISPR gRNA sequence
  source 1..20: mol_type = other DNA
cctcccaggccagtaaattt

SEQ ID NO: 81040 - DNA, 20 bp, synthetic construct
  misc_feature 1..20: note = CRISPR gRNA sequence
  source 1..20: mol_type = other DNA
ccaggccagtaaatttccaa

SEQ ID NO: 81041 - DNA, 20 bp, synthetic construct
  misc_feature 1..20: note = CRISPR gRNA sequence
  source 1..20: mol_type = other DNA
ccaaggccttggaggcctag

SEQ ID NO: 81042 - DNA, 20 bp, synthetic construct
  misc_feature 1..20: note = CRISPR gRNA sequence
  source 1..20: mol_type = other DNA
caaggccttggaggcctaga

SEQ ID NO: 81043 - DNA, 20 bp, synthetic construct
  misc_feature 1..20: note = CRISPR gRNA sequence
  source 1..20: mol_type = other DNA
ggaggcctagatggcaccag

SEQ ID NO: 81044 - DNA, 20 bp, synthetic construct
  misc_feature 1..20: note = CRISPR gRNA sequence
  source 1..20: mol_type = other DNA
gaggcctagatggcaccaga

SEQ ID NO: 81045 - DNA, 20 bp, synthetic construct
  misc_feature 1..20: note = CRISPR gRNA sequence
  source 1..20: mol_type = other DNA
gatggcaccagacaaggcta

SEQ ID NO: 81046 - DNA, 20 bp, synthetic construct
  misc_feature 1..20: note = CRISPR gRNA sequence
  source 1..20: mol_type = other DNA
agtccctggattttgtgtga

SEQ ID NO: 81047 - DNA, 20 bp, synthetic construct
  misc_feature 1..20: note = CRISPR gRNA sequence
  source 1..20: mol_type = other DNA
gattttgtgtgatctcggca

SEQ ID NO: 81048 - DNA, 20 bp, synthetic construct
  misc_feature 1..20: note = CRISPR gRNA sequence
  source 1..20: mol_type = other DNA
tgtgtgatctcggcaaaagg

SEQ ID NO: 81049 - DNA, 20 bp, synthetic construct
  misc_feature 1..20: note = CRISPR gRNA sequence
  source 1..20: mol_type = other DNA
gtgtgatctcggcaaaagga

SEQ ID NO: 81050 - DNA, 20 bp, synthetic construct
  misc_feature 1..20: note = CRISPR gRNA sequence
  source 1..20: mol_type = other DNA
tgtgatctcggcaaaaggat

SEQ ID NO: 81051 - DNA, 20 bp, synthetic construct
  misc_feature 1..20: note = CRISPR gRNA sequence
  source 1..20: mol_type = other DNA
ggcaaaaggatgtggccata

SEQ ID NO: 81052 - DNA, 20 bp, synthetic construct
  misc_feature 1..20: note = CRISPR gRNA sequence
  source 1..20: mol_type = other DNA
gggcataacttcttttccag

SEQ ID NO: 81053 - DNA, 20 bp, synthetic construct
  misc_feature 1..20: note = CRISPR gRNA sequence
  source 1..20: mol_type = other DNA
cttttccaggctatggtgtc

SEQ ID NO: 81054 - DNA, 20 bp, synthetic construct
  misc_feature 1..20: note = CRISPR gRNA sequence
  source 1..20: mol_type = other DNA
ttttccaggctatggtgtcc

SEQ ID NO: 81055 - DNA, 20 bp, synthetic construct
  misc_feature 1..20: note = CRISPR gRNA sequence
  source 1..20: mol_type = other DNA
ttccaggctatggtgtccag

SEQ ID NO: 81056 - DNA, 20 bp, synthetic construct
  misc_feature 1..20: note = CRISPR gRNA sequence
  source 1..20: mol_type = other DNA
tccaggctatggtgtccagc

SEQ ID NO: 81057 - DNA, 20 bp, synthetic construct
  misc_feature 1..20: note = CRISPR gRNA sequence
  source 1..20: mol_type = other DNA
ccaggctatggtgtccagca

SEQ ID NO: 81058 - DNA, 20 bp, synthetic construct
  misc_feature 1..20: note = CRISPR gRNA sequence
  source 1..20: mol_type = other DNA
caggctatggtgtccagcat

SEQ ID NO: 81059 - DNA, 20 bp, synthetic construct
  misc_feature 1..20: note = CRISPR gRNA sequence
  source 1..20: mol_type = other DNA
tggtgtccagcatccatgct

SEQ ID NO: 81060 - DNA, 20 bp, synthetic construct
  misc_feature 1..20: note = CRISPR gRNA sequence
  source 1..20: mol_type = other DNA
cccatgaagaaatggtccag

SEQ ID NO: 81061 - DNA, 20 bp, synthetic construct
  misc_feature 1..20: note = CRISPR gRNA sequence
  source 1..20: mol_type = other DNA
gatggtgtgatttctggtga

SEQ ID NO: 81062 - DNA, 20 bp, synthetic construct
  misc_feature 1..20: note = CRISPR gRNA sequence
  source 1..20: mol_type = other DNA
ctggtgatgtttctcatcct

SEQ ID NO: 81063 - DNA, 20 bp, synthetic construct
  misc_feature 1..20: note = CRISPR gRNA sequence
  source 1..20: mol_type = other DNA
tggtgatgtttctcatcctc

SEQ ID NO: 81064 - DNA, 20 bp, synthetic construct
  misc_feature 1..20: note = CRISPR gRNA sequence
  source 1..20: mol_type = other DNA
gtgatgtttctcatcctcaa

SEQ ID NO: 81065 - DNA, 20 bp, synthetic construct
  misc_feature 1..20: note = CRISPR gRNA sequence
  source 1..20: mol_type = other DNA
ctcatcctcaaatttctcct

SEQ ID NO: 81066 - DNA, 20 bp, synthetic construct
  misc_feature 1..20: note = CRISPR gRNA sequence
  source 1..20: mol_type = other DNA
tcatcctcaaatttctcctc

SEQ ID NO: 81067 - DNA, 20 bp, synthetic construct
  misc_feature 1..20: note = CRISPR gRNA sequence
  source 1..20: mol_type = other DNA
atcctcaaatttctcctcca

SEQ ID NO: 81068 - DNA, 20 bp, synthetic construct
  misc_feature 1..20: note = CRISPR gRNA sequence
  source 1..20: mol_type = other DNA
aaatttctcctccagccagt

SEQ ID NO: 81069 - DNA, 20 bp, synthetic construct
  misc_feature 1..20: note = CRISPR gRNA sequence
  source 1..20: mol_type = other DNA
ctcctccagccagtctaaca

SEQ ID NO: 81070 - DNA, 20 bp, synthetic construct
  misc_feature 1..20: note = CRISPR gRNA sequence
  source 1..20: mol_type = other DNA
tcctccagccagtctaacac

SEQ ID NO: 81071 - DNA, 20 bp, synthetic construct
  misc_feature 1..20: note = CRISPR gRNA sequence
  source 1..20: mol_type = other DNA
ctccagccagtctaacacaa

SEQ ID NO: 81072 - DNA, 20 bp, synthetic construct
  misc_feature 1..20: note = CRISPR gRNA sequence
  source 1..20: mol_type = other DNA
cagccagtctaacacaatac

SEQ ID NO: 81073 - DNA, 20 bp, synthetic construct
  misc_feature 1..20: note = CRISPR gRNA sequence
  source 1..20: mol_type = other DNA
acacaatacctttgtttcca

SEQ ID NO: 81074 - DNA, 20 bp, synthetic construct
  misc_feature 1..20: note = CRISPR gRNA sequence
  source 1..20: mol_type = other DNA
tgtttccatcattagtgttc

SEQ ID NO: 81075 - DNA, 20 bp, synthetic construct
  misc_feature 1..20: note = CRISPR gRNA sequence
  source 1..20: mol_type = other DNA
gtttccatcattagtgttct

SEQ ID NO: 81076 - DNA, 20 bp, synthetic construct
  misc_feature 1..20: note = CRISPR gRNA sequence
  source 1..20: mol_type = other DNA
tttccatcattagtgttcta

SEQ ID NO: 81077 - DNA, 20 bp, synthetic construct
  misc_feature 1..20: note = CRISPR gRNA sequence
  source 1..20: mol_type = other DNA
ccatcattagtgttctatcc

SEQ ID NO: 81078 - DNA, 20 bp, synthetic construct
  misc_feature 1..20: note = CRISPR gRNA sequence
  source 1..20: mol_type = other DNA
catcattagtgttctatccc

SEQ ID NO: 81079 - DNA, 20 bp, synthetic construct
  misc_feature 1..20: note = CRISPR gRNA sequence
  source 1..20: mol_type = other DNA
gtgttctatccccttaggat

SEQ ID NO: 81080 - DNA, 20 bp, synthetic construct
  misc_feature 1..20: note = CRISPR gRNA sequence
  source 1..20: mol_type = other DNA
tatccccttaggatatgaca

SEQ ID NO: 81081 - DNA, 20 bp, synthetic construct
  misc_feature 1..20: note = CRISPR gRNA sequence
  source 1..20: mol_type = other DNA
tccccttaggatatgacaca

SEQ ID NO: 81082 - DNA, 20 bp, synthetic construct
  misc_feature 1..20: note = CRISPR gRNA sequence
  source 1..20: mol_type = other DNA
aggatatgacacaaatctct

SEQ ID NO: 81083 - DNA, 20 bp, synthetic construct
  misc_feature 1..20: note = CRISPR gRNA sequence
  source 1..20: mol_type = other DNA
ggatatgacacaaatctctt

SEQ ID NO: 81084 - DNA, 20 bp, synthetic construct
  misc_feature 1..20: note = CRISPR gRNA sequence
  source 1..20: mol_type = other DNA
tttaaggctaaccatcctca

SEQ ID NO: 81085 - DNA, 20 bp, synthetic construct
  misc_feature 1..20: note = CRISPR gRNA sequence
  source 1..20: mol_type = other DNA
taaggctaaccatcctcagg

SEQ ID NO: 81086 - DNA, 20 bp, synthetic construct
  misc_feature 1..20: note = CRISPR gRNA sequence
  source 1..20: mol_type = other DNA
aaggctaaccatcctcagga

SEQ ID NO: 81087 - DNA, 20 bp, synthetic construct
  misc_feature 1..20: note = CRISPR gRNA sequence
  source 1..20: mol_type = other DNA
aggctaaccatcctcaggag

SEQ ID NO: 81088 - DNA, 20 bp, synthetic construct
  misc_feature 1..20: note = CRISPR gRNA sequence
  source 1..20: mol_type = other DNA
accatcctcaggagaaaaag

SEQ ID NO: 81089 - DNA, 20 bp, synthetic construct
  misc_feature 1..20: note = CRISPR gRNA sequence
  source 1..20: mol_type = other DNA
aggagaaaaagcacatggca

SEQ ID NO: 81090 - DNA, 20 bp, synthetic construct
  misc_feature 1..20: note = CRISPR gRNA sequence
  source 1..20: mol_type = other DNA
tcagtcattgagatttccat

SEQ ID NO: 81091 - DNA, 20 bp, synthetic construct
  misc_feature 1..20: note = CRISPR gRNA sequence
  source 1..20: mol_type = other DNA
agatttccatggggaataat

SEQ ID NO: 81092 - DNA, 20 bp, synthetic construct
  misc_feature 1..20: note = CRISPR gRNA sequence
  source 1..20: mol_type = other DNA
ccatggggaataatcttgga

SEQ ID NO: 81093 - DNA, 20 bp, synthetic construct
  misc_feature 1..20: note = CRISPR gRNA sequence
  source 1..20: mol_type = other DNA
catggggaataatcttggag

SEQ ID NO: 81094 - DNA, 20 bp, synthetic construct
  misc_feature 1..20: note = CRISPR gRNA sequence
  source 1..20: mol_type = other DNA
ggagacagaggacgatggtt

SEQ ID NO: 81095 - DNA, 20 bp, synthetic construct
  misc_feature 1..20: note = CRISPR gRNA sequence
  source 1..20: mol_type = other DNA
gagacagaggacgatggttg

SEQ ID NO: 81096 - DNA, 20 bp, synthetic construct
  misc_feature 1..20: note = CRISPR gRNA sequence
  source 1..20: mol_type = other DNA
aaagatccatggcccagctc

SEQ ID NO: 81097 - DNA, 20 bp, synthetic construct
  misc_feature 1..20: note = CRISPR gRNA sequence
  source 1..20: mol_type = other DNA
tgttactaattctctgtggt

SEQ ID NO: 81098 - DNA, 20 bp, synthetic construct
  misc_feature 1..20: note = CRISPR gRNA sequence
  source 1..20: mol_type = other DNA
ttactaattctctgtggtag

SEQ ID NO: 81099 - DNA, 20 bp, synthetic construct
  misc_feature 1..20: note = CRISPR gRNA sequence
  source 1..20: mol_type = other DNA
ctaattctctgtggtaggca

SEQ ID NO: 81100 - DNA, 20 bp, synthetic construct
  misc_feature 1..20: note = CRISPR gRNA sequence
  source 1..20: mol_type = other DNA
attctctgtggtaggcatta

SEQ ID NO: 81101 - DNA, 20 bp, synthetic construct
  misc_feature 1..20: note = CRISPR gRNA sequence
  source 1..20: mol_type = other DNA
tctgtggtaggcattagggc

SEQ ID NO: 81102 - DNA, 20 bp, synthetic construct
  misc_feature 1..20: note = CRISPR gRNA sequence
  source 1..20: mol_type = other DNA
tgtggtaggcattagggctg

SEQ ID NO: 81103 - DNA, 20 bp, synthetic construct
  misc_feature 1..20: note = CRISPR gRNA sequence
  source 1..20: mol_type = other DNA
tggtaggcattagggctgtt

SEQ ID NO: 81104 - DNA, 20 bp, synthetic construct
  misc_feature 1..20: note = CRISPR gRNA sequence
  source 1..20: mol_type = other DNA
gggctgttcacagatactct

SEQ ID NO: 81105 - DNA, 20 bp, synthetic construct
  misc_feature 1..20: note = CRISPR gRNA sequence
  source 1..20: mol_type = other DNA
ttcacagatactctttctcc

SEQ ID NO: 81106 - DNA, 20 bp, synthetic construct
  misc_feature 1..20: note = CRISPR gRNA sequence
  source 1..20: mol_type = other DNA
acagatactctttctcctct

SEQ ID NO: 81107 - DNA, 20 bp, synthetic construct
  misc_feature 1..20: note = CRISPR gRNA sequence
  source 1..20: mol_type = other DNA
tttctcctctttctaggcct

SEQ ID NO: 81108 - DNA, 20 bp, synthetic construct
  misc_feature 1..20: note = CRISPR gRNA sequence
  source 1..20: mol_type = other DNA
tctcctctttctaggccttt

SEQ ID NO: 81109 - DNA, 20 bp, synthetic construct
  misc_feature 1..20: note = CRISPR gRNA sequence
  source 1..20: mol_type = other DNA
ctcctctttctaggcctttg

SEQ ID NO: 81110 - DNA, 20 bp, synthetic construct
  misc_feature 1..20: note = CRISPR gRNA sequence
  source 1..20: mol_type = other DNA
tcctctttctaggcctttgg

SEQ ID NO: 81111 - DNA, 20 bp, synthetic construct
  misc_feature 1..20: note = CRISPR gRNA sequence
  source 1..20: mol_type = other DNA
ctctttctaggcctttggtg

SEQ ID NO: 81112 - DNA, 20 bp, synthetic construct
  misc_feature 1..20: note = CRISPR gRNA sequence
  source 1..20: mol_type = other DNA
tttctaggcctttggtggga

SEQ ID NO: 81113 - DNA, 20 bp, synthetic construct
  misc_feature 1..20: note = CRISPR gRNA sequence
  source 1..20: mol_type = other DNA
tctaggcctttggtgggatt

SEQ ID NO: 81114 - DNA, 20 bp, synthetic construct
  misc_feature 1..20: note = CRISPR gRNA sequence
  source 1..20: mol_type = other DNA
ctaggcctttggtgggatta

SEQ ID NO: 81115 - DNA, 20 bp, synthetic construct
  misc_feature 1..20: note = CRISPR gRNA sequence
  source 1..20: mol_type = other DNA
taggcctttggtgggattac

SEQ ID NO: 81116 - DNA, 20 bp, synthetic construct
  misc_feature 1..20: note = CRISPR gRNA sequence
  source 1..20: mol_type = other DNA
ggcctttggtgggattacac

SEQ ID NO: 81117 - DNA, 20 bp, synthetic construct
  misc_feature 1..20: note = CRISPR gRNA sequence
  source 1..20: mol_type = other DNA
tggtgggattacacttctct

SEQ ID NO: 81118 - DNA, 20 bp, synthetic construct
  misc_feature 1..20: note = CRISPR gRNA sequence
  source 1..20: mol_type = other DNA
ggtgggattacacttctctg

SEQ ID NO: 81119 - DNA, 20 bp, synthetic construct
  misc_feature 1..20: note = CRISPR gRNA sequence
  source 1..20: mol_type = other DNA
gtgggattacacttctctgc

SEQ ID NO: 81120 - DNA, 20 bp, synthetic construct
  misc_feature 1..20: note = CRISPR gRNA sequence
  source 1..20: mol_type = other DNA
cacttctctgcctccttgaa

SEQ ID NO: 81121 - DNA, 20 bp, synthetic construct
  misc_feature 1..20: note = CRISPR gRNA sequence
  source 1..20: mol_type = other DNA
ctctgcctccttgaaattgg

SEQ ID NO: 81122 - DNA, 20 bp, synthetic construct
  misc_feature 1..20: note = CRISPR gRNA sequence
  source 1..20: mol_type = other DNA
tctgcctccttgaaattggg

SEQ ID NO: 81123 - DNA, 20 bp, synthetic construct
  misc_feature 1..20: note = CRISPR gRNA sequence
  source 1..20: mol_type = other DNA
tgcctccttgaaattgggca

SEQ ID NO: 81124 - DNA, 20 bp, synthetic construct
  misc_feature 1..20: note = CRISPR gRNA sequence
  source 1..20: mol_type = other DNA
cctccttgaaattgggcaca

SEQ ID NO: 81125 - DNA, 20 bp, synthetic construct
  misc_feature 1..20: note = CRISPR gRNA sequence
  source 1..20: mol_type = other DNA
cttgaaattgggcacagcca

SEQ ID NO: 81126 - DNA, 20 bp, synthetic construct
  misc_feature 1..20: note = CRISPR gRNA sequence
  source 1..20: mol_type = other DNA
gaaattgggcacagccatga

SEQ ID NO: 81127 - DNA, 20 bp, synthetic construct
  misc_feature 1..20: note = CRISPR gRNA sequence
  source 1..20: mol_type = other DNA
aaattgggcacagccatgaa

SEQ ID NO: 81128 - DNA, 20 bp, synthetic construct
  misc_feature 1..20: note = CRISPR gRNA sequence
  source 1..20: mol_type = other DNA
ggcacagccatgaaacttgc

SEQ ID NO: 81129 - DNA, 20 bp, synthetic construct
  misc_feature 1..20: note = CRISPR gRNA sequence
  source 1..20: mol_type = other DNA
gctttggtcaatgaaacatg

SEQ ID NO: 81130 - DNA, 20 bp, synthetic construct
  misc_feature 1..20: note = CRISPR gRNA sequence
  source 1..20: mol_type = other DNA
ctttggtcaatgaaacatgc

SEQ ID NO: 81131 - DNA, 20 bp, synthetic construct
  misc_feature 1..20: note = CRISPR gRNA sequence
  source 1..20: mol_type = other DNA
tggtcaatgaaacatgctaa

SEQ ID NO: 81132 - DNA, 20 bp, synthetic construct
  misc_feature 1..20: note = CRISPR gRNA sequence
  source 1..20: mol_type = other DNA
ggtcaatgaaacatgctaaa

SEQ ID NO: 81133 - DNA, 20 bp, synthetic construct
  misc_feature 1..20: note = CRISPR gRNA sequence
  source 1..20: mol_type = other DNA
gtcaatgaaacatgctaaaa

SEQ ID NO: 81134 - DNA, 20 bp, synthetic construct
  misc_feature 1..20: note = CRISPR gRNA sequence
  source 1..20: mol_type = other DNA
aaaaagactcatgtcatgcc

SEQ ID NO: 81135 - DNA, 20 bp, synthetic construct
  misc_feature 1..20: note = CRISPR gRNA sequence
  source 1..20: mol_type = other DNA
atgtcatgcctgtagttgtt

SEQ ID NO: 81136 - DNA, 20 bp, synthetic construct
  misc_feature 1..20: note = CRISPR gRNA sequence
  source 1..20: mol_type = other DNA
tagttgttttaagaaccaag

SEQ ID NO: 81137 - DNA, 20 bp, synthetic construct
  misc_feature 1..20: note = CRISPR gRNA sequence
  source 1..20: mol_type = other DNA
ttttaagaaccaaggtgtaa

SEQ ID NO: 81138 - DNA, 20 bp, synthetic construct
  misc_feature 1..20: note = CRISPR gRNA sequence
  source 1..20: mol_type = other DNA
taagaaccaaggtgtaattg

SEQ ID NO: 81139 - DNA, 20 bp, synthetic construct
  misc_feature 1..20: note = CRISPR gRNA sequence
  source 1..20: mol_type = other DNA
aagaaccaaggtgtaattga

SEQ ID NO: 81140 - DNA, 20 bp, synthetic construct
  misc_feature 1..20: note = CRISPR gRNA sequence
  source 1..20: mol_type = other DNA
agaaccaaggtgtaattgac

SEQ ID NO: 81141 - DNA, 20 bp, synthetic construct
  misc_feature 1..20: note = CRISPR gRNA sequence
  source 1..20: mol_type = other DNA
acagtactttttcttttttt

SEQ ID NO: 81142 - DNA, 20 bp, synthetic construct
  misc_feature 1..20: note = CRISPR gRNA sequence
  source 1..20: mol_type = other DNA
tttctttttttctactccag

SEQ ID NO: 81143 - DNA, 20 bp, synthetic construct
  misc_feature 1..20: note = CRISPR gRNA sequence
  source 1..20: mol_type = other DNA
ttctttttttctactccagg

SEQ ID NO: 81144 - DNA, 20 bp, synthetic construct
  misc_feature 1..20: note = CRISPR gRNA sequence
  source 1..20: mol_type = other DNA
tctttttttctactccaggg

SEQ ID NO: 81145 - DNA, 20 bp, synthetic construct
  misc_feature 1..20: note = CRISPR gRNA sequence
  source 1..20: mol_type = other DNA
ctttttttctactccaggga

SEQ ID NO: 81146 - DNA, 20 bp, synthetic construct
  misc_feature 1..20: note = CRISPR gRNA sequence
  source 1..20: mol_type = other DNA
tttttttctactccagggac

SEQ ID NO: 81147 - DNA, 20 bp, synthetic construct
  misc_feature 1..20: note = CRISPR gRNA sequence
  source 1..20: mol_type = other DNA
tttttctactccagggacca

SEQ ID NO: 81148 - DNA, 20 bp, synthetic construct
  misc_feature 1..20: note = CRISPR gRNA sequence
  source 1..20: mol_type = other DNA
ttttctactccagggaccag

SEQ ID NO: 81149 - DNA, 20 bp, synthetic construct
  misc_feature 1..20: note = CRISPR gRNA sequence
  source 1..20: mol_type = other DNA
tttctactccagggaccaga

SEQ ID NO: 81150 - DNA, 20 bp, synthetic construct
  misc_feature 1..20: note = CRISPR gRNA sequence
  source 1..20: mol_type = other DNA
ttctactccagggaccagaa

SEQ ID NO: 81151 - DNA, 20 bp, synthetic construct
  misc_feature 1..20: note = CRISPR gRNA sequence
  source 1..20: mol_type = other DNA
tctactccagggaccagaaa

SEQ ID NO: 81152 - DNA, 20 bp, synthetic construct
  misc_feature 1..20: note = CRISPR gRNA sequence
  source 1..20: mol_type = other DNA
ctactccagggaccagaaat

SEQ ID NO: 81153 - DNA, 20 bp, synthetic construct
  misc_feature 1..20: note = CRISPR gRNA sequence
  source 1..20: mol_type = other DNA
tactccagggaccagaaata

SEQ ID NO: 81154 - DNA, 20 bp, synthetic construct
  misc_feature 1..20: note = CRISPR gRNA sequence
  source 1..20: mol_type = other DNA
ctccagggaccagaaatatt

SEQ ID NO: 81155 - DNA, 20 bp, synthetic construct
  misc_feature 1..20: note = CRISPR gRNA sequence
  source 1..20: mol_type = other DNA
cagggaccagaaatattgca

SEQ ID NO: 81156 - DNA, 20 bp, synthetic construct
  misc_feature 1..20: note = CRISPR gRNA sequence
  source 1..20: mol_type = other DNA
caaatcatggctaccctgtt

SEQ ID NO: 81157 - DNA, 20 bp, synthetic construct
  misc_feature 1..20: note = CRISPR gRNA sequence
  source 1..20: mol_type = other DNA
ccctgttagcctgagtgtgg

SEQ ID NO: 81158 - DNA, 20 bp, synthetic construct
  misc_feature 1..20: note = CRISPR gRNA sequence
  source 1..20: mol_type = other DNA
ttagcctgagtgtgggagac

SEQ ID NO: 81159 - DNA, 20 bp, synthetic construct
  misc_feature 1..20: note = CRISPR gRNA sequence
  source 1..20: mol_type = other DNA
gcctgagtgtgggagacagg

SEQ ID NO: 81160 - DNA, 20 bp, synthetic construct
  misc_feature 1..20: note = CRISPR gRNA sequence
  source 1..20: mol_type = other DNA
agtgtgggagacaggatgat

SEQ ID NO: 81161 - DNA, 20 bp, synthetic construct
  misc_feature 1..20: note = CRISPR gRNA sequence
  source 1..20: mol_type = other DNA
ttgttgccatgagtcactgg

SEQ ID NO: 81162 - DNA, 20 bp, synthetic construct
  misc_feature 1..20: note = CRISPR gRNA sequence
  source 1..20: mol_type = other DNA
tgttgccatgagtcactggg

SEQ ID NO: 81163 - DNA, 20 bp, synthetic construct
  misc_feature 1..20: note = CRISPR gRNA sequence
  source 1..20: mol_type = other DNA
gttgccatgagtcactggga

SEQ ID NO: 81164 - DNA, 20 bp, synthetic construct
  misc_feature 1..20: note = CRISPR gRNA sequence
  source 1..20: mol_type = other DNA
ttgccatgagtcactgggac

SEQ ID NO: 81165 - DNA, 20 bp, synthetic construct
  misc_feature 1..20: note = CRISPR gRNA sequence
  source 1..20: mol_type = other DNA
ccatgagtcactgggacttt

SEQ ID NO: 81166 - DNA, 20 bp, synthetic construct
  misc_feature 1..20: note = CRISPR gRNA sequence
  source 1..20: mol_type = other DNA
ggactttggagggtgcatgt

SEQ ID NO: 81167 - DNA, 20 bp, synthetic construct
  misc_feature 1..20: note = CRISPR gRNA sequence
  source 1..20: mol_type = other DNA
tggagggtgcatgtactaca

SEQ ID NO: 81168 - DNA, 20 bp, synthetic construct
  misc_feature 1..20: note = CRISPR gRNA sequence
  source 1..20: mol_type = other DNA
ggagggtgcatgtactacag

SEQ ID NO: 81169 - DNA, 20 bp, synthetic construct
  misc_feature 1..20: note = CRISPR gRNA sequence
  source 1..20: mol_type = other DNA
gagggtgcatgtactacagt

SEQ ID NO: 81170 - DNA, 20 bp, synthetic construct
  misc_feature 1..20: note = CRISPR gRNA sequence
  source 1..20: mol_type = other DNA
cagtgtaacctggcctatcc

SEQ ID NO: 81171 - DNA, 20 bp, synthetic construct
  misc_feature 1..20: note = CRISPR gRNA sequence
  source 1..20: mol_type = other DNA
gcctatcctagctgatacac

SEQ ID NO: 81172 - DNA, 20 bp, synthetic construct
  misc_feature 1..20: note = CRISPR gRNA sequence
  source 1..20: mol_type = other DNA
tcctagctgatacactcata

SEQ ID NO: 81173 - DNA, 20 bp, synthetic construct
  misc_feature 1..20: note = CRISPR gRNA sequence
  source 1..20: mol_type = other DNA
gctgatacactcatagtgtg

SEQ ID NO: 81174 - DNA, 20 bp, synthetic construct
  misc_feature 1..20: note = CRISPR gRNA sequence
  source 1..20: mol_type = other DNA
atacactcatagtgtgacct

SEQ ID NO: 81175 - DNA, 20 bp, synthetic construct
  misc_feature 1..20: note = CRISPR gRNA sequence
  source 1..20: mol_type = other DNA
atagtgtgaccttgagcaag

SEQ ID NO: 81176 - DNA, 20 bp, synthetic construct
  misc_feature 1..20: note = CRISPR gRNA sequence
  source 1..20: mol_type = other DNA
gagcaagcctttttcctata

SEQ ID NO: 81177 - DNA, 20 bp, synthetic construct
  misc_feature 1..20: note = CRISPR gRNA sequence
  source 1..20: mol_type = other DNA
agcaagcctttttcctatat

SEQ ID NO: 81178 - DNA, 20 bp, synthetic construct
  misc_feature 1..20: note = CRISPR gRNA sequence
  source 1..20: mol_type = other DNA
tttcctatataagcctcagt

SEQ ID NO: 81179 - DNA, 20 bp, synthetic construct
  misc_feature 1..20: note = CRISPR gRNA sequence
  source 1..20: mol_type = other DNA
ttcctatataagcctcagtc

SEQ ID NO: 81180 - DNA, 20 bp, synthetic construct
  misc_feature 1..20: note = CRISPR gRNA sequence
  source 1..20: mol_type = other DNA
tcctatataagcctcagtca

SEQ ID NO: 81181 - DNA, 20 bp, synthetic construct
  misc_feature 1..20: note = CRISPR gRNA sequence
  source 1..20: mol_type = other DNA
cctatataagcctcagtcat

SEQ ID NO: 81182 - DNA, 20 bp, synthetic construct
  misc_feature 1..20: note = CRISPR gRNA sequence
  source 1..20: mol_type = other DNA
ctatataagcctcagtcata

SEQ ID NO: 81183 - DNA, 20 bp, synthetic construct
  misc_feature 1..20: note = CRISPR gRNA sequence
  source 1..20: mol_type = other DNA
tataagcctcagtcatacca

SEQ ID NO: 81184 - DNA, 20 bp, synthetic construct
  misc_feature 1..20: note = CRISPR gRNA sequence
  source 1..20: mol_type = other DNA
agtcataccatctctaaaat

SEQ ID NO: 81185 - DNA, 20 bp, synthetic construct
  misc_feature 1..20: note = CRISPR gRNA sequence
  source 1..20: mol_type = other DNA
taaaatgggtagattagatg

SEQ ID NO: 81186 - DNA, 20 bp, synthetic construct
  misc_feature 1..20: note = CRISPR gRNA sequence
  source 1..20: mol_type = other DNA
aaatgggtagattagatgct

SEQ ID NO: 81187 - DNA, 20 bp, synthetic construct
  misc_feature 1..20: note = CRISPR gRNA sequence
  source 1..20: mol_type = other DNA
gatgctgtctcaaaactctt

SEQ ID NO: 81188 - DNA, 20 bp, synthetic construct
  misc_feature 1..20: note = CRISPR gRNA sequence
  source 1..20: mol_type = other DNA
tctcaaaactcttcctgatt

SEQ ID NO: 81189 - DNA, 20 bp, synthetic construct
  misc_feature 1..20: note = CRISPR gRNA sequence
  source 1..20: mol_type = other DNA
aaaactcttcctgattttct

SEQ ID NO: 81190 - DNA, 20 bp, synthetic construct
  misc_feature 1..20: note = CRISPR gRNA sequence
  source 1..20: mol_type = other DNA
ttcctgattttctgtgtctg

SEQ ID NO: 81191 - DNA, 20 bp, synthetic construct
  misc_feature 1..20: note = CRISPR gRNA sequence
  source 1..20: mol_type = other DNA
cctgattttctgtgtctgat

SEQ ID NO: 81192 - DNA, 20 bp, synthetic construct
  misc_feature 1..20: note = CRISPR gRNA sequence
  source 1..20: mol_type = other DNA
ctgattttctgtgtctgatc

SEQ ID NO: 81193 - DNA, 20 bp, synthetic construct
  misc_feature 1..20: note = CRISPR gRNA sequence
  source 1..20: mol_type = other DNA
attttctgtgtctgatcatt

SEQ ID NO: 81194 - DNA, 20 bp, synthetic construct
  misc_feature 1..20: note = CRISPR gRNA sequence
  source 1..20: mol_type = other DNA
tctgtgtctgatcattacat

SEQ ID NO: 81195 - DNA, 20 bp, synthetic construct
  misc_feature 1..20: note = CRISPR gRNA sequence
  source 1..20: mol_type = other DNA
ctgtgtctgatcattacatt

SEQ ID NO: 81196 - DNA, 20 bp, synthetic construct
  misc_feature 1..20: note = CRISPR gRNA sequence
  source 1..20: mol_type = other DNA
tgtgtctgatcattacattc

SEQ ID NO: 81197 - DNA, 20 bp, synthetic construct
  misc_feature 1..20: note = CRISPR gRNA sequence
  source 1..20: mol_type = other DNA
tgtctgatcattacattctc

SEQ ID NO: 81198 - DNA, 20 bp, synthetic construct
  misc_feature 1..20: note = CRISPR gRNA sequence
  source 1..20: mol_type = other DNA
atcattacattctcatgctg

SEQ ID NO: 81199 - DNA, 20 bp, synthetic construct
  misc_feature 1..20: note = CRISPR gRNA sequence
  source 1..20: mol_type = other DNA
cattctcatgctgaatgatg

SEQ ID NO: 81200 - DNA, 20 bp, synthetic construct
  misc_feature 1..20: note = CRISPR gRNA sequence
  source 1..20: mol_type = other DNA
tcatgctgaatgatggtcaa

SEQ ID NO: 81201 - DNA, 20 bp, synthetic construct
  misc_feature 1..20: note = CRISPR gRNA sequence
  source 1..20: mol_type = other DNA
atgctgaatgatggtcaagg

SEQ ID NO: 81202 - DNA, 20 bp, synthetic construct
  misc_feature 1..20: note = CRISPR gRNA sequence
  source 1..20: mol_type = other DNA
aatgatggtcaagggcaggt

SEQ ID NO: 81203 - DNA, 20 bp, synthetic construct
  misc_feature 1..20: note = CRISPR gRNA sequence
  source 1..20: mol_type = other DNA
gttgtgttgggggcagccca

SEQ ID NO: 81204 - DNA, 20 bp, synthetic construct
  misc_feature 1..20: note = CRISPR gRNA sequence
  source 1..20: mol_type = other DNA
ttgtgttgggggcagcccag

SEQ ID NO: 81205 - DNA, 20 bp, synthetic construct
  misc_feature 1..20: note = CRISPR gRNA sequence
  source 1..20: mol_type = other DNA
tgttgggggcagcccagtaa

SEQ ID NO: 81206 - DNA, 20 bp, synthetic construct
  misc_feature 1..20: note = CRISPR gRNA sequence
  source 1..20: mol_type = other DNA
ggggcagcccagtaaggcag

SEQ ID NO: 81207 - DNA, 20 bp, synthetic construct
  misc_feature 1..20: note = CRISPR gRNA sequence
  source 1..20: mol_type = other DNA
gggtagggaccagtcttggc

SEQ ID NO: 81208 - DNA, 20 bp, synthetic construct
  misc_feature 1..20: note = CRISPR gRNA sequence
  source 1..20: mol_type = other DNA
ggtagggaccagtcttggca

SEQ ID NO: 81209 - DNA, 20 bp, synthetic construct
  misc_feature 1..20: note = CRISPR gRNA sequence
  source 1..20: mol_type = other DNA
ggcagtaggagaaaagtgac

SEQ ID NO: 81210 - DNA, 20 bp, synthetic construct
  misc_feature 1..20: note = CRISPR gRNA sequence
  source 1..20: mol_type = other DNA
gcagtaggagaaaagtgacg

SEQ ID NO: 81211 - DNA, 20 bp, synthetic construct
  misc_feature 1..20: note = CRISPR gRNA sequence
  source 1..20: mol_type = other DNA
cttggtctcctcgttcatga

SEQ ID NO: 81212 - DNA, 20 bp, synthetic construct
  misc_feature 1..20: note = CRISPR gRNA sequence
  source 1..20: mol_type = other DNA
ggtctcctcgttcatgatag

SEQ ID NO: 81213 - DNA, 20 bp, synthetic construct
  misc_feature 1..20: note = CRISPR gRNA sequence
  source 1..20: mol_type = other DNA
gtctcctcgttcatgatagg

SEQ ID NO: 81214 - DNA, 20 bp, synthetic construct
  misc_feature 1..20: note = CRISPR gRNA sequence
  source 1..20: mol_type = other DNA
ctcgttcatgataggtgctc

SEQ ID NO: 81215 - DNA, 20 bp, synthetic construct
  misc_feature 1..20: note = CRISPR gRNA sequence
  source 1..20: mol_type = other DNA
gttcatgataggtgctctag

SEQ ID NO: 81216 - DNA, 20 bp, synthetic construct
  misc_feature 1..20: note = CRISPR gRNA sequence
  source 1..20: mol_type = other DNA
atgataggtgctctagggtc

SEQ ID NO: 81217 - DNA, 20 bp, synthetic construct
  misc_feature 1..20: note = CRISPR gRNA sequence
  source 1..20: mol_type = other DNA
tagggtccccacggagaggg

SEQ ID NO: 81218 - DNA, 20 bp, synthetic construct
  misc_feature 1..20: note = CRISPR gRNA sequence
  source 1..20: mol_type = other DNA
gggtccccacggagagggtc

SEQ ID NO: 81219 - DNA, 20 bp, synthetic construct
  misc_feature 1..20: note = CRISPR gRNA sequence
  source 1..20: mol_type = other DNA
atgggtgtctgggctatgtg

SEQ ID NO: 81220 - DNA, 20 bp, synthetic construct
  misc_feature 1..20: note = CRISPR gRNA sequence
  source 1..20: mol_type = other DNA
ggctatgtgtgccttgagct

SEQ ID NO: 81221 - DNA, 20 bp, synthetic construct
  misc_feature 1..20: note = CRISPR gRNA sequence
  source 1..20: mol_type = other DNA
tgtgtgccttgagctggatt

SEQ ID NO: 81222 - DNA, 20 bp, synthetic construct
  misc_feature 1..20: note = CRISPR gRNA sequence
  source 1..20: mol_type = other DNA
gagctggattgacaggttgt

SEQ ID NO: 81223 - DNA, 20 bp, synthetic construct
  misc_feature 1..20: note = CRISPR gRNA sequence
  source 1..20: mol_type = other DNA
agctggattgacaggttgtt

SEQ ID NO: 81224 - DNA, 20 bp, synthetic construct
  misc_feature 1..20: note = CRISPR gRNA sequence
  source 1..20: mol_type = other DNA
gattgacaggttgtttccat

SEQ ID NO: 81225 - DNA, 20 bp, synthetic construct
  misc_feature 1..20: note = CRISPR gRNA sequence
  source 1..20: mol_type = other DNA
acaggttgtttccatagtgc

SEQ ID NO: 81226 - DNA, 20 bp, synthetic construct
  misc_feature 1..20: note = CRISPR gRNA sequence
  source 1..20: mol_type = other DNA
tttccatagtgcagactcct

SEQ ID NO: 81227 - DNA, 20 bp, synthetic construct
  misc_feature 1..20: note = CRISPR gRNA sequence
  source 1..20: mol_type = other DNA
ccatagtgcagactcctaag

SEQ ID NO: 81228 - DNA, 20 bp, synthetic construct
  misc_feature 1..20: note = CRISPR gRNA sequence
  source 1..20: mol_type = other DNA
catagtgcagactcctaagg

SEQ ID NO: 81229 - DNA, 20 bp, synthetic construct
  misc_feature 1..20: note = CRISPR gRNA sequence
  source 1..20: mol_type = other DNA
ctaaggggagagaagacagg

SEQ ID NO: 81230 - DNA, 20 bp, synthetic construct
  misc_feature 1..20: note = CRISPR gRNA sequence
  source 1..20: mol_type = other DNA
aggggagagaagacagggag

SEQ ID NO: 81231 - DNA, 20 bp, synthetic construct
  misc_feature 1..20: note = CRISPR gRNA sequence
  source 1..20: mol_type = other DNA
tccccactattccagactcc

SEQ ID NO: 81232 - DNA, 20 bp, synthetic construct
  misc_feature 1..20: note = CRISPR gRNA sequence
  source 1..20: mol_type = other DNA
ccccactattccagactcca

SEQ ID NO: 81233 - DNA, 20 bp, synthetic construct
  misc_feature 1..20: note = CRISPR gRNA sequence
  source 1..20: mol_type = other DNA
cccactattccagactccaa

SEQ ID NO: 81234 - DNA, 20 bp, synthetic construct
  misc_feature 1..20: note = CRISPR gRNA sequence
  source 1..20: mol_type = other DNA
ttccagactccaaaaggaat

SEQ ID NO: 81235 - DNA, 20 bp, synthetic construct
  misc_feature 1..20: note = CRISPR gRNA sequence
  source 1..20: mol_type = other DNA
cagactccaaaaggaatgct

SEQ ID NO: 81236 - DNA, 20 bp, synthetic construct
  misc_feature 1..20: note = CRISPR gRNA sequence
  source 1..20: mol_type = other DNA
caaaaggaatgctgtaaacc

SEQ ID NO: 81237 - DNA, 20 bp, synthetic construct
  misc_feature 1..20: note = CRISPR gRNA sequence
  source 1..20: mol_type = other DNA
taaaccaggcaccagccctt

SEQ ID NO: 81238 - DNA, 20 bp, synthetic construct
  misc_feature 1..20: note = CRISPR gRNA sequence
  source 1..20: mol_type = other DNA
gcccctgcctgccggagaca

SEQ ID NO: 81239 - DNA, 20 bp, synthetic construct
  misc_feature 1..20: note = CRISPR gRNA sequence
  source 1..20: mol_type = other DNA
cccctgcctgccggagacac

SEQ ID NO: 81240 - DNA, 20 bp, synthetic construct
  misc_feature 1..20: note = CRISPR gRNA sequence
  source 1..20: mol_type = other DNA
gaaagtccctctctctaacc

SEQ ID NO: 81241 - DNA, 20 bp, synthetic construct
  misc_feature 1..20: note = CRISPR gRNA sequence
  source 1..20: mol_type = other DNA
ctaacctggcactgcgtcgc

SEQ ID NO: 81242 - DNA, 20 bp, synthetic construct
  misc_feature 1..20: note = CRISPR gRNA sequence
  source 1..20: mol_type = other DNA
ctggcactgcgtcgctggct

SEQ ID NO: 81243 - DNA, 20 bp, synthetic construct
  misc_feature 1..20: note = CRISPR gRNA sequence
  source 1..20: mol_type = other DNA
ggcactgcgtcgctggcttg

SEQ ID NO: 81244 - DNA, 20 bp, synthetic construct
  misc_feature 1..20: note = CRISPR gRNA sequence
  source 1..20: mol_type = other DNA
ctgcgtcgctggcttggaga

SEQ ID NO: 81245 - DNA, 20 bp, synthetic construct
  misc_feature 1..20: note = CRISPR gRNA sequence
  source 1..20: mol_type = other DNA
tgcgtcgctggcttggagac

SEQ ID NO: 81246 - DNA, 20 bp, synthetic construct
  misc_feature 1..20: note = CRISPR gRNA sequence
  source 1..20: mol_type = other DNA
gctggcttggagacaggtga

SEQ ID NO: 81247 - DNA, 20 bp, synthetic construct
  misc_feature 1..20: note = CRISPR gRNA sequence
  source 1..20: mol_type = other DNA
gagacaggtgacggtccctg

SEQ ID NO: 81248 - DNA, 20 bp, synthetic construct
  misc_feature 1..20: note = CRISPR gRNA sequence
  source 1..20: mol_type = other DNA
agacaggtgacggtccctgc

SEQ ID NO: 81249 - DNA, 20 bp, synthetic construct
  misc_feature 1..20: note = CRISPR gRNA sequence
  source 1..20: mol_type = other DNA
cctgcgggccttgtcctgat

SEQ ID NO: 81250 - DNA, 20 bp, synthetic construct
  misc_feature 1..20: note = CRISPR gRNA sequence
  source 1..20: mol_type = other DNA
cgggccttgtcctgattggc

SEQ ID NO: 81251 - DNA, 20 bp, synthetic construct
  misc_feature 1..20: note = CRISPR gRNA sequence
  source 1..20: mol_type = other DNA
gggccttgtcctgattggct

SEQ ID NO: 81252 - DNA, 20 bp, synthetic construct
  misc_feature 1..20: note = CRISPR gRNA sequence
  source 1..20: mol_type = other DNA
gctgggcacgcgtttaatat

SEQ ID NO: 81253 - DNA, 20 bp, synthetic construct
  misc_feature 1..20: note = CRISPR gRNA sequence
  source 1..20: mol_type = other DNA
gggcacgcgtttaatataag

SEQ ID NO: 81254 - DNA, 20 bp, synthetic construct
  misc_feature 1..20: note = CRISPR gRNA sequence
  source 1..20: mol_type = other DNA
gcacgcgtttaatataagtg

SEQ ID NO: 81255 - DNA, 20 bp, synthetic construct
  misc_feature 1..20: note = CRISPR gRNA sequence
  source 1..20: mol_type = other DNA
cacgcgtttaatataagtgg

SEQ ID NO: 81256 - DNA, 20 bp, synthetic construct
  misc_feature 1..20: note = CRISPR gRNA sequence
  source 1..20: mol_type = other DNA
tataagtggaggcgtcgcgc

SEQ ID NO: 81257 - DNA, 20 bp, synthetic construct
  misc_feature 1..20: note = CRISPR gRNA sequence
  source 1..20: mol_type = other DNA
aagtggaggcgtcgcgctgg

SEQ ID NO: 81258 - DNA, 20 bp, synthetic construct
  misc_feature 1..20: note = CRISPR gRNA sequence
  source 1..20: mol_type = other DNA
agtggaggcgtcgcgctggc

SEQ ID NO: 81259 - DNA, 20 bp, synthetic construct
  misc_feature 1..20: note = CRISPR gRNA sequence
  source 1..20: mol_type = other DNA
cgcgctggcgggcattcctg

SEQ ID NO: 81260 - DNA, 20 bp, synthetic construct
  misc_feature 1..20: note = CRISPR gRNA sequence
  source 1..20: mol_type = other DNA
gcgggcattcctgaagctga

SEQ ID NO: 81261 - DNA, 20 bp, synthetic construct
  misc_feature 1..20: note = CRISPR gRNA sequence
  source 1..20: mol_type = other DNA
ttcctgaagctgacagcatt

SEQ ID NO: 81262 - DNA, 20 bp, synthetic construct
  misc_feature 1..20: note = CRISPR gRNA sequence
  source 1..20: mol_type = other DNA
tcctgaagctgacagcattc

SEQ ID NO: 81263 - DNA, 20 bp, synthetic construct
  misc_feature 1..20: note = CRISPR gRNA sequence
  source 1..20: mol_type = other DNA
aagctgacagcattcgggcc

SEQ ID NO: 81264 - DNA, 20 bp, synthetic construct
  misc_feature 1..20: note = CRISPR gRNA sequence
  source 1..20: mol_type = other DNA
ggccgagatgtctcgctccg

SEQ ID NO: 81265 - DNA, 20 bp, synthetic construct
  misc_feature 1..20: note = CRISPR gRNA sequence
  source 1..20: mol_type = other DNA
gatgtctcgctccgtggcct

SEQ ID NO: 81266 - DNA, 20 bp, synthetic construct
  misc_feature 1..20: note = CRISPR gRNA sequence
  source 1..20: mol_type = other DNA
ctcgcgctactctctctttc

SEQ ID NO: 81267 - DNA, 20 bp, synthetic construct
  misc_feature 1..20: note = CRISPR gRNA sequence
  source 1..20: mol_type = other DNA
gctactctctctttctggcc

SEQ ID NO: 81268 - DNA, 20 bp, synthetic construct
  misc_feature 1..20: note = CRISPR gRNA sequence
  source 1..20: mol_type = other DNA
tactctctctttctggcctg

SEQ ID NO: 81269 - DNA, 20 bp, synthetic construct
  misc_feature 1..20: note = CRISPR gRNA sequence
  source 1..20: mol_type = other DNA
actctctctttctggcctgg

SEQ ID NO: 81270 - DNA, 20 bp, synthetic construct
  misc_feature 1..20: note = CRISPR gRNA sequence
  source 1..20: mol_type = other DNA
tttctggcctggaggctatc

SEQ ID NO: 81271 - DNA, 20 bp, synthetic construct
  misc_feature 1..20: note = CRISPR gRNA sequence
  source 1..20: mol_type = other DNA
gcctggaggctatccagcgt

SEQ ID NO: 81272 - DNA, 20 bp, synthetic construct
  misc_feature 1..20: note = CRISPR gRNA sequence
  source 1..20: mol_type = other DNA
tctctcctaccctcccgctc

SEQ ID NO: 81273 - DNA, 20 bp, synthetic construct
  misc_feature 1..20: note = CRISPR gRNA sequence
  source 1..20: mol_type = other DNA
ctcccgctctgcaccctctg

SEQ ID NO: 81274 - DNA, 20 bp, synthetic construct
  misc_feature 1..20: note = CRISPR gRNA sequence
  source 1..20: mol_type = other DNA
ctccgtgacttcccttctcc

SEQ ID NO: 81275 - DNA, 20 bp, synthetic construct
  misc_feature 1..20: note = CRISPR gRNA sequence
  source 1..20: mol_type = other DNA
tcccttctccaagttctcct

SEQ ID NO: 81276 - DNA, 20 bp, synthetic construct
  misc_feature 1..20: note = CRISPR gRNA sequence
  source 1..20: mol_type = other DNA
cttctccaagttctccttgg

SEQ ID NO: 81277 - DNA, 20 bp, synthetic construct
  misc_feature 1..20: note = CRISPR gRNA sequence
  source 1..20: mol_type = other DNA
ttctccttggtggcccgccg

SEQ ID NO: 81278 - DNA, 20 bp, synthetic construct
  misc_feature 1..20: note = CRISPR gRNA sequence
  source 1..20: mol_type = other DNA
tctccttggtggcccgccgt

SEQ ID NO: 81279 - DNA, 20 bp, synthetic construct
  misc_feature 1..20: note = CRISPR gRNA sequence
  source 1..20: mol_type = other DNA
ctccttggtggcccgccgtg

SEQ ID NO: 81280 - DNA, 20 bp, synthetic construct
  misc_feature 1..20: note = CRISPR gRNA sequence
  source 1..20: mol_type = other DNA
ttggtggcccgccgtggggc

SEQ ID NO: 81281 - DNA, 20 bp, synthetic construct
  misc_feature 1..20: note = CRISPR gRNA sequence
  source 1..20: mol_type = other DNA
ggcccgccgtggggctagtc

SEQ ID NO: 81282 - DNA, 20 bp, synthetic construct
  misc_feature 1..20: note = CRISPR gRNA sequence
  source 1..20: mol_type = other DNA
gcccgccgtggggctagtcc

SEQ ID NO: 81283 - DNA, 20 bp, synthetic construct
  misc_feature 1..20: note = CRISPR gRNA sequence
  source 1..20: mol_type = other DNA
cccgccgtggggctagtcca

SEQ ID NO: 81284 - DNA, 20 bp, synthetic construct
  misc_feature 1..20: note = CRISPR gRNA sequence
  source 1..20: mol_type = other DNA
ccgtggggctagtccagggc

SEQ ID NO: 81285 - DNA, 20 bp, synthetic construct
  misc_feature 1..20: note = CRISPR gRNA sequence
  source 1..20: mol_type = other DNA
gctagtccagggctggatct

SEQ ID NO: 81286 - DNA, 20 bp, synthetic construct
  misc_feature 1..20: note = CRISPR gRNA sequence
  source 1..20: mol_type = other DNA
ctagtccagggctggatctc

SEQ ID NO: 81287 - DNA, 20 bp, synthetic construct
  misc_feature 1..20: note = CRISPR gRNA sequence
  source 1..20: mol_type = other DNA
tagtccagggctggatctcg

SEQ ID NO: 81288 - DNA, 20 bp, synthetic construct
  misc_feature 1..20: note = CRISPR gRNA sequence
  source 1..20: mol_type = other DNA
tccagggctggatctcgggg

SEQ ID NO: 81289 - DNA, 20 bp, synthetic construct
  misc_feature 1..20: note = CRISPR gRNA sequence
  source 1..20: mol_type = other DNA
agggctggatctcggggaag

SEQ ID NO: 81290 - DNA, 20 bp, synthetic construct
  misc_feature 1..20: note = CRISPR gRNA sequence
  source 1..20: mol_type = other DNA
gctggatctcggggaagcgg

SEQ ID NO: 81291 - DNA, 20 bp, synthetic construct
  misc_feature 1..20: note = CRISPR gRNA sequence
  source 1..20: mol_type = other DNA
ctggatctcggggaagcggc

SEQ ID NO: 81292 - DNA, 20 bp, synthetic construct
  misc_feature 1..20: note = CRISPR gRNA sequence
  source 1..20: mol_type = other DNA
tggatctcggggaagcggcg

SEQ ID NO: 81293 - DNA, 20 bp, synthetic construct
  misc_feature 1..20: note = CRISPR gRNA sequence
  source 1..20: mol_type = other DNA
atctcggggaagcggcgggg

SEQ ID NO: 81294 - DNA, 20 bp, synthetic construct
  misc_feature 1..20: note = CRISPR gRNA sequence
  source 1..20: mol_type = other DNA
ggggaagcggcggggtggcc

SEQ ID NO: 81295 - DNA, 20 bp, synthetic construct
  misc_feature 1..20: note = CRISPR gRNA sequence
  source 1..20: mol_type = other DNA
gggaagcggcggggtggcct

SEQ ID NO: 81296 - DNA, 20 bp, synthetic construct
  misc_feature 1..20: note = CRISPR gRNA sequence
  source 1..20: mol_type = other DNA
gaagcggcggggtggcctgg

SEQ ID NO: 81297 - DNA, 20 bp, synthetic construct
  misc_feature 1..20: note = CRISPR gRNA sequence
  source 1..20: mol_type = other DNA
gcggcggggtggcctgggag

SEQ ID NO: 81298 - DNA, 20 bp, synthetic construct
  misc_feature 1..20: note = CRISPR gRNA sequence
  source 1..20: mol_type = other DNA
cggcggggtggcctgggagt

SEQ ID NO: 81299 - DNA, 20 bp, synthetic construct
  misc_feature 1..20: note = CRISPR gRNA sequence
  source 1..20: mol_type = other DNA
ggcggggtggcctgggagtg

SEQ ID NO: 81300 - DNA, 20 bp, synthetic construct
  misc_feature 1..20: note = CRISPR gRNA sequence
  source 1..20: mol_type = other DNA
ggggtggcctgggagtgggg

SEQ ID NO: 81301 - DNA, 20 bp, synthetic construct
  misc_feature 1..20: note = CRISPR gRNA sequence
  source 1..20: mol_type = other DNA
gggtggcctgggagtgggga

SEQ ID NO: 81302 - DNA, 20 bp, synthetic construct
  misc_feature 1..20: note = CRISPR gRNA sequence
  source 1..20: mol_type = other DNA
ggtggcctgggagtggggaa

SEQ ID NO: 81303 - DNA, 20 bp, synthetic construct
  misc_feature 1..20: note = CRISPR gRNA sequence
  source 1..20: mol_type = other DNA
gtggcctgggagtggggaag

SEQ ID NO: 81304 - DNA, 20 bp, synthetic construct
  misc_feature 1..20: note = CRISPR gRNA sequence
  source 1..20: mol_type = other DNA
tggcctgggagtggggaagg

SEQ ID NO: 81305 - DNA, 20 bp, synthetic construct
  misc_feature 1..20: note = CRISPR gRNA sequence
  source 1..20: mol_type = other DNA
tggggaagggggtgcgcacc

SEQ ID NO: 81306 - DNA, 20 bp, synthetic construct
  misc_feature 1..20: note = CRISPR gRNA sequence
  source 1..20: mol_type = other DNA
ggggaagggggtgcgcaccc

SEQ ID NO: 81307 - DNA, 20 bp, synthetic construct
  misc_feature 1..20: note = CRISPR gRNA sequence
  source 1..20: mol_type = other DNA
cgcgcgctacttgccccttt

SEQ ID NO: 81308 - DNA, 20 bp, synthetic construct
  misc_feature 1..20: note = CRISPR gRNA sequence
  source 1..20: mol_type = other DNA
gcgctacttgcccctttcgg

SEQ ID NO: 81309 - DNA, 20 bp, synthetic construct
  misc_feature 1..20: note = CRISPR gRNA sequence
  source 1..20: mol_type = other DNA
cgctacttgcccctttcggc

SEQ ID NO: 81310 - DNA, 20 bp, synthetic construct
  misc_feature 1..20: note = CRISPR gRNA sequence
  source 1..20: mol_type = other DNA
gctacttgcccctttcggcg

SEQ ID NO: 81311 - DNA, 20 bp, synthetic construct
  misc_feature 1..20: note = CRISPR gRNA sequence
  source 1..20: mol_type = other DNA
tacttgcccctttcggcggg

SEQ ID NO: 81312 - DNA, 20 bp, synthetic construct
  misc_feature 1..20: note = CRISPR gRNA sequence
  source 1..20: mol_type = other DNA
ttgcccctttcggcggggag

SEQ ID NO: 81313 - DNA, 20 bp, synthetic construct
  misc_feature 1..20: note = CRISPR gRNA sequence
  source 1..20: mol_type = other DNA
tgcccctttcggcggggagc

SEQ ID NO: 81314 - DNA, 20 bp, synthetic construct
  misc_feature 1..20: note = CRISPR gRNA sequence
  source 1..20: mol_type = other DNA
gcccctttcggcggggagca

SEQ ID NO: 81315 - DNA, 20 bp, synthetic construct
  misc_feature 1..20: note = CRISPR gRNA sequence
  source 1..20: mol_type = other DNA
cccctttcggcggggagcag

SEQ ID NO: 81316 - DNA, 20 bp, synthetic construct
  misc_feature 1..20: note = CRISPR gRNA sequence
  source 1..20: mol_type = other DNA
cctttcggcggggagcaggg

SEQ ID NO: 81317 - DNA, 20 bp, synthetic construct
  misc_feature 1..20: note = CRISPR gRNA sequence
  source 1..20: mol_type = other DNA
cggggagcaggggagacctt

SEQ ID NO: 81318 - DNA, 20 bp, synthetic construct
  misc_feature 1..20: note = CRISPR gRNA sequence
  source 1..20: mol_type = other DNA
caggggagacctttggccta

SEQ ID NO: 81319 - DNA, 20 bp, synthetic construct
  misc_feature 1..20: note = CRISPR gRNA sequence
  source 1..20: mol_type = other DNA
agacctttggcctacggcga

SEQ ID NO: 81320 - DNA, 20 bp, synthetic construct
  misc_feature 1..20: note = CRISPR gRNA sequence
  source 1..20: mol_type = other DNA
gacctttggcctacggcgac

SEQ ID NO: 81321 - DNA, 20 bp, synthetic construct
  misc_feature 1..20: note = CRISPR gRNA sequence
  source 1..20: mol_type = other DNA
cctttggcctacggcgacgg

SEQ ID NO: 81322 - DNA, 20 bp, synthetic construct
  misc_feature 1..20: note = CRISPR gRNA sequence
  source 1..20: mol_type = other DNA
ctttggcctacggcgacggg

SEQ ID NO: 81323 - DNA, 20 bp, synthetic construct
  misc_feature 1..20: note = CRISPR gRNA sequence
  source 1..20: mol_type = other DNA
tttggcctacggcgacggga

SEQ ID NO: 81324 - DNA, 20 bp, synthetic construct
  misc_feature 1..20: note = CRISPR gRNA sequence
  source 1..20: mol_type = other DNA
gcctacggcgacgggagggt

SEQ ID NO: 81325 - DNA, 20 bp, synthetic construct
  misc_feature 1..20: note = CRISPR gRNA sequence
  source 1..20: mol_type = other DNA
cctacggcgacgggagggtc

SEQ ID NO: 81326 - DNA, 20 bp, synthetic construct
  misc_feature 1..20: note = CRISPR gRNA sequence
  source 1..20: mol_type = other DNA
gcgacgggagggtcgggaca

SEQ ID NO: 81327 - DNA, 20 bp, synthetic construct
  misc_feature 1..20: note = CRISPR gRNA sequence
  source 1..20: mol_type = other DNA
gggagggtcgggacaaagtt

SEQ ID NO: 81328 - DNA, 20 bp, synthetic construct
  misc_feature 1..20: note = CRISPR gRNA sequence
  source 1..20: mol_type = other DNA
ggagggtcgggacaaagttt

SEQ ID NO: 81329 - DNA, 20 bp, synthetic construct
  misc_feature 1..20: note = CRISPR gRNA sequence
  source 1..20: mol_type = other DNA
gagggtcgggacaaagttta

SEQ ID NO: 81330 - DNA, 20 bp, synthetic construct
  misc_feature 1..20: note = CRISPR gRNA sequence
  source 1..20: mol_type = other DNA
acaaagtttagggcgtcgat

SEQ ID NO: 81331 - DNA, 20 bp, synthetic construct
  misc_feature 1..20: note = CRISPR gRNA sequence
  source 1..20: mol_type = other DNA
tttagggcgtcgataagcgt

SEQ ID NO: 81332 - DNA, 20 bp, synthetic construct
  misc_feature 1..20: note = CRISPR gRNA sequence
  source 1..20: mol_type = other DNA
tagggcgtcgataagcgtca

SEQ ID NO: 81333 - DNA, 20 bp, synthetic construct
  misc_feature 1..20: note = CRISPR gRNA sequence
  source 1..20: mol_type = other DNA
tcgataagcgtcagagcgcc

SEQ ID NO: 81334 - DNA, 20 bp, synthetic construct
  misc_feature 1..20: note = CRISPR gRNA sequence
  source 1..20: mol_type = other DNA
cgataagcgtcagagcgccg

SEQ ID NO: 81335 - DNA, 20 bp, synthetic construct
  misc_feature 1..20: note = CRISPR gRNA sequence
  source 1..20: mol_type = other DNA
aagcgtcagagcgccgaggt

SEQ ID NO: 81336 - DNA, 20 bp, synthetic construct
  misc_feature 1..20: note = CRISPR gRNA sequence
  source 1..20: mol_type = other DNA
agcgtcagagcgccgaggtt

SEQ ID NO: 81337 - DNA, 20 bp, synthetic construct
  misc_feature 1..20: note = CRISPR gRNA sequence
  source 1..20: mol_type = other DNA
gcgtcagagcgccgaggttg

SEQ ID NO: 81338 - DNA, 20 bp, synthetic construct
  misc_feature 1..20: note = CRISPR gRNA sequence
  source 1..20: mol_type = other DNA
cgtcagagcgccgaggttgg

SEQ ID NO: 81339 - DNA, 20 bp, synthetic construct
  misc_feature 1..20: note = CRISPR gRNA sequence
  source 1..20: mol_type = other DNA
tcagagcgccgaggttgggg

SEQ ID NO: 81340 - DNA, 20 bp, synthetic construct
  misc_feature 1..20: note = CRISPR gRNA sequence
  source 1..20: mol_type = other DNA
cagagcgccgaggttggggg

SEQ ID NO: 81341 - DNA, 20 bp, synthetic construct
  misc_feature 1..20: note = CRISPR gRNA sequence
  source 1..20: mol_type = other DNA
agagcgccgaggttggggga

SEQ ID NO: 81342 - DNA, 20 bp, synthetic construct
  misc_feature 1..20: note = CRISPR gRNA sequence
  source 1..20: mol_type = other DNA
gtttctcttccgctctttcg

SEQ ID NO: 81343 - DNA, 20 bp, synthetic construct
  misc_feature 1..20: note = CRISPR gRNA sequence
  source 1..20: mol_type = other DNA
tttctcttccgctctttcgc

SEQ ID NO: 81344 - DNA, 20 bp, synthetic construct
  misc_feature 1..20: note = CRISPR gRNA sequence
  source 1..20: mol_type = other DNA
ttctcttccgctctttcgcg

SEQ ID NO: 81345 - DNA, 20 bp, synthetic construct
  misc_feature 1..20: note = CRISPR gRNA sequence
  source 1..20: mol_type = other DNA
ccgctctttcgcggggcctc

SEQ ID NO: 81346 - DNA, 20 bp, synthetic construct
  misc_feature 1..20: note = CRISPR gRNA sequence
  source 1..20: mol_type = other DNA
cgcggggcctctggctcccc

SEQ ID NO: 81347 - DNA, 20 bp, synthetic construct
  misc_feature 1..20: note = CRISPR gRNA sequence
  source 1..20: mol_type = other DNA
ggcctctggctcccccagcg

SEQ ID NO: 81348 - DNA, 20 bp, synthetic construct
  misc_feature 1..20: note = CRISPR gRNA sequence
  source 1..20: mol_type = other DNA
tctggctcccccagcgcagc

SEQ ID NO: 81349 - DNA, 20 bp, synthetic construct
  misc_feature 1..20: note = CRISPR gRNA sequence
  source 1..20: mol_type = other DNA
tggctcccccagcgcagctg

SEQ ID NO: 81350 - DNA, 20 bp, synthetic construct
  misc_feature 1..20: note = CRISPR gRNA sequence
  source 1..20: mol_type = other DNA
ctcccccagcgcagctggag

SEQ ID NO: 81351 - DNA, 20 bp, synthetic construct
  misc_feature 1..20: note = CRISPR gRNA sequence
  source 1..20: mol_type = other DNA
tcccccagcgcagctggagt

SEQ ID NO: 81352 - DNA, 20 bp, synthetic construct
  misc_feature 1..20: note = CRISPR gRNA sequence
  source 1..20: mol_type = other DNA
cccccagcgcagctggagtg

SEQ ID NO: 81353 - DNA, 20 bp, synthetic construct
  misc_feature 1..20: note = CRISPR gRNA sequence
  source 1..20: mol_type = other DNA
ccccagcgcagctggagtgg

SEQ ID NO: 81354 - DNA, 20 bp, synthetic construct
  misc_feature 1..20: note = CRISPR gRNA sequence
  source 1..20: mol_type = other DNA
agcgcagctggagtggggga

SEQ ID NO: 81355 - DNA, 20 bp, synthetic construct
  misc_feature 1..20: note = CRISPR gRNA sequence
  source 1..20: mol_type = other DNA
gcgcagctggagtgggggac

SEQ ID NO: 81356 - DNA, 20 bp, synthetic construct
  misc_feature 1..20: note = CRISPR gRNA sequence
  source 1..20: mol_type = other DNA
cagctggagtgggggacggg

SEQ ID NO: 81357 - DNA, 20 bp, synthetic construct
  misc_feature 1..20: note = CRISPR gRNA sequence
  source 1..20: mol_type = other DNA
agctggagtgggggacgggt

SEQ ID NO: 81358 - DNA, 20 bp, synthetic construct
  misc_feature 1..20: note = CRISPR gRNA sequence
  source 1..20: mol_type = other DNA
ggacgggtaggctcgtccca

SEQ ID NO: 81359 - DNA, 20 bp, synthetic construct
  misc_feature 1..20: note = CRISPR gRNA sequence
  source 1..20: mol_type = other DNA
gacgggtaggctcgtcccaa

SEQ ID NO: 81360 - DNA, 20 bp, synthetic construct
  misc_feature 1..20: note = CRISPR gRNA sequence
  source 1..20: mol_type = other DNA
gtaggctcgtcccaaaggcg

SEQ ID NO: 81361 - DNA, 20 bp, synthetic construct
  misc_feature 1..20: note = CRISPR gRNA sequence
  source 1..20: mol_type = other DNA
cgtcccaaaggcgcggcgct

SEQ ID NO: 81362 - DNA, 20 bp, synthetic construct
  misc_feature 1..20: note = CRISPR gRNA sequence
  source 1..20: mol_type = other DNA
gtcccaaaggcgcggcgctg

SEQ ID NO: 81363 - DNA, 20 bp, synthetic construct
  misc_feature 1..20: note = CRISPR gRNA sequence
  source 1..20: mol_type = other DNA
cgctgaggtttgtgaacgcg

SEQ ID NO: 81364 - DNA, 20 bp, synthetic construct
  misc_feature 1..20: note = CRISPR gRNA sequence
  source 1..20: mol_type = other DNA
ctgaggtttgtgaacgcgtg

SEQ ID NO: 81365 - DNA, 20 bp, synthetic construct
  misc_feature 1..20: note = CRISPR gRNA sequence
  source 1..20: mol_type = other DNA
tgaggtttgtgaacgcgtgg

SEQ ID NO: 81366 - DNA, 20 bp, synthetic construct
  misc_feature 1..20: note = CRISPR gRNA sequence
  source 1..20: mol_type = other DNA
gaggtttgtgaacgcgtgga

SEQ ID NO: 81367 - DNA, 20 bp, synthetic construct
  misc_feature 1..20: note = CRISPR gRNA sequence
  source 1..20: mol_type = other DNA
aggtttgtgaacgcgtggag

SEQ ID NO: 81368 - DNA, 20 bp, synthetic construct
  misc_feature 1..20: note = CRISPR gRNA sequence
  source 1..20: mol_type = other DNA
tgaacgcgtggaggggcgct

SEQ ID NO: 81369 - DNA, 20 bp, synthetic construct
  misc_feature 1..20: note = CRISPR gRNA sequence
  source 1..20: mol_type = other DNA
gaacgcgtggaggggcgctt

SEQ ID NO: 81370 - DNA, 20 bp, synthetic construct
  misc_feature 1..20: note = CRISPR gRNA sequence
  source 1..20: mol_type = other DNA
aacgcgtggaggggcgcttg

SEQ ID NO: 81371 - DNA, 20 bp, synthetic construct
  misc_feature 1..20: note = CRISPR gRNA sequence
  source 1..20: mol_type = other DNA
gtggaggggcgcttggggtc

SEQ ID NO: 81372 - DNA, 20 bp, synthetic construct
  misc_feature 1..20: note = CRISPR gRNA sequence
  source 1..20: mol_type = other DNA
tggaggggcgcttggggtct

SEQ ID NO: 81373 - DNA, 20 bp, synthetic construct
  misc_feature 1..20: note = CRISPR gRNA sequence
  source 1..20: mol_type = other DNA
ggaggggcgcttggggtctg

SEQ ID NO: 81374 - DNA, 20 bp, synthetic construct
  misc_feature 1..20: note = CRISPR gRNA sequence
  source 1..20: mol_type = other DNA
gaggggcgcttggggtctgg

SEQ ID NO: 81375 - DNA, 20 bp, synthetic construct
  misc_feature 1..20: note = CRISPR gRNA sequence
  source 1..20: mol_type = other DNA
ggggcgcttggggtctgggg

SEQ ID NO: 81376 - DNA, 20 bp, synthetic construct
  misc_feature 1..20: note = CRISPR gRNA sequence
  source 1..20: mol_type = other DNA
gggcgcttggggtctggggg

SEQ ID NO: 81377 - DNA, 20 bp, synthetic construct
  misc_feature 1..20: note = CRISPR gRNA sequence
  source 1..20: mol_type = other DNA
ggtctgggggaggcgtcgcc

SEQ ID NO: 81378 - DNA, 20 bp, synthetic construct
  misc_feature 1..20: note = CRISPR gRNA sequence
  source 1..20: mol_type = other DNA
gtctgggggaggcgtcgccc

SEQ ID NO: 81379 - DNA, 20 bp, synthetic construct
  misc_feature 1..20: note = CRISPR gRNA sequence
  source 1..20: mol_type = other DNA
gggggaggcgtcgcccgggt

SEQ ID NO: 81380 - DNA, 20 bp, synthetic construct
  misc_feature 1..20: note = CRISPR gRNA sequence
  source 1..20: mol_type = other DNA
ccgggtaagcctgtctgctg

SEQ ID NO: 81381 - DNA, 20 bp, synthetic construct
  misc_feature 1..20: note = CRISPR gRNA sequence
  source 1..20: mol_type = other DNA
tgctgcggctctgcttccct

SEQ ID NO: 81382 - DNA, 20 bp, synthetic construct
  misc_feature 1..20: note = CRISPR gRNA sequence
  source 1..20: mol_type = other DNA
cggctctgcttcccttagac

SEQ ID NO: 81383 - DNA, 20 bp, synthetic construct
  misc_feature 1..20: note = CRISPR gRNA sequence
  source 1..20: mol_type = other DNA
gctctgcttcccttagactg

SEQ ID NO: 81384 - DNA, 20 bp, synthetic construct
  misc_feature 1..20: note = CRISPR gRNA sequence
  source 1..20: mol_type = other DNA
tctgcttcccttagactgga

SEQ ID NO: 81385 - DNA, 20 bp, synthetic construct
  misc_feature 1..20: note = CRISPR gRNA sequence
  source 1..20: mol_type = other DNA
tcccttagactggagagctg

SEQ ID NO: 81386 - DNA, 20 bp, synthetic construct
  misc_feature 1..20: note = CRISPR gRNA sequence
  source 1..20: mol_type = other DNA
ggagagctgtggacttcgtc

SEQ ID NO: 81387 - DNA, 20 bp, synthetic construct
  misc_feature 1..20: note = CRISPR gRNA sequence
  source 1..20: mol_type = other DNA
gagagctgtggacttcgtct

SEQ ID NO: 81388 - DNA, 20 bp, synthetic construct
  misc_feature 1..20: note = CRISPR gRNA sequence
  source 1..20: mol_type = other DNA
acttcgtctaggcgcccgct

SEQ ID NO: 81389 - DNA, 20 bp, synthetic construct
  misc_feature 1..20: note = CRISPR gRNA sequence
  source 1..20: mol_type = other DNA
cccgctaagttcgcatgtcc

SEQ ID NO: 81390 - DNA, 20 bp, synthetic construct
  misc_feature 1..20: note = CRISPR gRNA sequence
  source 1..20: mol_type = other DNA
ttcgcatgtcctagcacctc

SEQ ID NO: 81391 - DNA, 20 bp, synthetic construct
  misc_feature 1..20: note = CRISPR gRNA sequence
  source 1..20: mol_type = other DNA
tcgcatgtcctagcacctct

SEQ ID NO: 81392 - DNA, 20 bp, synthetic construct
  misc_feature 1..20: note = CRISPR gRNA sequence
  source 1..20: mol_type = other DNA
ctagcacctctgggtctatg

SEQ ID NO: 81393 - DNA, 20 bp, synthetic construct
  misc_feature 1..20: note = CRISPR gRNA sequence
  source 1..20: mol_type = other DNA
tagcacctctgggtctatgt

SEQ ID NO: 81394 - DNA, 20 bp, synthetic construct
  misc_feature 1..20: note = CRISPR gRNA sequence
  source 1..20: mol_type = other DNA
agcacctctgggtctatgtg

SEQ ID NO: 81395 - DNA, 20 bp, synthetic construct
  misc_feature 1..20: note = CRISPR gRNA sequence
  source 1..20: mol_type = other DNA
gtctatgtggggccacaccg

SEQ ID NO: 81396 - DNA, 20 bp, synthetic construct
  misc_feature 1..20: note = CRISPR gRNA sequence
  source 1..20: mol_type = other DNA
tctatgtggggccacaccgt

SEQ ID NO: 81397 - DNA, 20 bp, synthetic construct
  misc_feature 1..20: note = CRISPR gRNA sequence
  source 1..20: mol_type = other DNA
ctatgtggggccacaccgtg

SEQ ID NO: 81398 - DNA, 20 bp, synthetic construct
  misc_feature 1..20: note = CRISPR gRNA sequence
  source 1..20: mol_type = other DNA
atgtggggccacaccgtggg

SEQ ID NO: 81399 - DNA, 20 bp, synthetic construct
  misc_feature 1..20: note = CRISPR gRNA sequence
  source 1..20: mol_type = other DNA
tgtggggccacaccgtgggg

SEQ ID NO: 81400 - DNA, 20 bp, synthetic construct
  misc_feature 1..20: note = CRISPR gRNA sequence
  source 1..20: mol_type = other DNA
gccacaccgtggggaggaaa

SEQ ID NO: 81401 - DNA, 20 bp, synthetic construct
  misc_feature 1..20: note = CRISPR gRNA sequence
  source 1..20: mol_type = other DNA
gaaacagcacgcgacgtttg

SEQ ID NO: 81402 - DNA, 20 bp, synthetic construct
  misc_feature 1..20: note = CRISPR gRNA sequence
  source 1..20: mol_type = other DNA
cgcgacgtttgtagaatgct

SEQ ID NO: 81403 - DNA, 20 bp, synthetic construct
  misc_feature 1..20: note = CRISPR gRNA sequence
  source 1..20: mol_type = other DNA
gaatgcttggctgtgataca

SEQ ID NO: 81404 - DNA, 20 bp, synthetic construct
  misc_feature 1..20: note = CRISPR gRNA sequence
  source 1..20: mol_type = other DNA
tgcttggctgtgatacaaag

SEQ ID NO: 81405 - DNA, 20 bp, synthetic construct
  misc_feature 1..20: note = CRISPR gRNA sequence
  source 1..20: mol_type = other DNA
tgtcacttttaaaaaattat

SEQ ID NO: 81406 - DNA, 20 bp, synthetic construct
  misc_feature 1..20: note = CRISPR gRNA sequence
  source 1..20: mol_type = other DNA
ttgacatctttctgtgtgcc

SEQ ID NO: 81407 - DNA, 20 bp, synthetic construct
  misc_feature 1..20: note = CRISPR gRNA sequence
  source 1..20: mol_type = other DNA
tgacatctttctgtgtgcca

SEQ ID NO: 81408 - DNA, 20 bp, synthetic construct
  misc_feature 1..20: note = CRISPR gRNA sequence
  source 1..20: mol_type = other DNA
gcgtcatttaattttgaaaa

SEQ ID NO: 81409 - DNA, 20 bp, synthetic construct
  misc_feature 1..20: note = CRISPR gRNA sequence
  source 1..20: mol_type = other DNA
aaaacagttatcttccgcca

SEQ ID NO: 81410 - DNA, 20 bp, synthetic construct
  misc_feature 1..20: note = CRISPR gRNA sequence
  source 1..20: mol_type = other DNA
tccgccatagataactacta

SEQ ID NO: 81411 - DNA, 20 bp, synthetic construct
  misc_feature 1..20: note = CRISPR gRNA sequence
  source 1..20: mol_type = other DNA
tggttatcttctgcctctca

SEQ ID NO: 81412 - DNA, 20 bp, synthetic construct
  misc_feature 1..20: note = CRISPR gRNA sequence
  source 1..20: mol_type = other DNA
tcttctgcctctcacagatg

SEQ ID NO: 81413 - DNA, 20 bp, synthetic construct
  misc_feature 1..20: note = CRISPR gRNA sequence
  source 1..20: mol_type = other DNA
ctctcacagatgaagaaact

SEQ ID NO: 81414 - DNA, 20 bp, synthetic construct
  misc_feature 1..20: note = CRISPR gRNA sequence
  source 1..20: mol_type = other DNA
tctcacagatgaagaaacta

SEQ ID NO: 81415 - DNA, 20 bp, synthetic construct
  misc_feature 1..20: note = CRISPR gRNA sequence
  source 1..20: mol_type = other DNA
gatgaagaaactaaggcacc

SEQ ID NO: 81416 - DNA, 20 bp, synthetic construct
  misc_feature 1..20: note = CRISPR gRNA sequence
  source 1..20: mol_type = other DNA
aactaaggcaccgagatttt

SEQ ID NO: 81417 - DNA, 20 bp, synthetic construct
  misc_feature 1..20: note = CRISPR gRNA sequence
  source 1..20: mol_type = other DNA
ttttaagaaacttaattaca

SEQ ID NO: 81418 - DNA, 20 bp, synthetic construct
  misc_feature 1..20: note = CRISPR gRNA sequence
  source 1..20: mol_type = other DNA
tttaagaaacttaattacac

SEQ ID NO: 81419 - DNA, 20 bp, synthetic construct
  misc_feature 1..20: note = CRISPR gRNA sequence
  source 1..20: mol_type = other DNA
ttaagaaacttaattacaca

SEQ ID NO: 81420 - DNA, 20 bp, synthetic construct
  misc_feature 1..20: note = CRISPR gRNA sequence
  source 1..20: mol_type = other DNA
taagaaacttaattacacag

SEQ ID NO: 81421 - DNA, 20 bp, synthetic construct
  misc_feature 1..20: note = CRISPR gRNA sequence
  source 1..20: mol_type = other DNA
ttaattacacaggggataaa

SEQ ID NO: 81422 - DNA, 20 bp, synthetic construct
  misc_feature 1..20: note = CRISPR gRNA sequence
  source 1..20: mol_type = other DNA
attacacaggggataaatgg

SEQ ID NO: 81423 - DNA, 20 bp, synthetic construct
  misc_feature 1..20: note = CRISPR gRNA sequence
  source 1..20: mol_type = other DNA
ggggataaatggcagcaatc

SEQ ID NO: 81424 - DNA, 20 bp, synthetic construct
  misc_feature 1..20: note = CRISPR gRNA sequence
  source 1..20: mol_type = other DNA
aatggcagcaatcgagattg

SEQ ID NO: 81425 - DNA, 20 bp, synthetic construct
  misc_feature 1..20: note = CRISPR gRNA sequence
  source 1..20: mol_type = other DNA
cagcaatcgagattgaagtc

SEQ ID NO: 81426 - DNA, 20 bp, synthetic construct
  misc_feature 1..20: note = CRISPR gRNA sequence
  source 1..20: mol_type = other DNA
agattgaagtcaagcctaac

SEQ ID NO: 81427 - DNA, 20 bp, synthetic construct
  misc_feature 1..20: note = CRISPR gRNA sequence
  source 1..20: mol_type = other DNA
gattgaagtcaagcctaacc

SEQ ID NO: 81428 - DNA, 20 bp, synthetic construct
  misc_feature 1..20: note = CRISPR gRNA sequence
  source 1..20: mol_type = other DNA
attgaagtcaagcctaacca

SEQ ID NO: 81429 - DNA, 20 bp, synthetic construct
  misc_feature 1..20: note = CRISPR gRNA sequence
  source 1..20: mol_type = other DNA
aagcctaaccagggcttttg

SEQ ID NO: 81430 - DNA, 20 bp, synthetic construct
  misc_feature 1..20: note = CRISPR gRNA sequence
  source 1..20: mol_type = other DNA
agcctaaccagggcttttgc

SEQ ID NO: 81431 - DNA, 20 bp, synthetic construct
  misc_feature 1..20: note = CRISPR gRNA sequence
  source 1..20: mol_type = other DNA
cctaaccagggcttttgcgg

SEQ ID NO: 81432 - DNA, 20 bp, synthetic construct
  misc_feature 1..20: note = CRISPR gRNA sequence
  source 1..20: mol_type = other DNA
ttgcgggagcgcatgccttt

SEQ ID NO: 81433 - DNA, 20 bp, synthetic construct
  misc_feature 1..20: note = CRISPR gRNA sequence
  source 1..20: mol_type = other DNA
taattcgtgcattttttttt

SEQ ID NO: 81434 - DNA, 20 bp, synthetic construct
  misc_feature 1..20: note = CRISPR gRNA sequence
  source 1..20: mol_type = other DNA
aaaacgcctgccttctgcgt

SEQ ID NO: 81435 - DNA, 20 bp, synthetic construct
  misc_feature 1..20: note = CRISPR gRNA sequence
  source 1..20: mol_type = other DNA
gccttctgcgtgagattctc

SEQ ID NO: 81436 - DNA, 20 bp, synthetic construct
  misc_feature 1..20: note = CRISPR gRNA sequence
  source 1..20: mol_type = other DNA
cttctgcgtgagattctcca

SEQ ID NO: 81437 - DNA, 20 bp, synthetic construct
  misc_feature 1..20: note = CRISPR gRNA sequence
  source 1..20: mol_type = other DNA
tgagattctccagagcaaac

SEQ ID NO: 81438 - DNA, 20 bp, synthetic construct
  misc_feature 1..20: note = CRISPR gRNA sequence
  source 1..20: mol_type = other DNA
gagattctccagagcaaact

SEQ ID NO: 81439 - DNA, 20 bp, synthetic construct
  misc_feature 1..20: note = CRISPR gRNA sequence
  source 1..20: mol_type = other DNA
attctccagagcaaactggg

SEQ ID NO: 81440 - DNA, 20 bp, synthetic construct
  misc_feature 1..20: note = CRISPR gRNA sequence
  source 1..20: mol_type = other DNA
ccagagcaaactgggcggca

SEQ ID NO: 81441 - DNA, 20 bp, synthetic construct
  misc_feature 1..20: note = CRISPR gRNA sequence
  source 1..20: mol_type = other DNA
cagagcaaactgggcggcat

SEQ ID NO: 81442 - DNA, 20 bp, synthetic construct
  misc_feature 1..20: note = CRISPR gRNA sequence
  source 1..20: mol_type = other DNA
actgggcggcatgggccctg

SEQ ID NO: 81443 - DNA, 20 bp, synthetic construct
  misc_feature 1..20: note = CRISPR gRNA sequence
  source 1..20: mol_type = other DNA
ggccctgtggtcttttcgta

SEQ ID NO: 81444 - DNA, 20 bp, synthetic construct
  misc_feature 1..20: note = CRISPR gRNA sequence
  source 1..20: mol_type = other DNA
ccctgtggtcttttcgtaca

SEQ ID NO: 81445 - DNA, 20 bp, synthetic construct
  misc_feature 1..20: note = CRISPR gRNA sequence
  source 1..20: mol_type = other DNA
cctgtggtcttttcgtacag

SEQ ID NO: 81446 - DNA, 20 bp, synthetic construct
  misc_feature 1..20: note = CRISPR gRNA sequence
  source 1..20: mol_type = other DNA
ctgtggtcttttcgtacaga

SEQ ID NO: 81447 - DNA, 20 bp, synthetic construct
  misc_feature 1..20: note = CRISPR gRNA sequence
  source 1..20: mol_type = other DNA
cgtacagagggcttcctctt

SEQ ID NO: 81448 - DNA, 20 bp, synthetic construct
  misc_feature 1..20: note = CRISPR gRNA sequence
  source 1..20: mol_type = other DNA
ttcctctttggctctttgcc

SEQ ID NO: 81449 - DNA, 20 bp, synthetic construct
  misc_feature 1..20: note = CRISPR gRNA sequence
  source 1..20: mol_type = other DNA
ctctttgcctggttgtttcc

SEQ ID NO: 81450 - DNA, 20 bp, synthetic construct
  misc_feature 1..20: note = CRISPR gRNA sequence
  source 1..20: mol_type = other DNA
tgtactgtgcctcttacttt

SEQ ID NO: 81451 - DNA, 20 bp, synthetic construct
  misc_feature 1..20: note = CRISPR gRNA sequence
  source 1..20: mol_type = other DNA
actttcggttttgaaaacat

SEQ ID NO: 81452 - DNA, 20 bp, synthetic construct
  misc_feature 1..20: note = CRISPR gRNA sequence
  source 1..20: mol_type = other DNA
ctttcggttttgaaaacatg

SEQ ID NO: 81453 - DNA, 20 bp, synthetic construct
  misc_feature 1..20: note = CRISPR gRNA sequence
  source 1..20: mol_type = other DNA
tttcggttttgaaaacatga

SEQ ID NO: 81454 - DNA, 20 bp, synthetic construct
  misc_feature 1..20: note = CRISPR gRNA sequence
  source 1..20: mol_type = other DNA
ttcggttttgaaaacatgag

SEQ ID NO: 81455 - DNA, 20 bp, synthetic construct
  misc_feature 1..20: note = CRISPR gRNA sequence
  source 1..20: mol_type = other DNA
tcggttttgaaaacatgagg

SEQ ID NO: 81456 - DNA, 20 bp, synthetic construct
  misc_feature 1..20: note = CRISPR gRNA sequence
  source 1..20: mol_type = other DNA
ttttgaaaacatgagggggt

SEQ ID NO: 81457 - DNA, 20 bp, synthetic construct
  misc_feature 1..20: note = CRISPR gRNA sequence
  source 1..20: mol_type = other DNA
tttgaaaacatgagggggtt

SEQ ID NO: 81458 - DNA, 20 bp, synthetic construct
  misc_feature 1..20: note = CRISPR gRNA sequence
  source 1..20: mol_type = other DNA
aaacatgagggggttgggcg

SEQ ID NO: 81459 - DNA, 20 bp, synthetic construct
  misc_feature 1..20: note = CRISPR gRNA sequence
  source 1..20: mol_type = other DNA
catgagggggttgggcgtgg

SEQ ID NO: 81460 - DNA, 20 bp, synthetic construct
  misc_feature 1..20: note = CRISPR gRNA sequence
  source 1..20: mol_type = other DNA
gtagcttacgcctgtaatcc

SEQ ID NO: 81461 - DNA, 20 bp, synthetic construct
  misc_feature 1..20: note = CRISPR gRNA sequence
  source 1..20: mol_type = other DNA
acgcctgtaatcccagcact

SEQ ID NO: 81462 - DNA, 20 bp, synthetic construct
  misc_feature 1..20: note = CRISPR gRNA sequence
  source 1..20: mol_type = other DNA
cgcctgtaatcccagcactt

SEQ ID NO: 81463 - DNA, 20 bp, synthetic construct
  misc_feature 1..20: note = CRISPR gRNA sequence
  source 1..20: mol_type = other DNA
gcctgtaatcccagcactta

SEQ ID NO: 81464 - DNA, 20 bp, synthetic construct
  misc_feature 1..20: note = CRISPR gRNA sequence
  source 1..20: mol_type = other DNA
ctgtaatcccagcacttagg

SEQ ID NO: 81465 - DNA, 20 bp, synthetic construct
  misc_feature 1..20: note = CRISPR gRNA sequence
  source 1..20: mol_type = other DNA
tgtaatcccagcacttaggg

SEQ ID NO: 81466 - DNA, 20 bp, synthetic construct
  misc_feature 1..20: note = CRISPR gRNA sequence
  source 1..20: mol_type = other DNA
tcccagcacttagggaggcc

SEQ ID NO: 81467 - DNA, 20 bp, synthetic construct
  misc_feature 1..20: note = CRISPR gRNA sequence
  source 1..20: mol_type = other DNA
cccagcacttagggaggccg

SEQ ID NO: 81468 - DNA, 20 bp, synthetic construct
  misc_feature 1..20: note = CRISPR gRNA sequence
  source 1..20: mol_type = other DNA
agcacttagggaggccgagg

SEQ ID NO: 81469 - DNA, 20 bp, synthetic construct
  misc_feature 1..20: note = CRISPR gRNA sequence
  source 1..20: mol_type = other DNA
gcacttagggaggccgaggc

SEQ ID NO: 81470 - DNA, 20 bp, synthetic construct
  misc_feature 1..20: note = CRISPR gRNA sequence
  source 1..20: mol_type = other DNA
acttagggaggccgaggcgg

SEQ ID NO: 81471 - DNA, 20 bp, synthetic construct
  misc_feature 1..20: note = CRISPR gRNA sequence
  source 1..20: mol_type = other DNA
cttagggaggccgaggcggg

SEQ ID NO: 81472 - DNA, 20 bp, synthetic construct
  misc_feature 1..20: note = CRISPR gRNA sequence
  source 1..20: mol_type = other DNA
gggaggccgaggcgggagga

SEQ ID NO: 81473 - DNA, 20 bp, synthetic construct
  misc_feature 1..20: note = CRISPR gRNA sequence
  source 1..20: mol_type = other DNA
ccgaggcgggaggatggctt

SEQ ID NO: 81474 - DNA, 20 bp, synthetic construct
  misc_feature 1..20: note = CRISPR gRNA sequence
  source 1..20: mol_type = other DNA
cgaggcgggaggatggcttg

SEQ ID NO: 81475 - DNA, 20 bp, synthetic construct
  misc_feature 1..20: note = CRISPR gRNA sequence
  source 1..20: mol_type = other DNA
ggaggatggcttgaggtccg

SEQ ID NO: 81476 - DNA, 20 bp, synthetic construct
  misc_feature 1..20: note = CRISPR gRNA sequence
  source 1..20: mol_type = other DNA
atggcttgaggtccgtagtt

SEQ ID NO: 81477 - DNA, 20 bp, synthetic construct
  misc_feature 1..20: note = CRISPR gRNA sequence
  source 1..20: mol_type = other DNA
ttgaggtccgtagttgagac

SEQ ID NO: 81478 - DNA, 20 bp, synthetic construct
  misc_feature 1..20: note = CRISPR gRNA sequence
  source 1..20: mol_type = other DNA
gtccgtagttgagaccagcc

SEQ ID NO: 81479 - DNA, 20 bp, synthetic construct
  misc_feature 1..20: note = CRISPR gRNA sequence
  source 1..20: mol_type = other DNA
tgagaccagcctggccaaca

SEQ ID NO: 81480 - DNA, 20 bp, synthetic construct
  misc_feature 1..20: note = CRISPR gRNA sequence
  source 1..20: mol_type = other DNA
ccagcctggccaacatggtg

SEQ ID NO: 81481 - DNA, 20 bp, synthetic construct
  misc_feature 1..20: note = CRISPR gRNA sequence
  source 1..20: mol_type = other DNA
ctggccaacatggtgaagcc

SEQ ID NO: 81482 - DNA, 20 bp, synthetic construct
  misc_feature 1..20: note = CRISPR gRNA sequence
  source 1..20: mol_type = other DNA
caaaaaataataacaaaaat

SEQ ID NO: 81483 - DNA, 20 bp, synthetic construct
  misc_feature 1..20: note = CRISPR gRNA sequence
  source 1..20: mol_type = other DNA
aaataataacaaaaattagc

SEQ ID NO: 81484 - DNA, 20 bp, synthetic construct
  misc_feature 1..20: note = CRISPR gRNA sequence
  source 1..20: mol_type = other DNA
aataataacaaaaattagcc

SEQ ID NO: 81485 - DNA, 20 bp, synthetic construct
  misc_feature 1..20: note = CRISPR gRNA sequence
  source 1..20: mol_type = other DNA
taacaaaaattagccgggtg

SEQ ID NO: 81486 - DNA, 20 bp, synthetic construct
  misc_feature 1..20: note = CRISPR gRNA sequence
  source 1..20: mol_type = other DNA
caaaaattagccgggtgtgg

SEQ ID NO: 81487 - DNA, 20 bp, synthetic construct
  misc_feature 1..20: note = CRISPR gRNA sequence
  source 1..20: mol_type = other DNA
ggtgtggtggctcgtgcctg

SEQ ID NO: 81488 - DNA, 20 bp, synthetic construct
  misc_feature 1..20: note = CRISPR gRNA sequence
  source 1..20: mol_type = other DNA
gtggctcgtgcctgtggtcc

SEQ ID NO: 81489 - DNA, 20 bp, synthetic construct
  misc_feature 1..20: note = CRISPR gRNA sequence
  source 1..20: mol_type = other DNA
gcctgtggtcccagctgctc

SEQ ID NO: 81490 - DNA, 20 bp, synthetic construct
  misc_feature 1..20: note = CRISPR gRNA sequence
  source 1..20: mol_type = other DNA
tgtggtcccagctgctccgg

SEQ ID NO: 81491 - DNA, 20 bp, synthetic construct
  misc_feature 1..20: note = CRISPR gRNA sequence
  source 1..20: mol_type = other DNA
tcccagctgctccggtggct

SEQ ID NO: 81492 - DNA, 20 bp, synthetic construct
  misc_feature 1..20: note = CRISPR gRNA sequence
  source 1..20: mol_type = other DNA
cccagctgctccggtggctg

SEQ ID NO: 81493 - DNA, 20 bp, synthetic construct
  misc_feature 1..20: note = CRISPR gRNA sequence
  source 1..20: mol_type = other DNA
agctgctccggtggctgagg

SEQ ID NO: 81494 - DNA, 20 bp, synthetic construct
  misc_feature 1..20: note = CRISPR gRNA sequence
  source 1..20: mol_type = other DNA
gctgctccggtggctgaggc

SEQ ID NO: 81495 - DNA, 20 bp, synthetic construct
  misc_feature 1..20: note = CRISPR gRNA sequence
  source 1..20: mol_type = other DNA
tgctccggtggctgaggcgg

SEQ ID NO: 81496 - DNA, 20 bp, synthetic construct
  misc_feature 1..20: note = CRISPR gRNA sequence
  source 1..20: mol_type = other DNA
gctccggtggctgaggcggg

SEQ ID NO: 81497 - DNA, 20 bp, synthetic construct
  misc_feature 1..20: note = CRISPR gRNA sequence
  source 1..20: mol_type = other DNA
ctgaggcgggaggatctctt

SEQ ID NO: 81498 - DNA, 20 bp, synthetic construct
  misc_feature 1..20: note = CRISPR gRNA sequence
  source 1..20: mol_type = other DNA
gcgggaggatctcttgagct

SEQ ID NO: 81499 - DNA, 20 bp, synthetic construct
  misc_feature 1..20: note = CRISPR gRNA sequence
  source 1..20: mol_type = other DNA
cgggaggatctcttgagctt

SEQ ID NO: 81500 - DNA, 20 bp, synthetic construct
  misc_feature 1..20: note = CRISPR gRNA sequence
  source 1..20: mol_type = other DNA
tctcttgagcttaggctttt

SEQ ID NO: 81501 - DNA, 20 bp, synthetic construct
  misc_feature 1..20: note = CRISPR gRNA sequence
  source 1..20: mol_type = other DNA
cttaggcttttgagctatca

SEQ ID NO: 81502 - DNA, 20 bp, synthetic construct
  misc_feature 1..20: note = CRISPR gRNA sequence
  source 1..20: mol_type = other DNA
cttttgagctatcatggcgc

SEQ ID NO: 81503 - DNA, 20 bp, synthetic construct
  misc_feature 1..20: note = CRISPR gRNA sequence
  source 1..20: mol_type = other DNA
atcatggcgccagtgcactc

SEQ ID NO: 81504 - DNA, 20 bp, synthetic construct
  misc_feature 1..20: note = CRISPR gRNA sequence
  source 1..20: mol_type = other DNA
ggcgccagtgcactccagcg

SEQ ID NO: 81505 - DNA, 20 bp, synthetic construct
  misc_feature 1..20: note = CRISPR gRNA sequence
  source 1..20: mol_type = other DNA
gcgccagtgcactccagcgt

SEQ ID NO: 81506 - DNA, 20 bp, synthetic construct
  misc_feature 1..20: note = CRISPR gRNA sequence
  source 1..20: mol_type = other DNA
gtgcactccagcgtgggcaa

SEQ ID NO: 81507 - DNA, 20 bp, synthetic construct
  misc_feature 1..20: note = CRISPR gRNA sequence
  source 1..20: mol_type = other DNA
gcactccagcgtgggcaaca

SEQ ID NO: 81508 - DNA, 20 bp, synthetic construct
  misc_feature 1..20: note = CRISPR gRNA sequence
  source 1..20: mol_type = other DNA
tccagcgtgggcaacagagc

SEQ ID NO: 81509 - DNA, 20 bp, synthetic construct
  misc_feature 1..20: note = CRISPR gRNA sequence
  source 1..20: mol_type = other DNA
cgagaccctgtctctcaaaa

SEQ ID NO: 81510 - DNA, 20 bp, synthetic construct
  misc_feature 1..20: note = CRISPR gRNA sequence
  source 1..20: mol_type = other DNA
aaaaaagaaaaaaaaaaaaa

SEQ ID NO: 81511 - DNA, 20 bp, synthetic construct
  misc_feature 1..20: note = CRISPR gRNA sequence
  source 1..20: mol_type = other DNA
aagaaaaaaaaaaaaaaaga

SEQ ID NO: 81512 - DNA, 20 bp, synthetic construct
  misc_feature 1..20: note = CRISPR gRNA sequence
  source 1..20: mol_type = other DNA
gaaaaaaaaaaaaaaagaaa

SEQ ID NO: 81513 - DNA, 20 bp, synthetic construct
  misc_feature 1..20: note = CRISPR gRNA sequence
  source 1..20: mol_type = other DNA
aaaaaaaaaaagaaagagaa

SEQ ID NO: 81514 - DNA, 20 bp, synthetic construct
  misc_feature 1..20: note = CRISPR gRNA sequence
  source 1..20: mol_type = other DNA
aaaaaagaaagagaaaagaa

SEQ ID NO: 81515 - DNA, 20 bp, synthetic construct
  misc_feature 1..20: note = CRISPR gRNA sequence
  source 1..20: mol_type = other DNA
aagaaagagaaaagaaaaga

SEQ ID NO: 81516 - DNA, 20 bp, synthetic construct
  misc_feature 1..20: note = CRISPR gRNA sequence
  source 1..20: mol_type = other DNA
aagagaaaagaaaagaaaga

SEQ ID NO: 81517 - DNA, 20 bp, synthetic construct
  misc_feature 1..20: note = CRISPR gRNA sequence
  source 1..20: mol_type = other DNA
agaaaagaaaagaaagaaag

SEQ ID NO: 81518 - DNA, 20 bp, synthetic construct
  misc_feature 1..20: note = CRISPR gRNA sequence
  source 1..20: mol_type = other DNA
agaaaagaaagaaagaagtg

SEQ ID NO: 81519 - DNA, 20 bp, synthetic construct
  misc_feature 1..20: note = CRISPR gRNA sequence
  source 1..20: mol_type = other DNA
gaaaagaaagaaagaagtga

SEQ ID NO: 81520 - DNA, 20 bp, synthetic construct
  misc_feature 1..20: note = CRISPR gRNA sequence
  source 1..20: mol_type = other DNA
agaaagaagtgaaggtttgt

SEQ ID NO: 81521 - DNA, 20 bp, synthetic construct
  misc_feature 1..20: note = CRISPR gRNA sequence
  source 1..20: mol_type = other DNA
agaagtgaaggtttgtcagt

SEQ ID NO: 81522 - DNA, 20 bp, synthetic construct
  misc_feature 1..20: note = CRISPR gRNA sequence
  source 1..20: mol_type = other DNA
gaagtgaaggtttgtcagtc

SEQ ID NO: 81523 - DNA, 20 bp, synthetic construct
  misc_feature 1..20: note = CRISPR gRNA sequence
  source 1..20: mol_type = other DNA
aagtgaaggtttgtcagtca

SEQ ID NO: 81524 - DNA, 20 bp, synthetic construct
  misc_feature 1..20: note = CRISPR gRNA sequence
  source 1..20: mol_type = other DNA
agtgaaggtttgtcagtcag

SEQ ID NO: 81525 - DNA, 20 bp, synthetic construct
  misc_feature 1..20: note = CRISPR gRNA sequence
  source 1..20: mol_type = other DNA
tgaaggtttgtcagtcaggg

SEQ ID NO: 81526 - DNA, 20 bp, synthetic construct
  misc_feature 1..20: note = CRISPR gRNA sequence
  source 1..20: mol_type = other DNA
gagctgtaaaaccattaata

SEQ ID NO: 81527 - DNA, 20 bp, synthetic construct
  misc_feature 1..20: note = CRISPR gRNA sequence
  source 1..20: mol_type = other DNA
accattaataaagataatcc

SEQ ID NO: 81528 - DNA, 20 bp, synthetic construct
  misc_feature 1..20: note = CRISPR gRNA sequence
  source 1..20: mol_type = other DNA
ttaataaagataatccaaga

SEQ ID NO: 81529 - DNA, 20 bp, synthetic construct
  misc_feature 1..20: note = CRISPR gRNA sequence
  source 1..20: mol_type = other DNA
gataatccaagatggttacc

SEQ ID NO: 81530 - DNA, 20 bp, synthetic construct
  misc_feature 1..20: note = CRISPR gRNA sequence
  source 1..20: mol_type = other DNA
agatggttaccaagactgtt

SEQ ID NO: 81531 - DNA, 20 bp, synthetic construct
  misc_feature 1..20: note = CRISPR gRNA sequence
  source 1..20: mol_type = other DNA
gatggttaccaagactgttg

SEQ ID NO: 81532 - DNA, 20 bp, synthetic construct
  misc_feature 1..20: note = CRISPR gRNA sequence
  source 1..20: mol_type = other DNA
accaagactgttgaggacgc

SEQ ID NO: 81533 - DNA, 20 bp, synthetic construct
  misc_feature 1..20: note = CRISPR gRNA sequence
  source 1..20: mol_type = other DNA
caagactgttgaggacgcca

SEQ ID NO: 81534 - DNA, 20 bp, synthetic construct
  misc_feature 1..20: note = CRISPR gRNA sequence
  source 1..20: mol_type = other DNA
ttgaggacgccagagatctt

SEQ ID NO: 81535 - DNA, 20 bp, synthetic construct
  misc_feature 1..20: note = CRISPR gRNA sequence
  source 1..20: mol_type = other DNA
agagatcttgagcactttct

SEQ ID NO: 81536 - DNA, 20 bp, synthetic construct
  misc_feature 1..20: note = CRISPR gRNA sequence
  source 1..20: mol_type = other DNA
ttgagcactttctaagtacc

SEQ ID NO: 81537 - DNA, 20 bp, synthetic construct
  misc_feature 1..20: note = CRISPR gRNA sequence
  source 1..20: mol_type = other DNA
taagtacctggcaatacact

SEQ ID NO: 81538 - DNA, 20 bp, synthetic construct
  misc_feature 1..20: note = CRISPR gRNA sequence
  source 1..20: mol_type = other DNA
agcgcgctcaccttttcctc

SEQ ID NO: 81539 - DNA, 20 bp, synthetic construct
  misc_feature 1..20: note = CRISPR gRNA sequence
  source 1..20: mol_type = other DNA
ctctggcaaaacatgatcga

SEQ ID NO: 81540 - DNA, 20 bp, synthetic construct
  misc_feature 1..20: note = CRISPR gRNA sequence
  source 1..20: mol_type = other DNA
tggcaaaacatgatcgaaag

SEQ ID NO: 81541 - DNA, 20 bp, synthetic construct
  misc_feature 1..20: note = CRISPR gRNA sequence
  source 1..20: mol_type = other DNA
aagcagaatgttttgatcat

SEQ ID NO: 81542 - DNA, 20 bp, synthetic construct
  misc_feature 1..20: note = CRISPR gRNA sequence
  source 1..20: mol_type = other DNA
tacaatttatttacaacata

SEQ ID NO: 81543 - DNA, 20 bp, synthetic construct
  misc_feature 1..20: note = CRISPR gRNA sequence
  source 1..20: mol_type = other DNA
acaatttatttacaacataa

SEQ ID NO: 81544 - DNA, 20 bp, synthetic construct
  misc_feature 1..20: note = CRISPR gRNA sequence
  source 1..20: mol_type = other DNA
gtatatatcaccaccattac

SEQ ID NO: 81545 - DNA, 20 bp, synthetic construct
  misc_feature 1..20: note = CRISPR gRNA sequence
  source 1..20: mol_type = other DNA
ccaccattactggtatttgc

SEQ ID NO: 81546 - DNA, 20 bp, synthetic construct
  misc_feature 1..20: note = CRISPR gRNA sequence
  source 1..20: mol_type = other DNA
ctggtatttgctggttatgt

SEQ ID NO: 81547 - DNA, 20 bp, synthetic construct
  misc_feature 1..20: note = CRISPR gRNA sequence
  source 1..20: mol_type = other DNA
tcttattttgaaaatttcca

SEQ ID NO: 81548 - DNA, 20 bp, synthetic construct
  misc_feature 1..20: note = CRISPR gRNA sequence
  source 1..20: mol_type = other DNA
aaagtaatacatgccatgca

SEQ ID NO: 81549 - DNA, 20 bp, synthetic construct
  misc_feature 1..20: note = CRISPR gRNA sequence
  source 1..20: mol_type = other DNA
tgccatgcatagaccatttc

SEQ ID NO: 81550 - DNA, 20 bp, synthetic construct
  misc_feature 1..20: note = CRISPR gRNA sequence
  source 1..20: mol_type = other DNA
catgcatagaccatttctgg

SEQ ID NO: 81551 - DNA, 20 bp, synthetic construct
  misc_feature 1..20: note = CRISPR gRNA sequence
  source 1..20: mol_type = other DNA
ccatttctggaagataccac

SEQ ID NO: 81552 - DNA, 20 bp, synthetic construct
  misc_feature 1..20: note = CRISPR gRNA sequence
  source 1..20: mol_type = other DNA
tgtaatgatgattgcctctg

SEQ ID NO: 81553 - DNA, 20 bp, synthetic construct
  misc_feature 1..20: note = CRISPR gRNA sequence
  source 1..20: mol_type = other DNA
gtaatgatgattgcctctga

SEQ ID NO: 81554 - DNA, 20 bp, synthetic construct
  misc_feature 1..20: note = CRISPR gRNA sequence
  source 1..20: mol_type = other DNA
ttcctcctctgacctgtgtg

SEQ ID NO: 81555 - DNA, 20 bp, synthetic construct
  misc_feature 1..20: note = CRISPR gRNA sequence
  source 1..20: mol_type = other DNA
tcctcctctgacctgtgtgt

SEQ ID NO: 81556 - DNA, 20 bp, synthetic construct
  misc_feature 1..20: note = CRISPR gRNA sequence
  source 1..20: mol_type = other DNA
gttttgtttttgttttactg

SEQ ID NO: 81557 - DNA, 20 bp, synthetic construct
  misc_feature 1..20: note = CRISPR gRNA sequence
  source 1..20: mol_type = other DNA
ttttgtttttgttttactgt

SEQ ID NO: 81558 - DNA, 20 bp, synthetic construct
  misc_feature 1..20: note = CRISPR gRNA sequence
  source 1..20: mol_type = other DNA
gtgggcataaattaattttt

SEQ ID NO: 81559 - DNA, 20 bp, synthetic construct
  misc_feature 1..20: note = CRISPR gRNA sequence
  source 1..20: mol_type = other DNA
cataaattaatttttcagtt

SEQ ID NO: 81560 - DNA, 20 bp, synthetic construct
  misc_feature 1..20: note = CRISPR gRNA sequence
  source 1..20: mol_type = other DNA
ttaatttttcagttaagttt

SEQ ID NO: 81561 - DNA, 20 bp, synthetic construct
  misc_feature 1..20: note = CRISPR gRNA sequence
  source 1..20: mol_type = other DNA
atttttcagttaagttttgg

SEQ ID NO: 81562 - DNA, 20 bp, synthetic construct
  misc_feature 1..20: note = CRISPR gRNA sequence
  source 1..20: mol_type = other DNA
aagcttaaataactctccaa

SEQ ID NO: 81563 - DNA, 20 bp, synthetic construct
  misc_feature 1..20: note = CRISPR gRNA sequence
  source 1..20: mol_type = other DNA
ataactctccaaaagtcata

SEQ ID NO: 81564 - DNA, 20 bp, synthetic construct
  misc_feature 1..20: note = CRISPR gRNA sequence
  source 1..20: mol_type = other DNA
ctctccaaaagtcataaagc

SEQ ID NO: 81565 - DNA, 20 bp, synthetic construct
  misc_feature 1..20: note = CRISPR gRNA sequence
  source 1..20: mol_type = other DNA
aaagtcataaagccagtaac

SEQ ID NO: 81566 - DNA, 20 bp, synthetic construct
  misc_feature 1..20: note = CRISPR gRNA sequence
  source 1..20: mol_type = other DNA
cataaagccagtaactggtt

SEQ ID NO: 81567 - DNA, 20 bp, synthetic construct
  misc_feature 1..20: note = CRISPR gRNA sequence
  source 1..20: mol_type = other DNA
gttgagcccaaattcaaacc

SEQ ID NO: 81568 - DNA, 20 bp, synthetic construct
  misc_feature 1..20: note = CRISPR gRNA sequence
  source 1..20: mol_type = other DNA
tctgatacttgtcctcttct

SEQ ID NO: 81569 - DNA, 20 bp, synthetic construct
  misc_feature 1..20: note = CRISPR gRNA sequence
  source 1..20: mol_type = other DNA
tacttgtcctcttcttagaa

SEQ ID NO: 81570 - DNA, 20 bp, synthetic construct
  misc_feature 1..20: note = CRISPR gRNA sequence
  source 1..20: mol_type = other DNA
cctcttcttagaaaagatta

SEQ ID NO: 81571 - DNA, 20 bp, synthetic construct
  misc_feature 1..20: note = CRISPR gRNA sequence
  source 1..20: mol_type = other DNA
tcttgccgccttccctcaaa

SEQ ID NO: 81572 - DNA, 20 bp, synthetic construct
  misc_feature 1..20: note = CRISPR gRNA sequence
  source 1..20: mol_type = other DNA
ttgccgccttccctcaaaca

SEQ ID NO: 81573 - DNA, 20 bp, synthetic construct
  misc_feature 1..20: note = CRISPR gRNA sequence
  source 1..20: mol_type = other DNA
gccgccttccctcaaacaga

SEQ ID NO: 81574 - DNA, 20 bp, synthetic construct
  misc_feature 1..20: note = CRISPR gRNA sequence
  source 1..20: mol_type = other DNA
ttccctcaaacagagagttc

SEQ ID NO: 81575 - DNA, 20 bp, synthetic construct
  misc_feature 1..20: note = CRISPR gRNA sequence
  source 1..20: mol_type = other DNA
tccctcaaacagagagttcc

SEQ ID NO: 81576 - DNA, 20 bp, synthetic construct
  misc_feature 1..20: note = CRISPR gRNA sequence
  source 1..20: mol_type = other DNA
ctcaaacagagagttccagg

SEQ ID NO: 81577 - DNA, 20 bp, synthetic construct
  misc_feature 1..20: note = CRISPR gRNA sequence
  source 1..20: mol_type = other DNA
tcaaacagagagttccaggc

SEQ ID NO: 81578 - DNA, 20 bp, synthetic construct
  misc_feature 1..20: note = CRISPR gRNA sequence
  source 1..20: mol_type = other DNA
gaatctgtgctctgatccct

SEQ ID NO: 81579 - DNA, 20 bp, synthetic construct
  misc_feature 1..20: note = CRISPR gRNA sequence
  source 1..20: mol_type = other DNA
aatctgtgctctgatccctg

SEQ ID NO: 81580 - DNA, 20 bp, synthetic construct
  misc_feature 1..20: note = CRISPR gRNA sequence
  source 1..20: mol_type = other DNA
atttaatatgttcttattat

SEQ ID NO: 81581 - DNA, 20 bp, synthetic construct
  misc_feature 1..20: note = CRISPR gRNA sequence
  source 1..20: mol_type = other DNA
taatatgttcttattattag

SEQ ID NO: 81582 - DNA, 20 bp, synthetic construct
  misc_feature 1..20: note = CRISPR gRNA sequence
  source 1..20: mol_type = other DNA
tgttcttattattagaagct

SEQ ID NO: 81583 - DNA, 20 bp, synthetic construct
  misc_feature 1..20: note = CRISPR gRNA sequence
  source 1..20: mol_type = other DNA
ttattagaagctcagatgca

SEQ ID NO: 81584 - DNA, 20 bp, synthetic construct
  misc_feature 1..20: note = CRISPR gRNA sequence
  source 1..20: mol_type = other DNA
attagaagctcagatgcaaa

SEQ ID NO: 81585 - DNA, 20 bp, synthetic construct
  misc_feature 1..20: note = CRISPR gRNA sequence
  source 1..20: mol_type = other DNA
tcagatgcaaagagctctct

SEQ ID NO: 81586 - DNA, 20 bp, synthetic construct
  misc_feature 1..20: note = CRISPR gRNA sequence
  source 1..20: mol_type = other DNA
tttaatgttatgaaaaaaat

SEQ ID NO: 81587 - DNA, 20 bp, synthetic construct
  misc_feature 1..20: note = CRISPR gRNA sequence
  source 1..20: mol_type = other DNA
ttaatgttatgaaaaaaatc

SEQ ID NO: 81588 - DNA, 20 bp, synthetic construct
  misc_feature 1..20: note = CRISPR gRNA sequence
  source 1..20: mol_type = other DNA
gaaaaaaatcaggtcttcat

SEQ ID NO: 81589 - DNA, 20 bp, synthetic construct
  misc_feature 1..20: note = CRISPR gRNA sequence
  source 1..20: mol_type = other DNA
ttccccaatccacctcttga

SEQ ID NO: 81590 - DNA, 20 bp, synthetic construct
  misc_feature 1..20: note = CRISPR gRNA sequence
  source 1..20: mol_type = other DNA
tccccaatccacctcttgat

SEQ ID NO: 81591 - DNA, 20 bp, synthetic construct
  misc_feature 1..20: note = CRISPR gRNA sequence
  source 1..20: mol_type = other DNA
ccccaatccacctcttgatg

SEQ ID NO: 81592 - DNA, 20 bp, synthetic construct
  misc_feature 1..20: note = CRISPR gRNA sequence
  source 1..20: mol_type = other DNA
aatccacctcttgatggggc

SEQ ID NO: 81593 - DNA, 20 bp, synthetic construct
  misc_feature 1..20: note = CRISPR gRNA sequence
  source 1..20: mol_type = other DNA
ccacctcttgatggggctag

SEQ ID NO: 81594 - DNA, 20 bp, synthetic construct
  misc_feature 1..20: note = CRISPR gRNA sequence
  source 1..20: mol_type = other DNA
tagtagcctttccttaatga

SEQ ID NO: 81595 - DNA, 20 bp, synthetic construct
  misc_feature 1..20: note = CRISPR gRNA sequence
  source 1..20: mol_type = other DNA
agtagcctttccttaatgat

SEQ ID NO: 81596 - DNA, 20 bp, synthetic construct
  misc_feature 1..20: note = CRISPR gRNA sequence
  source 1..20: mol_type = other DNA
gtagcctttccttaatgata

SEQ ID NO: 81597 - DNA, 20 bp, synthetic construct
  misc_feature 1..20: note = CRISPR gRNA sequence
  source 1..20: mol_type = other DNA
ccttaatgatagggtgtttc

SEQ ID NO: 81598 - DNA, 20 bp, synthetic construct
  misc_feature 1..20: note = CRISPR gRNA sequence
  source 1..20: mol_type = other DNA
ttaatgatagggtgtttcta

SEQ ID NO: 81599 - DNA, 20 bp, synthetic construct
  misc_feature 1..20: note = CRISPR gRNA sequence
  source 1..20: mol_type = other DNA
aatgatagggtgtttctaga

SEQ ID NO: 81600 - DNA, 20 bp, synthetic construct
  misc_feature 1..20: note = CRISPR gRNA sequence
  source 1..20: mol_type = other DNA
tgtttctagagagatatatc

SEQ ID NO: 81601 - DNA, 20 bp, synthetic construct
  misc_feature 1..20: note = CRISPR gRNA sequence
  source 1..20: mol_type = other DNA
ctagagagatatatctggtc

SEQ ID NO: 81602 - DNA, 20 bp, synthetic construct
  misc_feature 1..20: note = CRISPR gRNA sequence
  source 1..20: mol_type = other DNA
tagagagatatatctggtca

SEQ ID NO: 81603 - DNA, 20 bp, synthetic construct
  misc_feature 1..20: note = CRISPR gRNA sequence
  source 1..20: mol_type = other DNA
agagatatatctggtcaagg

SEQ ID NO: 81604 - DNA, 20 bp, synthetic construct
  misc_feature 1..20: note = CRISPR gRNA sequence
  source 1..20: mol_type = other DNA
tatatctggtcaaggtggcc

SEQ ID NO: 81605 - DNA, 20 bp, synthetic construct
  misc_feature 1..20: note = CRISPR gRNA sequence
  source 1..20: mol_type = other DNA
ggtactcctccttctcccca

SEQ ID NO: 81606 - DNA, 20 bp, synthetic construct
  misc_feature 1..20: note = CRISPR gRNA sequence
  source 1..20: mol_type = other DNA
tccttctccccacagcctcc

SEQ ID NO: 81607 - DNA, 20 bp, synthetic construct
  misc_feature 1..20: note = CRISPR gRNA sequence
  source 1..20: mol_type = other DNA
ctccccacagcctcccagac

SEQ ID NO: 81608 - DNA, 20 bp, synthetic construct
  misc_feature 1..20: note = CRISPR gRNA sequence
  source 1..20: mol_type = other DNA
tccccacagcctcccagaca

SEQ ID NO: 81609 - DNA, 20 bp, synthetic construct
  misc_feature 1..20: note = CRISPR gRNA sequence
  source 1..20: mol_type = other DNA
cccacagcctcccagacaag

SEQ ID NO: 81610 - DNA, 20 bp, synthetic construct
  misc_feature 1..20: note = CRISPR gRNA sequence
  source 1..20: mol_type = other DNA
ccacagcctcccagacaagg

SEQ ID NO: 81611 - DNA, 20 bp, synthetic construct
  misc_feature 1..20: note = CRISPR gRNA sequence
  source 1..20: mol_type = other DNA
acagcctcccagacaaggag

SEQ ID NO: 81612 - DNA, 20 bp, synthetic construct
  misc_feature 1..20: note = CRISPR gRNA sequence
  source 1..20: mol_type = other DNA
gcctcccagacaaggaggag

SEQ ID NO: 81613 - DNA, 20 bp, synthetic construct
  misc_feature 1..20: note = CRISPR gRNA sequence
  source 1..20: mol_type = other DNA
aaggaggagtagctgccttt

SEQ ID NO: 81614 - DNA, 20 bp, synthetic construct
  misc_feature 1..20: note = CRISPR gRNA sequence
  source 1..20: mol_type = other DNA
tgatcatgtaccctgaatat

SEQ ID NO: 81615 - DNA, 20 bp, synthetic construct
  misc_feature 1..20: note = CRISPR gRNA sequence
  source 1..20: mol_type = other DNA
ctgaatataagtgtatttaa

SEQ ID NO: 81616 - DNA, 20 bp, synthetic construct
  misc_feature 1..20: note = CRISPR gRNA sequence
  source 1..20: mol_type = other DNA
gaattttatacacatatatt

SEQ ID NO: 81617 - DNA, 20 bp, synthetic construct
  misc_feature 1..20: note = CRISPR gRNA sequence
  source 1..20: mol_type = other DNA
ttagtgtcaatctgtatatt

SEQ ID NO: 81618 - DNA, 20 bp, synthetic construct
  misc_feature 1..20: note = CRISPR gRNA sequence
  source 1..20: mol_type = other DNA
gtgtcaatctgtatatttag

SEQ ID NO: 81619 - DNA, 20 bp, synthetic construct
  misc_feature 1..20: note = CRISPR gRNA sequence
  source 1..20: mol_type = other DNA
ttcattttcaatgaaaaata

SEQ ID NO: 81620 - DNA, 20 bp, synthetic construct
  misc_feature 1..20: note = CRISPR gRNA sequence
  source 1..20: mol_type = other DNA
cattttcaatgaaaaatata

SEQ ID NO: 81621 - DNA, 20 bp, synthetic construct
  misc_feature 1..20: note = CRISPR gRNA sequence
  source 1..20: mol_type = other DNA
attttcttcccacttcccca

SEQ ID NO: 81622 - DNA, 20 bp, synthetic construct
  misc_feature 1..20: note = CRISPR gRNA sequence
  source 1..20: mol_type = other DNA
tcttcccacttccccatgga

SEQ ID NO: 81623 - DNA, 20 bp, synthetic construct
  misc_feature 1..20: note = CRISPR gRNA sequence
  source 1..20: mol_type = other DNA
ccacttccccatggatggtc

SEQ ID NO: 81624 - DNA, 20 bp, synthetic construct
  misc_feature 1..20: note = CRISPR gRNA sequence
  source 1..20: mol_type = other DNA
tctagtcatgcctctcattt

SEQ ID NO: 81625 - DNA, 20 bp, synthetic construct
  misc_feature 1..20: note = CRISPR gRNA sequence
  source 1..20: mol_type = other DNA
gtcatgcctctcattttgga

SEQ ID NO: 81626 - DNA, 20 bp, synthetic construct
  misc_feature 1..20: note = CRISPR gRNA sequence
  source 1..20: mol_type = other DNA
aagtactgtttctgaaacat

SEQ ID NO: 81627 - DNA, 20 bp, synthetic construct
  misc_feature 1..20: note = CRISPR gRNA sequence
  source 1..20: mol_type = other DNA
agtactgtttctgaaacatt

SEQ ID NO: 81628 - DNA, 20 bp, synthetic construct
  misc_feature 1..20: note = CRISPR gRNA sequence
  source 1..20: mol_type = other DNA
taggcaatatattcccaacc

SEQ ID NO: 81629 - DNA, 20 bp, synthetic construct
  misc_feature 1..20: note = CRISPR gRNA sequence
  source 1..20: mol_type = other DNA
caatatattcccaacctggc

SEQ ID NO: 81630 - DNA, 20 bp, synthetic construct
  misc_feature 1..20: note = CRISPR gRNA sequence
  source 1..20: mol_type = other DNA
ttcccaacctggctagttta

SEQ ID NO: 81631 - DNA, 20 bp, synthetic construct
  misc_feature 1..20: note = CRISPR gRNA sequence
  source 1..20: mol_type = other DNA
tagtttacagcaatcacctg

SEQ ID NO: 81632 - DNA, 20 bp, synthetic construct
  misc_feature 1..20: note = CRISPR gRNA sequence
  source 1..20: mol_type = other DNA
attactccatttgatcataa

SEQ ID NO: 81633 - DNA, 20 bp, synthetic construct
  misc_feature 1..20: note = CRISPR gRNA sequence
  source 1..20: mol_type = other DNA
ctccatttgatcataatgga

SEQ ID NO: 81634 - DNA, 20 bp, synthetic construct
  misc_feature 1..20: note = CRISPR gRNA sequence
  source 1..20: mol_type = other DNA
atgttctgtcccatttgcca

SEQ ID NO: 81635 - DNA, 20 bp, synthetic construct
  misc_feature 1..20: note = CRISPR gRNA sequence
  source 1..20: mol_type = other DNA
ctatccctgttgtattttat

SEQ ID NO: 81636 - DNA, 20 bp, synthetic construct
  misc_feature 1..20: note = CRISPR gRNA sequence
  source 1..20: mol_type = other DNA
tatccctgttgtattttatc

SEQ ID NO: 81637 - DNA, 20 bp, synthetic construct
  misc_feature 1..20: note = CRISPR gRNA sequence
  source 1..20: mol_type = other DNA
cgggtccaactcaaccattt

SEQ ID NO: 81638 - DNA, 20 bp, synthetic construct
  misc_feature 1..20: note = CRISPR gRNA sequence
  source 1..20: mol_type = other DNA
gggtccaactcaaccattta

SEQ ID NO: 81639 - DNA, 20 bp, synthetic construct
  misc_feature 1..20: note = CRISPR gRNA sequence
  source 1..20: mol_type = other DNA
caaccatttaaggtatttgc

SEQ ID NO: 81640 - DNA, 20 bp, synthetic construct
  misc_feature 1..20: note = CRISPR gRNA sequence
  source 1..20: mol_type = other DNA
tgccagctcttgtatgcatt

SEQ ID NO: 81641 - DNA, 20 bp, synthetic construct
  misc_feature 1..20: note = CRISPR gRNA sequence
  source 1..20: mol_type = other DNA
gccagctcttgtatgcattt

SEQ ID NO: 81642 - DNA, 20 bp, synthetic construct
  misc_feature 1..20: note = CRISPR gRNA sequence
  source 1..20: mol_type = other DNA
ggttttgtttctttgttttt

SEQ ID NO: 81643 - DNA, 20 bp, synthetic construct
  misc_feature 1..20: note = CRISPR gRNA sequence
  source 1..20: mol_type = other DNA
tgttttttagctcatgaaat

SEQ ID NO: 81644 - DNA, 20 bp, synthetic construct
  misc_feature 1..20: note = CRISPR gRNA sequence
  source 1..20: mol_type = other DNA
gttttttagctcatgaaatt

SEQ ID NO: 81645 - DNA, 20 bp, synthetic construct
  misc_feature 1..20: note = CRISPR gRNA sequence
  source 1..20: mol_type = other DNA
agctcatgaaattaggtaca

SEQ ID NO: 81646 - DNA, 20 bp, synthetic construct
  misc_feature 1..20: note = CRISPR gRNA sequence
  source 1..20: mol_type = other DNA
catgaaattaggtacaaagt

SEQ ID NO: 81647 - DNA, 20 bp, synthetic construct
  misc_feature 1..20: note = CRISPR gRNA sequence
  source 1..20: mol_type = other DNA
tgaaattaggtacaaagtca

SEQ ID NO: 81648 - DNA, 20 bp, synthetic construct
  misc_feature 1..20: note = CRISPR gRNA sequence
  source 1..20: mol_type = other DNA
aaattaggtacaaagtcaga

SEQ ID NO: 81649 - DNA, 20 bp, synthetic construct
  misc_feature 1..20: note = CRISPR gRNA sequence
  source 1..20: mol_type = other DNA
aattaggtacaaagtcagag

SEQ ID NO: 81650 - DNA, 20 bp, synthetic construct
  misc_feature 1..20: note = CRISPR gRNA sequence
  source 1..20: mol_type = other DNA
attaggtacaaagtcagaga

SEQ ID NO: 81651 - DNA, 20 bp, synthetic construct
  misc_feature 1..20: note = CRISPR gRNA sequence
  source 1..20: mol_type = other DNA
ttaggtacaaagtcagagag

SEQ ID NO: 81652 - DNA, 20 bp, synthetic construct
  misc_feature 1..20: note = CRISPR gRNA sequence
  source 1..20: mol_type = other DNA
tacaaagtcagagaggggtc

SEQ ID NO: 81653 - DNA, 20 bp, synthetic construct
  misc_feature 1..20: note = CRISPR gRNA sequence
  source 1..20: mol_type = other DNA
gggtctggcatataaaacct

SEQ ID NO: 81654 - DNA, 20 bp, synthetic construct
  misc_feature 1..20: note = CRISPR gRNA sequence
  source 1..20: mol_type = other DNA
tctggcatataaaacctcag

SEQ ID NO: 81655 - DNA, 20 bp, synthetic construct
  misc_feature 1..20: note = CRISPR gRNA sequence
  source 1..20: mol_type = other DNA
ataaaacctcagcagaaata

SEQ ID NO: 81656 - DNA, 20 bp, synthetic construct
  misc_feature 1..20: note = CRISPR gRNA sequence
  source 1..20: mol_type = other DNA
aaaacctcagcagaaataaa

SEQ ID NO: 81657 - DNA, 20 bp, synthetic construct
  misc_feature 1..20: note = CRISPR gRNA sequence
  source 1..20: mol_type = other DNA
aaacctcagcagaaataaag

SEQ ID NO: 81658 - DNA, 20 bp, synthetic construct
  misc_feature 1..20: note = CRISPR gRNA sequence
  source 1..20: mol_type = other DNA
aataaagaggttttgttgtt

SEQ ID NO: 81659 - DNA, 20 bp, synthetic construct
  misc_feature 1..20: note = CRISPR gRNA sequence
  source 1..20: mol_type = other DNA
aagaggttttgttgtttggt

SEQ ID NO: 81660 - DNA, 20 bp, synthetic construct
  misc_feature 1..20: note = CRISPR gRNA sequence
  source 1..20: mol_type = other DNA
tgtttggtaagaacatacct

SEQ ID NO: 81661 - DNA, 20 bp, synthetic construct
  misc_feature 1..20: note = CRISPR gRNA sequence
  source 1..20: mol_type = other DNA
gtttggtaagaacatacctt

SEQ ID NO: 81662 - DNA, 20 bp, synthetic construct
  misc_feature 1..20: note = CRISPR gRNA sequence
  source 1..20: mol_type = other DNA
ggtaagaacataccttgggt

SEQ ID NO: 81663 - DNA, 20 bp, synthetic construct
  misc_feature 1..20: note = CRISPR gRNA sequence
  source 1..20: mol_type = other DNA
agaacataccttgggttggt

SEQ ID NO: 81664 - DNA, 20 bp, synthetic construct
  misc_feature 1..20: note = CRISPR gRNA sequence
  source 1..20: mol_type = other DNA
gaacataccttgggttggtt

SEQ ID NO: 81665 - DNA, 20 bp, synthetic construct
  misc_feature 1..20: note = CRISPR gRNA sequence
  source 1..20: mol_type = other DNA
taccttgggttggttgggca

SEQ ID NO: 81666 - DNA, 20 bp, synthetic construct
  misc_feature 1..20: note = CRISPR gRNA sequence
  source 1..20: mol_type = other DNA
cttgggttggttgggcacgg

SEQ ID NO: 81667 - DNA, 20 bp, synthetic construct
  misc_feature 1..20: note = CRISPR gRNA sequence
  source 1..20: mol_type = other DNA
tgcctgtaatcccaacactt

SEQ ID NO: 81668 - DNA, 20 bp, synthetic construct
  misc_feature 1..20: note = CRISPR gRNA sequence
  source 1..20: mol_type = other DNA
gcctgtaatcccaacacttt

SEQ ID NO: 81669 - DNA, 20 bp, synthetic construct
  misc_feature 1..20: note = CRISPR gRNA sequence
  source 1..20: mol_type = other DNA
ctgtaatcccaacactttgg

SEQ ID NO: 81670 - DNA, 20 bp, synthetic construct
  misc_feature 1..20: note = CRISPR gRNA sequence
  source 1..20: mol_type = other DNA
tgtaatcccaacactttggg

SEQ ID NO: 81671 - DNA, 20 bp, synthetic construct
  misc_feature 1..20: note = CRISPR gRNA sequence
  source 1..20: mol_type = other DNA
tcccaacactttgggaggcc

SEQ ID NO: 81672 - DNA, 20 bp, synthetic construct
  misc_feature 1..20: note = CRISPR gRNA sequence
  source 1..20: mol_type = other DNA
cccaacactttgggaggcca

SEQ ID NO: 81673 - DNA, 20 bp, synthetic construct
  misc_feature 1..20: note = CRISPR gRNA sequence
  source 1..20: mol_type = other DNA
aacactttgggaggccaagg

SEQ ID NO: 81674 - DNA, 20 bp, synthetic construct
  misc_feature 1..20: note = CRISPR gRNA sequence
  source 1..20: mol_type = other DNA
acactttgggaggccaaggc

SEQ ID NO: 81675 - DNA, 20 bp, synthetic construct
  misc_feature 1..20: note = CRISPR gRNA sequence
  source 1..20: mol_type = other DNA
caaggcaggctgatcacttg

SEQ ID NO: 81676 - DNA, 20 bp, synthetic construct
  misc_feature 1..20: note = CRISPR gRNA sequence
  source 1..20: mol_type = other DNA
gcaggctgatcacttgaagt

SEQ ID NO: 81677 - DNA, 20 bp, synthetic construct
  misc_feature 1..20: note = CRISPR gRNA sequence
  source 1..20: mol_type = other DNA
caggctgatcacttgaagtt

SEQ ID NO: 81678 - DNA, 20 bp, synthetic construct
  misc_feature 1..20: note = CRISPR gRNA sequence
  source 1..20: mol_type = other DNA
ggctgatcacttgaagttgg

SEQ ID NO: 81679 - DNA, 20 bp, synthetic construct
  misc_feature 1..20: note = CRISPR gRNA sequence
  source 1..20: mol_type = other DNA
tcacttgaagttgggagttc

SEQ ID NO: 81680 - DNA, 20 bp, synthetic construct
  misc_feature 1..20: note = CRISPR gRNA sequence
  source 1..20: mol_type = other DNA
tgaagttgggagttcaagac

SEQ ID NO: 81681 - DNA, 20 bp, synthetic construct
  misc_feature 1..20: note = CRISPR gRNA sequence
  source 1..20: mol_type = other DNA
ttgggagttcaagaccagcc

SEQ ID NO: 81682 - DNA, 20 bp, synthetic construct
  misc_feature 1..20: note = CRISPR gRNA sequence
  source 1..20: mol_type = other DNA
caagaccagcctggccaaca

SEQ ID NO: 81683 - DNA, 20 bp, synthetic construct
  misc_feature 1..20: note = CRISPR gRNA sequence
  source 1..20: mol_type = other DNA
ctgaaaatacaaaaattaac

SEQ ID NO: 81684 - DNA, 20 bp, synthetic construct
  misc_feature 1..20: note = CRISPR gRNA sequence
  source 1..20: mol_type = other DNA
tgaaaatacaaaaattaacc

SEQ ID NO: 81685 - DNA, 20 bp, synthetic construct
  misc_feature 1..20: note = CRISPR gRNA sequence
  source 1..20: mol_type = other DNA
atacaaaaattaaccaggca

SEQ ID NO: 81686 - DNA, 20 bp, synthetic construct
  misc_feature 1..20: note = CRISPR gRNA sequence
  source 1..20: mol_type = other DNA
caaaaattaaccaggcatgg

SEQ ID NO: 81687 - DNA, 20 bp, synthetic construct
  misc_feature 1..20: note = CRISPR gRNA sequence
  source 1..20: mol_type = other DNA
ggcatggtggtgtgtgcctg

SEQ ID NO: 81688 - DNA, 20 bp, synthetic construct
  misc_feature 1..20: note = CRISPR gRNA sequence
  source 1..20: mol_type = other DNA
gtggtgtgtgcctgtagtcc

SEQ ID NO: 81689 - DNA, 20 bp, synthetic construct
  misc_feature 1..20: note = CRISPR gRNA sequence
  source 1..20: mol_type = other DNA
tggtgtgtgcctgtagtccc

SEQ ID NO: 81690 - DNA, 20 bp, synthetic construct
  misc_feature 1..20: note = CRISPR gRNA sequence
  source 1..20: mol_type = other DNA
tcccaggaatcacttgaacc

SEQ ID NO: 81691 - DNA, 20 bp, synthetic construct
  misc_feature 1..20: note = CRISPR gRNA sequence
  source 1..20: mol_type = other DNA
cccaggaatcacttgaaccc

SEQ ID NO: 81692 - DNA, 20 bp, synthetic construct
  misc_feature 1..20: note = CRISPR gRNA sequence
  source 1..20: mol_type = other DNA
caggaatcacttgaacccag

SEQ ID NO: 81693 - DNA, 20 bp, synthetic construct
  misc_feature 1..20: note = CRISPR gRNA sequence
  source 1..20: mol_type = other DNA
aggaatcacttgaacccagg

SEQ ID NO: 81694 - DNA, 20 bp, synthetic construct
  misc_feature 1..20: note = CRISPR gRNA sequence
  source 1..20: mol_type = other DNA
aatcacttgaacccaggagg

SEQ ID NO: 81695 - DNA, 20 bp, synthetic construct
  misc_feature 1..20: note = CRISPR gRNA sequence
  source 1..20: mol_type = other DNA
tcacttgaacccaggaggcg

SEQ ID NO: 81696 - DNA, 20 bp, synthetic construct
  misc_feature 1..20: note = CRISPR gRNA sequence
  source 1..20: mol_type = other DNA
cacttgaacccaggaggcgg

SEQ ID NO: 81697 - DNA, 20 bp, synthetic construct
  misc_feature 1..20: note = CRISPR gRNA sequence
  source 1..20: mol_type = other DNA
aacccaggaggcggaggttg

SEQ ID NO: 81698 - DNA, 20 bp, synthetic construct
  misc_feature 1..20: note = CRISPR gRNA sequence
  source 1..20: mol_type = other DNA
caggaggcggaggttgcagt

SEQ ID NO: 81699 - DNA, 20 bp, synthetic construct
  misc_feature 1..20: note = CRISPR gRNA sequence
  source 1..20: mol_type = other DNA
ggcggaggttgcagtgagct

SEQ ID NO: 81700 - DNA, 20 bp, synthetic construct
  misc_feature 1..20: note = CRISPR gRNA sequence
  source 1..20: mol_type = other DNA
caccactgcacactgcactc

SEQ ID NO: 81701 - DNA, 20 bp, synthetic construct
  misc_feature 1..20: note = CRISPR gRNA sequence
  source 1..20: mol_type = other DNA
ctgcacactgcactccagcc

SEQ ID NO: 81702 - DNA, 20 bp, synthetic construct
  misc_feature 1..20: note = CRISPR gRNA sequence
  source 1..20: mol_type = other DNA
tgcacactgcactccagcct

SEQ ID NO: 81703 - DNA, 20 bp, synthetic construct
  misc_feature 1..20: note = CRISPR gRNA sequence
  source 1..20: mol_type = other DNA
ctgcactccagcctgggcaa

SEQ ID NO: 81704 - DNA, 20 bp, synthetic construct
  misc_feature 1..20: note = CRISPR gRNA sequence
  source 1..20: mol_type = other DNA
tccagcctgggcaatggaat

SEQ ID NO: 81705 - DNA, 20 bp, synthetic construct
  misc_feature 1..20: note = CRISPR gRNA sequence
  source 1..20: mol_type = other DNA
aataaaaaaataaaaaaata

SEQ ID NO: 81706 - DNA, 20 bp, synthetic construct
  misc_feature 1..20: note = CRISPR gRNA sequence
  source 1..20: mol_type = other DNA
aaaaaataaagaacatacct

SEQ ID NO: 81707 - DNA, 20 bp, synthetic construct
  misc_feature 1..20: note = CRISPR gRNA sequence
  source 1..20: mol_type = other DNA
aaaaataaagaacatacctt

SEQ ID NO: 81708 - DNA, 20 bp, synthetic construct
  misc_feature 1..20: note = CRISPR gRNA sequence
  source 1..20: mol_type = other DNA
ataccttgggttgatccact

SEQ ID NO: 81709 - DNA, 20 bp, synthetic construct
  misc_feature 1..20: note = CRISPR gRNA sequence
  source 1..20: mol_type = other DNA
taccttgggttgatccactt

SEQ ID NO: 81710 - DNA, 20 bp, synthetic construct
  misc_feature 1..20: note = CRISPR gRNA sequence
  source 1..20: mol_type = other DNA
gttgatccacttaggaacct

SEQ ID NO: 81711 - DNA, 20 bp, synthetic construct
  misc_feature 1..20: note = CRISPR gRNA sequence
  source 1..20: mol_type = other DNA
ataataacatctgccacgta

SEQ ID NO: 81712 - DNA, 20 bp, synthetic construct
  misc_feature 1..20: note = CRISPR gRNA sequence
  source 1..20: mol_type = other DNA
aataacatctgccacgtata

SEQ ID NO: 81713 - DNA, 20 bp, synthetic construct
  misc_feature 1..20: note = CRISPR gRNA sequence
  source 1..20: mol_type = other DNA
atagagcaattgctatgtcc

SEQ ID NO: 81714 - DNA, 20 bp, synthetic construct
  misc_feature 1..20: note = CRISPR gRNA sequence
  source 1..20: mol_type = other DNA
tagagcaattgctatgtccc

SEQ ID NO: 81715 - DNA, 20 bp, synthetic construct
  misc_feature 1..20: note = CRISPR gRNA sequence
  source 1..20: mol_type = other DNA
ctatgtcccaggcactctac

SEQ ID NO: 81716 - DNA, 20 bp, synthetic construct
  misc_feature 1..20: note = CRISPR gRNA sequence
  source 1..20: mol_type = other DNA
actctactagacacttcata

SEQ ID NO: 81717 - DNA, 20 bp, synthetic construct
  misc_feature 1..20: note = CRISPR gRNA sequence
  source 1..20: mol_type = other DNA
actagacacttcatacagtt

SEQ ID NO: 81718 - DNA, 20 bp, synthetic construct
  misc_feature 1..20: note = CRISPR gRNA sequence
  source 1..20: mol_type = other DNA
cttcatacagtttagaaaat

SEQ ID NO: 81719 - DNA, 20 bp, synthetic construct
  misc_feature 1..20: note = CRISPR gRNA sequence
  source 1..20: mol_type = other DNA
atacagtttagaaaatcaga

SEQ ID NO: 81720 - DNA, 20 bp, synthetic construct
  misc_feature 1..20: note = CRISPR gRNA sequence
  source 1..20: mol_type = other DNA
tacagtttagaaaatcagat

SEQ ID NO: 81721 - DNA, 20 bp, synthetic construct
  misc_feature 1..20: note = CRISPR gRNA sequence
  source 1..20: mol_type = other DNA
tttagaaaatcagatgggtg

SEQ ID NO: 81722 - DNA, 20 bp, synthetic construct
  misc_feature 1..20: note = CRISPR gRNA sequence
  source 1..20: mol_type = other DNA
aaatcagatgggtgtagatc

SEQ ID NO: 81723 - DNA, 20 bp, synthetic construct
  misc_feature 1..20: note = CRISPR gRNA sequence
  source 1..20: mol_type = other DNA
aatcagatgggtgtagatca

SEQ ID NO: 81724 - DNA, 20 bp, synthetic construct
  misc_feature 1..20: note = CRISPR gRNA sequence
  source 1..20: mol_type = other DNA
cagatgggtgtagatcaagg

SEQ ID NO: 81725 - DNA, 20 bp, synthetic construct
  misc_feature 1..20: note = CRISPR gRNA sequence
  source 1..20: mol_type = other DNA
agatgggtgtagatcaaggc

SEQ ID NO: 81726 - DNA, 20 bp, synthetic construct
  misc_feature 1..20: note = CRISPR gRNA sequence
  source 1..20: mol_type = other DNA
atgggtgtagatcaaggcag

SEQ ID NO: 81727 - DNA, 20 bp, synthetic construct
  misc_feature 1..20: note = CRISPR gRNA sequence
  source 1..20: mol_type = other DNA
ggtgtagatcaaggcaggag

SEQ ID NO: 81728 - DNA, 20 bp, synthetic construct
  misc_feature 1..20: note = CRISPR gRNA sequence
  source 1..20: mol_type = other DNA
gtgtagatcaaggcaggagc

SEQ ID NO: 81729 - DNA, 20 bp, synthetic construct
  misc_feature 1..20: note = CRISPR gRNA sequence
  source 1..20: mol_type = other DNA
aggcaggagcaggaaccaaa

SEQ ID NO: 81730 - DNA, 20 bp, synthetic construct
  misc_feature 1..20: note = CRISPR gRNA sequence
  source 1..20: mol_type = other DNA
aggagcaggaaccaaaaaga

SEQ ID NO: 81731 - DNA, 20 bp, synthetic construct
  misc_feature 1..20: note = CRISPR gRNA sequence
  source 1..20: mol_type = other DNA
ggagcaggaaccaaaaagaa

SEQ ID NO: 81732 - DNA, 20 bp, synthetic construct
  misc_feature 1..20: note = CRISPR gRNA sequence
  source 1..20: mol_type = other DNA
aaaaagaaaggcataaacat

SEQ ID NO: 81733 - DNA, 20 bp, synthetic construct
  misc_feature 1..20: note = CRISPR gRNA sequence
  source 1..20: mol_type = other DNA
cataaacataagaaaaaaaa

SEQ ID NO: 81734 - DNA, 20 bp, synthetic construct
  misc_feature 1..20: note = CRISPR gRNA sequence
  source 1..20: mol_type = other DNA
aaacataagaaaaaaaatgg

SEQ ID NO: 81735 - DNA, 20 bp, synthetic construct
  misc_feature 1..20: note = CRISPR gRNA sequence
  source 1..20: mol_type = other DNA
aacataagaaaaaaaatgga

SEQ ID NO: 81736 - DNA, 20 bp, synthetic construct
  misc_feature 1..20: note = CRISPR gRNA sequence
  source 1..20: mol_type = other DNA
acataagaaaaaaaatggaa

SEQ ID NO: 81737 - DNA, 20 bp, synthetic construct
  misc_feature 1..20: note = CRISPR gRNA sequence
  source 1..20: mol_type = other DNA
cataagaaaaaaaatggaag

SEQ ID NO: 81738 - DNA, 20 bp, synthetic construct
  misc_feature 1..20: note = CRISPR gRNA sequence
  source 1..20: mol_type = other DNA
aagaaaaaaaatggaagggg

SEQ ID NO: 81739 - DNA, 20 bp, synthetic construct
  misc_feature 1..20: note = CRISPR gRNA sequence
  source 1..20: mol_type = other DNA
aaaaatggaaggggtggaaa

SEQ ID NO: 81740 - DNA, 20 bp, synthetic construct
  misc_feature 1..20: note = CRISPR gRNA sequence
  source 1..20: mol_type = other DNA
aaatggaaggggtggaaaca

SEQ ID NO: 81741 - DNA, 20 bp, synthetic construct
  misc_feature 1..20: note = CRISPR gRNA sequence
  source 1..20: mol_type = other DNA
gaaacagagtacaataacat

SEQ ID NO: 81742 - DNA, 20 bp, synthetic construct
  misc_feature 1..20: note = CRISPR gRNA sequence
  source 1..20: mol_type = other DNA
caataacatgagtaatttga

SEQ ID NO: 81743 - DNA, 20 bp, synthetic construct
  misc_feature 1..20: note = CRISPR gRNA sequence
  source 1..20: mol_type = other DNA
aataacatgagtaatttgat

SEQ ID NO: 81744 - DNA, 20 bp, synthetic construct
  misc_feature 1..20: note = CRISPR gRNA sequence
  source 1..20: mol_type = other DNA
ataacatgagtaatttgatg

SEQ ID NO: 81745 - DNA, 20 bp, synthetic construct
  misc_feature 1..20: note = CRISPR gRNA sequence
  source 1..20: mol_type = other DNA
taacatgagtaatttgatgg

SEQ ID NO: 81746 - DNA, 20 bp, synthetic construct
  misc_feature 1..20: note = CRISPR gRNA sequence
  source 1..20: mol_type = other DNA
gatgggggctattatgaact

SEQ ID NO: 81747 - DNA, 20 bp, synthetic construct
  misc_feature 1..20: note = CRISPR gRNA sequence
  source 1..20: mol_type = other DNA
actgagaaatgaactttgaa

SEQ ID NO: 81748 - DNA, 20 bp, synthetic construct
  misc_feature 1..20: note = CRISPR gRNA sequence
  source 1..20: mol_type = other DNA
atgaactttgaaaagtatct

SEQ ID NO: 81749 - DNA, 20 bp, synthetic construct
  misc_feature 1..20: note = CRISPR gRNA sequence
  source 1..20: mol_type = other DNA
tgaactttgaaaagtatctt

SEQ ID NO: 81750 - DNA, 20 bp, synthetic construct
  misc_feature 1..20: note = CRISPR gRNA sequence
  source 1..20: mol_type = other DNA
gaactttgaaaagtatcttg

SEQ ID NO: 81751 - DNA, 20 bp, synthetic construct
  misc_feature 1..20: note = CRISPR gRNA sequence
  source 1..20: mol_type = other DNA
tatcttggggccaaatcatg

SEQ ID NO: 81752 - DNA, 20 bp, synthetic construct
  misc_feature 1..20: note = CRISPR gRNA sequence
  source 1..20: mol_type = other DNA
gccaaatcatgtagactctt

SEQ ID NO: 81753 - DNA, 20 bp, synthetic construct
  misc_feature 1..20: note = CRISPR gRNA sequence
  source 1..20: mol_type = other DNA
agactcttgagtgatgtgtt

SEQ ID NO: 81754 - DNA, 20 bp, synthetic construct
  misc_feature 1..20: note = CRISPR gRNA sequence
  source 1..20: mol_type = other DNA
gactcttgagtgatgtgtta

SEQ ID NO: 81755 - DNA, 20 bp, synthetic construct
  misc_feature 1..20: note = CRISPR gRNA sequence
  source 1..20: mol_type = other DNA
gatgtgttaaggaatgctat

SEQ ID NO: 81756 - DNA, 20 bp, synthetic construct
  misc_feature 1..20: note = CRISPR gRNA sequence
  source 1..20: mol_type = other DNA
taaggaatgctatgagtgct

SEQ ID NO: 81757 - DNA, 20 bp, synthetic construct
  misc_feature 1..20: note = CRISPR gRNA sequence
  source 1..20: mol_type = other DNA
aggaatgctatgagtgctga

SEQ ID NO: 81758 - DNA, 20 bp, synthetic construct
  misc_feature 1..20: note = CRISPR gRNA sequence
  source 1..20: mol_type = other DNA
ggaatgctatgagtgctgag

SEQ ID NO: 81759 - DNA, 20 bp, synthetic construct
  misc_feature 1..20: note = CRISPR gRNA sequence
  source 1..20: mol_type = other DNA
gaatgctatgagtgctgaga

SEQ ID NO: 81760 - DNA, 20 bp, synthetic construct
  misc_feature 1..20: note = CRISPR gRNA sequence
  source 1..20: mol_type = other DNA
tatgagtgctgagagggcat

SEQ ID NO: 81761 - DNA, 20 bp, synthetic construct
  misc_feature 1..20: note = CRISPR gRNA sequence
  source 1..20: mol_type = other DNA
gagtgctgagagggcatcag

SEQ ID NO: 81762 - DNA, 20 bp, synthetic construct
  misc_feature 1..20: note = CRISPR gRNA sequence
  source 1..20: mol_type = other DNA
agagggcatcagaagtcctt

SEQ ID NO: 81763 - DNA, 20 bp, synthetic construct
  misc_feature 1..20: note = CRISPR gRNA sequence
  source 1..20: mol_type = other DNA
agggcatcagaagtccttga

SEQ ID NO: 81764 - DNA, 20 bp, synthetic construct
  misc_feature 1..20: note = CRISPR gRNA sequence
  source 1..20: mol_type = other DNA
cagaagtccttgagagcctc

SEQ ID NO: 81765 - DNA, 20 bp, synthetic construct
  misc_feature 1..20: note = CRISPR gRNA sequence
  source 1..20: mol_type = other DNA
gaagtccttgagagcctcca

SEQ ID NO: 81766 - DNA, 20 bp, synthetic construct
  misc_feature 1..20: note = CRISPR gRNA sequence
  source 1..20: mol_type = other DNA
tccttgagagcctccagaga

SEQ ID NO: 81767 - DNA, 20 bp, synthetic construct
  misc_feature 1..20: note = CRISPR gRNA sequence
  source 1..20: mol_type = other DNA
ccttgagagcctccagagaa

SEQ ID NO: 81768 - DNA, 20 bp, synthetic construct
  misc_feature 1..20: note = CRISPR gRNA sequence
  source 1..20: mol_type = other DNA
gagaaaggctcttaaaaatg

SEQ ID NO: 81769 - DNA, 20 bp, synthetic construct
  misc_feature 1..20: note = CRISPR gRNA sequence
  source 1..20: mol_type = other DNA
taaaaatgcagcgcaatctc

SEQ ID NO: 81770 - DNA, 20 bp, synthetic construct
  misc_feature 1..20: note = CRISPR gRNA sequence
  source 1..20: mol_type = other DNA
tgcagcgcaatctccagtga

SEQ ID NO: 81771 - DNA, 20 bp, synthetic construct
  misc_feature 1..20: note = CRISPR gRNA sequence
  source 1..20: mol_type = other DNA
agcgcaatctccagtgacag

SEQ ID NO: 81772 - DNA, 20 bp, synthetic construct
  misc_feature 1..20: note = CRISPR gRNA sequence
  source 1..20: mol_type = other DNA
ccagtgacagaagatactgc

SEQ ID NO: 81773 - DNA, 20 bp, synthetic construct
  misc_feature 1..20: note = CRISPR gRNA sequence
  source 1..20: mol_type = other DNA
agatactgctagaaatctgc

SEQ ID NO: 81774 - DNA, 20 bp, synthetic construct
  misc_feature 1..20: note = CRISPR gRNA sequence
  source 1..20: mol_type = other DNA
ctgctagaaaaaaaacaaaa

SEQ ID NO: 81775 - DNA, 20 bp, synthetic construct
  misc_feature 1..20: note = CRISPR gRNA sequence
  source 1..20: mol_type = other DNA
tgctagaaaaaaaacaaaaa

SEQ ID NO: 81776 - DNA, 20 bp, synthetic construct
  misc_feature 1..20: note = CRISPR gRNA sequence
  source 1..20: mol_type = other DNA
aaaaacaaaaaaggcatgta

SEQ ID NO: 81777 - DNA, 20 bp, synthetic construct
  misc_feature 1..20: note = CRISPR gRNA sequence
  source 1..20: mol_type = other DNA
aaacaaaaaaggcatgtata

SEQ ID NO: 81778 - DNA, 20 bp, synthetic construct
  misc_feature 1..20: note = CRISPR gRNA sequence
  source 1..20: mol_type = other DNA
aacaaaaaaggcatgtatag

SEQ ID NO: 81779 - DNA, 20 bp, synthetic construct
  misc_feature 1..20: note = CRISPR gRNA sequence
  source 1..20: mol_type = other DNA
ggcatgtatagaggaattat

SEQ ID NO: 81780 - DNA, 20 bp, synthetic construct
  misc_feature 1..20: note = CRISPR gRNA sequence
  source 1..20: mol_type = other DNA
gcatgtatagaggaattatg

SEQ ID NO: 81781 - DNA, 20 bp, synthetic construct
  misc_feature 1..20: note = CRISPR gRNA sequence
  source 1..20: mol_type = other DNA
catgtatagaggaattatga

SEQ ID NO: 81782 - DNA, 20 bp, synthetic construct
  misc_feature 1..20: note = CRISPR gRNA sequence
  source 1..20: mol_type = other DNA
tatagaggaattatgaggga

SEQ ID NO: 81783 - DNA, 20 bp, synthetic construct
  misc_feature 1..20: note = CRISPR gRNA sequence
  source 1..20: mol_type = other DNA
aattatgagggaaagatacc

SEQ ID NO: 81784 - DNA, 20 bp, synthetic construct
  misc_feature 1..20: note = CRISPR gRNA sequence
  source 1..20: mol_type = other DNA
gagggaaagataccaagtca

SEQ ID NO: 81785 - DNA, 20 bp, synthetic construct
  misc_feature 1..20: note = CRISPR gRNA sequence
  source 1..20: mol_type = other DNA
tcacggtttattcttcaaaa

SEQ ID NO: 81786 - DNA, 20 bp, synthetic construct
  misc_feature 1..20: note = CRISPR gRNA sequence
  source 1..20: mol_type = other DNA
acggtttattcttcaaaatg

SEQ ID NO: 81787 - DNA, 20 bp, synthetic construct
  misc_feature 1..20: note = CRISPR gRNA sequence
  source 1..20: mol_type = other DNA
cggtttattcttcaaaatgg

SEQ ID NO: 81788 - DNA, 20 bp, synthetic construct
  misc_feature 1..20: note = CRISPR gRNA sequence
  source 1..20: mol_type = other DNA
tttattcttcaaaatggagg

SEQ ID NO: 81789 - DNA, 20 bp, synthetic construct
  misc_feature 1..20: note = CRISPR gRNA sequence
  source 1..20: mol_type = other DNA
tcaaaatggaggtggcttgt

SEQ ID NO: 81790 - DNA, 20 bp, synthetic construct
  misc_feature 1..20: note = CRISPR gRNA sequence
  source 1..20: mol_type = other DNA
caaaatggaggtggcttgtt

SEQ ID NO: 81791 - DNA, 20 bp, synthetic construct
  misc_feature 1..20: note = CRISPR gRNA sequence
  source 1..20: mol_type = other DNA
aatggaggtggcttgttggg

SEQ ID NO: 81792 - DNA, 20 bp, synthetic construct
  misc_feature 1..20: note = CRISPR gRNA sequence
  source 1..20: mol_type = other DNA
atggaggtggcttgttggga

SEQ ID NO: 81793 - DNA, 20 bp, synthetic construct
  misc_feature 1..20: note = CRISPR gRNA sequence
  source 1..20: mol_type = other DNA
gaggtggcttgttgggaagg

SEQ ID NO: 81794 - DNA, 20 bp, synthetic construct
  misc_feature 1..20: note = CRISPR gRNA sequence
  source 1..20: mol_type = other DNA
gtggcttgttgggaaggtgg

SEQ ID NO: 81795 - DNA, 20 bp, synthetic construct
  misc_feature 1..20: note = CRISPR gRNA sequence
  source 1..20: mol_type = other DNA
tgggaaggtggaagctcatt

SEQ ID NO: 81796 - DNA, 20 bp, synthetic construct
  misc_feature 1..20: note = CRISPR gRNA sequence
  source 1..20: mol_type = other DNA
aaggtggaagctcatttggc

SEQ ID NO: 81797 - DNA, 20 bp, synthetic construct
  misc_feature 1..20: note = CRISPR gRNA sequence
  source 1..20: mol_type = other DNA
ggtggaagctcatttggcca

SEQ ID NO: 81798 - DNA, 20 bp, synthetic construct
  misc_feature 1..20: note = CRISPR gRNA sequence
  source 1..20: mol_type = other DNA
ggaagctcatttggccagag

SEQ ID NO: 81799 - DNA, 20 bp, synthetic construct
  misc_feature 1..20: note = CRISPR gRNA sequence
  source 1..20: mol_type = other DNA
tcatttggccagagtggaaa

SEQ ID NO: 81800 - DNA, 20 bp, synthetic construct
  misc_feature 1..20: note = CRISPR gRNA sequence
  source 1..20: mol_type = other DNA
ggccagagtggaaatggaat

SEQ ID NO: 81801 - DNA, 20 bp, synthetic construct
  misc_feature 1..20: note = CRISPR gRNA sequence
  source 1..20: mol_type = other DNA
gccagagtggaaatggaatt

SEQ ID NO: 81802 - DNA, 20 bp, synthetic construct
  misc_feature 1..20: note = CRISPR gRNA sequence
  source 1..20: mol_type = other DNA
cagagtggaaatggaattgg

SEQ ID NO: 81803 - DNA, 20 bp, synthetic construct
  misc_feature 1..20: note = CRISPR gRNA sequence
  source 1..20: mol_type = other DNA
gatgaccaaatgtaaacact

SEQ ID NO: 81804 - DNA, 20 bp, synthetic construct
  misc_feature 1..20: note = CRISPR gRNA sequence
  source 1..20: mol_type = other DNA
taaacacttggtgcctgata

SEQ ID NO: 81805 - DNA, 20 bp, synthetic construct
  misc_feature 1..20: note = CRISPR gRNA sequence
  source 1..20: mol_type = other DNA
gcctgatatagcttgacacc

SEQ ID NO: 81806 - DNA, 20 bp, synthetic construct
  misc_feature 1..20: note = CRISPR gRNA sequence
  source 1..20: mol_type = other DNA
gatatagcttgacaccaagt

SEQ ID NO: 81807 - DNA, 20 bp, synthetic construct
  misc_feature 1..20: note = CRISPR gRNA sequence
  source 1..20: mol_type = other DNA
cttgacaccaagttagcccc

SEQ ID NO: 81808 - DNA, 20 bp, synthetic construct
  misc_feature 1..20: note = CRISPR gRNA sequence
  source 1..20: mol_type = other DNA
tagccccaagtgaaataccc

SEQ ID NO: 81809 - DNA, 20 bp, synthetic construct
  misc_feature 1..20: note = CRISPR gRNA sequence
  source 1..20: mol_type = other DNA
tgtcttttcccgatattcct

SEQ ID NO: 81810 - DNA, 20 bp, synthetic construct
  misc_feature 1..20: note = CRISPR gRNA sequence
  source 1..20: mol_type = other DNA
gtcttttcccgatattcctc

SEQ ID NO: 81811 - DNA, 20 bp, synthetic construct
  misc_feature 1..20: note = CRISPR gRNA sequence
  source 1..20: mol_type = other DNA
gatattcctcaggtactcca

SEQ ID NO: 81812 - DNA, 20 bp, synthetic construct
  misc_feature 1..20: note = CRISPR gRNA sequence
  source 1..20: mol_type = other DNA
cctcaggtactccaaagatt

SEQ ID NO: 81813 - DNA, 20 bp, synthetic construct
  misc_feature 1..20: note = CRISPR gRNA sequence
  source 1..20: mol_type = other DNA
ctcaggtactccaaagattc

SEQ ID NO: 81814 - DNA, 20 bp, synthetic construct
  misc_feature 1..20: note = CRISPR gRNA sequence
  source 1..20: mol_type = other DNA
tcaggtttactcacgtcatc

SEQ ID NO: 81815 - DNA, 20 bp, synthetic construct
  misc_feature 1..20: note = CRISPR gRNA sequence
  source 1..20: mol_type = other DNA
ggtttactcacgtcatccag

SEQ ID NO: 81816 - DNA, 20 bp, synthetic construct
  misc_feature 1..20: note = CRISPR gRNA sequence
  source 1..20: mol_type = other DNA
tttactcacgtcatccagca

SEQ ID NO: 81817 - DNA, 20 bp, synthetic construct
  misc_feature 1..20: note = CRISPR gRNA sequence
  source 1..20: mol_type = other DNA
tcacgtcatccagcagagaa

SEQ ID NO: 81818 - DNA, 20 bp, synthetic construct
  misc_feature 1..20: note = CRISPR gRNA sequence
  source 1..20: mol_type = other DNA
gtcatccagcagagaatgga

SEQ ID NO: 81819 - DNA, 20 bp, synthetic construct
  misc_feature 1..20: note = CRISPR gRNA sequence
  source 1..20: mol_type = other DNA
ttcctgaattgctatgtgtc

SEQ ID NO: 81820 - DNA, 20 bp, synthetic construct
  misc_feature 1..20: note = CRISPR gRNA sequence
  source 1..20: mol_type = other DNA
tcctgaattgctatgtgtct

SEQ ID NO: 81821 - DNA, 20 bp, synthetic construct
  misc_feature 1..20: note = CRISPR gRNA sequence
  source 1..20: mol_type = other DNA
gtttcatccatccgacattg

SEQ ID NO: 81822 - DNA, 20 bp, synthetic construct
  misc_feature 1..20: note = CRISPR gRNA sequence
  source 1..20: mol_type = other DNA
acattgaagttgacttactg

SEQ ID NO: 81823 - DNA, 20 bp, synthetic construct
  misc_feature 1..20: note = CRISPR gRNA sequence
  source 1..20: mol_type = other DNA
gaagttgacttactgaagaa

SEQ ID NO: 81824 - DNA, 20 bp, synthetic construct
  misc_feature 1..20: note = CRISPR gRNA sequence
  source 1..20: mol_type = other DNA
agttgacttactgaagaatg

SEQ ID NO: 81825 - DNA, 20 bp, synthetic construct
  misc_feature 1..20: note = CRISPR gRNA sequence
  source 1..20: mol_type = other DNA
ttgacttactgaagaatgga

SEQ ID NO: 81826 - DNA, 20 bp, synthetic construct
  misc_feature 1..20: note = CRISPR gRNA sequence
  source 1..20: mol_type = other DNA
gacttactgaagaatggaga

SEQ ID NO: 81827 - DNA, 20 bp, synthetic construct
  misc_feature 1..20: note = CRISPR gRNA sequence
  source 1..20: mol_type = other DNA
gaatggagagagaattgaaa

SEQ ID NO: 81828 - DNA, 20 bp, synthetic construct
  misc_feature 1..20: note = CRISPR gRNA sequence
  source 1..20: mol_type = other DNA
tggagagagaattgaaaaag

SEQ ID NO: 81829 - DNA, 20 bp, synthetic construct
  misc_feature 1..20: note = CRISPR gRNA sequence
  source 1..20: mol_type = other DNA
gagagagaattgaaaaagtg

SEQ ID NO: 81830 - DNA, 20 bp, synthetic construct
  misc_feature 1..20: note = CRISPR gRNA sequence
  source 1..20: mol_type = other DNA
aattgaaaaagtggagcatt

SEQ ID NO: 81831 - DNA, 20 bp, synthetic construct
  misc_feature 1..20: note = CRISPR gRNA sequence
  source 1..20: mol_type = other DNA
gagcattcagacttgtcttt

SEQ ID NO: 81832 - DNA, 20 bp, synthetic construct
  misc_feature 1..20: note = CRISPR gRNA sequence
  source 1..20: mol_type = other DNA
attcagacttgtctttcagc

SEQ ID NO: 81833 - DNA, 20 bp, synthetic construct
  misc_feature 1..20: note = CRISPR gRNA sequence
  source 1..20: mol_type = other DNA
ttcagacttgtctttcagca

SEQ ID NO: 81834 - DNA, 20 bp, synthetic construct
  misc_feature 1..20: note = CRISPR gRNA sequence
  source 1..20: mol_type = other DNA
acttgtctttcagcaaggac

SEQ ID NO: 81835 - DNA, 20 bp, synthetic construct
  misc_feature 1..20: note = CRISPR gRNA sequence
  source 1..20: mol_type = other DNA
tgaattcacccccactgaaa

SEQ ID NO: 81836 - DNA, 20 bp, synthetic construct
  misc_feature 1..20: note = CRISPR gRNA sequence
  source 1..20: mol_type = other DNA
tcacccccactgaaaaagat

SEQ ID NO: 81837 - DNA, 20 bp, synthetic construct
  misc_feature 1..20: note = CRISPR gRNA sequence
  source 1..20: mol_type = other DNA
tgaaccatgtgactttgtca

SEQ ID NO: 81838 - DNA, 20 bp, synthetic construct
  misc_feature 1..20: note = CRISPR gRNA sequence
  source 1..20: mol_type = other DNA
atgtgactttgtcacagccc

SEQ ID NO: 81839 - DNA, 20 bp, synthetic construct
  misc_feature 1..20: note = CRISPR gRNA sequence
  source 1..20: mol_type = other DNA
gactttgtcacagcccaaga

SEQ ID NO: 81840 - DNA, 20 bp, synthetic construct
  misc_feature 1..20: note = CRISPR gRNA sequence
  source 1..20: mol_type = other DNA
tgtcacagcccaagatagtt

SEQ ID NO: 81841 - DNA, 20 bp, synthetic construct
  misc_feature 1..20: note = CRISPR gRNA sequence
  source 1..20: mol_type = other DNA
cacagcccaagatagttaag

SEQ ID NO: 81842 - DNA, 20 bp, synthetic construct
  misc_feature 1..20: note = CRISPR gRNA sequence
  source 1..20: mol_type = other DNA
acagcccaagatagttaagt

SEQ ID NO: 81843 - DNA, 20 bp, synthetic construct
  misc_feature 1..20: note = CRISPR gRNA sequence
  source 1..20: mol_type = other DNA
cagcccaagatagttaagtg

SEQ ID NO: 81844 - DNA, 20 bp, synthetic construct
  misc_feature 1..20: note = CRISPR gRNA sequence
  source 1..20: mol_type = other DNA
ccaagatagttaagtggggt

SEQ ID NO: 81845 - DNA, 20 bp, synthetic construct
  misc_feature 1..20: note = CRISPR gRNA sequence
  source 1..20: mol_type = other DNA
taagtcttacattcttttgt

SEQ ID NO: 81846 - DNA, 20 bp, synthetic construct
  misc_feature 1..20: note = CRISPR gRNA sequence
  source 1..20: mol_type = other DNA
attcttttgtaagctgctga

SEQ ID NO: 81847 - DNA, 20 bp, synthetic construct
  misc_feature 1..20: note = CRISPR gRNA sequence
  source 1..20: mol_type = other DNA
agctgctgaaagttgtgtat

SEQ ID NO: 81848 - DNA, 20 bp, synthetic construct
  misc_feature 1..20: note = CRISPR gRNA sequence
  source 1..20: mol_type = other DNA
tgctgaaagttgtgtatgag

SEQ ID NO: 81849 - DNA, 20 bp, synthetic construct
  misc_feature 1..20: note = CRISPR gRNA sequence
  source 1..20: mol_type = other DNA
gtatgagtagtcatatcata

SEQ ID NO: 81850 - DNA, 20 bp, synthetic construct
  misc_feature 1..20: note = CRISPR gRNA sequence
  source 1..20: mol_type = other DNA
aaagctgctttgatataaaa

SEQ ID NO: 81851 - DNA, 20 bp, synthetic construct
  misc_feature 1..20: note = CRISPR gRNA sequence
  source 1..20: mol_type = other DNA
aagctgctttgatataaaaa

SEQ ID NO: 81852 - DNA, 20 bp, synthetic construct
  misc_feature 1..20: note = CRISPR gRNA sequence
  source 1..20: mol_type = other DNA
tttgatataaaaaaggtcta

SEQ ID NO: 81853 - DNA, 20 bp, synthetic construct
  misc_feature 1..20: note = CRISPR gRNA sequence
  source 1..20: mol_type = other DNA
atggccatactaccctgaat

SEQ ID NO: 81854 - DNA, 20 bp, synthetic construct
  misc_feature 1..20: note = CRISPR gRNA sequence
  source 1..20: mol_type = other DNA
gatataaacaatctgcatat

SEQ ID NO: 81855 - DNA, 20 bp, synthetic construct
  misc_feature 1..20: note = CRISPR gRNA sequence
  source 1..20: mol_type = other DNA
atataaacaatctgcatatt

SEQ ID NO: 81856 - DNA, 20 bp, synthetic construct
  misc_feature 1..20: note = CRISPR gRNA sequence
  source 1..20: mol_type = other DNA
aatctgcatattgggattgt

SEQ ID NO: 81857 - DNA, 20 bp, synthetic construct
  misc_feature 1..20: note = CRISPR gRNA sequence
  source 1..20: mol_type = other DNA
atctgcatattgggattgtc

SEQ ID NO: 81858 - DNA, 20 bp, synthetic construct
  misc_feature 1..20: note = CRISPR gRNA sequence
  source 1..20: mol_type = other DNA
tctgcatattgggattgtca

SEQ ID NO: 81859 - DNA, 20 bp, synthetic construct
  misc_feature 1..20: note = CRISPR gRNA sequence
  source 1..20: mol_type = other DNA
attgtcagggaatgttctta

SEQ ID NO: 81860 - DNA, 20 bp, synthetic construct
  misc_feature 1..20: note = CRISPR gRNA sequence
  source 1..20: mol_type = other DNA
cagggaatgttcttaaagat

SEQ ID NO: 81861 - DNA, 20 bp, synthetic construct
  misc_feature 1..20: note = CRISPR gRNA sequence
  source 1..20: mol_type = other DNA
aatgttcttaaagatcagat

SEQ ID NO: 81862 - DNA, 20 bp, synthetic construct
  misc_feature 1..20: note = CRISPR gRNA sequence
  source 1..20: mol_type = other DNA
gttcttaaagatcagattag

SEQ ID NO: 81863 - DNA, 20 bp, synthetic construct
  misc_feature 1..20: note = CRISPR gRNA sequence
  source 1..20: mol_type = other DNA
tcagattagtggcacctgct

SEQ ID NO: 81864 - DNA, 20 bp, synthetic construct
  misc_feature 1..20: note = CRISPR gRNA sequence
  source 1..20: mol_type = other DNA
cctgctgagatactgatgca

SEQ ID NO: 81865 - DNA, 20 bp, synthetic construct
  misc_feature 1..20: note = CRISPR gRNA sequence
  source 1..20: mol_type = other DNA
tgagatactgatgcacagca

SEQ ID NO: 81866 - DNA, 20 bp, synthetic construct
  misc_feature 1..20: note = CRISPR gRNA sequence
  source 1..20: mol_type = other DNA
gcacagcatggtttctgaac

SEQ ID NO: 81867 - DNA, 20 bp, synthetic construct
  misc_feature 1..20: note = CRISPR gRNA sequence
  source 1..20: mol_type = other DNA
cagcatggtttctgaaccag

SEQ ID NO: 81868 - DNA, 20 bp, synthetic construct
  misc_feature 1..20: note = CRISPR gRNA sequence
  source 1..20: mol_type = other DNA
ctgaaccagtagtttccctg

SEQ ID NO: 81869 - DNA, 20 bp, synthetic construct
  misc_feature 1..20: note = CRISPR gRNA sequence
  source 1..20: mol_type = other DNA
ccagtagtttccctgcagtt

SEQ ID NO: 81870 - DNA, 20 bp, synthetic construct
  misc_feature 1..20: note = CRISPR gRNA sequence
  source 1..20: mol_type = other DNA
gtagtttccctgcagttgag

SEQ ID NO: 81871 - DNA, 20 bp, synthetic construct
  misc_feature 1..20: note = CRISPR gRNA sequence
  source 1..20: mol_type = other DNA
tagtttccctgcagttgagc

SEQ ID NO: 81872 - DNA, 20 bp, synthetic construct
  misc_feature 1..20: note = CRISPR gRNA sequence
  source 1..20: mol_type = other DNA
agtttccctgcagttgagca

SEQ ID NO: 81873 - DNA, 20 bp, synthetic construct
  misc_feature 1..20: note = CRISPR gRNA sequence
  source 1..20: mol_type = other DNA
tttccctgcagttgagcagg

SEQ ID NO: 81874 - DNA, 20 bp, synthetic construct
  misc_feature 1..20: note = CRISPR gRNA sequence
  source 1..20: mol_type = other DNA
ccctgcagttgagcagggag

SEQ ID NO: 81875 - DNA, 20 bp, synthetic construct
  misc_feature 1..20: note = CRISPR gRNA sequence
  source 1..20: mol_type = other DNA
tgcagttgagcagggagcag

SEQ ID NO: 81876 - DNA, 20 bp, synthetic construct
  misc_feature 1..20: note = CRISPR gRNA sequence
  source 1..20: mol_type = other DNA
agttgagcagggagcagcag

SEQ ID NO: 81877 - DNA, 20 bp, synthetic construct
  misc_feature 1..20: note = CRISPR gRNA sequence
  source 1..20: mol_type = other DNA
tcttaacacttcttacctac

SEQ ID NO: 81878 - DNA, 20 bp, synthetic construct
  misc_feature 1..20: note = CRISPR gRNA sequence
  source 1..20: mol_type = other DNA
tcttacctactggcttcctc

SEQ ID NO: 81879 - DNA, 20 bp, synthetic construct
  misc_feature 1..20: note = CRISPR gRNA sequence
  source 1..20: mol_type = other DNA
ctggcttcctctagcttttg

SEQ ID NO: 81880 - DNA, 20 bp, synthetic construct
  misc_feature 1..20: note = CRISPR gRNA sequence
  source 1..20: mol_type = other DNA
gcttcctctagcttttgtgg

SEQ ID NO: 81881 - DNA, 20 bp, synthetic construct
  misc_feature 1..20: note = CRISPR gRNA sequence
  source 1..20: mol_type = other DNA
tctagcttttgtggcagctt

SEQ ID NO: 81882 - DNA, 20 bp, synthetic construct
  misc_feature 1..20: note = CRISPR gRNA sequence
  source 1..20: mol_type = other DNA
ctagcttttgtggcagcttc

SEQ ID NO: 81883 - DNA, 20 bp, synthetic construct
  misc_feature 1..20: note = CRISPR gRNA sequence
  source 1..20: mol_type = other DNA
gtggcagcttcaggtatatt

SEQ ID NO: 81884 - DNA, 20 bp, synthetic construct
  misc_feature 1..20: note = CRISPR gRNA sequence
  source 1..20: mol_type = other DNA
tagcactgaacgaacatctc

SEQ ID NO: 81885 - DNA, 20 bp, synthetic construct
  misc_feature 1..20: note = CRISPR gRNA sequence
  source 1..20: mol_type = other DNA
cactgaacgaacatctcaag

SEQ ID NO: 81886 - DNA, 20 bp, synthetic construct
  misc_feature 1..20: note = CRISPR gRNA sequence
  source 1..20: mol_type = other DNA
actgaacgaacatctcaaga

SEQ ID NO: 81887 - DNA, 20 bp, synthetic construct
  misc_feature 1..20: note = CRISPR gRNA sequence
  source 1..20: mol_type = other DNA
acgaacatctcaagaaggta

SEQ ID NO: 81888 - DNA, 20 bp, synthetic construct
  misc_feature 1..20: note = CRISPR gRNA sequence
  source 1..20: mol_type = other DNA
cgaacatctcaagaaggtat

SEQ ID NO: 81889 - DNA, 20 bp, synthetic construct
  misc_feature 1..20: note = CRISPR gRNA sequence
  source 1..20: mol_type = other DNA
aggtataggcctttgtttgt

SEQ ID NO: 81890 - DNA, 20 bp, synthetic construct
  misc_feature 1..20: note = CRISPR gRNA sequence
  source 1..20: mol_type = other DNA
gtttgtaagtcctgctgtcc

SEQ ID NO: 81891 - DNA, 20 bp, synthetic construct
  misc_feature 1..20: note = CRISPR gRNA sequence
  source 1..20: mol_type = other DNA
gtcctagcatcctataatcc

SEQ ID NO: 81892 - DNA, 20 bp, synthetic construct
  misc_feature 1..20: note = CRISPR gRNA sequence
  source 1..20: mol_type = other DNA
cctataatcctggacttctc

SEQ ID NO: 81893 - DNA, 20 bp, synthetic construct
  misc_feature 1..20: note = CRISPR gRNA sequence
  source 1..20: mol_type = other DNA
tggacttctccagtactttc

SEQ ID NO: 81894 - DNA, 20 bp, synthetic construct
  misc_feature 1..20: note = CRISPR gRNA sequence
  source 1..20: mol_type = other DNA
cttctccagtactttctggc

SEQ ID NO: 81895 - DNA, 20 bp, synthetic construct
  misc_feature 1..20: note = CRISPR gRNA sequence
  source 1..20: mol_type = other DNA
ccagtactttctggctggat

SEQ ID NO: 81896 - DNA, 20 bp, synthetic construct
  misc_feature 1..20: note = CRISPR gRNA sequence
  source 1..20: mol_type = other DNA
ttctggctggattggtatct

SEQ ID NO: 81897 - DNA, 20 bp, synthetic construct
  misc_feature 1..20: note = CRISPR gRNA sequence
  source 1..20: mol_type = other DNA
tctggctggattggtatctg

SEQ ID NO: 81898 - DNA, 20 bp, synthetic construct
  misc_feature 1..20: note = CRISPR gRNA sequence
  source 1..20: mol_type = other DNA
gctggattggtatctgaggc

SEQ ID NO: 81899 - DNA, 20 bp, synthetic construct
  misc_feature 1..20: note = CRISPR gRNA sequence
  source 1..20: mol_type = other DNA
ggattggtatctgaggctag

SEQ ID NO: 81900 - DNA, 20 bp, synthetic construct
  misc_feature 1..20: note = CRISPR gRNA sequence
  source 1..20: mol_type = other DNA
gattggtatctgaggctagt

SEQ ID NO: 81901 - DNA, 20 bp, synthetic construct
  misc_feature 1..20: note = CRISPR gRNA sequence
  source 1..20: mol_type = other DNA
tggtatctgaggctagtagg

SEQ ID NO: 81902 - DNA, 20 bp, synthetic construct
  misc_feature 1..20: note = CRISPR gRNA sequence
  source 1..20: mol_type = other DNA
ggtatctgaggctagtagga

SEQ ID NO: 81903 - DNA, 20 bp, synthetic construct
  misc_feature 1..20: note = CRISPR gRNA sequence
  source 1..20: mol_type = other DNA
gtatctgaggctagtaggaa

SEQ ID NO: 81904 - DNA, 20 bp, synthetic construct
  misc_feature 1..20: note = CRISPR gRNA sequence
  source 1..20: mol_type = other DNA
taggaagggcttgttcctgc

SEQ ID NO: 81905 - DNA, 20 bp, synthetic construct
  misc_feature 1..20: note = CRISPR gRNA sequence
  source 1..20: mol_type = other DNA
aggaagggcttgttcctgct

SEQ ID NO: 81906 - DNA, 20 bp, synthetic construct
  misc_feature 1..20: note = CRISPR gRNA sequence
  source 1..20: mol_type = other DNA
aagggcttgttcctgctggg

SEQ ID NO: 81907 - DNA, 20 bp, synthetic construct
  misc_feature 1..20: note = CRISPR gRNA sequence
  source 1..20: mol_type = other DNA
agctctaaacaatgtattca

SEQ ID NO: 81908 - DNA, 20 bp, synthetic construct
  misc_feature 1..20: note = CRISPR gRNA sequence
  source 1..20: mol_type = other DNA
gctctaaacaatgtattcat

SEQ ID NO: 81909 - DNA, 20 bp, synthetic construct
  misc_feature 1..20: note = CRISPR gRNA sequence
  source 1..20: mol_type = other DNA
ctaaacaatgtattcatggg

SEQ ID NO: 81910 - DNA, 20 bp, synthetic construct
  misc_feature 1..20: note = CRISPR gRNA sequence
  source 1..20: mol_type = other DNA
taaacaatgtattcatgggt

SEQ ID NO: 81911 - DNA, 20 bp, synthetic construct
  misc_feature 1..20: note = CRISPR gRNA sequence
  source 1..20: mol_type = other DNA
aatgtattcatgggtaggaa

SEQ ID NO: 81912 - DNA, 20 bp, synthetic construct
  misc_feature 1..20: note = CRISPR gRNA sequence
  source 1..20: mol_type = other DNA
gtattcatgggtaggaacag

SEQ ID NO: 81913 - DNA, 20 bp, synthetic construct
  misc_feature 1..20: note = CRISPR gRNA sequence
  source 1..20: mol_type = other DNA
ggaacagcagcctattctgc

SEQ ID NO: 81914 - DNA, 20 bp, synthetic construct
  misc_feature 1..20: note = CRISPR gRNA sequence
  source 1..20: mol_type = other DNA
agccttatttctaaccattt

SEQ ID NO: 81915 - DNA, 20 bp, synthetic construct
  misc_feature 1..20: note = CRISPR gRNA sequence
  source 1..20: mol_type = other DNA
taaccattttagacatttgt

SEQ ID NO: 81916 - DNA, 20 bp, synthetic construct
  misc_feature 1..20: note = CRISPR gRNA sequence
  source 1..20: mol_type = other DNA
tttagacatttgttagtaca

SEQ ID NO: 81917 - DNA, 20 bp, synthetic construct
  misc_feature 1..20: note = CRISPR gRNA sequence
  source 1..20: mol_type = other DNA
gttagtacatggtattttaa

SEQ ID NO: 81918 - DNA, 20 bp, synthetic construct
  misc_feature 1..20: note = CRISPR gRNA sequence
  source 1..20: mol_type = other DNA
tttctccactgtctttttca

SEQ ID NO: 81919 - DNA, 20 bp, synthetic construct
  misc_feature 1..20: note = CRISPR gRNA sequence
  source 1..20: mol_type = other DNA
cactgtctttttcatagatc

SEQ ID NO: 81920 - DNA, 20 bp, synthetic construct
  misc_feature 1..20: note = CRISPR gRNA sequence
  source 1..20: mol_type = other DNA
tttcatagatcgagacatgt

SEQ ID NO: 81921 - DNA, 20 bp, synthetic construct
  misc_feature 1..20: note = CRISPR gRNA sequence
  source 1..20: mol_type = other DNA
catagatcgagacatgtaag

SEQ ID NO: 81922 - DNA, 20 bp, synthetic construct
  misc_feature 1..20: note = CRISPR gRNA sequence
  source 1..20: mol_type = other DNA
gagacatgtaagcagcatca

SEQ ID NO: 81923 - DNA, 20 bp, synthetic construct
  misc_feature 1..20: note = CRISPR gRNA sequence
  source 1..20: mol_type = other DNA
gacatgtaagcagcatcatg

SEQ ID NO: 81924 - DNA, 20 bp, synthetic construct
  misc_feature 1..20: note = CRISPR gRNA sequence
  source 1..20: mol_type = other DNA
acatgtaagcagcatcatgg

SEQ ID NO: 81925 - DNA, 20 bp, synthetic construct
  misc_feature 1..20: note = CRISPR gRNA sequence
  source 1..20: mol_type = other DNA
gtaagcagcatcatggaggt

SEQ ID NO: 81926 - DNA, 20 bp, synthetic construct
  misc_feature 1..20: note = CRISPR gRNA sequence
  source 1..20: mol_type = other DNA
ggaggtaagtttttgacctt

SEQ ID NO: 81927 - DNA, 20 bp, synthetic construct
  misc_feature 1..20: note = CRISPR gRNA sequence
  source 1..20: mol_type = other DNA
tgtttttgtttcactgtcct

SEQ ID NO: 81928 - DNA, 20 bp, synthetic construct
  misc_feature 1..20: note = CRISPR gRNA sequence
  source 1..20: mol_type = other DNA
gtttttgtttcactgtcctg

SEQ ID NO: 81929 - DNA, 20 bp, synthetic construct
  misc_feature 1..20: note = CRISPR gRNA sequence
  source 1..20: mol_type = other DNA
actgtcctgaggactattta

SEQ ID NO: 81930 - DNA, 20 bp, synthetic construct
  misc_feature 1..20: note = CRISPR gRNA sequence
  source 1..20: mol_type = other DNA
tcctgaggactatttataga

SEQ ID NO: 81931 - DNA, 20 bp, synthetic construct
  misc_feature 1..20: note = CRISPR gRNA sequence
  source 1..20: mol_type = other DNA
acatgataaccctcactatg

SEQ ID NO: 81932 - DNA, 20 bp, synthetic construct
  misc_feature 1..20: note = CRISPR gRNA sequence
  source 1..20: mol_type = other DNA
atgataaccctcactatgtg

SEQ ID NO: 81933 - DNA, 20 bp, synthetic construct
  misc_feature 1..20: note = CRISPR gRNA sequence
  source 1..20: mol_type = other DNA
cactatgtggagaacattga

SEQ ID NO: 81934 - DNA, 20 bp, synthetic construct
  misc_feature 1..20: note = CRISPR gRNA sequence
  source 1..20: mol_type = other DNA
ctatgtggagaacattgaca

SEQ ID NO: 81935 - DNA, 20 bp, synthetic construct
  misc_feature 1..20: note = CRISPR gRNA sequence
  source 1..20: mol_type = other DNA
acattgacagagtaacattt

SEQ ID NO: 81936 - DNA, 20 bp, synthetic construct
  misc_feature 1..20: note = CRISPR gRNA sequence
  source 1..20: mol_type = other DNA
ttgacagagtaacattttag

SEQ ID NO: 81937 - DNA, 20 bp, synthetic construct
  misc_feature 1..20: note = CRISPR gRNA sequence
  source 1..20: mol_type = other DNA
tgacagagtaacattttagc

SEQ ID NO: 81938 - DNA, 20 bp, synthetic construct
  misc_feature 1..20: note = CRISPR gRNA sequence
  source 1..20: mol_type = other DNA
gacagagtaacattttagca

SEQ ID NO: 81939 - DNA, 20 bp, synthetic construct
  misc_feature 1..20: note = CRISPR gRNA sequence
  source 1..20: mol_type = other DNA
gagtaacattttagcaggga

SEQ ID NO: 81940 - DNA, 20 bp, synthetic construct
  misc_feature 1..20: note = CRISPR gRNA sequence
  source 1..20: mol_type = other DNA
taacattttagcagggaaag

SEQ ID NO: 81941 - DNA, 20 bp, synthetic construct
  misc_feature 1..20: note = CRISPR gRNA sequence
  source 1..20: mol_type = other DNA
gcagggaaagaagaatccta

SEQ ID NO: 81942 - DNA, 20 bp, synthetic construct
  misc_feature 1..20: note = CRISPR gRNA sequence
  source 1..20: mol_type = other DNA
cagggaaagaagaatcctac

SEQ ID NO: 81943 - DNA, 20 bp, synthetic construct
  misc_feature 1..20: note = CRISPR gRNA sequence
  source 1..20: mol_type = other DNA
agggaaagaagaatcctaca

SEQ ID NO: 81944 - DNA, 20 bp, synthetic construct
  misc_feature 1..20: note = CRISPR gRNA sequence
  source 1..20: mol_type = other DNA
ggtcatgttcccttctcctg

SEQ ID NO: 81945 - DNA, 20 bp, synthetic construct
  misc_feature 1..20: note = CRISPR gRNA sequence
  source 1..20: mol_type = other DNA
tcatgttcccttctcctgtg

SEQ ID NO: 81946 - DNA, 20 bp, synthetic construct
  misc_feature 1..20: note = CRISPR gRNA sequence
  source 1..20: mol_type = other DNA
tgttcccttctcctgtggag

SEQ ID NO: 81947 - DNA, 20 bp, synthetic construct
  misc_feature 1..20: note = CRISPR gRNA sequence
  source 1..20: mol_type = other DNA
ttctcctgtggagtggcatg

SEQ ID NO: 81948 - DNA, 20 bp, synthetic construct
  misc_feature 1..20: note = CRISPR gRNA sequence
  source 1..20: mol_type = other DNA
tcctgtggagtggcatgaag

SEQ ID NO: 81949 - DNA, 20 bp, synthetic construct
  misc_feature 1..20: note = CRISPR gRNA sequence
  source 1..20: mol_type = other DNA
cctgtggagtggcatgaaga

SEQ ID NO: 81950 - DNA, 20 bp, synthetic construct
  misc_feature 1..20: note = CRISPR gRNA sequence
  source 1..20: mol_type = other DNA
agtggcatgaagaaggtgta

SEQ ID NO: 81951 - DNA, 20 bp, synthetic construct
  misc_feature 1..20: note = CRISPR gRNA sequence
  source 1..20: mol_type = other DNA
atgaagaaggtgtatggccc

SEQ ID NO: 81952 - DNA, 20 bp, synthetic construct
  misc_feature 1..20: note = CRISPR gRNA sequence
  source 1..20: mol_type = other DNA
tgaagaaggtgtatggcccc

SEQ ID NO: 81953 - DNA, 20 bp, synthetic construct
  misc_feature 1..20: note = CRISPR gRNA sequence
  source 1..20: mol_type = other DNA
aaggtgtatggccccaggta

SEQ ID NO: 81954 - DNA, 20 bp, synthetic construct
  misc_feature 1..20: note = CRISPR gRNA sequence
  source 1..20: mol_type = other DNA
gccatattactgaccctcta

SEQ ID NO: 81955 - DNA, 20 bp, synthetic construct
  misc_feature 1..20: note = CRISPR gRNA sequence
  source 1..20: mol_type = other DNA
catattactgaccctctaca

SEQ ID NO: 81956 - DNA, 20 bp, synthetic construct
  misc_feature 1..20: note = CRISPR gRNA sequence
  source 1..20: mol_type = other DNA
tattactgaccctctacaga

SEQ ID NO: 81957 - DNA, 20 bp, synthetic construct
  misc_feature 1..20: note = CRISPR gRNA sequence
  source 1..20: mol_type = other DNA
attactgaccctctacagag

SEQ ID NO: 81958 - DNA, 20 bp, synthetic construct
  misc_feature 1..20: note = CRISPR gRNA sequence
  source 1..20: mol_type = other DNA
ttactgaccctctacagaga

SEQ ID NO: 81959 - DNA, 20 bp, synthetic construct
  misc_feature 1..20: note = CRISPR gRNA sequence
  source 1..20: mol_type = other DNA
gaccctctacagagagggca

SEQ ID NO: 81960 - DNA, 20 bp, synthetic construct
  misc_feature 1..20: note = CRISPR gRNA sequence
  source 1..20: mol_type = other DNA
accctctacagagagggcaa

SEQ ID NO: 81961 - DNA, 20 bp, synthetic construct
  misc_feature 1..20: note = CRISPR gRNA sequence
  source 1..20: mol_type = other DNA
agagagggcaaaggaactgc

SEQ ID NO: 81962 - DNA, 20 bp, synthetic construct
  misc_feature 1..20: note = CRISPR gRNA sequence
  source 1..20: mol_type = other DNA
gggcaaaggaactgccagta

SEQ ID NO: 81963 - DNA, 20 bp, synthetic construct
  misc_feature 1..20: note = CRISPR gRNA sequence
  source 1..20: mol_type = other DNA
gaactgccagtatggtattg

SEQ ID NO: 81964 - DNA, 20 bp, synthetic construct
  misc_feature 1..20: note = CRISPR gRNA sequence
  source 1..20: mol_type = other DNA
aactgccagtatggtattgc

SEQ ID NO: 81965 - DNA, 20 bp, synthetic construct
  misc_feature 1..20: note = CRISPR gRNA sequence
  source 1..20: mol_type = other DNA
cagtatggtattgcaggata

SEQ ID NO: 81966 - DNA, 20 bp, synthetic construct
  misc_feature 1..20: note = CRISPR gRNA sequence
  source 1..20: mol_type = other DNA
agtatggtattgcaggataa

SEQ ID NO: 81967 - DNA, 20 bp, synthetic construct
  misc_feature 1..20: note = CRISPR gRNA sequence
  source 1..20: mol_type = other DNA
atggtattgcaggataaagg

SEQ ID NO: 81968 - DNA, 20 bp, synthetic construct
  misc_feature 1..20: note = CRISPR gRNA sequence
  source 1..20: mol_type = other DNA
tggtattgcaggataaaggc

SEQ ID NO: 81969 - DNA, 20 bp, synthetic construct
  misc_feature 1..20: note = CRISPR gRNA sequence
  source 1..20: mol_type = other DNA
tattgcaggataaaggcagg

SEQ ID NO: 81970 - DNA, 20 bp, synthetic construct
  misc_feature 1..20: note = CRISPR gRNA sequence
  source 1..20: mol_type = other DNA
tggttacccacattacctgc

SEQ ID NO: 81971 - DNA, 20 bp, synthetic construct
  misc_feature 1..20: note = CRISPR gRNA sequence
  source 1..20: mol_type = other DNA
ggttacccacattacctgca

SEQ ID NO: 81972 - DNA, 20 bp, synthetic construct
  misc_feature 1..20: note = CRISPR gRNA sequence
  source 1..20: mol_type = other DNA
ttcttctgccatttccacat

SEQ ID NO: 81973 - DNA, 20 bp, synthetic construct
  misc_feature 1..20: note = CRISPR gRNA sequence
  source 1..20: mol_type = other DNA
ccacattggacatctctgct

SEQ ID NO: 81974 - DNA, 20 bp, synthetic construct
  misc_feature 1..20: note = CRISPR gRNA sequence
  source 1..20: mol_type = other DNA
cacattggacatctctgctg

SEQ ID NO: 81975 - DNA, 20 bp, synthetic construct
  misc_feature 1..20: note = CRISPR gRNA sequence
  source 1..20: mol_type = other DNA
cattggacatctctgctgag

SEQ ID NO: 81976 - DNA, 20 bp, synthetic construct
  misc_feature 1..20: note = CRISPR gRNA sequence
  source 1..20: mol_type = other DNA
ttggacatctctgctgagga

SEQ ID NO: 81977 - DNA, 20 bp, synthetic construct
  misc_feature 1..20: note = CRISPR gRNA sequence
  source 1..20: mol_type = other DNA
tataatgttgttttattctt

SEQ ID NO: 81978 - DNA, 20 bp, synthetic construct
  misc_feature 1..20: note = CRISPR gRNA sequence
  source 1..20: mol_type = other DNA
atgttgttttattcttcaga

SEQ ID NO: 81979 - DNA, 20 bp, synthetic construct
  misc_feature 1..20: note = CRISPR gRNA sequence
  source 1..20: mol_type = other DNA
ttgttttattcttcagacag

SEQ ID NO: 81980 - DNA, 20 bp, synthetic construct
  misc_feature 1..20: note = CRISPR gRNA sequence
  source 1..20: mol_type = other DNA
gttttattcttcagacagaa

SEQ ID NO: 81981 - DNA, 20 bp, synthetic construct
  misc_feature 1..20: note = CRISPR gRNA sequence
  source 1..20: mol_type = other DNA
tttattcttcagacagaaga

SEQ ID NO: 81982 - DNA, 20 bp, synthetic construct
  misc_feature 1..20: note = CRISPR gRNA sequence
  source 1..20: mol_type = other DNA
ttattcttcagacagaagag

SEQ ID NO: 81983 - DNA, 20 bp, synthetic construct
  misc_feature 1..20: note = CRISPR gRNA sequence
  source 1..20: mol_type = other DNA
attcttcagacagaagagag

SEQ ID NO: 81984 - DNA, 20 bp, synthetic construct
  misc_feature 1..20: note = CRISPR gRNA sequence
  source 1..20: mol_type = other DNA
gacagaagagaggagttata

SEQ ID NO: 81985 - DNA, 20 bp, synthetic construct
  misc_feature 1..20: note = CRISPR gRNA sequence
  source 1..20: mol_type = other DNA
agaggagttatacagctctg

SEQ ID NO: 81986 - DNA, 20 bp, synthetic construct
  misc_feature 1..20: note = CRISPR gRNA sequence
  source 1..20: mol_type = other DNA
gcagacatcccattcctgta

SEQ ID NO: 81987 - DNA, 20 bp, synthetic construct
  misc_feature 1..20: note = CRISPR gRNA sequence
  source 1..20: mol_type = other DNA
cagacatcccattcctgtat

SEQ ID NO: 81988 - DNA, 20 bp, synthetic construct
  misc_feature 1..20: note = CRISPR gRNA sequence
  source 1..20: mol_type = other DNA
agacatcccattcctgtatg

SEQ ID NO: 81989 - DNA, 20 bp, synthetic construct
  misc_feature 1..20: note = CRISPR gRNA sequence
  source 1..20: mol_type = other DNA
tggggactgtgtttgcctct

SEQ ID NO: 81990 - DNA, 20 bp, synthetic construct
  misc_feature 1..20: note = CRISPR gRNA sequence
  source 1..20: mol_type = other DNA
gggactgtgtttgcctctta

SEQ ID NO: 81991 - DNA, 20 bp, synthetic construct
  misc_feature 1..20: note = CRISPR gRNA sequence
  source 1..20: mol_type = other DNA
ggactgtgtttgcctcttag

SEQ ID NO: 81992 - DNA, 20 bp, synthetic construct
  misc_feature 1..20: note = CRISPR gRNA sequence
  source 1..20: mol_type = other DNA
gtttgcctcttagaggttcc

SEQ ID NO: 81993 - DNA, 20 bp, synthetic construct
  misc_feature 1..20: note = CRISPR gRNA sequence
  source 1..20: mol_type = other DNA
tttgcctcttagaggttccc

SEQ ID NO: 81994 - DNA, 20 bp, synthetic construct
  misc_feature 1..20: note = CRISPR gRNA sequence
  source 1..20: mol_type = other DNA
cttagaggttcccaggccac

SEQ ID NO: 81995 - DNA, 20 bp, synthetic construct
  misc_feature 1..20: note = CRISPR gRNA sequence
  source 1..20: mol_type = other DNA
tagaggttcccaggccacta

SEQ ID NO: 81996 - DNA, 20 bp, synthetic construct
  misc_feature 1..20: note = CRISPR gRNA sequence
  source 1..20: mol_type = other DNA
agaggttcccaggccactag

SEQ ID NO: 81997 - DNA, 20 bp, synthetic construct
  misc_feature 1..20: note = CRISPR gRNA sequence
  source 1..20: mol_type = other DNA
aggttcccaggccactagag

SEQ ID NO: 81998 - DNA, 20 bp, synthetic construct
  misc_feature 1..20: note = CRISPR gRNA sequence
  source 1..20: mol_type = other DNA
ccaggccactagaggagata

SEQ ID NO: 81999 - DNA, 20 bp, synthetic construct
  misc_feature 1..20: note = CRISPR gRNA sequence
  source 1..20: mol_type = other DNA
caggccactagaggagataa

SEQ ID NO: 82000 - DNA, 20 bp, synthetic construct
  misc_feature 1..20: note = CRISPR gRNA sequence
  source 1..20: mol_type = other DNA
aggccactagaggagataaa

SEQ ID NO: 82001 - DNA, 20 bp, synthetic construct
  misc_feature 1..20: note = CRISPR gRNA sequence
  source 1..20: mol_type = other DNA
ctagaggagataaagggaaa

SEQ ID NO: 82002 - DNA, 20 bp, synthetic construct
  misc_feature 1..20: note = CRISPR gRNA sequence
  source 1..20: mol_type = other DNA
ttgatataatgatactataa

SEQ ID NO: 82003 - DNA, 20 bp, synthetic construct
  misc_feature 1..20: note = CRISPR gRNA sequence
  source 1..20: mol_type = other DNA
actataatagatgtaactac

SEQ ID NO: 82004 - DNA, 20 bp, synthetic construct
  misc_feature 1..20: note = CRISPR gRNA sequence
  source 1..20: mol_type = other DNA
ctataatagatgtaactaca

SEQ ID NO: 82005 - DNA, 20 bp, synthetic construct
  misc_feature 1..20: note = CRISPR gRNA sequence
  source 1..20: mol_type = other DNA
ataatagatgtaactacaag

SEQ ID NO: 82006 - DNA, 20 bp, synthetic construct
  misc_feature 1..20: note = CRISPR gRNA sequence
  source 1..20: mol_type = other DNA
gatgtaactacaaggagctc

SEQ ID NO: 82007 - DNA, 20 bp, synthetic construct
  misc_feature 1..20: note = CRISPR gRNA sequence
  source 1..20: mol_type = other DNA
gtaactacaaggagctccag

SEQ ID NO: 82008 - DNA, 20 bp, synthetic construct
  misc_feature 1..20: note = CRISPR gRNA sequence
  source 1..20: mol_type = other DNA
ctacaaggagctccagaagc

SEQ ID NO: 82009 - DNA, 20 bp, synthetic construct
  misc_feature 1..20: note = CRISPR gRNA sequence
  source 1..20: mol_type = other DNA
acaaggagctccagaagcaa

SEQ ID NO: 82010 - DNA, 20 bp, synthetic construct
  misc_feature 1..20: note = CRISPR gRNA sequence
  source 1..20: mol_type = other DNA
aaggagctccagaagcaaga

SEQ ID NO: 82011 - DNA, 20 bp, synthetic construct
  misc_feature 1..20: note = CRISPR gRNA sequence
  source 1..20: mol_type = other DNA
ggagctccagaagcaagaga

SEQ ID NO: 82012 - DNA, 20 bp, synthetic construct
  misc_feature 1..20: note = CRISPR gRNA sequence
  source 1..20: mol_type = other DNA
gagctccagaagcaagagag

SEQ ID NO: 82013 - DNA, 20 bp, synthetic construct
  misc_feature 1..20: note = CRISPR gRNA sequence
  source 1..20: mol_type = other DNA
agctccagaagcaagagaga

SEQ ID NO: 82014 - DNA, 20 bp, synthetic construct
  misc_feature 1..20: note = CRISPR gRNA sequence
  source 1..20: mol_type = other DNA
ctccagaagcaagagagagg

SEQ ID NO: 82015 - DNA, 20 bp, synthetic construct
  misc_feature 1..20: note = CRISPR gRNA sequence
  source 1..20: mol_type = other DNA
tccagaagcaagagagaggg

SEQ ID NO: 82016 - DNA, 20 bp, synthetic construct
  misc_feature 1..20: note = CRISPR gRNA sequence
  source 1..20: mol_type = other DNA
gcaagagagagggaggaact

SEQ ID NO: 82017 - DNA, 20 bp, synthetic construct
  misc_feature 1..20: note = CRISPR gRNA sequence
  source 1..20: mol_type = other DNA
cttggacttctctgcatctt

SEQ ID NO: 82018 - DNA, 20 bp, synthetic construct
  misc_feature 1..20: note = CRISPR gRNA sequence
  source 1..20: mol_type = other DNA
gacttctctgcatctttagt

SEQ ID NO: 82019 - DNA, 20 bp, synthetic construct
  misc_feature 1..20: note = CRISPR gRNA sequence
  source 1..20: mol_type = other DNA
cttctctgcatctttagttg

SEQ ID NO: 82020 - DNA, 20 bp, synthetic construct
  misc_feature 1..20: note = CRISPR gRNA sequence
  source 1..20: mol_type = other DNA
gcatctttagttggagtcca

SEQ ID NO: 82021 - DNA, 20 bp, synthetic construct
  misc_feature 1..20: note = CRISPR gRNA sequence
  source 1..20: mol_type = other DNA
catctttagttggagtccaa

SEQ ID NO: 82022 - DNA, 20 bp, synthetic construct
  misc_feature 1..20: note = CRISPR gRNA sequence
  source 1..20: mol_type = other DNA
ttcaatgaaattctactgcc

SEQ ID NO: 82023 - DNA, 20 bp, synthetic construct
  misc_feature 1..20: note = CRISPR gRNA sequence
  source 1..20: mol_type = other DNA
tcaatgaaattctactgccc

SEQ ID NO: 82024 - DNA, 20 bp, synthetic construct
  misc_feature 1..20: note = CRISPR gRNA sequence
  source 1..20: mol_type = other DNA
caatgaaattctactgccca

SEQ ID NO: 82025 - DNA, 20 bp, synthetic construct
  misc_feature 1..20: note = CRISPR gRNA sequence
  source 1..20: mol_type = other DNA
tcaaatctcctgttatattc

SEQ ID NO: 82026 - DNA, 20 bp, synthetic construct
  misc_feature 1..20: note = CRISPR gRNA sequence
  source 1..20: mol_type = other DNA
tctcctgttatattctagaa

SEQ ID NO: 82027 - DNA, 20 bp, synthetic construct
  misc_feature 1..20: note = CRISPR gRNA sequence
  source 1..20: mol_type = other DNA
ctcctgttatattctagaac

SEQ ID NO: 82028 - DNA, 20 bp, synthetic construct
  misc_feature 1..20: note = CRISPR gRNA sequence
  source 1..20: mol_type = other DNA
tcctgttatattctagaaca

SEQ ID NO: 82029 - DNA, 20 bp, synthetic construct
  misc_feature 1..20: note = CRISPR gRNA sequence
  source 1..20: mol_type = other DNA
tctagaacagggaattgatt

SEQ ID NO: 82030 - DNA, 20 bp, synthetic construct
  misc_feature 1..20: note = CRISPR gRNA sequence
  source 1..20: mol_type = other DNA
ctagaacagggaattgattt

SEQ ID NO: 82031 - DNA, 20 bp, synthetic construct
  misc_feature 1..20: note = CRISPR gRNA sequence
  source 1..20: mol_type = other DNA
agaacagggaattgatttgg

SEQ ID NO: 82032 - DNA, 20 bp, synthetic construct
  misc_feature 1..20: note = CRISPR gRNA sequence
  source 1..20: mol_type = other DNA
aacagggaattgatttggga

SEQ ID NO: 82033 - DNA, 20 bp, synthetic construct
  misc_feature 1..20: note = CRISPR gRNA sequence
  source 1..20: mol_type = other DNA
gaattgatttgggagagcat

SEQ ID NO: 82034 - DNA, 20 bp, synthetic construct
  misc_feature 1..20: note = CRISPR gRNA sequence
  source 1..20: mol_type = other DNA
aattgatttgggagagcatc

SEQ ID NO: 82035 - DNA, 20 bp, synthetic construct
  misc_feature 1..20: note = CRISPR gRNA sequence
  source 1..20: mol_type = other DNA
tgatttgggagagcatcagg

SEQ ID NO: 82036 - DNA, 20 bp, synthetic construct
  misc_feature 1..20: note = CRISPR gRNA sequence
  source 1..20: mol_type = other DNA
gatttgggagagcatcagga

SEQ ID NO: 82037 - DNA, 20 bp, synthetic construct
  misc_feature 1..20: note = CRISPR gRNA sequence
  source 1..20: mol_type = other DNA
ttgggagagcatcaggaagg

SEQ ID NO: 82038 - DNA, 20 bp, synthetic construct
  misc_feature 1..20: note = CRISPR gRNA sequence
  source 1..20: mol_type = other DNA
aggaaggtggatgatctgcc

SEQ ID NO: 82039 - DNA, 20 bp, synthetic construct
  misc_feature 1..20: note = CRISPR gRNA sequence
  source 1..20: mol_type = other DNA
gatctgcccagtcacactgt

SEQ ID NO: 82040 - DNA, 20 bp, synthetic construct
  misc_feature 1..20: note = CRISPR gRNA sequence
  source 1..20: mol_type = other DNA
gtcacactgttagtaaattg

SEQ ID NO: 82041 - DNA, 20 bp, synthetic construct
  misc_feature 1..20: note = CRISPR gRNA sequence
  source 1..20: mol_type = other DNA
cacactgttagtaaattgta

SEQ ID NO: 82042 - DNA, 20 bp, synthetic construct
  misc_feature 1..20: note = CRISPR gRNA sequence
  source 1..20: mol_type = other DNA
ctgttagtaaattgtagagc

SEQ ID NO: 82043 - DNA, 20 bp, synthetic construct
  misc_feature 1..20: note = CRISPR gRNA sequence
  source 1..20: mol_type = other DNA
tgttagtaaattgtagagcc

SEQ ID NO: 82044 - DNA, 20 bp, synthetic construct
  misc_feature 1..20: note = CRISPR gRNA sequence
  source 1..20: mol_type = other DNA
ccaggacctgaactctaata

SEQ ID NO: 82045 - DNA, 20 bp, synthetic construct
  misc_feature 1..20: note = CRISPR gRNA sequence
  source 1..20: mol_type = other DNA
agtcatgtgttacttaatga

SEQ ID NO: 82046 - DNA, 20 bp, synthetic construct
  misc_feature 1..20: note = CRISPR gRNA sequence
  source 1..20: mol_type = other DNA
gtcatgtgttacttaatgac

SEQ ID NO: 82047 - DNA, 20 bp, synthetic construct
  misc_feature 1..20: note = CRISPR gRNA sequence
  source 1..20: mol_type = other DNA
tcatgtgttacttaatgacg

SEQ ID NO: 82048 - DNA, 20 bp, synthetic construct
  misc_feature 1..20: note = CRISPR gRNA sequence
  source 1..20: mol_type = other DNA
taatgacggggacatgttct

SEQ ID NO: 82049 - DNA, 20 bp, synthetic construct
  misc_feature 1..20: note = CRISPR gRNA sequence
  source 1..20: mol_type = other DNA
gagaaatgcttacacaaacc

SEQ ID NO: 82050 - DNA, 20 bp, synthetic construct
  misc_feature 1..20: note = CRISPR gRNA sequence
  source 1..20: mol_type = other DNA
agaaatgcttacacaaacct

SEQ ID NO: 82051 - DNA, 20 bp, synthetic construct
  misc_feature 1..20: note = CRISPR gRNA sequence
  source 1..20: mol_type = other DNA
ttacacaaacctaggtgttg

SEQ ID NO: 82052 - DNA, 20 bp, synthetic construct
  misc_feature 1..20: note = CRISPR gRNA sequence
  source 1..20: mol_type = other DNA
gttgtagcctactacacgca

SEQ ID NO: 82053 - DNA, 20 bp, synthetic construct
  misc_feature 1..20: note = CRISPR gRNA sequence
  source 1..20: mol_type = other DNA
ttgtagcctactacacgcat

SEQ ID NO: 82054 - DNA, 20 bp, synthetic construct
  misc_feature 1..20: note = CRISPR gRNA sequence
  source 1..20: mol_type = other DNA
tactacacgcataggctaca

SEQ ID NO: 82055 - DNA, 20 bp, synthetic construct
  misc_feature 1..20: note = CRISPR gRNA sequence
  source 1..20: mol_type = other DNA
cacgcataggctacatggta

SEQ ID NO: 82056 - DNA, 20 bp, synthetic construct
  misc_feature 1..20: note = CRISPR gRNA sequence
  source 1..20: mol_type = other DNA
atggtatagcctattgctcc

SEQ ID NO: 82057 - DNA, 20 bp, synthetic construct
  misc_feature 1..20: note = CRISPR gRNA sequence
  source 1..20: mol_type = other DNA
tcctagactacaaacctgta

SEQ ID NO: 82058 - DNA, 20 bp, synthetic construct
  misc_feature 1..20: note = CRISPR gRNA sequence
  source 1..20: mol_type = other DNA
tgttactgtactgaatactg

SEQ ID NO: 82059 - DNA, 20 bp, synthetic construct
  misc_feature 1..20: note = CRISPR gRNA sequence
  source 1..20: mol_type = other DNA
gttactgtactgaatactgt

SEQ ID NO: 82060 - DNA, 20 bp, synthetic construct
  misc_feature 1..20: note = CRISPR gRNA sequence
  source 1..20: mol_type = other DNA
actgtactgaatactgtggg

SEQ ID NO: 82061 - DNA, 20 bp, synthetic construct
  misc_feature 1..20: note = CRISPR gRNA sequence
  source 1..20: mol_type = other DNA
tgtgggcagttgtaacacaa

SEQ ID NO: 82062 - DNA, 20 bp, synthetic construct
  misc_feature 1..20: note = CRISPR gRNA sequence
  source 1..20: mol_type = other DNA
ggcagttgtaacacaatggt

SEQ ID NO: 82063 - DNA, 20 bp, synthetic construct
  misc_feature 1..20: note = CRISPR gRNA sequence
  source 1..20: mol_type = other DNA
agtatttgtgtatctaaaca

SEQ ID NO: 82064 - DNA, 20 bp, synthetic construct
  misc_feature 1..20: note = CRISPR gRNA sequence
  source 1..20: mol_type = other DNA
atttgtgtatctaaacatag

SEQ ID NO: 82065 - DNA, 20 bp, synthetic construct
  misc_feature 1..20: note = CRISPR gRNA sequence
  source 1..20: mol_type = other DNA
gtatctaaacatagaagttg

SEQ ID NO: 82066 - DNA, 20 bp, synthetic construct
  misc_feature 1..20: note = CRISPR gRNA sequence
  source 1..20: mol_type = other DNA
atatgctattttaatcttat

SEQ ID NO: 82067 - DNA, 20 bp, synthetic construct
  misc_feature 1..20: note = CRISPR gRNA sequence
  source 1..20: mol_type = other DNA
tgagaccactgtcatatata

SEQ ID NO: 82068 - DNA, 20 bp, synthetic construct
  misc_feature 1..20: note = CRISPR gRNA sequence
  source 1..20: mol_type = other DNA
cattgaccaaaacatcatat

SEQ ID NO: 82069 - DNA, 20 bp, synthetic construct
  misc_feature 1..20: note = CRISPR gRNA sequence
  source 1..20: mol_type = other DNA
atatcagcattttttcttct

SEQ ID NO: 82070 - DNA, 20 bp, synthetic construct
  misc_feature 1..20: note = CRISPR gRNA sequence
  source 1..20: mol_type = other DNA
cattttttcttctaagattt

SEQ ID NO: 82071 - DNA, 20 bp, synthetic construct
  misc_feature 1..20: note = CRISPR gRNA sequence
  source 1..20: mol_type = other DNA
attttttcttctaagatttt

SEQ ID NO: 82072 - DNA, 20 bp, synthetic construct
  misc_feature 1..20: note = CRISPR gRNA sequence
  source 1..20: mol_type = other DNA
tttttcttctaagattttgg

SEQ ID NO: 82073 - DNA, 20 bp, synthetic construct
  misc_feature 1..20: note = CRISPR gRNA sequence
  source 1..20: mol_type = other DNA
ctaagattttgggagcacca

SEQ ID NO: 82074 - DNA, 20 bp, synthetic construct
  misc_feature 1..20: note = CRISPR gRNA sequence
  source 1..20: mol_type = other DNA
taagattttgggagcaccaa

SEQ ID NO: 82075 - DNA, 20 bp, synthetic construct
  misc_feature 1..20: note = CRISPR gRNA sequence
  source 1..20: mol_type = other DNA
aagattttgggagcaccaaa

SEQ ID NO: 82076 - DNA, 20 bp, synthetic construct
  misc_feature 1..20: note = CRISPR gRNA sequence
  source 1..20: mol_type = other DNA
gcaccaaagggatacactaa

SEQ ID NO: 82077 - DNA, 20 bp, synthetic construct
  misc_feature 1..20: note = CRISPR gRNA sequence
  source 1..20: mol_type = other DNA
caccaaagggatacactaac

SEQ ID NO: 82078 - DNA, 20 bp, synthetic construct
  misc_feature 1..20: note = CRISPR gRNA sequence
  source 1..20: mol_type = other DNA
acaggatatactctttataa

SEQ ID NO: 82079 - DNA, 20 bp, synthetic construct
  misc_feature 1..20: note = CRISPR gRNA sequence
  source 1..20: mol_type = other DNA
caggatatactctttataat

SEQ ID NO: 82080 - DNA, 20 bp, synthetic construct
  misc_feature 1..20: note = CRISPR gRNA sequence
  source 1..20: mol_type = other DNA
tatactctttataatgggtt

SEQ ID NO: 82081 - DNA, 20 bp, synthetic construct
  misc_feature 1..20: note = CRISPR gRNA sequence
  source 1..20: mol_type = other DNA
tactctttataatgggtttg

SEQ ID NO: 82082 - DNA, 20 bp, synthetic construct
  misc_feature 1..20: note = CRISPR gRNA sequence
  source 1..20: mol_type = other DNA
tgggtttggagaactgtctg

SEQ ID NO: 82083 - DNA, 20 bp, synthetic construct
  misc_feature 1..20: note = CRISPR gRNA sequence
  source 1..20: mol_type = other DNA
ctgcagctacttcttttaaa

SEQ ID NO: 82084 - DNA, 20 bp, synthetic construct
  misc_feature 1..20: note = CRISPR gRNA sequence
  source 1..20: mol_type = other DNA
tgcagctacttcttttaaaa

SEQ ID NO: 82085 - DNA, 20 bp, synthetic construct
  misc_feature 1..20: note = CRISPR gRNA sequence
  source 1..20: mol_type = other DNA
ttttaaaaaggtgatctaca

SEQ ID NO: 82086 - DNA, 20 bp, synthetic construct
  misc_feature 1..20: note = CRISPR gRNA sequence
  source 1..20: mol_type = other DNA
taaaaaggtgatctacacag

SEQ ID NO: 82087 - DNA, 20 bp, synthetic construct
  misc_feature 1..20: note = CRISPR gRNA sequence
  source 1..20: mol_type = other DNA
gtgatctacacagtagaaat

SEQ ID NO: 82088 - DNA, 20 bp, synthetic construct
  misc_feature 1..20: note = CRISPR gRNA sequence
  source 1..20: mol_type = other DNA
ctacacagtagaaattagac

SEQ ID NO: 82089 - DNA, 20 bp, synthetic construct
  misc_feature 1..20: note = CRISPR gRNA sequence
  source 1..20: mol_type = other DNA
cagtagaaattagacaagtt

SEQ ID NO: 82090 - DNA, 20 bp, synthetic construct
  misc_feature 1..20: note = CRISPR gRNA sequence
  source 1..20: mol_type = other DNA
aattagacaagtttggtaat

SEQ ID NO: 82091 - DNA, 20 bp, synthetic construct
  misc_feature 1..20: note = CRISPR gRNA sequence
  source 1..20: mol_type = other DNA
taacctttttcttttctttt

SEQ ID NO: 82092 - DNA, 20 bp, synthetic construct
  misc_feature 1..20: note = CRISPR gRNA sequence
  source 1..20: mol_type = other DNA
aacctttttcttttcttttc

SEQ ID NO: 82093 - DNA, 20 bp, synthetic construct
  misc_feature 1..20: note = CRISPR gRNA sequence
  source 1..20: mol_type = other DNA
ttcttttcttttcaggtttg

SEQ ID NO: 82094 - DNA, 20 bp, synthetic construct
  misc_feature 1..20: note = CRISPR gRNA sequence
  source 1..20: mol_type = other DNA
aggtttgaagatgccgcatt

SEQ ID NO: 82095 - DNA, 20 bp, synthetic construct
  misc_feature 1..20: note = CRISPR gRNA sequence
  source 1..20: mol_type = other DNA
tgaagatgccgcatttggat

SEQ ID NO: 82096 - DNA, 20 bp, synthetic construct
  misc_feature 1..20: note = CRISPR gRNA sequence
  source 1..20: mol_type = other DNA
tacactttatgcacaaaatg

SEQ ID NO: 82097 - DNA, 20 bp, synthetic construct
  misc_feature 1..20: note = CRISPR gRNA sequence
  source 1..20: mol_type = other DNA
acactttatgcacaaaatgt

SEQ ID NO: 82098 - DNA, 20 bp, synthetic construct
  misc_feature 1..20: note = CRISPR gRNA sequence
  source 1..20: mol_type = other DNA
cactttatgcacaaaatgta

SEQ ID NO: 82099 - DNA, 20 bp, synthetic construct
  misc_feature 1..20: note = CRISPR gRNA sequence
  source 1..20: mol_type = other DNA
gggttataataatgttaaca

SEQ ID NO: 82100 - DNA, 20 bp, synthetic construct
  misc_feature 1..20: note = CRISPR gRNA sequence
  source 1..20: mol_type = other DNA
cttctttataattctacttt

SEQ ID NO: 82101 - DNA, 20 bp, synthetic construct
  misc_feature 1..20: note = CRISPR gRNA sequence
  source 1..20: mol_type = other DNA
tctccatgtttgatgtatct

SEQ ID NO: 82102 - DNA, 20 bp, synthetic construct
  misc_feature 1..20: note = CRISPR gRNA sequence
  source 1..20: mol_type = other DNA
ccatgtttgatgtatctgag

SEQ ID NO: 82103 - DNA, 20 bp, synthetic construct
  misc_feature 1..20: note = CRISPR gRNA sequence
  source 1..20: mol_type = other DNA
catgtttgatgtatctgagc

SEQ ID NO: 82104 - DNA, 20 bp, synthetic construct
  misc_feature 1..20: note = CRISPR gRNA sequence
  source 1..20: mol_type = other DNA
tatctgagcaggttgctcca

SEQ ID NO: 82105 - DNA, 20 bp, synthetic construct
  misc_feature 1..20: note = CRISPR gRNA sequence
  source 1..20: mol_type = other DNA
atctgagcaggttgctccac

SEQ ID NO: 82106 - DNA, 20 bp, synthetic construct
  misc_feature 1..20: note = CRISPR gRNA sequence
  source 1..20: mol_type = other DNA
tgagcaggttgctccacagg

SEQ ID NO: 82107 - DNA, 20 bp, synthetic construct
  misc_feature 1..20: note = CRISPR gRNA sequence
  source 1..20: mol_type = other DNA
ggttgctccacaggtagctc

SEQ ID NO: 82108 - DNA, 20 bp, synthetic construct
  misc_feature 1..20: note = CRISPR gRNA sequence
  source 1..20: mol_type = other DNA
gttgctccacaggtagctct

SEQ ID NO: 82109 - DNA, 20 bp, synthetic construct
  misc_feature 1..20: note = CRISPR gRNA sequence
  source 1..20: mol_type = other DNA
tgctccacaggtagctctag

SEQ ID NO: 82110 - DNA, 20 bp, synthetic construct
  misc_feature 1..20: note = CRISPR gRNA sequence
  source 1..20: mol_type = other DNA
gctccacaggtagctctagg

SEQ ID NO: 82111 - DNA, 20 bp, synthetic construct
  misc_feature 1..20: note = CRISPR gRNA sequence
  source 1..20: mol_type = other DNA
ctccacaggtagctctagga

SEQ ID NO: 82112 - DNA, 20 bp, synthetic construct
  misc_feature 1..20: note = CRISPR gRNA sequence
  source 1..20: mol_type = other DNA
acaggtagctctaggagggc

SEQ ID NO: 82113 - DNA, 20 bp, synthetic construct
  misc_feature 1..20: note = CRISPR gRNA sequence
  source 1..20: mol_type = other DNA
ctctaggagggctggcaact

SEQ ID NO: 82114 - DNA, 20 bp, synthetic construct
  misc_feature 1..20: note = CRISPR gRNA sequence
  source 1..20: mol_type = other DNA
ctaggagggctggcaactta

SEQ ID NO: 82115 - DNA, 20 bp, synthetic construct
  misc_feature 1..20: note = CRISPR gRNA sequence
  source 1..20: mol_type = other DNA
taggagggctggcaacttag

SEQ ID NO: 82116 - DNA, 20 bp, synthetic construct
  misc_feature 1..20: note = CRISPR gRNA sequence
  source 1..20: mol_type = other DNA
gagggctggcaacttagagg

SEQ ID NO: 82117 - DNA, 20 bp, synthetic construct
  misc_feature 1..20: note = CRISPR gRNA sequence
  source 1..20: mol_type = other DNA
agggctggcaacttagaggt

SEQ ID NO: 82118 - DNA, 20 bp, synthetic construct
  misc_feature 1..20: note = CRISPR gRNA sequence
  source 1..20: mol_type = other DNA
gggctggcaacttagaggtg

SEQ ID NO: 82119 - DNA, 20 bp, synthetic construct
  misc_feature 1..20: note = CRISPR gRNA sequence
  source 1..20: mol_type = other DNA
gctggcaacttagaggtggg

SEQ ID NO: 82120 - DNA, 20 bp, synthetic construct
  misc_feature 1..20: note = CRISPR gRNA sequence
  source 1..20: mol_type = other DNA
ggcaacttagaggtggggag

SEQ ID NO: 82121 - DNA, 20 bp, synthetic construct
  misc_feature 1..20: note = CRISPR gRNA sequence
  source 1..20: mol_type = other DNA
caacttagaggtggggagca

SEQ ID NO: 82122 - DNA, 20 bp, synthetic construct
  misc_feature 1..20: note = CRISPR gRNA sequence
  source 1..20: mol_type = other DNA
cttatccaacatcaacatct

SEQ ID NO: 82123 - DNA, 20 bp, synthetic construct
  misc_feature 1..20: note = CRISPR gRNA sequence
  source 1..20: mol_type = other DNA
tccaacatcaacatcttggt

SEQ ID NO: 82124 - DNA, 20 bp, synthetic construct
  misc_feature 1..20: note = CRISPR gRNA sequence
  source 1..20: mol_type = other DNA
tcttcaatctcttgcactca

SEQ ID NO: 82125 - DNA, 20 bp, synthetic construct
  misc_feature 1..20: note = CRISPR gRNA sequence
  source 1..20: mol_type = other DNA
tcttgcactcaaagcttgtt

SEQ ID NO: 82126 - DNA, 20 bp, synthetic construct
  misc_feature 1..20: note = CRISPR gRNA sequence
  source 1..20: mol_type = other DNA
gcactcaaagcttgttaaga

SEQ ID NO: 82127 - DNA, 20 bp, synthetic construct
  misc_feature 1..20: note = CRISPR gRNA sequence
  source 1..20: mol_type = other DNA
caaagcttgttaagatagtt

SEQ ID NO: 82128 - DNA, 20 bp, synthetic construct
  misc_feature 1..20: note = CRISPR gRNA sequence
  source 1..20: mol_type = other DNA
taagatagttaagcgtgcat

SEQ ID NO: 82129 - DNA, 20 bp, synthetic construct
  misc_feature 1..20: note = CRISPR gRNA sequence
  source 1..20: mol_type = other DNA
tccaatttacatactctgct

SEQ ID NO: 82130 - DNA, 20 bp, synthetic construct
  misc_feature 1..20: note = CRISPR gRNA sequence
  source 1..20: mol_type = other DNA
tacatactctgcttagaatt

SEQ ID NO: 82131 - DNA, 20 bp, synthetic construct
  misc_feature 1..20: note = CRISPR gRNA sequence
  source 1..20: mol_type = other DNA
acatactctgcttagaattt

SEQ ID NO: 82132 - DNA, 20 bp, synthetic construct
  misc_feature 1..20: note = CRISPR gRNA sequence
  source 1..20: mol_type = other DNA
catactctgcttagaatttg

SEQ ID NO: 82133 - DNA, 20 bp, synthetic construct
  misc_feature 1..20: note = CRISPR gRNA sequence
  source 1..20: mol_type = other DNA
atactctgcttagaatttgg

SEQ ID NO: 82134 - DNA, 20 bp, synthetic construct
  misc_feature 1..20: note = CRISPR gRNA sequence
  source 1..20: mol_type = other DNA
ttagaatttgggggaaaatt

SEQ ID NO: 82135 - DNA, 20 bp, synthetic construct
  misc_feature 1..20: note = CRISPR gRNA sequence
  source 1..20: mol_type = other DNA
aaatttagaaatataattga

SEQ ID NO: 82136 - DNA, 20 bp, synthetic construct
  misc_feature 1..20: note = CRISPR gRNA sequence
  source 1..20: mol_type = other DNA
aatttagaaatataattgac

SEQ ID NO: 82137 - DNA, 20 bp, synthetic construct
  misc_feature 1..20: note = CRISPR gRNA sequence
  source 1..20: mol_type = other DNA
aatataattgacaggattat

SEQ ID NO: 82138 - DNA, 20 bp, synthetic construct
  misc_feature 1..20: note = CRISPR gRNA sequence
  source 1..20: mol_type = other DNA
aatgaaacattttgtcatat

SEQ ID NO: 82139 - DNA, 20 bp, synthetic construct
  misc_feature 1..20: note = CRISPR gRNA sequence
  source 1..20: mol_type = other DNA
tacttcttatacatttgata

SEQ ID NO: 82140 - DNA, 20 bp, synthetic construct
  misc_feature 1..20: note = CRISPR gRNA sequence
  source 1..20: mol_type = other DNA
tcttatacatttgataaagt

SEQ ID NO: 82141 - DNA, 20 bp, synthetic construct
  misc_feature 1..20: note = CRISPR gRNA sequence
  source 1..20: mol_type = other DNA
cttatacatttgataaagta

SEQ ID NO: 82142 - DNA, 20 bp, synthetic construct
  misc_feature 1..20: note = CRISPR gRNA sequence
  source 1..20: mol_type = other DNA
acatttgataaagtaaggca

SEQ ID NO: 82143 - DNA, 20 bp, synthetic construct
  misc_feature 1..20: note = CRISPR gRNA sequence
  source 1..20: mol_type = other DNA
gataaagtaaggcatggttg

SEQ ID NO: 82144 - DNA, 20 bp, synthetic construct
  misc_feature 1..20: note = CRISPR gRNA sequence
  source 1..20: mol_type = other DNA
aggcatggttgtggttaatc

SEQ ID NO: 82145 - DNA, 20 bp, synthetic construct
  misc_feature 1..20: note = CRISPR gRNA sequence
  source 1..20: mol_type = other DNA
ctggtttatttttgttccac

SEQ ID NO: 82146 - DNA, 20 bp, synthetic construct
  misc_feature 1..20: note = CRISPR gRNA sequence
  source 1..20: mol_type = other DNA
attacccctttattttcaaa

SEQ ID NO: 82147 - DNA, 20 bp, synthetic construct
  misc_feature 1..20: note = CRISPR gRNA sequence
  source 1..20: mol_type = other DNA
ttacccctttattttcaaac

SEQ ID NO: 82148 - DNA, 20 bp, synthetic construct
  misc_feature 1..20: note = CRISPR gRNA sequence
  source 1..20: mol_type = other DNA
tacccctttattttcaaaca

SEQ ID NO: 82149 - DNA, 20 bp, synthetic construct
  misc_feature 1..20: note = CRISPR gRNA sequence
  source 1..20: mol_type = other DNA
tttattttcaaacagggaaa

SEQ ID NO: 82150 - DNA, 20 bp, synthetic construct
  misc_feature 1..20: note = CRISPR gRNA sequence
  source 1..20: mol_type = other DNA
caaacagggaaacagtcttc

SEQ ID NO: 82151 - DNA, 20 bp, synthetic construct
  misc_feature 1..20: note = CRISPR gRNA sequence
  source 1..20: mol_type = other DNA
aacagtcttcaagttccact

SEQ ID NO: 82152 - DNA, 20 bp, synthetic construct
  misc_feature 1..20: note = CRISPR gRNA sequence
  source 1..20: mol_type = other DNA
aaatgtgaaccccttgtata

SEQ ID NO: 82153 - DNA, 20 bp, synthetic construct
  misc_feature 1..20: note = CRISPR gRNA sequence
  source 1..20: mol_type = other DNA
atgtgaaccccttgtatata

SEQ ID NO: 82154 - DNA, 20 bp, synthetic construct
  misc_feature 1..20: note = CRISPR gRNA sequence
  source 1..20: mol_type = other DNA
aaccccttgtatatagagtt

SEQ ID NO: 82155 - DNA, 20 bp, synthetic construct
  misc_feature 1..20: note = CRISPR gRNA sequence
  source 1..20: mol_type = other DNA
agccaaactctatatacaag

SEQ ID NO: 82156 - DNA, 20 bp, synthetic construct
  misc_feature 1..20: note = CRISPR gRNA sequence
  source 1..20: mol_type = other DNA
aggggttcacattttttacc

SEQ ID NO: 82157 - DNA, 20 bp, synthetic construct
  misc_feature 1..20: note = CRISPR gRNA sequence
  source 1..20: mol_type = other DNA
ggttcacattttttaccaag

SEQ ID NO: 82158 - DNA, 20 bp, synthetic construct
  misc_feature 1..20: note = CRISPR gRNA sequence
  source 1..20: mol_type = other DNA
tttttaccaagtggaacttg

SEQ ID NO: 82159 - DNA, 20 bp, synthetic construct
  misc_feature 1..20: note = CRISPR gRNA sequence
  source 1..20: mol_type = other DNA
tgtttccctgtttgaaaata

SEQ ID NO: 82160 - DNA, 20 bp, synthetic construct
  misc_feature 1..20: note = CRISPR gRNA sequence
  source 1..20: mol_type = other DNA
gtttccctgtttgaaaataa

SEQ ID NO: 82161 - DNA, 20 bp, synthetic construct
  misc_feature 1..20: note = CRISPR gRNA sequence
  source 1..20: mol_type = other DNA
tttccctgtttgaaaataaa

SEQ ID NO: 82162 - DNA, 20 bp, synthetic construct
  misc_feature 1..20: note = CRISPR gRNA sequence
  source 1..20: mol_type = other DNA
ttccctgtttgaaaataaag

SEQ ID NO: 82163 - DNA, 20 bp, synthetic construct
  misc_feature 1..20: note = CRISPR gRNA sequence
  source 1..20: mol_type = other DNA
gtttgaaaataaaggggtaa

SEQ ID NO: 82164 - DNA, 20 bp, synthetic construct
  misc_feature 1..20: note = CRISPR gRNA sequence
  source 1..20: mol_type = other DNA
tgaaaataaaggggtaatag

SEQ ID NO: 82165 - DNA, 20 bp, synthetic construct
  misc_feature 1..20: note = CRISPR gRNA sequence
  source 1..20: mol_type = other DNA
gaaaataaaggggtaatagt

SEQ ID NO: 82166 - DNA, 20 bp, synthetic construct
  misc_feature 1..20: note = CRISPR gRNA sequence
  source 1..20: mol_type = other DNA
aaataaaggggtaatagtgg

SEQ ID NO: 82167 - DNA, 20 bp, synthetic construct
  misc_feature 1..20: note = CRISPR gRNA sequence
  source 1..20: mol_type = other DNA
aaaggggtaatagtgggagt

SEQ ID NO: 82168 - DNA, 20 bp, synthetic construct
  misc_feature 1..20: note = CRISPR gRNA sequence
  source 1..20: mol_type = other DNA
taatagtgggagtgagatat

SEQ ID NO: 82169 - DNA, 20 bp, synthetic construct
  misc_feature 1..20: note = CRISPR gRNA sequence
  source 1..20: mol_type = other DNA
atagtgggagtgagatataa

SEQ ID NO: 82170 - DNA, 20 bp, synthetic construct
  misc_feature 1..20: note = CRISPR gRNA sequence
  source 1..20: mol_type = other DNA
gatataagagataacacatc

SEQ ID NO: 82171 - DNA, 20 bp, synthetic construct
  misc_feature 1..20: note = CRISPR gRNA sequence
  source 1..20: mol_type = other DNA
tttatgatttatttaacttg

SEQ ID NO: 82172 - DNA, 20 bp, synthetic construct
  misc_feature 1..20: note = CRISPR gRNA sequence
  source 1..20: mol_type = other DNA
cttgtggaacaaaaataaac

SEQ ID NO: 82173 - DNA, 20 bp, synthetic construct
  misc_feature 1..20: note = CRISPR gRNA sequence
  source 1..20: mol_type = other DNA
ccttactttatcaaatgtat

SEQ ID NO: 82174 - DNA, 20 bp, synthetic construct
  misc_feature 1..20: note = CRISPR gRNA sequence
  source 1..20: mol_type = other DNA
tactttatcaaatgtataag

SEQ ID NO: 82175 - DNA, 20 bp, synthetic construct
  misc_feature 1..20: note = CRISPR gRNA sequence
  source 1..20: mol_type = other DNA
taaattttcccccaaattct

SEQ ID NO: 82176 - DNA, 20 bp, synthetic construct
  misc_feature 1..20: note = CRISPR gRNA sequence
  source 1..20: mol_type = other DNA
attttcccccaaattctaag

SEQ ID NO: 82177 - DNA, 20 bp, synthetic construct
  misc_feature 1..20: note = CRISPR gRNA sequence
  source 1..20: mol_type = other DNA
tttcccccaaattctaagca

SEQ ID NO: 82178 - DNA, 20 bp, synthetic construct
  misc_feature 1..20: note = CRISPR gRNA sequence
  source 1..20: mol_type = other DNA
tctaagcagagtatgtaaat

SEQ ID NO: 82179 - DNA, 20 bp, synthetic construct
  misc_feature 1..20: note = CRISPR gRNA sequence
  source 1..20: mol_type = other DNA
aagcagagtatgtaaattgg

SEQ ID NO: 82180 - DNA, 20 bp, synthetic construct
  misc_feature 1..20: note = CRISPR gRNA sequence
  source 1..20: mol_type = other DNA
gcacgcttaactatcttaac

SEQ ID NO: 82181 - DNA, 20 bp, synthetic construct
  misc_feature 1..20: note = CRISPR gRNA sequence
  source 1..20: mol_type = other DNA
taactatcttaacaagcttt

SEQ ID NO: 82182 - DNA, 20 bp, synthetic construct
  misc_feature 1..20: note = CRISPR gRNA sequence
  source 1..20: mol_type = other DNA
tcttaacaagctttgagtgc

SEQ ID NO: 82183 - DNA, 20 bp, synthetic construct
  misc_feature 1..20: note = CRISPR gRNA sequence
  source 1..20: mol_type = other DNA
ttaacaagctttgagtgcaa

SEQ ID NO: 82184 - DNA, 20 bp, synthetic construct
  misc_feature 1..20: note = CRISPR gRNA sequence
  source 1..20: mol_type = other DNA
gctttgagtgcaagagattg

SEQ ID NO: 82185 - DNA, 20 bp, synthetic construct
  misc_feature 1..20: note = CRISPR gRNA sequence
  source 1..20: mol_type = other DNA
tttgagtgcaagagattgaa

SEQ ID NO: 82186 - DNA, 20 bp, synthetic construct
  misc_feature 1..20: note = CRISPR gRNA sequence
  source 1..20: mol_type = other DNA
tgaagagttcaaatctgacc

SEQ ID NO: 82187 - DNA, 20 bp, synthetic construct
  misc_feature 1..20: note = CRISPR gRNA sequence
  source 1..20: mol_type = other DNA
tctgaccaagatgttgatgt

SEQ ID NO: 82188 - DNA, 20 bp, synthetic construct
  misc_feature 1..20: note = CRISPR gRNA sequence
  source 1..20: mol_type = other DNA
ccaagatgttgatgttggat

SEQ ID NO: 82189 - DNA, 20 bp, synthetic construct
  misc_feature 1..20: note = CRISPR gRNA sequence
  source 1..20: mol_type = other DNA
aagatgttgatgttggataa

SEQ ID NO: 82190 - DNA, 20 bp, synthetic construct
  misc_feature 1..20: note = CRISPR gRNA sequence
  source 1..20: mol_type = other DNA
attctctgctccccacctct

SEQ ID NO: 82191 - DNA, 20 bp, synthetic construct
  misc_feature 1..20: note = CRISPR gRNA sequence
  source 1..20: mol_type = other DNA
gctccccacctctaagttgc

SEQ ID NO: 82192 - DNA, 20 bp, synthetic construct
  misc_feature 1..20: note = CRISPR gRNA sequence
  source 1..20: mol_type = other DNA
ctctaagttgccagccctcc

SEQ ID NO: 82193 - DNA, 20 bp, synthetic construct
  misc_feature 1..20: note = CRISPR gRNA sequence
  source 1..20: mol_type = other DNA
ctaagttgccagccctccta

SEQ ID NO: 82194 - DNA, 20 bp, synthetic construct
  misc_feature 1..20: note = CRISPR gRNA sequence
  source 1..20: mol_type = other DNA
agccctcctagagctacctg

SEQ ID NO: 82195 - DNA, 20 bp, synthetic construct
  misc_feature 1..20: note = CRISPR gRNA sequence
  source 1..20: mol_type = other DNA
ccctcctagagctacctgtg

SEQ ID NO: 82196 - DNA, 20 bp, synthetic construct
  misc_feature 1..20: note = CRISPR gRNA sequence
  source 1..20: mol_type = other DNA
tacctgtggagcaacctgct

SEQ ID NO: 82197 - DNA, 20 bp, synthetic construct
  misc_feature 1..20: note = CRISPR gRNA sequence
  source 1..20: mol_type = other DNA
ctgctcagatacatcaaaca

SEQ ID NO: 82198 - DNA, 20 bp, synthetic construct
  misc_feature 1..20: note = CRISPR gRNA sequence
  source 1..20: mol_type = other DNA
gctcagatacatcaaacatg

SEQ ID NO: 82199 - DNA, 20 bp, synthetic construct
  misc_feature 1..20: note = CRISPR gRNA sequence
  source 1..20: mol_type = other DNA
agatacatcaaacatggaga

SEQ ID NO: 82200 - DNA, 20 bp, synthetic construct
  misc_feature 1..20: note = CRISPR gRNA sequence
  source 1..20: mol_type = other DNA
aaacatggagacagcactca

SEQ ID NO: 82201 - DNA, 20 bp, synthetic construct
  misc_feature 1..20: note = CRISPR gRNA sequence
  source 1..20: mol_type = other DNA
catggagacagcactcaaag

SEQ ID NO: 82202 - DNA, 20 bp, synthetic construct
  misc_feature 1..20: note = CRISPR gRNA sequence
  source 1..20: mol_type = other DNA
gcactcaaagtagaattata

SEQ ID NO: 82203 - DNA, 20 bp, synthetic construct
  misc_feature 1..20: note = CRISPR gRNA sequence
  source 1..20: mol_type = other DNA
ctcaaagtagaattataaag

SEQ ID NO: 82204 - DNA, 20 bp, synthetic construct
  misc_feature 1..20: note = CRISPR gRNA sequence
  source 1..20: mol_type = other DNA
aaccctacattttgtgcata

SEQ ID NO: 82205 - DNA, 20 bp, synthetic construct
  misc_feature 1..20: note = CRISPR gRNA sequence
  source 1..20: mol_type = other DNA
acattttgtgcataaagtgt

SEQ ID NO: 82206 - DNA, 20 bp, synthetic construct
  misc_feature 1..20: note = CRISPR gRNA sequence
  source 1..20: mol_type = other DNA
tgcataaagtgtaagtgtat

SEQ ID NO: 82207 - DNA, 20 bp, synthetic construct
  misc_feature 1..20: note = CRISPR gRNA sequence
  source 1..20: mol_type = other DNA
ataagcatatcaatattaaa

SEQ ID NO: 82208 - DNA, 20 bp, synthetic construct
  misc_feature 1..20: note = CRISPR gRNA sequence
  source 1..20: mol_type = other DNA
gcatatcaatattaaaaagc

SEQ ID NO: 82209 - DNA, 20 bp, synthetic construct
  misc_feature 1..20: note = CRISPR gRNA sequence
  source 1..20: mol_type = other DNA
atcaatattaaaaagcaagc

SEQ ID NO: 82210 - DNA, 20 bp, synthetic construct
  misc_feature 1..20: note = CRISPR gRNA sequence
  source 1..20: mol_type = other DNA
aatattaaaaagcaagcaag

SEQ ID NO: 82211 - DNA, 20 bp, synthetic construct
  misc_feature 1..20: note = CRISPR gRNA sequence
  source 1..20: mol_type = other DNA
aaaagcaagcaagcagaatt

SEQ ID NO: 82212 - DNA, 20 bp, synthetic construct
  misc_feature 1..20: note = CRISPR gRNA sequence
  source 1..20: mol_type = other DNA
gaattcatccaatccaaatg

SEQ ID NO: 82213 - DNA, 20 bp, synthetic construct
  misc_feature 1..20: note = CRISPR gRNA sequence
  source 1..20: mol_type = other DNA
gcggcatcttcaaacctgaa

SEQ ID NO: 82214 - DNA, 20 bp, synthetic construct
  misc_feature 1..20: note = CRISPR gRNA sequence
  source 1..20: mol_type = other DNA
atcttcaaacctgaaaagaa

SEQ ID NO: 82215 - DNA, 20 bp, synthetic construct
  misc_feature 1..20: note = CRISPR gRNA sequence
  source 1..20: mol_type = other DNA
aaacctgaaaagaaaagaaa

SEQ ID NO: 82216 - DNA, 20 bp, synthetic construct
  misc_feature 1..20: note = CRISPR gRNA sequence
  source 1..20: mol_type = other DNA
aacctgaaaagaaaagaaaa

SEQ ID NO: 82217 - DNA, 20 bp, synthetic construct
  misc_feature 1..20: note = CRISPR gRNA sequence
  source 1..20: mol_type = other DNA
tgaaaagaaaagaaaaaggt

SEQ ID NO: 82218 - DNA, 20 bp, synthetic construct
  misc_feature 1..20: note = CRISPR gRNA sequence
  source 1..20: mol_type = other DNA
agcaatgaatttattttatt

SEQ ID NO: 82219 - DNA, 20 bp, synthetic construct
  misc_feature 1..20: note = CRISPR gRNA sequence
  source 1..20: mol_type = other DNA
aatttattttatttggattg

SEQ ID NO: 82220 - DNA, 20 bp, synthetic construct
  misc_feature 1..20: note = CRISPR gRNA sequence
  source 1..20: mol_type = other DNA
cttgtctaatttctactgtg

SEQ ID NO: 82221 - DNA, 20 bp, synthetic construct
  misc_feature 1..20: note = CRISPR gRNA sequence
  source 1..20: mol_type = other DNA
tgtgtagatcacctttttaa

SEQ ID NO: 82222 - DNA, 20 bp, synthetic construct
  misc_feature 1..20: note = CRISPR gRNA sequence
  source 1..20: mol_type = other DNA
gtagatcacctttttaaaag

SEQ ID NO: 82223 - DNA, 20 bp, synthetic construct
  misc_feature 1..20: note = CRISPR gRNA sequence
  source 1..20: mol_type = other DNA
gatcacctttttaaaagaag

SEQ ID NO: 82224 - DNA, 20 bp, synthetic construct
  misc_feature 1..20: note = CRISPR gRNA sequence
  source 1..20: mol_type = other DNA
ctttttaaaagaagtagctg

SEQ ID NO: 82225 - DNA, 20 bp, synthetic construct
  misc_feature 1..20: note = CRISPR gRNA sequence
  source 1..20: mol_type = other DNA
ttaaaagaagtagctgcaga

SEQ ID NO: 82226 - DNA, 20 bp, synthetic construct
  misc_feature 1..20: note = CRISPR gRNA sequence
  source 1..20: mol_type = other DNA
agttctccaaacccattata

SEQ ID NO: 82227 - DNA, 20 bp, synthetic construct
  misc_feature 1..20: note = CRISPR gRNA sequence
  source 1..20: mol_type = other DNA
ttctccaaacccattataaa

SEQ ID NO: 82228 - DNA, 20 bp, synthetic construct
  misc_feature 1..20: note = CRISPR gRNA sequence
  source 1..20: mol_type = other DNA
ttataaagagtatatcctgt

SEQ ID NO: 82229 - DNA, 20 bp, synthetic construct
  misc_feature 1..20: note = CRISPR gRNA sequence
  source 1..20: mol_type = other DNA
atcctgttagtgtatccctt

SEQ ID NO: 82230 - DNA, 20 bp, synthetic construct
  misc_feature 1..20: note = CRISPR gRNA sequence
  source 1..20: mol_type = other DNA
ctttggtgctcccaaaatct

SEQ ID NO: 82231 - DNA, 20 bp, synthetic construct
  misc_feature 1..20: note = CRISPR gRNA sequence
  source 1..20: mol_type = other DNA
tggtgctcccaaaatcttag

SEQ ID NO: 82232 - DNA, 20 bp, synthetic construct
  misc_feature 1..20: note = CRISPR gRNA sequence
  source 1..20: mol_type = other DNA
aaaatgctgatatgatgttt

SEQ ID NO: 82233 - DNA, 20 bp, synthetic construct
  misc_feature 1..20: note = CRISPR gRNA sequence
  source 1..20: mol_type = other DNA
tatgatgttttggtcaatga

SEQ ID NO: 82234 - DNA, 20 bp, synthetic construct
  misc_feature 1..20: note = CRISPR gRNA sequence
  source 1..20: mol_type = other DNA
atgatggactgtatatatga

SEQ ID NO: 82235 - DNA, 20 bp, synthetic construct
  misc_feature 1..20: note = CRISPR gRNA sequence
  source 1..20: mol_type = other DNA
atggactgtatatatgacag

SEQ ID NO: 82236 - DNA, 20 bp, synthetic construct
  misc_feature 1..20: note = CRISPR gRNA sequence
  source 1..20: mol_type = other DNA
atatatgacagtggtctcat

SEQ ID NO: 82237 - DNA, 20 bp, synthetic construct
  misc_feature 1..20: note = CRISPR gRNA sequence
  source 1..20: mol_type = other DNA
gtggtctcataagattaaaa

SEQ ID NO: 82238 - DNA, 20 bp, synthetic construct
  misc_feature 1..20: note = CRISPR gRNA sequence
  source 1..20: mol_type = other DNA
tttactgcaacttctatgtt

SEQ ID NO: 82239 - DNA, 20 bp, synthetic construct
  misc_feature 1..20: note = CRISPR gRNA sequence
  source 1..20: mol_type = other DNA
cattgtgttacaactgccca

SEQ ID NO: 82240 - DNA, 20 bp, synthetic construct
  misc_feature 1..20: note = CRISPR gRNA sequence
  source 1..20: mol_type = other DNA
ttacaactgcccacagtatt

SEQ ID NO: 82241 - DNA, 20 bp, synthetic construct
  misc_feature 1..20: note = CRISPR gRNA sequence
  source 1..20: mol_type = other DNA
actgcccacagtattcagta

SEQ ID NO: 82242 - DNA, 20 bp, synthetic construct
  misc_feature 1..20: note = CRISPR gRNA sequence
  source 1..20: mol_type = other DNA
cacagtattcagtacagtaa

SEQ ID NO: 82243 - DNA, 20 bp, synthetic construct
  misc_feature 1..20: note = CRISPR gRNA sequence
  source 1..20: mol_type = other DNA
acagtattcagtacagtaac

SEQ ID NO: 82244 - DNA, 20 bp, synthetic construct
  misc_feature 1..20: note = CRISPR gRNA sequence
  source 1..20: mol_type = other DNA
cagtacagtaacaggctgta

SEQ ID NO: 82245 - DNA, 20 bp, synthetic construct
  misc_feature 1..20: note = CRISPR gRNA sequence
  source 1..20: mol_type = other DNA
agtacagtaacaggctgtac

SEQ ID NO: 82246 - DNA, 20 bp, synthetic construct
  misc_feature 1..20: note = CRISPR gRNA sequence
  source 1..20: mol_type = other DNA
taacaggctgtacaggtttg

SEQ ID NO: 82247 - DNA, 20 bp, synthetic construct
  misc_feature 1..20: note = CRISPR gRNA sequence
  source 1..20: mol_type = other DNA
ggctgtacaggtttgtagtc

SEQ ID NO: 82248 - DNA, 20 bp, synthetic construct
  misc_feature 1..20: note = CRISPR gRNA sequence
  source 1..20: mol_type = other DNA
gctgtacaggtttgtagtct

SEQ ID NO: 82249 - DNA, 20 bp, synthetic construct
  misc_feature 1..20: note = CRISPR gRNA sequence
  source 1..20: mol_type = other DNA
tgtacaggtttgtagtctag

SEQ ID NO: 82250 - DNA, 20 bp, synthetic construct
  misc_feature 1..20: note = CRISPR gRNA sequence
  source 1..20: mol_type = other DNA
ggtttgtagtctaggagcaa

SEQ ID NO: 82251 - DNA, 20 bp, synthetic construct
  misc_feature 1..20: note = CRISPR gRNA sequence
  source 1..20: mol_type = other DNA
gtttgtagtctaggagcaat

SEQ ID NO: 82252 - DNA, 20 bp, synthetic construct
  misc_feature 1..20: note = CRISPR gRNA sequence
  source 1..20: mol_type = other DNA
gagcaataggctataccatg

SEQ ID NO: 82253 - DNA, 20 bp, synthetic construct
  misc_feature 1..20: note = CRISPR gRNA sequence
  source 1..20: mol_type = other DNA
taccatgtagcctatgcgtg

SEQ ID NO: 82254 - DNA, 20 bp, synthetic construct
  misc_feature 1..20: note = CRISPR gRNA sequence
  source 1..20: mol_type = other DNA
catgtagcctatgcgtgtag

SEQ ID NO: 82255 - DNA, 20 bp, synthetic construct
  misc_feature 1..20: note = CRISPR gRNA sequence
  source 1..20: mol_type = other DNA
atgtagcctatgcgtgtagt

SEQ ID NO: 82256 - DNA, 20 bp, synthetic construct
  misc_feature 1..20: note = CRISPR gRNA sequence
  source 1..20: mol_type = other DNA
gtgtagtaggctacaacacc

SEQ ID NO: 82257 - DNA, 20 bp, synthetic construct
  misc_feature 1..20: note = CRISPR gRNA sequence
  source 1..20: mol_type = other DNA
tgtagtaggctacaacacct

SEQ ID NO: 82258 - DNA, 20 bp, synthetic construct
  misc_feature 1..20: note = CRISPR gRNA sequence
  source 1..20: mol_type = other DNA
tacaacacctaggtttgtgt

SEQ ID NO: 82259 - DNA, 20 bp, synthetic construct
  misc_feature 1..20: note = CRISPR gRNA sequence
  source 1..20: mol_type = other DNA
aggtttgtgtaagcatttct

SEQ ID NO: 82260 - DNA, 20 bp, synthetic construct
  misc_feature 1..20: note = CRISPR gRNA sequence
  source 1..20: mol_type = other DNA
cagaacatgtccccgtcatt

SEQ ID NO: 82261 - DNA, 20 bp, synthetic construct
  misc_feature 1..20: note = CRISPR gRNA sequence
  source 1..20: mol_type = other DNA
taagtaacacatgactatat

SEQ ID NO: 82262 - DNA, 20 bp, synthetic construct
  misc_feature 1..20: note = CRISPR gRNA sequence
  source 1..20: mol_type = other DNA
agtaacacatgactatatta

SEQ ID NO: 82263 - DNA, 20 bp, synthetic construct
  misc_feature 1..20: note = CRISPR gRNA sequence
  source 1..20: mol_type = other DNA
cacatgactatattagagtt

SEQ ID NO: 82264 - DNA, 20 bp, synthetic construct
  misc_feature 1..20: note = CRISPR gRNA sequence
  source 1..20: mol_type = other DNA
acatgactatattagagttc

SEQ ID NO: 82265 - DNA, 20 bp, synthetic construct
  misc_feature 1..20: note = CRISPR gRNA sequence
  source 1..20: mol_type = other DNA
ctatattagagttcaggtcc

SEQ ID NO: 82266 - DNA, 20 bp, synthetic construct
  misc_feature 1..20: note = CRISPR gRNA sequence
  source 1..20: mol_type = other DNA
ctggctctacaatttactaa

SEQ ID NO: 82267 - DNA, 20 bp, synthetic construct
  misc_feature 1..20: note = CRISPR gRNA sequence
  source 1..20: mol_type = other DNA
caatttactaacagtgtgac

SEQ ID NO: 82268 - DNA, 20 bp, synthetic construct
  misc_feature 1..20: note = CRISPR gRNA sequence
  source 1..20: mol_type = other DNA
aatttactaacagtgtgact

SEQ ID NO: 82269 - DNA, 20 bp, synthetic construct
  misc_feature 1..20: note = CRISPR gRNA sequence
  source 1..20: mol_type = other DNA
ttactaacagtgtgactggg

SEQ ID NO: 82270 - DNA, 20 bp, synthetic construct
  misc_feature 1..20: note = CRISPR gRNA sequence
  source 1..20: mol_type = other DNA
cccaaatcaattccctgttc

SEQ ID NO: 82271 - DNA, 20 bp, synthetic construct
  misc_feature 1..20: note = CRISPR gRNA sequence
  source 1..20: mol_type = other DNA
ttccctgttctagaatataa

SEQ ID NO: 82272 - DNA, 20 bp, synthetic construct
  misc_feature 1..20: note = CRISPR gRNA sequence
  source 1..20: mol_type = other DNA
tccctgttctagaatataac

SEQ ID NO: 82273 - DNA, 20 bp, synthetic construct
  misc_feature 1..20: note = CRISPR gRNA sequence
  source 1..20: mol_type = other DNA
cctgttctagaatataacag

SEQ ID NO: 82274 - DNA, 20 bp, synthetic construct
  misc_feature 1..20: note = CRISPR gRNA sequence
  source 1..20: mol_type = other DNA
aatataacaggagatttgaa

SEQ ID NO: 82275 - DNA, 20 bp, synthetic construct
  misc_feature 1..20: note = CRISPR gRNA sequence
  source 1..20: mol_type = other DNA
atataacaggagatttgaat

SEQ ID NO: 82276 - DNA, 20 bp, synthetic construct
  misc_feature 1..20: note = CRISPR gRNA sequence
  source 1..20: mol_type = other DNA
tataacaggagatttgaatg

SEQ ID NO: 82277 - DNA, 20 bp, synthetic construct
  misc_feature 1..20: note = CRISPR gRNA sequence
  source 1..20: mol_type = other DNA
aggagatttgaatggggttt

SEQ ID NO: 82278 - DNA, 20 bp, synthetic construct
  misc_feature 1..20: note = CRISPR gRNA sequence
  source 1..20: mol_type = other DNA
gtttcagcatcaatgtaccc

SEQ ID NO: 82279 - DNA, 20 bp, synthetic construct
  misc_feature 1..20: note = CRISPR gRNA sequence
  source 1..20: mol_type = other DNA
tttcagcatcaatgtaccct

SEQ ID NO: 82280 - DNA, 20 bp, synthetic construct
  misc_feature 1..20: note = CRISPR gRNA sequence
  source 1..20: mol_type = other DNA
cagcatcaatgtaccctggg

SEQ ID NO: 82281 - DNA, 20 bp, synthetic construct
  misc_feature 1..20: note = CRISPR gRNA sequence
  source 1..20: mol_type = other DNA
catcaatgtaccctgggcag

SEQ ID NO: 82282 - DNA, 20 bp, synthetic construct
  misc_feature 1..20: note = CRISPR gRNA sequence
  source 1..20: mol_type = other DNA
ggcagtagaatttcattgaa

SEQ ID NO: 82283 - DNA, 20 bp, synthetic construct
  misc_feature 1..20: note = CRISPR gRNA sequence
  source 1..20: mol_type = other DNA
gaatttcattgaaaagcctt

SEQ ID NO: 82284 - DNA, 20 bp, synthetic construct
  misc_feature 1..20: note = CRISPR gRNA sequence
  source 1..20: mol_type = other DNA
aagcctttggactccaacta

SEQ ID NO: 82285 - DNA, 20 bp, synthetic construct
  misc_feature 1..20: note = CRISPR gRNA sequence
  source 1..20: mol_type = other DNA
ttggactccaactaaagatg

SEQ ID NO: 82286 - DNA, 20 bp, synthetic construct
  misc_feature 1..20: note = CRISPR gRNA sequence
  source 1..20: mol_type = other DNA
ggactccaactaaagatgca

SEQ ID NO: 82287 - DNA, 20 bp, synthetic construct
  misc_feature 1..20: note = CRISPR gRNA sequence
  source 1..20: mol_type = other DNA
ctccaactaaagatgcagag

SEQ ID NO: 82288 - DNA, 20 bp, synthetic construct
  misc_feature 1..20: note = CRISPR gRNA sequence
  source 1..20: mol_type = other DNA
ctaaagatgcagagaagtcc

SEQ ID NO: 82289 - DNA, 20 bp, synthetic construct
  misc_feature 1..20: note = CRISPR gRNA sequence
  source 1..20: mol_type = other DNA
tcctccctctctcttgcttc

SEQ ID NO: 82290 - DNA, 20 bp, synthetic construct
  misc_feature 1..20: note = CRISPR gRNA sequence
  source 1..20: mol_type = other DNA
ctccctctctcttgcttctg

SEQ ID NO: 82291 - DNA, 20 bp, synthetic construct
  misc_feature 1..20: note = CRISPR gRNA sequence
  source 1..20: mol_type = other DNA
cttgcttctggagctccttg

SEQ ID NO: 82292 - DNA, 20 bp, synthetic construct
  misc_feature 1..20: note = CRISPR gRNA sequence
  source 1..20: mol_type = other DNA
ccttgtagttacatctatta

SEQ ID NO: 82293 - DNA, 20 bp, synthetic construct
  misc_feature 1..20: note = CRISPR gRNA sequence
  source 1..20: mol_type = other DNA
tattatagtatcattatatc

SEQ ID NO: 82294 - DNA, 20 bp, synthetic construct
  misc_feature 1..20: note = CRISPR gRNA sequence
  source 1..20: mol_type = other DNA
ctgtttccctttatctcctc

SEQ ID NO: 82295 - DNA, 20 bp, synthetic construct
  misc_feature 1..20: note = CRISPR gRNA sequence
  source 1..20: mol_type = other DNA
tttccctttatctcctctag

SEQ ID NO: 82296 - DNA, 20 bp, synthetic construct
  misc_feature 1..20: note = CRISPR gRNA sequence
  source 1..20: mol_type = other DNA
ctttatctcctctagtggcc

SEQ ID NO: 82297 - DNA, 20 bp, synthetic construct
  misc_feature 1..20: note = CRISPR gRNA sequence
  source 1..20: mol_type = other DNA
tttatctcctctagtggcct

SEQ ID NO: 82298 - DNA, 20 bp, synthetic construct
  misc_feature 1..20: note = CRISPR gRNA sequence
  source 1..20: mol_type = other DNA
ctagtggcctgggaacctct

SEQ ID NO: 82299 - DNA, 20 bp, synthetic construct
  misc_feature 1..20: note = CRISPR gRNA sequence
  source 1..20: mol_type = other DNA
agtggcctgggaacctctaa

SEQ ID NO: 82300 - DNA, 20 bp, synthetic construct
  misc_feature 1..20: note = CRISPR gRNA sequence
  source 1..20: mol_type = other DNA
gtggcctgggaacctctaag

SEQ ID NO: 82301 - DNA, 20 bp, synthetic construct
  misc_feature 1..20: note = CRISPR gRNA sequence
  source 1..20: mol_type = other DNA
gaacctctaagaggcaaaca

SEQ ID NO: 82302 - DNA, 20 bp, synthetic construct
  misc_feature 1..20: note = CRISPR gRNA sequence
  source 1..20: mol_type = other DNA
aggcaaacacagtccccata

SEQ ID NO: 82303 - DNA, 20 bp, synthetic construct
  misc_feature 1..20: note = CRISPR gRNA sequence
  source 1..20: mol_type = other DNA
ggcaaacacagtccccatac

SEQ ID NO: 82304 - DNA, 20 bp, synthetic construct
  misc_feature 1..20: note = CRISPR gRNA sequence
  source 1..20: mol_type = other DNA
acacagtccccatacaggaa

SEQ ID NO: 82305 - DNA, 20 bp, synthetic construct
  misc_feature 1..20: note = CRISPR gRNA sequence
  source 1..20: mol_type = other DNA
cacagtccccatacaggaat

SEQ ID NO: 82306 - DNA, 20 bp, synthetic construct
  misc_feature 1..20: note = CRISPR gRNA sequence
  source 1..20: mol_type = other DNA
atacaggaatgggatgtctg

SEQ ID NO: 82307 - DNA, 20 bp, synthetic construct
  misc_feature 1..20: note = CRISPR gRNA sequence
  source 1..20: mol_type = other DNA
acaggaatgggatgtctgca

SEQ ID NO: 82308 - DNA, 20 bp, synthetic construct
  misc_feature 1..20: note = CRISPR gRNA sequence
  source 1..20: mol_type = other DNA
taactcctctcttctgtctg

SEQ ID NO: 82309 - DNA, 20 bp, synthetic construct
  misc_feature 1..20: note = CRISPR gRNA sequence
  source 1..20: mol_type = other DNA
gaataaaacaacattataca

SEQ ID NO: 82310 - DNA, 20 bp, synthetic construct
  misc_feature 1..20: note = CRISPR gRNA sequence
  source 1..20: mol_type = other DNA
aataaaacaacattatacaa

SEQ ID NO: 82311 - DNA, 20 bp, synthetic construct
  misc_feature 1..20: note = CRISPR gRNA sequence
  source 1..20: mol_type = other DNA
aacaacattatacaaaggaa

SEQ ID NO: 82312 - DNA, 20 bp, synthetic construct
  misc_feature 1..20: note = CRISPR gRNA sequence
  source 1..20: mol_type = other DNA
caacattatacaaaggaaaa

SEQ ID NO: 82313 - DNA, 20 bp, synthetic construct
  misc_feature 1..20: note = CRISPR gRNA sequence
  source 1..20: mol_type = other DNA
cattatacaaaggaaaagag

SEQ ID NO: 82314 - DNA, 20 bp, synthetic construct
  misc_feature 1..20: note = CRISPR gRNA sequence
  source 1..20: mol_type = other DNA
agtggttcattttctctcct

SEQ ID NO: 82315 - DNA, 20 bp, synthetic construct
  misc_feature 1..20: note = CRISPR gRNA sequence
  source 1..20: mol_type = other DNA
ggttcattttctctcctcag

SEQ ID NO: 82316 - DNA, 20 bp, synthetic construct
  misc_feature 1..20: note = CRISPR gRNA sequence
  source 1..20: mol_type = other DNA
ttcattttctctcctcagca

SEQ ID NO: 82317 - DNA, 20 bp, synthetic construct
  misc_feature 1..20: note = CRISPR gRNA sequence
  source 1..20: mol_type = other DNA
ctcagcagagatgtccaatg

SEQ ID NO: 82318 - DNA, 20 bp, synthetic construct
  misc_feature 1..20: note = CRISPR gRNA sequence
  source 1..20: mol_type = other DNA
agagatgtccaatgtggaaa

SEQ ID NO: 82319 - DNA, 20 bp, synthetic construct
  misc_feature 1..20: note = CRISPR gRNA sequence
  source 1..20: mol_type = other DNA
gatgtccaatgtggaaatgg

SEQ ID NO: 82320 - DNA, 20 bp, synthetic construct
  misc_feature 1..20: note = CRISPR gRNA sequence
  source 1..20: mol_type = other DNA
gtccaatgtggaaatggcag

SEQ ID NO: 82321 - DNA, 20 bp, synthetic construct
  misc_feature 1..20: note = CRISPR gRNA sequence
  source 1..20: mol_type = other DNA
aatgtggaaatggcagaaga

SEQ ID NO: 82322 - DNA, 20 bp, synthetic construct
  misc_feature 1..20: note = CRISPR gRNA sequence
  source 1..20: mol_type = other DNA
aaatggcagaagaaagatca

SEQ ID NO: 82323 - DNA, 20 bp, synthetic construct
  misc_feature 1..20: note = CRISPR gRNA sequence
  source 1..20: mol_type = other DNA
gaagaaagatcaaagccttg

SEQ ID NO: 82324 - DNA, 20 bp, synthetic construct
  misc_feature 1..20: note = CRISPR gRNA sequence
  source 1..20: mol_type = other DNA
aagaaagatcaaagccttgc

SEQ ID NO: 82325 - DNA, 20 bp, synthetic construct
  misc_feature 1..20: note = CRISPR gRNA sequence
  source 1..20: mol_type = other DNA
tcaaagccttgcaggtaatg

SEQ ID NO: 82326 - DNA, 20 bp, synthetic construct
  misc_feature 1..20: note = CRISPR gRNA sequence
  source 1..20: mol_type = other DNA
caaagccttgcaggtaatgt

SEQ ID NO: 82327 - DNA, 20 bp, synthetic construct
  misc_feature 1..20: note = CRISPR gRNA sequence
  source 1..20: mol_type = other DNA
tttatcctgcaataccatac

SEQ ID NO: 82328 - DNA, 20 bp, synthetic construct
  misc_feature 1..20: note = CRISPR gRNA sequence
  source 1..20: mol_type = other DNA
atcctgcaataccatactgg

SEQ ID NO: 82329 - DNA, 20 bp, synthetic construct
  misc_feature 1..20: note = CRISPR gRNA sequence
  source 1..20: mol_type = other DNA
cagttcctttgccctctctg

SEQ ID NO: 82330 - DNA, 20 bp, synthetic construct
  misc_feature 1..20: note = CRISPR gRNA sequence
  source 1..20: mol_type = other DNA
gttcctttgccctctctgta

SEQ ID NO: 82331 - DNA, 20 bp, synthetic construct
  misc_feature 1..20: note = CRISPR gRNA sequence
  source 1..20: mol_type = other DNA
ttcctttgccctctctgtag

SEQ ID NO: 82332 - DNA, 20 bp, synthetic construct
  misc_feature 1..20: note = CRISPR gRNA sequence
  source 1..20: mol_type = other DNA
tcctttgccctctctgtaga

SEQ ID NO: 82333 - DNA, 20 bp, synthetic construct
  misc_feature 1..20: note = CRISPR gRNA sequence
  source 1..20: mol_type = other DNA
ttgccctctctgtagagggt

SEQ ID NO: 82334 - DNA, 20 bp, synthetic construct
  misc_feature 1..20: note = CRISPR gRNA sequence
  source 1..20: mol_type = other DNA
tctgtagagggtcagtaata

SEQ ID NO: 82335 - DNA, 20 bp, synthetic construct
  misc_feature 1..20: note = CRISPR gRNA sequence
  source 1..20: mol_type = other DNA
gtcagtaatatggccatacc

SEQ ID NO: 82336 - DNA, 20 bp, synthetic construct
  misc_feature 1..20: note = CRISPR gRNA sequence
  source 1..20: mol_type = other DNA
tcagtaatatggccatacct

SEQ ID NO: 82337 - DNA, 20 bp, synthetic construct
  misc_feature 1..20: note = CRISPR gRNA sequence
  source 1..20: mol_type = other DNA
cagtaatatggccatacctg

SEQ ID NO: 82338 - DNA, 20 bp, synthetic construct
  misc_feature 1..20: note = CRISPR gRNA sequence
  source 1..20: mol_type = other DNA
accttcttcatgccactcca

SEQ ID NO: 82339 - DNA, 20 bp, synthetic construct
  misc_feature 1..20: note = CRISPR gRNA sequence
  source 1..20: mol_type = other DNA
ccttcttcatgccactccac

SEQ ID NO: 82340 - DNA, 20 bp, synthetic construct
  misc_feature 1..20: note = CRISPR gRNA sequence
  source 1..20: mol_type = other DNA
ttcttcatgccactccacag

SEQ ID NO: 82341 - DNA, 20 bp, synthetic construct
  misc_feature 1..20: note = CRISPR gRNA sequence
  source 1..20: mol_type = other DNA
ttcatgccactccacaggag

SEQ ID NO: 82342 - DNA, 20 bp, synthetic construct
  misc_feature 1..20: note = CRISPR gRNA sequence
  source 1..20: mol_type = other DNA
tcatgccactccacaggaga

SEQ ID NO: 82343 - DNA, 20 bp, synthetic construct
  misc_feature 1..20: note = CRISPR gRNA sequence
  source 1..20: mol_type = other DNA
catgccactccacaggagaa

SEQ ID NO: 82344 - DNA, 20 bp, synthetic construct
  misc_feature 1..20: note = CRISPR gRNA sequence
  source 1..20: mol_type = other DNA
gagaagggaacatgaccctg

SEQ ID NO: 82345 - DNA, 20 bp, synthetic construct
  misc_feature 1..20: note = CRISPR gRNA sequence
  source 1..20: mol_type = other DNA
agaagggaacatgaccctgt

SEQ ID NO: 82346 - DNA, 20 bp, synthetic construct
  misc_feature 1..20: note = CRISPR gRNA sequence
  source 1..20: mol_type = other DNA
ctctgtcaatgttctccaca

SEQ ID NO: 82347 - DNA, 20 bp, synthetic construct
  misc_feature 1..20: note = CRISPR gRNA sequence
  source 1..20: mol_type = other DNA
gtcaatgttctccacatagt

SEQ ID NO: 82348 - DNA, 20 bp, synthetic construct
  misc_feature 1..20: note = CRISPR gRNA sequence
  source 1..20: mol_type = other DNA
tcaatgttctccacatagtg

SEQ ID NO: 82349 - DNA, 20 bp, synthetic construct
  misc_feature 1..20: note = CRISPR gRNA sequence
  source 1..20: mol_type = other DNA
caatgttctccacatagtga

SEQ ID NO: 82350 - DNA, 20 bp, synthetic construct
  misc_feature 1..20: note = CRISPR gRNA sequence
  source 1..20: mol_type = other DNA
catagtgagggttatcatgt

SEQ ID NO: 82351 - DNA, 20 bp, synthetic construct
  misc_feature 1..20: note = CRISPR gRNA sequence
  source 1..20: mol_type = other DNA
tagtgagggttatcatgtta

SEQ ID NO: 82352 - DNA, 20 bp, synthetic construct
  misc_feature 1..20: note = CRISPR gRNA sequence
  source 1..20: mol_type = other DNA
atgttagagctgtctataaa

SEQ ID NO: 82353 - DNA, 20 bp, synthetic construct
  misc_feature 1..20: note = CRISPR gRNA sequence
  source 1..20: mol_type = other DNA
agctgtctataaatagtcct

SEQ ID NO: 82354 - DNA, 20 bp, synthetic construct
  misc_feature 1..20: note = CRISPR gRNA sequence
  source 1..20: mol_type = other DNA
gctgtctataaatagtcctc

SEQ ID NO: 82355 - DNA, 20 bp, synthetic construct
  misc_feature 1..20: note = CRISPR gRNA sequence
  source 1..20: mol_type = other DNA
tctataaatagtcctcagga

SEQ ID NO: 82356 - DNA, 20 bp, synthetic construct
  misc_feature 1..20: note = CRISPR gRNA sequence
  source 1..20: mol_type = other DNA
tgaaacaaaaacattttctc

SEQ ID NO: 82357 - DNA, 20 bp, synthetic construct
  misc_feature 1..20: note = CRISPR gRNA sequence
  source 1..20: mol_type = other DNA
gaaacaaaaacattttctca

SEQ ID NO: 82358 - DNA, 20 bp, synthetic construct
  misc_feature 1..20: note = CRISPR gRNA sequence
  source 1..20: mol_type = other DNA
acatgtctcgatctatgaaa

SEQ ID NO: 82359 - DNA, 20 bp, synthetic construct
  misc_feature 1..20: note = CRISPR gRNA sequence
  source 1..20: mol_type = other DNA
gtctcgatctatgaaaaaga

SEQ ID NO: 82360 - DNA, 20 bp, synthetic construct
  misc_feature 1..20: note = CRISPR gRNA sequence
  source 1..20: mol_type = other DNA
tcgatctatgaaaaagacag

SEQ ID NO: 82361 - DNA, 20 bp, synthetic construct
  misc_feature 1..20: note = CRISPR gRNA sequence
  source 1..20: mol_type = other DNA
gatctatgaaaaagacagtg

SEQ ID NO: 82362 - DNA, 20 bp, synthetic construct
  misc_feature 1..20: note = CRISPR gRNA sequence
  source 1..20: mol_type = other DNA
aaaagacagtggagaaaaaa

SEQ ID NO: 82363 - DNA, 20 bp, synthetic construct
  misc_feature 1..20: note = CRISPR gRNA sequence
  source 1..20: mol_type = other DNA
aaagacagtggagaaaaaaa

SEQ ID NO: 82364 - DNA, 20 bp, synthetic construct
  misc_feature 1..20: note = CRISPR gRNA sequence
  source 1..20: mol_type = other DNA
gacagtggagaaaaaaaagg

SEQ ID NO: 82365 - DNA, 20 bp, synthetic construct
  misc_feature 1..20: note = CRISPR gRNA sequence
  source 1..20: mol_type = other DNA
agaaaaaaaaggaagacatt

SEQ ID NO: 82366 - DNA, 20 bp, synthetic construct
  misc_feature 1..20: note = CRISPR gRNA sequence
  source 1..20: mol_type = other DNA
gtactaacaaatgtctaaaa

SEQ ID NO: 82367 - DNA, 20 bp, synthetic construct
  misc_feature 1..20: note = CRISPR gRNA sequence
  source 1..20: mol_type = other DNA
taacaaatgtctaaaatggt

SEQ ID NO: 82368 - DNA, 20 bp, synthetic construct
  misc_feature 1..20: note = CRISPR gRNA sequence
  source 1..20: mol_type = other DNA
tgtctaaaatggttagaaat

SEQ ID NO: 82369 - DNA, 20 bp, synthetic construct
  misc_feature 1..20: note = CRISPR gRNA sequence
  source 1..20: mol_type = other DNA
gtctaaaatggttagaaata

SEQ ID NO: 82370 - DNA, 20 bp, synthetic construct
  misc_feature 1..20: note = CRISPR gRNA sequence
  source 1..20: mol_type = other DNA
aaaatggttagaaataaggc

SEQ ID NO: 82371 - DNA, 20 bp, synthetic construct
  misc_feature 1..20: note = CRISPR gRNA sequence
  source 1..20: mol_type = other DNA
atggttagaaataaggctgg

SEQ ID NO: 82372 - DNA, 20 bp, synthetic construct
  misc_feature 1..20: note = CRISPR gRNA sequence
  source 1..20: mol_type = other DNA
tagaaataaggctggcagaa

SEQ ID NO: 82373 - DNA, 20 bp, synthetic construct
  misc_feature 1..20: note = CRISPR gRNA sequence
  source 1..20: mol_type = other DNA
agaaataaggctggcagaat

SEQ ID NO: 82374 - DNA, 20 bp, synthetic construct
  misc_feature 1..20: note = CRISPR gRNA sequence
  source 1..20: mol_type = other DNA
ctacccatgaatacattgtt

SEQ ID NO: 82375 - DNA, 20 bp, synthetic construct
  misc_feature 1..20: note = CRISPR gRNA sequence
  source 1..20: mol_type = other DNA
acccatgaatacattgttta

SEQ ID NO: 82376 - DNA, 20 bp, synthetic construct
  misc_feature 1..20: note = CRISPR gRNA sequence
  source 1..20: mol_type = other DNA
atacattgtttagagctacc

SEQ ID NO: 82377 - DNA, 20 bp, synthetic construct
  misc_feature 1..20: note = CRISPR gRNA sequence
  source 1..20: mol_type = other DNA
cattgtttagagctacccag

SEQ ID NO: 82378 - DNA, 20 bp, synthetic construct
  misc_feature 1..20: note = CRISPR gRNA sequence
  source 1..20: mol_type = other DNA
attgtttagagctacccagc

SEQ ID NO: 82379 - DNA, 20 bp, synthetic construct
  misc_feature 1..20: note = CRISPR gRNA sequence
  source 1..20: mol_type = other DNA
tagagctacccagcaggaac

SEQ ID NO: 82380 - DNA, 20 bp, synthetic construct
  misc_feature 1..20: note = CRISPR gRNA sequence
  source 1..20: mol_type = other DNA
caggaacaagcccttcctac

SEQ ID NO: 82381 - DNA, 20 bp, synthetic construct
  misc_feature 1..20: note = CRISPR gRNA sequence
  source 1..20: mol_type = other DNA
caagcccttcctactagcct

SEQ ID NO: 82382 - DNA, 20 bp, synthetic construct
  misc_feature 1..20: note = CRISPR gRNA sequence
  source 1..20: mol_type = other DNA
actagcctcagataccaatc

SEQ ID NO: 82383 - DNA, 20 bp, synthetic construct
  misc_feature 1..20: note = CRISPR gRNA sequence
  source 1..20: mol_type = other DNA
gcctcagataccaatccagc

SEQ ID NO: 82384 - DNA, 20 bp, synthetic construct
  misc_feature 1..20: note = CRISPR gRNA sequence
  source 1..20: mol_type = other DNA
cagataccaatccagccaga

SEQ ID NO: 82385 - DNA, 20 bp, synthetic construct
  misc_feature 1..20: note = CRISPR gRNA sequence
  source 1..20: mol_type = other DNA
ccaatccagccagaaagtac

SEQ ID NO: 82386 - DNA, 20 bp, synthetic construct
  misc_feature 1..20: note = CRISPR gRNA sequence
  source 1..20: mol_type = other DNA
aatccagccagaaagtactg

SEQ ID NO: 82387 - DNA, 20 bp, synthetic construct
  misc_feature 1..20: note = CRISPR gRNA sequence
  source 1..20: mol_type = other DNA
ccagccagaaagtactggag

SEQ ID NO: 82388 - DNA, 20 bp, synthetic construct
  misc_feature 1..20: note = CRISPR gRNA sequence
  source 1..20: mol_type = other DNA
cagaaagtactggagaagtc

SEQ ID NO: 82389 - DNA, 20 bp, synthetic construct
  misc_feature 1..20: note = CRISPR gRNA sequence
  source 1..20: mol_type = other DNA
agaaagtactggagaagtcc

SEQ ID NO: 82390 - DNA, 20 bp, synthetic construct
  misc_feature 1..20: note = CRISPR gRNA sequence
  source 1..20: mol_type = other DNA
actggagaagtccaggatta

SEQ ID NO: 82391 - DNA, 20 bp, synthetic construct
  misc_feature 1..20: note = CRISPR gRNA sequence
  source 1..20: mol_type = other DNA
ctggagaagtccaggattat

SEQ ID NO: 82392 - DNA, 20 bp, synthetic construct
  misc_feature 1..20: note = CRISPR gRNA sequence
  source 1..20: mol_type = other DNA
agtccaggattataggatgc

SEQ ID NO: 82393 - DNA, 20 bp, synthetic construct
  misc_feature 1..20: note = CRISPR gRNA sequence
  source 1..20: mol_type = other DNA
gtccaggattataggatgct

SEQ ID NO: 82394 - DNA, 20 bp, synthetic construct
  misc_feature 1..20: note = CRISPR gRNA sequence
  source 1..20: mol_type = other DNA
aggattataggatgctagga

SEQ ID NO: 82395 - DNA, 20 bp, synthetic construct
  misc_feature 1..20: note = CRISPR gRNA sequence
  source 1..20: mol_type = other DNA
attataggatgctaggacag

SEQ ID NO: 82396 - DNA, 20 bp, synthetic construct
  misc_feature 1..20: note = CRISPR gRNA sequence
  source 1..20: mol_type = other DNA
ttataggatgctaggacagc

SEQ ID NO: 82397 - DNA, 20 bp, synthetic construct
  misc_feature 1..20: note = CRISPR gRNA sequence
  source 1..20: mol_type = other DNA
gacagcaggacttacaaaca

SEQ ID NO: 82398 - DNA, 20 bp, synthetic construct
  misc_feature 1..20: note = CRISPR gRNA sequence
  source 1..20: mol_type = other DNA
acagcaggacttacaaacaa

SEQ ID NO: 82399 - DNA, 20 bp, synthetic construct
  misc_feature 1..20: note = CRISPR gRNA sequence
  source 1..20: mol_type = other DNA
acaaaggcctataccttctt

SEQ ID NO: 82400 - DNA, 20 bp, synthetic construct
  misc_feature 1..20: note = CRISPR gRNA sequence
  source 1..20: mol_type = other DNA
accttcttgagatgttcgtt

SEQ ID NO: 82401 - DNA, 20 bp, synthetic construct
  misc_feature 1..20: note = CRISPR gRNA sequence
  source 1..20: mol_type = other DNA
ttcagtgctaaatatacctg

SEQ ID NO: 82402 - DNA, 20 bp, synthetic construct
  misc_feature 1..20: note = CRISPR gRNA sequence
  source 1..20: mol_type = other DNA
tatacctgaagctgccacaa

SEQ ID NO: 82403 - DNA, 20 bp, synthetic construct
  misc_feature 1..20: note = CRISPR gRNA sequence
  source 1..20: mol_type = other DNA
cctgaagctgccacaaaagc

SEQ ID NO: 82404 - DNA, 20 bp, synthetic construct
  misc_feature 1..20: note = CRISPR gRNA sequence
  source 1..20: mol_type = other DNA
tgaagctgccacaaaagcta

SEQ ID NO: 82405 - DNA, 20 bp, synthetic construct
  misc_feature 1..20: note = CRISPR gRNA sequence
  source 1..20: mol_type = other DNA
gaagctgccacaaaagctag

SEQ ID NO: 82406 - DNA, 20 bp, synthetic construct
  misc_feature 1..20: note = CRISPR gRNA sequence
  source 1..20: mol_type = other DNA
gctgccacaaaagctagagg

SEQ ID NO: 82407 - DNA, 20 bp, synthetic construct
  misc_feature 1..20: note = CRISPR gRNA sequence
  source 1..20: mol_type = other DNA
ccacaaaagctagaggaagc

SEQ ID NO: 82408 - DNA, 20 bp, synthetic construct
  misc_feature 1..20: note = CRISPR gRNA sequence
  source 1..20: mol_type = other DNA
caaaagctagaggaagccag

SEQ ID NO: 82409 - DNA, 20 bp, synthetic construct
  misc_feature 1..20: note = CRISPR gRNA sequence
  source 1..20: mol_type = other DNA
aaaagctagaggaagccagt

SEQ ID NO: 82410 - DNA, 20 bp, synthetic construct
  misc_feature 1..20: note = CRISPR gRNA sequence
  source 1..20: mol_type = other DNA
gctagaggaagccagtaggt

SEQ ID NO: 82411 - DNA, 20 bp, synthetic construct
  misc_feature 1..20: note = CRISPR gRNA sequence
  source 1..20: mol_type = other DNA
agaggaagccagtaggtaag

SEQ ID NO: 82412 - DNA, 20 bp, synthetic construct
  misc_feature 1..20: note = CRISPR gRNA sequence
  source 1..20: mol_type = other DNA
gccagtaggtaagaagtgtt

SEQ ID NO: 82413 - DNA, 20 bp, synthetic construct
  misc_feature 1..20: note = CRISPR gRNA sequence
  source 1..20: mol_type = other DNA
cagtaggtaagaagtgttaa

SEQ ID NO: 82414 - DNA, 20 bp, synthetic construct
  misc_feature 1..20: note = CRISPR gRNA sequence
  source 1..20: mol_type = other DNA
gagtgtatatgtatttgtgc

SEQ ID NO: 82415 - DNA, 20 bp, synthetic construct
  misc_feature 1..20: note = CRISPR gRNA sequence
  source 1..20: mol_type = other DNA
tgctgctccctgctcaactg

SEQ ID NO: 82416 - DNA, 20 bp, synthetic construct
  misc_feature 1..20: note = CRISPR gRNA sequence
  source 1..20: mol_type = other DNA
gctgctccctgctcaactgc

SEQ ID NO: 82417 - DNA, 20 bp, synthetic construct
  misc_feature 1..20: note = CRISPR gRNA sequence
  source 1..20: mol_type = other DNA
ctgctccctgctcaactgca

SEQ ID NO: 82418 - DNA, 20 bp, synthetic construct
  misc_feature 1..20: note = CRISPR gRNA sequence
  source 1..20: mol_type = other DNA
ctcaactgcagggaaactac

SEQ ID NO: 82419 - DNA, 20 bp, synthetic construct
  misc_feature 1..20: note = CRISPR gRNA sequence
  source 1..20: mol_type = other DNA
ctgcagggaaactactggtt

SEQ ID NO: 82420 - DNA, 20 bp, synthetic construct
  misc_feature 1..20: note = CRISPR gRNA sequence
  source 1..20: mol_type = other DNA
tcagaaaccatgctgtgcat

SEQ ID NO: 82421 - DNA, 20 bp, synthetic construct
  misc_feature 1..20: note = CRISPR gRNA sequence
  source 1..20: mol_type = other DNA
catgctgtgcatcagtatct

SEQ ID NO: 82422 - DNA, 20 bp, synthetic construct
  misc_feature 1..20: note = CRISPR gRNA sequence
  source 1..20: mol_type = other DNA
gctgtgcatcagtatctcag

SEQ ID NO: 82423 - DNA, 20 bp, synthetic construct
  misc_feature 1..20: note = CRISPR gRNA sequence
  source 1..20: mol_type = other DNA
ctgtgcatcagtatctcagc

SEQ ID NO: 82424 - DNA, 20 bp, synthetic construct
  misc_feature 1..20: note = CRISPR gRNA sequence
  source 1..20: mol_type = other DNA
gtgccactaatctgatcttt

SEQ ID NO: 82425 - DNA, 20 bp, synthetic construct
  misc_feature 1..20: note = CRISPR gRNA sequence
  source 1..20: mol_type = other DNA
tccctgacaatcccaatatg

SEQ ID NO: 82426 - DNA, 20 bp, synthetic construct
  misc_feature 1..20: note = CRISPR gRNA sequence
  source 1..20: mol_type = other DNA
aatatgcagattgtttatat

SEQ ID NO: 82427 - DNA, 20 bp, synthetic construct
  misc_feature 1..20: note = CRISPR gRNA sequence
  source 1..20: mol_type = other DNA
tgcagattgtttatatcaga

SEQ ID NO: 82428 - DNA, 20 bp, synthetic construct
  misc_feature 1..20: note = CRISPR gRNA sequence
  source 1..20: mol_type = other DNA
gcagattgtttatatcagat

SEQ ID NO: 82429 - DNA, 20 bp, synthetic construct
  misc_feature 1..20: note = CRISPR gRNA sequence
  source 1..20: mol_type = other DNA
attgtttatatcagatggga

SEQ ID NO: 82430 - DNA, 20 bp, synthetic construct
  misc_feature 1..20: note = CRISPR gRNA sequence
  source 1..20: mol_type = other DNA
ttgtttatatcagatgggat

SEQ ID NO: 82431 - DNA, 20 bp, synthetic construct
  misc_feature 1..20: note = CRISPR gRNA sequence
  source 1..20: mol_type = other DNA
cagatgggatgggactcatt

SEQ ID NO: 82432 - DNA, 20 bp, synthetic construct
  misc_feature 1..20: note = CRISPR gRNA sequence
  source 1..20: mol_type = other DNA
agatgggatgggactcattc

SEQ ID NO: 82433 - DNA, 20 bp, synthetic construct
  misc_feature 1..20: note = CRISPR gRNA sequence
  source 1..20: mol_type = other DNA
gatgggatgggactcattca

SEQ ID NO: 82434 - DNA, 20 bp, synthetic construct
  misc_feature 1..20: note = CRISPR gRNA sequence
  source 1..20: mol_type = other DNA
gggatgggactcattcaggg

SEQ ID NO: 82435 - DNA, 20 bp, synthetic construct
  misc_feature 1..20: note = CRISPR gRNA sequence
  source 1..20: mol_type = other DNA
gggactcattcagggtagta

SEQ ID NO: 82436 - DNA, 20 bp, synthetic construct
  misc_feature 1..20: note = CRISPR gRNA sequence
  source 1..20: mol_type = other DNA
cattcagggtagtatggcca

SEQ ID NO: 82437 - DNA, 20 bp, synthetic construct
  misc_feature 1..20: note = CRISPR gRNA sequence
  source 1..20: mol_type = other DNA
catagaccttttttatatca

SEQ ID NO: 82438 - DNA, 20 bp, synthetic construct
  misc_feature 1..20: note = CRISPR gRNA sequence
  source 1..20: mol_type = other DNA
agaccttttttatatcaaag

SEQ ID NO: 82439 - DNA, 20 bp, synthetic construct
  misc_feature 1..20: note = CRISPR gRNA sequence
  source 1..20: mol_type = other DNA
gactactcatacacaacttt

SEQ ID NO: 82440 - DNA, 20 bp, synthetic construct
  misc_feature 1..20: note = CRISPR gRNA sequence
  source 1..20: mol_type = other DNA
tactcatacacaactttcag

SEQ ID NO: 82441 - DNA, 20 bp, synthetic construct
  misc_feature 1..20: note = CRISPR gRNA sequence
  source 1..20: mol_type = other DNA
caactttcagcagcttacaa

SEQ ID NO: 82442 - DNA, 20 bp, synthetic construct
  misc_feature 1..20: note = CRISPR gRNA sequence
  source 1..20: mol_type = other DNA
agcagcttacaaaagaatgt

SEQ ID NO: 82443 - DNA, 20 bp, synthetic construct
  misc_feature 1..20: note = CRISPR gRNA sequence
  source 1..20: mol_type = other DNA
cttaccccacttaactatct

SEQ ID NO: 82444 - DNA, 20 bp, synthetic construct
  misc_feature 1..20: note = CRISPR gRNA sequence
  source 1..20: mol_type = other DNA
ttaccccacttaactatctt

SEQ ID NO: 82445 - DNA, 20 bp, synthetic construct
  misc_feature 1..20: note = CRISPR gRNA sequence
  source 1..20: mol_type = other DNA
aactatcttgggctgtgaca

SEQ ID NO: 82446 - DNA, 20 bp, synthetic construct
  misc_feature 1..20: note = CRISPR gRNA sequence
  source 1..20: mol_type = other DNA
tgggctgtgacaaagtcaca

SEQ ID NO: 82447 - DNA, 20 bp, synthetic construct
  misc_feature 1..20: note = CRISPR gRNA sequence
  source 1..20: mol_type = other DNA
acaaagtcacatggttcaca

SEQ ID NO: 82448 - DNA, 20 bp, synthetic construct
  misc_feature 1..20: note = CRISPR gRNA sequence
  source 1..20: mol_type = other DNA
aagtcacatggttcacacgg

SEQ ID NO: 82449 - DNA, 20 bp, synthetic construct
  misc_feature 1..20: note = CRISPR gRNA sequence
  source 1..20: mol_type = other DNA
agtcacatggttcacacggc

SEQ ID NO: 82450 - DNA, 20 bp, synthetic construct
  misc_feature 1..20: note = CRISPR gRNA sequence
  source 1..20: mol_type = other DNA
gcaggcatactcatcttttt

SEQ ID NO: 82451 - DNA, 20 bp, synthetic construct
  misc_feature 1..20: note = CRISPR gRNA sequence
  source 1..20: mol_type = other DNA
ggcatactcatctttttcag

SEQ ID NO: 82452 - DNA, 20 bp, synthetic construct
  misc_feature 1..20: note = CRISPR gRNA sequence
  source 1..20: mol_type = other DNA
gcatactcatctttttcagt

SEQ ID NO: 82453 - DNA, 20 bp, synthetic construct
  misc_feature 1..20: note = CRISPR gRNA sequence
  source 1..20: mol_type = other DNA
catactcatctttttcagtg

SEQ ID NO: 82454 - DNA, 20 bp, synthetic construct
  misc_feature 1..20: note = CRISPR gRNA sequence
  source 1..20: mol_type = other DNA
atactcatctttttcagtgg

SEQ ID NO: 82455 - DNA, 20 bp, synthetic construct
  misc_feature 1..20: note = CRISPR gRNA sequence
  source 1..20: mol_type = other DNA
tttttcagtgggggtgaatt

SEQ ID NO: 82456 - DNA, 20 bp, synthetic construct
  misc_feature 1..20: note = CRISPR gRNA sequence
  source 1..20: mol_type = other DNA
cagtgggggtgaattcagtg

SEQ ID NO: 82457 - DNA, 20 bp, synthetic construct
  misc_feature 1..20: note = CRISPR gRNA sequence
  source 1..20: mol_type = other DNA
gggtgaattcagtgtagtac

SEQ ID NO: 82458 - DNA, 20 bp, synthetic construct
  misc_feature 1..20: note = CRISPR gRNA sequence
  source 1..20: mol_type = other DNA
gtgaattcagtgtagtacaa

SEQ ID NO: 82459 - DNA, 20 bp, synthetic construct
  misc_feature 1..20: note = CRISPR gRNA sequence
  source 1..20: mol_type = other DNA
attcagtgtagtacaagaga

SEQ ID NO: 82460 - DNA, 20 bp, synthetic construct
  misc_feature 1..20: note = CRISPR gRNA sequence
  source 1..20: mol_type = other DNA
agtgtagtacaagagataga

SEQ ID NO: 82461 - DNA, 20 bp, synthetic construct
  misc_feature 1..20: note = CRISPR gRNA sequence
  source 1..20: mol_type = other DNA
agtacaagagatagaaagac

SEQ ID NO: 82462 - DNA, 20 bp, synthetic construct
  misc_feature 1..20: note = CRISPR gRNA sequence
  source 1..20: mol_type = other DNA
gaaagaccagtccttgctga

SEQ ID NO: 82463 - DNA, 20 bp, synthetic construct
  misc_feature 1..20: note = CRISPR gRNA sequence
  source 1..20: mol_type = other DNA
accagtccttgctgaaagac

SEQ ID NO: 82464 - DNA, 20 bp, synthetic construct
  misc_feature 1..20: note = CRISPR gRNA sequence
  source 1..20: mol_type = other DNA
tcaattctctctccattctt

SEQ ID NO: 82465 - DNA, 20 bp, synthetic construct
  misc_feature 1..20: note = CRISPR gRNA sequence
  source 1..20: mol_type = other DNA
ttctctctccattcttcagt

SEQ ID NO: 82466 - DNA, 20 bp, synthetic construct
  misc_feature 1..20: note = CRISPR gRNA sequence
  source 1..20: mol_type = other DNA
cagtaagtcaacttcaatgt

SEQ ID NO: 82467 - DNA, 20 bp, synthetic construct
  misc_feature 1..20: note = CRISPR gRNA sequence
  source 1..20: mol_type = other DNA
aagtcaacttcaatgtcgga

SEQ ID NO: 82468 - DNA, 20 bp, synthetic construct
  misc_feature 1..20: note = CRISPR gRNA sequence
  source 1..20: mol_type = other DNA
aatgtcggatggatgaaacc

SEQ ID NO: 82469 - DNA, 20 bp, synthetic construct
  misc_feature 1..20: note = CRISPR gRNA sequence
  source 1..20: mol_type = other DNA
atggatgaaacccagacaca

SEQ ID NO: 82470 - DNA, 20 bp, synthetic construct
  misc_feature 1..20: note = CRISPR gRNA sequence
  source 1..20: mol_type = other DNA
aacccagacacatagcaatt

SEQ ID NO: 82471 - DNA, 20 bp, synthetic construct
  misc_feature 1..20: note = CRISPR gRNA sequence
  source 1..20: mol_type = other DNA
acccagacacatagcaattc

SEQ ID NO: 82472 - DNA, 20 bp, synthetic construct
  misc_feature 1..20: note = CRISPR gRNA sequence
  source 1..20: mol_type = other DNA
tttgactttccattctctgc

SEQ ID NO: 82473 - DNA, 20 bp, synthetic construct
  misc_feature 1..20: note = CRISPR gRNA sequence
  source 1..20: mol_type = other DNA
cattctctgctggatgacgt

SEQ ID NO: 82474 - DNA, 20 bp, synthetic construct
  misc_feature 1..20: note = CRISPR gRNA sequence
  source 1..20: mol_type = other DNA
cgtgagtaaacctgaatctt

SEQ ID NO: 82475 - DNA, 20 bp, synthetic construct
  misc_feature 1..20: note = CRISPR gRNA sequence
  source 1..20: mol_type = other DNA
tgagtaaacctgaatctttg

SEQ ID NO: 82476 - DNA, 20 bp, synthetic construct
  misc_feature 1..20: note = CRISPR gRNA sequence
  source 1..20: mol_type = other DNA
cctgaatctttggagtacct

SEQ ID NO: 82477 - DNA, 20 bp, synthetic construct
  misc_feature 1..20: note = CRISPR gRNA sequence
  source 1..20: mol_type = other DNA
ctgaatctttggagtacctg

SEQ ID NO: 82478 - DNA, 20 bp, synthetic construct
  misc_feature 1..20: note = CRISPR gRNA sequence
  source 1..20: mol_type = other DNA
ttggagtacctgaggaatat

SEQ ID NO: 82479 - DNA, 20 bp, synthetic construct
  misc_feature 1..20: note = CRISPR gRNA sequence
  source 1..20: mol_type = other DNA
tggagtacctgaggaatatc

SEQ ID NO: 82480 - DNA, 20 bp, synthetic construct
  misc_feature 1..20: note = CRISPR gRNA sequence
  source 1..20: mol_type = other DNA
tacctgaggaatatcgggaa

SEQ ID NO: 82481 - DNA, 20 bp, synthetic construct
  misc_feature 1..20: note = CRISPR gRNA sequence
  source 1..20: mol_type = other DNA
aaaagacacattaatattgc

SEQ ID NO: 82482 - DNA, 20 bp, synthetic construct
  misc_feature 1..20: note = CRISPR gRNA sequence
  source 1..20: mol_type = other DNA
aaagacacattaatattgcc

SEQ ID NO: 82483 - DNA, 20 bp, synthetic construct
  misc_feature 1..20: note = CRISPR gRNA sequence
  source 1..20: mol_type = other DNA
aagacacattaatattgcca

SEQ ID NO: 82484 - DNA, 20 bp, synthetic construct
  misc_feature 1..20: note = CRISPR gRNA sequence
  source 1..20: mol_type = other DNA
tattgccagggtatttcact

SEQ ID NO: 82485 - DNA, 20 bp, synthetic construct
  misc_feature 1..20: note = CRISPR gRNA sequence
  source 1..20: mol_type = other DNA
attgccagggtatttcactt

SEQ ID NO: 82486 - DNA, 20 bp, synthetic construct
  misc_feature 1..20: note = CRISPR gRNA sequence
  source 1..20: mol_type = other DNA
ttgccagggtatttcacttg

SEQ ID NO: 82487 - DNA, 20 bp, synthetic construct
  misc_feature 1..20: note = CRISPR gRNA sequence
  source 1..20: mol_type = other DNA
tatttcacttggggctaact

SEQ ID NO: 82488 - DNA, 20 bp, synthetic construct
  misc_feature 1..20: note = CRISPR gRNA sequence
  source 1..20: mol_type = other DNA
cttggggctaacttggtgtc

SEQ ID NO: 82489 - DNA, 20 bp, synthetic construct
  misc_feature 1..20: note = CRISPR gRNA sequence
  source 1..20: mol_type = other DNA
aacttggtgtcaagctatat

SEQ ID NO: 82490 - DNA, 20 bp, synthetic construct
  misc_feature 1..20: note = CRISPR gRNA sequence
  source 1..20: mol_type = other DNA
acttggtgtcaagctatatc

SEQ ID NO: 82491 - DNA, 20 bp, synthetic construct
  misc_feature 1..20: note = CRISPR gRNA sequence
  source 1..20: mol_type = other DNA
gtcaagctatatcaggcacc

SEQ ID NO: 82492 - DNA, 20 bp, synthetic construct
  misc_feature 1..20: note = CRISPR gRNA sequence
  source 1..20: mol_type = other DNA
aggcaccaagtgtttacatt

SEQ ID NO: 82493 - DNA, 20 bp, synthetic construct
  misc_feature 1..20: note = CRISPR gRNA sequence
  source 1..20: mol_type = other DNA
tcccaattccatttccactc

SEQ ID NO: 82494 - DNA, 20 bp, synthetic construct
  misc_feature 1..20: note = CRISPR gRNA sequence
  source 1..20: mol_type = other DNA
catttccactctggccaaat

SEQ ID NO: 82495 - DNA, 20 bp, synthetic construct
  misc_feature 1..20: note = CRISPR gRNA sequence
  source 1..20: mol_type = other DNA
tgagcttccaccttcccaac

SEQ ID NO: 82496 - DNA, 20 bp, synthetic construct
  misc_feature 1..20: note = CRISPR gRNA sequence
  source 1..20: mol_type = other DNA
aacaagccacctccattttg

SEQ ID NO: 82497 - DNA, 20 bp, synthetic construct
  misc_feature 1..20: note = CRISPR gRNA sequence
  source 1..20: mol_type = other DNA
ttgaagaataaaccgtgact

SEQ ID NO: 82498 - DNA, 20 bp, synthetic construct
  misc_feature 1..20: note = CRISPR gRNA sequence
  source 1..20: mol_type = other DNA
tgccttttttgttttttttc

SEQ ID NO: 82499 - DNA, 20 bp, synthetic construct
  misc_feature 1..20: note = CRISPR gRNA sequence
  source 1..20: mol_type = other DNA
cttttttgttttttttctag

SEQ ID NO: 82500 - DNA, 20 bp, synthetic construct
  misc_feature 1..20: note = CRISPR gRNA sequence
  source 1..20: mol_type = other DNA
ttttttttctagcagatttc

SEQ ID NO: 82501 - DNA, 20 bp, synthetic construct
  misc_feature 1..20: note = CRISPR gRNA sequence
  source 1..20: mol_type = other DNA
tttttctagcagatttctag

SEQ ID NO: 82502 - DNA, 20 bp, synthetic construct
  misc_feature 1..20: note = CRISPR gRNA sequence
  source 1..20: mol_type = other DNA
ctagcagtatcttctgtcac

SEQ ID NO: 82503 - DNA, 20 bp, synthetic construct
  misc_feature 1..20: note = CRISPR gRNA sequence
  source 1..20: mol_type = other DNA
agcagtatcttctgtcactg

SEQ ID NO: 82504 - DNA, 20 bp, synthetic construct
  misc_feature 1..20: note = CRISPR gRNA sequence
  source 1..20: mol_type = other DNA
ggagattgcgctgcattttt

SEQ ID NO: 82505 - DNA, 20 bp, synthetic construct
  misc_feature 1..20: note = CRISPR gRNA sequence
  source 1..20: mol_type = other DNA
agattgcgctgcatttttaa

SEQ ID NO: 82506 - DNA, 20 bp, synthetic construct
  misc_feature 1..20: note = CRISPR gRNA sequence
  source 1..20: mol_type = other DNA
catttttaagagcctttctc

SEQ ID NO: 82507 - DNA, 20 bp, synthetic construct
  misc_feature 1..20: note = CRISPR gRNA sequence
  source 1..20: mol_type = other DNA
tttttaagagcctttctctg

SEQ ID NO: 82508 - DNA, 20 bp, synthetic construct
  misc_feature 1..20: note = CRISPR gRNA sequence
  source 1..20: mol_type = other DNA
ttttaagagcctttctctgg

SEQ ID NO: 82509 - DNA, 20 bp, synthetic construct
  misc_feature 1..20: note = CRISPR gRNA sequence
  source 1..20: mol_type = other DNA
gcctttctctggaggctctc

SEQ ID NO: 82510 - DNA, 20 bp, synthetic construct
  misc_feature 1..20: note = CRISPR gRNA sequence
  source 1..20: mol_type = other DNA
cctttctctggaggctctca

SEQ ID NO: 82511 - DNA, 20 bp, synthetic construct
  misc_feature 1..20: note = CRISPR gRNA sequence
  source 1..20: mol_type = other DNA
aaggacttctgatgccctct

SEQ ID NO: 82512 - DNA, 20 bp, synthetic construct
  misc_feature 1..20: note = CRISPR gRNA sequence
  source 1..20: mol_type = other DNA
tgatgccctctcagcactca

SEQ ID NO: 82513 - DNA, 20 bp, synthetic construct
  misc_feature 1..20: note = CRISPR gRNA sequence
  source 1..20: mol_type = other DNA
cattccttaacacatcactc

SEQ ID NO: 82514 - DNA, 20 bp, synthetic construct
  misc_feature 1..20: note = CRISPR gRNA sequence
  source 1..20: mol_type = other DNA
ttccttaacacatcactcaa

SEQ ID NO: 82515 - DNA, 20 bp, synthetic construct
  misc_feature 1..20: note = CRISPR gRNA sequence
  source 1..20: mol_type = other DNA
actcaagagtctacatgatt

SEQ ID NO: 82516 - DNA, 20 bp, synthetic construct
  misc_feature 1..20: note = CRISPR gRNA sequence
  source 1..20: mol_type = other DNA
agtctacatgatttggcccc

SEQ ID NO: 82517 - DNA, 20 bp, synthetic construct
  misc_feature 1..20: note = CRISPR gRNA sequence
  source 1..20: mol_type = other DNA
tggccccaagatacttttca

SEQ ID NO: 82518 - DNA, 20 bp, synthetic construct
  misc_feature 1..20: note = CRISPR gRNA sequence
  source 1..20: mol_type = other DNA
acttttcaaagttcatttct

SEQ ID NO: 82519 - DNA, 20 bp, synthetic construct
  misc_feature 1..20: note = CRISPR gRNA sequence
  source 1..20: mol_type = other DNA
gttcatttctcagttcataa

SEQ ID NO: 82520 - DNA, 20 bp, synthetic construct
  misc_feature 1..20: note = CRISPR gRNA sequence
  source 1..20: mol_type = other DNA
tatgtttatgcctttctttt

SEQ ID NO: 82521 - DNA, 20 bp, synthetic construct
  misc_feature 1..20: note = CRISPR gRNA sequence
  source 1..20: mol_type = other DNA
ctgattttctaaactgtatg

SEQ ID NO: 82522 - DNA, 20 bp, synthetic construct
  misc_feature 1..20: note = CRISPR gRNA sequence
  source 1..20: mol_type = other DNA
tctaaactgtatgaagtgtc

SEQ ID NO: 82523 - DNA, 20 bp, synthetic construct
  misc_feature 1..20: note = CRISPR gRNA sequence
  source 1..20: mol_type = other DNA
aaactgtatgaagtgtctag

SEQ ID NO: 82524 - DNA, 20 bp, synthetic construct
  misc_feature 1..20: note = CRISPR gRNA sequence
  source 1..20: mol_type = other DNA
actgtatgaagtgtctagta

SEQ ID NO: 82525 - DNA, 20 bp, synthetic construct
  misc_feature 1..20: note = CRISPR gRNA sequence
  source 1..20: mol_type = other DNA
gaagtgtctagtagagtgcc

SEQ ID NO: 82526 - DNA, 20 bp, synthetic construct
  misc_feature 1..20: note = CRISPR gRNA sequence
  source 1..20: mol_type = other DNA
aagtgtctagtagagtgcct

SEQ ID NO: 82527 - DNA, 20 bp, synthetic construct
  misc_feature 1..20: note = CRISPR gRNA sequence
  source 1..20: mol_type = other DNA
ctagtagagtgcctgggaca

SEQ ID NO: 82528 - DNA, 20 bp, synthetic construct
  misc_feature 1..20: note = CRISPR gRNA sequence
  source 1..20: mol_type = other DNA
catagcaattgctctatacg

SEQ ID NO: 82529 - DNA, 20 bp, synthetic construct
  misc_feature 1..20: note = CRISPR gRNA sequence
  source 1..20: mol_type = other DNA
agcaattgctctatacgtgg

SEQ ID NO: 82530 - DNA, 20 bp, synthetic construct
  misc_feature 1..20: note = CRISPR gRNA sequence
  source 1..20: mol_type = other DNA
cgtggcagatgttattatct

SEQ ID NO: 82531 - DNA, 20 bp, synthetic construct
  misc_feature 1..20: note = CRISPR gRNA sequence
  source 1..20: mol_type = other DNA
gtggcagatgttattatctg

SEQ ID NO: 82532 - DNA, 20 bp, synthetic construct
  misc_feature 1..20: note = CRISPR gRNA sequence
  source 1..20: mol_type = other DNA
tgttattatctgaggttcct

SEQ ID NO: 82533 - DNA, 20 bp, synthetic construct
  misc_feature 1..20: note = CRISPR gRNA sequence
  source 1..20: mol_type = other DNA
tattatctgaggttcctaag

SEQ ID NO: 82534 - DNA, 20 bp, synthetic construct
  misc_feature 1..20: note = CRISPR gRNA sequence
  source 1..20: mol_type = other DNA
gttcctaagtggatcaaccc

SEQ ID NO: 82535 - DNA, 20 bp, synthetic construct
  misc_feature 1..20: note = CRISPR gRNA sequence
  source 1..20: mol_type = other DNA
ttcctaagtggatcaaccca

SEQ ID NO: 82536 - DNA, 20 bp, synthetic construct
  misc_feature 1..20: note = CRISPR gRNA sequence
  source 1..20: mol_type = other DNA
ttttttatttttttattttt

SEQ ID NO: 82537 - DNA, 20 bp, synthetic construct
  misc_feature 1..20: note = CRISPR gRNA sequence
  source 1..20: mol_type = other DNA
tttttatttttttatttttt

SEQ ID NO: 82538 - DNA, 20 bp, synthetic construct
  misc_feature 1..20: note = CRISPR gRNA sequence
  source 1..20: mol_type = other DNA
tatttttttattttttggga

SEQ ID NO: 82539 - DNA, 20 bp, synthetic construct
  misc_feature 1..20: note = CRISPR gRNA sequence
  source 1..20: mol_type = other DNA
tggaatctcattccattgcc

SEQ ID NO: 82540 - DNA, 20 bp, synthetic construct
  misc_feature 1..20: note = CRISPR gRNA sequence
  source 1..20: mol_type = other DNA
ggaatctcattccattgccc

SEQ ID NO: 82541 - DNA, 20 bp, synthetic construct
  misc_feature 1..20: note = CRISPR gRNA sequence
  source 1..20: mol_type = other DNA
tctcattccattgcccaggc

SEQ ID NO: 82542 - DNA, 20 bp, synthetic construct
  misc_feature 1..20: note = CRISPR gRNA sequence
  source 1..20: mol_type = other DNA
tcattccattgcccaggctg

SEQ ID NO: 82543 - DNA, 20 bp, synthetic construct
  misc_feature 1..20: note = CRISPR gRNA sequence
  source 1..20: mol_type = other DNA
ccattgcccaggctggagtg

SEQ ID NO: 82544 - DNA, 20 bp, synthetic construct
  misc_feature 1..20: note = CRISPR gRNA sequence
  source 1..20: mol_type = other DNA
ccaggctggagtgcagtgtg

SEQ ID NO: 82545 - DNA, 20 bp, synthetic construct
  misc_feature 1..20: note = CRISPR gRNA sequence
  source 1..20: mol_type = other DNA
ggctggagtgcagtgtgcag

SEQ ID NO: 82546 - DNA, 20 bp, synthetic construct
  misc_feature 1..20: note = CRISPR gRNA sequence
  source 1..20: mol_type = other DNA
ggagtgcagtgtgcagtggt

SEQ ID NO: 82547 - DNA, 20 bp, synthetic construct
  misc_feature 1..20: note = CRISPR gRNA sequence
  source 1..20: mol_type = other DNA
agtgtgcagtggtgagatct

SEQ ID NO: 82548 - DNA, 20 bp, synthetic construct
  misc_feature 1..20: note = CRISPR gRNA sequence
  source 1..20: mol_type = other DNA
tcactgcaacctccgcctcc

SEQ ID NO: 82549 - DNA, 20 bp, synthetic construct
  misc_feature 1..20: note = CRISPR gRNA sequence
  source 1..20: mol_type = other DNA
cactgcaacctccgcctcct

SEQ ID NO: 82550 - DNA, 20 bp, synthetic construct
  misc_feature 1..20: note = CRISPR gRNA sequence
  source 1..20: mol_type = other DNA
aacctccgcctcctgggttc

SEQ ID NO: 82551 - DNA, 20 bp, synthetic construct
  misc_feature 1..20: note = CRISPR gRNA sequence
  source 1..20: mol_type = other DNA
tcctgggttcaagtgattcc

SEQ ID NO: 82552 - DNA, 20 bp, synthetic construct
  misc_feature 1..20: note = CRISPR gRNA sequence
  source 1..20: mol_type = other DNA
cctgggttcaagtgattcct

SEQ ID NO: 82553 - DNA, 20 bp, synthetic construct
  misc_feature 1..20: note = CRISPR gRNA sequence
  source 1..20: mol_type = other DNA
tcaagtgattcctgggacta

SEQ ID NO: 82554 - DNA, 20 bp, synthetic construct
  misc_feature 1..20: note = CRISPR gRNA sequence
  source 1..20: mol_type = other DNA
caagtgattcctgggactac

SEQ ID NO: 82555 - DNA, 20 bp, synthetic construct
  misc_feature 1..20: note = CRISPR gRNA sequence
  source 1..20: mol_type = other DNA
caggcacacaccaccatgcc

SEQ ID NO: 82556 - DNA, 20 bp, synthetic construct
  misc_feature 1..20: note = CRISPR gRNA sequence
  source 1..20: mol_type = other DNA
ctggttaatttttgtatttt

SEQ ID NO: 82557 - DNA, 20 bp, synthetic construct
  misc_feature 1..20: note = CRISPR gRNA sequence
  source 1..20: mol_type = other DNA
gttaatttttgtattttcag

SEQ ID NO: 82558 - DNA, 20 bp, synthetic construct
  misc_feature 1..20: note = CRISPR gRNA sequence
  source 1..20: mol_type = other DNA
taatttttgtattttcagta

SEQ ID NO: 82559 - DNA, 20 bp, synthetic construct
  misc_feature 1..20: note = CRISPR gRNA sequence
  source 1..20: mol_type = other DNA
ttttgtattttcagtagaga

SEQ ID NO: 82560 - DNA, 20 bp, synthetic construct
  misc_feature 1..20: note = CRISPR gRNA sequence
  source 1..20: mol_type = other DNA
tttgtattttcagtagagac

SEQ ID NO: 82561 - DNA, 20 bp, synthetic construct
  misc_feature 1..20: note = CRISPR gRNA sequence
  source 1..20: mol_type = other DNA
gagacgggatttcaccatgt

SEQ ID NO: 82562 - DNA, 20 bp, synthetic construct
  misc_feature 1..20: note = CRISPR gRNA sequence
  source 1..20: mol_type = other DNA
cgggatttcaccatgttggc

SEQ ID NO: 82563 - DNA, 20 bp, synthetic construct
  misc_feature 1..20: note = CRISPR gRNA sequence
  source 1..20: mol_type = other DNA
gggatttcaccatgttggcc

SEQ ID NO: 82564 - DNA, 20 bp, synthetic construct
  misc_feature 1..20: note = CRISPR gRNA sequence
  source 1..20: mol_type = other DNA
tttcaccatgttggccaggc

SEQ ID NO: 82565 - DNA, 20 bp, synthetic construct
  misc_feature 1..20: note = CRISPR gRNA sequence
  source 1..20: mol_type = other DNA
ggtcttgaactcccaacttc

SEQ ID NO: 82566 - DNA, 20 bp, synthetic construct
  misc_feature 1..20: note = CRISPR gRNA sequence
  source 1..20: mol_type = other DNA
aactcccaacttcaagtgat

SEQ ID NO: 82567 - DNA, 20 bp, synthetic construct
  misc_feature 1..20: note = CRISPR gRNA sequence
  source 1..20: mol_type = other DNA
ttcaagtgatcagcctgcct

SEQ ID NO: 82568 - DNA, 20 bp, synthetic construct
  misc_feature 1..20: note = CRISPR gRNA sequence
  source 1..20: mol_type = other DNA
cagcctgccttggcctccca

SEQ ID NO: 82569 - DNA, 20 bp, synthetic construct
  misc_feature 1..20: note = CRISPR gRNA sequence
  source 1..20: mol_type = other DNA
gccttggcctcccaaagtgt

SEQ ID NO: 82570 - DNA, 20 bp, synthetic construct
  misc_feature 1..20: note = CRISPR gRNA sequence
  source 1..20: mol_type = other DNA
ccttggcctcccaaagtgtt

SEQ ID NO: 82571 - DNA, 20 bp, synthetic construct
  misc_feature 1..20: note = CRISPR gRNA sequence
  source 1..20: mol_type = other DNA
ctcccaaagtgttgggatta

SEQ ID NO: 82572 - DNA, 20 bp, synthetic construct
  misc_feature 1..20: note = CRISPR gRNA sequence
  source 1..20: mol_type = other DNA
tcccaaagtgttgggattac

SEQ ID NO: 82573 - DNA, 20 bp, synthetic construct
  misc_feature 1..20: note = CRISPR gRNA sequence
  source 1..20: mol_type = other DNA
agtgttgggattacaggcac

SEQ ID NO: 82574 - DNA, 20 bp, synthetic construct
  misc_feature 1..20: note = CRISPR gRNA sequence
  source 1..20: mol_type = other DNA
ccaccgtgcccaaccaaccc

SEQ ID NO: 82575 - DNA, 20 bp, synthetic construct
  misc_feature 1..20: note = CRISPR gRNA sequence
  source 1..20: mol_type = other DNA
caccgtgcccaaccaaccca

SEQ ID NO: 82576 - DNA, 20 bp, synthetic construct
  misc_feature 1..20: note = CRISPR gRNA sequence
  source 1..20: mol_type = other DNA
aaaacctctttatttctgct

SEQ ID NO: 82577 - DNA, 20 bp, synthetic construct
  misc_feature 1..20: note = CRISPR gRNA sequence
  source 1..20: mol_type = other DNA
aaacctctttatttctgctg

SEQ ID NO: 82578 - DNA, 20 bp, synthetic construct
  misc_feature 1..20: note = CRISPR gRNA sequence
  source 1..20: mol_type = other DNA
tctgctgaggttttatatgc

SEQ ID NO: 82579 - DNA, 20 bp, synthetic construct
  misc_feature 1..20: note = CRISPR gRNA sequence
  source 1..20: mol_type = other DNA
gactttgtacctaatttcat

SEQ ID NO: 82580 - DNA, 20 bp, synthetic construct
  misc_feature 1..20: note = CRISPR gRNA sequence
  source 1..20: mol_type = other DNA
atttcatgagctaaaaaaca

SEQ ID NO: 82581 - DNA, 20 bp, synthetic construct
  misc_feature 1..20: note = CRISPR gRNA sequence
  source 1..20: mol_type = other DNA
aacaaaacctaaatgcatac

SEQ ID NO: 82582 - DNA, 20 bp, synthetic construct
  misc_feature 1..20: note = CRISPR gRNA sequence
  source 1..20: mol_type = other DNA
caaaacctaaatgcatacaa

SEQ ID NO: 82583 - DNA, 20 bp, synthetic construct
  misc_feature 1..20: note = CRISPR gRNA sequence
  source 1..20: mol_type = other DNA
acctaaatgcatacaagagc

SEQ ID NO: 82584 - DNA, 20 bp, synthetic construct
  misc_feature 1..20: note = CRISPR gRNA sequence
  source 1..20: mol_type = other DNA
gagctggcaaataccttaaa

SEQ ID NO: 82585 - DNA, 20 bp, synthetic construct
  misc_feature 1..20: note = CRISPR gRNA sequence
  source 1..20: mol_type = other DNA
ggcaaataccttaaatggtt

SEQ ID NO: 82586 - DNA, 20 bp, synthetic construct
  misc_feature 1..20: note = CRISPR gRNA sequence
  source 1..20: mol_type = other DNA
aataccttaaatggttgagt

SEQ ID NO: 82587 - DNA, 20 bp, synthetic construct
  misc_feature 1..20: note = CRISPR gRNA sequence
  source 1..20: mol_type = other DNA
ttggacccgataaaatacaa

SEQ ID NO: 82588 - DNA, 20 bp, synthetic construct
  misc_feature 1..20: note = CRISPR gRNA sequence
  source 1..20: mol_type = other DNA
tggacccgataaaatacaac

SEQ ID NO: 82589 - DNA, 20 bp, synthetic construct
  misc_feature 1..20: note = CRISPR gRNA sequence
  source 1..20: mol_type = other DNA
ggacccgataaaatacaaca

SEQ ID NO: 82590 - DNA, 20 bp, synthetic construct
  misc_feature 1..20: note = CRISPR gRNA sequence
  source 1..20: mol_type = other DNA
ccgataaaatacaacaggga

SEQ ID NO: 82591 - DNA, 20 bp, synthetic construct
  misc_feature 1..20: note = CRISPR gRNA sequence
  source 1..20: mol_type = other DNA
cgataaaatacaacagggat

SEQ ID NO: 82592 - DNA, 20 bp, synthetic construct
  misc_feature 1..20: note = CRISPR gRNA sequence
  source 1..20: mol_type = other DNA
aaaatacaacagggataggt

SEQ ID NO: 82593 - DNA, 20 bp, synthetic construct
  misc_feature 1..20: note = CRISPR gRNA sequence
  source 1..20: mol_type = other DNA
aaatacaacagggataggtg

SEQ ID NO: 82594 - DNA, 20 bp, synthetic construct
  misc_feature 1..20: note = CRISPR gRNA sequence
  source 1..20: mol_type = other DNA
acagggataggtgaggacta

SEQ ID NO: 82595 - DNA, 20 bp, synthetic construct
  misc_feature 1..20: note = CRISPR gRNA sequence
  source 1..20: mol_type = other DNA
taggtgaggactatggcaaa

SEQ ID NO: 82596 - DNA, 20 bp, synthetic construct
  misc_feature 1..20: note = CRISPR gRNA sequence
  source 1..20: mol_type = other DNA
aggtgaggactatggcaaat

SEQ ID NO: 82597 - DNA, 20 bp, synthetic construct
  misc_feature 1..20: note = CRISPR gRNA sequence
  source 1..20: mol_type = other DNA
gaggactatggcaaatggga

SEQ ID NO: 82598 - DNA, 20 bp, synthetic construct
  misc_feature 1..20: note = CRISPR gRNA sequence
  source 1..20: mol_type = other DNA
tactttccattatgatcaaa

SEQ ID NO: 82599 - DNA, 20 bp, synthetic construct
  misc_feature 1..20: note = CRISPR gRNA sequence
  source 1..20: mol_type = other DNA
ctttccattatgatcaaatg

SEQ ID NO: 82600 - DNA, 20 bp, synthetic construct
  misc_feature 1..20: note = CRISPR gRNA sequence
  source 1..20: mol_type = other DNA
aaatggagtaatgcatgtga

SEQ ID NO: 82601 - DNA, 20 bp, synthetic construct
  misc_feature 1..20: note = CRISPR gRNA sequence
  source 1..20: mol_type = other DNA
tggagtaatgcatgtgacag

SEQ ID NO: 82602 - DNA, 20 bp, synthetic construct
  misc_feature 1..20: note = CRISPR gRNA sequence
  source 1..20: mol_type = other DNA
ggagtaatgcatgtgacagt

SEQ ID NO: 82603 - DNA, 20 bp, synthetic construct
  misc_feature 1..20: note = CRISPR gRNA sequence
  source 1..20: mol_type = other DNA
agtgggatttgcgttttaat

SEQ ID NO: 82604 - DNA, 20 bp, synthetic construct
  misc_feature 1..20: note = CRISPR gRNA sequence
  source 1..20: mol_type = other DNA
tgcgttttaattagcatcca

SEQ ID NO: 82605 - DNA, 20 bp, synthetic construct
  misc_feature 1..20: note = CRISPR gRNA sequence
  source 1..20: mol_type = other DNA
gcgttttaattagcatccac

SEQ ID NO: 82606 - DNA, 20 bp, synthetic construct
  misc_feature 1..20: note = CRISPR gRNA sequence
  source 1..20: mol_type = other DNA
cacaggtgattgctgtaaac

SEQ ID NO: 82607 - DNA, 20 bp, synthetic construct
  misc_feature 1..20: note = CRISPR gRNA sequence
  source 1..20: mol_type = other DNA
ggtgattgctgtaaactagc

SEQ ID NO: 82608 - DNA, 20 bp, synthetic construct
  misc_feature 1..20: note = CRISPR gRNA sequence
  source 1..20: mol_type = other DNA
gtgattgctgtaaactagcc

SEQ ID NO: 82609 - DNA, 20 bp, synthetic construct
  misc_feature 1..20: note = CRISPR gRNA sequence
  source 1..20: mol_type = other DNA
ttgctgtaaactagccaggt

SEQ ID NO: 82610 - DNA, 20 bp, synthetic construct
  misc_feature 1..20: note = CRISPR gRNA sequence
  source 1..20: mol_type = other DNA
tgctgtaaactagccaggtt

SEQ ID NO: 82611 - DNA, 20 bp, synthetic construct
  misc_feature 1..20: note = CRISPR gRNA sequence
  source 1..20: mol_type = other DNA
gaatatattgcctaatgttt

SEQ ID NO: 82612 - DNA, 20 bp, synthetic construct
  misc_feature 1..20: note = CRISPR gRNA sequence
  source 1..20: mol_type = other DNA
attgcctaatgtttcagaaa

SEQ ID NO: 82613 - DNA, 20 bp, synthetic construct
  misc_feature 1..20: note = CRISPR gRNA sequence
  source 1..20: mol_type = other DNA
gaaacagtactttccaaaat

SEQ ID NO: 82614 - DNA, 20 bp, synthetic construct
  misc_feature 1..20: note = CRISPR gRNA sequence
  source 1..20: mol_type = other DNA
aacagtactttccaaaatga

SEQ ID NO: 82615 - DNA, 20 bp, synthetic construct
  misc_feature 1..20: note = CRISPR gRNA sequence
  source 1..20: mol_type = other DNA
acagtactttccaaaatgag

SEQ ID NO: 82616 - DNA, 20 bp, synthetic construct
  misc_feature 1..20: note = CRISPR gRNA sequence
  source 1..20: mol_type = other DNA
tccaaaatgagaggcatgac

SEQ ID NO: 82617 - DNA, 20 bp, synthetic construct
  misc_feature 1..20: note = CRISPR gRNA sequence
  source 1..20: mol_type = other DNA
aggcatgactagaccatcca

SEQ ID NO: 82618 - DNA, 20 bp, synthetic construct
  misc_feature 1..20: note = CRISPR gRNA sequence
  source 1..20: mol_type = other DNA
ggcatgactagaccatccat

SEQ ID NO: 82619 - DNA, 20 bp, synthetic construct
  misc_feature 1..20: note = CRISPR gRNA sequence
  source 1..20: mol_type = other DNA
gcatgactagaccatccatg

SEQ ID NO: 82620 - DNA, 20 bp, synthetic construct
  misc_feature 1..20: note = CRISPR gRNA sequence
  source 1..20: mol_type = other DNA
tgactagaccatccatgggg

SEQ ID NO: 82621 - DNA, 20 bp, synthetic construct
  misc_feature 1..20: note = CRISPR gRNA sequence
  source 1..20: mol_type = other DNA
ctagaccatccatggggaag

SEQ ID NO: 82622 - DNA, 20 bp, synthetic construct
  misc_feature 1..20: note = CRISPR gRNA sequence
  source 1..20: mol_type = other DNA
tagaccatccatggggaagt

SEQ ID NO: 82623 - DNA, 20 bp, synthetic construct
  misc_feature 1..20: note = CRISPR gRNA sequence
  source 1..20: mol_type = other DNA
accatccatggggaagtggg

SEQ ID NO: 82624 - DNA, 20 bp, synthetic construct
  misc_feature 1..20: note = CRISPR gRNA sequence
  source 1..20: mol_type = other DNA
tatatttttcattgaaaatg

SEQ ID NO: 82625 - DNA, 20 bp, synthetic construct
  misc_feature 1..20: note = CRISPR gRNA sequence
  source 1..20: mol_type = other DNA
tatttttcattgaaaatgaa

SEQ ID NO: 82626 - DNA, 20 bp, synthetic construct
  misc_feature 1..20: note = CRISPR gRNA sequence
  source 1..20: mol_type = other DNA
ttttcattgaaaatgaagag

SEQ ID NO: 82627 - DNA, 20 bp, synthetic construct
  misc_feature 1..20: note = CRISPR gRNA sequence
  source 1..20: mol_type = other DNA
ttgaaaatgaagagaagtgt

SEQ ID NO: 82628 - DNA, 20 bp, synthetic construct
  misc_feature 1..20: note = CRISPR gRNA sequence
  source 1..20: mol_type = other DNA
tgttagtgctactaaatata

SEQ ID NO: 82629 - DNA, 20 bp, synthetic construct
  misc_feature 1..20: note = CRISPR gRNA sequence
  source 1..20: mol_type = other DNA
cttttaaatacacttatatt

SEQ ID NO: 82630 - DNA, 20 bp, synthetic construct
  misc_feature 1..20: note = CRISPR gRNA sequence
  source 1..20: mol_type = other DNA
ttttaaatacacttatattc

SEQ ID NO: 82631 - DNA, 20 bp, synthetic construct
  misc_feature 1..20: note = CRISPR gRNA sequence
  source 1..20: mol_type = other DNA
tttaaatacacttatattca

SEQ ID NO: 82632 - DNA, 20 bp, synthetic construct
  misc_feature 1..20: note = CRISPR gRNA sequence
  source 1..20: mol_type = other DNA
tcagggtacatgatcactaa

SEQ ID NO: 82633 - DNA, 20 bp, synthetic construct
  misc_feature 1..20: note = CRISPR gRNA sequence
  source 1..20: mol_type = other DNA
cagggtacatgatcactaaa

SEQ ID NO: 82634 - DNA, 20 bp, synthetic construct
  misc_feature 1..20: note = CRISPR gRNA sequence
  source 1..20: mol_type = other DNA
ggtacatgatcactaaaagg

SEQ ID NO: 82635 - DNA, 20 bp, synthetic construct
  misc_feature 1..20: note = CRISPR gRNA sequence
  source 1..20: mol_type = other DNA
ggcagctactcctccttgtc

SEQ ID NO: 82636 - DNA, 20 bp, synthetic construct
  misc_feature 1..20: note = CRISPR gRNA sequence
  source 1..20: mol_type = other DNA
gcagctactcctccttgtct

SEQ ID NO: 82637 - DNA, 20 bp, synthetic construct
  misc_feature 1..20: note = CRISPR gRNA sequence
  source 1..20: mol_type = other DNA
agctactcctccttgtctgg

SEQ ID NO: 82638 - DNA, 20 bp, synthetic construct
  misc_feature 1..20: note = CRISPR gRNA sequence
  source 1..20: mol_type = other DNA
gctactcctccttgtctggg

SEQ ID NO: 82639 - DNA, 20 bp, synthetic construct
  misc_feature 1..20: note = CRISPR gRNA sequence
  source 1..20: mol_type = other DNA
cctccttgtctgggaggctg

SEQ ID NO: 82640 - DNA, 20 bp, synthetic construct
  misc_feature 1..20: note = CRISPR gRNA sequence
  source 1..20: mol_type = other DNA
ctccttgtctgggaggctgt

SEQ ID NO: 82641 - DNA, 20 bp, synthetic construct
  misc_feature 1..20: note = CRISPR gRNA sequence
  source 1..20: mol_type = other DNA
tccttgtctgggaggctgtg

SEQ ID NO: 82642 - DNA, 20 bp, synthetic construct
  misc_feature 1..20: note = CRISPR gRNA sequence
  source 1..20: mol_type = other DNA
cttgtctgggaggctgtggg

SEQ ID NO: 82643 - DNA, 20 bp, synthetic construct
  misc_feature 1..20: note = CRISPR gRNA sequence
  source 1..20: mol_type = other DNA
gtctgggaggctgtggggag

SEQ ID NO: 82644 - DNA, 20 bp, synthetic construct
  misc_feature 1..20: note = CRISPR gRNA sequence
  source 1..20: mol_type = other DNA
tctgggaggctgtggggaga

SEQ ID NO: 82645 - DNA, 20 bp, synthetic construct
  misc_feature 1..20: note = CRISPR gRNA sequence
  source 1..20: mol_type = other DNA
tgggaggctgtggggagaag

SEQ ID NO: 82646 - DNA, 20 bp, synthetic construct
  misc_feature 1..20: note = CRISPR gRNA sequence
  source 1..20: mol_type = other DNA
gggaggctgtggggagaagg

SEQ ID NO: 82647 - DNA, 20 bp, synthetic construct
  misc_feature 1..20: note = CRISPR gRNA sequence
  source 1..20: mol_type = other DNA
gaggctgtggggagaaggag

SEQ ID NO: 82648 - DNA, 20 bp, synthetic construct
  misc_feature 1..20: note = CRISPR gRNA sequence
  source 1..20: mol_type = other DNA
gtggggagaaggaggagtac

SEQ ID NO: 82649 - DNA, 20 bp, synthetic construct
  misc_feature 1..20: note = CRISPR gRNA sequence
  source 1..20: mol_type = other DNA
tggggagaaggaggagtacc

SEQ ID NO: 82650 - DNA, 20 bp, synthetic construct
  misc_feature 1..20: note = CRISPR gRNA sequence
  source 1..20: mol_type = other DNA
gagtaccaggccaccttgac

SEQ ID NO: 82651 - DNA, 20 bp, synthetic construct
  misc_feature 1..20: note = CRISPR gRNA sequence
  source 1..20: mol_type = other DNA
cttgaccagatatatctctc

SEQ ID NO: 82652 - DNA, 20 bp, synthetic construct
  misc_feature 1..20: note = CRISPR gRNA sequence
  source 1..20: mol_type = other DNA
tctagaaacaccctatcatt

SEQ ID NO: 82653 - DNA, 20 bp, synthetic construct
  misc_feature 1..20: note = CRISPR gRNA sequence
  source 1..20: mol_type = other DNA
ctagaaacaccctatcatta

SEQ ID NO: 82654 - DNA, 20 bp, synthetic construct
  misc_feature 1..20: note = CRISPR gRNA sequence
  source 1..20: mol_type = other DNA
aaacaccctatcattaagga

SEQ ID NO: 82655 - DNA, 20 bp, synthetic construct
  misc_feature 1..20: note = CRISPR gRNA sequence
  source 1..20: mol_type = other DNA
aacaccctatcattaaggaa

SEQ ID NO: 82656 - DNA, 20 bp, synthetic construct
  misc_feature 1..20: note = CRISPR gRNA sequence
  source 1..20: mol_type = other DNA
tatcattaaggaaaggctac

SEQ ID NO: 82657 - DNA, 20 bp, synthetic construct
  misc_feature 1..20: note = CRISPR gRNA sequence
  source 1..20: mol_type = other DNA
gaaaggctactagccccatc

SEQ ID NO: 82658 - DNA, 20 bp, synthetic construct
  misc_feature 1..20: note = CRISPR gRNA sequence
  source 1..20: mol_type = other DNA
aaggctactagccccatcaa

SEQ ID NO: 82659 - DNA, 20 bp, synthetic construct
  misc_feature 1..20: note = CRISPR gRNA sequence
  source 1..20: mol_type = other DNA
aggctactagccccatcaag

SEQ ID NO: 82660 - DNA, 20 bp, synthetic construct
  misc_feature 1..20: note = CRISPR gRNA sequence
  source 1..20: mol_type = other DNA
ctactagccccatcaagagg

SEQ ID NO: 82661 - DNA, 20 bp, synthetic construct
  misc_feature 1..20: note = CRISPR gRNA sequence
  source 1..20: mol_type = other DNA
agccccatcaagaggtggat

SEQ ID NO: 82662 - DNA, 20 bp, synthetic construct
  misc_feature 1..20: note = CRISPR gRNA sequence
  source 1..20: mol_type = other DNA
gccccatcaagaggtggatt

SEQ ID NO: 82663 - DNA, 20 bp, synthetic construct
  misc_feature 1..20: note = CRISPR gRNA sequence
  source 1..20: mol_type = other DNA
ccccatcaagaggtggattg

SEQ ID NO: 82664 - DNA, 20 bp, synthetic construct
  misc_feature 1..20: note = CRISPR gRNA sequence
  source 1..20: mol_type = other DNA
gtggattggggaatctaatg

SEQ ID NO: 82665 - DNA, 20 bp, synthetic construct
  misc_feature 1..20: note = CRISPR gRNA sequence
  source 1..20: mol_type = other DNA
gatttttttcataacattaa

SEQ ID NO: 82666 - DNA, 20 bp, synthetic construct
  misc_feature 1..20: note = CRISPR gRNA sequence
  source 1..20: mol_type = other DNA
ttttcataacattaaaagct

SEQ ID NO: 82667 - DNA, 20 bp, synthetic construct
  misc_feature 1..20: note = CRISPR gRNA sequence
  source 1..20: mol_type = other DNA
ttcataacattaaaagctaa

SEQ ID NO: 82668 - DNA, 20 bp, synthetic construct
  misc_feature 1..20: note = CRISPR gRNA sequence
  source 1..20: mol_type = other DNA
cataacattaaaagctaaga

SEQ ID NO: 82669 - DNA, 20 bp, synthetic construct
  misc_feature 1..20: note = CRISPR gRNA sequence
  source 1..20: mol_type = other DNA
taagagagctctttgcatct

SEQ ID NO: 82670 - DNA, 20 bp, synthetic construct
  misc_feature 1..20: note = CRISPR gRNA sequence
  source 1..20: mol_type = other DNA
gcatctgagcttctaataat

SEQ ID NO: 82671 - DNA, 20 bp, synthetic construct
  misc_feature 1..20: note = CRISPR gRNA sequence
  source 1..20: mol_type = other DNA
taagaacatattaaatgcct

SEQ ID NO: 82672 - DNA, 20 bp, synthetic construct
  misc_feature 1..20: note = CRISPR gRNA sequence
  source 1..20: mol_type = other DNA
aagaacatattaaatgcctc

SEQ ID NO: 82673 - DNA, 20 bp, synthetic construct
  misc_feature 1..20: note = CRISPR gRNA sequence
  source 1..20: mol_type = other DNA
agaacatattaaatgcctca

SEQ ID NO: 82674 - DNA, 20 bp, synthetic construct
  misc_feature 1..20: note = CRISPR gRNA sequence
  source 1..20: mol_type = other DNA
atattaaatgcctcagggat

SEQ ID NO: 82675 - DNA, 20 bp, synthetic construct
  misc_feature 1..20: note = CRISPR gRNA sequence
  source 1..20: mol_type = other DNA
attaaatgcctcagggatca

SEQ ID NO: 82676 - DNA, 20 bp, synthetic construct
  misc_feature 1..20: note = CRISPR gRNA sequence
  source 1..20: mol_type = other DNA
atgcctcagggatcagagca

SEQ ID NO: 82677 - DNA, 20 bp, synthetic construct
  misc_feature 1..20: note = CRISPR gRNA sequence
  source 1..20: mol_type = other DNA
gagcacagattcatcctgcc

SEQ ID NO: 82678 - DNA, 20 bp, synthetic construct
  misc_feature 1..20: note = CRISPR gRNA sequence
  source 1..20: mol_type = other DNA
ctgcctggaactctctgttt

SEQ ID NO: 82679 - DNA, 20 bp, synthetic construct
  misc_feature 1..20: note = CRISPR gRNA sequence
  source 1..20: mol_type = other DNA
tgcctggaactctctgtttg

SEQ ID NO: 82680 - DNA, 20 bp, synthetic construct
  misc_feature 1..20: note = CRISPR gRNA sequence
  source 1..20: mol_type = other DNA
gcctggaactctctgtttga

SEQ ID NO: 82681 - DNA, 20 bp, synthetic construct
  misc_feature 1..20: note = CRISPR gRNA sequence
  source 1..20: mol_type = other DNA
tggaactctctgtttgaggg

SEQ ID NO: 82682 - DNA, 20 bp, synthetic construct
  misc_feature 1..20: note = CRISPR gRNA sequence
  source 1..20: mol_type = other DNA
ggaactctctgtttgaggga

SEQ ID NO: 82683 - DNA, 20 bp, synthetic construct
  misc_feature 1..20: note = CRISPR gRNA sequence
  source 1..20: mol_type = other DNA
actctctgtttgagggaagg

SEQ ID NO: 82684 - DNA, 20 bp, synthetic construct
  misc_feature 1..20: note = CRISPR gRNA sequence
  source 1..20: mol_type = other DNA
tctgtttgagggaaggcggc

SEQ ID NO: 82685 - DNA, 20 bp, synthetic construct
  misc_feature 1..20: note = CRISPR gRNA sequence
  source 1..20: mol_type = other DNA
ggaaggcggcaagattttgt

SEQ ID NO: 82686 - DNA, 20 bp, synthetic construct
  misc_feature 1..20: note = CRISPR gRNA sequence
  source 1..20: mol_type = other DNA
aaggcggcaagattttgtga

SEQ ID NO: 82687 - DNA, 20 bp, synthetic construct
  misc_feature 1..20: note = CRISPR gRNA sequence
  source 1..20: mol_type = other DNA
gcatcactgtaatcttttct

SEQ ID NO: 82688 - DNA, 20 bp, synthetic construct
  misc_feature 1..20: note = CRISPR gRNA sequence
  source 1..20: mol_type = other DNA
tcactgtaatcttttctaag

SEQ ID NO: 82689 - DNA, 20 bp, synthetic construct
  misc_feature 1..20: note = CRISPR gRNA sequence
  source 1..20: mol_type = other DNA
actgtaatcttttctaagaa

SEQ ID NO: 82690 - DNA, 20 bp, synthetic construct
  misc_feature 1..20: note = CRISPR gRNA sequence
  source 1..20: mol_type = other DNA
ctgtaatcttttctaagaag

SEQ ID NO: 82691 - DNA, 20 bp, synthetic construct
  misc_feature 1..20: note = CRISPR gRNA sequence
  source 1..20: mol_type = other DNA
atcttttctaagaagaggac

SEQ ID NO: 82692 - DNA, 20 bp, synthetic construct
  misc_feature 1..20: note = CRISPR gRNA sequence
  source 1..20: mol_type = other DNA
tctaagaagaggacaagtat

SEQ ID NO: 82693 - DNA, 20 bp, synthetic construct
  misc_feature 1..20: note = CRISPR gRNA sequence
  source 1..20: mol_type = other DNA
agaagaggacaagtatcaga

SEQ ID NO: 82694 - DNA, 20 bp, synthetic construct
  misc_feature 1..20: note = CRISPR gRNA sequence
  source 1..20: mol_type = other DNA
gaagaggacaagtatcagac

SEQ ID NO: 82695 - DNA, 20 bp, synthetic construct
  misc_feature 1..20: note = CRISPR gRNA sequence
  source 1..20: mol_type = other DNA
aggacaagtatcagacaggc

SEQ ID NO: 82696 - DNA, 20 bp, synthetic construct
  misc_feature 1..20: note = CRISPR gRNA sequence
  source 1..20: mol_type = other DNA
ggacaagtatcagacaggct

SEQ ID NO: 82697 - DNA, 20 bp, synthetic construct
  misc_feature 1..20: note = CRISPR gRNA sequence
  source 1..20: mol_type = other DNA
agacaggctgggtttgaatt

SEQ ID NO: 82698 - DNA, 20 bp, synthetic construct
  misc_feature 1..20: note = CRISPR gRNA sequence
  source 1..20: mol_type = other DNA
gacaggctgggtttgaattt

SEQ ID NO: 82699 - DNA, 20 bp, synthetic construct
  misc_feature 1..20: note = CRISPR gRNA sequence
  source 1..20: mol_type = other DNA
ggtttgaatttgggctcaac

SEQ ID NO: 82700 - DNA, 20 bp, synthetic construct
  misc_feature 1..20: note = CRISPR gRNA sequence
  source 1..20: mol_type = other DNA
atttgggctcaaccagttac

SEQ ID NO: 82701 - DNA, 20 bp, synthetic construct
  misc_feature 1..20: note = CRISPR gRNA sequence
  source 1..20: mol_type = other DNA
gttactggctttatgacttt

SEQ ID NO: 82702 - DNA, 20 bp, synthetic construct
  misc_feature 1..20: note = CRISPR gRNA sequence
  source 1..20: mol_type = other DNA
tactggctttatgacttttg

SEQ ID NO: 82703 - DNA, 20 bp, synthetic construct
  misc_feature 1..20: note = CRISPR gRNA sequence
  source 1..20: mol_type = other DNA
ctggctttatgacttttgga

SEQ ID NO: 82704 - DNA, 20 bp, synthetic construct
  misc_feature 1..20: note = CRISPR gRNA sequence
  source 1..20: mol_type = other DNA
tgacttttggagagttattt

SEQ ID NO: 82705 - DNA, 20 bp, synthetic construct
  misc_feature 1..20: note = CRISPR gRNA sequence
  source 1..20: mol_type = other DNA
gaaaaattaatttatgccca

SEQ ID NO: 82706 - DNA, 20 bp, synthetic construct
  misc_feature 1..20: note = CRISPR gRNA sequence
  source 1..20: mol_type = other DNA
acaaaaacaaaacccacaca

SEQ ID NO: 82707 - DNA, 20 bp, synthetic construct
  misc_feature 1..20: note = CRISPR gRNA sequence
  source 1..20: mol_type = other DNA
caaaaacaaaacccacacac

SEQ ID NO: 82708 - DNA, 20 bp, synthetic construct
  misc_feature 1..20: note = CRISPR gRNA sequence
  source 1..20: mol_type = other DNA
aacaaaacccacacacaggt

SEQ ID NO: 82709 - DNA, 20 bp, synthetic construct
  misc_feature 1..20: note = CRISPR gRNA sequence
  source 1..20: mol_type = other DNA
caaaacccacacacaggtca

SEQ ID NO: 82710 - DNA, 20 bp, synthetic construct
  misc_feature 1..20: note = CRISPR gRNA sequence
  source 1..20: mol_type = other DNA
aaaacccacacacaggtcag

SEQ ID NO: 82711 - DNA, 20 bp, synthetic construct
  misc_feature 1..20: note = CRISPR gRNA sequence
  source 1..20: mol_type = other DNA
aacccacacacaggtcagag

SEQ ID NO: 82712 - DNA, 20 bp, synthetic construct
  misc_feature 1..20: note = CRISPR gRNA sequence
  source 1..20: mol_type = other DNA
acccacacacaggtcagagg

SEQ ID NO: 82713 - DNA, 20 bp, synthetic construct
  misc_feature 1..20: note = CRISPR gRNA sequence
  source 1..20: mol_type = other DNA
cacaggtcagaggaggaaaa

SEQ ID NO: 82714 - DNA, 20 bp, synthetic construct
  misc_feature 1..20: note = CRISPR gRNA sequence
  source 1..20: mol_type = other DNA
agaggaggaaaatagacctt

SEQ ID NO: 82715 - DNA, 20 bp, synthetic construct
  misc_feature 1..20: note = CRISPR gRNA sequence
  source 1..20: mol_type = other DNA
aggaggaaaatagaccttca

SEQ ID NO: 82716 - DNA, 20 bp, synthetic construct
  misc_feature 1..20: note = CRISPR gRNA sequence
  source 1..20: mol_type = other DNA
ggaggaaaatagaccttcag

SEQ ID NO: 82717 - DNA, 20 bp, synthetic construct
  misc_feature 1..20: note = CRISPR gRNA sequence
  source 1..20: mol_type = other DNA
tcatcattacatgtttcttg

SEQ ID NO: 82718 - DNA, 20 bp, synthetic construct
  misc_feature 1..20: note = CRISPR gRNA sequence
  source 1..20: mol_type = other DNA
atgtttcttgtggtatcttc

SEQ ID NO: 82719 - DNA, 20 bp, synthetic construct
  misc_feature 1..20: note = CRISPR gRNA sequence
  source 1..20: mol_type = other DNA
cttgtggtatcttccagaaa

SEQ ID NO: 82720 - DNA, 20 bp, synthetic construct
  misc_feature 1..20: note = CRISPR gRNA sequence
  source 1..20: mol_type = other DNA
ttccagaaatggtctatgca

SEQ ID NO: 82721 - DNA, 20 bp, synthetic construct
  misc_feature 1..20: note = CRISPR gRNA sequence
  source 1..20: mol_type = other DNA
atgcatggcatgtattactt

SEQ ID NO: 82722 - DNA, 20 bp, synthetic construct
  misc_feature 1..20: note = CRISPR gRNA sequence
  source 1..20: mol_type = other DNA
actttggaaattttcaaaat

SEQ ID NO: 82723 - DNA, 20 bp, synthetic construct
  misc_feature 1..20: note = CRISPR gRNA sequence
  source 1..20: mol_type = other DNA
taagatttttttttaaatat

SEQ ID NO: 82724 - DNA, 20 bp, synthetic construct
  misc_feature 1..20: note = CRISPR gRNA sequence
  source 1..20: mol_type = other DNA
aaaatgacatctaacataac

SEQ ID NO: 82725 - DNA, 20 bp, synthetic construct
  misc_feature 1..20: note = CRISPR gRNA sequence
  source 1..20: mol_type = other DNA
ctaacataaccagcaaatac

SEQ ID NO: 82726 - DNA, 20 bp, synthetic construct
  misc_feature 1..20: note = CRISPR gRNA sequence
  source 1..20: mol_type = other DNA
taaccagcaaataccagtaa

SEQ ID NO: 82727 - DNA, 20 bp, synthetic construct
  misc_feature 1..20: note = CRISPR gRNA sequence
  source 1..20: mol_type = other DNA
ccagcaaataccagtaatgg

SEQ ID NO: 82728 - DNA, 20 bp, synthetic construct
  misc_feature 1..20: note = CRISPR gRNA sequence
  source 1..20: mol_type = other DNA
tgctttcgatcatgttttgc

SEQ ID NO: 82729 - DNA, 20 bp, synthetic construct
  misc_feature 1..20: note = CRISPR gRNA sequence
  source 1..20: mol_type = other DNA
ctttcgatcatgttttgcca

SEQ ID NO: 82730 - DNA, 20 bp, synthetic construct
  misc_feature 1..20: note = CRISPR gRNA sequence
  source 1..20: mol_type = other DNA
tttcgatcatgttttgccag

SEQ ID NO: 82731 - DNA, 20 bp, synthetic construct
  misc_feature 1..20: note = CRISPR gRNA sequence
  source 1..20: mol_type = other DNA
atcatgttttgccagaggaa

SEQ ID NO: 82732 - DNA, 20 bp, synthetic construct
  misc_feature 1..20: note = CRISPR gRNA sequence
  source 1..20: mol_type = other DNA
tcatgttttgccagaggaaa

SEQ ID NO: 82733 - DNA, 20 bp, synthetic construct
  misc_feature 1..20: note = CRISPR gRNA sequence
  source 1..20: mol_type = other DNA
gttttgccagaggaaaaggt

SEQ ID NO: 82734 - DNA, 20 bp, synthetic construct
  misc_feature 1..20: note = CRISPR gRNA sequence
  source 1..20: mol_type = other DNA
gaggaaaaggtgagcgcgct

SEQ ID NO: 82735 - DNA, 20 bp, synthetic construct
  misc_feature 1..20: note = CRISPR gRNA sequence
  source 1..20: mol_type = other DNA
gagcgcgcttagtgtattgc

SEQ ID NO: 82736 - DNA, 20 bp, synthetic construct
  misc_feature 1..20: note = CRISPR gRNA sequence
  source 1..20: mol_type = other DNA
agcgcgcttagtgtattgcc

SEQ ID NO: 82737 - DNA, 20 bp, synthetic construct
  misc_feature 1..20: note = CRISPR gRNA sequence
  source 1..20: mol_type = other DNA
ttagtgtattgccaggtact

SEQ ID NO: 82738 - DNA, 20 bp, synthetic construct
  misc_feature 1..20: note = CRISPR gRNA sequence
  source 1..20: mol_type = other DNA
tgtattgccaggtacttaga

SEQ ID NO: 82739 - DNA, 20 bp, synthetic construct
  misc_feature 1..20: note = CRISPR gRNA sequence
  source 1..20: mol_type = other DNA
caggtacttagaaagtgctc

SEQ ID NO: 82740 - DNA, 20 bp, synthetic construct
  misc_feature 1..20: note = CRISPR gRNA sequence
  source 1..20: mol_type = other DNA
tagaaagtgctcaagatctc

SEQ ID NO: 82741 - DNA, 20 bp, synthetic construct
  misc_feature 1..20: note = CRISPR gRNA sequence
  source 1..20: mol_type = other DNA
aagatctctggcgtcctcaa

SEQ ID NO: 82742 - DNA, 20 bp, synthetic construct
  misc_feature 1..20: note = CRISPR gRNA sequence
  source 1..20: mol_type = other DNA
tctggcgtcctcaacagtct

SEQ ID NO: 82743 - DNA, 20 bp, synthetic construct
  misc_feature 1..20: note = CRISPR gRNA sequence
  source 1..20: mol_type = other DNA
aacagtcttggtaaccatct

SEQ ID NO: 82744 - DNA, 20 bp, synthetic construct
  misc_feature 1..20: note = CRISPR gRNA sequence
  source 1..20: mol_type = other DNA
tcttggattatctttattaa

SEQ ID NO: 82745 - DNA, 20 bp, synthetic construct
  misc_feature 1..20: note = CRISPR gRNA sequence
  source 1..20: mol_type = other DNA
tatctttattaatggtttta

SEQ ID NO: 82746 - DNA, 20 bp, synthetic construct
  misc_feature 1..20: note = CRISPR gRNA sequence
  source 1..20: mol_type = other DNA
tttttttttttttctttttt

SEQ ID NO: 82747 - DNA, 20 bp, synthetic construct
  misc_feature 1..20: note = CRISPR gRNA sequence
  source 1..20: mol_type = other DNA
tttttttttttcttttttga

SEQ ID NO: 82748 - DNA, 20 bp, synthetic construct
  misc_feature 1..20: note = CRISPR gRNA sequence
  source 1..20: mol_type = other DNA
tttttttcttttttgagaga

SEQ ID NO: 82749 - DNA, 20 bp, synthetic construct
  misc_feature 1..20: note = CRISPR gRNA sequence
  source 1..20: mol_type = other DNA
ttttttcttttttgagagac

SEQ ID NO: 82750 - DNA, 20 bp, synthetic construct
  misc_feature 1..20: note = CRISPR gRNA sequence
  source 1..20: mol_type = other DNA
tttttcttttttgagagaca

SEQ ID NO: 82751 - DNA, 20 bp, synthetic construct
  misc_feature 1..20: note = CRISPR gRNA sequence
  source 1..20: mol_type = other DNA
tctcgctctgttgcccacgc

SEQ ID NO: 82752 - DNA, 20 bp, synthetic construct
  misc_feature 1..20: note = CRISPR gRNA sequence
  source 1..20: mol_type = other DNA
tcgctctgttgcccacgctg

SEQ ID NO: 82753 - DNA, 20 bp, synthetic construct
  misc_feature 1..20: note = CRISPR gRNA sequence
  source 1..20: mol_type = other DNA
ttgcccacgctggagtgcac

SEQ ID NO: 82754 - DNA, 20 bp, synthetic construct
  misc_feature 1..20: note = CRISPR gRNA sequence
  source 1..20: mol_type = other DNA
ggagtgcactggcgccatga

SEQ ID NO: 82755 - DNA, 20 bp, synthetic construct
  misc_feature 1..20: note = CRISPR gRNA sequence
  source 1..20: mol_type = other DNA
ctggcgccatgatagctcaa

SEQ ID NO: 82756 - DNA, 20 bp, synthetic construct
  misc_feature 1..20: note = CRISPR gRNA sequence
  source 1..20: mol_type = other DNA
ccatgatagctcaaaagcct

SEQ ID NO: 82757 - DNA, 20 bp, synthetic construct
  misc_feature 1..20: note = CRISPR gRNA sequence
  source 1..20: mol_type = other DNA
tagctcaaaagcctaagctc

SEQ ID NO: 82758 - DNA, 20 bp, synthetic construct
  misc_feature 1..20: note = CRISPR gRNA sequence
  source 1..20: mol_type = other DNA
gctcaaaagcctaagctcaa

SEQ ID NO: 82759 - DNA, 20 bp, synthetic construct
  misc_feature 1..20: note = CRISPR gRNA sequence
  source 1..20: mol_type = other DNA
ctcaagagatcctcccgcct

SEQ ID NO: 82760 - DNA, 20 bp, synthetic construct
  misc_feature 1..20: note = CRISPR gRNA sequence
  source 1..20: mol_type = other DNA
gatcctcccgcctcagccac

SEQ ID NO: 82761 - DNA, 20 bp, synthetic construct
  misc_feature 1..20: note = CRISPR gRNA sequence
  source 1..20: mol_type = other DNA
tcctcccgcctcagccaccg

SEQ ID NO: 82762 - DNA, 20 bp, synthetic construct
  misc_feature 1..20: note = CRISPR gRNA sequence
  source 1..20: mol_type = other DNA
tcccgcctcagccaccggag

SEQ ID NO: 82763 - DNA, 20 bp, synthetic construct
  misc_feature 1..20: note = CRISPR gRNA sequence
  source 1..20: mol_type = other DNA
gcctcagccaccggagcagc

SEQ ID NO: 82764 - DNA, 20 bp, synthetic construct
  misc_feature 1..20: note = CRISPR gRNA sequence
  source 1..20: mol_type = other DNA
cctcagccaccggagcagct

SEQ ID NO: 82765 - DNA, 20 bp, synthetic construct
  misc_feature 1..20: note = CRISPR gRNA sequence
  source 1..20: mol_type = other DNA
caccggagcagctgggacca

SEQ ID NO: 82766 - DNA, 20 bp, synthetic construct
  misc_feature 1..20: note = CRISPR gRNA sequence
  source 1..20: mol_type = other DNA
accggagcagctgggaccac

SEQ ID NO: 82767 - DNA, 20 bp, synthetic construct
  misc_feature 1..20: note = CRISPR gRNA sequence
  source 1..20: mol_type = other DNA
gcagctgggaccacaggcac

SEQ ID NO: 82768 - DNA, 20 bp, synthetic construct
  misc_feature 1..20: note = CRISPR gRNA sequence
  source 1..20: mol_type = other DNA
caggcacgagccaccacacc

SEQ ID NO: 82769 - DNA, 20 bp, synthetic construct
  misc_feature 1..20: note = CRISPR gRNA sequence
  source 1..20: mol_type = other DNA
atttttgttattattttttg

SEQ ID NO: 82770 - DNA, 20 bp, synthetic construct
  misc_feature 1..20: note = CRISPR gRNA sequence
  source 1..20: mol_type = other DNA
ttttgttattattttttgta

SEQ ID NO: 82771 - DNA, 20 bp, synthetic construct
  misc_feature 1..20: note = CRISPR gRNA sequence
  source 1..20: mol_type = other DNA
ttattattttttgtagagac

SEQ ID NO: 82772 - DNA, 20 bp, synthetic construct
  misc_feature 1..20: note = CRISPR gRNA sequence
  source 1..20: mol_type = other DNA
tattattttttgtagagacc

SEQ ID NO: 82773 - DNA, 20 bp, synthetic construct
  misc_feature 1..20: note = CRISPR gRNA sequence
  source 1..20: mol_type = other DNA
gagaccaggcttcaccatgt

SEQ ID NO: 82774 - DNA, 20 bp, synthetic construct
  misc_feature 1..20: note = CRISPR gRNA sequence
  source 1..20: mol_type = other DNA
ccaggcttcaccatgttggc

SEQ ID NO: 82775 - DNA, 20 bp, synthetic construct
  misc_feature 1..20: note = CRISPR gRNA sequence
  source 1..20: mol_type = other DNA
caggcttcaccatgttggcc

SEQ ID NO: 82776 - DNA, 20 bp, synthetic construct
  misc_feature 1..20: note = CRISPR gRNA sequence
  source 1..20: mol_type = other DNA
cttcaccatgttggccaggc

SEQ ID NO: 82777 - DNA, 20 bp, synthetic construct
  misc_feature 1..20: note = CRISPR gRNA sequence
  source 1..20: mol_type = other DNA
ggccaggctggtctcaacta

SEQ ID NO: 82778 - DNA, 20 bp, synthetic construct
  misc_feature 1..20: note = CRISPR gRNA sequence
  source 1..20: mol_type = other DNA
tggtctcaactacggacctc

SEQ ID NO: 82779 - DNA, 20 bp, synthetic construct
  misc_feature 1..20: note = CRISPR gRNA sequence
  source 1..20: mol_type = other DNA
ctcaagccatcctcccgcct

SEQ ID NO: 82780 - DNA, 20 bp, synthetic construct
  misc_feature 1..20: note = CRISPR gRNA sequence
  source 1..20: mol_type = other DNA
cctcccgcctcggcctccct

SEQ ID NO: 82781 - DNA, 20 bp, synthetic construct
  misc_feature 1..20: note = CRISPR gRNA sequence
  source 1..20: mol_type = other DNA
gcctcggcctccctaagtgc

SEQ ID NO: 82782 - DNA, 20 bp, synthetic construct
  misc_feature 1..20: note = CRISPR gRNA sequence
  source 1..20: mol_type = other DNA
cctcggcctccctaagtgct

SEQ ID NO: 82783 - DNA, 20 bp, synthetic construct
  misc_feature 1..20: note = CRISPR gRNA sequence
  source 1..20: mol_type = other DNA
ctccctaagtgctgggatta

SEQ ID NO: 82784 - DNA, 20 bp, synthetic construct
  misc_feature 1..20: note = CRISPR gRNA sequence
  source 1..20: mol_type = other DNA
tccctaagtgctgggattac

SEQ ID NO: 82785 - DNA, 20 bp, synthetic construct
  misc_feature 1..20: note = CRISPR gRNA sequence
  source 1..20: mol_type = other DNA
agtgctgggattacaggcgt

SEQ ID NO: 82786 - DNA, 20 bp, synthetic construct
  misc_feature 1..20: note = CRISPR gRNA sequence
  source 1..20: mol_type = other DNA
cctcatgttttcaaaaccga

SEQ ID NO: 82787 - DNA, 20 bp, synthetic construct
  misc_feature 1..20: note = CRISPR gRNA sequence
  source 1..20: mol_type = other DNA
atgttttcaaaaccgaaagt

SEQ ID NO: 82788 - DNA, 20 bp, synthetic construct
  misc_feature 1..20: note = CRISPR gRNA sequence
  source 1..20: mol_type = other DNA
gttttcaaaaccgaaagtaa

SEQ ID NO: 82789 - DNA, 20 bp, synthetic construct
  misc_feature 1..20: note = CRISPR gRNA sequence
  source 1..20: mol_type = other DNA
ttttcaaaaccgaaagtaag

SEQ ID NO: 82790 - DNA, 20 bp, synthetic construct
  misc_feature 1..20: note = CRISPR gRNA sequence
  source 1..20: mol_type = other DNA
aaaaccgaaagtaagaggca

SEQ ID NO: 82791 - DNA, 20 bp, synthetic construct
  misc_feature 1..20: note = CRISPR gRNA sequence
  source 1..20: mol_type = other DNA
gtaagaggcacagtacatct

SEQ ID NO: 82792 - DNA, 20 bp, synthetic construct
  misc_feature 1..20: note = CRISPR gRNA sequence
  source 1..20: mol_type = other DNA
cagtacatcttggaaacaac

SEQ ID NO: 82793 - DNA, 20 bp, synthetic construct
  misc_feature 1..20: note = CRISPR gRNA sequence
  source 1..20: mol_type = other DNA
agtacatcttggaaacaacc

SEQ ID NO: 82794 - DNA, 20 bp, synthetic construct
  misc_feature 1..20: note = CRISPR gRNA sequence
  source 1..20: mol_type = other DNA
atcttggaaacaaccaggca

SEQ ID NO: 82795 - DNA, 20 bp, synthetic construct
  misc_feature 1..20: note = CRISPR gRNA sequence
  source 1..20: mol_type = other DNA
cttggaaacaaccaggcaaa

SEQ ID NO: 82796 - DNA, 20 bp, synthetic construct
  misc_feature 1..20: note = CRISPR gRNA sequence
  source 1..20: mol_type = other DNA
aacaaccaggcaaagagcca

SEQ ID NO: 82797 - DNA, 20 bp, synthetic construct
  misc_feature 1..20: note = CRISPR gRNA sequence
  source 1..20: mol_type = other DNA
caaccaggcaaagagccaaa

SEQ ID NO: 82798 - DNA, 20 bp, synthetic construct
  misc_feature 1..20: note = CRISPR gRNA sequence
  source 1..20: mol_type = other DNA
aaccaggcaaagagccaaag

SEQ ID NO: 82799 - DNA, 20 bp, synthetic construct
  misc_feature 1..20: note = CRISPR gRNA sequence
  source 1..20: mol_type = other DNA
caggcaaagagccaaagagg

SEQ ID NO: 82800 - DNA, 20 bp, synthetic construct
  misc_feature 1..20: note = CRISPR gRNA sequence
  source 1..20: mol_type = other DNA
gaggaagccctctgtacgaa

SEQ ID NO: 82801 - DNA, 20 bp, synthetic construct
  misc_feature 1..20: note = CRISPR gRNA sequence
  source 1..20: mol_type = other DNA
ccctctgtacgaaaagacca

SEQ ID NO: 82802 - DNA, 20 bp, synthetic construct
  misc_feature 1..20: note = CRISPR gRNA sequence
  source 1..20: mol_type = other DNA
cctctgtacgaaaagaccac

SEQ ID NO: 82803 - DNA, 20 bp, synthetic construct
  misc_feature 1..20: note = CRISPR gRNA sequence
  source 1..20: mol_type = other DNA
ctctgtacgaaaagaccaca

SEQ ID NO: 82804 - DNA, 20 bp, synthetic construct
  misc_feature 1..20: note = CRISPR gRNA sequence
  source 1..20: mol_type = other DNA
accacagggcccatgccgcc

SEQ ID NO: 82805 - DNA, 20 bp, synthetic construct
  misc_feature 1..20: note = CRISPR gRNA sequence
  source 1..20: mol_type = other DNA
ccatgccgcccagtttgctc

SEQ ID NO: 82806 - DNA, 20 bp, synthetic construct
  misc_feature 1..20: note = CRISPR gRNA sequence
  source 1..20: mol_type = other DNA
atgccgcccagtttgctctg

SEQ ID NO: 82807 - DNA, 20 bp, synthetic construct
  misc_feature 1..20: note = CRISPR gRNA sequence
  source 1..20: mol_type = other DNA
ttgctctggagaatctcacg

SEQ ID NO: 82808 - DNA, 20 bp, synthetic construct
  misc_feature 1..20: note = CRISPR gRNA sequence
  source 1..20: mol_type = other DNA
ctctggagaatctcacgcag

SEQ ID NO: 82809 - DNA, 20 bp, synthetic construct
  misc_feature 1..20: note = CRISPR gRNA sequence
  source 1..20: mol_type = other DNA
tctggagaatctcacgcaga

SEQ ID NO: 82810 - DNA, 20 bp, synthetic construct
  misc_feature 1..20: note = CRISPR gRNA sequence
  source 1..20: mol_type = other DNA
ggagaatctcacgcagaagg

SEQ ID NO: 82811 - DNA, 20 bp, synthetic construct
  misc_feature 1..20: note = CRISPR gRNA sequence
  source 1..20: mol_type = other DNA
gagaatctcacgcagaaggc

SEQ ID NO: 82812 - DNA, 20 bp, synthetic construct
  misc_feature 1..20: note = CRISPR gRNA sequence
  source 1..20: mol_type = other DNA
aaaaaaaaatgcacgaatta

SEQ ID NO: 82813 - DNA, 20 bp, synthetic construct
  misc_feature 1..20: note = CRISPR gRNA sequence
  source 1..20: mol_type = other DNA
aatgcacgaattacagccaa

SEQ ID NO: 82814 - DNA, 20 bp, synthetic construct
  misc_feature 1..20: note = CRISPR gRNA sequence
  source 1..20: mol_type = other DNA
atgcacgaattacagccaaa

SEQ ID NO: 82815 - DNA, 20 bp, synthetic construct
  misc_feature 1..20: note = CRISPR gRNA sequence
  source 1..20: mol_type = other DNA
aaaggcatgcgctcccgcaa

SEQ ID NO: 82816 - DNA, 20 bp, synthetic construct
  misc_feature 1..20: note = CRISPR gRNA sequence
  source 1..20: mol_type = other DNA
atgcgctcccgcaaaagccc

SEQ ID NO: 82817 - DNA, 20 bp, synthetic construct
  misc_feature 1..20: note = CRISPR gRNA sequence
  source 1..20: mol_type = other DNA
gctcccgcaaaagccctggt

SEQ ID NO: 82818 - DNA, 20 bp, synthetic construct
  misc_feature 1..20: note = CRISPR gRNA sequence
  source 1..20: mol_type = other DNA
ctcccgcaaaagccctggtt

SEQ ID NO: 82819 - DNA, 20 bp, synthetic construct
  misc_feature 1..20: note = CRISPR gRNA sequence
  source 1..20: mol_type = other DNA
catttatcccctgtgtaatt

SEQ ID NO: 82820 - DNA, 20 bp, synthetic construct
  misc_feature 1..20: note = CRISPR gRNA sequence
  source 1..20: mol_type = other DNA
aattaagtttcttaaaatct

SEQ ID NO: 82821 - DNA, 20 bp, synthetic construct
  misc_feature 1..20: note = CRISPR gRNA sequence
  source 1..20: mol_type = other DNA
ttcttaaaatctcggtgcct

SEQ ID NO: 82822 - DNA, 20 bp, synthetic construct
  misc_feature 1..20: note = CRISPR gRNA sequence
  source 1..20: mol_type = other DNA
gccttagtttcttcatctgt

SEQ ID NO: 82823 - DNA, 20 bp, synthetic construct
  misc_feature 1..20: note = CRISPR gRNA sequence
  source 1..20: mol_type = other DNA
cttagtttcttcatctgtga

SEQ ID NO: 82824 - DNA, 20 bp, synthetic construct
  misc_feature 1..20: note = CRISPR gRNA sequence
  source 1..20: mol_type = other DNA
ttagtttcttcatctgtgag

SEQ ID NO: 82825 - DNA, 20 bp, synthetic construct
  misc_feature 1..20: note = CRISPR gRNA sequence
  source 1..20: mol_type = other DNA
gtttcttcatctgtgagagg

SEQ ID NO: 82826 - DNA, 20 bp, synthetic construct
  misc_feature 1..20: note = CRISPR gRNA sequence
  source 1..20: mol_type = other DNA
tcttcatctgtgagaggcag

SEQ ID NO: 82827 - DNA, 20 bp, synthetic construct
  misc_feature 1..20: note = CRISPR gRNA sequence
  source 1..20: mol_type = other DNA
tgagaggcagaagataacca

SEQ ID NO: 82828 - DNA, 20 bp, synthetic construct
  misc_feature 1..20: note = CRISPR gRNA sequence
  source 1..20: mol_type = other DNA
gaggcagaagataaccatag

SEQ ID NO: 82829 - DNA, 20 bp, synthetic construct
  misc_feature 1..20: note = CRISPR gRNA sequence
  source 1..20: mol_type = other DNA
ataaccatagtagttatcta

SEQ ID NO: 82830 - DNA, 20 bp, synthetic construct
  misc_feature 1..20: note = CRISPR gRNA sequence
  source 1..20: mol_type = other DNA
accatagtagttatctatgg

SEQ ID NO: 82831 - DNA, 20 bp, synthetic construct
  misc_feature 1..20: note = CRISPR gRNA sequence
  source 1..20: mol_type = other DNA
atagtagttatctatggcgg

SEQ ID NO: 82832 - DNA, 20 bp, synthetic construct
  misc_feature 1..20: note = CRISPR gRNA sequence
  source 1..20: mol_type = other DNA
tttcaaaattaaatgacgca

SEQ ID NO: 82833 - DNA, 20 bp, synthetic construct
  misc_feature 1..20: note = CRISPR gRNA sequence
  source 1..20: mol_type = other DNA
taaatgacgcaaagcacata

SEQ ID NO: 82834 - DNA, 20 bp, synthetic construct
  misc_feature 1..20: note = CRISPR gRNA sequence
  source 1..20: mol_type = other DNA
cgcaaagcacataaagtcct

SEQ ID NO: 82835 - DNA, 20 bp, synthetic construct
  misc_feature 1..20: note = CRISPR gRNA sequence
  source 1..20: mol_type = other DNA
cacataaagtccttggcaca

SEQ ID NO: 82836 - DNA, 20 bp, synthetic construct
  misc_feature 1..20: note = CRISPR gRNA sequence
  source 1..20: mol_type = other DNA
taaagtccttggcacacaga

SEQ ID NO: 82837 - DNA, 20 bp, synthetic construct
  misc_feature 1..20: note = CRISPR gRNA sequence
  source 1..20: mol_type = other DNA
acacagaaagatgtcaataa

SEQ ID NO: 82838 - DNA, 20 bp, synthetic construct
  misc_feature 1..20: note = CRISPR gRNA sequence
  source 1..20: mol_type = other DNA
cacagaaagatgtcaataac

SEQ ID NO: 82839 - DNA, 20 bp, synthetic construct
  misc_feature 1..20: note = CRISPR gRNA sequence
  source 1..20: mol_type = other DNA
agaaagatgtcaataacggg

SEQ ID NO: 82840 - DNA, 20 bp, synthetic construct
  misc_feature 1..20: note = CRISPR gRNA sequence
  source 1..20: mol_type = other DNA
tagttcttataattttttaa

SEQ ID NO: 82841 - DNA, 20 bp, synthetic construct
  misc_feature 1..20: note = CRISPR gRNA sequence
  source 1..20: mol_type = other DNA
tttttaaaagtgacatgtga

SEQ ID NO: 82842 - DNA, 20 bp, synthetic construct
  misc_feature 1..20: note = CRISPR gRNA sequence
  source 1..20: mol_type = other DNA
ttttaaaagtgacatgtgat

SEQ ID NO: 82843 - DNA, 20 bp, synthetic construct
  misc_feature 1..20: note = CRISPR gRNA sequence
  source 1..20: mol_type = other DNA
gacatgtgatgggaacaaat

SEQ ID NO: 82844 - DNA, 20 bp, synthetic construct
  misc_feature 1..20: note = CRISPR gRNA sequence
  source 1..20: mol_type = other DNA
ttcgaaaccgctttgtatca

SEQ ID NO: 82845 - DNA, 20 bp, synthetic construct
  misc_feature 1..20: note = CRISPR gRNA sequence
  source 1..20: mol_type = other DNA
aaccgctttgtatcacagcc

SEQ ID NO: 82846 - DNA, 20 bp, synthetic construct
  misc_feature 1..20: note = CRISPR gRNA sequence
  source 1..20: mol_type = other DNA
cgcgtgctgtttcctcccca

SEQ ID NO: 82847 - DNA, 20 bp, synthetic construct
  misc_feature 1..20: note = CRISPR gRNA sequence
  source 1..20: mol_type = other DNA
gctgtttcctccccacggtg

SEQ ID NO: 82848 - DNA, 20 bp, synthetic construct
  misc_feature 1..20: note = CRISPR gRNA sequence
  source 1..20: mol_type = other DNA
ccccacggtgtggccccaca

SEQ ID NO: 82849 - DNA, 20 bp, synthetic construct
  misc_feature 1..20: note = CRISPR gRNA sequence
  source 1..20: mol_type = other DNA
ggtgtggccccacatagacc

SEQ ID NO: 82850 - DNA, 20 bp, synthetic construct
  misc_feature 1..20: note = CRISPR gRNA sequence
  source 1..20: mol_type = other DNA
tgtggccccacatagaccca

SEQ ID NO: 82851 - DNA, 20 bp, synthetic construct
  misc_feature 1..20: note = CRISPR gRNA sequence
  source 1..20: mol_type = other DNA
gtggccccacatagacccag

SEQ ID NO: 82852 - DNA, 20 bp, synthetic construct
  misc_feature 1..20: note = CRISPR gRNA sequence
  source 1..20: mol_type = other DNA
ccacatagacccagaggtgc

SEQ ID NO: 82853 - DNA, 20 bp, synthetic construct
  misc_feature 1..20: note = CRISPR gRNA sequence
  source 1..20: mol_type = other DNA
cacatagacccagaggtgct

SEQ ID NO: 82854 - DNA, 20 bp, synthetic construct
  misc_feature 1..20: note = CRISPR gRNA sequence
  source 1..20: mol_type = other DNA
ggtgctaggacatgcgaact

SEQ ID NO: 82855 - DNA, 20 bp, synthetic construct
  misc_feature 1..20: note = CRISPR gRNA sequence
  source 1..20: mol_type = other DNA
gctaggacatgcgaacttag

SEQ ID NO: 82856 - DNA, 20 bp, synthetic construct
  misc_feature 1..20: note = CRISPR gRNA sequence
  source 1..20: mol_type = other DNA
ctaggacatgcgaacttagc

SEQ ID NO: 82857 - DNA, 20 bp, synthetic construct
  misc_feature 1..20: note = CRISPR gRNA sequence
  source 1..20: mol_type = other DNA
atgcgaacttagcgggcgcc

SEQ ID NO: 82858 - DNA, 20 bp, synthetic construct
  misc_feature 1..20: note = CRISPR gRNA sequence
  source 1..20: mol_type = other DNA
acttagcgggcgcctagacg

SEQ ID NO: 82859 - DNA, 20 bp, synthetic construct
  misc_feature 1..20: note = CRISPR gRNA sequence
  source 1..20: mol_type = other DNA
gggcgcctagacgaagtcca

SEQ ID NO: 82860 - DNA, 20 bp, synthetic construct
  misc_feature 1..20: note = CRISPR gRNA sequence
  source 1..20: mol_type = other DNA
agacgaagtccacagctctc

SEQ ID NO: 82861 - DNA, 20 bp, synthetic construct
  misc_feature 1..20: note = CRISPR gRNA sequence
  source 1..20: mol_type = other DNA
agtccacagctctccagtct

SEQ ID NO: 82862 - DNA, 20 bp, synthetic construct
  misc_feature 1..20: note = CRISPR gRNA sequence
  source 1..20: mol_type = other DNA
gtccacagctctccagtcta

SEQ ID NO: 82863 - DNA, 20 bp, synthetic construct
  misc_feature 1..20: note = CRISPR gRNA sequence
  source 1..20: mol_type = other DNA
tccacagctctccagtctaa

SEQ ID NO: 82864 - DNA, 20 bp, synthetic construct
  misc_feature 1..20: note = CRISPR gRNA sequence
  source 1..20: mol_type = other DNA
acagctctccagtctaaggg

SEQ ID NO: 82865 - DNA, 20 bp, synthetic construct
  misc_feature 1..20: note = CRISPR gRNA sequence
  source 1..20: mol_type = other DNA
gctctccagtctaagggaag

SEQ ID NO: 82866 - DNA, 20 bp, synthetic construct
  misc_feature 1..20: note = CRISPR gRNA sequence
  source 1..20: mol_type = other DNA
tctccagtctaagggaagca

SEQ ID NO: 82867 - DNA, 20 bp, synthetic construct
  misc_feature 1..20: note = CRISPR gRNA sequence
  source 1..20: mol_type = other DNA
gtctaagggaagcagagccg

SEQ ID NO: 82868 - DNA, 20 bp, synthetic construct
  misc_feature 1..20: note = CRISPR gRNA sequence
  source 1..20: mol_type = other DNA
taagggaagcagagccgcag

SEQ ID NO: 82869 - DNA, 20 bp, synthetic construct
  misc_feature 1..20: note = CRISPR gRNA sequence
  source 1..20: mol_type = other DNA
ggaagcagagccgcagcaga

SEQ ID NO: 82870 - DNA, 20 bp, synthetic construct
  misc_feature 1..20: note = CRISPR gRNA sequence
  source 1..20: mol_type = other DNA
gaagcagagccgcagcagac

SEQ ID NO: 82871 - DNA, 20 bp, synthetic construct
  misc_feature 1..20: note = CRISPR gRNA sequence
  source 1..20: mol_type = other DNA
ccgcagcagacaggcttacc

SEQ ID NO: 82872 - DNA, 20 bp, synthetic construct
  misc_feature 1..20: note = CRISPR gRNA sequence
  source 1..20: mol_type = other DNA
cgcagcagacaggcttaccc

SEQ ID NO: 82873 - DNA, 20 bp, synthetic construct
  misc_feature 1..20: note = CRISPR gRNA sequence
  source 1..20: mol_type = other DNA
tacccgggcgacgcctcccc

SEQ ID NO: 82874 - DNA, 20 bp, synthetic construct
  misc_feature 1..20: note = CRISPR gRNA sequence
  source 1..20: mol_type = other DNA
cgacgcctcccccagacccc

SEQ ID NO: 82875 - DNA, 20 bp, synthetic construct
  misc_feature 1..20: note = CRISPR gRNA sequence
  source 1..20: mol_type = other DNA
ctccacgcgttcacaaacct

SEQ ID NO: 82876 - DNA, 20 bp, synthetic construct
  misc_feature 1..20: note = CRISPR gRNA sequence
  source 1..20: mol_type = other DNA
aaacctcagcgccgcgcctt

SEQ ID NO: 82877 - DNA, 20 bp, synthetic construct
  misc_feature 1..20: note = CRISPR gRNA sequence
  source 1..20: mol_type = other DNA
aacctcagcgccgcgccttt

SEQ ID NO: 82878 - DNA, 20 bp, synthetic construct
  misc_feature 1..20: note = CRISPR gRNA sequence
  source 1..20: mol_type = other DNA
cagcgccgcgcctttgggac

SEQ ID NO: 82879 - DNA, 20 bp, synthetic construct
  misc_feature 1..20: note = CRISPR gRNA sequence
  source 1..20: mol_type = other DNA
agcctacccgtcccccactc

SEQ ID NO: 82880 - DNA, 20 bp, synthetic construct
  misc_feature 1..20: note = CRISPR gRNA sequence
  source 1..20: mol_type = other DNA
gtcccccactccagctgcgc

SEQ ID NO: 82881 - DNA, 20 bp, synthetic construct
  misc_feature 1..20: note = CRISPR gRNA sequence
  source 1..20: mol_type = other DNA
tcccccactccagctgcgct

SEQ ID NO: 82882 - DNA, 20 bp, synthetic construct
  misc_feature 1..20: note = CRISPR gRNA sequence
  source 1..20: mol_type = other DNA
cccccactccagctgcgctg

SEQ ID NO: 82883 - DNA, 20 bp, synthetic construct
  misc_feature 1..20: note = CRISPR gRNA sequence
  source 1..20: mol_type = other DNA
ccccactccagctgcgctgg

SEQ ID NO: 82884 - DNA, 20 bp, synthetic construct
  misc_feature 1..20: note = CRISPR gRNA sequence
  source 1..20: mol_type = other DNA
ccactccagctgcgctgggg

SEQ ID NO: 82885 - DNA, 20 bp, synthetic construct
  misc_feature 1..20: note = CRISPR gRNA sequence
  source 1..20: mol_type = other DNA
tccagctgcgctgggggagc

SEQ ID NO: 82886 - DNA, 20 bp, synthetic construct
  misc_feature 1..20: note = CRISPR gRNA sequence
  source 1..20: mol_type = other DNA
cagctgcgctgggggagcca

SEQ ID NO: 82887 - DNA, 20 bp, synthetic construct
  misc_feature 1..20: note = CRISPR gRNA sequence
  source 1..20: mol_type = other DNA
agctgcgctgggggagccag

SEQ ID NO: 82888 - DNA, 20 bp, synthetic construct
  misc_feature 1..20: note = CRISPR gRNA sequence
  source 1..20: mol_type = other DNA
gggagccagaggccccgcga

SEQ ID NO: 82889 - DNA, 20 bp, synthetic construct
  misc_feature 1..20: note = CRISPR gRNA sequence
  source 1..20: mol_type = other DNA
gagccagaggccccgcgaaa

SEQ ID NO: 82890 - DNA, 20 bp, synthetic construct
  misc_feature 1..20: note = CRISPR gRNA sequence
  source 1..20: mol_type = other DNA
ccagaggccccgcgaaagag

SEQ ID NO: 82891 - DNA, 20 bp, synthetic construct
  misc_feature 1..20: note = CRISPR gRNA sequence
  source 1..20: mol_type = other DNA
gaggccccgcgaaagagcgg

SEQ ID NO: 82892 - DNA, 20 bp, synthetic construct
  misc_feature 1..20: note = CRISPR gRNA sequence
  source 1..20: mol_type = other DNA
ggccccgcgaaagagcggaa

SEQ ID NO: 82893 - DNA, 20 bp, synthetic construct
  misc_feature 1..20: note = CRISPR gRNA sequence
  source 1..20: mol_type = other DNA
gagaaaccctcccccaacct

SEQ ID NO: 82894 - DNA, 20 bp, synthetic construct
  misc_feature 1..20: note = CRISPR gRNA sequence
  source 1..20: mol_type = other DNA
tcccgaccctcccgtcgccg

SEQ ID NO: 82895 - DNA, 20 bp, synthetic construct
  misc_feature 1..20: note = CRISPR gRNA sequence
  source 1..20: mol_type = other DNA
cccgaccctcccgtcgccgt

SEQ ID NO: 82896 - DNA, 20 bp, synthetic construct
  misc_feature 1..20: note = CRISPR gRNA sequence
  source 1..20: mol_type = other DNA
cctcccgtcgccgtaggcca

SEQ ID NO: 82897 - DNA, 20 bp, synthetic construct
  misc_feature 1..20: note = CRISPR gRNA sequence
  source 1..20: mol_type = other DNA
ctcccgtcgccgtaggccaa

SEQ ID NO: 82898 - DNA, 20 bp, synthetic construct
  misc_feature 1..20: note = CRISPR gRNA sequence
  source 1..20: mol_type = other DNA
tctcccctgctccccgccga

SEQ ID NO: 82899 - DNA, 20 bp, synthetic construct
  misc_feature 1..20: note = CRISPR gRNA sequence
  source 1..20: mol_type = other DNA
ctcccctgctccccgccgaa

SEQ ID NO: 82900 - DNA, 20 bp, synthetic construct
  misc_feature 1..20: note = CRISPR gRNA sequence
  source 1..20: mol_type = other DNA
tcccctgctccccgccgaaa

SEQ ID NO: 82901 - DNA, 20 bp, synthetic construct
  misc_feature 1..20: note = CRISPR gRNA sequence
  source 1..20: mol_type = other DNA
cccctgctccccgccgaaag

SEQ ID NO: 82902 - DNA, 20 bp, synthetic construct
  misc_feature 1..20: note = CRISPR gRNA sequence
  source 1..20: mol_type = other DNA
tgctccccgccgaaaggggc

SEQ ID NO: 82903 - DNA, 20 bp, synthetic construct
  misc_feature 1..20: note = CRISPR gRNA sequence
  source 1..20: mol_type = other DNA
tccccgccgaaaggggcaag

SEQ ID NO: 82904 - DNA, 20 bp, synthetic construct
  misc_feature 1..20: note = CRISPR gRNA sequence
  source 1..20: mol_type = other DNA
ggggcaagtagcgcgcgtcc

SEQ ID NO: 82905 - DNA, 20 bp, synthetic construct
  misc_feature 1..20: note = CRISPR gRNA sequence
  source 1..20: mol_type = other DNA
gggcaagtagcgcgcgtccc

SEQ ID NO: 82906 - DNA, 20 bp, synthetic construct
  misc_feature 1..20: note = CRISPR gRNA sequence
  source 1..20: mol_type = other DNA
cgcacccccttccccactcc

SEQ ID NO: 82907 - DNA, 20 bp, synthetic construct
  misc_feature 1..20: note = CRISPR gRNA sequence
  source 1..20: mol_type = other DNA
gcacccccttccccactccc

SEQ ID NO: 82908 - DNA, 20 bp, synthetic construct
  misc_feature 1..20: note = CRISPR gRNA sequence
  source 1..20: mol_type = other DNA
ggccaccccgccgcttcccc

SEQ ID NO: 82909 - DNA, 20 bp, synthetic construct
  misc_feature 1..20: note = CRISPR gRNA sequence
  source 1..20: mol_type = other DNA
cccgccgcttccccgagatc

SEQ ID NO: 82910 - DNA, 20 bp, synthetic construct
  misc_feature 1..20: note = CRISPR gRNA sequence
  source 1..20: mol_type = other DNA
gcttccccgagatccagccc

SEQ ID NO: 82911 - DNA, 20 bp, synthetic construct
  misc_feature 1..20: note = CRISPR gRNA sequence
  source 1..20: mol_type = other DNA
cccgagatccagccctggac

SEQ ID NO: 82912 - DNA, 20 bp, synthetic construct
  misc_feature 1..20: note = CRISPR gRNA sequence
  source 1..20: mol_type = other DNA
ccagccctggactagcccca

SEQ ID NO: 82913 - DNA, 20 bp, synthetic construct
  misc_feature 1..20: note = CRISPR gRNA sequence
  source 1..20: mol_type = other DNA
gccctggactagccccacgg

SEQ ID NO: 82914 - DNA, 20 bp, synthetic construct
  misc_feature 1..20: note = CRISPR gRNA sequence
  source 1..20: mol_type = other DNA
ccctggactagccccacggc

SEQ ID NO: 82915 - DNA, 20 bp, synthetic construct
  misc_feature 1..20: note = CRISPR gRNA sequence
  source 1..20: mol_type = other DNA
tagccccacggcgggccacc

SEQ ID NO: 82916 - DNA, 20 bp, synthetic construct
  misc_feature 1..20: note = CRISPR gRNA sequence
  source 1..20: mol_type = other DNA
agccccacggcgggccacca

SEQ ID NO: 82917 - DNA, 20 bp, synthetic construct
  misc_feature 1..20: note = CRISPR gRNA sequence
  source 1..20: mol_type = other DNA
ccccacggcgggccaccaag

SEQ ID NO: 82918 - DNA, 20 bp, synthetic construct
  misc_feature 1..20: note = CRISPR gRNA sequence
  source 1..20: mol_type = other DNA
gcgggccaccaaggagaact

SEQ ID NO: 82919 - DNA, 20 bp, synthetic construct
  misc_feature 1..20: note = CRISPR gRNA sequence
  source 1..20: mol_type = other DNA
gggccaccaaggagaacttg

SEQ ID NO: 82920 - DNA, 20 bp, synthetic construct
  misc_feature 1..20: note = CRISPR gRNA sequence
  source 1..20: mol_type = other DNA
ccaccaaggagaacttggag

SEQ ID NO: 82921 - DNA, 20 bp, synthetic construct
  misc_feature 1..20: note = CRISPR gRNA sequence
  source 1..20: mol_type = other DNA
caccaaggagaacttggaga

SEQ ID NO: 82922 - DNA, 20 bp, synthetic construct
  misc_feature 1..20: note = CRISPR gRNA sequence
  source 1..20: mol_type = other DNA
accaaggagaacttggagaa

SEQ ID NO: 82923 - DNA, 20 bp, synthetic construct
  misc_feature 1..20: note = CRISPR gRNA sequence
  source 1..20: mol_type = other DNA
aaggagaacttggagaaggg

SEQ ID NO: 82924 - DNA, 20 bp, synthetic construct
  misc_feature 1..20: note = CRISPR gRNA sequence
  source 1..20: mol_type = other DNA
aacttggagaagggaagtca

SEQ ID NO: 82925 - DNA, 20 bp, synthetic construct
  misc_feature 1..20: note = CRISPR gRNA sequence
  source 1..20: mol_type = other DNA
cttggagaagggaagtcacg

SEQ ID NO: 82926 - DNA, 20 bp, synthetic construct
  misc_feature 1..20: note = CRISPR gRNA sequence
  source 1..20: mol_type = other DNA
gagaagggaagtcacggagc

SEQ ID NO: 82927 - DNA, 20 bp, synthetic construct
  misc_feature 1..20: note = CRISPR gRNA sequence
  source 1..20: mol_type = other DNA
gaagggaagtcacggagcga

SEQ ID NO: 82928 - DNA, 20 bp, synthetic construct
  misc_feature 1..20: note = CRISPR gRNA sequence
  source 1..20: mol_type = other DNA
agggaagtcacggagcgaga

SEQ ID NO: 82929 - DNA, 20 bp, synthetic construct
  misc_feature 1..20: note = CRISPR gRNA sequence
  source 1..20: mol_type = other DNA
agtcacggagcgagagagca

SEQ ID NO: 82930 - DNA, 20 bp, synthetic construct
  misc_feature 1..20: note = CRISPR gRNA sequence
  source 1..20: mol_type = other DNA
acggagcgagagagcacagc

SEQ ID NO: 82931 - DNA, 20 bp, synthetic construct
  misc_feature 1..20: note = CRISPR gRNA sequence
  source 1..20: mol_type = other DNA
cggagcgagagagcacagcg

SEQ ID NO: 82932 - DNA, 20 bp, synthetic construct
  misc_feature 1..20: note = CRISPR gRNA sequence
  source 1..20: mol_type = other DNA
ggagcgagagagcacagcga

SEQ ID NO: 82933 - DNA, 20 bp, synthetic construct
  misc_feature 1..20: note = CRISPR gRNA sequence
  source 1..20: mol_type = other DNA
agagagcacagcgagggcca

SEQ ID NO: 82934 - DNA, 20 bp, synthetic construct
  misc_feature 1..20: note = CRISPR gRNA sequence
  source 1..20: mol_type = other DNA
agagcacagcgagggccaca

SEQ ID NO: 82935 - DNA, 20 bp, synthetic construct
  misc_feature 1..20: note = CRISPR gRNA sequence
  source 1..20: mol_type = other DNA
gagcacagcgagggccacag

SEQ ID NO: 82936 - DNA, 20 bp, synthetic construct
  misc_feature 1..20: note = CRISPR gRNA sequence
  source 1..20: mol_type = other DNA
agcacagcgagggccacaga

SEQ ID NO: 82937 - DNA, 20 bp, synthetic construct
  misc_feature 1..20: note = CRISPR gRNA sequence
  source 1..20: mol_type = other DNA
agcgagggccacagagggtg

SEQ ID NO: 82938 - DNA, 20 bp, synthetic construct
  misc_feature 1..20: note = CRISPR gRNA sequence
  source 1..20: mol_type = other DNA
cgagggccacagagggtgca

SEQ ID NO: 82939 - DNA, 20 bp, synthetic construct
  misc_feature 1..20: note = CRISPR gRNA sequence
  source 1..20: mol_type = other DNA
gggccacagagggtgcagag

SEQ ID NO: 82940 - DNA, 20 bp, synthetic construct
  misc_feature 1..20: note = CRISPR gRNA sequence
  source 1..20: mol_type = other DNA
ggccacagagggtgcagagc

SEQ ID NO: 82941 - DNA, 20 bp, synthetic construct
  misc_feature 1..20: note = CRISPR gRNA sequence
  source 1..20: mol_type = other DNA
ccacagagggtgcagagcgg

SEQ ID NO: 82942 - DNA, 20 bp, synthetic construct
  misc_feature 1..20: note = CRISPR gRNA sequence
  source 1..20: mol_type = other DNA
acagagggtgcagagcggga

SEQ ID NO: 82943 - DNA, 20 bp, synthetic construct
  misc_feature 1..20: note = CRISPR gRNA sequence
  source 1..20: mol_type = other DNA
cagagggtgcagagcgggag

SEQ ID NO: 82944 - DNA, 20 bp, synthetic construct
  misc_feature 1..20: note = CRISPR gRNA sequence
  source 1..20: mol_type = other DNA
agggtgcagagcgggagagg

SEQ ID NO: 82945 - DNA, 20 bp, synthetic construct
  misc_feature 1..20: note = CRISPR gRNA sequence
  source 1..20: mol_type = other DNA
gggtgcagagcgggagagga

SEQ ID NO: 82946 - DNA, 20 bp, synthetic construct
  misc_feature 1..20: note = CRISPR gRNA sequence
  source 1..20: mol_type = other DNA
cagagcgggagaggaaggac

SEQ ID NO: 82947 - DNA, 20 bp, synthetic construct
  misc_feature 1..20: note = CRISPR gRNA sequence
  source 1..20: mol_type = other DNA
gagcgggagaggaaggacca

SEQ ID NO: 82948 - DNA, 20 bp, synthetic construct
  misc_feature 1..20: note = CRISPR gRNA sequence
  source 1..20: mol_type = other DNA
cgggagaggaaggaccagag

SEQ ID NO: 82949 - DNA, 20 bp, synthetic construct
  misc_feature 1..20: note = CRISPR gRNA sequence
  source 1..20: mol_type = other DNA
gggagaggaaggaccagagc

SEQ ID NO: 82950 - DNA, 20 bp, synthetic construct
  misc_feature 1..20: note = CRISPR gRNA sequence
  source 1..20: mol_type = other DNA
gagaggaaggaccagagcgg

SEQ ID NO: 82951 - DNA, 20 bp, synthetic construct
  misc_feature 1..20: note = CRISPR gRNA sequence
  source 1..20: mol_type = other DNA
agaggaaggaccagagcggg

SEQ ID NO: 82952 - DNA, 20 bp, synthetic construct
  misc_feature 1..20: note = CRISPR gRNA sequence
  source 1..20: mol_type = other DNA
gaggaaggaccagagcggga

SEQ ID NO: 82953 - DNA, 20 bp, synthetic construct
  misc_feature 1..20: note = CRISPR gRNA sequence
  source 1..20: mol_type = other DNA
gaaggaccagagcgggaggg

SEQ ID NO: 82954 - DNA, 20 bp, synthetic construct
  misc_feature 1..20: note = CRISPR gRNA sequence
  source 1..20: mol_type = other DNA
aaggaccagagcgggagggt

SEQ ID NO: 82955 - DNA, 20 bp, synthetic construct
  misc_feature 1..20: note = CRISPR gRNA sequence
  source 1..20: mol_type = other DNA
ggaccagagcgggagggtag

SEQ ID NO: 82956 - DNA, 20 bp, synthetic construct
  misc_feature 1..20: note = CRISPR gRNA sequence
  source 1..20: mol_type = other DNA
accagagcgggagggtagga

SEQ ID NO: 82957 - DNA, 20 bp, synthetic construct
  misc_feature 1..20: note = CRISPR gRNA sequence
  source 1..20: mol_type = other DNA
agggtaggagagactcacgc

SEQ ID NO: 82958 - DNA, 20 bp, synthetic construct
  misc_feature 1..20: note = CRISPR gRNA sequence
  source 1..20: mol_type = other DNA
taggagagactcacgctgga

SEQ ID NO: 82959 - DNA, 20 bp, synthetic construct
  misc_feature 1..20: note = CRISPR gRNA sequence
  source 1..20: mol_type = other DNA
gactcacgctggatagcctc

SEQ ID NO: 82960 - DNA, 20 bp, synthetic construct
  misc_feature 1..20: note = CRISPR gRNA sequence
  source 1..20: mol_type = other DNA
actcacgctggatagcctcc

SEQ ID NO: 82961 - DNA, 20 bp, synthetic construct
  misc_feature 1..20: note = CRISPR gRNA sequence
  source 1..20: mol_type = other DNA
acgctggatagcctccaggc

SEQ ID NO: 82962 - DNA, 20 bp, synthetic construct
  misc_feature 1..20: note = CRISPR gRNA sequence
  source 1..20: mol_type = other DNA
tggatagcctccaggccaga

SEQ ID NO: 82963 - DNA, 20 bp, synthetic construct
  misc_feature 1..20: note = CRISPR gRNA sequence
  source 1..20: mol_type = other DNA
gatagcctccaggccagaaa

SEQ ID NO: 82964 - DNA, 20 bp, synthetic construct
  misc_feature 1..20: note = CRISPR gRNA sequence
  source 1..20: mol_type = other DNA
tagcctccaggccagaaaga

SEQ ID NO: 82965 - DNA, 20 bp, synthetic construct
  misc_feature 1..20: note = CRISPR gRNA sequence
  source 1..20: mol_type = other DNA
gcctccaggccagaaagaga

SEQ ID NO: 82966 - DNA, 20 bp, synthetic construct
  misc_feature 1..20: note = CRISPR gRNA sequence
  source 1..20: mol_type = other DNA
tccaggccagaaagagagag

SEQ ID NO: 82967 - DNA, 20 bp, synthetic construct
  misc_feature 1..20: note = CRISPR gRNA sequence
  source 1..20: mol_type = other DNA
ccagaaagagagagtagcgc

SEQ ID NO: 82968 - DNA, 20 bp, synthetic construct
  misc_feature 1..20: note = CRISPR gRNA sequence
  source 1..20: mol_type = other DNA
aagagagagtagcgcgagca

SEQ ID NO: 82969 - DNA, 20 bp, synthetic construct
  misc_feature 1..20: note = CRISPR gRNA sequence
  source 1..20: mol_type = other DNA
agagtagcgcgagcacagct

SEQ ID NO: 82970 - DNA, 20 bp, synthetic construct
  misc_feature 1..20: note = CRISPR gRNA sequence
  source 1..20: mol_type = other DNA
gagtagcgcgagcacagcta

SEQ ID NO: 82971 - DNA, 20 bp, synthetic construct
  misc_feature 1..20: note = CRISPR gRNA sequence
  source 1..20: mol_type = other DNA
cgcgagcacagctaaggcca

SEQ ID NO: 82972 - DNA, 20 bp, synthetic construct
  misc_feature 1..20: note = CRISPR gRNA sequence
  source 1..20: mol_type = other DNA
cgagcacagctaaggccacg

SEQ ID NO: 82973 - DNA, 20 bp, synthetic construct
  misc_feature 1..20: note = CRISPR gRNA sequence
  source 1..20: mol_type = other DNA
cacagctaaggccacggagc

SEQ ID NO: 82974 - DNA, 20 bp, synthetic construct
  misc_feature 1..20: note = CRISPR gRNA sequence
  source 1..20: mol_type = other DNA
ggccacggagcgagacatct

SEQ ID NO: 82975 - DNA, 20 bp, synthetic construct
  misc_feature 1..20: note = CRISPR gRNA sequence
  source 1..20: mol_type = other DNA
catctcggcccgaatgctgt

SEQ ID NO: 82976 - DNA, 20 bp, synthetic construct
  misc_feature 1..20: note = CRISPR gRNA sequence
  source 1..20: mol_type = other DNA
ggcccgaatgctgtcagctt

SEQ ID NO: 82977 - DNA, 20 bp, synthetic construct
  misc_feature 1..20: note = CRISPR gRNA sequence
  source 1..20: mol_type = other DNA
gcccgaatgctgtcagcttc

SEQ ID NO: 82978 - DNA, 20 bp, synthetic construct
  misc_feature 1..20: note = CRISPR gRNA sequence
  source 1..20: mol_type = other DNA
tcagcttcaggaatgcccgc

SEQ ID NO: 82979 - DNA, 20 bp, synthetic construct
  misc_feature 1..20: note = CRISPR gRNA sequence
  source 1..20: mol_type = other DNA
acttatattaaacgcgtgcc

SEQ ID NO: 82980 - DNA, 20 bp, synthetic construct
  misc_feature 1..20: note = CRISPR gRNA sequence
  source 1..20: mol_type = other DNA
taaacgcgtgcccagccaat

SEQ ID NO: 82981 - DNA, 20 bp, synthetic construct
  misc_feature 1..20: note = CRISPR gRNA sequence
  source 1..20: mol_type = other DNA
aaacgcgtgcccagccaatc

SEQ ID NO: 82982 - DNA, 20 bp, synthetic construct
  misc_feature 1..20: note = CRISPR gRNA sequence
  source 1..20: mol_type = other DNA
cgtgcccagccaatcaggac

SEQ ID NO: 82983 - DNA, 20 bp, synthetic construct
  misc_feature 1..20: note = CRISPR gRNA sequence
  source 1..20: mol_type = other DNA
gtgcccagccaatcaggaca

SEQ ID NO: 82984 - DNA, 20 bp, synthetic construct
  misc_feature 1..20: note = CRISPR gRNA sequence
  source 1..20: mol_type = other DNA
gccaatcaggacaaggcccg

SEQ ID NO: 82985 - DNA, 20 bp, synthetic construct
  misc_feature 1..20: note = CRISPR gRNA sequence
  source 1..20: mol_type = other DNA
ccaatcaggacaaggcccgc

SEQ ID NO: 82986 - DNA, 20 bp, synthetic construct
  misc_feature 1..20: note = CRISPR gRNA sequence
  source 1..20: mol_type = other DNA
caatcaggacaaggcccgca

SEQ ID NO: 82987 - DNA, 20 bp, synthetic construct
  misc_feature 1..20: note = CRISPR gRNA sequence
  source 1..20: mol_type = other DNA
agggaccgtcacctgtctcc

SEQ ID NO: 82988 - DNA, 20 bp, synthetic construct
  misc_feature 1..20: note = CRISPR gRNA sequence
  source 1..20: mol_type = other DNA
accgtcacctgtctccaagc

SEQ ID NO: 82989 - DNA, 20 bp, synthetic construct
  misc_feature 1..20: note = CRISPR gRNA sequence
  source 1..20: mol_type = other DNA
ctgtctccaagccagcgacg

SEQ ID NO: 82990 - DNA, 20 bp, synthetic construct
  misc_feature 1..20: note = CRISPR gRNA sequence
  source 1..20: mol_type = other DNA
ccaagccagcgacgcagtgc

SEQ ID NO: 82991 - DNA, 20 bp, synthetic construct
  misc_feature 1..20: note = CRISPR gRNA sequence
  source 1..20: mol_type = other DNA
caagccagcgacgcagtgcc

SEQ ID NO: 82992 - DNA, 20 bp, synthetic construct
  misc_feature 1..20: note = CRISPR gRNA sequence
  source 1..20: mol_type = other DNA
ccagcgacgcagtgccaggt

SEQ ID NO: 82993 - DNA, 20 bp, synthetic construct
  misc_feature 1..20: note = CRISPR gRNA sequence
  source 1..20: mol_type = other DNA
agcgacgcagtgccaggtta

SEQ ID NO: 82994 - DNA, 20 bp, synthetic construct
  misc_feature 1..20: note = CRISPR gRNA sequence
  source 1..20: mol_type = other DNA
cgacgcagtgccaggttaga

SEQ ID NO: 82995 - DNA, 20 bp, synthetic construct
  misc_feature 1..20: note = CRISPR gRNA sequence
  source 1..20: mol_type = other DNA
acgcagtgccaggttagaga

SEQ ID NO: 82996 - DNA, 20 bp, synthetic construct
  misc_feature 1..20: note = CRISPR gRNA sequence
  source 1..20: mol_type = other DNA
cgcagtgccaggttagagag

SEQ ID NO: 82997 - DNA, 20 bp, synthetic construct
  misc_feature 1..20: note = CRISPR gRNA sequence
  source 1..20: mol_type = other DNA
gcagtgccaggttagagaga

SEQ ID NO: 82998 - DNA, 20 bp, synthetic construct
  misc_feature 1..20: note = CRISPR gRNA sequence
  source 1..20: mol_type = other DNA
tggcctggaggctatccagc

SEQ ID NO: 82999 - DNA, 20 bp, synthetic construct
  misc_feature 1..20: note = CRISPR gRNA sequence
  source 1..20: mol_type = other DNA
gccgtggggctagtccaggg

SEQ ID NO: 83000 - DNA, 20 bp, synthetic construct
  misc_feature 1..20: note = CRISPR gRNA sequence
  source 1..20: mol_type = other DNA
gctggatctcggggaagcgg

SEQ ID NO: 83001 - DNA, 20 bp, synthetic construct
  misc_feature 1..20: note = CRISPR gRNA sequence
  source 1..20: mol_type = other DNA
gggaagcggcggggtggcct

SEQ ID NO: 83002 - DNA, 20 bp, synthetic construct
  misc_feature 1..20: note = CRISPR gRNA sequence
  source 1..20: mol_type = other DNA
ggtggcctgggagtggggaa

SEQ ID NO: 83003 - DNA, 20 bp, synthetic construct
  misc_feature 1..20: note = CRISPR gRNA sequence
  source 1..20: mol_type = other DNA
cctttggcctacggcgacgg

SEQ ID NO: 83004 - DNA, 20 bp, synthetic construct
  misc_feature 1..20: note = CRISPR gRNA sequence
  source 1..20: mol_type = other DNA
tcagagcgccgaggttgggg

SEQ ID NO: 83005 - DNA, 20 bp, synthetic construct
  misc_feature 1..20: note = CRISPR gRNA sequence
  source 1..20: mol_type = other DNA
tctggctcccccagcgcagc

SEQ ID NO: 83006 - DNA, 20 bp, synthetic construct
  misc_feature 1..20: note = CRISPR gRNA sequence
  source 1..20: mol_type = other DNA
cagcgcagctggagtggggg

SEQ ID NO: 83007 - DNA, 20 bp, synthetic construct
  misc_feature 1..20: note = CRISPR gRNA sequence
  source 1..20: mol_type = other DNA
tgaacgcgtggaggggcgct

SEQ ID NO: 83008 - DNA, 20 bp, synthetic construct
  misc_feature 1..20: note = CRISPR gRNA sequence
  source 1..20: mol_type = other DNA
gggtctgggggaggcgtcgc

SEQ ID NO: 83009 - DNA, 20 bp, synthetic construct
  misc_feature 1..20: note = CRISPR gRNA sequence
  source 1..20: mol_type = other DNA
gttcgcatgtcctagcacct

SEQ ID NO: 83010 - DNA, 20 bp, synthetic construct
  misc_feature 1..20: note = CRISPR gRNA sequence
  source 1..20: mol_type = other DNA
gaaacagcacgcgacgtttg

SEQ ID NO: 83011 - DNA, 20 bp, synthetic construct
  misc_feature 1..20: note = CRISPR gRNA sequence
  source 1..20: mol_type = other DNA
ggctgtgatacaaagcggtt

SEQ ID NO: 83012 - DNA, 20 bp, synthetic construct
  misc_feature 1..20: note = CRISPR gRNA sequence
  source 1..20: mol_type = other DNA
ttaagaaacttaattacaca

SEQ ID NO: 83013 - DNA, 20 bp, synthetic construct
  misc_feature 1..20: note = CRISPR gRNA sequence
  source 1..20: mol_type = other DNA
tttcggttttgaaaacatga

SEQ ID NO: 83014 - DNA, 20 bp, synthetic construct
  misc_feature 1..20: note = CRISPR gRNA sequence
  source 1..20: mol_type = other DNA
acttagggaggccgaggcgg

SEQ ID NO: 83015 - DNA, 20 bp, synthetic construct
  misc_feature 1..20: note = CRISPR gRNA sequence
  source 1..20: mol_type = other DNA
aaaataataacaaaaattag

SEQ ID NO: 83016 - DNA, 20 bp, synthetic construct
  misc_feature 1..20: note = CRISPR gRNA sequence
  source 1..20: mol_type = other DNA
tgctccggtggctgaggcgg

SEQ ID NO: 83017 - DNA, 20 bp, synthetic construct
  misc_feature 1..20: note = CRISPR gRNA sequence
  source 1..20: mol_type = other DNA
tggcaaaacatgatcgaaag

SEQ ID NO: 83018 - DNA, 20 bp, synthetic construct
  misc_feature 1..20: note = CRISPR gRNA sequence
  source 1..20: mol_type = other DNA
atgagaaaattgcatttaat

SEQ ID NO: 83019 - DNA, 20 bp, synthetic construct
  misc_feature 1..20: note = CRISPR gRNA sequence
  source 1..20: mol_type = other DNA
tacaatttatttacaacata

SEQ ID NO: 83020 - DNA, 20 bp, synthetic construct
  misc_feature 1..20: note = CRISPR gRNA sequence
  source 1..20: mol_type = other DNA
tttcctcctctgacctgtgt

SEQ ID NO: 83021 - DNA, 20 bp, synthetic construct
  misc_feature 1..20: note = CRISPR gRNA sequence
  source 1..20: mol_type = other DNA
ttgccgccttccctcaaaca

SEQ ID NO: 83022 - DNA, 20 bp, synthetic construct
  misc_feature 1..20: note = CRISPR gRNA sequence
  source 1..20: mol_type = other DNA
ctcaaacagagagttccagg

SEQ ID NO: 83023 - DNA, 20 bp, synthetic construct
  misc_feature 1..20: note = CRISPR gRNA sequence
  source 1..20: mol_type = other DNA
aacagagagttccaggcagg

SEQ ID NO: 83024 - DNA, 20 bp, synthetic construct
  misc_feature 1..20: note = CRISPR gRNA sequence
  source 1..20: mol_type = other DNA
tagtagcctttccttaatga

SEQ ID NO: 83025 - DNA, 20 bp, synthetic construct
  misc_feature 1..20: note = CRISPR gRNA sequence
  source 1..20: mol_type = other DNA
ccacagcctcccagacaagg

SEQ ID NO: 83026 - DNA, 20 bp, synthetic construct
  misc_feature 1..20: note = CRISPR gRNA sequence
  source 1..20: mol_type = other DNA
ccttttagtgatcatgtacc

SEQ ID NO: 83027 - DNA, 20 bp, synthetic construct
  misc_feature 1..20: note = CRISPR gRNA sequence
  source 1..20: mol_type = other DNA
ctgaatataagtgtatttaa

SEQ ID NO: 83028 - DNA, 20 bp, synthetic construct
  misc_feature 1..20: note = CRISPR gRNA sequence
  source 1..20: mol_type = other DNA
ttcattttcaatgaaaaata

SEQ ID NO: 83029 - DNA, 20 bp, synthetic construct
  misc_feature 1..20: note = CRISPR gRNA sequence
  source 1..20: mol_type = other DNA
tattttcttcccacttcccc

SEQ ID NO: 83030 - DNA, 20 bp, synthetic construct
  misc_feature 1..20: note = CRISPR gRNA sequence
  source 1..20: mol_type = other DNA
ctagtttacagcaatcacct

SEQ ID NO: 83031 - DNA, 20 bp, synthetic construct
  misc_feature 1..20: note = CRISPR gRNA sequence
  source 1..20: mol_type = other DNA
cctatccctgttgtatttta

SEQ ID NO: 83032 - DNA, 20 bp, synthetic construct
  misc_feature 1..20: note = CRISPR gRNA sequence
  source 1..20: mol_type = other DNA
aattaggtacaaagtcagag

SEQ ID NO: 83033 - DNA, 20 bp, synthetic construct
  misc_feature 1..20: note = CRISPR gRNA sequence
  source 1..20: mol_type = other DNA
ttgtttggtaagaacatacc

SEQ ID NO: 83034 - DNA, 20 bp, synthetic construct
  misc_feature 1..20: note = CRISPR gRNA sequence
  source 1..20: mol_type = other DNA
caggctgatcacttgaagtt

SEQ ID NO: 83035 - DNA, 20 bp, synthetic construct
  misc_feature 1..20: note = CRISPR gRNA sequence
  source 1..20: mol_type = other DNA
tggtgtgtgcctgtagtccc

SEQ ID NO: 83036 - DNA, 20 bp, synthetic construct
  misc_feature 1..20: note = CRISPR gRNA sequence
  source 1..20: mol_type = other DNA
ctgcactccagcctgggcaa

SEQ ID NO: 83037 - DNA, 20 bp, synthetic construct
  misc_feature 1..20: note = CRISPR gRNA sequence
  source 1..20: mol_type = other DNA
aaaaaaataaagaacatacc

SEQ ID NO: 83038 - DNA, 20 bp, synthetic construct
  misc_feature 1..20: note = CRISPR gRNA sequence
  source 1..20: mol_type = other DNA
catacagtttagaaaatcag

SEQ ID NO: 83039 - DNA, 20 bp, synthetic construct
  misc_feature 1..20: note = CRISPR gRNA sequence
  source 1..20: mol_type = other DNA
aacataagaaaaaaaatgga

SEQ ID NO: 83040 - DNA, 20 bp, synthetic construct
  misc_feature 1..20: note = CRISPR gRNA sequence
  source 1..20: mol_type = other DNA
aaaaatggaaggggtggaaa

SEQ ID NO: 83041 - DNA, 20 bp, synthetic construct
  misc_feature 1..20: note = CRISPR gRNA sequence
  source 1..20: mol_type = other DNA
tggaaacagagtacaataac

SEQ ID NO: 83042 - DNA, 20 bp, synthetic construct
  misc_feature 1..20: note = CRISPR gRNA sequence
  source 1..20: mol_type = other DNA
gggccaaatcatgtagactc

SEQ ID NO: 83043 - DNA, 20 bp, synthetic construct
  misc_feature 1..20: note = CRISPR gRNA sequence
  source 1..20: mol_type = other DNA
gactcttgagtgatgtgtta

SEQ ID NO: 83044 - DNA, 20 bp, synthetic construct
  misc_feature 1..20: note = CRISPR gRNA sequence
  source 1..20: mol_type = other DNA
gtgatgtgttaaggaatgct

SEQ ID NO: 83045 - DNA, 20 bp, synthetic construct
  misc_feature 1..20: note = CRISPR gRNA sequence
  source 1..20: mol_type = other DNA
aacaaaaaaggcatgtatag

SEQ ID NO: 83046 - DNA, 20 bp, synthetic construct
  misc_feature 1..20: note = CRISPR gRNA sequence
  source 1..20: mol_type = other DNA
aaggtggaagctcatttggc

SEQ ID NO: 83047 - DNA, 20 bp, synthetic construct
  misc_feature 1..20: note = CRISPR gRNA sequence
  source 1..20: mol_type = other DNA
tcatttggccagagtggaaa

SEQ ID NO: 83048 - DNA, 20 bp, synthetic construct
  misc_feature 1..20: note = CRISPR gRNA sequence
  source 1..20: mol_type = other DNA
tttactcacgtcatccagca

SEQ ID NO: 83049 - DNA, 20 bp, synthetic construct
  misc_feature 1..20: note = CRISPR gRNA sequence
  source 1..20: mol_type = other DNA
agaatggaaagtcaaatttc

SEQ ID NO: 83050 - DNA, 20 bp, synthetic construct
  misc_feature 1..20: note = CRISPR gRNA sequence
  source 1..20: mol_type = other DNA
tttcctgaattgctatgtgt

SEQ ID NO: 83051 - DNA, 20 bp, synthetic construct
  misc_feature 1..20: note = CRISPR gRNA sequence
  source 1..20: mol_type = other DNA
acattgaagttgacttactg

SEQ ID NO: 83052 - DNA, 20 bp, synthetic construct
  misc_feature 1..20: note = CRISPR gRNA sequence
  source 1..20: mol_type = other DNA
gacttactgaagaatggaga

SEQ ID NO: 83053 - DNA, 20 bp, synthetic construct
  misc_feature 1..20: note = CRISPR gRNA sequence
  source 1..20: mol_type = other DNA
tttctatctcttgtactaca

SEQ ID NO: 83054 - DNA, 20 bp, synthetic construct
  misc_feature 1..20: note = CRISPR gRNA sequence
  source 1..20: mol_type = other DNA
attcacccccactgaaaaag

SEQ ID NO: 83055 - DNA, 20 bp, synthetic construct
  misc_feature 1..20: note = CRISPR gRNA sequence
  source 1..20: mol_type = other DNA
cacagcccaagatagttaag

SEQ ID NO: 83056 - DNA, 20 bp, synthetic construct
  misc_feature 1..20: note = CRISPR gRNA sequence
  source 1..20: mol_type = other DNA
taagctgctgaaagttgtgt

SEQ ID NO: 83057 - DNA, 20 bp, synthetic construct
  misc_feature 1..20: note = CRISPR gRNA sequence
  source 1..20: mol_type = other DNA
aggtctatggccatactacc

SEQ ID NO: 83058 - DNA, 20 bp, synthetic construct
  misc_feature 1..20: note = CRISPR gRNA sequence
  source 1..20: mol_type = other DNA
ctatggccatactaccctga

SEQ ID NO: 83059 - DNA, 20 bp, synthetic construct
  misc_feature 1..20: note = CRISPR gRNA sequence
  source 1..20: mol_type = other DNA
gatataaacaatctgcatat

SEQ ID NO: 83060 - DNA, 20 bp, synthetic construct
  misc_feature 1..20: note = CRISPR gRNA sequence
  source 1..20: mol_type = other DNA
tctgcatattgggattgtca

SEQ ID NO: 83061 - DNA, 20 bp, synthetic construct
  misc_feature 1..20: note = CRISPR gRNA sequence
  source 1..20: mol_type = other DNA
acttctccagtactttctgg

SEQ ID NO: 83062 - DNA, 20 bp, synthetic construct
  misc_feature 1..20: note = CRISPR gRNA sequence
  source 1..20: mol_type = other DNA
gtaggaagggcttgttcctg

SEQ ID NO: 83063 - DNA, 20 bp, synthetic construct
  misc_feature 1..20: note = CRISPR gRNA sequence
  source 1..20: mol_type = other DNA
tagctctaaacaatgtattc

SEQ ID NO: 83064 - DNA, 20 bp, synthetic construct
  misc_feature 1..20: note = CRISPR gRNA sequence
  source 1..20: mol_type = other DNA
cactatgtggagaacattga

SEQ ID NO: 83065 - DNA, 20 bp, synthetic construct
  misc_feature 1..20: note = CRISPR gRNA sequence
  source 1..20: mol_type = other DNA
taacattttagcagggaaag

SEQ ID NO: 83066 - DNA, 20 bp, synthetic construct
  misc_feature 1..20: note = CRISPR gRNA sequence
  source 1..20: mol_type = other DNA
gcagggaaagaagaatccta

SEQ ID NO: 83067 - DNA, 20 bp, synthetic construct
  misc_feature 1..20: note = CRISPR gRNA sequence
  source 1..20: mol_type = other DNA
ggtcatgttcccttctcctg

SEQ ID NO: 83068 - DNA, 20 bp, synthetic construct
  misc_feature 1..20: note = CRISPR gRNA sequence
  source 1..20: mol_type = other DNA
gaactgccagtatggtattg

SEQ ID NO: 83069 - DNA, 20 bp, synthetic construct
  misc_feature 1..20: note = CRISPR gRNA sequence
  source 1..20: mol_type = other DNA
ttattcttcagacagaagag

SEQ ID NO: 83070 - DNA, 20 bp, synthetic construct
  misc_feature 1..20: note = CRISPR gRNA sequence
  source 1..20: mol_type = other DNA
gacttctctgcatctttagt

SEQ ID NO: 83071 - DNA, 20 bp, synthetic construct
  misc_feature 1..20: note = CRISPR gRNA sequence
  source 1..20: mol_type = other DNA
ttcaatgaaattctactgcc

SEQ ID NO: 83072 - DNA, 20 bp, synthetic construct
  misc_feature 1..20: note = CRISPR gRNA sequence
  source 1..20: mol_type = other DNA
tcctgttatattctagaaca

SEQ ID NO: 83073 - DNA, 20 bp, synthetic construct
  misc_feature 1..20: note = CRISPR gRNA sequence
  source 1..20: mol_type = other DNA
tttgggagagcatcaggaag

SEQ ID NO: 83074 - DNA, 20 bp, synthetic construct
  misc_feature 1..20: note = CRISPR gRNA sequence
  source 1..20: mol_type = other DNA
ctgtacagcctgttactgta

SEQ ID NO: 83075 - DNA, 20 bp, synthetic construct
  misc_feature 1..20: note = CRISPR gRNA sequence
  source 1..20: mol_type = other DNA
taagattttgggagcaccaa

SEQ ID NO: 83076 - DNA, 20 bp, synthetic construct
  misc_feature 1..20: note = CRISPR gRNA sequence
  source 1..20: mol_type = other DNA
gcaccaaagggatacactaa

SEQ ID NO: 83077 - DNA, 20 bp, synthetic construct
  misc_feature 1..20: note = CRISPR gRNA sequence
  source 1..20: mol_type = other DNA
aacaggatatactctttata

SEQ ID NO: 83078 - DNA, 20 bp, synthetic construct
  misc_feature 1..20: note = CRISPR gRNA sequence
  source 1..20: mol_type = other DNA
caggtttgaagatgccgcat

SEQ ID NO: 83079 - DNA, 20 bp, synthetic construct
  misc_feature 1..20: note = CRISPR gRNA sequence
  source 1..20: mol_type = other DNA
ttgaagatgccgcatttgga

SEQ ID NO: 83080 - DNA, 20 bp, synthetic construct
  misc_feature 1..20: note = CRISPR gRNA sequence
  source 1..20: mol_type = other DNA
agatgccgcatttggattgg

SEQ ID NO: 83081 - DNA, 20 bp, synthetic construct
  misc_feature 1..20: note = CRISPR gRNA sequence
  source 1..20: mol_type = other DNA
tacactttatgcacaaaatg

SEQ ID NO: 83082 - DNA, 20 bp, synthetic construct
  misc_feature 1..20: note = CRISPR gRNA sequence
  source 1..20: mol_type = other DNA
atcttctttataattctact

SEQ ID NO: 83083 - DNA, 20 bp, synthetic construct
  misc_feature 1..20: note = CRISPR gRNA sequence
  source 1..20: mol_type = other DNA
caacttagaggtggggagca

SEQ ID NO: 83084 - DNA, 20 bp, synthetic construct
  misc_feature 1..20: note = CRISPR gRNA sequence
  source 1..20: mol_type = other DNA
tccaatttacatactctgct

SEQ ID NO: 83085 - DNA, 20 bp, synthetic construct
  misc_feature 1..20: note = CRISPR gRNA sequence
  source 1..20: mol_type = other DNA
aaatttagaaatataattga

SEQ ID NO: 83086 - DNA, 20 bp, synthetic construct
  misc_feature 1..20: note = CRISPR gRNA sequence
  source 1..20: mol_type = other DNA
attattggaaatttgttata

SEQ ID NO: 83087 - DNA, 20 bp, synthetic construct
  misc_feature 1..20: note = CRISPR gRNA sequence
  source 1..20: mol_type = other DNA
aaatgtgaaccccttgtata

SEQ ID NO: 83088 - DNA, 20 bp, synthetic construct
  misc_feature 1..20: note = CRISPR gRNA sequence
  source 1..20: mol_type = other DNA
gtttccctgtttgaaaataa

SEQ ID NO: 83089 - DNA, 20 bp, synthetic construct
  misc_feature 1..20: note = CRISPR gRNA sequence
  source 1..20: mol_type = other DNA
gaaaataaaggggtaatagt

SEQ ID NO: 83090 - DNA, 20 bp, synthetic construct
  misc_feature 1..20: note = CRISPR gRNA sequence
  source 1..20: mol_type = other DNA
caaatgtataagaagtaaat

SEQ ID NO: 83091 - DNA, 20 bp, synthetic construct
  misc_feature 1..20: note = CRISPR gRNA sequence
  source 1..20: mol_type = other DNA
attttcccccaaattctaag

SEQ ID NO: 83092 - DNA, 20 bp, synthetic construct
  misc_feature 1..20: note = CRISPR gRNA sequence
  source 1..20: mol_type = other DNA
cttaactatcttaacaagct

SEQ ID NO: 83093 - DNA, 20 bp, synthetic construct
  misc_feature 1..20: note = CRISPR gRNA sequence
  source 1..20: mol_type = other DNA
gctttgagtgcaagagattg

SEQ ID NO: 83094 - DNA, 20 bp, synthetic construct
  misc_feature 1..20: note = CRISPR gRNA sequence
  source 1..20: mol_type = other DNA
atctgaccaagatgttgatg

SEQ ID NO: 83095 - DNA, 20 bp, synthetic construct
  misc_feature 1..20: note = CRISPR gRNA sequence
  source 1..20: mol_type = other DNA
aagatgttgatgttggataa

SEQ ID NO: 83096 - DNA, 20 bp, synthetic construct
  misc_feature 1..20: note = CRISPR gRNA sequence
  source 1..20: mol_type = other DNA
catggagacagcactcaaag

SEQ ID NO: 83097 - DNA, 20 bp, synthetic construct
  misc_feature 1..20: note = CRISPR gRNA sequence
  source 1..20: mol_type = other DNA
aatattaaaaagcaagcaag

SEQ ID NO: 83098 - DNA, 20 bp, synthetic construct
  misc_feature 1..20: note = CRISPR gRNA sequence
  source 1..20: mol_type = other DNA
aaaagcaagcaagcagaatt

SEQ ID NO: 83099 - DNA, 20 bp, synthetic construct
  misc_feature 1..20: note = CRISPR gRNA sequence
  source 1..20: mol_type = other DNA
agaaaagaaaaaggttagca

SEQ ID NO: 83100 - DNA, 20 bp, synthetic construct
  misc_feature 1..20: note = CRISPR gRNA sequence
  source 1..20: mol_type = other DNA
tagcaatgaatttattttat

SEQ ID NO: 83101 - DNA, 20 bp, synthetic construct
  misc_feature 1..20: note = CRISPR gRNA sequence
  source 1..20: mol_type = other DNA
agttctccaaacccattata

SEQ ID NO: 83102 - DNA, 20 bp, synthetic construct
  misc_feature 1..20: note = CRISPR gRNA sequence
  source 1..20: mol_type = other DNA
taagtaacacatgactatat

SEQ ID NO: 83103 - DNA, 20 bp, synthetic construct
  misc_feature 1..20: note = CRISPR gRNA sequence
  source 1..20: mol_type = other DNA
cccaaatcaattccctgttc

SEQ ID NO: 83104 - DNA, 20 bp, synthetic construct
  misc_feature 1..20: note = CRISPR gRNA sequence
  source 1..20: mol_type = other DNA
tctagaatataacaggagat

SEQ ID NO: 83105 - DNA, 20 bp, synthetic construct
  misc_feature 1..20: note = CRISPR gRNA sequence
  source 1..20: mol_type = other DNA
aatataacaggagatttgaa

SEQ ID NO: 83106 - DNA, 20 bp, synthetic construct
  misc_feature 1..20: note = CRISPR gRNA sequence
  source 1..20: mol_type = other DNA
catcaatgtaccctgggcag

SEQ ID NO: 83107 - DNA, 20 bp, synthetic construct
  misc_feature 1..20: note = CRISPR gRNA sequence
  source 1..20: mol_type = other DNA
ggcaaacacagtccccatac

SEQ ID NO: 83108 - DNA, 20 bp, synthetic construct
  misc_feature 1..20: note = CRISPR gRNA sequence
  source 1..20: mol_type = other DNA
acacagtccccatacaggaa

SEQ ID NO: 83109 - DNA, 20 bp, synthetic construct
  misc_feature 1..20: note = CRISPR gRNA sequence
  source 1..20: mol_type = other DNA
taactcctctcttctgtctg

SEQ ID NO: 83110 - DNA, 20 bp, synthetic construct
  misc_feature 1..20: note = CRISPR gRNA sequence
  source 1..20: mol_type = other DNA
aacaacattatacaaaggaa

SEQ ID NO: 83111 - DNA, 20 bp, synthetic construct
  misc_feature 1..20: note = CRISPR gRNA sequence
  source 1..20: mol_type = other DNA
atcaaagccttgcaggtaat

SEQ ID NO: 83112 - DNA, 20 bp, synthetic construct
  misc_feature 1..20: note = CRISPR gRNA sequence
  source 1..20: mol_type = other DNA
gttcctttgccctctctgta

SEQ ID NO: 83113 - DNA, 20 bp, synthetic construct
  misc_feature 1..20: note = CRISPR gRNA sequence
  source 1..20: mol_type = other DNA
gagaagggaacatgaccctg

SEQ ID NO: 83114 - DNA, 20 bp, synthetic construct
  misc_feature 1..20: note = CRISPR gRNA sequence
  source 1..20: mol_type = other DNA
gtcaatgttctccacatagt

SEQ ID NO: 83115 - DNA, 20 bp, synthetic construct
  misc_feature 1..20: note = CRISPR gRNA sequence
  source 1..20: mol_type = other DNA
atggttagaaataaggctgg

SEQ ID NO: 83116 - DNA, 20 bp, synthetic construct
  misc_feature 1..20: note = CRISPR gRNA sequence
  source 1..20: mol_type = other DNA
ataggctgctgttcctaccc

SEQ ID NO: 83117 - DNA, 20 bp, synthetic construct
  misc_feature 1..20: note = CRISPR gRNA sequence
  source 1..20: mol_type = other DNA
cagaaagtactggagaagtc

SEQ ID NO: 83118 - DNA, 20 bp, synthetic construct
  misc_feature 1..20: note = CRISPR gRNA sequence
  source 1..20: mol_type = other DNA
actggagaagtccaggatta

SEQ ID NO: 83119 - DNA, 20 bp, synthetic construct
  misc_feature 1..20: note = CRISPR gRNA sequence
  source 1..20: mol_type = other DNA
gccagtaggtaagaagtgtt

SEQ ID NO: 83120 - DNA, 20 bp, synthetic construct
  misc_feature 1..20: note = CRISPR gRNA sequence
  source 1..20: mol_type = other DNA
tgcagattgtttatatcaga

SEQ ID NO: 83121 - DNA, 20 bp, synthetic construct
  misc_feature 1..20: note = CRISPR gRNA sequence
  source 1..20: mol_type = other DNA
cagatgggatgggactcatt

SEQ ID NO: 83122 - DNA, 20 bp, synthetic construct
  misc_feature 1..20: note = CRISPR gRNA sequence
  source 1..20: mol_type = other DNA
caactttcagcagcttacaa

SEQ ID NO: 83123 - DNA, 20 bp, synthetic construct
  misc_feature 1..20: note = CRISPR gRNA sequence
  source 1..20: mol_type = other DNA
gcatactcatctttttcagt

SEQ ID NO: 83124 - DNA, 20 bp, synthetic construct
  misc_feature 1..20: note = CRISPR gRNA sequence
  source 1..20: mol_type = other DNA
actcatctttttcagtgggg

SEQ ID NO: 83125 - DNA, 20 bp, synthetic construct
  misc_feature 1..20: note = CRISPR gRNA sequence
  source 1..20: mol_type = other DNA
gtccttgctgaaagacaagt

SEQ ID NO: 83126 - DNA, 20 bp, synthetic construct
  misc_feature 1..20: note = CRISPR gRNA sequence
  source 1..20: mol_type = other DNA
tcagtaagtcaacttcaatg

SEQ ID NO: 83127 - DNA, 20 bp, synthetic construct
  misc_feature 1..20: note = CRISPR gRNA sequence
  source 1..20: mol_type = other DNA
taagtcaacttcaatgtcgg

SEQ ID NO: 83128 - DNA, 20 bp, synthetic construct
  misc_feature 1..20: note = CRISPR gRNA sequence
  source 1..20: mol_type = other DNA
atttgactttccattctctg

SEQ ID NO: 83129 - DNA, 20 bp, synthetic construct
  misc_feature 1..20: note = CRISPR gRNA sequence
  source 1..20: mol_type = other DNA
tccattctctgctggatgac

SEQ ID NO: 83130 - DNA, 20 bp, synthetic construct
  misc_feature 1..20: note = CRISPR gRNA sequence
  source 1..20: mol_type = other DNA
gctggatgacgtgagtaaac

SEQ ID NO: 83131 - DNA, 20 bp, synthetic construct
  misc_feature 1..20: note = CRISPR gRNA sequence
  source 1..20: mol_type = other DNA
cgtgagtaaacctgaatctt

SEQ ID NO: 83132 - DNA, 20 bp, synthetic construct
  misc_feature 1..20: note = CRISPR gRNA sequence
  source 1..20: mol_type = other DNA
ctgaatctttggagtacctg

SEQ ID NO: 83133 - DNA, 20 bp, synthetic construct
  misc_feature 1..20: note = CRISPR gRNA sequence
  source 1..20: mol_type = other DNA
aaaagacacattaatattgc

SEQ ID NO: 83134 - DNA, 20 bp, synthetic construct
  misc_feature 1..20: note = CRISPR gRNA sequence
  source 1..20: mol_type = other DNA
aacaagccacctccattttg

SEQ ID NO: 83135 - DNA, 20 bp, synthetic construct
  misc_feature 1..20: note = CRISPR gRNA sequence
  source 1..20: mol_type = other DNA
cattccttaacacatcactc

SEQ ID NO: 83136 - DNA, 20 bp, synthetic construct
  misc_feature 1..20: note = CRISPR gRNA sequence
  source 1..20: mol_type = other DNA
aaactgtatgaagtgtctag

SEQ ID NO: 83137 - DNA, 20 bp, synthetic construct
  misc_feature 1..20: note = CRISPR gRNA sequence
  source 1..20: mol_type = other DNA
ttattatctgaggttcctaa

SEQ ID NO: 83138 - DNA, 20 bp, synthetic construct
  misc_feature 1..20: note = CRISPR gRNA sequence
  source 1..20: mol_type = other DNA
ttttttatttttttattttt

SEQ ID NO: 83139 - DNA, 20 bp, synthetic construct
  misc_feature 1..20: note = CRISPR gRNA sequence
  source 1..20: mol_type = other DNA
tatttttttattttttggga

SEQ ID NO: 83140 - DNA, 20 bp, synthetic construct
  misc_feature 1..20: note = CRISPR gRNA sequence
  source 1..20: mol_type = other DNA
tctcattccattgcccaggc

SEQ ID NO: 83141 - DNA, 20 bp, synthetic construct
  misc_feature 1..20: note = CRISPR gRNA sequence
  source 1..20: mol_type = other DNA
ctcactgcaacctccgcctc

SEQ ID NO: 83142 - DNA, 20 bp, synthetic construct
  misc_feature 1..20: note = CRISPR gRNA sequence
  source 1..20: mol_type = other DNA
ttttgtattttcagtagaga

SEQ ID NO: 83143 - DNA, 20 bp, synthetic construct
  misc_feature 1..20: note = CRISPR gRNA sequence
  source 1..20: mol_type = other DNA
gccttggcctcccaaagtgt

SEQ ID NO: 83144 - DNA, 20 bp, synthetic construct
  misc_feature 1..20: note = CRISPR gRNA sequence
  source 1..20: mol_type = other DNA
ctggcaaataccttaaatgg

SEQ ID NO: 83145 - DNA, 20 bp, synthetic construct
  misc_feature 1..20: note = CRISPR gRNA sequence
  source 1..20: mol_type = other DNA
tggacccgataaaatacaac

SEQ ID NO: 83146 - DNA, 20 bp, synthetic construct
  misc_feature 1..20: note = CRISPR gRNA sequence
  source 1..20: mol_type = other DNA
tactttccattatgatcaaa

SEQ ID NO: 83147 - DNA, 20 bp, synthetic construct
  misc_feature 1..20: note = CRISPR gRNA sequence
  source 1..20: mol_type = other DNA
tggagtaatgcatgtgacag

SEQ ID NO: 83148 - DNA, 20 bp, synthetic construct
  misc_feature 1..20: note = CRISPR gRNA sequence
  source 1..20: mol_type = other DNA
tgctgtaaactagccaggtt

SEQ ID NO: 83149 - DNA, 20 bp, synthetic construct
  misc_feature 1..20: note = CRISPR gRNA sequence
  source 1..20: mol_type = other DNA
cttttaaatacacttatatt

SEQ ID NO: 83150 - DNA, 20 bp, synthetic construct
  misc_feature 1..20: note = CRISPR gRNA sequence
  source 1..20: mol_type = other DNA
gggaggctgtggggagaagg

SEQ ID NO: 83151 - DNA, 20 bp, synthetic construct
  misc_feature 1..20: note = CRISPR gRNA sequence
  source 1..20: mol_type = other DNA
gctactagccccatcaagag

SEQ ID NO: 83152 - DNA, 20 bp, synthetic construct
  misc_feature 1..20: note = CRISPR gRNA sequence
  source 1..20: mol_type = other DNA
ccccatcaagaggtggattg

SEQ ID NO: 83153 - DNA, 20 bp, synthetic construct
  misc_feature 1..20: note = CRISPR gRNA sequence
  source 1..20: mol_type = other DNA
aagaacatattaaatgcctc

SEQ ID NO: 83154 - DNA, 20 bp, synthetic construct
  misc_feature 1..20: note = CRISPR gRNA sequence
  source 1..20: mol_type = other DNA
gaggacaagtatcagacagg

SEQ ID NO: 83155 - DNA, 20 bp, synthetic construct
  misc_feature 1..20: note = CRISPR gRNA sequence
  source 1..20: mol_type = other DNA
aagtatcagacaggctgggt

SEQ ID NO: 83156 - DNA, 20 bp, synthetic construct
  misc_feature 1..20: note = CRISPR gRNA sequence
  source 1..20: mol_type = other DNA
tactggctttatgacttttg

SEQ ID NO: 83157 - DNA, 20 bp, synthetic construct
  misc_feature 1..20: note = CRISPR gRNA sequence
  source 1..20: mol_type = other DNA
caacagtcttggtaaccatc

SEQ ID NO: 83158 - DNA, 20 bp, synthetic construct
  misc_feature 1..20: note = CRISPR gRNA sequence
  source 1..20: mol_type = other DNA
tttttttcttttttgagaga

SEQ ID NO: 83159 - DNA, 20 bp, synthetic construct
  misc_feature 1..20: note = CRISPR gRNA sequence
  source 1..20: mol_type = other DNA
tctcgctctgttgcccacgc

SEQ ID NO: 83160 - DNA, 20 bp, synthetic construct
  misc_feature 1..20: note = CRISPR gRNA sequence
  source 1..20: mol_type = other DNA
gcctcggcctccctaagtgc

SEQ ID NO: 83161 - DNA, 20 bp, synthetic construct
  misc_feature 1..20: note = CRISPR gRNA sequence
  source 1..20: mol_type = other DNA
atgccgcccagtttgctctg

SEQ ID NO: 83162 - DNA, 20 bp, synthetic construct
  misc_feature 1..20: note = CRISPR gRNA sequence
  source 1..20: mol_type = other DNA
tttttcttaaaaaaaaatgc

SEQ ID NO: 83163 - DNA, 20 bp, synthetic construct
  misc_feature 1..20: note = CRISPR gRNA sequence
  source 1..20: mol_type = other DNA
cacacagaaagatgtcaata

SEQ ID NO: 83164 - DNA, 20 bp, synthetic construct
  misc_feature 1..20: note = CRISPR gRNA sequence
  source 1..20: mol_type = other DNA
aggggcaagtagcgcgcgtc

SEQ ID NO: 83165 - DNA, 20 bp, synthetic construct
  misc_feature 1..20: note = CRISPR gRNA sequence
  source 1..20: mol_type = other DNA
agagcacagcgagggccaca

SEQ ID NO: 83166 - DNA, 20 bp, synthetic construct
  misc_feature 1..20: note = CRISPR gRNA sequence
  source 1..20: mol_type = other DNA
gagaggaaggaccagagcgg

SEQ ID NO: 83167 - DNA, 20 bp, synthetic construct
  misc_feature 1..20: note = CRISPR gRNA sequence
  source 1..20: mol_type = other DNA
gagggtaggagagactcacg

SEQ ID NO: 83168 - DNA, 20 bp, synthetic construct
  misc_feature 1..20: note = CRISPR gRNA sequence
  source 1..20: mol_type = other DNA
tagcctccaggccagaaaga

SEQ ID NO: 83169 - DNA, 20 bp, synthetic construct
  misc_feature 1..20: note = CRISPR gRNA sequence
  source 1..20: mol_type = other DNA
acggagcgagacatctcggc

SEQ ID NO: 83170 - DNA, 20 bp, synthetic construct
  misc_feature 1..20: note = CRISPR gRNA sequence
  source 1..20: mol_type = other DNA
gcccgaatgctgtcagcttc

SEQ ID NO: 83171 - DNA, 20 bp, synthetic construct
  misc_feature 1..20: note = CRISPR gRNA sequence
  source 1..20: mol_type = other DNA
ctctaacctggcactgcgtc

SEQ ID NO: 83172 - DNA, 20 bp, synthetic construct
  misc_feature 1..20: note = CRISPR gRNA sequence
  source 1..20: mol_type = other DNA
gacggtccctgcgggccttg

SEQ ID NO: 83173 - DNA, 20 bp, synthetic construct
  misc_feature 1..20: note = CRISPR gRNA sequence
  source 1..20: mol_type = other DNA
cttgtcctgattggctgggc

SEQ ID NO: 83174 - DNA, 20 bp, synthetic construct
  misc_feature 1..20: note = CRISPR gRNA sequence
  source 1..20: mol_type = other DNA
cggcgacgggagggtcggga

SEQ ID NO: 83175 - DNA, 20 bp, synthetic construct
  misc_feature 1..20: note = CRISPR gRNA sequence
  source 1..20: mol_type = other DNA
tcagagcgccgaggttgggg

SEQ ID NO: 83176 - DNA, 20 bp, synthetic construct
  misc_feature 1..20: note = CRISPR gRNA sequence
  source 1..20: mol_type = other DNA
tcgtcccaaaggcgcggcgc

SEQ ID NO: 83177 - DNA, 20 bp, synthetic construct
  misc_feature 1..20: note = CRISPR gRNA sequence
  source 1..20: mol_type = other DNA
aggtttgtgaacgcgtggag

SEQ ID NO: 83178 - DNA, 20 bp, synthetic construct
  misc_feature 1..20: note = CRISPR gRNA sequence
  source 1..20: mol_type = other DNA
ggtaagcctgtctgctgcgg

SEQ ID NO: 83179 - DNA, 20 bp, synthetic construct
  misc_feature 1..20: note = CRISPR gRNA sequence
  source 1..20: mol_type = other DNA
cgtggggaggaaacagcacg

SEQ ID NO: 83180 - DNA, 20 bp, synthetic construct
  misc_feature 1..20: note = CRISPR gRNA sequence
  source 1..20: mol_type = other DNA
aacagcacgcgacgtttgta

SEQ ID NO: 83181 - DNA, 20 bp, synthetic construct
  misc_feature 1..20: note = CRISPR gRNA sequence
  source 1..20: mol_type = other DNA
aatgcttggctgtgatacaa

SEQ ID NO: 83182 - DNA, 20 bp, synthetic construct
  misc_feature 1..20: note = CRISPR gRNA sequence
  source 1..20: mol_type = other DNA
ttctgtgtgccaaggacttt

SEQ ID NO: 83183 - DNA, 20 bp, synthetic construct
  misc_feature 1..20: note = CRISPR gRNA sequence
  source 1..20: mol_type = other DNA
cagatgaagaaactaaggca

SEQ ID NO: 83184 - DNA, 20 bp, synthetic construct
  misc_feature 1..20: note = CRISPR gRNA sequence
  source 1..20: mol_type = other DNA
caggggataaatggcagcaa

SEQ ID NO: 83185 - DNA, 20 bp, synthetic construct
  misc_feature 1..20: note = CRISPR gRNA sequence
  source 1..20: mol_type = other DNA
agattgaagtcaagcctaac

SEQ ID NO: 83186 - DNA, 20 bp, synthetic construct
  misc_feature 1..20: note = CRISPR gRNA sequence
  source 1..20: mol_type = other DNA
gaaaaacgcctgccttctgc

SEQ ID NO: 83187 - DNA, 20 bp, synthetic construct
  misc_feature 1..20: note = CRISPR gRNA sequence
  source 1..20: mol_type = other DNA
ccctgtggtcttttcgtaca

SEQ ID NO: 83188 - DNA, 20 bp, synthetic construct
  misc_feature 1..20: note = CRISPR gRNA sequence
  source 1..20: mol_type = other DNA
tcctctttggctctttgcct

SEQ ID NO: 83189 - DNA, 20 bp, synthetic construct
  misc_feature 1..20: note = CRISPR gRNA sequence
  source 1..20: mol_type = other DNA
gatgtactgtgcctcttact

SEQ ID NO: 83190 - DNA, 20 bp, synthetic construct
  misc_feature 1..20: note = CRISPR gRNA sequence
  source 1..20: mol_type = other DNA
aacatgagggggttgggcgt

SEQ ID NO: 83191 - DNA, 20 bp, synthetic construct
  misc_feature 1..20: note = CRISPR gRNA sequence
  source 1..20: mol_type = other DNA
tagggaggccgaggcgggag

SEQ ID NO: 83192 - DNA, 20 bp, synthetic construct
  misc_feature 1..20: note = CRISPR gRNA sequence
  source 1..20: mol_type = other DNA
ggctgaggcgggaggatctc

SEQ ID NO: 83193 - DNA, 20 bp, synthetic construct
  misc_feature 1..20: note = CRISPR gRNA sequence
  source 1..20: mol_type = other DNA
ggcgggaggatctcttgagc

SEQ ID NO: 83194 - DNA, 20 bp, synthetic construct
  misc_feature 1..20: note = CRISPR gRNA sequence
  source 1..20: mol_type = other DNA
aagaaaagaaagaaagaagt

SEQ ID NO: 83195 - DNA, 20 bp, synthetic construct
  misc_feature 1..20: note = CRISPR gRNA sequence
  source 1..20: mol_type = other DNA
gcaaaacatgatcgaaagca

SEQ ID NO: 83196 - DNA, 20 bp, synthetic construct
  misc_feature 1..20: note = CRISPR gRNA sequence
  source 1..20: mol_type = other DNA
ataccacaagaaacatgtaa

SEQ ID NO: 83197 - DNA, 20 bp, synthetic construct
  misc_feature 1..20: note = CRISPR gRNA sequence
  source 1..20: mol_type = other DNA
tttcctcctctgacctgtgt

SEQ ID NO: 83198 - DNA, 20 bp, synthetic construct
  misc_feature 1..20: note = CRISPR gRNA sequence
  source 1..20: mol_type = other DNA
tcctctgacctgtgtgtggg

SEQ ID NO: 83199 - DNA, 20 bp, synthetic construct
  misc_feature 1..20: note = CRISPR gRNA sequence
  source 1..20: mol_type = other DNA
gacctgtgtgtgggttttgt

SEQ ID NO: 83200 - DNA, 20 bp, synthetic construct
  misc_feature 1..20: note = CRISPR gRNA sequence
  source 1..20: mol_type = other DNA
ggcataaattaatttttcag

SEQ ID NO: 83201 - DNA, 20 bp, synthetic construct
  misc_feature 1..20: note = CRISPR gRNA sequence
  source 1..20: mol_type = other DNA
taatttttcagttaagtttt

SEQ ID NO: 83202 - DNA, 20 bp, synthetic construct
  misc_feature 1..20: note = CRISPR gRNA sequence
  source 1..20: mol_type = other DNA
gatacttgtcctcttcttag

SEQ ID NO: 83203 - DNA, 20 bp, synthetic construct
  misc_feature 1..20: note = CRISPR gRNA sequence
  source 1..20: mol_type = other DNA
gctcagatgcaaagagctct

SEQ ID NO: 83204 - DNA, 20 bp, synthetic construct
  misc_feature 1..20: note = CRISPR gRNA sequence
  source 1..20: mol_type = other DNA
atgaaaaaaatcaggtcttc

SEQ ID NO: 83205 - DNA, 20 bp, synthetic construct
  misc_feature 1..20: note = CRISPR gRNA sequence
  source 1..20: mol_type = other DNA
gtagcctttccttaatgata

SEQ ID NO: 83206 - DNA, 20 bp, synthetic construct
  misc_feature 1..20: note = CRISPR gRNA sequence
  source 1..20: mol_type = other DNA
ttcattttcaatgaaaaata

SEQ ID NO: 83207 - DNA, 20 bp, synthetic construct
  misc_feature 1..20: note = CRISPR gRNA sequence
  source 1..20: mol_type = other DNA
atgcctctcattttggaaag

SEQ ID NO: 83208 - DNA, 20 bp, synthetic construct
  misc_feature 1..20: note = CRISPR gRNA sequence
  source 1..20: mol_type = other DNA
ggcaatatattcccaacctg

SEQ ID NO: 83209 - DNA, 20 bp, synthetic construct
  misc_feature 1..20: note = CRISPR gRNA sequence
  source 1..20: mol_type = other DNA
ttgccagctcttgtatgcat

SEQ ID NO: 83210 - DNA, 20 bp, synthetic construct
  misc_feature 1..20: note = CRISPR gRNA sequence
  source 1..20: mol_type = other DNA
agctcttgtatgcatttagg

SEQ ID NO: 83211 - DNA, 20 bp, synthetic construct
  misc_feature 1..20: note = CRISPR gRNA sequence
  source 1..20: mol_type = other DNA
tatgcatttaggttttgttt

SEQ ID NO: 83212 - DNA, 20 bp, synthetic construct
  misc_feature 1..20: note = CRISPR gRNA sequence
  source 1..20: mol_type = other DNA
taaaacctcagcagaaataa

SEQ ID NO: 83213 - DNA, 20 bp, synthetic construct
  misc_feature 1..20: note = CRISPR gRNA sequence
  source 1..20: mol_type = other DNA
cagcagaaataaagaggttt

SEQ ID NO: 83214 - DNA, 20 bp, synthetic construct
  misc_feature 1..20: note = CRISPR gRNA sequence
  source 1..20: mol_type = other DNA
actccagcctgggcaatgga

SEQ ID NO: 83215 - DNA, 20 bp, synthetic construct
  misc_feature 1..20: note = CRISPR gRNA sequence
  source 1..20: mol_type = other DNA
gcactctactagacacttca

SEQ ID NO: 83216 - DNA, 20 bp, synthetic construct
  misc_feature 1..20: note = CRISPR gRNA sequence
  source 1..20: mol_type = other DNA
atgagggaaagataccaagt

SEQ ID NO: 83217 - DNA, 20 bp, synthetic construct
  misc_feature 1..20: note = CRISPR gRNA sequence
  source 1..20: mol_type = other DNA
ggtttattcttcaaaatgga

SEQ ID NO: 83218 - DNA, 20 bp, synthetic construct
  misc_feature 1..20: note = CRISPR gRNA sequence
  source 1..20: mol_type = other DNA
tgtaaacacttggtgcctga

SEQ ID NO: 83219 - DNA, 20 bp, synthetic construct
  misc_feature 1..20: note = CRISPR gRNA sequence
  source 1..20: mol_type = other DNA
ccgatattcctcaggtactc

SEQ ID NO: 83220 - DNA, 20 bp, synthetic construct
  misc_feature 1..20: note = CRISPR gRNA sequence
  source 1..20: mol_type = other DNA
tcctcaggtactccaaagat

SEQ ID NO: 83221 - DNA, 20 bp, synthetic construct
  misc_feature 1..20: note = CRISPR gRNA sequence
  source 1..20: mol_type = other DNA
tttcctgaattgctatgtgt

SEQ ID NO: 83222 - DNA, 20 bp, synthetic construct
  misc_feature 1..20: note = CRISPR gRNA sequence
  source 1..20: mol_type = other DNA
tatgagtagtcatatcataa

SEQ ID NO: 83223 - DNA, 20 bp, synthetic construct
  misc_feature 1..20: note = CRISPR gRNA sequence
  source 1..20: mol_type = other DNA
tgatataaacaatctgcata

SEQ ID NO: 83224 - DNA, 20 bp, synthetic construct
  misc_feature 1..20: note = CRISPR gRNA sequence
  source 1..20: mol_type = other DNA
gtcagggaatgttcttaaag

SEQ ID NO: 83225 - DNA, 20 bp, synthetic construct
  misc_feature 1..20: note = CRISPR gRNA sequence
  source 1..20: mol_type = other DNA
gctgagatactgatgcacag

SEQ ID NO: 83226 - DNA, 20 bp, synthetic construct
  misc_feature 1..20: note = CRISPR gRNA sequence
  source 1..20: mol_type = other DNA
cacagcatggtttctgaacc

SEQ ID NO: 83227 - DNA, 20 bp, synthetic construct
  misc_feature 1..20: note = CRISPR gRNA sequence
  source 1..20: mol_type = other DNA
actcttaacacttcttacct

SEQ ID NO: 83228 - DNA, 20 bp, synthetic construct
  misc_feature 1..20: note = CRISPR gRNA sequence
  source 1..20: mol_type = other DNA
cttcttacctactggcttcc

SEQ ID NO: 83229 - DNA, 20 bp, synthetic construct
  misc_feature 1..20: note = CRISPR gRNA sequence
  source 1..20: mol_type = other DNA
tggcttcctctagcttttgt

SEQ ID NO: 83230 - DNA, 20 bp, synthetic construct
  misc_feature 1..20: note = CRISPR gRNA sequence
  source 1..20: mol_type = other DNA
catctcaagaaggtataggc

SEQ ID NO: 83231 - DNA, 20 bp, synthetic construct
  misc_feature 1..20: note = CRISPR gRNA sequence
  source 1..20: mol_type = other DNA
gacttctccagtactttctg

SEQ ID NO: 83232 - DNA, 20 bp, synthetic construct
  misc_feature 1..20: note = CRISPR gRNA sequence
  source 1..20: mol_type = other DNA
tggtatctgaggctagtagg

SEQ ID NO: 83233 - DNA, 20 bp, synthetic construct
  misc_feature 1..20: note = CRISPR gRNA sequence
  source 1..20: mol_type = other DNA
atgtaagcagcatcatggag

SEQ ID NO: 83234 - DNA, 20 bp, synthetic construct
  misc_feature 1..20: note = CRISPR gRNA sequence
  source 1..20: mol_type = other DNA
gtaagtttttgaccttgaga

SEQ ID NO: 83235 - DNA, 20 bp, synthetic construct
  misc_feature 1..20: note = CRISPR gRNA sequence
  source 1..20: mol_type = other DNA
ttttgaccttgagaaaatgt

SEQ ID NO: 83236 - DNA, 20 bp, synthetic construct
  misc_feature 1..20: note = CRISPR gRNA sequence
  source 1..20: mol_type = other DNA
gtggttacccacattacctg

SEQ ID NO: 83237 - DNA, 20 bp, synthetic construct
  misc_feature 1..20: note = CRISPR gRNA sequence
  source 1..20: mol_type = other DNA
cactcttttcctttgtataa

SEQ ID NO: 83238 - DNA, 20 bp, synthetic construct
  misc_feature 1..20: note = CRISPR gRNA sequence
  source 1..20: mol_type = other DNA
atcccattcctgtatgggga

SEQ ID NO: 83239 - DNA, 20 bp, synthetic construct
  misc_feature 1..20: note = CRISPR gRNA sequence
  source 1..20: mol_type = other DNA
cactagaggagataaaggga

SEQ ID NO: 83240 - DNA, 20 bp, synthetic construct
  misc_feature 1..20: note = CRISPR gRNA sequence
  source 1..20: mol_type = other DNA
tgcatctttagttggagtcc

SEQ ID NO: 83241 - DNA, 20 bp, synthetic construct
  misc_feature 1..20: note = CRISPR gRNA sequence
  source 1..20: mol_type = other DNA
tgttatattctagaacaggg

SEQ ID NO: 83242 - DNA, 20 bp, synthetic construct
  misc_feature 1..20: note = CRISPR gRNA sequence
  source 1..20: mol_type = other DNA
tgacggggacatgttctgag

SEQ ID NO: 83243 - DNA, 20 bp, synthetic construct
  misc_feature 1..20: note = CRISPR gRNA sequence
  source 1..20: mol_type = other DNA
tcatatcagcattttttctt

SEQ ID NO: 83244 - DNA, 20 bp, synthetic construct
  misc_feature 1..20: note = CRISPR gRNA sequence
  source 1..20: mol_type = other DNA
aacaggatatactctttata

SEQ ID NO: 83245 - DNA, 20 bp, synthetic construct
  misc_feature 1..20: note = CRISPR gRNA sequence
  source 1..20: mol_type = other DNA
atctacacagtagaaattag

SEQ ID NO: 83246 - DNA, 20 bp, synthetic construct
  misc_feature 1..20: note = CRISPR gRNA sequence
  source 1..20: mol_type = other DNA
ctaacctttttcttttcttt

SEQ ID NO: 83247 - DNA, 20 bp, synthetic construct
  misc_feature 1..20: note = CRISPR gRNA sequence
  source 1..20: mol_type = other DNA
tcaggtttgaagatgccgca

SEQ ID NO: 83248 - DNA, 20 bp, synthetic construct
  misc_feature 1..20: note = CRISPR gRNA sequence
  source 1..20: mol_type = other DNA
tggattggatgaattccaaa

SEQ ID NO: 83249 - DNA, 20 bp, synthetic construct
  misc_feature 1..20: note = CRISPR gRNA sequence
  source 1..20: mol_type = other DNA
ttggatgaattccaaattct

SEQ ID NO: 83250 - DNA, 20 bp, synthetic construct
  misc_feature 1..20: note = CRISPR gRNA sequence
  source 1..20: mol_type = other DNA
atgaattccaaattctgctt

SEQ ID NO: 83251 - DNA, 20 bp, synthetic construct
  misc_feature 1..20: note = CRISPR gRNA sequence
  source 1..20: mol_type = other DNA
ttgcttgctttttaatattg

SEQ ID NO: 83252 - DNA, 20 bp, synthetic construct
  misc_feature 1..20: note = CRISPR gRNA sequence
  source 1..20: mol_type = other DNA
ttctactttgagtgctgtct

SEQ ID NO: 83253 - DNA, 20 bp, synthetic construct
  misc_feature 1..20: note = CRISPR gRNA sequence
  source 1..20: mol_type = other DNA
tatccaacatcaacatcttg

SEQ ID NO: 83254 - DNA, 20 bp, synthetic construct
  misc_feature 1..20: note = CRISPR gRNA sequence
  source 1..20: mol_type = other DNA
actcttcaatctcttgcact

SEQ ID NO: 83255 - DNA, 20 bp, synthetic construct
  misc_feature 1..20: note = CRISPR gRNA sequence
  source 1..20: mol_type = other DNA
gttaacttccaatttacata

SEQ ID NO: 83256 - DNA, 20 bp, synthetic construct
  misc_feature 1..20: note = CRISPR gRNA sequence
  source 1..20: mol_type = other DNA
aaaatttagaaatataattg

SEQ ID NO: 83257 - DNA, 20 bp, synthetic construct
  misc_feature 1..20: note = CRISPR gRNA sequence
  source 1..20: mol_type = other DNA
tgaatgaaacattttgtcat

SEQ ID NO: 83258 - DNA, 20 bp, synthetic construct
  misc_feature 1..20: note = CRISPR gRNA sequence
  source 1..20: mol_type = other DNA
taaggcatggttgtggttaa

SEQ ID NO: 83259 - DNA, 20 bp, synthetic construct
  misc_feature 1..20: note = CRISPR gRNA sequence
  source 1..20: mol_type = other DNA
aaatgtgaaccccttgtata

SEQ ID NO: 83260 - DNA, 20 bp, synthetic construct
  misc_feature 1..20: note = CRISPR gRNA sequence
  source 1..20: mol_type = other DNA
tttaccaagtggaacttgaa

SEQ ID NO: 83261 - DNA, 20 bp, synthetic construct
  misc_feature 1..20: note = CRISPR gRNA sequence
  source 1..20: mol_type = other DNA
gtggaacttgaagactgttt

SEQ ID NO: 83262 - DNA, 20 bp, synthetic construct
  misc_feature 1..20: note = CRISPR gRNA sequence
  source 1..20: mol_type = other DNA
gagatataagagataacaca

SEQ ID NO: 83263 - DNA, 20 bp, synthetic construct
  misc_feature 1..20: note = CRISPR gRNA sequence
  source 1..20: mol_type = other DNA
aagagataacacatcaagtt

SEQ ID NO: 83264 - DNA, 20 bp, synthetic construct
  misc_feature 1..20: note = CRISPR gRNA sequence
  source 1..20: mol_type = other DNA
aacttgtggaacaaaaataa

SEQ ID NO: 83265 - DNA, 20 bp, synthetic construct
  misc_feature 1..20: note = CRISPR gRNA sequence
  source 1..20: mol_type = other DNA
aatatgaatcttatatgaca

SEQ ID NO: 83266 - DNA, 20 bp, synthetic construct
  misc_feature 1..20: note = CRISPR gRNA sequence
  source 1..20: mol_type = other DNA
taaattggaagttaacttat

SEQ ID NO: 83267 - DNA, 20 bp, synthetic construct
  misc_feature 1..20: note = CRISPR gRNA sequence
  source 1..20: mol_type = other DNA
atgcacgcttaactatctta

SEQ ID NO: 83268 - DNA, 20 bp, synthetic construct
  misc_feature 1..20: note = CRISPR gRNA sequence
  source 1..20: mol_type = other DNA
tcttaacaagctttgagtgc

SEQ ID NO: 83269 - DNA, 20 bp, synthetic construct
  misc_feature 1..20: note = CRISPR gRNA sequence
  source 1..20: mol_type = other DNA
ttagcaatgaatttatttta

SEQ ID NO: 83270 - DNA, 20 bp, synthetic construct
  misc_feature 1..20: note = CRISPR gRNA sequence
  source 1..20: mol_type = other DNA
tagaagaaaaaatgctgata

SEQ ID NO: 83271 - DNA, 20 bp, synthetic construct
  misc_feature 1..20: note = CRISPR gRNA sequence
  source 1..20: mol_type = other DNA
gtatatatgacagtggtctc

SEQ ID NO: 83272 - DNA, 20 bp, synthetic construct
  misc_feature 1..20: note = CRISPR gRNA sequence
  source 1..20: mol_type = other DNA
gcatatttttactgcaactt

SEQ ID NO: 83273 - DNA, 20 bp, synthetic construct
  misc_feature 1..20: note = CRISPR gRNA sequence
  source 1..20: mol_type = other DNA
tcagtacagtaacaggctgt

SEQ ID NO: 83274 - DNA, 20 bp, synthetic construct
  misc_feature 1..20: note = CRISPR gRNA sequence
  source 1..20: mol_type = other DNA
cgtgtagtaggctacaacac

SEQ ID NO: 83275 - DNA, 20 bp, synthetic construct
  misc_feature 1..20: note = CRISPR gRNA sequence
  source 1..20: mol_type = other DNA
tccctgttctagaatataac

SEQ ID NO: 83276 - DNA, 20 bp, synthetic construct
  misc_feature 1..20: note = CRISPR gRNA sequence
  source 1..20: mol_type = other DNA
aatataacaggagatttgaa

SEQ ID NO: 83277 - DNA, 20 bp, synthetic construct
  misc_feature 1..20: note = CRISPR gRNA sequence
  source 1..20: mol_type = other DNA
agtccaagttcctccctctc

SEQ ID NO: 83278 - DNA, 20 bp, synthetic construct
  misc_feature 1..20: note = CRISPR gRNA sequence
  source 1..20: mol_type = other DNA
cattatatcaagttataaca

SEQ ID NO: 83279 - DNA, 20 bp, synthetic construct
  misc_feature 1..20: note = CRISPR gRNA sequence
  source 1..20: mol_type = other DNA
ggagaagggaacatgaccct

SEQ ID NO: 83280 - DNA, 20 bp, synthetic construct
  misc_feature 1..20: note = CRISPR gRNA sequence
  source 1..20: mol_type = other DNA
tcaaaaacttacctccatga

SEQ ID NO: 83281 - DNA, 20 bp, synthetic construct
  misc_feature 1..20: note = CRISPR gRNA sequence
  source 1..20: mol_type = other DNA
ggagaaaaaaaaggaagaca

SEQ ID NO: 83282 - DNA, 20 bp, synthetic construct
  misc_feature 1..20: note = CRISPR gRNA sequence
  source 1..20: mol_type = other DNA
gctgttcctacccatgaata

SEQ ID NO: 83283 - DNA, 20 bp, synthetic construct
  misc_feature 1..20: note = CRISPR gRNA sequence
  source 1..20: mol_type = other DNA
ccagaaagtactggagaagt

SEQ ID NO: 83284 - DNA, 20 bp, synthetic construct
  misc_feature 1..20: note = CRISPR gRNA sequence
  source 1..20: mol_type = other DNA
attccctgacaatcccaata

SEQ ID NO: 83285 - DNA, 20 bp, synthetic construct
  misc_feature 1..20: note = CRISPR gRNA sequence
  source 1..20: mol_type = other DNA
cctgacaatcccaatatgca

SEQ ID NO: 83286 - DNA, 20 bp, synthetic construct
  misc_feature 1..20: note = CRISPR gRNA sequence
  source 1..20: mol_type = other DNA
atagaccttttttatatcaa

SEQ ID NO: 83287 - DNA, 20 bp, synthetic construct
  misc_feature 1..20: note = CRISPR gRNA sequence
  source 1..20: mol_type = other DNA
actactcatacacaactttc

SEQ ID NO: 83288 - DNA, 20 bp, synthetic construct
  misc_feature 1..20: note = CRISPR gRNA sequence
  source 1..20: mol_type = other DNA
gtcaagctatatcaggcacc

SEQ ID NO: 83289 - DNA, 20 bp, synthetic construct
  misc_feature 1..20: note = CRISPR gRNA sequence
  source 1..20: mol_type = other DNA
accaagtgtttacatttggt

SEQ ID NO: 83290 - DNA, 20 bp, synthetic construct
  misc_feature 1..20: note = CRISPR gRNA sequence
  source 1..20: mol_type = other DNA
tccatttccactctggccaa

SEQ ID NO: 83291 - DNA, 20 bp, synthetic construct
  misc_feature 1..20: note = CRISPR gRNA sequence
  source 1..20: mol_type = other DNA
aattcctctatacatgcctt

SEQ ID NO: 83292 - DNA, 20 bp, synthetic construct
  misc_feature 1..20: note = CRISPR gRNA sequence
  source 1..20: mol_type = other DNA
gccttttttgttttttttct

SEQ ID NO: 83293 - DNA, 20 bp, synthetic construct
  misc_feature 1..20: note = CRISPR gRNA sequence
  source 1..20: mol_type = other DNA
ctagcagtatcttctgtcac

SEQ ID NO: 83294 - DNA, 20 bp, synthetic construct
  misc_feature 1..20: note = CRISPR gRNA sequence
  source 1..20: mol_type = other DNA
aacacatcactcaagagtct

SEQ ID NO: 83295 - DNA, 20 bp, synthetic construct
  misc_feature 1..20: note = CRISPR gRNA sequence
  source 1..20: mol_type = other DNA
aaattactcatgttattgta

SEQ ID NO: 83296 - DNA, 20 bp, synthetic construct
  misc_feature 1..20: note = CRISPR gRNA sequence
  source 1..20: mol_type = other DNA
caccccttccattttttttc

SEQ ID NO: 83297 - DNA, 20 bp, synthetic construct
  misc_feature 1..20: note = CRISPR gRNA sequence
  source 1..20: mol_type = other DNA
tcctgccttgatctacaccc

SEQ ID NO: 83298 - DNA, 20 bp, synthetic construct
  misc_feature 1..20: note = CRISPR gRNA sequence
  source 1..20: mol_type = other DNA
aacctccgcctcctgggttc

SEQ ID NO: 83299 - DNA, 20 bp, synthetic construct
  misc_feature 1..20: note = CRISPR gRNA sequence
  source 1..20: mol_type = other DNA
tttttgtattttcagtagag

SEQ ID NO: 83300 - DNA, 20 bp, synthetic construct
  misc_feature 1..20: note = CRISPR gRNA sequence
  source 1..20: mol_type = other DNA
tgccttggcctcccaaagtg

SEQ ID NO: 83301 - DNA, 20 bp, synthetic construct
  misc_feature 1..20: note = CRISPR gRNA sequence
  source 1..20: mol_type = other DNA
caaaacctctttatttctgc

SEQ ID NO: 83302 - DNA, 20 bp, synthetic construct
  misc_feature 1..20: note = CRISPR gRNA sequence
  source 1..20: mol_type = other DNA
atggagtaatgcatgtgaca

SEQ ID NO: 83303 - DNA, 20 bp, synthetic construct
  misc_feature 1..20: note = CRISPR gRNA sequence
  source 1..20: mol_type = other DNA
aatgcatgtgacagtgggat

SEQ ID NO: 83304 - DNA, 20 bp, synthetic construct
  misc_feature 1..20: note = CRISPR gRNA sequence
  source 1..20: mol_type = other DNA
gcgttttaattagcatccac

SEQ ID NO: 83305 - DNA, 20 bp, synthetic construct
  misc_feature 1..20: note = CRISPR gRNA sequence
  source 1..20: mol_type = other DNA
caggttgggaatatattgcc

SEQ ID NO: 83306 - DNA, 20 bp, synthetic construct
  misc_feature 1..20: note = CRISPR gRNA sequence
  source 1..20: mol_type = other DNA
agtgttagtgctactaaata

SEQ ID NO: 83307 - DNA, 20 bp, synthetic construct
  misc_feature 1..20: note = CRISPR gRNA sequence
  source 1..20: mol_type = other DNA
ggctactagccccatcaaga

SEQ ID NO: 83308 - DNA, 20 bp, synthetic construct
  misc_feature 1..20: note = CRISPR gRNA sequence
  source 1..20: mol_type = other DNA
gattggggaatctaatgaag

SEQ ID NO: 83309 - DNA, 20 bp, synthetic construct
  misc_feature 1..20: note = CRISPR gRNA sequence
  source 1..20: mol_type = other DNA
gctaagagagctctttgcat

SEQ ID NO: 83310 - DNA, 20 bp, synthetic construct
  misc_feature 1..20: note = CRISPR gRNA sequence
  source 1..20: mol_type = other DNA
aaatgcctcagggatcagag

SEQ ID NO: 83311 - DNA, 20 bp, synthetic construct
  misc_feature 1..20: note = CRISPR gRNA sequence
  source 1..20: mol_type = other DNA
gattcatcctgcctggaact

SEQ ID NO: 83312 - DNA, 20 bp, synthetic construct
  misc_feature 1..20: note = CRISPR gRNA sequence
  source 1..20: mol_type = other DNA
tctctgtttgagggaaggcg

SEQ ID NO: 83313 - DNA, 20 bp, synthetic construct
  misc_feature 1..20: note = CRISPR gRNA sequence
  source 1..20: mol_type = other DNA
gaggacaagtatcagacagg

SEQ ID NO: 83314 - DNA, 20 bp, synthetic construct
  misc_feature 1..20: note = CRISPR gRNA sequence
  source 1..20: mol_type = other DNA
gaatttgggctcaaccagtt

SEQ ID NO: 83315 - DNA, 20 bp, synthetic construct
  misc_feature 1..20: note = CRISPR gRNA sequence
  source 1..20: mol_type = other DNA
tatgacttttggagagttat

SEQ ID NO: 83316 - DNA, 20 bp, synthetic construct
  misc_feature 1..20: note = CRISPR gRNA sequence
  source 1..20: mol_type = other DNA
cttcagaggcaatcatcatt

SEQ ID NO: 83317 - DNA, 20 bp, synthetic construct
  misc_feature 1..20: note = CRISPR gRNA sequence
  source 1..20: mol_type = other DNA
ttactttggaaattttcaaa

SEQ ID NO: 83318 - DNA, 20 bp, synthetic construct
  misc_feature 1..20: note = CRISPR gRNA sequence
  source 1..20: mol_type = other DNA
aataagatttttttttaaat

SEQ ID NO: 83319 - DNA, 20 bp, synthetic construct
  misc_feature 1..20: note = CRISPR gRNA sequence
  source 1..20: mol_type = other DNA
attttctcatgatcaaaaca

SEQ ID NO: 83320 - DNA, 20 bp, synthetic construct
  misc_feature 1..20: note = CRISPR gRNA sequence
  source 1..20: mol_type = other DNA
tcaaaacattctgctttcga

SEQ ID NO: 83321 - DNA, 20 bp, synthetic construct
  misc_feature 1..20: note = CRISPR gRNA sequence
  source 1..20: mol_type = other DNA
tttgccagaggaaaaggtga

SEQ ID NO: 83322 - DNA, 20 bp, synthetic construct
  misc_feature 1..20: note = CRISPR gRNA sequence
  source 1..20: mol_type = other DNA
tcaacagtcttggtaaccat

SEQ ID NO: 83323 - DNA, 20 bp, synthetic construct
  misc_feature 1..20: note = CRISPR gRNA sequence
  source 1..20: mol_type = other DNA
catcttggattatctttatt

SEQ ID NO: 83324 - DNA, 20 bp, synthetic construct
  misc_feature 1..20: note = CRISPR gRNA sequence
  source 1..20: mol_type = other DNA
gttattattttttgtagaga

SEQ ID NO: 83325 - DNA, 20 bp, synthetic construct
  misc_feature 1..20: note = CRISPR gRNA sequence
  source 1..20: mol_type = other DNA
cgcctcggcctccctaagtg

SEQ ID NO: 83326 - DNA, 20 bp, synthetic construct
  misc_feature 1..20: note = CRISPR gRNA sequence
  source 1..20: mol_type = other DNA
agctaccacgcccaaccccc

SEQ ID NO: 83327 - DNA, 20 bp, synthetic construct
  misc_feature 1..20: note = CRISPR gRNA sequence
  source 1..20: mol_type = other DNA
agaccacagggcccatgccg

SEQ ID NO: 83328 - DNA, 20 bp, synthetic construct
  misc_feature 1..20: note = CRISPR gRNA sequence
  source 1..20: mol_type = other DNA
gagaatctcacgcagaaggc

SEQ ID NO: 83329 - DNA, 20 bp, synthetic construct
  misc_feature 1..20: note = CRISPR gRNA sequence
  source 1..20: mol_type = other DNA
cgctcccgcaaaagccctgg

SEQ ID NO: 83330 - DNA, 20 bp, synthetic construct
  misc_feature 1..20: note = CRISPR gRNA sequence
  source 1..20: mol_type = other DNA
ctggttaggcttgacttcaa

SEQ ID NO: 83331 - DNA, 20 bp, synthetic construct
  misc_feature 1..20: note = CRISPR gRNA sequence
  source 1..20: mol_type = other DNA
gccatttatcccctgtgtaa

SEQ ID NO: 83332 - DNA, 20 bp, synthetic construct
  misc_feature 1..20: note = CRISPR gRNA sequence
  source 1..20: mol_type = other DNA
gtttcttaaaatctcggtgc

SEQ ID NO: 83333 - DNA, 20 bp, synthetic construct
  misc_feature 1..20: note = CRISPR gRNA sequence
  source 1..20: mol_type = other DNA
agttatctatggcggaagat

SEQ ID NO: 83334 - DNA, 20 bp, synthetic construct
  misc_feature 1..20: note = CRISPR gRNA sequence
  source 1..20: mol_type = other DNA
caaataagttaattattcga

SEQ ID NO: 83335 - DNA, 20 bp, synthetic construct
  misc_feature 1..20: note = CRISPR gRNA sequence
  source 1..20: mol_type = other DNA
agcattctacaaacgtcgcg

SEQ ID NO: 83336 - DNA, 20 bp, synthetic construct
  misc_feature 1..20: note = CRISPR gRNA sequence
  source 1..20: mol_type = other DNA
gggaagcagagccgcagcag

SEQ ID NO: 83337 - DNA, 20 bp, synthetic construct
  misc_feature 1..20: note = CRISPR gRNA sequence
  source 1..20: mol_type = other DNA
ctcccccaacctcggcgctc

SEQ ID NO: 83338 - DNA, 20 bp, synthetic construct
  misc_feature 1..20: note = CRISPR gRNA sequence
  source 1..20: mol_type = other DNA
tccccactcccaggccaccc

SEQ ID NO: 83339 - DNA, 20 bp, synthetic construct
  misc_feature 1..20: note = CRISPR gRNA sequence
  source 1..20: mol_type = other DNA
gacatctcggcccgaatgct

SEQ ID NO: 83340 - DNA, 20 bp, synthetic construct
  misc_feature 1..20: note = CRISPR gRNA sequence
  source 1..20: mol_type = other DNA
caggttagagagagggactt

SEQ ID NO: 83341 - DNA, 20 bp, synthetic construct
  misc_feature 1..20: note = CRISPR gRNA sequence
  source 1..20: mol_type = other DNA
ggaaacagcacgcgacgttt

SEQ ID NO: 83342 - DNA, 20 bp, synthetic construct
  misc_feature 1..20: note = CRISPR gRNA sequence
  source 1..20: mol_type = other DNA
atcttctgcctctcacagat

SEQ ID NO: 83343 - DNA, 20 bp, synthetic construct
  misc_feature 1..20: note = CRISPR gRNA sequence
  source 1..20: mol_type = other DNA
aaactaaggcaccgagattt

SEQ ID NO: 83344 - DNA, 20 bp, synthetic construct
  misc_feature 1..20: note = CRISPR gRNA sequence
  source 1..20: mol_type = other DNA
gtaattcgtgcatttttttt

SEQ ID NO: 83345 - DNA, 20 bp, synthetic construct
  misc_feature 1..20: note = CRISPR gRNA sequence
  source 1..20: mol_type = other DNA
gcgagaccctgtctctcaaa

SEQ ID NO: 83346 - DNA, 20 bp, synthetic construct
  misc_feature 1..20: note = CRISPR gRNA sequence
  source 1..20: mol_type = other DNA
caaaaaagaaaaaaaaaaaa

SEQ ID NO: 83347 - DNA, 20 bp, synthetic construct
  misc_feature 1..20: note = CRISPR gRNA sequence
  source 1..20: mol_type = other DNA
agaaaaaaaaaaaaaaagaa

SEQ ID NO: 83348 - DNA, 20 bp, synthetic construct
  misc_feature 1..20: note = CRISPR gRNA sequence
  source 1..20: mol_type = other DNA
aaaaaaaaaaaagaaagaga

SEQ ID NO: 83349 - DNA, 20 bp, synthetic construct
  misc_feature 1..20: note = CRISPR gRNA sequence
  source 1..20: mol_type = other DNA
aaaaaaagaaagagaaaaga

SEQ ID NO: 83350 - DNA, 20 bp, synthetic construct
  misc_feature 1..20: note = CRISPR gRNA sequence
  source 1..20: mol_type = other DNA
aaagaaagagaaaagaaaag

SEQ ID NO: 83351 - DNA, 20 bp, synthetic construct
  misc_feature 1..20: note = CRISPR gRNA sequence
  source 1..20: mol_type = other DNA
ctggcaaaacatgatcgaaa

SEQ ID NO: 83352 - DNA, 20 bp, synthetic construct
  misc_feature 1..20: note = CRISPR gRNA sequence
  source 1..20: mol_type = other DNA
aaagcagaatgttttgatca

SEQ ID NO: 83353 - DNA, 20 bp, synthetic construct
  misc_feature 1..20: note = CRISPR gRNA sequence
  source 1..20: mol_type = other DNA
accatttctggaagatacca

SEQ ID NO: 83354 - DNA, 20 bp, synthetic construct
  misc_feature 1..20: note = CRISPR gRNA sequence
  source 1..20: mol_type = other DNA
gtctgatacttgtcctcttc

SEQ ID NO: 83355 - DNA, 20 bp, synthetic construct
  misc_feature 1..20: note = CRISPR gRNA sequence
  source 1..20: mol_type = other DNA
cctgaatataagtgtattta

SEQ ID NO: 83356 - DNA, 20 bp, synthetic construct
  misc_feature 1..20: note = CRISPR gRNA sequence
  source 1..20: mol_type = other DNA
gtctggcatataaaacctca

SEQ ID NO: 83357 - DNA, 20 bp, synthetic construct
  misc_feature 1..20: note = CRISPR gRNA sequence
  source 1..20: mol_type = other DNA
tactagacacttcatacagt

SEQ ID NO: 83358 - DNA, 20 bp, synthetic construct
  misc_feature 1..20: note = CRISPR gRNA sequence
  source 1..20: mol_type = other DNA
aaggcaggagcaggaaccaa

SEQ ID NO: 83359 - DNA, 20 bp, synthetic construct
  misc_feature 1..20: note = CRISPR gRNA sequence
  source 1..20: mol_type = other DNA
caaaaagaaaggcataaaca

SEQ ID NO: 83360 - DNA, 20 bp, synthetic construct
  misc_feature 1..20: note = CRISPR gRNA sequence
  source 1..20: mol_type = other DNA
tgatgggggctattatgaac

SEQ ID NO: 83361 - DNA, 20 bp, synthetic construct
  misc_feature 1..20: note = CRISPR gRNA sequence
  source 1..20: mol_type = other DNA
agaagtccttgagagcctcc

SEQ ID NO: 83362 - DNA, 20 bp, synthetic construct
  misc_feature 1..20: note = CRISPR gRNA sequence
  source 1..20: mol_type = other DNA
tccagtgacagaagatactg

SEQ ID NO: 83363 - DNA, 20 bp, synthetic construct
  misc_feature 1..20: note = CRISPR gRNA sequence
  source 1..20: mol_type = other DNA
aagatactgctagaaatctg

SEQ ID NO: 83364 - DNA, 20 bp, synthetic construct
  misc_feature 1..20: note = CRISPR gRNA sequence
  source 1..20: mol_type = other DNA
ccagagtggaaatggaattg

SEQ ID NO: 83365 - DNA, 20 bp, synthetic construct
  misc_feature 1..20: note = CRISPR gRNA sequence
  source 1..20: mol_type = other DNA
gtttactcacgtcatccagc

SEQ ID NO: 83366 - DNA, 20 bp, synthetic construct
  misc_feature 1..20: note = CRISPR gRNA sequence
  source 1..20: mol_type = other DNA
gacattgaagttgacttact

SEQ ID NO: 83367 - DNA, 20 bp, synthetic construct
  misc_feature 1..20: note = CRISPR gRNA sequence
  source 1..20: mol_type = other DNA
tgacttactgaagaatggag

SEQ ID NO: 83368 - DNA, 20 bp, synthetic construct
  misc_feature 1..20: note = CRISPR gRNA sequence
  source 1..20: mol_type = other DNA
tggaggtaagtttttgacct

SEQ ID NO: 83369 - DNA, 20 bp, synthetic construct
  misc_feature 1..20: note = CRISPR gRNA sequence
  source 1..20: mol_type = other DNA
gtaacattttagcagggaaa

SEQ ID NO: 83370 - DNA, 20 bp, synthetic construct
  misc_feature 1..20: note = CRISPR gRNA sequence
  source 1..20: mol_type = other DNA
attggacatctctgctgagg

SEQ ID NO: 83371 - DNA, 20 bp, synthetic construct
  misc_feature 1..20: note = CRISPR gRNA sequence
  source 1..20: mol_type = other DNA
ttaatgacggggacatgttc

SEQ ID NO: 83372 - DNA, 20 bp, synthetic construct
  misc_feature 1..20: note = CRISPR gRNA sequence
  source 1..20: mol_type = other DNA
ttaaaaaggtgatctacaca

SEQ ID NO: 83373 - DNA, 20 bp, synthetic construct
  misc_feature 1..20: note = CRISPR gRNA sequence
  source 1..20: mol_type = other DNA
gcaacttagaggtggggagc

SEQ ID NO: 83374 - DNA, 20 bp, synthetic construct
  misc_feature 1..20: note = CRISPR gRNA sequence
  source 1..20: mol_type = other DNA
ttccaatttacatactctgc

SEQ ID NO: 83375 - DNA, 20 bp, synthetic construct
  misc_feature 1..20: note = CRISPR gRNA sequence
  source 1..20: mol_type = other DNA
cttagaatttgggggaaaat

SEQ ID NO: 83376 - DNA, 20 bp, synthetic construct
  misc_feature 1..20: note = CRISPR gRNA sequence
  source 1..20: mol_type = other DNA
caagatgttgatgttggata

SEQ ID NO: 83377 - DNA, 20 bp, synthetic construct
  misc_feature 1..20: note = CRISPR gRNA sequence
  source 1..20: mol_type = other DNA
acatggagacagcactcaaa

SEQ ID NO: 83378 - DNA, 20 bp, synthetic construct
  misc_feature 1..20: note = CRISPR gRNA sequence
  source 1..20: mol_type = other DNA
caatattaaaaagcaagcaa

SEQ ID NO: 83379 - DNA, 20 bp, synthetic construct
  misc_feature 1..20: note = CRISPR gRNA sequence
  source 1..20: mol_type = other DNA
tgcggcatcttcaaacctga

SEQ ID NO: 83380 - DNA, 20 bp, synthetic construct
  misc_feature 1..20: note = CRISPR gRNA sequence
  source 1..20: mol_type = other DNA
catcttcaaacctgaaaaga

SEQ ID NO: 83381 - DNA, 20 bp, synthetic construct
  misc_feature 1..20: note = CRISPR gRNA sequence
  source 1..20: mol_type = other DNA
ttggtgctcccaaaatctta

SEQ ID NO: 83382 - DNA, 20 bp, synthetic construct
  misc_feature 1..20: note = CRISPR gRNA sequence
  source 1..20: mol_type = other DNA
tcccaaatcaattccctgtt

SEQ ID NO: 83383 - DNA, 20 bp, synthetic construct
  misc_feature 1..20: note = CRISPR gRNA sequence
  source 1..20: mol_type = other DNA
gcatcaatgtaccctgggca

SEQ ID NO: 83384 - DNA, 20 bp, synthetic construct
  misc_feature 1..20: note = CRISPR gRNA sequence
  source 1..20: mol_type = other DNA
ataactcctctcttctgtct

SEQ ID NO: 83385 - DNA, 20 bp, synthetic construct
  misc_feature 1..20: note = CRISPR gRNA sequence
  source 1..20: mol_type = other DNA
tgtccaatgtggaaatggca

SEQ ID NO: 83386 - DNA, 20 bp, synthetic construct
  misc_feature 1..20: note = CRISPR gRNA sequence
  source 1..20: mol_type = other DNA
cgatctatgaaaaagacagt

SEQ ID NO: 83387 - DNA, 20 bp, synthetic construct
  misc_feature 1..20: note = CRISPR gRNA sequence
  source 1..20: mol_type = other DNA
ctaacaaatgtctaaaatgg

SEQ ID NO: 83388 - DNA, 20 bp, synthetic construct
  misc_feature 1..20: note = CRISPR gRNA sequence
  source 1..20: mol_type = other DNA
aatggttagaaataaggctg

SEQ ID NO: 83389 - DNA, 20 bp, synthetic construct
  misc_feature 1..20: note = CRISPR gRNA sequence
  source 1..20: mol_type = other DNA
agcctcagataccaatccag

SEQ ID NO: 83390 - DNA, 20 bp, synthetic construct
  misc_feature 1..20: note = CRISPR gRNA sequence
  source 1..20: mol_type = other DNA
actgcagggaaactactggt

SEQ ID NO: 83391 - DNA, 20 bp, synthetic construct
  misc_feature 1..20: note = CRISPR gRNA sequence
  source 1..20: mol_type = other DNA
acaactttcagcagcttaca

SEQ ID NO: 83392 - DNA, 20 bp, synthetic construct
  misc_feature 1..20: note = CRISPR gRNA sequence
  source 1..20: mol_type = other DNA
aattcagtgtagtacaagag

SEQ ID NO: 83393 - DNA, 20 bp, synthetic construct
  misc_feature 1..20: note = CRISPR gRNA sequence
  source 1..20: mol_type = other DNA
caacaagccacctccatttt

SEQ ID NO: 83394 - DNA, 20 bp, synthetic construct
  misc_feature 1..20: note = CRISPR gRNA sequence
  source 1..20: mol_type = other DNA
aatttcatgagctaaaaaac

SEQ ID NO: 83395 - DNA, 20 bp, synthetic construct
  misc_feature 1..20: note = CRISPR gRNA sequence
  source 1..20: mol_type = other DNA
ggaatatattgcctaatgtt

SEQ ID NO: 83396 - DNA, 20 bp, synthetic construct
  misc_feature 1..20: note = CRISPR gRNA sequence
  source 1..20: mol_type = other DNA
gaccatccatggggaagtgg

SEQ ID NO: 83397 - DNA, 20 bp, synthetic construct
  misc_feature 1..20: note = CRISPR gRNA sequence
  source 1..20: mol_type = other DNA
ccttgaccagatatatctct

SEQ ID NO: 83398 - DNA, 20 bp, synthetic construct
  misc_feature 1..20: note = CRISPR gRNA sequence
  source 1..20: mol_type = other DNA
catgtttcttgtggtatctt

SEQ ID NO: 83399 - DNA, 20 bp, synthetic construct
  misc_feature 1..20: note = CRISPR gRNA sequence
  source 1..20: mol_type = other DNA
cttagtgtattgccaggtac

SEQ ID NO: 83400 - DNA, 20 bp, synthetic construct
  misc_feature 1..20: note = CRISPR gRNA sequence
  source 1..20: mol_type = other DNA
catgccgcccagtttgctct

SEQ ID NO: 83401 - DNA, 20 bp, synthetic construct
  misc_feature 1..20: note = CRISPR gRNA sequence
  source 1..20: mol_type = other DNA
gcacataaagtccttggcac

SEQ ID NO: 83402 - DNA, 20 bp, synthetic construct
  misc_feature 1..20: note = CRISPR gRNA sequence
  source 1..20: mol_type = other DNA
aggccccgcgaaagagcgga

SEQ ID NO: 83403 - DNA, 20 bp, synthetic construct
  misc_feature 1..20: note = CRISPR gRNA sequence
  source 1..20: mol_type = other DNA
cacgctggatagcctccagg

SEQ ID NO: 83404 - DNA, 20 bp, synthetic construct
  misc_feature 1..20: note = CRISPR gRNA sequence
  source 1..20: mol_type = other DNA
gctttgcgtcatttaatttt

SEQ ID NO: 83405 - DNA, 20 bp, synthetic construct
  misc_feature 1..20: note = CRISPR gRNA sequence
  source 1..20: mol_type = other DNA
ttcgtgcatttttttttaag

SEQ ID NO: 83406 - DNA, 20 bp, synthetic construct
  misc_feature 1..20: note = CRISPR gRNA sequence
  source 1..20: mol_type = other DNA
tgcctcttactttcggtttt

SEQ ID NO: 83407 - DNA, 20 bp, synthetic construct
  misc_feature 1..20: note = CRISPR gRNA sequence
  source 1..20: mol_type = other DNA
tttgtcagtcaggggagctg

SEQ ID NO: 83408 - DNA, 20 bp, synthetic construct
  misc_feature 1..20: note = CRISPR gRNA sequence
  source 1..20: mol_type = other DNA
gcgctcaccttttcctctgg

SEQ ID NO: 83409 - DNA, 20 bp, synthetic construct
  misc_feature 1..20: note = CRISPR gRNA sequence
  source 1..20: mol_type = other DNA
aatcacctgtggatgctaat

SEQ ID NO: 83410 - DNA, 20 bp, synthetic construct
  misc_feature 1..20: note = CRISPR gRNA sequence
  source 1..20: mol_type = other DNA
tcagagaggggtctggcata

SEQ ID NO: 83411 - DNA, 20 bp, synthetic construct
  misc_feature 1..20: note = CRISPR gRNA sequence
  source 1..20: mol_type = other DNA
tgctagaaatctgctagaaa

SEQ ID NO: 83412 - DNA, 20 bp, synthetic construct
  misc_feature 1..20: note = CRISPR gRNA sequence
  source 1..20: mol_type = other DNA
agtacatggtattttaaaag

SEQ ID NO: 83413 - DNA, 20 bp, synthetic construct
  misc_feature 1..20: note = CRISPR gRNA sequence
  source 1..20: mol_type = other DNA
atatacagtccatcattgac

SEQ ID NO: 83414 - DNA, 20 bp, synthetic construct
  misc_feature 1..20: note = CRISPR gRNA sequence
  source 1..20: mol_type = other DNA
tccacaagttaaataaatca

SEQ ID NO: 83415 - DNA, 20 bp, synthetic construct
  misc_feature 1..20: note = CRISPR gRNA sequence
  source 1..20: mol_type = other DNA
cctctcttctgtctgaagaa

SEQ ID NO: 83416 - DNA, 20 bp, synthetic construct
  misc_feature 1..20: note = CRISPR gRNA sequence
  source 1..20: mol_type = other DNA
agtcctcaggacagtgaaac

SEQ ID NO: 83417 - DNA, 20 bp, synthetic construct
  misc_feature 1..20: note = CRISPR gRNA sequence
  source 1..20: mol_type = other DNA
aaaaacattttctcaaggtc

SEQ ID NO: 83418 - DNA, 20 bp, synthetic construct
  misc_feature 1..20: note = CRISPR gRNA sequence
  source 1..20: mol_type = other DNA
ggtatgttcttaccaaacaa

SEQ ID NO: 83419 - DNA, 20 bp, synthetic construct
  misc_feature 1..20: note = CRISPR gRNA sequence
  source 1..20: mol_type = other DNA
gtacctaatttcatgagcta

SEQ ID NO: 83420 - DNA, 20 bp, synthetic construct
  misc_feature 1..20: note = CRISPR gRNA sequence
  source 1..20: mol_type = other DNA
tgagctaaaaaacaaagaaa

SEQ ID NO: 83421 - DNA, 20 bp, synthetic construct
  misc_feature 1..20: note = CRISPR gRNA sequence
  source 1..20: mol_type = other DNA
tggagagttatttaagcttc

SEQ ID NO: 83422 - DNA, 20 bp, synthetic construct
  misc_feature 1..20: note = CRISPR gRNA sequence
  source 1..20: mol_type = other DNA
aaattaatttatgcccacag

SEQ ID NO: 83423 - DNA, 20 bp, synthetic construct
  misc_feature 1..20: note = CRISPR gRNA sequence
  source 1..20: mol_type = other DNA
atttatgcccacagtaaaac

SEQ ID NO: 83424 - DNA, 20 bp, synthetic construct
  misc_feature 1..20: note = CRISPR gRNA sequence
  source 1..20: mol_type = other DNA
tgcccacagtaaaacaaaaa

SEQ ID NO: 83425 - DNA, 20 bp, synthetic construct
  misc_feature 1..20: note = CRISPR gRNA sequence
  source 1..20: mol_type = other DNA
aaatgcaattttctcatgat

SEQ ID NO: 83426 - DNA, 20 bp, synthetic construct
  misc_feature 1..20: note = CRISPR gRNA sequence
  source 1..20: mol_type = other DNA
gcccaaccccctcatgtttt

SEQ ID NO: 83427 - DNA, 20 bp, synthetic construct
  misc_feature 1..20: note = CRISPR gRNA sequence
  source 1..20: mol_type = other DNA
tctctaacctggcactgcgt

SEQ ID NO: 83428 - DNA, 20 bp, synthetic construct
  misc_feature 1..20: note = CRISPR gRNA sequence
  source 1..20: mol_type = other DNA
tctaacctggcactgcgtcg

SEQ ID NO: 83429 - DNA, 20 bp, synthetic construct
  misc_feature 1..20: note = CRISPR gRNA sequence
  source 1..20: mol_type = other DNA
taacctggcactgcgtcgct

SEQ ID NO: 83430 - DNA, 20 bp, synthetic construct
  misc_feature 1..20: note = CRISPR gRNA sequence
  source 1..20: mol_type = other DNA
acctggcactgcgtcgctgg

SEQ ID NO: 83431 - DNA, 20 bp, synthetic construct
  misc_feature 1..20: note = CRISPR gRNA sequence
  source 1..20: mol_type = other DNA
gcactgcgtcgctggcttgg

SEQ ID NO: 83432 - DNA, 20 bp, synthetic construct
  misc_feature 1..20: note = CRISPR gRNA sequence
  source 1..20: mol_type = other DNA
cgtcgctggcttggagacag

SEQ ID NO: 83433 - DNA, 20 bp, synthetic construct
  misc_feature 1..20: note = CRISPR gRNA sequence
  source 1..20: mol_type = other DNA
gcttggagacaggtgacggt

SEQ ID NO: 83434 - DNA, 20 bp, synthetic construct
  misc_feature 1..20: note = CRISPR gRNA sequence
  source 1..20: mol_type = other DNA
ggagacaggtgacggtccct

SEQ ID NO: 83435 - DNA, 20 bp, synthetic construct
  misc_feature 1..20: note = CRISPR gRNA sequence
  source 1..20: mol_type = other DNA
gagacaggtgacggtccctg

SEQ ID NO: 83436 - DNA, 20 bp, synthetic construct
  misc_feature 1..20: note = CRISPR gRNA sequence
  source 1..20: mol_type = other DNA
cgggccttgtcctgattggc

SEQ ID NO: 83437 - DNA, 20 bp, synthetic construct
  misc_feature 1..20: note = CRISPR gRNA sequence
  source 1..20: mol_type = other DNA
gtcctgattggctgggcacg

SEQ ID NO: 83438 - DNA, 20 bp, synthetic construct
  misc_feature 1..20: note = CRISPR gRNA sequence
  source 1..20: mol_type = other DNA
tcctgattggctgggcacgc

SEQ ID NO: 83439 - DNA, 20 bp, synthetic construct
  misc_feature 1..20: note = CRISPR gRNA sequence
  source 1..20: mol_type = other DNA
attggctgggcacgcgttta

SEQ ID NO: 83440 - DNA, 20 bp, synthetic construct
  misc_feature 1..20: note = CRISPR gRNA sequence
  source 1..20: mol_type = other DNA
gctgggcacgcgtttaatat

SEQ ID NO: 83441 - DNA, 20 bp, synthetic construct
  misc_feature 1..20: note = CRISPR gRNA sequence
  source 1..20: mol_type = other DNA
ggcacgcgtttaatataagt

SEQ ID NO: 83442 - DNA, 20 bp, synthetic construct
  misc_feature 1..20: note = CRISPR gRNA sequence
  source 1..20: mol_type = other DNA
aatataagtggaggcgtcgc

SEQ ID NO: 83443 - DNA, 20 bp, synthetic construct
  misc_feature 1..20: note = CRISPR gRNA sequence
  source 1..20: mol_type = other DNA
atataagtggaggcgtcgcg

SEQ ID NO: 83444 - DNA, 20 bp, synthetic construct
  misc_feature 1..20: note = CRISPR gRNA sequence
  source 1..20: mol_type = other DNA
gcgggcattcctgaagctga

SEQ ID NO: 83445 - DNA, 20 bp, synthetic construct
  misc_feature 1..20: note = CRISPR gRNA sequence
  source 1..20: mol_type = other DNA
ctgaagctgacagcattcgg

SEQ ID NO: 83446 - DNA, 20 bp, synthetic construct
  misc_feature 1..20: note = CRISPR gRNA sequence
  source 1..20: mol_type = other DNA
aagctgacagcattcgggcc

SEQ ID NO: 83447 - DNA, 20 bp, synthetic construct
  misc_feature 1..20: note = CRISPR gRNA sequence
  source 1..20: mol_type = other DNA
acagcattcgggccgagatg

SEQ ID NO: 83448 - DNA, 20 bp, synthetic construct
  misc_feature 1..20: note = CRISPR gRNA sequence
  source 1..20: mol_type = other DNA
gggccgagatgtctcgctcc

SEQ ID NO: 83449 - DNA, 20 bp, synthetic construct
  misc_feature 1..20: note = CRISPR gRNA sequence
  source 1..20: mol_type = other DNA
gctccgtggccttagctgtg

SEQ ID NO: 83450 - DNA, 20 bp, synthetic construct
  misc_feature 1..20: note = CRISPR gRNA sequence
  source 1..20: mol_type = other DNA
cgtggccttagctgtgctcg

SEQ ID NO: 83451 - DNA, 20 bp, synthetic construct
  misc_feature 1..20: note = CRISPR gRNA sequence
  source 1..20: mol_type = other DNA
agctgtgctcgcgctactct

SEQ ID NO: 83452 - DNA, 20 bp, synthetic construct
  misc_feature 1..20: note = CRISPR gRNA sequence
  source 1..20: mol_type = other DNA
gctgtgctcgcgctactctc

SEQ ID NO: 83453 - DNA, 20 bp, synthetic construct
  misc_feature 1..20: note = CRISPR gRNA sequence
  source 1..20: mol_type = other DNA
tgctcgcgctactctctctt

SEQ ID NO: 83454 - DNA, 20 bp, synthetic construct
  misc_feature 1..20: note = CRISPR gRNA sequence
  source 1..20: mol_type = other DNA
gcgctactctctctttctgg

SEQ ID NO: 83455 - DNA, 20 bp, synthetic construct
  misc_feature 1..20: note = CRISPR gRNA sequence
  source 1..20: mol_type = other DNA
ctctctctttctggcctgga

SEQ ID NO: 83456 - DNA, 20 bp, synthetic construct
  misc_feature 1..20: note = CRISPR gRNA sequence
  source 1..20: mol_type = other DNA
tctctttctggcctggaggc

SEQ ID NO: 83457 - DNA, 20 bp, synthetic construct
  misc_feature 1..20: note = CRISPR gRNA sequence
  source 1..20: mol_type = other DNA
tctttctggcctggaggcta

SEQ ID NO: 83458 - DNA, 20 bp, synthetic construct
  misc_feature 1..20: note = CRISPR gRNA sequence
  source 1..20: mol_type = other DNA
tttctggcctggaggctatc

SEQ ID NO: 83459 - DNA, 20 bp, synthetic construct
  misc_feature 1..20: note = CRISPR gRNA sequence
  source 1..20: mol_type = other DNA
tctggcctggaggctatcca

SEQ ID NO: 83460 - DNA, 20 bp, synthetic construct
  misc_feature 1..20: note = CRISPR gRNA sequence
  source 1..20: mol_type = other DNA
ctggcctggaggctatccag

SEQ ID NO: 83461 - DNA, 20 bp, synthetic construct
  misc_feature 1..20: note = CRISPR gRNA sequence
  source 1..20: mol_type = other DNA
tggcctggaggctatccagc

SEQ ID NO: 83462 - DNA, 20 bp, synthetic construct
  misc_feature 1..20: note = CRISPR gRNA sequence
  source 1..20: mol_type = other DNA
gcctggaggctatccagcgt

SEQ ID NO: 83463 - DNA, 20 bp, synthetic construct
  misc_feature 1..20: note = CRISPR gRNA sequence
  source 1..20: mol_type = other DNA
gaggctatccagcgtgagtc

SEQ ID NO: 83464 - DNA, 20 bp, synthetic construct
  misc_feature 1..20: note = CRISPR gRNA sequence
  source 1..20: mol_type = other DNA
tccagcgtgagtctctccta

SEQ ID NO: 83465 - DNA, 20 bp, synthetic construct
  misc_feature 1..20: note = CRISPR gRNA sequence
  source 1..20: mol_type = other DNA
tcctaccctcccgctctggt

SEQ ID NO: 83466 - DNA, 20 bp, synthetic construct
  misc_feature 1..20: note = CRISPR gRNA sequence
  source 1..20: mol_type = other DNA
ctaccctcccgctctggtcc

SEQ ID NO: 83467 - DNA, 20 bp, synthetic construct
  misc_feature 1..20: note = CRISPR gRNA sequence
  source 1..20: mol_type = other DNA
ccctcccgctctggtccttc

SEQ ID NO: 83468 - DNA, 20 bp, synthetic construct
  misc_feature 1..20: note = CRISPR gRNA sequence
  source 1..20: mol_type = other DNA
ccgctctggtccttcctctc

SEQ ID NO: 83469 - DNA, 20 bp, synthetic construct
  misc_feature 1..20: note = CRISPR gRNA sequence
  source 1..20: mol_type = other DNA
tggtccttcctctcccgctc

SEQ ID NO: 83470 - DNA, 20 bp, synthetic construct
  misc_feature 1..20: note = CRISPR gRNA sequence
  source 1..20: mol_type = other DNA
gtccttcctctcccgctctg

SEQ ID NO: 83471 - DNA, 20 bp, synthetic construct
  misc_feature 1..20: note = CRISPR gRNA sequence
  source 1..20: mol_type = other DNA
cctctcccgctctgcaccct

SEQ ID NO: 83472 - DNA, 20 bp, synthetic construct
  misc_feature 1..20: note = CRISPR gRNA sequence
  source 1..20: mol_type = other DNA
ctctcccgctctgcaccctc

SEQ ID NO: 83473 - DNA, 20 bp, synthetic construct
  misc_feature 1..20: note = CRISPR gRNA sequence
  source 1..20: mol_type = other DNA
tcccgctctgcaccctctgt

SEQ ID NO: 83474 - DNA, 20 bp, synthetic construct
  misc_feature 1..20: note = CRISPR gRNA sequence
  source 1..20: mol_type = other DNA
ccgctctgcaccctctgtgg

SEQ ID NO: 83475 - DNA, 20 bp, synthetic construct
  misc_feature 1..20: note = CRISPR gRNA sequence
  source 1..20: mol_type = other DNA
tgcaccctctgtggccctcg

SEQ ID NO: 83476 - DNA, 20 bp, synthetic construct
  misc_feature 1..20: note = CRISPR gRNA sequence
  source 1..20: mol_type = other DNA
caccctctgtggccctcgct

SEQ ID NO: 83477 - DNA, 20 bp, synthetic construct
  misc_feature 1..20: note = CRISPR gRNA sequence
  source 1..20: mol_type = other DNA
tgtggccctcgctgtgctct

SEQ ID NO: 83478 - DNA, 20 bp, synthetic construct
  misc_feature 1..20: note = CRISPR gRNA sequence
  source 1..20: mol_type = other DNA
tggccctcgctgtgctctct

SEQ ID NO: 83479 - DNA, 20 bp, synthetic construct
  misc_feature 1..20: note = CRISPR gRNA sequence
  source 1..20: mol_type = other DNA
gctgtgctctctcgctccgt

SEQ ID NO: 83480 - DNA, 20 bp, synthetic construct
  misc_feature 1..20: note = CRISPR gRNA sequence
  source 1..20: mol_type = other DNA
tgctctctcgctccgtgact

SEQ ID NO: 83481 - DNA, 20 bp, synthetic construct
  misc_feature 1..20: note = CRISPR gRNA sequence
  source 1..20: mol_type = other DNA
tctcgctccgtgacttccct

SEQ ID NO: 83482 - DNA, 20 bp, synthetic construct
  misc_feature 1..20: note = CRISPR gRNA sequence
  source 1..20: mol_type = other DNA
tcgctccgtgacttcccttc

SEQ ID NO: 83483 - DNA, 20 bp, synthetic construct
  misc_feature 1..20: note = CRISPR gRNA sequence
  source 1..20: mol_type = other DNA
gctccgtgacttcccttctc

SEQ ID NO: 83484 - DNA, 20 bp, synthetic construct
  misc_feature 1..20: note = CRISPR gRNA sequence
  source 1..20: mol_type = other DNA
cgtgacttcccttctccaag

SEQ ID NO: 83485 - DNA, 20 bp, synthetic construct
  misc_feature 1..20: note = CRISPR gRNA sequence
  source 1..20: mol_type = other DNA
cccttctccaagttctcctt

SEQ ID NO: 83486 - DNA, 20 bp, synthetic construct
  misc_feature 1..20: note = CRISPR gRNA sequence
  source 1..20: mol_type = other DNA
ccttctccaagttctccttg

SEQ ID NO: 83487 - DNA, 20 bp, synthetic construct
  misc_feature 1..20: note = CRISPR gRNA sequence
  source 1..20: mol_type = other DNA
ctccaagttctccttggtgg

SEQ ID NO: 83488 - DNA, 20 bp, synthetic construct
  misc_feature 1..20: note = CRISPR gRNA sequence
  source 1..20: mol_type = other DNA
tccaagttctccttggtggc

SEQ ID NO: 83489 - DNA, 20 bp, synthetic construct
  misc_feature 1..20: note = CRISPR gRNA sequence
  source 1..20: mol_type = other DNA
caagttctccttggtggccc

SEQ ID NO: 83490 - DNA, 20 bp, synthetic construct
  misc_feature 1..20: note = CRISPR gRNA sequence
  source 1..20: mol_type = other DNA
tccttggtggcccgccgtgg

SEQ ID NO: 83491 - DNA, 20 bp, synthetic construct
  misc_feature 1..20: note = CRISPR gRNA sequence
  source 1..20: mol_type = other DNA
cttggtggcccgccgtgggg

SEQ ID NO: 83492 - DNA, 20 bp, synthetic construct
  misc_feature 1..20: note = CRISPR gRNA sequence
  source 1..20: mol_type = other DNA
ggtggcccgccgtggggcta

SEQ ID NO: 83493 - DNA, 20 bp, synthetic construct
  misc_feature 1..20: note = CRISPR gRNA sequence
  source 1..20: mol_type = other DNA
gtggcccgccgtggggctag

SEQ ID NO: 83494 - DNA, 20 bp, synthetic construct
  misc_feature 1..20: note = CRISPR gRNA sequence
  source 1..20: mol_type = other DNA
gtccagggctggatctcggg

SEQ ID NO: 83495 - DNA, 20 bp, synthetic construct
  misc_feature 1..20: note = CRISPR gRNA sequence
  source 1..20: mol_type = other DNA
gatctcggggaagcggcggg

SEQ ID NO: 83496 - DNA, 20 bp, synthetic construct
  misc_feature 1..20: note = CRISPR gRNA sequence
  source 1..20: mol_type = other DNA
ggggaagcggcggggtggcc

SEQ ID NO: 83497 - DNA, 20 bp, synthetic construct
  misc_feature 1..20: note = CRISPR gRNA sequence
  source 1..20: mol_type = other DNA
ggagtggggaagggggtgcg

SEQ ID NO: 83498 - DNA, 20 bp, synthetic construct
  misc_feature 1..20: note = CRISPR gRNA sequence
  source 1..20: mol_type = other DNA
cttgcccctttcggcgggga

SEQ ID NO: 83499 - DNA, 20 bp, synthetic construct
  misc_feature 1..20: note = CRISPR gRNA sequence
  source 1..20: mol_type = other DNA
gcccctttcggcggggagca

SEQ ID NO: 83500 - DNA, 20 bp, synthetic construct
  misc_feature 1..20: note = CRISPR gRNA sequence
  source 1..20: mol_type = other DNA
cccctttcggcggggagcag

SEQ ID NO: 83501 - DNA, 20 bp, synthetic construct
  misc_feature 1..20: note = CRISPR gRNA sequence
  source 1..20: mol_type = other DNA
tcggcggggagcaggggaga

SEQ ID NO: 83502 - DNA, 20 bp, synthetic construct
  misc_feature 1..20: note = CRISPR gRNA sequence
  source 1..20: mol_type = other DNA
cggcggggagcaggggagac

SEQ ID NO: 83503 - DNA, 20 bp, synthetic construct
  misc_feature 1..20: note = CRISPR gRNA sequence
  source 1..20: mol_type = other DNA
ggcggggagcaggggagacc

SEQ ID NO: 83504 - DNA, 20 bp, synthetic construct
  misc_feature 1..20: note = CRISPR gRNA sequence
  source 1..20: mol_type = other DNA
tggcctacggcgacgggagg

SEQ ID NO: 83505 - DNA, 20 bp, synthetic construct
  misc_feature 1..20: note = CRISPR gRNA sequence
  source 1..20: mol_type = other DNA
ggcctacggcgacgggaggg

SEQ ID NO: 83506 - DNA, 20 bp, synthetic construct
  misc_feature 1..20: note = CRISPR gRNA sequence
  source 1..20: mol_type = other DNA
gcctacggcgacgggagggt

SEQ ID NO: 83507 - DNA, 20 bp, synthetic construct
  misc_feature 1..20: note = CRISPR gRNA sequence
  source 1..20: mol_type = other DNA
cggcgacgggagggtcggga

SEQ ID NO: 83508 - DNA, 20 bp, synthetic construct
  misc_feature 1..20: note = CRISPR gRNA sequence
  source 1..20: mol_type = other DNA
agggcgtcgataagcgtcag

SEQ ID NO: 83509 - DNA, 20 bp, synthetic construct
  misc_feature 1..20: note = CRISPR gRNA sequence
  source 1..20: mol_type = other DNA
gggcgtcgataagcgtcaga

SEQ ID NO: 83510 - DNA, 20 bp, synthetic construct
  misc_feature 1..20: note = CRISPR gRNA sequence
  source 1..20: mol_type = other DNA
ggggagggtttctcttccgc

SEQ ID NO: 83511 - DNA, 20 bp, synthetic construct
  misc_feature 1..20: note = CRISPR gRNA sequence
  source 1..20: mol_type = other DNA
ctcttccgctctttcgcggg

SEQ ID NO: 83512 - DNA, 20 bp, synthetic construct
  misc_feature 1..20: note = CRISPR gRNA sequence
  source 1..20: mol_type = other DNA
tcttccgctctttcgcgggg

SEQ ID NO: 83513 - DNA, 20 bp, synthetic construct
  misc_feature 1..20: note = CRISPR gRNA sequence
  source 1..20: mol_type = other DNA
ttccgctctttcgcggggcc

SEQ ID NO: 83514 - DNA, 20 bp, synthetic construct
  misc_feature 1..20: note = CRISPR gRNA sequence
  source 1..20: mol_type = other DNA
ccgctctttcgcggggcctc

SEQ ID NO: 83515 - DNA, 20 bp, synthetic construct
  misc_feature 1..20: note = CRISPR gRNA sequence
  source 1..20: mol_type = other DNA
cgctctttcgcggggcctct

SEQ ID NO: 83516 - DNA, 20 bp, synthetic construct
  misc_feature 1..20: note = CRISPR gRNA sequence
  source 1..20: mol_type = other DNA
tttcgcggggcctctggctc

SEQ ID NO: 83517 - DNA, 20 bp, synthetic construct
  misc_feature 1..20: note = CRISPR gRNA sequence
  source 1..20: mol_type = other DNA
tcgcggggcctctggctccc

SEQ ID NO: 83518 - DNA, 20 bp, synthetic construct
  misc_feature 1..20: note = CRISPR gRNA sequence
  source 1..20: mol_type = other DNA
cgcggggcctctggctcccc

SEQ ID NO: 83519 - DNA, 20 bp, synthetic construct
  misc_feature 1..20: note = CRISPR gRNA sequence
  source 1..20: mol_type = other DNA
gcggggcctctggctccccc

SEQ ID NO: 83520 - DNA, 20 bp, synthetic construct
  misc_feature 1..20: note = CRISPR gRNA sequence
  source 1..20: mol_type = other DNA
tggctcccccagcgcagctg

SEQ ID NO: 83521 - DNA, 20 bp, synthetic construct
  misc_feature 1..20: note = CRISPR gRNA sequence
  source 1..20: mol_type = other DNA
gctcccccagcgcagctgga

SEQ ID NO: 83522 - DNA, 20 bp, synthetic construct
  misc_feature 1..20: note = CRISPR gRNA sequence
  source 1..20: mol_type = other DNA
ccccagcgcagctggagtgg

SEQ ID NO: 83523 - DNA, 20 bp, synthetic construct
  misc_feature 1..20: note = CRISPR gRNA sequence
  source 1..20: mol_type = other DNA
gagtgggggacgggtaggct

SEQ ID NO: 83524 - DNA, 20 bp, synthetic construct
  misc_feature 1..20: note = CRISPR gRNA sequence
  source 1..20: mol_type = other DNA
gtcccaaaggcgcggcgctg

SEQ ID NO: 83525 - DNA, 20 bp, synthetic construct
  misc_feature 1..20: note = CRISPR gRNA sequence
  source 1..20: mol_type = other DNA
aggtttgtgaacgcgtggag

SEQ ID NO: 83526 - DNA, 20 bp, synthetic construct
  misc_feature 1..20: note = CRISPR gRNA sequence
  source 1..20: mol_type = other DNA
gtgaacgcgtggaggggcgc

SEQ ID NO: 83527 - DNA, 20 bp, synthetic construct
  misc_feature 1..20: note = CRISPR gRNA sequence
  source 1..20: mol_type = other DNA
tgaacgcgtggaggggcgct

SEQ ID NO: 83528 - DNA, 20 bp, synthetic construct
  misc_feature 1..20: note = CRISPR gRNA sequence
  source 1..20: mol_type = other DNA
ggggtctgggggaggcgtcg

SEQ ID NO: 83529 - DNA, 20 bp, synthetic construct
  misc_feature 1..20: note = CRISPR gRNA sequence
  source 1..20: mol_type = other DNA
gggtctgggggaggcgtcgc

SEQ ID NO: 83530 - DNA, 20 bp, synthetic construct
  misc_feature 1..20: note = CRISPR gRNA sequence
  source 1..20: mol_type = other DNA
ggggaggcgtcgcccgggta

SEQ ID NO: 83531 - DNA, 20 bp, synthetic construct
  misc_feature 1..20: note = CRISPR gRNA sequence
  source 1..20: mol_type = other DNA
tctgctgcggctctgcttcc

SEQ ID NO: 83532 - DNA, 20 bp, synthetic construct
  misc_feature 1..20: note = CRISPR gRNA sequence
  source 1..20: mol_type = other DNA
ctgcggctctgcttccctta

SEQ ID NO: 83533 - DNA, 20 bp, synthetic construct
  misc_feature 1..20: note = CRISPR gRNA sequence
  source 1..20: mol_type = other DNA
cggctctgcttcccttagac

SEQ ID NO: 83534 - DNA, 20 bp, synthetic construct
  misc_feature 1..20: note = CRISPR gRNA sequence
  source 1..20: mol_type = other DNA
tgcttcccttagactggaga

SEQ ID NO: 83535 - DNA, 20 bp, synthetic construct
  misc_feature 1..20: note = CRISPR gRNA sequence
  source 1..20: mol_type = other DNA
cttcccttagactggagagc

SEQ ID NO: 83536 - DNA, 20 bp, synthetic construct
  misc_feature 1..20: note = CRISPR gRNA sequence
  source 1..20: mol_type = other DNA
cccttagactggagagctgt

SEQ ID NO: 83537 - DNA, 20 bp, synthetic construct
  misc_feature 1..20: note = CRISPR gRNA sequence
  source 1..20: mol_type = other DNA
ccttagactggagagctgtg

SEQ ID NO: 83538 - DNA, 20 bp, synthetic construct
  misc_feature 1..20: note = CRISPR gRNA sequence
  source 1..20: mol_type = other DNA
agactggagagctgtggact

SEQ ID NO: 83539 - DNA, 20 bp, synthetic construct
  misc_feature 1..20: note = CRISPR gRNA sequence
  source 1..20: mol_type = other DNA
gactggagagctgtggactt

SEQ ID NO: 83540 - DNA, 20 bp, synthetic construct
  misc_feature 1..20: note = CRISPR gRNA sequence
  source 1..20: mol_type = other DNA
gagagctgtggacttcgtct

SEQ ID NO: 83541 - DNA, 20 bp, synthetic construct
  misc_feature 1..20: note = CRISPR gRNA sequence
  source 1..20: mol_type = other DNA
tggacttcgtctaggcgccc

SEQ ID NO: 83542 - DNA, 20 bp, synthetic construct
  misc_feature 1..20: note = CRISPR gRNA sequence
  source 1..20: mol_type = other DNA
cgtctaggcgcccgctaagt

SEQ ID NO: 83543 - DNA, 20 bp, synthetic construct
  misc_feature 1..20: note = CRISPR gRNA sequence
  source 1..20: mol_type = other DNA
gtctaggcgcccgctaagtt

SEQ ID NO: 83544 - DNA, 20 bp, synthetic construct
  misc_feature 1..20: note = CRISPR gRNA sequence
  source 1..20: mol_type = other DNA
ggcgcccgctaagttcgcat

SEQ ID NO: 83545 - DNA, 20 bp, synthetic construct
  misc_feature 1..20: note = CRISPR gRNA sequence
  source 1..20: mol_type = other DNA
agttcgcatgtcctagcacc

SEQ ID NO: 83546 - DNA, 20 bp, synthetic construct
  misc_feature 1..20: note = CRISPR gRNA sequence
  source 1..20: mol_type = other DNA
gcatgtcctagcacctctgg

SEQ ID NO: 83547 - DNA, 20 bp, synthetic construct
  misc_feature 1..20: note = CRISPR gRNA sequence
  source 1..20: mol_type = other DNA
gcacctctgggtctatgtgg

SEQ ID NO: 83548 - DNA, 20 bp, synthetic construct
  misc_feature 1..20: note = CRISPR gRNA sequence
  source 1..20: mol_type = other DNA
tgggtctatgtggggccaca

SEQ ID NO: 83549 - DNA, 20 bp, synthetic construct
  misc_feature 1..20: note = CRISPR gRNA sequence
  source 1..20: mol_type = other DNA
ggtctatgtggggccacacc

SEQ ID NO: 83550 - DNA, 20 bp, synthetic construct
  misc_feature 1..20: note = CRISPR gRNA sequence
  source 1..20: mol_type = other DNA
tgtggggccacaccgtgggg

SEQ ID NO: 83551 - DNA, 20 bp, synthetic construct
  misc_feature 1..20: note = CRISPR gRNA sequence
  source 1..20: mol_type = other DNA
gtagaatgcttggctgtgat

SEQ ID NO: 83552 - DNA, 20 bp, synthetic construct
  misc_feature 1..20: note = CRISPR gRNA sequence
  source 1..20: mol_type = other DNA
tagaatgcttggctgtgata

SEQ ID NO: 83553 - DNA, 20 bp, synthetic construct
  misc_feature 1..20: note = CRISPR gRNA sequence
  source 1..20: mol_type = other DNA
ggctgtgatacaaagcggtt

SEQ ID NO: 83554 - DNA, 20 bp, synthetic construct
  misc_feature 1..20: note = CRISPR gRNA sequence
  source 1..20: mol_type = other DNA
gctgtgatacaaagcggttt

SEQ ID NO: 83555 - DNA, 20 bp, synthetic construct
  misc_feature 1..20: note = CRISPR gRNA sequence
  source 1..20: mol_type = other DNA
tgatacaaagcggtttcgaa

SEQ ID NO: 83556 - DNA, 20 bp, synthetic construct
  misc_feature 1..20: note = CRISPR gRNA sequence
  source 1..20: mol_type = other DNA
cgaataattaacttatttgt

SEQ ID NO: 83557 - DNA, 20 bp, synthetic construct
  misc_feature 1..20: note = CRISPR gRNA sequence
  source 1..20: mol_type = other DNA
gaataattaacttatttgtt

SEQ ID NO: 83558 - DNA, 20 bp, synthetic construct
  misc_feature 1..20: note = CRISPR gRNA sequence
  source 1..20: mol_type = other DNA
acttatttgttcccatcaca

SEQ ID NO: 83559 - DNA, 20 bp, synthetic construct
  misc_feature 1..20: note = CRISPR gRNA sequence
  source 1..20: mol_type = other DNA
atttgttcccatcacatgtc

SEQ ID NO: 83560 - DNA, 20 bp, synthetic construct
  misc_feature 1..20: note = CRISPR gRNA sequence
  source 1..20: mol_type = other DNA
tttgttcccatcacatgtca

SEQ ID NO: 83561 - DNA, 20 bp, synthetic construct
  misc_feature 1..20: note = CRISPR gRNA sequence
  source 1..20: mol_type = other DNA
gttcccatcacatgtcactt

SEQ ID NO: 83562 - DNA, 20 bp, synthetic construct
  misc_feature 1..20: note = CRISPR gRNA sequence
  source 1..20: mol_type = other DNA
ttcccatcacatgtcacttt

SEQ ID NO: 83563 - DNA, 20 bp, synthetic construct
  misc_feature 1..20: note = CRISPR gRNA sequence
  source 1..20: mol_type = other DNA
ccatcacatgtcacttttaa

SEQ ID NO: 83564 - DNA, 20 bp, synthetic construct
  misc_feature 1..20: note = CRISPR gRNA sequence
  source 1..20: mol_type = other DNA
ttaaaaaattataagaacta

SEQ ID NO: 83565 - DNA, 20 bp, synthetic construct
  misc_feature 1..20: note = CRISPR gRNA sequence
  source 1..20: mol_type = other DNA
taaaaaattataagaactac

SEQ ID NO: 83566 - DNA, 20 bp, synthetic construct
  misc_feature 1..20: note = CRISPR gRNA sequence
  source 1..20: mol_type = other DNA
aaaaaattataagaactacc

SEQ ID NO: 83567 - DNA, 20 bp, synthetic construct
  misc_feature 1..20: note = CRISPR gRNA sequence
  source 1..20: mol_type = other DNA
aaaaattataagaactaccc

SEQ ID NO: 83568 - DNA, 20 bp, synthetic construct
  misc_feature 1..20: note = CRISPR gRNA sequence
  source 1..20: mol_type = other DNA
taagaactacccgttattga

SEQ ID NO: 83569 - DNA, 20 bp, synthetic construct
  misc_feature 1..20: note = CRISPR gRNA sequence
  source 1..20: mol_type = other DNA
cccgttattgacatctttct

SEQ ID NO: 83570 - DNA, 20 bp, synthetic construct
  misc_feature 1..20: note = CRISPR gRNA sequence
  source 1..20: mol_type = other DNA
ttgacatctttctgtgtgcc

SEQ ID NO: 83571 - DNA, 20 bp, synthetic construct
  misc_feature 1..20: note = CRISPR gRNA sequence
  source 1..20: mol_type = other DNA
acatctttctgtgtgccaag

SEQ ID NO: 83572 - DNA, 20 bp, synthetic construct
  misc_feature 1..20: note = CRISPR gRNA sequence
  source 1..20: mol_type = other DNA
tctgtgtgccaaggacttta

SEQ ID NO: 83573 - DNA, 20 bp, synthetic construct
  misc_feature 1..20: note = CRISPR gRNA sequence
  source 1..20: mol_type = other DNA
ctgtgtgccaaggactttat

SEQ ID NO: 83574 - DNA, 20 bp, synthetic construct
  misc_feature 1..20: note = CRISPR gRNA sequence
  source 1..20: mol_type = other DNA
tgtgtgccaaggactttatg

SEQ ID NO: 83575 - DNA, 20 bp, synthetic construct
  misc_feature 1..20: note = CRISPR gRNA sequence
  source 1..20: mol_type = other DNA
tgtgccaaggactttatgtg

SEQ ID NO: 83576 - DNA, 20 bp, synthetic construct
  misc_feature 1..20: note = CRISPR gRNA sequence
  source 1..20: mol_type = other DNA
tatgtgctttgcgtcattta

SEQ ID NO: 83577 - DNA, 20 bp, synthetic construct
  misc_feature 1..20: note = CRISPR gRNA sequence
  source 1..20: mol_type = other DNA
atgtgctttgcgtcatttaa

SEQ ID NO: 83578 - DNA, 20 bp, synthetic construct
  misc_feature 1..20: note = CRISPR gRNA sequence
  source 1..20: mol_type = other DNA
tgtgctttgcgtcatttaat

SEQ ID NO: 83579 - DNA, 20 bp, synthetic construct
  misc_feature 1..20: note = CRISPR gRNA sequence
  source 1..20: mol_type = other DNA
tgcgtcatttaattttgaaa

SEQ ID NO: 83580 - DNA, 20 bp, synthetic construct
  misc_feature 1..20: note = CRISPR gRNA sequence
  source 1..20: mol_type = other DNA
gcgtcatttaattttgaaaa

SEQ ID NO: 83581 - DNA, 20 bp, synthetic construct
  misc_feature 1..20: note = CRISPR gRNA sequence
  source 1..20: mol_type = other DNA
cgtcatttaattttgaaaac

SEQ ID NO: 83582 - DNA, 20 bp, synthetic construct
  misc_feature 1..20: note = CRISPR gRNA sequence
  source 1..20: mol_type = other DNA
aattttgaaaacagttatct

SEQ ID NO: 83583 - DNA, 20 bp, synthetic construct
  misc_feature 1..20: note = CRISPR gRNA sequence
  source 1..20: mol_type = other DNA
attttgaaaacagttatctt

SEQ ID NO: 83584 - DNA, 20 bp, synthetic construct
  misc_feature 1..20: note = CRISPR gRNA sequence
  source 1..20: mol_type = other DNA
tgaaaacagttatcttccgc

SEQ ID NO: 83585 - DNA, 20 bp, synthetic construct
  misc_feature 1..20: note = CRISPR gRNA sequence
  source 1..20: mol_type = other DNA
gaaaacagttatcttccgcc

SEQ ID NO: 83586 - DNA, 20 bp, synthetic construct
  misc_feature 1..20: note = CRISPR gRNA sequence
  source 1..20: mol_type = other DNA
aaaacagttatcttccgcca

SEQ ID NO: 83587 - DNA, 20 bp, synthetic construct
  misc_feature 1..20: note = CRISPR gRNA sequence
  source 1..20: mol_type = other DNA
tcttccgccatagataacta

SEQ ID NO: 83588 - DNA, 20 bp, synthetic construct
  misc_feature 1..20: note = CRISPR gRNA sequence
  source 1..20: mol_type = other DNA
ccgccatagataactactat

SEQ ID NO: 83589 - DNA, 20 bp, synthetic construct
  misc_feature 1..20: note = CRISPR gRNA sequence
  source 1..20: mol_type = other DNA
cgccatagataactactatg

SEQ ID NO: 83590 - DNA, 20 bp, synthetic construct
  misc_feature 1..20: note = CRISPR gRNA sequence
  source 1..20: mol_type = other DNA
ctatggttatcttctgcctc

SEQ ID NO: 83591 - DNA, 20 bp, synthetic construct
  misc_feature 1..20: note = CRISPR gRNA sequence
  source 1..20: mol_type = other DNA
tggttatcttctgcctctca

SEQ ID NO: 83592 - DNA, 20 bp, synthetic construct
  misc_feature 1..20: note = CRISPR gRNA sequence
  source 1..20: mol_type = other DNA
tcttctgcctctcacagatg

SEQ ID NO: 83593 - DNA, 20 bp, synthetic construct
  misc_feature 1..20: note = CRISPR gRNA sequence
  source 1..20: mol_type = other DNA
ctgcctctcacagatgaaga

SEQ ID NO: 83594 - DNA, 20 bp, synthetic construct
  misc_feature 1..20: note = CRISPR gRNA sequence
  source 1..20: mol_type = other DNA
tgcctctcacagatgaagaa

SEQ ID NO: 83595 - DNA, 20 bp, synthetic construct
  misc_feature 1..20: note = CRISPR gRNA sequence
  source 1..20: mol_type = other DNA
cctctcacagatgaagaaac

SEQ ID NO: 83596 - DNA, 20 bp, synthetic construct
  misc_feature 1..20: note = CRISPR gRNA sequence
  source 1..20: mol_type = other DNA
tcacagatgaagaaactaag

SEQ ID NO: 83597 - DNA, 20 bp, synthetic construct
  misc_feature 1..20: note = CRISPR gRNA sequence
  source 1..20: mol_type = other DNA
acagatgaagaaactaaggc

SEQ ID NO: 83598 - DNA, 20 bp, synthetic construct
  misc_feature 1..20: note = CRISPR gRNA sequence
  source 1..20: mol_type = other DNA
aggcaccgagattttaagaa

SEQ ID NO: 83599 - DNA, 20 bp, synthetic construct
  misc_feature 1..20: note = CRISPR gRNA sequence
  source 1..20: mol_type = other DNA
taagaaacttaattacacag

SEQ ID NO: 83600 - DNA, 20 bp, synthetic construct
  misc_feature 1..20: note = CRISPR gRNA sequence
  source 1..20: mol_type = other DNA
aagaaacttaattacacagg

SEQ ID NO: 83601 - DNA, 20 bp, synthetic construct
  misc_feature 1..20: note = CRISPR gRNA sequence
  source 1..20: mol_type = other DNA
agaaacttaattacacaggg

SEQ ID NO: 83602 - DNA, 20 bp, synthetic construct
  misc_feature 1..20: note = CRISPR gRNA sequence
  source 1..20: mol_type = other DNA
aattacacaggggataaatg

SEQ ID NO: 83603 - DNA, 20 bp, synthetic construct
  misc_feature 1..20: note = CRISPR gRNA sequence
  source 1..20: mol_type = other DNA
attacacaggggataaatgg

SEQ ID NO: 83604 - DNA, 20 bp, synthetic construct
  misc_feature 1..20: note = CRISPR gRNA sequence
  source 1..20: mol_type = other DNA
cacaggggataaatggcagc

SEQ ID NO: 83605 - DNA, 20 bp, synthetic construct
  misc_feature 1..20: note = CRISPR gRNA sequence
  source 1..20: mol_type = other DNA
aagtcaagcctaaccagggc

SEQ ID NO: 83606 - DNA, 20 bp, synthetic construct
  misc_feature 1..20: note = CRISPR gRNA sequence
  source 1..20: mol_type = other DNA
accagggcttttgcgggagc

SEQ ID NO: 83607 - DNA, 20 bp, synthetic construct
  misc_feature 1..20: note = CRISPR gRNA sequence
  source 1..20: mol_type = other DNA
ttgcgggagcgcatgccttt

SEQ ID NO: 83608 - DNA, 20 bp, synthetic construct
  misc_feature 1..20: note = CRISPR gRNA sequence
  source 1..20: mol_type = other DNA
tgcgggagcgcatgcctttt

SEQ ID NO: 83609 - DNA, 20 bp, synthetic construct
  misc_feature 1..20: note = CRISPR gRNA sequence
  source 1..20: mol_type = other DNA
gcgggagcgcatgccttttg

SEQ ID NO: 83610 - DNA, 20 bp, synthetic construct
  misc_feature 1..20: note = CRISPR gRNA sequence
  source 1..20: mol_type = other DNA
cgggagcgcatgccttttgg

SEQ ID NO: 83611 - DNA, 20 bp, synthetic construct
  misc_feature 1..20: note = CRISPR gRNA sequence
  source 1..20: mol_type = other DNA
ttggctgtaattcgtgcatt

SEQ ID NO: 83612 - DNA, 20 bp, synthetic construct
  misc_feature 1..20: note = CRISPR gRNA sequence
  source 1..20: mol_type = other DNA
tggctgtaattcgtgcattt

SEQ ID NO: 83613 - DNA, 20 bp, synthetic construct
  misc_feature 1..20: note = CRISPR gRNA sequence
  source 1..20: mol_type = other DNA
ggctgtaattcgtgcatttt

SEQ ID NO: 83614 - DNA, 20 bp, synthetic construct
  misc_feature 1..20: note = CRISPR gRNA sequence
  source 1..20: mol_type = other DNA
gctgtaattcgtgcattttt

SEQ ID NO: 83615 - DNA, 20 bp, synthetic construct
  misc_feature 1..20: note = CRISPR gRNA sequence
  source 1..20: mol_type = other DNA
taattcgtgcattttttttt

SEQ ID NO: 83616 - DNA, 20 bp, synthetic construct
  misc_feature 1..20: note = CRISPR gRNA sequence
  source 1..20: mol_type = other DNA
gtgcatttttttttaagaaa

SEQ ID NO: 83617 - DNA, 20 bp, synthetic construct
  misc_feature 1..20: note = CRISPR gRNA sequence
  source 1..20: mol_type = other DNA
ttttttaagaaaaacgcctg

SEQ ID NO: 83618 - DNA, 20 bp, synthetic construct
  misc_feature 1..20: note = CRISPR gRNA sequence
  source 1..20: mol_type = other DNA
tttttaagaaaaacgcctgc

SEQ ID NO: 83619 - DNA, 20 bp, synthetic construct
  misc_feature 1..20: note = CRISPR gRNA sequence
  source 1..20: mol_type = other DNA
ttttaagaaaaacgcctgcc

SEQ ID NO: 83620 - DNA, 20 bp, synthetic construct
  misc_feature 1..20: note = CRISPR gRNA sequence
  source 1..20: mol_type = other DNA
tttaagaaaaacgcctgcct

SEQ ID NO: 83621 - DNA, 20 bp, synthetic construct
  misc_feature 1..20: note = CRISPR gRNA sequence
  source 1..20: mol_type = other DNA
ttaagaaaaacgcctgcctt

SEQ ID NO: 83622 - DNA, 20 bp, synthetic construct
  misc_feature 1..20: note = CRISPR gRNA sequence
  source 1..20: mol_type = other DNA
taagaaaaacgcctgccttc

SEQ ID NO: 83623 - DNA, 20 bp, synthetic construct
  misc_feature 1..20: note = CRISPR gRNA sequence
  source 1..20: mol_type = other DNA
aagaaaaacgcctgccttct

SEQ ID NO: 83624 - DNA, 20 bp, synthetic construct
  misc_feature 1..20: note = CRISPR gRNA sequence
  source 1..20: mol_type = other DNA
agaaaaacgcctgccttctg

SEQ ID NO: 83625 - DNA, 20 bp, synthetic construct
  misc_feature 1..20: note = CRISPR gRNA sequence
  source 1..20: mol_type = other DNA
ccttctgcgtgagattctcc

SEQ ID NO: 83626 - DNA, 20 bp, synthetic construct
  misc_feature 1..20: note = CRISPR gRNA sequence
  source 1..20: mol_type = other DNA
ctgcgtgagattctccagag

SEQ ID NO: 83627 - DNA, 20 bp, synthetic construct
  misc_feature 1..20: note = CRISPR gRNA sequence
  source 1..20: mol_type = other DNA
tgcgtgagattctccagagc

SEQ ID NO: 83628 - DNA, 20 bp, synthetic construct
  misc_feature 1..20: note = CRISPR gRNA sequence
  source 1..20: mol_type = other DNA
cgtgagattctccagagcaa

SEQ ID NO: 83629 - DNA, 20 bp, synthetic construct
  misc_feature 1..20: note = CRISPR gRNA sequence
  source 1..20: mol_type = other DNA
tccagagcaaactgggcggc

SEQ ID NO: 83630 - DNA, 20 bp, synthetic construct
  misc_feature 1..20: note = CRISPR gRNA sequence
  source 1..20: mol_type = other DNA
cagagcaaactgggcggcat

SEQ ID NO: 83631 - DNA, 20 bp, synthetic construct
  misc_feature 1..20: note = CRISPR gRNA sequence
  source 1..20: mol_type = other DNA
ggcggcatgggccctgtggt

SEQ ID NO: 83632 - DNA, 20 bp, synthetic construct
  misc_feature 1..20: note = CRISPR gRNA sequence
  source 1..20: mol_type = other DNA
tggtcttttcgtacagaggg

SEQ ID NO: 83633 - DNA, 20 bp, synthetic construct
  misc_feature 1..20: note = CRISPR gRNA sequence
  source 1..20: mol_type = other DNA
ttcgtacagagggcttcctc

SEQ ID NO: 83634 - DNA, 20 bp, synthetic construct
  misc_feature 1..20: note = CRISPR gRNA sequence
  source 1..20: mol_type = other DNA
tcgtacagagggcttcctct

SEQ ID NO: 83635 - DNA, 20 bp, synthetic construct
  misc_feature 1..20: note = CRISPR gRNA sequence
  source 1..20: mol_type = other DNA
cgtacagagggcttcctctt

SEQ ID NO: 83636 - DNA, 20 bp, synthetic construct
  misc_feature 1..20: note = CRISPR gRNA sequence
  source 1..20: mol_type = other DNA
gtacagagggcttcctcttt

SEQ ID NO: 83637 - DNA, 20 bp, synthetic construct
  misc_feature 1..20: note = CRISPR gRNA sequence
  source 1..20: mol_type = other DNA
cctctttggctctttgcctg

SEQ ID NO: 83638 - DNA, 20 bp, synthetic construct
  misc_feature 1..20: note = CRISPR gRNA sequence
  source 1..20: mol_type = other DNA
ctctttggctctttgcctgg

SEQ ID NO: 83639 - DNA, 20 bp, synthetic construct
  misc_feature 1..20: note = CRISPR gRNA sequence
  source 1..20: mol_type = other DNA
tttggctctttgcctggttg

SEQ ID NO: 83640 - DNA, 20 bp, synthetic construct
  misc_feature 1..20: note = CRISPR gRNA sequence
  source 1..20: mol_type = other DNA
tggctctttgcctggttgtt

SEQ ID NO: 83641 - DNA, 20 bp, synthetic construct
  misc_feature 1..20: note = CRISPR gRNA sequence
  source 1..20: mol_type = other DNA
ggctctttgcctggttgttt

SEQ ID NO: 83642 - DNA, 20 bp, synthetic construct
  misc_feature 1..20: note = CRISPR gRNA sequence
  source 1..20: mol_type = other DNA
gctctttgcctggttgtttc

SEQ ID NO: 83643 - DNA, 20 bp, synthetic construct
  misc_feature 1..20: note = CRISPR gRNA sequence
  source 1..20: mol_type = other DNA
tttgcctggttgtttccaag

SEQ ID NO: 83644 - DNA, 20 bp, synthetic construct
  misc_feature 1..20: note = CRISPR gRNA sequence
  source 1..20: mol_type = other DNA
tgcctggttgtttccaagat

SEQ ID NO: 83645 - DNA, 20 bp, synthetic construct
  misc_feature 1..20: note = CRISPR gRNA sequence
  source 1..20: mol_type = other DNA
gcctggttgtttccaagatg

SEQ ID NO: 83646 - DNA, 20 bp, synthetic construct
  misc_feature 1..20: note = CRISPR gRNA sequence
  source 1..20: mol_type = other DNA
cctggttgtttccaagatgt

SEQ ID NO: 83647 - DNA, 20 bp, synthetic construct
  misc_feature 1..20: note = CRISPR gRNA sequence
  source 1..20: mol_type = other DNA
gttgtttccaagatgtactg

SEQ ID NO: 83648 - DNA, 20 bp, synthetic construct
  misc_feature 1..20: note = CRISPR gRNA sequence
  source 1..20: mol_type = other DNA
tttccaagatgtactgtgcc

SEQ ID NO: 83649 - DNA, 20 bp, synthetic construct
  misc_feature 1..20: note = CRISPR gRNA sequence
  source 1..20: mol_type = other DNA
ccaagatgtactgtgcctct

SEQ ID NO: 83650 - DNA, 20 bp, synthetic construct
  misc_feature 1..20: note = CRISPR gRNA sequence
  source 1..20: mol_type = other DNA
caagatgtactgtgcctctt

SEQ ID NO: 83651 - DNA, 20 bp, synthetic construct
  misc_feature 1..20: note = CRISPR gRNA sequence
  source 1..20: mol_type = other DNA
tgcctcttactttcggtttt

SEQ ID NO: 83652 - DNA, 20 bp, synthetic construct
  misc_feature 1..20: note = CRISPR gRNA sequence
  source 1..20: mol_type = other DNA
ttactttcggttttgaaaac

SEQ ID NO: 83653 - DNA, 20 bp, synthetic construct
  misc_feature 1..20: note = CRISPR gRNA sequence
  source 1..20: mol_type = other DNA
actttcggttttgaaaacat

SEQ ID NO: 83654 - DNA, 20 bp, synthetic construct
  misc_feature 1..20: note = CRISPR gRNA sequence
  source 1..20: mol_type = other DNA
ctttcggttttgaaaacatg

SEQ ID NO: 83655 - DNA, 20 bp, synthetic construct
  misc_feature 1..20: note = CRISPR gRNA sequence
  source 1..20: mol_type = other DNA
tcggttttgaaaacatgagg

SEQ ID NO: 83656 - DNA, 20 bp, synthetic construct
  misc_feature 1..20: note = CRISPR gRNA sequence
  source 1..20: mol_type = other DNA
cggttttgaaaacatgaggg

SEQ ID NO: 83657 - DNA, 20 bp, synthetic construct
  misc_feature 1..20: note = CRISPR gRNA sequence
  source 1..20: mol_type = other DNA
ggttttgaaaacatgagggg

SEQ ID NO: 83658 - DNA, 20 bp, synthetic construct
  misc_feature 1..20: note = CRISPR gRNA sequence
  source 1..20: mol_type = other DNA
tgaaaacatgagggggttgg

SEQ ID NO: 83659 - DNA, 20 bp, synthetic construct
  misc_feature 1..20: note = CRISPR gRNA sequence
  source 1..20: mol_type = other DNA
gaaaacatgagggggttggg

SEQ ID NO: 83660 - DNA, 20 bp, synthetic construct
  misc_feature 1..20: note = CRISPR gRNA sequence
  source 1..20: mol_type = other DNA
aaaacatgagggggttgggc

SEQ ID NO: 83661 - DNA, 20 bp, synthetic construct
  misc_feature 1..20: note = CRISPR gRNA sequence
  source 1..20: mol_type = other DNA
ggcgtggtagcttacgcctg

SEQ ID NO: 83662 - DNA, 20 bp, synthetic construct
  misc_feature 1..20: note = CRISPR gRNA sequence
  source 1..20: mol_type = other DNA
acgcctgtaatcccagcact

SEQ ID NO: 83663 - DNA, 20 bp, synthetic construct
  misc_feature 1..20: note = CRISPR gRNA sequence
  source 1..20: mol_type = other DNA
cgcctgtaatcccagcactt

SEQ ID NO: 83664 - DNA, 20 bp, synthetic construct
  misc_feature 1..20: note = CRISPR gRNA sequence
  source 1..20: mol_type = other DNA
taatcccagcacttagggag

SEQ ID NO: 83665 - DNA, 20 bp, synthetic construct
  misc_feature 1..20: note = CRISPR gRNA sequence
  source 1..20: mol_type = other DNA
agggaggccgaggcgggagg

SEQ ID NO: 83666 - DNA, 20 bp, synthetic construct
  misc_feature 1..20: note = CRISPR gRNA sequence
  source 1..20: mol_type = other DNA
gggaggccgaggcgggagga

SEQ ID NO: 83667 - DNA, 20 bp, synthetic construct
  misc_feature 1..20: note = CRISPR gRNA sequence
  source 1..20: mol_type = other DNA
gaggtccgtagttgagacca

SEQ ID NO: 83668 - DNA, 20 bp, synthetic construct
  misc_feature 1..20: note = CRISPR gRNA sequence
  source 1..20: mol_type = other DNA
aggtccgtagttgagaccag

SEQ ID NO: 83669 - DNA, 20 bp, synthetic construct
  misc_feature 1..20: note = CRISPR gRNA sequence
  source 1..20: mol_type = other DNA
agaccagcctggccaacatg

SEQ ID NO: 83670 - DNA, 20 bp, synthetic construct
  misc_feature 1..20: note = CRISPR gRNA sequence
  source 1..20: mol_type = other DNA
gccaacatggtgaagcctgg

SEQ ID NO: 83671 - DNA, 20 bp, synthetic construct
  misc_feature 1..20: note = CRISPR gRNA sequence
  source 1..20: mol_type = other DNA
gtctctacaaaaaataataa

SEQ ID NO: 83672 - DNA, 20 bp, synthetic construct
  misc_feature 1..20: note = CRISPR gRNA sequence
  source 1..20: mol_type = other DNA
tacaaaaaataataacaaaa

SEQ ID NO: 83673 - DNA, 20 bp, synthetic construct
  misc_feature 1..20: note = CRISPR gRNA sequence
  source 1..20: mol_type = other DNA
caaaaaataataacaaaaat

SEQ ID NO: 83674 - DNA, 20 bp, synthetic construct
  misc_feature 1..20: note = CRISPR gRNA sequence
  source 1..20: mol_type = other DNA
gccgggtgtggtggctcgtg

SEQ ID NO: 83675 - DNA, 20 bp, synthetic construct
  misc_feature 1..20: note = CRISPR gRNA sequence
  source 1..20: mol_type = other DNA
gtgcctgtggtcccagctgc

SEQ ID NO: 83676 - DNA, 20 bp, synthetic construct
  misc_feature 1..20: note = CRISPR gRNA sequence
  source 1..20: mol_type = other DNA
tggtcccagctgctccggtg

SEQ ID NO: 83677 - DNA, 20 bp, synthetic construct
  misc_feature 1..20: note = CRISPR gRNA sequence
  source 1..20: mol_type = other DNA
ctccggtggctgaggcggga

SEQ ID NO: 83678 - DNA, 20 bp, synthetic construct
  misc_feature 1..20: note = CRISPR gRNA sequence
  source 1..20: mol_type = other DNA
cggtggctgaggcgggagga

SEQ ID NO: 83679 - DNA, 20 bp, synthetic construct
  misc_feature 1..20: note = CRISPR gRNA sequence
  source 1..20: mol_type = other DNA
aggcgggaggatctcttgag

SEQ ID NO: 83680 - DNA, 20 bp, synthetic construct
  misc_feature 1..20: note = CRISPR gRNA sequence
  source 1..20: mol_type = other DNA
ttgagcttaggcttttgagc

SEQ ID NO: 83681 - DNA, 20 bp, synthetic construct
  misc_feature 1..20: note = CRISPR gRNA sequence
  source 1..20: mol_type = other DNA
gagcttaggcttttgagcta

SEQ ID NO: 83682 - DNA, 20 bp, synthetic construct
  misc_feature 1..20: note = CRISPR gRNA sequence
  source 1..20: mol_type = other DNA
agcttaggcttttgagctat

SEQ ID NO: 83683 - DNA, 20 bp, synthetic construct
  misc_feature 1..20: note = CRISPR gRNA sequence
  source 1..20: mol_type = other DNA
aggcttttgagctatcatgg

SEQ ID NO: 83684 - DNA, 20 bp, synthetic construct
  misc_feature 1..20: note = CRISPR gRNA sequence
  source 1..20: mol_type = other DNA
ggcttttgagctatcatggc

SEQ ID NO: 83685 - DNA, 20 bp, synthetic construct
  misc_feature 1..20: note = CRISPR gRNA sequence
  source 1..20: mol_type = other DNA
ttgagctatcatggcgccag

SEQ ID NO: 83686 - DNA, 20 bp, synthetic construct
  misc_feature 1..20: note = CRISPR gRNA sequence
  source 1..20: mol_type = other DNA
tgagctatcatggcgccagt

SEQ ID NO: 83687 - DNA, 20 bp, synthetic construct
  misc_feature 1..20: note = CRISPR gRNA sequence
  source 1..20: mol_type = other DNA
gagctatcatggcgccagtg

SEQ ID NO: 83688 - DNA, 20 bp, synthetic construct
  misc_feature 1..20: note = CRISPR gRNA sequence
  source 1..20: mol_type = other DNA
agctatcatggcgccagtgc

SEQ ID NO: 83689 - DNA, 20 bp, synthetic construct
  misc_feature 1..20: note = CRISPR gRNA sequence
  source 1..20: mol_type = other DNA
tcatggcgccagtgcactcc

SEQ ID NO: 83690 - DNA, 20 bp, synthetic construct
  misc_feature 1..20: note = CRISPR gRNA sequence
  source 1..20: mol_type = other DNA
cagcgtgggcaacagagcga

SEQ ID NO: 83691 - DNA, 20 bp, synthetic construct
  misc_feature 1..20: note = CRISPR gRNA sequence
  source 1..20: mol_type = other DNA
tctctcaaaaaagaaaaaaa

SEQ ID NO: 83692 - DNA, 20 bp, synthetic construct
  misc_feature 1..20: note = CRISPR gRNA sequence
  source 1..20: mol_type = other DNA
tcaaaaaagaaaaaaaaaaa

SEQ ID NO: 83693 - DNA, 20 bp, synthetic construct
  misc_feature 1..20: note = CRISPR gRNA sequence
  source 1..20: mol_type = other DNA
aaaaaagaaaaaaaaaaaaa

SEQ ID NO: 83694 - DNA, 20 bp, synthetic construct
  misc_feature 1..20: note = CRISPR gRNA sequence
  source 1..20: mol_type = other DNA
gtcagtcaggggagctgtaa

SEQ ID NO: 83695 - DNA, 20 bp, synthetic construct
  misc_feature 1..20: note = CRISPR gRNA sequence
  source 1..20: mol_type = other DNA
tcagtcaggggagctgtaaa

SEQ ID NO: 83696 - DNA, 20 bp, synthetic construct
  misc_feature 1..20: note = CRISPR gRNA sequence
  source 1..20: mol_type = other DNA
taaaaccattaataaagata

SEQ ID NO: 83697 - DNA, 20 bp, synthetic construct
  misc_feature 1..20: note = CRISPR gRNA sequence
  source 1..20: mol_type = other DNA
ataaagataatccaagatgg

SEQ ID NO: 83698 - DNA, 20 bp, synthetic construct
  misc_feature 1..20: note = CRISPR gRNA sequence
  source 1..20: mol_type = other DNA
ccaagactgttgaggacgcc

SEQ ID NO: 83699 - DNA, 20 bp, synthetic construct
  misc_feature 1..20: note = CRISPR gRNA sequence
  source 1..20: mol_type = other DNA
ttgaggacgccagagatctt

SEQ ID NO: 83700 - DNA, 20 bp, synthetic construct
  misc_feature 1..20: note = CRISPR gRNA sequence
  source 1..20: mol_type = other DNA
aggacgccagagatcttgag

SEQ ID NO: 83701 - DNA, 20 bp, synthetic construct
  misc_feature 1..20: note = CRISPR gRNA sequence
  source 1..20: mol_type = other DNA
gagcactttctaagtacctg

SEQ ID NO: 83702 - DNA, 20 bp, synthetic construct
  misc_feature 1..20: note = CRISPR gRNA sequence
  source 1..20: mol_type = other DNA
agcactttctaagtacctgg

SEQ ID NO: 83703 - DNA, 20 bp, synthetic construct
  misc_feature 1..20: note = CRISPR gRNA sequence
  source 1..20: mol_type = other DNA
tctaagtacctggcaataca

SEQ ID NO: 83704 - DNA, 20 bp, synthetic construct
  misc_feature 1..20: note = CRISPR gRNA sequence
  source 1..20: mol_type = other DNA
ctaagtacctggcaatacac

SEQ ID NO: 83705 - DNA, 20 bp, synthetic construct
  misc_feature 1..20: note = CRISPR gRNA sequence
  source 1..20: mol_type = other DNA
taagtacctggcaatacact

SEQ ID NO: 83706 - DNA, 20 bp, synthetic construct
  misc_feature 1..20: note = CRISPR gRNA sequence
  source 1..20: mol_type = other DNA
agtacctggcaatacactaa

SEQ ID NO: 83707 - DNA, 20 bp, synthetic construct
  misc_feature 1..20: note = CRISPR gRNA sequence
  source 1..20: mol_type = other DNA
gcaatacactaagcgcgctc

SEQ ID NO: 83708 - DNA, 20 bp, synthetic construct
  misc_feature 1..20: note = CRISPR gRNA sequence
  source 1..20: mol_type = other DNA
agcgcgctcaccttttcctc

SEQ ID NO: 83709 - DNA, 20 bp, synthetic construct
  misc_feature 1..20: note = CRISPR gRNA sequence
  source 1..20: mol_type = other DNA
accttttcctctggcaaaac

SEQ ID NO: 83710 - DNA, 20 bp, synthetic construct
  misc_feature 1..20: note = CRISPR gRNA sequence
  source 1..20: mol_type = other DNA
ttcctctggcaaaacatgat

SEQ ID NO: 83711 - DNA, 20 bp, synthetic construct
  misc_feature 1..20: note = CRISPR gRNA sequence
  source 1..20: mol_type = other DNA
tcctctggcaaaacatgatc

SEQ ID NO: 83712 - DNA, 20 bp, synthetic construct
  misc_feature 1..20: note = CRISPR gRNA sequence
  source 1..20: mol_type = other DNA
cctctggcaaaacatgatcg

SEQ ID NO: 83713 - DNA, 20 bp, synthetic construct
  misc_feature 1..20: note = CRISPR gRNA sequence
  source 1..20: mol_type = other DNA
ctctggcaaaacatgatcga

SEQ ID NO: 83714 - DNA, 20 bp, synthetic construct
  misc_feature 1..20: note = CRISPR gRNA sequence
  source 1..20: mol_type = other DNA
tggcaaaacatgatcgaaag

SEQ ID NO: 83715 - DNA, 20 bp, synthetic construct
  misc_feature 1..20: note = CRISPR gRNA sequence
  source 1..20: mol_type = other DNA
gcaaaacatgatcgaaagca

SEQ ID NO: 83716 - DNA, 20 bp, synthetic construct
  misc_feature 1..20: note = CRISPR gRNA sequence
  source 1..20: mol_type = other DNA
tgatcatgagaaaattgcat

SEQ ID NO: 83717 - DNA, 20 bp, synthetic construct
  misc_feature 1..20: note = CRISPR gRNA sequence
  source 1..20: mol_type = other DNA
gatcatgagaaaattgcatt

SEQ ID NO: 83718 - DNA, 20 bp, synthetic construct
  misc_feature 1..20: note = CRISPR gRNA sequence
  source 1..20: mol_type = other DNA
atcatgagaaaattgcattt

SEQ ID NO: 83719 - DNA, 20 bp, synthetic construct
  misc_feature 1..20: note = CRISPR gRNA sequence
  source 1..20: mol_type = other DNA
catttaatttgaatacaatt

SEQ ID NO: 83720 - DNA, 20 bp, synthetic construct
  misc_feature 1..20: note = CRISPR gRNA sequence
  source 1..20: mol_type = other DNA
aatttgaatacaatttattt

SEQ ID NO: 83721 - DNA, 20 bp, synthetic construct
  misc_feature 1..20: note = CRISPR gRNA sequence
  source 1..20: mol_type = other DNA
atttgaatacaatttattta

SEQ ID NO: 83722 - DNA, 20 bp, synthetic construct
  misc_feature 1..20: note = CRISPR gRNA sequence
  source 1..20: mol_type = other DNA
gaatacaatttatttacaac

SEQ ID NO: 83723 - DNA, 20 bp, synthetic construct
  misc_feature 1..20: note = CRISPR gRNA sequence
  source 1..20: mol_type = other DNA
aatacaatttatttacaaca

SEQ ID NO: 83724 - DNA, 20 bp, synthetic construct
  misc_feature 1..20: note = CRISPR gRNA sequence
  source 1..20: mol_type = other DNA
atttacaacataaaggataa

SEQ ID NO: 83725 - DNA, 20 bp, synthetic construct
  misc_feature 1..20: note = CRISPR gRNA sequence
  source 1..20: mol_type = other DNA
tttacaacataaaggataat

SEQ ID NO: 83726 - DNA, 20 bp, synthetic construct
  misc_feature 1..20: note = CRISPR gRNA sequence
  source 1..20: mol_type = other DNA
acaacataaaggataatgta

SEQ ID NO: 83727 - DNA, 20 bp, synthetic construct
  misc_feature 1..20: note = CRISPR gRNA sequence
  source 1..20: mol_type = other DNA
caacataaaggataatgtat

SEQ ID NO: 83728 - DNA, 20 bp, synthetic construct
  misc_feature 1..20: note = CRISPR gRNA sequence
  source 1..20: mol_type = other DNA
ctggtatttgctggttatgt

SEQ ID NO: 83729 - DNA, 20 bp, synthetic construct
  misc_feature 1..20: note = CRISPR gRNA sequence
  source 1..20: mol_type = other DNA
gtatttgctggttatgttag

SEQ ID NO: 83730 - DNA, 20 bp, synthetic construct
  misc_feature 1..20: note = CRISPR gRNA sequence
  source 1..20: mol_type = other DNA
gctggttatgttagatgtca

SEQ ID NO: 83731 - DNA, 20 bp, synthetic construct
  misc_feature 1..20: note = CRISPR gRNA sequence
  source 1..20: mol_type = other DNA
ctggttatgttagatgtcat

SEQ ID NO: 83732 - DNA, 20 bp, synthetic construct
  misc_feature 1..20: note = CRISPR gRNA sequence
  source 1..20: mol_type = other DNA
gttatgttagatgtcatttt

SEQ ID NO: 83733 - DNA, 20 bp, synthetic construct
  misc_feature 1..20: note = CRISPR gRNA sequence
  source 1..20: mol_type = other DNA
tgttagatgtcattttaaaa

SEQ ID NO: 83734 - DNA, 20 bp, synthetic construct
  misc_feature 1..20: note = CRISPR gRNA sequence
  source 1..20: mol_type = other DNA
gatgtcattttaaaaaataa

SEQ ID NO: 83735 - DNA, 20 bp, synthetic construct
  misc_feature 1..20: note = CRISPR gRNA sequence
  source 1..20: mol_type = other DNA
taaaaaataacaatctgata

SEQ ID NO: 83736 - DNA, 20 bp, synthetic construct
  misc_feature 1..20: note = CRISPR gRNA sequence
  source 1..20: mol_type = other DNA
aaaaaataacaatctgatat

SEQ ID NO: 83737 - DNA, 20 bp, synthetic construct
  misc_feature 1..20: note = CRISPR gRNA sequence
  source 1..20: mol_type = other DNA
aaaaataacaatctgatatt

SEQ ID NO: 83738 - DNA, 20 bp, synthetic construct
  misc_feature 1..20: note = CRISPR gRNA sequence
  source 1..20: mol_type = other DNA
atatttaaaaaaaaatctta

SEQ ID NO: 83739 - DNA, 20 bp, synthetic construct
  misc_feature 1..20: note = CRISPR gRNA sequence
  source 1..20: mol_type = other DNA
aaaaaaaaatcttattttga

SEQ ID NO: 83740 - DNA, 20 bp, synthetic construct
  misc_feature 1..20: note = CRISPR gRNA sequence
  source 1..20: mol_type = other DNA
aaaaaaaatcttattttgaa

SEQ ID NO: 83741 - DNA, 20 bp, synthetic construct
  misc_feature 1..20: note = CRISPR gRNA sequence
  source 1..20: mol_type = other DNA
attttgaaaatttccaaagt

SEQ ID NO: 83742 - DNA, 20 bp, synthetic construct
  misc_feature 1..20: note = CRISPR gRNA sequence
  source 1..20: mol_type = other DNA
ttttgaaaatttccaaagta

SEQ ID NO: 83743 - DNA, 20 bp, synthetic construct
  misc_feature 1..20: note = CRISPR gRNA sequence
  source 1..20: mol_type = other DNA
tgaaaatttccaaagtaata

SEQ ID NO: 83744 - DNA, 20 bp, synthetic construct
  misc_feature 1..20: note = CRISPR gRNA sequence
  source 1..20: mol_type = other DNA
gaaaatttccaaagtaatac

SEQ ID NO: 83745 - DNA, 20 bp, synthetic construct
  misc_feature 1..20: note = CRISPR gRNA sequence
  source 1..20: mol_type = other DNA
aaaatttccaaagtaataca

SEQ ID NO: 83746 - DNA, 20 bp, synthetic construct
  misc_feature 1..20: note = CRISPR gRNA sequence
  source 1..20: mol_type = other DNA
ccaaagtaatacatgccatg

SEQ ID NO: 83747 - DNA, 20 bp, synthetic construct
  misc_feature 1..20: note = CRISPR gRNA sequence
  source 1..20: mol_type = other DNA
caaagtaatacatgccatgc

SEQ ID NO: 83748 - DNA, 20 bp, synthetic construct
  misc_feature 1..20: note = CRISPR gRNA sequence
  source 1..20: mol_type = other DNA
ctggaagataccacaagaaa

SEQ ID NO: 83749 - DNA, 20 bp, synthetic construct
  misc_feature 1..20: note = CRISPR gRNA sequence
  source 1..20: mol_type = other DNA
tggaagataccacaagaaac

SEQ ID NO: 83750 - DNA, 20 bp, synthetic construct
  misc_feature 1..20: note = CRISPR gRNA sequence
  source 1..20: mol_type = other DNA
gaagataccacaagaaacat

SEQ ID NO: 83751 - DNA, 20 bp, synthetic construct
  misc_feature 1..20: note = CRISPR gRNA sequence
  source 1..20: mol_type = other DNA
cctctgaaggtctattttcc

SEQ ID NO: 83752 - DNA, 20 bp, synthetic construct
  misc_feature 1..20: note = CRISPR gRNA sequence
  source 1..20: mol_type = other DNA
tgaaggtctattttcctcct

SEQ ID NO: 83753 - DNA, 20 bp, synthetic construct
  misc_feature 1..20: note = CRISPR gRNA sequence
  source 1..20: mol_type = other DNA
aaggtctattttcctcctct

SEQ ID NO: 83754 - DNA, 20 bp, synthetic construct
  misc_feature 1..20: note = CRISPR gRNA sequence
  source 1..20: mol_type = other DNA
ttttcctcctctgacctgtg

SEQ ID NO: 83755 - DNA, 20 bp, synthetic construct
  misc_feature 1..20: note = CRISPR gRNA sequence
  source 1..20: mol_type = other DNA
tcctcctctgacctgtgtgt

SEQ ID NO: 83756 - DNA, 20 bp, synthetic construct
  misc_feature 1..20: note = CRISPR gRNA sequence
  source 1..20: mol_type = other DNA
cctcctctgacctgtgtgtg

SEQ ID NO: 83757 - DNA, 20 bp, synthetic construct
  misc_feature 1..20: note = CRISPR gRNA sequence
  source 1..20: mol_type = other DNA
ctcctctgacctgtgtgtgg

SEQ ID NO: 83758 - DNA, 20 bp, synthetic construct
  misc_feature 1..20: note = CRISPR gRNA sequence
  source 1..20: mol_type = other DNA
ctctgacctgtgtgtgggtt

SEQ ID NO: 83759 - DNA, 20 bp, synthetic construct
  misc_feature 1..20: note = CRISPR gRNA sequence
  source 1..20: mol_type = other DNA
tgacctgtgtgtgggttttg

SEQ ID NO: 83760 - DNA, 20 bp, synthetic construct
  misc_feature 1..20: note = CRISPR gRNA sequence
  source 1..20: mol_type = other DNA
acctgtgtgtgggttttgtt

SEQ ID NO: 83761 - DNA, 20 bp, synthetic construct
  misc_feature 1..20: note = CRISPR gRNA sequence
  source 1..20: mol_type = other DNA
tgtgtgggttttgtttttgt

SEQ ID NO: 83762 - DNA, 20 bp, synthetic construct
  misc_feature 1..20: note = CRISPR gRNA sequence
  source 1..20: mol_type = other DNA
tgtttttgttttactgtggg

SEQ ID NO: 83763 - DNA, 20 bp, synthetic construct
  misc_feature 1..20: note = CRISPR gRNA sequence
  source 1..20: mol_type = other DNA
gtttttgttttactgtgggc

SEQ ID NO: 83764 - DNA, 20 bp, synthetic construct
  misc_feature 1..20: note = CRISPR gRNA sequence
  source 1..20: mol_type = other DNA
tttttgttttactgtgggca

SEQ ID NO: 83765 - DNA, 20 bp, synthetic construct
  misc_feature 1..20: note = CRISPR gRNA sequence
  source 1..20: mol_type = other DNA
ttgttttactgtgggcataa

SEQ ID NO: 83766 - DNA, 20 bp, synthetic construct
  misc_feature 1..20: note = CRISPR gRNA sequence
  source 1..20: mol_type = other DNA
tgttttactgtgggcataaa

SEQ ID NO: 83767 - DNA, 20 bp, synthetic construct
  misc_feature 1..20: note = CRISPR gRNA sequence
  source 1..20: mol_type = other DNA
gttttactgtgggcataaat

SEQ ID NO: 83768 - DNA, 20 bp, synthetic construct
  misc_feature 1..20: note = CRISPR gRNA sequence
  source 1..20: mol_type = other DNA
ttttactgtgggcataaatt

SEQ ID NO: 83769 - DNA, 20 bp, synthetic construct
  misc_feature 1..20: note = CRISPR gRNA sequence
  source 1..20: mol_type = other DNA
tactgtgggcataaattaat

SEQ ID NO: 83770 - DNA, 20 bp, synthetic construct
  misc_feature 1..20: note = CRISPR gRNA sequence
  source 1..20: mol_type = other DNA
actgtgggcataaattaatt

SEQ ID NO: 83771 - DNA, 20 bp, synthetic construct
  misc_feature 1..20: note = CRISPR gRNA sequence
  source 1..20: mol_type = other DNA
ctgtgggcataaattaattt

SEQ ID NO: 83772 - DNA, 20 bp, synthetic construct
  misc_feature 1..20: note = CRISPR gRNA sequence
  source 1..20: mol_type = other DNA
tgggcataaattaatttttc

SEQ ID NO: 83773 - DNA, 20 bp, synthetic construct
  misc_feature 1..20: note = CRISPR gRNA sequence
  source 1..20: mol_type = other DNA
atttttcagttaagttttgg

SEQ ID NO: 83774 - DNA, 20 bp, synthetic construct
  misc_feature 1..20: note = CRISPR gRNA sequence
  source 1..20: mol_type = other DNA
ttcagttaagttttggaagc

SEQ ID NO: 83775 - DNA, 20 bp, synthetic construct
  misc_feature 1..20: note = CRISPR gRNA sequence
  source 1..20: mol_type = other DNA
tcagttaagttttggaagct

SEQ ID NO: 83776 - DNA, 20 bp, synthetic construct
  misc_feature 1..20: note = CRISPR gRNA sequence
  source 1..20: mol_type = other DNA
cagttaagttttggaagctt

SEQ ID NO: 83777 - DNA, 20 bp, synthetic construct
  misc_feature 1..20: note = CRISPR gRNA sequence
  source 1..20: mol_type = other DNA
agttaagttttggaagctta

SEQ ID NO: 83778 - DNA, 20 bp, synthetic construct
  misc_feature 1..20: note = CRISPR gRNA sequence
  source 1..20: mol_type = other DNA
agttttggaagcttaaataa

SEQ ID NO: 83779 - DNA, 20 bp, synthetic construct
  misc_feature 1..20: note = CRISPR gRNA sequence
  source 1..20: mol_type = other DNA
tggaagcttaaataactctc

SEQ ID NO: 83780 - DNA, 20 bp, synthetic construct
  misc_feature 1..20: note = CRISPR gRNA sequence
  source 1..20: mol_type = other DNA
ggaagcttaaataactctcc

SEQ ID NO: 83781 - DNA, 20 bp, synthetic construct
  misc_feature 1..20: note = CRISPR gRNA sequence
  source 1..20: mol_type = other DNA
gaagcttaaataactctcca

SEQ ID NO: 83782 - DNA, 20 bp, synthetic construct
  misc_feature 1..20: note = CRISPR gRNA sequence
  source 1..20: mol_type = other DNA
aaataactctccaaaagtca

SEQ ID NO: 83783 - DNA, 20 bp, synthetic construct
  misc_feature 1..20: note = CRISPR gRNA sequence
  source 1..20: mol_type = other DNA
aataactctccaaaagtcat

SEQ ID NO: 83784 - DNA, 20 bp, synthetic construct
  misc_feature 1..20: note = CRISPR gRNA sequence
  source 1..20: mol_type = other DNA
tccaaaagtcataaagccag

SEQ ID NO: 83785 - DNA, 20 bp, synthetic construct
  misc_feature 1..20: note = CRISPR gRNA sequence
  source 1..20: mol_type = other DNA
caaaagtcataaagccagta

SEQ ID NO: 83786 - DNA, 20 bp, synthetic construct
  misc_feature 1..20: note = CRISPR gRNA sequence
  source 1..20: mol_type = other DNA
gttgagcccaaattcaaacc

SEQ ID NO: 83787 - DNA, 20 bp, synthetic construct
  misc_feature 1..20: note = CRISPR gRNA sequence
  source 1..20: mol_type = other DNA
agcccaaattcaaacccagc

SEQ ID NO: 83788 - DNA, 20 bp, synthetic construct
  misc_feature 1..20: note = CRISPR gRNA sequence
  source 1..20: mol_type = other DNA
aaacccagcctgtctgatac

SEQ ID NO: 83789 - DNA, 20 bp, synthetic construct
  misc_feature 1..20: note = CRISPR gRNA sequence
  source 1..20: mol_type = other DNA
tctgatacttgtcctcttct

SEQ ID NO: 83790 - DNA, 20 bp, synthetic construct
  misc_feature 1..20: note = CRISPR gRNA sequence
  source 1..20: mol_type = other DNA
atacttgtcctcttcttaga

SEQ ID NO: 83791 - DNA, 20 bp, synthetic construct
  misc_feature 1..20: note = CRISPR gRNA sequence
  source 1..20: mol_type = other DNA
gtcctcttcttagaaaagat

SEQ ID NO: 83792 - DNA, 20 bp, synthetic construct
  misc_feature 1..20: note = CRISPR gRNA sequence
  source 1..20: mol_type = other DNA
tcctcttcttagaaaagatt

SEQ ID NO: 83793 - DNA, 20 bp, synthetic construct
  misc_feature 1..20: note = CRISPR gRNA sequence
  source 1..20: mol_type = other DNA
ttcttagaaaagattacagt

SEQ ID NO: 83794 - DNA, 20 bp, synthetic construct
  misc_feature 1..20: note = CRISPR gRNA sequence
  source 1..20: mol_type = other DNA
cttagaaaagattacagtga

SEQ ID NO: 83795 - DNA, 20 bp, synthetic construct
  misc_feature 1..20: note = CRISPR gRNA sequence
  source 1..20: mol_type = other DNA
ttagaaaagattacagtgat

SEQ ID NO: 83796 - DNA, 20 bp, synthetic construct
  misc_feature 1..20: note = CRISPR gRNA sequence
  source 1..20: mol_type = other DNA
agaaaagattacagtgatgc

SEQ ID NO: 83797 - DNA, 20 bp, synthetic construct
  misc_feature 1..20: note = CRISPR gRNA sequence
  source 1..20: mol_type = other DNA
gaaaagattacagtgatgct

SEQ ID NO: 83798 - DNA, 20 bp, synthetic construct
  misc_feature 1..20: note = CRISPR gRNA sequence
  source 1..20: mol_type = other DNA
cagtgatgctctcacaaaat

SEQ ID NO: 83799 - DNA, 20 bp, synthetic construct
  misc_feature 1..20: note = CRISPR gRNA sequence
  source 1..20: mol_type = other DNA
tcacaaaatcttgccgcctt

SEQ ID NO: 83800 - DNA, 20 bp, synthetic construct
  misc_feature 1..20: note = CRISPR gRNA sequence
  source 1..20: mol_type = other DNA
acaaaatcttgccgccttcc

SEQ ID NO: 83801 - DNA, 20 bp, synthetic construct
  misc_feature 1..20: note = CRISPR gRNA sequence
  source 1..20: mol_type = other DNA
gccgccttccctcaaacaga

SEQ ID NO: 83802 - DNA, 20 bp, synthetic construct
  misc_feature 1..20: note = CRISPR gRNA sequence
  source 1..20: mol_type = other DNA
ccgccttccctcaaacagag

SEQ ID NO: 83803 - DNA, 20 bp, synthetic construct
  misc_feature 1..20: note = CRISPR gRNA sequence
  source 1..20: mol_type = other DNA
ccctcaaacagagagttcca

SEQ ID NO: 83804 - DNA, 20 bp, synthetic construct
  misc_feature 1..20: note = CRISPR gRNA sequence
  source 1..20: mol_type = other DNA
cctcaaacagagagttccag

SEQ ID NO: 83805 - DNA, 20 bp, synthetic construct
  misc_feature 1..20: note = CRISPR gRNA sequence
  source 1..20: mol_type = other DNA
aaacagagagttccaggcag

SEQ ID NO: 83806 - DNA, 20 bp, synthetic construct
  misc_feature 1..20: note = CRISPR gRNA sequence
  source 1..20: mol_type = other DNA
caggcaggatgaatctgtgc

SEQ ID NO: 83807 - DNA, 20 bp, synthetic construct
  misc_feature 1..20: note = CRISPR gRNA sequence
  source 1..20: mol_type = other DNA
tgctctgatccctgaggcat

SEQ ID NO: 83808 - DNA, 20 bp, synthetic construct
  misc_feature 1..20: note = CRISPR gRNA sequence
  source 1..20: mol_type = other DNA
tgatccctgaggcatttaat

SEQ ID NO: 83809 - DNA, 20 bp, synthetic construct
  misc_feature 1..20: note = CRISPR gRNA sequence
  source 1..20: mol_type = other DNA
atccctgaggcatttaatat

SEQ ID NO: 83810 - DNA, 20 bp, synthetic construct
  misc_feature 1..20: note = CRISPR gRNA sequence
  source 1..20: mol_type = other DNA
aggcatttaatatgttctta

SEQ ID NO: 83811 - DNA, 20 bp, synthetic construct
  misc_feature 1..20: note = CRISPR gRNA sequence
  source 1..20: mol_type = other DNA
aatatgttcttattattaga

SEQ ID NO: 83812 - DNA, 20 bp, synthetic construct
  misc_feature 1..20: note = CRISPR gRNA sequence
  source 1..20: mol_type = other DNA
atatgttcttattattagaa

SEQ ID NO: 83813 - DNA, 20 bp, synthetic construct
  misc_feature 1..20: note = CRISPR gRNA sequence
  source 1..20: mol_type = other DNA
ttattattagaagctcagat

SEQ ID NO: 83814 - DNA, 20 bp, synthetic construct
  misc_feature 1..20: note = CRISPR gRNA sequence
  source 1..20: mol_type = other DNA
attattagaagctcagatgc

SEQ ID NO: 83815 - DNA, 20 bp, synthetic construct
  misc_feature 1..20: note = CRISPR gRNA sequence
  source 1..20: mol_type = other DNA
ttattagaagctcagatgca

SEQ ID NO: 83816 - DNA, 20 bp, synthetic construct
  misc_feature 1..20: note = CRISPR gRNA sequence
  source 1..20: mol_type = other DNA
ttagaagctcagatgcaaag

SEQ ID NO: 83817 - DNA, 20 bp, synthetic construct
  misc_feature 1..20: note = CRISPR gRNA sequence
  source 1..20: mol_type = other DNA
gaagctcagatgcaaagagc

SEQ ID NO: 83818 - DNA, 20 bp, synthetic construct
  misc_feature 1..20: note = CRISPR gRNA sequence
  source 1..20: mol_type = other DNA
agatgcaaagagctctctta

SEQ ID NO: 83819 - DNA, 20 bp, synthetic construct
  misc_feature 1..20: note = CRISPR gRNA sequence
  source 1..20: mol_type = other DNA
tcttagcttttaatgttatg

SEQ ID NO: 83820 - DNA, 20 bp, synthetic construct
  misc_feature 1..20: note = CRISPR gRNA sequence
  source 1..20: mol_type = other DNA
ttagcttttaatgttatgaa

SEQ ID NO: 83821 - DNA, 20 bp, synthetic construct
  misc_feature 1..20: note = CRISPR gRNA sequence
  source 1..20: mol_type = other DNA
agcttttaatgttatgaaaa

SEQ ID NO: 83822 - DNA, 20 bp, synthetic construct
  misc_feature 1..20: note = CRISPR gRNA sequence
  source 1..20: mol_type = other DNA
gcttttaatgttatgaaaaa

SEQ ID NO: 83823 - DNA, 20 bp, synthetic construct
  misc_feature 1..20: note = CRISPR gRNA sequence
  source 1..20: mol_type = other DNA
ttaatgttatgaaaaaaatc

SEQ ID NO: 83824 - DNA, 20 bp, synthetic construct
  misc_feature 1..20: note = CRISPR gRNA sequence
  source 1..20: mol_type = other DNA
taatgttatgaaaaaaatca

SEQ ID NO: 83825 - DNA, 20 bp, synthetic construct
  misc_feature 1..20: note = CRISPR gRNA sequence
  source 1..20: mol_type = other DNA
aatgttatgaaaaaaatcag

SEQ ID NO: 83826 - DNA, 20 bp, synthetic construct
  misc_feature 1..20: note = CRISPR gRNA sequence
  source 1..20: mol_type = other DNA
atgttatgaaaaaaatcagg

SEQ ID NO: 83827 - DNA, 20 bp, synthetic construct
  misc_feature 1..20: note = CRISPR gRNA sequence
  source 1..20: mol_type = other DNA
tgaaaaaaatcaggtcttca

SEQ ID NO: 83828 - DNA, 20 bp, synthetic construct
  misc_feature 1..20: note = CRISPR gRNA sequence
  source 1..20: mol_type = other DNA
cattagattccccaatccac

SEQ ID NO: 83829 - DNA, 20 bp, synthetic construct
  misc_feature 1..20: note = CRISPR gRNA sequence
  source 1..20: mol_type = other DNA
attagattccccaatccacc

SEQ ID NO: 83830 - DNA, 20 bp, synthetic construct
  misc_feature 1..20: note = CRISPR gRNA sequence
  source 1..20: mol_type = other DNA
gattccccaatccacctctt

SEQ ID NO: 83831 - DNA, 20 bp, synthetic construct
  misc_feature 1..20: note = CRISPR gRNA sequence
  source 1..20: mol_type = other DNA
cccaatccacctcttgatgg

SEQ ID NO: 83832 - DNA, 20 bp, synthetic construct
  misc_feature 1..20: note = CRISPR gRNA sequence
  source 1..20: mol_type = other DNA
ttgatggggctagtagcctt

SEQ ID NO: 83833 - DNA, 20 bp, synthetic construct
  misc_feature 1..20: note = CRISPR gRNA sequence
  source 1..20: mol_type = other DNA
gatggggctagtagcctttc

SEQ ID NO: 83834 - DNA, 20 bp, synthetic construct
  misc_feature 1..20: note = CRISPR gRNA sequence
  source 1..20: mol_type = other DNA
atggggctagtagcctttcc

SEQ ID NO: 83835 - DNA, 20 bp, synthetic construct
  misc_feature 1..20: note = CRISPR gRNA sequence
  source 1..20: mol_type = other DNA
gtagcctttccttaatgata

SEQ ID NO: 83836 - DNA, 20 bp, synthetic construct
  misc_feature 1..20: note = CRISPR gRNA sequence
  source 1..20: mol_type = other DNA
tccttaatgatagggtgttt

SEQ ID NO: 83837 - DNA, 20 bp, synthetic construct
  misc_feature 1..20: note = CRISPR gRNA sequence
  source 1..20: mol_type = other DNA
ccttaatgatagggtgtttc

SEQ ID NO: 83838 - DNA, 20 bp, synthetic construct
  misc_feature 1..20: note = CRISPR gRNA sequence
  source 1..20: mol_type = other DNA
cttaatgatagggtgtttct

SEQ ID NO: 83839 - DNA, 20 bp, synthetic construct
  misc_feature 1..20: note = CRISPR gRNA sequence
  source 1..20: mol_type = other DNA
aatgatagggtgtttctaga

SEQ ID NO: 83840 - DNA, 20 bp, synthetic construct
  misc_feature 1..20: note = CRISPR gRNA sequence
  source 1..20: mol_type = other DNA
atgatagggtgtttctagag

SEQ ID NO: 83841 - DNA, 20 bp, synthetic construct
  misc_feature 1..20: note = CRISPR gRNA sequence
  source 1..20: mol_type = other DNA
ctagagagatatatctggtc

SEQ ID NO: 83842 - DNA, 20 bp, synthetic construct
  misc_feature 1..20: note = CRISPR gRNA sequence
  source 1..20: mol_type = other DNA
tagagagatatatctggtca

SEQ ID NO: 83843 - DNA, 20 bp, synthetic construct
  misc_feature 1..20: note = CRISPR gRNA sequence
  source 1..20: mol_type = other DNA
gagagatatatctggtcaag

SEQ ID NO: 83844 - DNA, 20 bp, synthetic construct
  misc_feature 1..20: note = CRISPR gRNA sequence
  source 1..20: mol_type = other DNA
gtcaaggtggcctggtactc

SEQ ID NO: 83845 - DNA, 20 bp, synthetic construct
  misc_feature 1..20: note = CRISPR gRNA sequence
  source 1..20: mol_type = other DNA
gtactcctccttctccccac

SEQ ID NO: 83846 - DNA, 20 bp, synthetic construct
  misc_feature 1..20: note = CRISPR gRNA sequence
  source 1..20: mol_type = other DNA
ctccttctccccacagcctc

SEQ ID NO: 83847 - DNA, 20 bp, synthetic construct
  misc_feature 1..20: note = CRISPR gRNA sequence
  source 1..20: mol_type = other DNA
cttctccccacagcctccca

SEQ ID NO: 83848 - DNA, 20 bp, synthetic construct
  misc_feature 1..20: note = CRISPR gRNA sequence
  source 1..20: mol_type = other DNA
ctccccacagcctcccagac

SEQ ID NO: 83849 - DNA, 20 bp, synthetic construct
  misc_feature 1..20: note = CRISPR gRNA sequence
  source 1..20: mol_type = other DNA
tccccacagcctcccagaca

SEQ ID NO: 83850 - DNA, 20 bp, synthetic construct
  misc_feature 1..20: note = CRISPR gRNA sequence
  source 1..20: mol_type = other DNA
cccacagcctcccagacaag

SEQ ID NO: 83851 - DNA, 20 bp, synthetic construct
  misc_feature 1..20: note = CRISPR gRNA sequence
  source 1..20: mol_type = other DNA
ccagacaaggaggagtagct

SEQ ID NO: 83852 - DNA, 20 bp, synthetic construct
  misc_feature 1..20: note = CRISPR gRNA sequence
  source 1..20: mol_type = other DNA
ccttttagtgatcatgtacc

SEQ ID NO: 83853 - DNA, 20 bp, synthetic construct
  misc_feature 1..20: note = CRISPR gRNA sequence
  source 1..20: mol_type = other DNA
ttagtgatcatgtaccctga

SEQ ID NO: 83854 - DNA, 20 bp, synthetic construct
  misc_feature 1..20: note = CRISPR gRNA sequence
  source 1..20: mol_type = other DNA
tagtgatcatgtaccctgaa

SEQ ID NO: 83855 - DNA, 20 bp, synthetic construct
  misc_feature 1..20: note = CRISPR gRNA sequence
  source 1..20: mol_type = other DNA
agtgatcatgtaccctgaat

SEQ ID NO: 83856 - DNA, 20 bp, synthetic construct
  misc_feature 1..20: note = CRISPR gRNA sequence
  source 1..20: mol_type = other DNA
gtgatcatgtaccctgaata

SEQ ID NO: 83857 - DNA, 20 bp, synthetic construct
  misc_feature 1..20: note = CRISPR gRNA sequence
  source 1..20: mol_type = other DNA
aatataagtgtatttaaaag

SEQ ID NO: 83858 - DNA, 20 bp, synthetic construct
  misc_feature 1..20: note = CRISPR gRNA sequence
  source 1..20: mol_type = other DNA
aaaagaattttatacacata

SEQ ID NO: 83859 - DNA, 20 bp, synthetic construct
  misc_feature 1..20: note = CRISPR gRNA sequence
  source 1..20: mol_type = other DNA
aaagaattttatacacatat

SEQ ID NO: 83860 - DNA, 20 bp, synthetic construct
  misc_feature 1..20: note = CRISPR gRNA sequence
  source 1..20: mol_type = other DNA
tatacacatatatttagtgt

SEQ ID NO: 83861 - DNA, 20 bp, synthetic construct
  misc_feature 1..20: note = CRISPR gRNA sequence
  source 1..20: mol_type = other DNA
atacacatatatttagtgtc

SEQ ID NO: 83862 - DNA, 20 bp, synthetic construct
  misc_feature 1..20: note = CRISPR gRNA sequence
  source 1..20: mol_type = other DNA
tacacatatatttagtgtca

SEQ ID NO: 83863 - DNA, 20 bp, synthetic construct
  misc_feature 1..20: note = CRISPR gRNA sequence
  source 1..20: mol_type = other DNA
agtgtcaatctgtatattta

SEQ ID NO: 83864 - DNA, 20 bp, synthetic construct
  misc_feature 1..20: note = CRISPR gRNA sequence
  source 1..20: mol_type = other DNA
gtgtcaatctgtatatttag

SEQ ID NO: 83865 - DNA, 20 bp, synthetic construct
  misc_feature 1..20: note = CRISPR gRNA sequence
  source 1..20: mol_type = other DNA
tatatttagtagcactaaca

SEQ ID NO: 83866 - DNA, 20 bp, synthetic construct
  misc_feature 1..20: note = CRISPR gRNA sequence
  source 1..20: mol_type = other DNA
agtagcactaacacttctct

SEQ ID NO: 83867 - DNA, 20 bp, synthetic construct
  misc_feature 1..20: note = CRISPR gRNA sequence
  source 1..20: mol_type = other DNA
gtagcactaacacttctctt

SEQ ID NO: 83868 - DNA, 20 bp, synthetic construct
  misc_feature 1..20: note = CRISPR gRNA sequence
  source 1..20: mol_type = other DNA
acacttctcttcattttcaa

SEQ ID NO: 83869 - DNA, 20 bp, synthetic construct
  misc_feature 1..20: note = CRISPR gRNA sequence
  source 1..20: mol_type = other DNA
ctcttcattttcaatgaaaa

SEQ ID NO: 83870 - DNA, 20 bp, synthetic construct
  misc_feature 1..20: note = CRISPR gRNA sequence
  source 1..20: mol_type = other DNA
tcttcattttcaatgaaaaa

SEQ ID NO: 83871 - DNA, 20 bp, synthetic construct
  misc_feature 1..20: note = CRISPR gRNA sequence
  source 1..20: mol_type = other DNA
ttcattttcaatgaaaaata

SEQ ID NO: 83872 - DNA, 20 bp, synthetic construct
  misc_feature 1..20: note = CRISPR gRNA sequence
  source 1..20: mol_type = other DNA
cattttcaatgaaaaatata
